United States Patent 7,468,248 (METHODS AND SYSTEMS FOR INFERRING BOVINE TRAITS) - sequence listing, part 19

SEQ ID NO: 56550 - DNA, 4539 bp, Bovine  19866880912946
ttagagagacaccgatatataacacagtaaaacaaagtggctttgacggaagtaagagaggtgacccagagcgctgcatctgcagctaccttctgggaaatactaggagtttggacccttactatacctggggctctgcccacttctaaaatgcaatgatttcaacatcaatttcaagttaactgtaaaacttctccgaaatgtgcctagcttgtctacagatctcaatctataatgggtcaactacagcaatgaatttttttctcatcagaatgcgaaggtcagaaagtcagagcttcctaatcttatctcctggcttcatctccacagggactaggcatcagctcctatggaaaaccagagatgggaaaggaaactgcctccctgcacagagagtacacatgaggacacgctgccagttacaccacacaaaactgacaggagggcagtatcaccaccacaaaacaaaaagtaccacagatgcaatctgggcatggttgaaaaggccccactgtagatctggactcctcatctctccaactagtttaaacaacccattcaatccatcccttacttttttcaataaatgaataggggtatctaaggtcttttctagctttagatttctgtgatgctaaactaacatgatgttttcttaagtacatgaggtgtttttaaagttattatttggggtatttgttctaacgtgaaagaggctattgtcatcagtcaacacatgtggctcaaaactaatacccaaccaaaaaaggaaacttactgacatcacaaaccactcttctactttagtctttatttcacaaggtttaggtttcacagtaggggagcagctcgaccattctggagcactaaagcttctaattaaggcaagcatcgttggggcaaacaattctgggaattccctgatggtccagtggttaggactcggcattttcactgccatgggcccaggttcaatccctggttagggaactgctgctgctgctaagtcacttcagtcgtgtccgaccctgtgtgaccccatagacggcagccccaccaggctctcctgtccttgggattctcaaggcaagaacactggagtgggttaccatttccttctccaatgcataaaagtgaagtcgctcagtcgtgtccgactcttaaatcctacaaattgctcagtgaggtcaaaaccaaaccaaaccaaaccaattctccttaagaaaggaattgcaagtggaagtaaaattaatgtggtaactattctctcctgggtattagctagctatttccacactccagcccagtgctaacagggcctgcaataaatgtcgagtcacagctgtcatgggcacagcaccatcttggctgttgccatcatatgaacttaaatgaaaacatgaagctagaaacttgttttccttatcctccaaattctaagtgggaaaaagtagtgtaacctagacaacaaataattcctttctcatcaaaagcaggacacaatacttttcagtcacaacatgatctcaaaatatacacattttaaaagcacacattttttttcagtcaaacctgtagacctaaccctcctttgcacccactcttcagaatgcaaaagaaaaactttaaatccagtaatatcagactatttcaaataaatttcagctcactgtacagccttttacttaggcaactcccactcctcagtgtataagcatgatccaaaggattttagagatttccatttacaaaaatatagtaatactttagccccttctctgctaacctgcccccccacctgagtaacttcagcctatgttcatgaaatttagctacttgcttaaagtgatcatatctgaaaggctctgaaagacaggaaagcatgccacttctacactagcttttatgctgaaccactacctctgcataactcagaaagggagggagggaaggagggaagaagaaagagaagaggtaagagacaaagctgtgagtgctaaggataagaataaatacaatgcaatggttggccggaggagatgggctaccaaggataactattcaccagtaaaaggtaaaaatttattcctcaggaggaaatggtttcttgagtataaaacgcatcaaacaacaaagaccaagtaaacctgctgcttcttggaattaatacttttgggtatctatctcattatacctttacaagtaatcaatggtaagaaatcccaagccccctaaagtaaaaacacatttctgtaagaaaattcatttaagtcttttgatagagaccacttatactcaaatttgtggagcccacttatttcagataatgataaacagaaagaaacagattagaatgtagatgaaaaaaaatattttaggttaattcctgtgaattcaggtggtgttattaaagaagtcaaagtatggtttagtaaatcaatcagaacattcatgttacacagttttaagcttactcattccaaaataggttttctataaaaaagagaaaagcccacattaagtgccaagatcagtacttaatggtaaaagtaccattcaacatctataacaatgttacaacgctgctgcttgtattcagcattcctacaaagctctaagaggtctgaaagggagaccctgtagcagatctcttctttctacattttgcacattatgtacctccaaagccaaggctgtcttgtcgtaggcattagggactcgcttctggattaccctggcataaatgggcccattctggaggttagggagcggagtgttgacgctgggttgggcatagggcccaggctccggcccacccagtggctgtgggtgggaaccctcctggttacctccaatcagagccgatactgaggcggaggcaggtctatacttctccacgtaagggactggaatcatccctctcttgccttcgctgtcctccgcattccaccactgctcttcaggcttatcccggattctcaggatgtctcctttcttaaagggaagatcttcttcatcattcccattaaagtcaaagagggctcgtacatactctgcctcttcctgcctgagaatcactccactaccctgcctggatctggaaactggttctatcaacgttgtagtgtccaaatagtgtattttgtagaattccagtaaagcaggcaatgaatcaaattcttgatctcctattcggagtctggagggactcacccctaaaaaaaaaacagagcagggtattattgaaagatatactggagatgaaatgcagattttaagcatctccccgcacatatttactcaatatttaaccaaaaagaaagagaaggaaaaaaataatctaaataaccccttctcctaacagtaaactaaaatcatactttgtacctcaaatgttccctgggaataaagtaagcgatcaccacctgcagcagagaagagacagaggctgtgatagagcaaccacgcctgtcaggacaagctcacatactggaccaaagacagagcaccatggagacttcttgttcattctaccaaaacgttctgtggctattcgatttacagagtacaagggttcaaggctgtgttagtcttctttttcttttcaacctcaggaaatgtagcaagctctccgttttcacaggtcccagcagctatcccaacaaaaggcgggatattttattctcaatttttcactactgcaaaccatgctcttacgagtgcttttattaatgaacattttttattacctccttaggataaacttcttaaaatgcaactgctggatcaaagggtaggaacactaaggtttacgttgcctgtcgtccaaaaagttttgattttacactcgcaccagtggattatgagttcccatttcccccatgtccttgccagaacagcaaggatgtctcttgttaaatatcatctttgattgtttgatgtttttcacatttattcaatatctgtacttcttttgtgaaaattacttgttcgagttctttgttaaagagagggcctaaactaccctcaccactcctattaaaaccagtcagtcaaaacaaaaacctaaccaatccatctaaaaaccctttgctgttaatgctgtgaaacaggaacactgcagtagcccagatgtctaaattgcttcgccactctaaaaaaatgagaccaaattattttgttccgtgttagaaaacactctgtccagatagaccagaaaaagtacatttcaaattctctcctggggagaggtgaagtgataaactttggaggttaaccagaagtcctcagtatagaacatatattgatgagtgacttctctttgcacccatatgaaacaaaggccgagcctcaatttagaggacagatgcacatttcttacattgcaaaagtccatctgtggaattcatggctataaactaaaacaagttaatagcccacagccagtaatgctggctgtctctctgactcaagatgttgaaatacatgctcatacccaggattgtccatctatggcaaacactcctcagacactagcag

SEQ ID NO: 56551 - DNA, 1564 bp, Bovine  19866880936088
atgcctcccagctcccagtcagcagagtagagcggatgcccataacccggcgccccccaaaccttcttacccacagagggtctccctggaggggacccatcatagccagaaacaggggctgctgcaggagagcgaagagggcgctgatcagggactgcaggcccgtgaggctcccaaactgtgtggaggggtacctgccaggacaggagagggcctgtcaccgcggggcccactgtccggcttcccggatgctcctcggcctcagcctggccccacttgccggtgcccccaggctgcaacttgaggtatcaaaggagatgtgggaacagcttcagaggacagtccggtgtccatctttggactgctttgtgatgagcagttccatgcagagaatttccctcttggaccagcatgaaggccctggggcccacgggtgcctggccgagccgagtggacaacatgattccggcaggagtctgtggctcgggagctaggcccagggagcaggtgggaggctgggccgggcttggctgcaccttcatccagaggagcattgtataatcacggaaacatagcatcacagccctcagccgactccctcagactctgccagggtggcctcaacttcctctaggtcttggggcggggagggtggcgtggggtggagcatgcagacctgggatgacccccatgggatgctcttgggagcggggagaaagttctggcataatctcaggacattaggcatcgtggcttagcaaggaatggctgcaggaatgagcctgtctttggtcagagagagacagcggatggtgtttgggttctggtgtttgagccaagccccagcctgaggaagacgaacaactatggttccttaggtgtgtgtggcctcttggaaaaggaggcaggtttcactttagccaagggctgagaaaactgcgggcagaccagccctttgaggccctgtgtgggctctgtcaggtacattcagggctcagttatttatgtcgctgctgccactgaaggccatttgaaggtcaacattcagatgcatgtagccagaactcacccctgcgcttcccatgagcagtcagcagcagccccaggactcagatgagcagcagcccctgaggccgtaacgataccgagctgcaccctagctgggggaactgacttcgtgttaaatgccaaggcttgtgggcacccaactgtctgcccactgacctgttcccaccgagtacggccttctcctgacacaccccacagaaaccctaatatctaagacaagaggaggaacctcaggtagacaagatggtccccttcaggccctcagccccacctggaagccccctcaggtcatccatccccttaccctcagccaccaggccacccgcagcccccaggacttacacggcagcatataagcccccgacggccgagtggatgaatcctcgcacgattgtgtgcaggatgaaggagaggatctgagatggggagagcagagtgtgagcaggagacatgggagggtctccctttgtccccctgccccaaagctcccagggtc

SEQ ID NO: 56552 - DNA, 1795 bp, Bovine  19866880947296
cctgagctgtcttagtcttctcatcttgataaatggcagctttgactttggggctgctcatgtcaaaattcttggggttattcttggctcctctcttctcacacctccatatctaatctgtcagcgatccaagtcttctttaccttcaaaataaacacatacagtgctttcttaccactgcaccctagttcgattcagtgaaatgccttctgattagtttctctagctcctccctcctcctgctctccagtctatttccaacacagccactggaaggatctctgtttctatttatttattttatatttggtcgtgccgggtcttcgttgccacacgccagctctctccagttgcggtgcacaggcttctcattgcagtggcttctcttgttgtggagcacgggctctaggtgcgtgggcttcagtaattgcagttcctgggctctagagccctggctcagtagttgtagtgcacgggctttgttgctccatggcatgtgggatcctcctggaccaggggttgaacccatgtaccctgtattggcaggcaaattcttggtgtttttttttttttaatttattttttttatttggaggacagttgctttacaatattgtgttaatttggaagagaggttcaagagagagggggcataacatatacctatggctgactcatgttgctatatagcaggtgaattcttaaccactagaccacctggaaagcccagaatgatctctttaaagcatcagtaagatcgtgtcccttctctatgaactctctggtccagctcttgctactttgcttgtgcccggtatgccctagtcacgttggcatccttgctgttcctcagaccagccgcacactcaagggtctttgcacttggtttcctcgtaacctggaacaccctgtccccagagcactgtgttgccctctcacgcccttcgcaatgccaccttggttggagaggtcttccctggctaccctatgtaagatgctacatgccttcctgtgcccttttctctctttctttccatggcagagaaaaataacatctctttaatatctagcatgtgtcagtccctggacaagctacttctgtccagtatttaagtccacacaaagtgcctgccaagtaggtattagtaccttcattttataaaagagaaaactgaggctcaagaaaggagcgaagagtgatgatcagctcttatgaagtatctccaccaccgacctggaagatcagtatcgatgtgggggactctttagggactctcaaccttttggatatctgaagaagacagacatcttctccagcttctggtgttcacgactaagaaatgtaaagtatctcaaggactttgtagtggcaacatgagaatttcatcgtggtcgagcgtggtcacgtttggcccagcctggatgtgcactagacaggcgctcactgagcagacctacaccactcctgtgtgcacagcaagagaggttcagacgtgtaaggcagacacccacctagtttggaagataacttgtggcatacacaaagatgtgacaagcaaacaagttcatttgcatctgtagttaaggaggaactcttgaaattttattgaattggtagtttcccaccgaaggcattgctcaaggagcactgacttggcattaaccgatcactgtatttcccaagtaaattccaagaaactctagttttataggttcttaatagttaggtgaaaaaaagttccacaatcatgtaaattagagtaacacagtattagacagaagccattactgcagg

SEQ ID NO: 56553 - DNA, 983 bp, Bovine  19866880951270
ccatgagtctccgctgatcaaagtccctgaaggacctctgagccccagtcctggtccacagacctcatccctctgagggttctagacctggtggccagtggctgaggaggagcggtgcaccctgcctgggcaggtgcccctgctgccagcctagcagcgggcgagttctccatccctgcccagcctgattgccctcggttcagtggcctcctgcaaacacataggtgagctggcaggaagggaaaagctcccacacagttccgccacccagaagaacgtgctgcagaagacagctccttggacatgtttccgccaccgcagaccaagcctcctcagccggcccagctagtctgaatcagaactcaagatctttgagagcttcaagggcccacgtggggcaggcactgctcgttgaagggtggtggggggggactctggcaggtccggtgagccacaaagatgaagcagagtcatgagggcagaaagggaaaggaccaggaaaagacgccagcggggagggaaaggaccgagaagcctgaagaagataaggagagagagagggagagtgctgtgtgtgtgtgtgataaagagacttcatttaagcagtcgtttctttctgcgcattacagcctgggtcctaggctgctgtgagtctggggcagactccagctctgggcgtgcctctggcaggcaggactaagctgaccccctccagtcccctcagaggcggccctgtctgggccccaggggctctctttccagatccatagctgggattttttgatatctggcccttcagctccacccggaggcaaattaagggaacactctgggtgtggggtgggggggctgcggctctgggagtgaggggtgcaagccatgctagattctgggaagaaggaggaggggacaaatgcaggtgggatggggcaggagcccagatcaggcccctgcagcaggcaggcaggagagaggcccgtggt

SEQ ID NO: 56554 - DNA, 1060 bp, Bovine  19866880958928
ccttacactacagcacccgcctacagtcgcccccaccccctggctggactccagaacagcacccagccctccagaggcctgaaataactctgcttctcacactcacgcccagccccagccaactttgcctaagatactggagattgcagggcagggggtcatggggaggcggcttggggaggtggaaggaggtttatcataccctgatgcaggctcatacttcagcactgatctgctgtgagatgctgagcgagttgctcaacctccctgacctgggttttactggcggagggcctctgcagctctgtgtcctcggagttcagctagtgtctgcctggcagggctcagacaggattgctcagtccagtcctgcagctagtagaggctaagagaatgccttacctggggtttctattgcaagatggaccaatcttcttaatcttcagcacaagctcactttctcacctccaagccatctacacattccttcctgcctgtcctagtctttccccttctcagcctgatgaattcagccctcaagaccaatggcacctcttccgtgaaacctttttggatggtctttcagccccttacagagctagcagagtccccacccacactgcctcttcctagcacattctaagatagctatgggtcttcccctacagaagcttgccataagcttctgaaaatccaaggctttgttgttgttgttcagtcattaagccacatctgactgtttgcaacctcatggactgcagaataccaagcctatgtagttagcacaaacctcagtgttgctgaatgcatgtatgagtgaatgaatgatactggccttctttttgagcttcctaacatggcaagtttatctccaaggaatcacacgactctctcacttcaattagatctctgcttagatgtcacctgctcagagtgctttccctgatcccctcttatcagctccagaacaaaacctgacttattttttcttcttccaagcaagatctcatctggactttcctaaattggtccctaataacggtaaatttcacaaggacag

SEQ ID NO: 56555 - DNA, 1285 bp, Bovine  19866880963159
caggtaaacacaggaagtttcggggagcctgattcccactgaggagttagggggttaacatgttcctcctttaagtagttccagtttttaaaaccactaagggaagaagatgataattagtatgaaggcttaaaaggctgagaacttcagcctcagctgaaggctggctagtggcgggggaagtgggcaacacgctcggatggctcgggagtctccctgtgctcttccctcgctgccagtcagcctgtacaccctgcacacgaggagaatggcagagatacaaggattaagtacgtgaattttgaagtcagacaaaactgagtttgaggcccaggtctgttgttatctctgtggacttgggaagtcccctctgaacttcactttcctcaactgtgaggtgagggtcgtgttgccacagccctcacaggctggggtgaagactgagtgaggtaccgtgcgcctggcgtactgtgggcccccggtacagtgagctgtcggtaccaggcagaggctgggggctcctgcctgcccagagtgggtggtgagggggcagttactctgcagcttcgagccgagtgactgcaaggtgtcctttcccctcccgcagaatgagtacatgaaagaagacttcctgattaaaattgaaacctggcacaaacctgatcttgggaccctggagaacgtaagtagcacttcccaagccccccgaggccttccaaggcctcaggacagggtaccgaggactatccctgccaagggctcttcactgtggtcccctttttcttggccaggaagctcgcatcctgtgcctagatctgtcctaccagcatgggattgctctgtctctaatcttagaagtatgatctccaagatgctttcaaggaccttctgctagtgctgggattggtctaaaatacaactcctggcacagaagagctaaagttttataacatcaaaatgagcgaatcccctgaccacccagtggttaggactcggcactttcactgcctgggcctgggttcagtccctgctcagggaactaagatcccagagccacatgtgcgatgcgcccccacacccctgaaaaaagcccatcaaaattacagcctctgtagagcatagtttgccagtaactcctcgggtttaaaatatacgtgtcccttactccagcagttccacacctaggaatttatactatagttatgttttcgtatgtgtgaaatcattcaatatacagggagagtcattgctgtattgttggtgtggttagtcactacatcatatc

SEQ ID NO: 56556 - DNA, 1226 bp, Bovine  19866881005742
ggaaggctgtaccccagtcgatggacaggcgtggacatgccacctgcacccacctataagaagggaaatcaggtcagatcctgggggagggggtagcctccctgttcctgccagcatgctgaagaacatgactgtgtccccaacacactcaacggggcttactattaattcgaaagtaaagactgtcacccactgctgtttagaatagcactatgacattgttttcttgtttcctccaatgtgagcttttttaaggtttttattgaatttgttacaatattgcatatcttatgtgggatcttagctccccaactagggaattgaaacctgcagcccccgacactggaaggtgaagtctcaaccactggacggtcaggaagtccctgactatgacctttctgaagagagggcttgggcagcatgtttgcaatcagaccccaggataaaatttagcgcctggtccaatgcaagtgccaaccacccctcaaactcatctcacacagaacgactatgacgtagccgttgcctgtgagcccccaagccaaagttgggttgacccatagccaaaagtagcccctgcgagatgagtgctctctaaacattaaaatttcatggtcatgggagcacgactccagcctgcaataggtgatgggcagaacccagattctaagcttccttagccagtcatcgctagatagattaaggtggggaaacgtacacatccacctcgggaaggaggctgagcttgctggggaagatctcagagagcagcagcctcacgaagggaagtcccaaggcttggagccgagattccaggtgctgttgggagagggaggcagagctggggtgatcaagcggccaaagtaaatccctgggcctcctgattttctcagctgggttcccagctagtcccctttcccaaagccctctaacctccaggatcttgggactgccttggcggcccaaagtgcccaggatgagaccccaggatttagctgaccgggcagtggctatggcttccttggcggttggcctgcatgcgcttggtggtcatagtgctctctggacaggaccttgctgtaagggtcgtatctggaaaagaagctgtcagggtcactgggacagccactcacagaacttgtgctgtacacacagctccctcatgcagcaccttggtcttcggaaccttcaggctccatgcaggcaattaggaacagaggcaagag

SEQ ID NO: 56557 - DNA, 1101 bp, Bovine  19866881019760
ggcttctaaagaagttagttccgcatttgccttgtgctttcgaacaggtttgtggttactattcagtgtcatatatgattttttttttactggcttaattttttacttaatttttgttggagtataattgcttcacagtgttgtgttagtttctgctgtacagcagagtgaatcggctgtatgtacatatatcccctcttttttagatttccttctagcttaattttttttactgaattttttattttgagatgattgtgagattcacatgcaggggtaagaaataatacagagaggagatctgcttctcccagtgactacgtcttacaaaatgataatatgatatcacacccaggaaattgacactgatacttttacaagttcctttaagtcaaaggtgtatttcatacttataggaaaagcagttttcaaaagatgcagaaaaatattttttaaaaaagaagaagacgaccaaataaataaataaaaataagtagaggaatgaaagtccctttcttccagcccctggcctcattgcctagagcaaagccctgctaaaaagaaatcattcaggaccggagcttctgtttttgtgttccttgactgtatgtgcatagatagccggtgatggcttgatccgaggaacactataaatgttagataaaatctctcattttaggcccctgaaaacaggaaataagcattcttagaacatttcattgtaagaatgaaatattgcatttttatttcggtgcaccctctgtggggggaccttgtctttgagagtaaaggaagctattgtgtttcctgataggaagttgcatcttatttcaagcaataggagaacaggacctggctttgcgttagtaaatgcaagccaggcagtgagctctcagggtctataggtatctgcttgagacccaaaagctttgctcccataatactaaatcttagcctctttgattattgaaaatgtacatgaatggtcattagtgagcagccatgtaatgagtgcatttctgtcttctttcacatttatttatttggctggctgcgctgggtcttaagttgtgggcactccagatctttagttgtggcatg

SEQ ID NO: 56558 - DNA, 1368 bp, Bovine  19866881146808
aataatgtaaaaatcttttaatcgcataaatgtccattttattctgtttcaaatacccacctaaagatttctttattaattcgaaataatcccttttaaaaattttaccctgttggaaatagtagctagacttcgtctttttgttgttgctgacattaattattctaatactcttattagcatctctaagacccattgagggaaacaaagaccacaaatgaagcttcccaaaccagattttcttaacttgttttaaacaacagaagttcttaggttagttatttttttacacttttaatttgatttttgttttatagatatctataaaacagctgtttataatgagaaaaaaaatacagtaattagctttttgaattggcttcagtcacatagcataaagcatttgagagtcatccatgttgtctcctgtgtcactaattcatttttgttgctgttgcagagtaggattccatggtatggatataccacaatttgtttatttatttaccaactgatgagcatttgtcttgtctgcagcttttggtagctgtggatagaatgactgcaaacattcatatataggtttttatgtgaacttgggttttcatttctcttgagtaaatacttcggaatgaatggacgggtcatttgttaagtgtaggtttaaatttattagaaattaccagactgtttgcagagtggctgcaccgttttgtgttcccaccagccacgtacaagaagtccagtttccccacatccgtgccagcacccgggtactgctgttctgttttgtttttaaagtcattccaacaggtatcccattgcagttttaacttgcatttctcaaatagctaatgatgttgagcatcttttcttgtgcttggcagagtgtcttcaaatcttttgcctatatttaagttggaatgtttgttttcttactgcgtttcgagaggtttttatgtattctcattgcaggtcctttgtcagatatatatgttgcccgtatgttctctcagcctgtggcttgtctcttcacttcagagacttaaggttttgactgattaaatgctgagtgttagaggtttcaggctctcttggtagaagaaagtaaggaaattgagaccttcgtcagcagaaagatgtgaggaccaccccttttgaagctgtttatttaaaatacaagaagggggaaaggagtgccccaggactgagttgtgcagacagatgtctgaagctttcattaattccttctcctctctcctgtccccacctatggtgtggattctgggctcttggcttcaatggggttcttcagttcctcccatcacttcagccccactgaggcccctccagccccgcaaacaccaa

SEQ ID NO: 56559 - DNA, 648 bp, Bovine  19866881169954
tgattgacatcagcctgtcagaggcgcccaggtgcatcccttccaagtatttacaaatgaaacggcaagcccaaacagccagtctttgcctctggtctccattcttctggtttgtgctttgctagcagtaaaagcagggactaaaagggcgtctgtgtgagtctaagcatgcttctcccactgtctgcgctgagacccttccctccggtcaggctctccctaaaaggggtctccaagccaatacgtgggcttaagggccttcgaagccattagtcaccacccttgcagtctcactcccaactgcgaatggggccacccgtgacacaaaactctggcaagattaggggactaggcaagagcagaagaaaccacaatacgccggagactcccaggagaacaatgactagtcctggtagggaacagactgacagagcagacagactctaaccaggcctcgttctgttttcgatgcaacacaaatgttttccattagaagttccttgccccacaaacactcatacatgcggctatgaaatccacatacttaacttctgcttttctggcactctgaccccactacctctcctgttcctctggaacggagcaaagggagagtgaggagattccaaaattcccaggacaaaggta

SEQ ID NO: 56560 - DNA, 1311 bp, Bovine  19866881243407
ataggtaccaggccgcatacacggccgtgtgctcctcagacatgagtgacagcacgaaaggcagcaagatctccaagccctcaggggtgatgtcactcagaacggcacccagctgctgccacagggcaaagaccagctcccgcccctgggcctcgtcctccacgcgcctcacctggtacaggaggatgaatttgtgcagcgcggggaagtatggggggaaggggaccacagagctgaaggggctgaggagctgggcggggcagggtgggggcaatccctgggagacgggcctatatgtaaacagtgggtccagcttgcccctccctgcaaccacggggccttgagggccactcagctgcagaagtgtgtccagcacgggctgcagagacaccgggacctccttgggatggcgtgcacagagcccctgcacagccttgaagcgtacccacaaaggtgcatcaggctgcagcgtccggaccctggtggcaaacaccatctcagccaacaggacccccagagcctgcatgtcccgatgaaagaggtcccgcagctgcacggggggctgaacccagggttgctcaggcacctccaagcggccccctaggcctttggtcaagaagttgcctagtttctccagctcctccagagcctgcagaggactgaagccctccggaagaagaatcttgccctcctcaccttccctggggtctgtcccagcagctctgttccgacggcccggtcgagaggctgaggcccctgagaaaggcaagaggcctggcgggacttgactggaggacgaagtagaggagggagacggtcccagctggtcacctgtcttcccagcgagagagatggaatccagagcttctgtggcctgctccaactcatcttcccctaccccgggcctgtccctggcccagccagcctcacagggagtagcctccaaaactgtcctgcccatcccattcgtaagctgtgcagggaagtcctcccggcctgtgctctcctggatggtgtggaaccatagcctggggacgaggggaggttcaggggcgagggcaggggcccctgccaggcgctggggatgtggctgatcgaagagctgtaccacgccatagctggtcaggtgtgtgtgggcgtccaccaggtgcagacacacgttcttctccttcacagcctccttgccctgtagtttgtagccaaaggtgaggtcaatccagtggtgtaggtcctgggacacctctcggctctccagcagcgcccggtgggcagccacgaactccggtggagcagcaccaggccggcacatcc

SEQ ID NO: 56561 - DNA, 823 bp, Bovine  19866881281364
tggcctggccagtgcaccccgaaggaaagggccgcttccggcattctgcatggaggtcctgccttctgctgtccctggaggctctgttcctgtttgccagctattttgcttcctcggccatctgttccctccctgtcatctcctctctgctttaaccttaaccactacttcgctgcagatggcaccaaacagatccgttcttgacatccttcagcaggcctgccccctccttctcatctccagagagtgaacttctgctctgtcctttctcaggccctgacttcaaagcttggagttggactcacccccccacaagcctccctcctagatcccatctgctgtcaactctgccacaggtcagggggcaaacagtcctaccagcctcccctgtcttttccatttcctaatgagacttcctcgcttcagacttggctaagaacctctccccgtgtcaagtccactgtctgctctggttatccacctggtctcctaaaacagagccactgtaccctccagggcagtgggggtcgagcttagcagcctgagtccgagatcagaaactcggtttcattcctgcagtagaggagtcagtgcgtccacgctgggagtttgggtcttgaacagttcctctgcagcacctagacctggaaactgcggtgaagagttggcctcgtgctggcatgacaggggcggaaccaaaacacattttctacatcgtcttaactcacaaacggggagcactgcatttctttccttgcttttattctggctactggtgagaaatgcattcaaggactttatttagccactctgcctcttctct

SEQ ID NO: 56562 - DNA, 1343 bp, Bovine  19866881318803
gaaggagaggccggcgggcggtggcgcggcctagaggaggcggggttcccgggctcagtcgagccacgtgcggttgtttccgtaccggggcgatcacgtgagcagcgtcagctgacccgtcacggtggagcctggcgctggcgcccctcagcccccgcccggccgcgcccggagcgcaggaccctgcggaggggtaagagcgcccccgcggccccactctgtccccggcccatccccgcctcctccgccccagccccagtccctcgctcacccctacccacctggcatcccggaagccgaggcgagggggggctgtggccgggctcagccccgcgctgcccccaggcggccaagaggggatggccctgaggagcagggggcggggaagtcgcgcttaccgcgaaggcggaggactggtcaccgcccccgagccccgacatggaggagctgctccggagcgtggagagggacctgaacatcgatgcccgacagctggctccggccccggggggcgcacacgtggtggctctagtgcccgcgcgctggctggccagcctccgcgagcgcaggctgcccccgggaccctgtccgcgcgccgaaggcctgagcgaagcggaagtcaggactttcttgcaacgctccgtgcagaggctgcctgccggctggactcgagtcgaggtgcacgggctgcggaaacgaaggctctcctacgcgctgggcggcctgccttttgaggaggggtccagcaccccggagaccctcactcgcttcatgcaggatgtggctgcccagaattatcgcaacctgtggcgccacgcgtatcatacttacgggcagccctacagtcatagccctgcccccgcggctgtccctgccctggattcagtgcgacaggctctgcagagggtctatggttgccctttcctgccactgggtgaagctgcacagtgcccctcatatgccagagaaggcccctgtgcccctcggggctgccctgcctctcccagtcttctgagagccgaggctctgttggagtcaccggagatgctctacgtggtctacccgtatgtgcagttctccctgcacgatgtggtcaccttcagccccgccaagctgaccaacagccaagccaaggtgctcttcattctcttccgtgtgctgagggccatggatgcctgtcaccaccagggactggcctgcggggccctgtctttgcaccacatcgccgtggatgagaaactttgcagcgagctccgcctggacctgagtgcttatgagaggcccgaggaggcaggggatgaggagaccccggaagcaagaaacggggcaggtgtcgagcctgg

SEQ ID NO: 56563 - DNA, 787 bp, Bovine  19866881320960
ctctattgaggcagagttttaacaccctaaatagctagacacagcaaggagattttagtaggttctcctcatcccgagtgctttgtgaataacaacatactgcccacaaaagcccattgtgcccactgcactcgatcagagtctggtgaatacacactagaagatgcgatcggcaccggagtctagacggaacaagacgcctagccaccacccccctccacccgcagagacccacggctttgagccgtgaaatgaaagacacctcctctcacggagctccagcacaaagctgctacagcccgtcttcacctgcttcgcaggatcaaggttggcgggcagcgttcctgtcctaattgctccctgcgactctccaggtttgtcatgggattacaggtttgtcagtttaagggctttagagccatcctctcagaaggcataatgcctccaagaaatataggaactgcttcatttagtaacagagccctctgcttggcagacagatcacacgctgattacaggaaccaaaagaaccagttcttctccaagcccaagttcaaatagcccctgtgttgagccccaaaaaacctaccatccacgaagcttataggcctctgggatgtcagggttcacaatgatggtgcttgaagataggacagagaggctccgtccaccaaaatcagaaactctggctcctttgatggccatcacggggttgtctagagccatcaaatttatcagcctgcgtaacaacagaaacaacaaacaaacaagtgtcaatggcaggaag

SEQ ID NO: 56564 - DNA, 900 bp, Bovine  19866881386492
ttagttagttccagccttttcccctgaatggatcccattggaaaatgcatttgaaaggaaaccagttatacacttccccttcctttgaaactctgttggcaccttttccagtgcagtaaaccatacaacatgtattttcaaagtttccaaacacagacacactggcgttaaatttatgaaaaaatattttattcagctgtatggtaactgtgactttcagagatgctgatcagatttgaaattggtgctgactttcggaattcccgacaggtttgaaatctctgcaggaagtagagccacaccagctcttgggcatctgtgatgccttggccttggattgcaggactcgggtaagggacataggtgtgagaatccctcagccacaccaaaggaaaacagggaaggccagtgtgccattgaatatcacgcctagttacgtcgggcacaggagcagaaataaaattgtttactctggtctaggactggaggtcacgtaacacctgtttgtgtgggatgtcatttactttagggtgccatggctaagaagagcttgtttgtttgtattcaaagcaatgatgatgtcactgatgtctgtaagtgattacctcccccctccgtccttatacctgtggccttctgtccccacccctcaaaaaaaagtgtgctagaatcagtctatttaaatatctgtggatttgactgaggtttgaatttggtccatagggacagtgagccttctcaaggatcccagctgttaattcagaggatccctgggaatactcttgaaagaaacctttcagaagaaggtttcttccaaattgcttaagcagctgaactctgtcttggctcacttatattcatgtacggaccgtttcagcttttcttgctaccaatccaacg

SEQ ID NO: 56565 - DNA, 1024 bp, Bovine  19866881398549
ttaaaaggcgagaatttaaaagttatgtaattcacatagtcaagaggatgttaagtgagaaactacccagataaattattaacagagaatagtgtatcattttgatttttttttttaaagaaaagcatattaagtatctttcaaagactgtctttaatcatttttttcaatcacacacttgacaatgaaaattggaattattctttgcaagaagcaactgtcatgtgcagcattgtgaaaactccctttagtcccagattaaatttcaaatcatcactcaaaagcctgccgcacacaatcagcacgtgtccttgggtggcagccttacccattcctgggctcccattctgttgctggggcctgctggttggtggactggctgctgagacaggaggaggaactactggctgctgtccgtgtcctgatgatcaaaagggaaagaccattttagtgccaataatttggattaagagatttaaacttaagcagaagaaatattctgagaaagtgtaaatttgtgatttttgtcaaagactctcctgggtcagaattcatgctggggcactttactgcatgcagcgaaagtgctgggggttcacttttgttttcattacctaaaaggttggctccatttacctttcacctgcttataattgatggctttcagttttaatgaggttctcccctaaagccttgcccatttctcctgcgtgaacctgaagtaaagtcactgggctgaatcggtgacattaccactatttccatagcaacaaatcgatgttatcaacagaactgtgttcacggcaggatctatcagaagaaaaagctgggtggtaacaaaaacctaaaagcagttcaattgtctctgaagtgctcctgcttcaaagggaaagaagacattcagaaaggattctaccctttcccttccaaacaaagcaaccttattttgcaactgacagttggtggaaaataagagttgaaagtgccttaggtaccgtgaagcgcgagtgaactgtcacagcag

SEQ ID NO: 56566 - DNA, 1338 bp, Bovine  19866881412124
gtatgtgaggcctgcgccctgtgcatgcacggcctgctcagcagccctccctgcctcacctgccctggttgatgttgatgttgttcactcggtcagcgctgagggctgtcttggtcagggtctcgatcacgtggtcactctgcagcaccacgtccccctgggggcccacatagggacaggggtcaggccctgcccagcgcttagaggacccgtcccctccccgcctccccaggccccaaggggcaccttctgcttattgtcctcacgctgcacgtggagcacaaagaggctgtcgctcaggctgctgacggagattcctggggggaaagggcagaggtcagggatcaaggggcagagcagggccccctctatggacccaacctggactcaggctcaccggtcaggttggtgtactcaatcctctgcttgaccttggcgtcctccacaatgaccacggcgttgggcgtcagcagcagctgccgggagcgcggcttgtagcccttgcggtcgtacttcacgacgggcacggcgtactggggacagagggtgggttgaggggcctcctcaccccctgcccaggccccgacccccgcccacgcagcccttgggcagctgaactgtgtggggctgagggctgcccacagggtctcacctggatgggctccgagcccagggcctgcagcactctggggttgatctcatctgcacctgcaacccagataggggagcgaagggggcgtgagcgaaggagagaggggaccgggctgctgatggagggtttgcacactggaggggcgggggctcaccgagccgcgtgctgatgaaaagtctggggacactctgggggtaattgtccttcttgcccttgaagatctcactcgcaacggccttttgctgcagctgaggagacaacagcagggagggcgggggatgtcagagaggtggggccgtcacagcagagcaggagtctgctgagacaggagctgagaccaccttccctcaccctctctctggacccaaaagcaggaggctaagccctgccaccaatactccccttcagccccttctctctcttacccccgtccccaccaaccgaggcagtggcctctccacaagggtcatgacagtgctgtcagggtccaggccccacttcggggattattcccatcatcacaggccctggagcccctgagattcagctctggcctgagatcttaaagttggctgatactaatactcagaactactgtggggcttccctggcggtcctgcgattaagaatctgccttgtaatgcaagggacatcagtttaatccctatctgagaagatcctacata

SEQ ID NO: 56567 - DNA, 834 bp, Bovine  19866881457449
atgtgcatcgagtcggtggtgccatccagccatctcatcctctgtcgtccccttctcctcctgcccccaatccctcccagcatcagggtcttttccaatgagtcaactcttcacatgaggtggccaaagtattggagtttcagcctcagcatcagcccttccaatgaactaacactaaataaatgcttactaagtgaatgaataaatttaagataaagaagctggcttactgtctttcgtaatggcttgctgcgaatggcaagaccgtccatgtagtcctccagtttgaacttataagtgacctgcagcttctgaagcaaactatcaaagaagtcactaccctataaagagaaaaaataagaatcagccaaatcagcctgttcggattcattctacccagaaactggggcaagtaaccctttcacagttctgctattgttcagccagcagatgttaagggaggtatgtgcagtatttagtggccaccaactaaacccaagacaaattgatagcataagcctttctgtggttttaaagatatgaaaacatacacagggacttgcctggcagtccagtggttaagactgagcttccactgcagggggcatgggtttgatccctggtcagggaactaagagcccacatgctgcaaggtgcagtcaaaaacacacacacacatgaacacacattccaggtaagacattcagaaagcttccaagctcaaaactaactcctcctgtcggttaaattatagtgtcaaggaagcaacagaggtagggtaggcctaaactcaagaaaagagcataacgtttgtcgtcaatgttctattataaa

SEQ ID NO: 56568 - DNA, 1212 bp, Bovine  19866881488835
tgagccttagtttttttggtctgtaaaatggaaacagcagcacctatctcatagagttgttatgaagattaatcatggtaagatgttgaatgtgcttgatacaacatcttacatgtagtaagcacccaagttacaatgattactgggtcgatgatgctttaatatactcatatgagctgatgctaatataatgtgggagggtgtaatgtaggagggtggcagcctgtccctgactcgggacaacacgtcttcctgggaggagatgtaggagagaacaggacgactccggcccccactgaggctctcccctctccctggcaggcagtggagggcagcatcctggtcagctcctcctctgaccactccttgactgtctggaaggagctggagccgaagcccacgcaccactacaagtctgcctctgaccccatccacaccttcgacttgtacggcagcgaggtggtgaccggcactgtggccaacaagattggcgtctgctccctgctcgagcccccttcccaggccaccaccaagctcagctctgagaacttccgcggcacgctcaccagcctggccttgctgcccaccaaacgccacctcctgctgggctctgacaacggggtggtccgcctcttggcgtaggctgaggcgagatctggtcaggcagaggtggcacacatcgtccaggaagccgtccctcatctgtgtttccccagtagctccttcctggcaagcctcaggccccacgccctgggtgcccacgtggcctgccagctagggtggtgtgggagcctgggctcctgaatccccagagtcactgaggcccccggaggggatctcattcatgacttggggcgatgttgctcggagccagcgggaagcagatgggagagcctggcaggggcttccctggtggcccagtgattaagactctgtgcttccactgcaaggggcgtgggttcagtgcctggtcggggaactaagatcccacataccgaatggtgcggccaagaaataaaaattaaaaaaagagggagagcctgggaaagcatcgctgccctcccttctctccagctccgccctctgcatccgcatggggacaggatgctctggggaagagggaaggagaccccctgccaagctgtctctaccacagcccccctccagcggctctctctgacactgtcctccaaggatagggaagctgcccca

SEQ ID NO: 56569 - DNA, 1152 bp, Bovine  19866881593041
ggcgctgagccccacttatagaggtgagggcgtggagcttaccggccctggaaggtctcaggggccagcgtccgcagctgccggttgtcgccaaggtctagctcctccaggtgcacgaagccctggaaggtgttggggtcgatgaaggtgatgttgttggagtagatccacagggtgaccatggcggggctgaagtggccctgccggaggagggtgatgtggttgttctgcaggaagatgcgctcgctgtcctccgggatgccctcggggatggcggcgaagttgtgcgcctggcagctgactgtcatgggtgcggggtagcacacgcagtcccgcgggcagccgctgcccagaggcagctccccggccagcagcagcagcagcagttccacacagcaccctggaggggagagagagagcacagccaggtcacagggggctgcccgggacgtgggagacggtcagagaagccgagctccacgggtatgtgagcctccttggtcaccggggctctgtcctcgtcttagccacacagcgatctggggtctggggtcatagccccctgactcctgatggcttcccatgccctggcgccccatctcttctgggggtttctattccagcctgggttgtgaggtgcgttggtgtagaggctgcggtccccctacatctggcggacttctttagccccaccctgcaaagccctagccccgcccacagcttctgagccccgcccccttaggccctgtcatcctggctaggattggggtcacagcccgtggactcagcagccagcctcgggggtcctgtccccctggggtctcagctctgccacttacttgcctttatctgcatgagcagatagtggggcaggctcctgttctaacaaagtaaatatctcatatgggctcctgaagagtctttttatttcaattattcccaataacaaacaaagcgagcagacatgtcaccaaagttttatcttgaaagatttctcatttacagtgccttccacgtcctcaagcatgcatcatccctcatgacttaagattcctcatttctaagtaataatagtttttctctgcaaaggacacgtgtgtgtatgcgagtgtgagagagagagagagaggtagagacagagagagaggagga

SEQ ID NO: 56570 - DNA, 887 bp, Bovine  19866881789713
ttgctcccctgtccccttcccgcccacccaccctcctgaagatgcggtcactcctttgtgacggccccaggagtttcatgctaaatatagctgcagcccattcacactgccacccagctgcggggggcggcgctgtggaacaatggggcatacacagagcccccacacctgtatggaatccagcggaaggcggacactcagccctggctcctaactgtcggagacggggcgggagccagcgcactacccggccaagggcacgttcacgccccgacaggaaggcacagcagcccatggagctgggcaaacgcccatcccagagtttgcttcagccactcgcaactctctggttcctgcagcatccacagggggctgagagacctcctgagagaggtcaggcttttcggccgaaatacccttgggctgctgcttggagcaagcccagggttggcatgcttggccctgccactccctgtccatcctgaaagggcagcaagaagtagcgggcaagtcatcataattataaccttgaaaaagacagcaagtatatgttaagctctgtggtactgactctggatatccagagaagggaccctaagcagaaatgttcccatgagcaacccccccgcaatgaagatgctaagggaagccagtgacccaagctgctttgtggagcagatgcagaatctgcacccgtgggtttctgcagctcaagaaggaatgcctgggagttccctggtggtccattggattagactggaagcttccactgcagggggcttgggttcaatccctggttggggggctaagaccccacatgctgcacagtgtgtcccccccaaaaaaagaatgtctgcctgcaatgccggtgtatctcaccagctttt

SEQ ID NO: 56571 - DNA, 480 bp, Bovine  19866882049118
ctcttttctgctcaccttcgacggcagctgccccggaatattctggacacttcttggcccacgcccccacctgccctgcgtgaggtccgtgggctctccctgctgactgggggactaccaacttacgcagcagagggacctaataaccgtgtgacccgaggatccatgggaagggaagggacttggagctgggccatggagagcgagttctttgcagagaaacaattcaggaatggaagggtgtccaggttgagggggtgtcacttaggccaagacccgatggtgggcacgtgcctgttgtctgcagagggaaggagccaggctgcctgggtgccctgacctccctctcacccacaggcctcagagctgctgcgggagctgtgccggaagaacatggtgtggaaatactgccggagcatcagccctgaatggaagcagcaggtatggggctgggaggcaggtacggggtgggggtgggtt

SEQ ID NO: 56572 - DNA, 1291 bp, Bovine  19866880410531
ttactcacttacagtcaacaagattttctccaggtggtaaaacatccaaacactctttgaccatctacagagtttggacagcaacctctaaagtgctctcagaaccaattgatagagatcagaaacaagtgtctcactaaatattacattctaattgcatacatgactaggaaagatgggcaaaaatgtttattcacattgaactttttaaatagattcagctgatttatacagtttctcctgccatcaccaattttaagtagctctttatttcatgtcctttgctcacataaacaaattctgtacacaacagacacccggctgcattcaggaatgaaggcaatctttactcaatgaatttttaaataacctatgaaaactgctattttttccaccctagttcaggttatgcaatgactcagtcacacatctgctctctcaaggctacaaggatacattatgttcttcatttaagcttgttcttgagatgaatgtttgacttttgaattgttggaagtgaatttgtacaaggcttccatggctcaactactgaagagacaaacatccattctgcagccaaaatgttttctcaactcatttcagggaaattctgactcagtgtagaagctgtaaattatctctcacctggcaagaaataacggcttcccaaatgccgtgtaatctcagctcaggtaaaaatagacactagtactcatgaaattgtctccttgttggggacaataagtttgctaaaccactcagaacttaatgcaataaaaaattaatttctccatgtattgatcactcttaaaagtcatacatctttcaaagaattctaaacctaaaaagaaaacataacactaacttacatttatttctttacagtttcaaagcatgtagtattttattgtagctattcaaatatttctcattttccagaacctaaggctttgaagaattaaatatgctttgtacaagtaaataaatttagtgcaacaagtcttctaatttctggtgataaaaaccaaaattaaatttagtaaaattcattgtgtgatttttcactatacttgaattttatagctacatctttagtaagtaattgattgattcattacacaaatgtttactaaaaacttagacctgtgatagttggtgggggaaatgtagagaaatataaaactgtcccaattctcaaaaaggtagctaatccatagtgtgtttaacagaaaagagaggtatgtgtgtgtttgcatgtgtgtacatgtgcaatgtgtttatcttactaaaa

SEQ ID NO: 56573 - DNA, 1293 bp, Bovine  19866880599163
tttattgtgatccacaaagtcaaaggctgtggcatagtcaataaagcagaaatcaatgtttttctgggactctcttataaatatgaatgtatatatatatatggatgtatgtatatacgcgtgtgtttgtgtgaagagctttatgcaaatatatgtatacatttgtatatgtatatttgttaaaaaaatgttatttgcttagtcatgtccaactctttgcaaccccatggactgtaaccccaggctccttgtccatgggattctccaggcaagtatgctggagtgggtagacatttccttctccatgagatcgtcccaacccagggatcaaacctcagtctcttgtactgcaagcagattctttactgtctgagccaccaggccaaccatatgtatatatacatacatatagtatgtaacattgattggtattttatttgcaactaagagctactccatttttgctctttaggaactcctacagagtacctatttcatgtatatctgaagcaatttcacacgaatgttacattaggtgctctttaagggaatgcctatttaaagatcaaataaaataagtgtgtgctaattgatatgaaccagatggcccacagaaagaagacttagtctcaacagattgttccacttatttatttatatgcagtacactgaaacacactcccactcttgtatgtacctcaggtccattctgtcccaactcataaaatgcactgtccattcccctaccccatcattctagacatcaagagcagctcttcttttctacctgccaaaaggttctggcaggaaaaatgcctagttgcatccatactcactttgtcttgttcttttggactcatgtgctctttagggtgaatctaactccttccacatacaccaggtcctccaggacattttgacacttgcagaatgtcccattttgttgggatgtatatcttgataccccactcttctatcttatttcctttgtgcctgctagagtgtccgtgccattataaataaaacccacacatcctgaagctttctgtgttttacttctatctctgccatgcatgcacctgaccagaactgtccagagaattgtttaagttagatatcaaaccatgaaatagatctcaatagatctctctgtgtgttacaagtagcccctgcttattttccttcaccatctagggatatgggagttgaattagcatttttcttgctctttaatgctctctaataatctctcctagattatttatctgcctatgtatagagacagagaaggca

SEQ ID NO: 56574 - DNA, 1696 bp, Bovine  19866880641379
ctatgccttaaacatatcaaaataataaaggcatattataaaatgaaatcacaagaaaaattgcatggctcttgcattatattcatgatggagcatttacatgattgctatatgagtcactctttttaatatgtctgctattataactagtacattaaaaaatctatataaatgtaattccactacatcataaacctaggttctaaatcacacaaaaatgaatgtcaaatgctaacactattaataagaaaaacctagaaagtgaatatactatgtttaattaaagacaaaaatcatttgtatcagacagtgattaataagtataactgaaggaaaatttatgaaccagatggactaattttttttaaagtttcctcatcacaccttttaccctttcctacccctctttctgttggaaagcctatcctatttcactaaataggaaacttaatgttcaacatattctagatatttttacatttgttaaagttgattattttgtagatttttaaaaaagacttttattttgtattgtggtatagctgattaacaatgttgtgatagttttaggacaacagccatacatataaagggaagtcgctcagtcgtgtccgactctttgcgaccccatggactatagcctactaggctcctcagtccatggaattttccaggcaagagtactggagtgggttgccgtttccttctccaggggatcttcccaacccagggattgaacccgtctgtctcccgcacagcaggcagacgctttaccgtctgagccaccagggaagccctaggcataaatatacatatatccatttttcaccaaactcccctcccatccaggctgccacataacattgagcagagttaaaccattataaaagcattctagttgagttatgtaagcattatggcttgttatagaaacagaaatttctctaagttcattgcctaaaagaatgtccttgccctattgatgtcactttataattcttatttcaagtgttcagtcacgggaactttattgttggcataaattttcttcttttaaaacagattggctcatctccaaatctgcagctctttgtagagaatgtttgaaaggttgaatgaaagtcagaatgtcaatatatttattggcaaaacgacaatcacctattaccttttctgcagcactttcattttctataaggaatttagtgtgattgtgtttgtttttttagtttgttttataagaaccatttaaagaaaaaaaaattatacaaaatttcaaatgctcaaagcttcctgagaacattggacctttatatcttttccaccagctaagtgaaattgctgatttactcttaggagttactcaactgagtaacccagattacaggcctcatttaaaccccaggcacttctgttatacttcctggtaacctaagtttttagggagataattgaagacatatgaatttgcttttgcctgtatttacccaaaaggtactctaaaccttcatttttagaaagaattaaataaacaggcttcataatggcagtggtaggcagtgagaaagagaatcttgactcctgacctcgtttatactgactattggagaaaataaagaagtaatcgcaattcattttcagattgttttcctgtatagattattacagaatgttgaatagagttccctgagctata

SEQ ID NO: 56575 - DNA, 1737 bp, Bovine  19866880663690
cttgctcttgctctctctctcacacacacaaccacacacaaccacacacacacacacatcttttacaagttaaattgaaacccaaaccttaaataatgatgcaccctaccacctgctcccaagccaaccaaattacatctatgatattgtagagatggctttctctttttgtttagctcttttttcttttgtttagctctttgcttattaaaaaacaaacaaaacaaacaaaaaaagcagtcacctggattaggtactttttcaatggggtcagctgtactttaagactggattgagatcatatcattctccataggataccaaaaatgcaaatagctacaaacatctatcactgtgaaaaataaccatattttaaatggttaaagctgtgagagcttgaaacaattgttttgtgcttataccattttgaaaatatttttacaaattagaaataaaggcttgcattactttactataaaatatatgtgtaattttcacattatcagatcataaatgtatacgtttttctgtgaaatttgggctgtggtatcttttgactcttctttttatattccacctgggagtgtctaattcctcatttgtgctttaaagagcaacatgtgaaagagaacagcagtgaatttagaaaaacctaagtcagaaacagcatcctgttttaaaagataccttttttcagtctcttccccaatttttggtttatgaatatgtcttttctggacagcttgcctttaaaatgaattagaaacatgggacttacaaagtgtattagtaataataaaattatatgttaaatgctaatttttaactttaatacatgcataaatgtttactacaggctttagagaccgaataataaatttagccaggcataactccagccaagcatttcccaaaaatgtaaatgtaaaaaagaaaaagttctgaaaaaataacccagacaaatgtaccgctttaacataaactatccaaaaatgtccttttaatcttaagaaagtaaaggtaatatcattaaagtgagaaataaaaccagagtgaaagaaaatactttccagaactttaccctacccagatcattttaattacattataccaaggagctgcagtcatagcatcatctttaagtagtattgcctccttcttttgttcactgagaattattgtctaggtgccccaaaagctttagttacactactgggtcttgaggtcggagagaaaaagaagactgaacagggtctccatcttccagaagcccaaattctagagttagaaaaaagccgttaaacaactacgacattggaggtgatgtgctcagttgctcagttgtgtccgactcacctgtcaagtggtctctgcagcgcacatatgccttgggctctagggacttggactccacaagactgttaaatctgtgccttttgactctcctatattgttggtgggaaagtaaattgatgcagccatttacagagaacagtatcccttcagttcagttcagtcactcagtggtgtccgactgtttgcgaccccatgaatcgcagcactccaggcctccctgtccatcaccaactcccagagttcactcagactcacgtccgtcgagtcagtgatgccatccagtcatctcatcctctgtcgtcccgtgctcctcctgcccccaatccctcccagcatcacagtcttttccaatgagtcaacccttcgcatgaggggccaaag

SEQ ID NO: 56576 - DNA, 1912 bp, Bovine  19866880699056
tgttttgtttttttacaaaaaaaaaacattttactgggcagtttagaatgaaagtggggctcaaacactttctggtcaatggaagcccaagagtggctgtgtatctttacccaggaccacagccaagggcgcaccatcagtagcagcaccgagcccatgaaaaacaaaatccctagactcttagtccaagacttttggatacacaaaaatagactctgtcttttaatgatattgtcttcttattttttctttttattcctatttcatagttttgtctgctcaagtcagggtggaatctgaaaagtataaagagtgttgaagagttcttttttttcttcagatactgctaaaacaaagtgaaatgtacggattaactcgatcacactaacaggcctgaaatatcctgtttaccccaggttttgatacaatgggtctttcataattttctagaggtatgtggaaattgtcaagagtgatgccggcctttaaggaggaatgttttttcttagacagataaggatcaggtttgtacttgtggtgccagaaataagaatgaagtttcacttcagagcctgagctatgttgatctacctattctcattacacagagccatttatagccatcaggagccgcagactgacctgtgacaattgctttcctgggaacttaaaaaatgcactagaccttcagctgcagggacaagcaacagcaccttggatgaactggccacgcgaatagcaccaccaagtacctgctggcacaatgccgtatatttttcaaaggaaataaggcaattataaggcttctttcataaagtcagtaaatggtatttgacctaaggtgaaatccctatgtttaattggagtctggaaactcttcatttttttttccctttgccctacttatatttatttttttagagagttcatggcaaaatttttgtatcctaagcaacaaaaacacacttgcttttgacctccttcttttcttgctgttcactttgataataattattccagctcttgaaaagtactgtatttggtcctcagccaaagctgacatttatttatggaaataaaattgtccagcatatgcatccactttaatattcattttgttaaaacttgccatgaagacaattttcctaagatgagacttcatactaacatcctagagatcatgtacattaattttgccaaattcaaaatgagaaactggattttcagatgaaggctttcatagtaagtcagtcttctgttcgtgtaataagatagaagttcttgggttgcacggcattcagcagtcttgttaaacagatctgaaacctgaagcccaagtaaggtatgaacttcaggaagactttggcaaaaagagaccacacctgttccagcttctagtaaaataaatcatggttgtggaaagacctgaccattagcagtaagagaacaccctccagtgcagcttctactattcaaagtgaaaactatgacaccaaattctgttctgcccttcactactatacaagcagttttttgctattatgaaagccacttcttaaatataacacataattgtagtcattttccatctcttattgtcctagcagtgtcaaccaaaatcctttaaaatattcaaagtgcttagatattctgagaccaaatgtcttagaaatgtaaggtattatattgtcatttggggtccagacttcatcagtgtaagtctgtcactcaacttttcagtgtttatgatgacaaattgggatgtaacaacaggatgagaaatagataaatatttttattttagcaatgccattttagcattgttttgatagtgatcaccagtggggttatacagtttgttttcccttcaccctttctttatgagagatggtaacagatgccagaaataatt

SEQ ID NO: 56577 - DNA, 1806 bp, Bovine  19866880775906
aattaagagaaaaatgtgttcttagaattttttttgtagcaaagaatgcaagaagtattttaagtataatatgtctacactagagtctgaaaccacattggaatgatttgatttttattaaaatatacaacttacttgtatatttatgcagggagtcttgaggtgacagtgtttttttgcatcaaagaaagtatacaattgctgcagagactaaactcttacttggctaagagctgttaaatatatttttacacccaccctccaacccttggacacagagcgccctttcacgtgaagagtatgggctgtcttccatttctgctgatgttttttgttccagttaattccgagctatctaagaaacaatctcacagatagaatgatttgtagttggaaagaaaaggcagttgctaaaactgcagaaacggtaaaaggcagacagatcattttaagttaatatacccaagtgggttataaattagaatttagactaattgaaagtttggaatttgattcatattttcacatcaaaagccacaaagatttaaaagcttagggtcaacacagcaatctaaatccaatggagagaactgctctctagaagtaagtttgtcaccatttaaaatgacaaaatagatatgttttcttcaatatccccatccatgttcctgataattcttttcttttagcatttattgaagaatatgtgatgagatattttgttatgagaaaattcatagatatatatggtattgccctgtgtctcttaagagcctctcttgctttggagaagaaatatatactgtacaatatttgtacaatacgtgtacaaaatatacctgtacaagtatttgtgtgtgtcagtatgtcctacaagtagctggaaagattttgagaaggaagagaggccactgttgagagcagaggatatcacaactcttaaagaaaaccaaacaaactagcaaacaaataaacacctgggaattatctagcataaatttgatagcaactatataataaatatctctcaagaatttattaaaaatgtatattatcagatgtcagagtttatgattctctttttctggagaaaaataaaattatctgcattttcatcaaatgtgcttagagattctgatccgagacgatctcacactgaattagagggaggagtatgctctaaaccacaaactgagcaggatacagagagttttactacaagatgttggggaaatacttttttatattcaaacaagcatgaatattttatgggtagactggagactctgcttgcatattttatagctaacatgcccatgtgttctctatttttccagatttcaaaaaagagtgagattttcccttagaattagatggatatatttcaatttttttccaattattccagtgagattttttttttcatgatttcagtttgtagtacttgcttttattgtaccaactttttctgagcttccgattaaaacccatcaagtttgtcaactgtcagtgtctgttatgcctggagctacgatgcatgaccacctgccatcttttctgggttaacactagcttgtctgataatttgcagatggcgaaggcccagcaccaaggcaccgttccaggatacatgtttttttctcgggtgtgatgagggtgatgagacactgccagttaaacaagactgtcccgaccatcaagaaacattctttcattcttcctgtacgctttgacatgcaatcttaattttgtcagagttacagttgcttgtctttaaaaagcaactcttcttgggctagttacaca

SEQ ID NO: 56578 - DNA, 1740 bp, Bovine  19866880857549
ttaaaaaagtatggattacaagtaatattatcaagaagaatagctctctatataaataaaaccattaaaaatattcagatctggatttatacattttgtttcaaaaacaggtatggttttgtgatgtaactgcccgacaaatacatattttaaaaataaatactgtttcttggttaacaaaaaatatgatacatattttacatgaaggccaagattttttaaaaaataaaacttttcacaaagtttttgatatgaaaaaagatgttatttttcagcctttgtaggtttaacattttaaaataatggtgcttatactacagtacacaaagtaaaacatacatactctattataaattactccgaaattaaacaagaaattttcttttctttctaagagatctgaaatgtgcactggctctcaatgtgtgtggcctccaaacagaaacaagcttgcactgttttatttcagttttgcttcatttcttcccaaacaatctctcactgctaatctacagggccttttttcccctctcttctagcataaaggaaacaaaaatcaaagacattattaactccttatgcaccattggaaagctgaatatatatcctttgccctggttttcttttccttacttattaatggagcatgactggagaatatacatttccacaaataattcttgaaaactgcatgaaaattctaaaatttttaatgtgtgtagtcaatctgttagtactttttaagctcttaacaactagccatatagtttcaggtatatatcttatgctaagtttttccctaaactaacacttagtctataataactacttgaaagagcaaaatgggaagatgaattttatttatgtcttagtctaaggtacctgggaatcaagaaaaagtattagaagtttaatatctcaaaggaaagaatatctatatacaatatatgtaaaatatactaaggactcctctcgtggctcagatggtaaaaaatctgcctacaaggtgggagacccagaccagcatcactttgttcacaatagtaagggatcccttgtttcactgtatgctctcattcactagtggagtgaaagatagtgggtgaatcatcttacaaaggtaagcacaattgttaatggaaacacgtgtgacaaaaactgcttctgagaattttaactaatgcattaaaactctcctgctaagatgtatggtgatcagagccatggaattttaaaggctgactagaatcaaatattcattcaagctcccaaaaaaggactgcagagttcagtcttatttgttaaatacaaaagatattaaaataaactttctttataattatcccagaaaagtgctattatactccacagttttctatgtatgaaaagatgcaaaatattcattcagataattattaaaaagcaggaacgatgactatgtacatcaatgcacatgacatcataagtaggcactatttaactacttgggtgtctagtctccaaccaaaaaagatgccaattccattctttaaagagggtaagcatcatggtccttggcaatagaacataacacaccaggccaaggagaatatttggtgtcattactctattgttcagttttctggtttatgagtcattactactgtgcaacatacagtaaatgaggaagcttcatggggttcacagaccctccaggagcaatggaggatgaggtaccactgagcagctgcacagcgacaa

SEQ ID NO: 56579 - DNA, 3493 bp, Bovine  19866880937875
aagtggttattttggatgatgatttacagttaattatatgtgttttatttttttcctattttttgatttttcagtgtttttacaaggatttcctttggagggttaatttttgtgaaataaaattttgtcgtgtttttagaatgcaaaaatttagttataaatatatatgatagtaaaaagggaaaataggggtagcaaagtcagtcaattcatatatcaatttagaggagaaattagcatattttgaagtattctataactgctagaatggacctattttgaagctgagagttcctgatgaacaagtaaacacaaactgacataattggcagcatcagtaacttaaaatcaaatgagatctcaggtaaagacaattaccccttataatggggcataagagatttttgttggcctttacaagaggatactgaattatgttgtcaaatgaagtagacaagaagtctttgttgaatgggcaagatttcaactaaatatttaggtttggatatttgaataggtagagaggacactggatggacacatttctaacagaaaaaatggtgagaacaaagctctaaagtgatgaatgaactcaacttgctccaggtcatttgaaatggcaagagcagggaattcatgttagagggatgtagacaaaggatagtgtgaaaatgtcacatgtgaggttctcagggtgcagataaagatgaggatagaaagagaaagagggagaaggagggcattacattctattggagagaaaatatgtgtcattatcttaaaaaacaattgatcattgttaaaagaaggaaaatactcaaatttcaattttgcatgcttagaaagaaaacacaataacatcatataataatcagtttagttcagtcgctcagtggtgtccgactgtttgcgaccccatgaatcacagcacaccaggcctccctgtccatcaccaactcccagagttcacccaaactcatgtccattgagtcagtgatgacatccagccattttgtcctctgtcgtccccttcttctcctgctcccaatccctcccagcatcagggtcttttccaacgagtcaactcttcaactgaggtggccaaagtattggagtttcagctttagcatcagtccttccaatgaacacccaggactgatctcctataggatggactggttggacctccttgcagtccaagggactctcaagagtcttctccaacatcacagttcaaaagcatcagttcttcggcactcagctttcttcacagtccaactctcacatccatacatgaccactggaaaaaccatagccttgactagatggagctttgttggcaaagtaatgtctctgctttttaatatggtatctaggttggtcataactttccttccaaggagtaagcgtcctttaatttcatgactgcagtcaccatctgcagtgattttggagcccaaaaagataaagtctgacactgtttccactgtttcccccatctatttcccatgaagtgatgggaccatagctactctttattaaccttttaggaactgctggaaatttcctagaccacaaaacttcagaaagctcttcacaattttatttttcccatataaatgatttcttatgagagttacagacactctggtattcctagaaaagtatctggaacaatcagacacgatgcaaaaatctgaggacaaatgtagaattacatttacttgtactgaagttgttatttttatgtgacaaacttcagaatgtacaccatgttatcatcaatggaaatactcataatactgctataattatgatatttcttacaaactaattaccagtgtggactggttatttatttacttaatcatggactttataaaatggggtaaaagctttaatcatcttctaagtttatagtgagacttttctgcaaggagaattttatttctttttctttctttgcttcctacatgtaacttgcactttctattcaaacaatatagtttacttattccttcattttgcccttcaaccattcaagtatgagcaattcaaagaaactttaaaaccaagttttcctgttctgatttacatgacaaatctttatgtttcaggaaaaagtctcatattcagaatcttatatgttctatttagtttctgggatggaggatgtaaggcttgaaaaaattactcctgcctataaatattatattgcaggatatttttctgctcttctgtgaaggtagaaaagtgctgaggataaaatgaaaacctaagttctgacatgacaggctgattgctgtgaagtaagaaaattaaatgacttttcaacaaatatataagaaaacttattatgtatgtggttgctgttcagtcactcagatgtgtacaactctttgcaaccccatggactgcagaacaccaggcttccccattcttcaccatctcccagaaattgctcaaactcatgtccactggagtcagtgatgccatccatccatttcctcctctgttgtccctttctcctcctgccttcaaccttcccccagcatcagagccttttccagtgagtcagctcttctcatcaggtggccaaagtattggagtttcagcttcaacatcaatccttccaatgaatattcaggataggtttcctttaggattgactggattgatctccttgcagtccaagggactctccagaatcttctccaacaccacagttcaaaagcatcaattcttcagccctcagatttctttattgtccagctctcacatccatacatgactactggaaaaaccatagctttgactaaacagacctttgttggcattgtaatgtctctgcattttaatatgctgtcgtggtttttcttccaaggagcaaacttcttttactttcaagcctgaagtcatcatctgcagtgattttggagccccaaaaaataaagtttgtcattgtttccactttttccccatctatttgccatgaagtgataggaccagatgccatgatattagttttttgaatgttgagttttaagccagttttttgaccctcttctttcactttcatcaagaggcactttagttcttcctcactttctgccgtaagagtggtgtcatctgcatctctgaggttattgatatttctccaagcaatcttgattccagcttgtgcttcatccagcccaacttttctcatgatgtactctgcatagaagttaaataagaagggtgacaatatacagtcttgatgtcctcctttcccaatttggaaccagtccgttatgccatatctgattctgttgtttcttgacatgcatataggttttgcaggaggtaggtcaggtagtttggtattcccatctctttaagaattttccacagtttgttttgatccacatagtcaaaggctttagtgtcgtcaatgaagcataagtagatgtttttctggaattctctttctttttccatagatattactaat

SEQ ID NO: 56580 - DNA, 1770 bp, Bovine  19866880956279
atgttctaggttagaaaaaaggcaaatattttatccttatgaaattcagtgtatgattgatctggaagttttccaaactccattgacagagatttatattaaatagctaggaattctgaccatgttgtgtcatatattatttctccagtacttaggaagataaaatctttagctcataaatctagtggaagagattccccaggagtgctctgcattcaacctgttcttcctctttctgttcttcttctttgaatactcccagtgcgatcctgtctactgcatgcacatactcttattctgtgcatcaggcttccagaggctcagcaagcagctgtgctcatggcagcacaggtggaatttccttgagtaacactgatttgtgttagaacaactattttttacccagtattttaaaaaattgaagtatagttgatttatagtgttgtattactatcaagtatacaacaaaagtgattcaattctatacatatatgtatattttttcagattattttcctttatgccagtgtgatttttatttataaagaaattttaggtgcaaaagtacctaacaaataccattgagacagagccagtcaattgtggatagtaattggttggcgatcatgttctgcacagaatttgttaatggaaagatttacatgaacaaataccataaataatttcttaggtctgtcttactgctatgttaataaagttacctaaaagaatatagcataaaactgaaataacgatggtgtgttattttggaatcacaatgttactttgaaagagatgtattctcagtgcaaattcattacagtgtttgcttaatctgttttaaaaacattcaatattttatagcaattcaaaatcaatatgttcttttgctaatcatacttcttaaatgcaagtctggacttttaatctcccacttaaagttcttcagtaggtctcatagtcttcagaataaagtgaaaataaacccttaggcatgctgttaaatggtcttcattacctggttttactctcctcttggcttcatcctcattttacattcccccatcatgctccagccatggtgtagttctgaatacctttgggactcacattcaattcatatgctcatgtacatcctctttaggaaaaaaatacctgtactcgaggaacttctatcctgttagcttctaattattccacaatgctcatctcctttgggaaacactcataactcttgcagtctgtgttgtgccctctcagagttctgttttccttactttggatggcttcagtgttagtaaaatttcttactagtttttatatttcagttgtctccacagtgtttggcccagagtagatacttaaaatatatttttattaaaacaaaaatagaataaaatagatacatgtcatttcatcagccttcatgagtcattttcttactaaaaataaataacatctgatgttattgttctaaccctctatcatttccaccttcaccagctttcaataactggatcttaggtttcaataattcacaaataaagtataagaaacagttgaatttatcacagtctataaataaaaaaaattgtcaaaataataacacaaaaatctttatcaaaagtacagctaattatttaaccttgggattaacagtatttacttggtattatcaatttcacctaatgagatctcctgttattggcacttggtgacttatatgtgagggtgaaaaatgtccagaaagtctcaagagaaggctcttta

SEQ ID NO: 56581 - DNA, 3187 bp, Bovine  19866881084059
tggtgatggtgatcatatttgagtagtatactaggggacatcacatttgtacttctgaattgctattataagtagaatgggataaaaatagccaaaatgatttcaatacttttgttatagtgcaataaatagatacaaatgtttacaataatacataaagggtacaagaaattgtgacacaaatgaaaatagagtaacaattataatcagagaaaatagatttcttaaattcctgtaagaattttgaaacttccctattggggcacaaaggacataaatattatttaaccaggataaacattaagataagtaggaaaattgagattactgcttttaaaatatatattttactaaaacattgatttgaaaagaatatttaacacattttgttgttgttcagttgctaaattgtgtgtgactcttttgtgtgcccatgggctgtagcccaccaggctcctctgtgtatggggatttcccaggcaagaacactggagtggtttcctatttccctcttcaggagatctttcgaacccagggattgaacccgcatctcctgggttggcaggtgggttctttactattgagccattagggagtttgctgctgctgctgctgctaagtcgcttcagtcatgtccgactctatgcaaccccatagacggtagcccaccaggctctgccatccctgggattctccaggcaagaacactggagtgggttgccatttccttctccaatagggagtttcagttcagttcagttcagttcagtcgctcagtcgtgtccgactctttgcgaccccatgaatcacagcacgccaggccattttccaaaaaaaaaaaaaaaaagatgaaaaatgtcatggatgtatttgtaagggacccacctaaaaaaatcaacttttggtgggtatggaaagaaatagaaagaacaatgtcaccttaatgggggagaaaaaaataaaacatcatataaaagcactaactcttaaggcaatacagacactaaagacttaaagtgacaacacgcacgttatttgtgataactatagtgacacttatgaaaaaacatcaagccagagaaagtttttggttcttggttttccttaatctcgtgtttaagaggggaaaaataaataaccaagtctgaaatgcatacataggggcatctctaagtggtacttactggcatgacaatgttgtagtggatgcagaacccgggctccgagggaaaatactcatcagatacaaatctgatcctgatttgatttcctttagaaatctgctttcctggcacactgccagacccacaccagcgccctaaaatggttccatcacttggttcttcaacctctacaaaatcatacctgcaagagaccaggagaaaagagacataaaaccatgacctgttattttaagaattcaagggagtgagttcatctcaaatttaactgtgtaaatagaataaaatatgccaaagatgagacacaactgaaaaagcattctcaattaaagaaagatgagtcttctattctaagccctccattcttgttggtaaggaactccaaattcactaaacagccacgtcaaacttagacattttgtatgtagcaaccatatctgacaatttatgaattattcagtttaatttccatttggatatggcagttttgctctactcttaatttccatgattattgtccaacactttccggcagtaactccttcacctggtcagattccttgctccctatcctcatctgtgtccaagcttttctagagcctcttcattatatacatattctccaaatcccactccgtactacattgcctctgtgagaccttcgtgtgtcctcagctcacagacgtctttctctttctgtcaaacacatattttcaacatttaactacatatatgcacgtgatacatctagttggctaggctgtaaaactcttgaagaaacgattcaattctcttgtggttctagtttacactgcattacacatggcatcttaaacctaagcagtgaatgactaatacttctctaaccactgttaccttgggtttgaaggtttcgatcagtggtactcatggagagcagagttgccttatagaatgttccagaaatgtgtagaggcattttaggttgtctcagtgatggtggatgaggagggcaaggtccctggacacccaacacaggagagtccagaaaacgggtattcactccacaccctccaggcctttcaaacagttcactggacattcacataagcaacattcttgctattgtccatctgagtttgcaacataatactgtctcacatataaaagcaaatatgtttcaaaggtttagtttaaacccaattttctagacattcaactatcaaataagttgaacgaagtgtctatgctttggaaaaagaattactattctagagaatcaaaccactaacaggagcatgacttatactctgcatcatgatgaaaacaattagacatacccatttagtctattaccatagctatcgtatacacaatgagtctgttacttaaaaagatacaaacatctgactacttcatttttgtgcaattaggcatgtgtatctatgtacttaaatgcattattttaatataaattactgctgttatgtcaactttacatagcatgtaggcctttatatctatttttaaacaactgcatatataaatagaggatcactgttatgaactgcatttcagaattcttaggacattgccaaatttttcttaagggaggtctggcgtggatgaaaactattggtagattttttttagaaagtctaaaaccagtatataccagacaacgaaaattaatatattttgcatagtatagaatttacagaagaaaaaaatgttgaaaaaggacaaagtgcataacaaaccaattatacttataaatcctattctaaataattagccagaactctctaatggaaactatacctgttccaacctaatttttcttgtccttaaataggatagtgcaacctgactcacagggatattttgagaaaagggaaatggaacagttcctgagcagtgctgaaagcgttgtgctatacagctgccagttaacagtttgccccacatccctacccagcacatattgcccctactccatacctataaccctgagagttgaaagcata

SEQ ID NO: 56582 - DNA, 1619 bp, Bovine  19866881161073
agagctggattcagagtatgttattgattttctgctccatacattccctcccctgtgatttcatacaggtagccaaggaaagcatatattttcacaggaaggcaaattttagtacttcttataaaaagtctaattattaaaaaagtacaattttttttacatcataagcttgtcaaaaaacagataaattataagttgccattgtgagtccatttgacgtaggagatgacagaagctggttagacatgaaataattgtagcttgaaagtgaggtcaaggttagagaaatgttgatgctgtttgcttggtgggaaataattgtctcaatgaacagggtagggaacagcagaaaagctgataatagaactttggttatggggccatttttatactaaaaaatgaacatcaaatctatacacaacaaaatactaatcaaaagttgtacaagtatttgatgttttagtcaacattcaacattttaggtgacattcaagtcatatgagtgcatttcctccatcatcagatattttattacagggaagaaaagagttggtctaaattatctagatatttattttacccctattatattaatgttgcattcctaaagcctcaatggtatttcacttgtttaagataatatgactatagtttcctttagtaaagggcatgtagacttgacttctagttattaattaaaaattctagtaacccagggtctcagagcttccatgaggacacagctgtacatgagtagccatgtccagggctgatgcttggattgctgggcactcagctgtctatatgctcaaactccatccaagggtcaaatgctaattggtccaaatctgtgttgctcatatacttaggcaaaagctgtttcttaaagatctctatttctataattgcccagttcctaggactgttcttttgccttggttttctggtttgaactctttgctgaggctgcagacctgtcctgatccccaacccccaaacaactcttgtcaatacctgggtgggaaggagcccttggagaaggaaatggcaacccactccattacttttgcctggggaattccatgaacagaagagcacatggggtcccacagtcagacatgactgagggactgagcacacactcatgctgttctccgaaggggccaatggagaagagtgagatatctgcagtgaatgacagaagtgaattcaagtgctccaagtgacagagtgagtgaaaacacaacatagaaaaagaaaaaaagaaaaaaaattggtaaatttgtccctgagtcttgatcccaaacagtcttttctagatcataagagaacaaggcagctttcatcattttgatcctgcatataaaaaacagacatgaaatatttacagtgatgcaagctggctttgaaatcagcaagtcctggctgacaccagccaccaaattggcacagtcattggaaatgatgttcaaagcagctcacaggaggaatgggaaaagcagctttggcttctctgatagaatacagagcagcatttcctttggaatccacattcatgcttgatgctgtaagcatggatggagatatgcagaaagatgaaagtgtcctacattcaaatt

SEQ ID NO: 56583 - DNA, 1573 bp, Bovine  19866881180869
tattactaattatactgaatgtactgagtgattcttgagggaatcatggcttctatggttttgtaattccctatactcatgtagcaataaatacataataccccagggcactcttcacctgccagcttttctacatcagtttcagtctctggatgcccacgggtactatagtagtagcagctttgctcaacatttccatacgaagagcatttgctcttcagaaattctcttaggagaaaggattttttttttttttctcagaagcttcccagcattggccactcctgaaccaatcactagtaaagaggaaaaagcaatcatgattggctcagatctatagtctggtaaagaacaaatactggagaaccaatcactatgtccattacacgatttcacttgatcatcacactcactcacttggttacataggagagacataaaccacacagagaatagtttctcacagagaaagaggaaaaaacatataggcagagagttagcaacagacaagtaaatggggccataaggcatgtatatatgaaaaccaggacacagcaaggttcagagattttccgaggtgggagagtgaagaatgaaccctggtaatccctactactagccatcatttcacaaacttgccataataaaagtggaatattatctatcttttattactgtccatccatatactcctttatgtgatagaggatattaatcttaccaattttcaaaatcattcatcctgacaatttgaagttacacgtttctacaacttgccagggtctccctttcctgtagtcatcttcagatgcttggacttctctccacagtaaaactttaaaatatcttaacttgttagtaagcacaaaaacacagtttgggttgacaaaaaaatctcttgaaatgaaaacaagagtatatcaaatatgttatagacctttttctttattcttatttgtgtcagtacatattttcatgtctttgctgtaagcaactggatacgaatctttaattaactcttcacctttctttatattagaaattcaaagacatttaaaaatttaagtgaaatctaatgtagtttattttcacatacatgaatccagggcattttccctacctaaaaaagcagaaattttttttttttcagcttcaccaatcctaaaacaacattaaagtcatctttaccgattaagtatatatatataagccactttattttctttcaaccaatctgtcaacagttctgatattattacacaaccagattgatttcatggaaatatgatattaatttaagacaataattgagtccattcagggaaagtgatcaaatgactagagaaaataatgtcttagaccaaaagcctttttacaatctgtcctcttttgttcacttgcctaaacttgaactgatgtcatgactaatatgtaaagatatgcatggaatggaccaggctgtatagctggatgatgtaacgttttccagaactaaaggaaaaatccagaaatgtctttccaaagggggaagctcagttttccattaactgcagaatgttcttattttccgtga

SEQ ID NO: 56584 - DNA, 722 bp, Bovine  19866881267963
aaatcctgcccctctgtttgcttttcttcagtgcctttggttcaaataatttttatgctgaagaggtatagattgtggggtgttgtattcttcctcccttcacagctgggaagaaaatcaggctgaacagttctctaccacaaaaattattatgagacttggctggtatttaggactccacacttccaatgcagggggcacggatttgatccctggttgggggactaatcctccatggcatggccaaaaaaataaatagataagttattattaattggttttatgatgtctggttcttgcattacttagaagaaacagacttttgaaggattttacattgagagataataataacagttcttaattgatcctattcaagtgtagtttgtaatccatcaattctatcttccttccttgaatgagaaaacctgtaaatgagtttggacactaatttgcatcctaatatccaattttctgaaataggctcattttctttgaagttttctacattttgcttaggaatgacagtcggctctaagaaggttacaatttcccttgcaatgaaatggaaaaatctcattactagtccccaaaacctgcaactaggtaggatatgagagctgcataaggtcaagagatacaacttaaatctacttaatcttctgcactttggggagatttgactaattggttttcactttatttctccaatgttttggatt

SEQ ID NO: 56585 - DNA, 1858 bp, Bovine  19866881342677
taaaaacagagtggtactcttcatcagaaaggtaatcttaaagcaaatatagggcatgagagaattagccagagagagcagcttcagacagaggaaaccacccaggtgaaaatgccccaaaacaggagcatgcgtcaggattccaaggagaccagggtggctaggatggagagtggtggttgagtcaggagtcaaatggggagacaggtggtgagcctgctgtcaatgctctggttttattctgagtcagatgaggggccactgcagagtatgaaccagaagctatgatgttccatcatcttcctaagatgcaatgaatcaggacctaaaatagtgtcaccgtataagaaatggataccctacagaacttctcatagttataaagatctgaatttttgaattggaaagttttattttaattgggctcttttattgcatttttcagcaaaaagaactttaatagcaacatttcagaatcaaaactcttacttacagaacgaaaaatatggatttaatgggggaaaggcaaggatagattgaaagtaatattagagttaaatttgtttgtcaccagtggctctgtggtaaagaattcacctgccaaagcaggagactcatgtttgatccctaggtaggaaagataccctggaggaggaaatgacaaaccacttcagtattcttgcctgggaaatcccatggacagaggaatctggagggcaaaaaagttggacacgacttagtagctgaacaacaaaaatagttcaaaataaaaatgaatagtttgatcttttaaacaactgaattaaggcagtgatttgaaatactgaatatgtaactaatttgcatttgattttcctctttccatttttatgtcttattaaataatctgatttataaatatattgtcatggtcaacctggattaaatcaccagtaagaaggtcctgacttgctgccacacaggtatttttctggtttgcatggacaccatggcttggacaacagcaaaaataggtatgcagagtataatttggaaaaagcaagcagaatgtggagaatcttctaggaatatagcacatttcccagaatagttgtcttcttttgtcccttaatctttttgtcttcttttgtcccttaatcttttcctcataactcgatggctactctagaattacatgtgctctaagttcacactagattttaaagtacaaatagccctcattttcaacttcacgaggcaaaagtctcaccgcttccattagccttttgtcttggcttacagtgatgctgggtgtgttatggccttcgtggccctgccttccatttaaaatagaggcacatcttgagagtcactaaagggcatgcctgcaggctcacagccctgagacacagcaagcactcggagaaagccttctacttgctcaagtgtcagagaacaattttcattttaggctggagtggcctgctacagtcattgagagtatagcttagatttttgttataaagccgaggggacatgattgcagaggaatatctgaagaatgagagaggggaaagtaaaaacctaaatgattcatacaagagtacccttggaagtggttagatctggtaaccaaactggaaattcctgatgactcagggccactgctcatctattcttgcaaattagtggagagttgaaggcttgtctcatgcaggaaactgggagtagttaagtagtaaagcacagctttgcaagaggaagaataaaaagtgttatgttaggaaactgacatagagcttttagtctccaaagaaaaggtcatctgctttgaaagtgatgttgctacggacgaaactgagacacttgcccagaaaag

SEQ ID NO: 56586 - DNA, 1239 bp, Bovine  19866881351049
ctgcttaaaatatgacattggtgaaagctatgaagaaaacagctattgttcagactggaaatgtctgcagccaagaatagcaatgatttctctggtgccacttctgtcatcaggatttttattcctggcaatttaacattagcatgtggggaatttattgaacaaagaaacattgaattaatgagccaacaaaaatgatcaacatcaaagactccatgtagatggggaaaagtgagcaaaagaaagaacgcgttcaaagatgttagcgagttcatgactatcctaaaggatgtcacctatcaaccttttgaataaacaaagcattagttaacaattggcactgaaattgcctcttccggagatttggatgagatcccggtgaatatatcacccaggcagaatggaggatttcccctaatctctaacactttaaacccaaagccattctgttgaatcttcagagccttctaatacccatttaactaatccatttacaccagttgttgtgattctgcatgtaacatacacaataggccctaccagccctagcagaaaggaaaaggttaaaaatgtataagtgtacattagtctatctgcatggactgtaactctgatattgattgtgctttacagtgaagtaaggacccaaagacatggtacttctcaagattctagcagggacttccctggtgggttcagtggctaagactctgtgctcccaaggcaggggactcggattcagttcctggtcagggaactagattccacatgctacagctaaagatcccacataccacaatgatgattgaagatctgtatgccacaaataagacccagagcaaccaaataaataattaaatattaaaaaaaaattctaacaataagataaaaataggactccaggaaatgggatcttgggccagaatagtacagcaaaagacagacttgttagaaagttttgagtttatactaatatataatacaatataatatgatatgatatgatatgatagtatatatgcatgttttcaagccaggtattatatagtgcacatttgagtgtttagttcatcctacagttgacctgagacactaaaatgtcattctgggaaataaatcatatcttcttaaaattttacagcgggctagttgtcacagtcaaattaagtagagcattgaaagattttgtggtaatagcctgagaggtccaatatatacttgctccaattctgttcttca

SEQ ID NO: 56587 - DNA, 1616 bp, Bovine  19866881369477
cgcctggaaccaaggggattaggcaggatgcccagggcctggtgccatctgagtttccagaaagtgtccaccatctgagctgtagacatgtggcattaagggtttcctcatgagggtggcccgcagagcaagtcctagtataaataccaagtgaaatgacagtaatccttgttgacaagcaaagtgtgtcaatcttacatctggacatcaggagcacagcataaattctcatatctcagaaggggattaatctgcctttccagttcataaagaggtttttagtagatattttggctctcagaaaagctttagcctcaaaaacttaaacaaccagtctcagatagaaaatgcctcagttagaatagatcatgatattttacttctaaacacaattttgtataaaatattcttataaccatcatccaaataaactgtcatccaattttactgaagcaccttcagctccatcaacagcatgtcgataattctgtagtaagatgtgctgtgctatgcttagttgcttagtcgtgtccaactctttgccacctgtggactgtatccccccagactcctctctccatgggattctccaggcaagaatattggagtgggttgccatgctctcatccaggggatcttcccaacccagggatagaacccaggtctcctgcattgcaggcagattctttaccatctgagccaccaggcaagcccttgtagtaggatacgtgagtttaattctggaaagaaaaaaggggatacagagaaacttttcctatccactgctgtctggaacattctcctttggcagttcagtagcttttgcaaatttaacatttccaacatttaaaaatctcctacagggacttccctggtgatccagtgattaagaatctgcttccagtgcaggggacatggatttgatccctggccaagagactaagctcttacatgctgtggggcagctagctaccccttggagctgcaactactgagcctatgagctctggagcctgtgatccacaagagaagctgatcaaccacagcaaagcccagtgcagccaaaataaaaaataataataataattaattacttaattaataaatattaaaaattcctacaaatagtttctttccataatttctgaagttcatgtctccattttctcagtccataaaccttggctcatctctttctattgaatccatatcttcttcatcaattcctttcagctctgactttttcccccactctggttttgcatgtgaatgtagaatcactctcttctaggctaaactcttgcaacttatttggcacctgaagcccggggttatttagatcaaattatgtcactgtttgtccagtatagcccagcggcattctttctcattcagattcaagttccagttctcaccgtgggtcctgggggcccagtgggactttaccactgccttttccatagatatccccctctgttctcctcttcctcagctccccctgctccctccatcccattgcctccacccctagtttccgtggatgacccaggtcccctcaggtttttggccttctcagtcatccagcccctcatccaggtctgcacagactttacctc

SEQ ID NO: 56588 - DNA, 1655 bp, Bovine  19866881374412
acgactgagtgactgaactgaactgaattttcttgtatatatgtatctcacagcttctttatccactcttctgctgatgaagtgtcagtgtagtctatttttagtttcctttattaatttacaaacatcattgttgctgttttacagtttaaaaaattttgctctctgctcattttttgaagtgttttcttgtattatttgaaggatccatttttatttccttacttagacgacctgaggaatgtgtcacccaggttgtgagaagttaaaaatgaatgctattaccagttggcaaggaagcatgggctggaaaactaaccacagattgagtgactttgtttggatgtttccaggcttgtcagctcttacagagggaacagtgagagacattcttctcctggtttcctggtcccctggccagttctccttagggcaataggatgggtaacaactttatccttttcctagaaccatgatcataaagcagacagggatgtttctccatgaaagccacagcttgggatgtcatcacctgagtttccccagggggctgtcctttcagactgcaaagccttgtgatggatgctgctcctcgaagggccccttggaaagagcagcttgtacaagagactgtgtgacctcctgcttctccctgagctgtagcccttggccccaacttcttagaacacataaacactcagatgactagaggaaatttttcttgttttaaataaggattcattagtagtataggaagccatctttatagaatcttttgctggttgttaactttttccatcttcttgaataaaaaagttagacaagcaacactttcatatattgaagtctgcaaaattgcagcattgtgtgcctgatgaaaactaaagaatgttcaatatttcatcttttgtaggtaaaaagagttcctcacatttgaattaactaaagtaaaaaactgtatctgtatgtattagacaaacttttcgactcttatttttcatctggccaagtgaaatctctcaaatcaaggctgccctatttattcacaaaaaatgttatcctgataaattgtgaaaatgaagaggcctatttcttgaaatacattttgtcctacttgtcaatgtggagaatgtaaaatatattgcttcagaaacaacagaaatagcgttaaatttgctgagcttcattcacatgttaacatttgagctttttcgacctccttaaatcttggcacacttcctgcttcctggcttttctcatcttccagatcaattcccatttggagacacaaatttgttaaaagcagcatttaagtgttcataatgaaatcattggaactgtgctaaatgccctctattataaaatctgaaatatattcttccactagtcaaataaagcctcttttgcttttagctattccatcagtaacactgtacctggtttggcatttggagaagccattgtttgtcttggttttcaaatggaaacaattaatcaactgcacatatttttttcttgcaattataccaaccaaatggaataaaggaagaactatttctggaattcttttatttctttgagaaaacaaactcagacaaaaacacaaacaaatacacaaacaaaaccccataatcttccaaggggtgtagacttat

SEQ ID NO: 56589 - DNA, 1189 bp, Bovine  19866881377029
tgtgtgtgatattgagtaattagtcagtcatgacacgttctcacttccctactcaatctccagctgcaaaaattaagatgaaaaactctccacaaatgtaatcgttacaaagtgttgaagcagatttggatgaaagacagtttagaaacaagtcattcagatttattgccatgccagtcgactgcagcaagacacatgtcttgttacagcagtttgtttgcctttattccatgatgatgacacaatgcattgtcaaagtagatacacgttatgcaatacaggaagaatttgatttagcaagtcgcatacattaaaccacccagatatatgatgtcagtcaaaactcattggttgaatgatcaagtgtttcagaagagttctcaagatattcaccatagaattggtcaatatacatctcttcatcttatgctttttgtttctggtaagtttcttctcaaggtggtcaagtccagtagcctctcaatctccagggattccaggagctaagctggaagcaataccagctccctccctcctgcttctgctgaaatgctggcaaatcatgttttcagatcacagctttaagacagaaagcaaggcatatcaaatacggccaatgaattattcatgtacttcctgctttccttgtaatagattttttttccagatatgtatgacatgtacttgttgatctctgaatattctgaaattaagactaccagtctagaaatttggaaggtaaaccctaccatacatactatcattaaaaaaaaatagcatctccattaggatatattaattttattcctgctgctgctgctgctaagtcgcttcagttgtgtccaactctgtgtgaccccatagacggcagcccaccaggctctgccatccctgggattctccaggcaagaactctggagtgggttgccatttccttctctagtgcatgaaagtgaaaagtgaaacgtgaagtcgctcagtcgtgtccaactctagtgcaggttaaatatagaaaaccaggaatacatcttattctctaaattgtagaggggattgtgcctcaaaatttgtctattgtttactattattattaaatagacattttagttataccagaaactaggttatttcatataaatgatattttatttacatctctgctgtggtgtcattggaagggaaaggtaag

SEQ ID NO: 56590 - DNA, 1111 bp, Bovine  19866881398772
tgtgtgcacttgaaatttgggaaaacactagggattatagcccacctggaacaatctaatagcagtttccatggtaaaaagaatgacctaaataacctcgttggtttctactttctgtgatgccccagttgcatggcccaagaaaaatgccacatttcatttcattcacacgctgtgatgcttggtggcattattgttctttgcatatatgtatttatttcaggactatcttatctctcaccataaaatcttgtttcttgccttaatgcagattccggcagcttactaaatttccagtgcatctgagaattttaagaaattcagtgggaggaaatggttatctggtgaagttccgcggcagtttcagcaatggaaatatacctgcatttcacttaattagggttggaagataatgtggctgtgaactctcagatattgagcaatgagttttttctccaaaggttatattattctgcttcaaactagaagtatcattggcaccaagactccttgggtacactttttaacaaataaatctgctgcagaatgacatcagcatcattagaagttcagctggccagtagtagaatgtgctggcatacaacctttccatcaaaactaataataagcttccaaatgatcataaagttcaggcagtggtgcaaggtatgtgtgatgatcacaatccattgcaaagttgaggggacagtcaagggggatcaaatttcagacaggtatacggtcagtcctcctagagacaagagtgaaaggcagccaacaagggtacttctgaatttatacaatgaaaaataatcaacgatggatcagcaggaaaccgaaggtggtgcctcagtaaaaagtcacggttccttacccagttcctggacctgcgccagtcctcagacctggaactggtcactgagggagaaacaagattctcgggagaatagaccctgcatctcagcagcaagggtactcagtggtaattcctagtccttctctgaagtgaattgtgaaaattaactaatgcaagtgtatgatgggaagacagagatgctcagaccttcagagatctttccccaagggtctagattgatatcaccagccagag

SEQ ID NO: 56591 - DNA, 1225 bp, Bovine  19866881450769
attatgagtgtgtatttttagatgtacccagcctcctcttaagaactctgtaccttgttgcattattgtctgtaagtgtatttgatttgagtcagatgggaggggcaggaagcatttaactatctttggatagcaacaacgaaactgccccaatgtgaagctgaagattattcgggttactctccatcatgagcagtgtgctccaggcaggacctaaacctacacctggggttacctgccctccttccttcagttcctagtccccaagtcccttgagacactgttctcctggtacaactgtttgattgacaactacagaaaacagtacagttttgtggtggtttgtctgcaaacactgtgttcttacagtctcaaacagttctacaacatggaggcattttgtttcatttagagatgcttttgtatgcagagatcttttaatacccttttcacaatttgcctccttcctcaaggagaattttgaggtcattttatagtagcaaaacactttttttcttttttgttttgaactgaatgtttattctctgatgatatttcctggctcccaaagcctaaagaaaatcacagggaataaaatagagctctctttctttgatgtctatccaagagcatggaaaaactatcacttcgttcacctaaaatgcccttaatttggtcccttgactgctaagagatgacaattaaagtattcaggccctaaaatggaatcaaaaggtataataaaaaaccacaagaagcactctttaagatttcaccatggttacaaatgtaagattaagtttatgtctgaaaaaaatagtatgataaagaacagatataatttttgatacctaaggccaaaaaactttagcctattattttaagttttctaaatgattgctgattatagttttaattctatgttataaaattaggtatactaaaattttgaacttgcttcagttaaaacttccatttcttttatagaacaaaacattattttcctatttttaatgtttaatttaaataataatcaatatgatacagtagcagtgtatgatcgtgtaggggaagagagattatataatacaagaggtgctctgtgaataagagctctacctccatacataccactcttcccctttctcttgcaacaagcaatttgcttgtggataaaaataatagtttcaggtgattatgtataataatccgttaatcccttatt

SEQ ID NO: 56592 - DNA, 1069 bp, Bovine  19866881497495
tttctaaactcctttgctcttgatgctaccattatgaagtctttttgagactactttgtaaatagaaattttatactgcacatgaaaccacaatgttaatgcaggctgtctaaaattagaatattaaacaccctgtttacaagtagtggctcttagttttatttgaaaagaaatgtacatgtttttactgctttgtgtgccatctatttagaatgcaagaatgctgtctcttcattaaccaagcgacatgaacataagcagcatacttaggagactggaatggtgtacgctgtgtttttaagtctgagcaccattttctcgatgttttgggggcgtttccaagctttagttttgtactgaaactctccaaagtgttcacctttaagaaagcacagaaagttctaaagtacagaaggagagaaaataaggattcctgggacctttgtagccattatgtgtatttattgtactggcagcaagacaagctatcacattcatcagctagacttaatgtggctgcttcttacaacttgttgatgtgatggcacatggcacctgcaggctgcttgagctgctgatcaaaaggcagcctagggatccatctctaatcacggggactgcagaggactggggagagggggtgatcaaagaagtcacagcaccagctgtaccctggcaggaaacggatcagaccaacctttgttctttctcatgtaaaataaatgtcaagctcaaaatattgcctcttactggacagactttcttaaaatgagtatgcatgctattcctggcttctggcttctgttttttacttttcctgccccaggtcccttcttctgctctcacatatcaggcctggcctgacatctcttatgttccctagtccctttaggacttgtacccgtcattgtcctttccttgtcattttgtcgtgtggtccatgtgccaccatcccttttaaccagactccagaactttcacaggatcttaggccacttcctggagtaggtgcacaccctcctgagggatgggttcatgaagtcaggccacacacattctgttgccgtca

SEQ ID NO: 56593 - DNA, 833 bp, Bovine  19866881846460
gatttgataacctcaaaagcctgtcaggagacccctaaagcccagattaaaagagtgtaggccctgcacacactctaatcttatcagcaactccatccttaaaccattgctataatcctcttcaccaaatctgccaggttgggacagacagttttggagggtgccagcccactatgtccccctttgcctgtcaaagtaataaacctattcttttctactttatcccaaactctctttaagatttgattcagcaccagtgcatgaaggccgagttttcaacatcaatttcagaattgaattagatcctggttgtgtatgtgtattgaatctcttgtgccaccttaagtgccctcttgtagggttgctgcaaagcatactggtgtaacaggatattaaggtgaggctttcctcttggaggaggctttggctcaggtcccaaagctgagaacaaagtatgatagagggtgtaatatgggtgatccgaaatagtcttttgtgaatggagagcatgccagctttttagaaacaagaaaatatgtttctgtacccagttgggtgctcaggaagctgcaggaactcaggcttccaaacacagtgacagcatccttgggagtttgtgattcctgggatttgggggtggtcggctggctgctatgattcttccctgggagagtcaaagtctaggattggagttgcttgagaatctgagcaaagcttgcagctgccaggggaggggctggtcctaaagaattcggtgggcaaaagaagtataacatttcccaaagccagaggcagcagcctggaaggcagccagggtgactcatcaggaaaga

SEQ ID NO: 56594 - DNA, 1882 bp, Bovine  19866880376169
ataaataaatctttaaatacacacacacacacacatatagacagaaaaataaaaaagaaaacctcagtgtcctcatgtgtgacatgttgatgacaaatgcagagtggactgcgtgaagtagtatgcgcctaaggcggtgtctggtacacagcagcagtcaataaatgtaagctgaatgagacgtgaggagacaaccgctccccggccacatgaatggataaaaggagaacacagtcttactgataaaaagaacctgggagggggagacaaatgaagcactggtgcatgctgcagtatggataaacctcaaaaaacatacactgaggagaagcaaccagtcacaaaagatcacaaagcttatgaccccattcatatcaaagtcctgaatagggctatttacagaaagtaagttagtggttactgagggaggggagggagggtgctaaggaaggcgggtgatggctgataacggctttctttctggggtgataaaagtgctctgaaattaacatggtaatgattgcatgttctctgtgaatacattaaaaccattcaacggtacactttaaaatgaatgaatgtatgatatgtggattatatctcaagaaaattgttttcgtaaaaaggaacctaagggttaactctgggtttctacctgatggaataaacctacagtggcagataaatgattctccaaaataacctgcagatgatattaaggaacttaagggtcacattaaggaactcctttttctaaccctttcatattaaattctaactcagaaaaataaaatctttaaagttagaaagcaaagttcaagttcagcccttccattttacagatgaaaaaggaaaccttttgctcaaattaacagagttgtcagacttttcttaacctcttcaaaaaaaaaaaaaattctaactctatctataattaacaagagacttaaagatcacagtgttactttcaccaggcaagcactgggatcaacagagcaacagaaaggtattaaagtaaacttggcttctatttcttctgacaggatcccataaatgggaatgaatcatggccttttttctgtcctgttttcactcatttaacttattttactgaggacttactctataatgaaaatacataatgaataagacacgatctctgtcgttacggatattaatgttacggaataataacagctaatatctactaagctcctattatgtgcccagcatcatgttaagaatttcatatgcataattccatttaatcccgacagcaatctcagtacggtgttacctttccctttttacagaggagaaaactggatcagaaagggtaacttgcctgagaacacataacaaaaacacagatctagggcttccctggtgactcagtggaaagaatctgcctgccagtgcaggagacatggatttgatccctgatctgggaagatccctcctgcctcggagcaactagcccgcgccacagctactgaagcctgtgctccagacccaggagccacggccactgaagcccacacaccctagagcctgtgctccgcaacaggagaagccaccgtgatgagaagccggcacagcgcaactagagagcagcccactcaccgcaactagagaagagcccgagcaacagtgaagagccagcccagccaaaatagataaattaaaaaaaaaaaaaaaagacccaaatgtggccctggcatttacgtactacctgcccatgctacctcccgtcaaccactgctcaaaaacaacgcttaaagagaaagtctgcttgctgtgagtctacatctggactataacacactcagagactcaggagccacagataggaacaggggttccaactgctgagataacaagg

SEQ ID NO: 56595 - DNA, 1432 bp, Bovine  19866880576936
tccgtagtagtactatttaattatgaagagagaactcaacggcactacctgggtcatacagactgtgtaaaatggttggtatcattttatacatatatatatatatttcatgctctttttttgtattttattaagctaggtttttattggaaatgatttcttgtggaaaaatgagaatttaaggatattatggacatcctgtaggtagatttcaaaaataaaaaagacttacaggcctccaaaatagttggtgtgatacctgcatcaataggtacctgcaatagatacctgcaacatatcatctataaattttgatgggggcttctttggctttcccagagcttttatactttttcctctggcctgaaacatcagatatatgtggcagactagacttttacatacttctgagagtgattattggttacttaatatttattgagaatttgttttatgtaagtaagttttgaacttgagactttgaggagaaaagggaaatgatagctgaataaggatcaaactgtaaaacagaatgagaaccataaaaatgtgagaactccttttctatgcttggcgtattttttgaagtactcaattttactaatttgaagttaactttaattacctattgcttaaattcattattttccaatatttaaaatgtattctggcaactatatctatacctagaaaaaaattaatatatattagacttaaaatatagatattgttaaacttttagagatgattaaaattttgtctttttcactagaagaatacatgtacaagattacttattacaacatcatttttgatggtaaaggttggaaagaacctgaatatcttttagctggtgactagtaacatgtggtttccatgcagccatgcagccataaagaaagaatgaggttagatggacttagagattaccctacttaagtgaagtaagtcagaaagaaaaagacaattaaaatatgctttcacatatttagaatctaaaatctcagtaagaaatagacttactgagtagagaatagatttattgagattggggagaaaagaattgggagtttggaattagcagatgcaatctattatatataggatggatatacaacacagtcctattgtatagcacagggaattatattcagtaccctgtgataaaccataatggaaatgaatgtaaaaaagaaaaaaaatatatatatatatatgtaactgaatcactttgctgtgcaacataaattaacacaacattgtaaatcaactctgcttcaataaaattagaatgaggaggagtttttgtgtattagaaattagaaagaatgaggagagtgtttgtgtattaagtggaaaaattcctaagatacatttgtaagtataaaagaacaagaaaatgtgtagtattttaccattgtataaaaaagga

SEQ ID NO: 56596 - DNA, 3339 bp, Bovine  19866880664703
tccgattgcacattcccaccacaatgcagcagggtccagtttctccacattcacattctgctgtcttttttttccttttaaagcaggtatgaagaggtatctccttgcgattttgatttttatttccctaatgacttatgatgttgaaagcatatctttccaaatgcttattggcctctatttttgacacaggacacgactgagcgacttcactttcacttttgacacaggacacagagaagtagggaaaatgcttttcactcaaccactggaaaataccctcccaatcacttgccatcaggctgacttataaatctacctgtacttttgctacagaactagcttttccattaataggttactcaatgcatattagagtattcactttacataatactgacaattacaaacatcaacattttacatttacaaaattttacaccttaagtgtttccaagaaaggaaaaattgaagtactcctaataaccaaagtcagaatacttggtttggggatatcagtaacaatcacgctgaagtctacaattcatataaagcctagacaatattgtttctttcaacataacttaaatcctgaactaactaagaagttcaaattctcaagagaaacaccaattcaagtaatcctagaactctgaagtccttatctgtaccaaatgcatcttgtggtaatatctgctcaaagtgttaatttaatttcaggattgtcagttttagtttaaaatttcactttttcttactaggtaagagagttccgtggacagcaaggaaatcaaacctgtcaatcctaaaggaaaccaaccctgaatagtcattggaaggactggtggtgaagctgaagctccaatactctggccacctgatgcaaagaaccgactcattggaaaagaccctggtgctaggaaacactgagggcaggagaagagggcgagaggatgagatggttggatggcatcactcaatggacatgagtttaagcaaactctgagagacagtaaaggacagagaagtctggtgtgctgcagttcacaaggtcgcagagagtcagacacgacttagcgactaaaaaacaacaaaaaaatctaaattatgctaaaactctattaaaagaaattctacaaccaatggaaaagatcgactgtgatatattcatacaatgaagttctgtactgcaataaaaggaatacatgtaacatgaatgaaccccaaaaatactgataaattagaggtttatacaaaacagcactgtgtggttccatttatatgaaattcaaaaacaggcaaaactatctctatctagtgataaaaaaaagaacaggaagatgaacagggactgacagggcaagaataaaaagtaacttcctaggggtgaggtaatgttatatatgtttgtaagtgtgggttacacagtgtgtttgtcaaaactcaaattgcaacattttaagatccatgtgctgaaaaatacacatctctatagaagagtatttgctttacagcagaagccaatatgaatagaaatggttatttcttataatctgcaaagccagtcactgttgtcaattccttctaatcctcaaattttttttgataaattttcctccttcactctcctttctcttgagagtcccttggactgcaaggagatccaaccagtccattctaaaggagataagccctgggtgttctttggaaggactgatgctaaagctgaaactccaatactttggcctcctcatgcaaagagttgactcaatggaaaagactctgatgttgggagggattgggggcaggagaaggggacgacagaggatgagatggctggatggcatcactcactcgatggatgtgttggagtgaactccggtagttggtgatggcaaggggaggcctggcatgctgcaattcatggggtcgcaaagagtgggacacgactgagcgactgaactgaactgaactctcctttcatgtttctgcaatctgatcaaaactccatcattctttcctaatgtggtccctggatgatcttctcccaccacagcttctactaccacctatgggctgaagacacctagatctattaaacttcatattcataaacccagctgcaaccagacaagacatattaccatgaactcaatccggacccttactccccaaccccacacccccaaaaaacttgcactttttcttgccctctttatcctgtggtggtttagtcgctaattggtgtcggactcttgcactgcaaggactgcaggccgcctggctcctctgtggaatttcccaggcaagaatactggagtgggttgccatttcgtcctccaggggatcttcctgacccagggatccaaccagggcctcctatattgcagacagattctttaggtctgagccaccagagaagccccattaacagcatatctattcttagactgaaatcattcttaaacatctcccccttgagcatgctgcagtgtttcacagaatgaggaggaggtaacaatggagcattctttacatcccacctggggcccttactattctatccagttctccaactgcattatctcatcacccctttcctacctactctgaggatgaggaatgaaaatgatggtatctcagacctagtttttagagaacagcttatccagtaacagccacctgccaacgattgctggtcacctgacacacacctcatttaatctgtattacagctgctctagagaaaactgagctcacaatgaattaacttggtcaaggtcataaaatgaaagcagctaaaccaagatctgagcctaaattaagaatctgggactctaaaagcccttcacctctacattctcagctggagactgatccttcaattcgctcaggcaaaatctgaacgaactcgcaatacttatcaaaccattcaaaagcaaccgtcaaccactttacagctgggaaaatgtcagctctttgcacgttaactacgaagactcacccaaacatttgaattaactcattgctgctgctgctgctgctaagtagcttcagtcgtgtccgactctgtgcgaccccagagacggcagcccaccaggctcccccgtccctgggattctccaggcaagaacactggagtgggttgccatttccttctccaatgcgtgaaagtgaaaagtgaaagtgaagtcgctcagtcgtgtccgaccctcagcgaccccatggaatgcagctttccaggctcctccgtccatgggattttccaggcaagagtactggagtggggtgccattgccttctccggaattaactcattaagtctcctaattctgatca

SEQ ID NO: 56597 - DNA, 723 bp, Bovine  19866880714460
tttcagtcaatcatttgcagatgctcctttttttttttctttcctgcttgcattcttcaagcctctgtcctcctggcaattccacaagtaatccagaaaaggaggaacgagcatgcagagaatttgaccacagctgggaagtgagccaagagaactctgaagaacttgagtattagctccttcactttgttaggtggggtggatgtggggctgtgggatgttcctcttatgttgttcttctcatctctaatttggttatacagtgattccctatggcacttacagagtccatgagggcatggactgagtcgccttgttttccccagtatccaggccatacaggatgctcagtaaatagtagtaaattgtgacagagaaagtttgagaaagaattcaggggaaagaaggtacatacatccttagtgtctctgtaaaaaaagaactgtctcaactctgtgggctcgtgagtcgagccaacactgcaggaatttggtggtgttgattgaagagcaggaacctggagctttagccatcagactgtcaaagatggagacacactcccaggcaggcagagcctaacctgggtctagtccagggagaatgtcagtccattctttcttggaagggaaccccaacagtgcctgcaagttcaactgagatggctttccagaaagcattttgaatcaatttcaaatgcattgacagtacttggttgaaacccca

SEQ ID NO: 56598 - DNA, 507 bp, Bovine  19866880726975
aggcgccagcgctgcgccccactggccgagaaagaggctgccagcgccgccgcccctcgcgcctgggggatgctccctccgaggccggggtgccctttcaaggcggcggcgctgttccccccctccccgggggcgtgcgcgccgagaggaagcgagggcgctggatggctccgggtccctggcgctccctctggccgcggctccggcaagggccccaccgccgtccagaagcaagaggcaaagtgagcgggttcggaggcggcagagagccggccccgcgaggcgggggcggggcctcctcgcggttacccctccttgcctcctggctccgctccgctcacctccctccgcgcgccgccctcctcttcccacccgagtccgcacctcgctcaggctgggattccccggcgccccgccctggacctcgggctccccgcctcgtgacgctgtcctccccctccgctctcgcctgcagggccgggaggggtccgcagagcagggatgcgc

SEQ ID NO: 56599 - DNA, 1136 bp, Bovine  19866880752203
tgggtggaatgagaacatgaaattgctgtgtgcactcatgttttgtttatggagcaatcatctctagacgtgttttctttttttatggagaatcttttctatgtttgattttgaattccccaccttcctcccggtccccagctctcccacactcactaaaaagaaacgtagagagtattacgaaaatctccacaaatttaaagaataggttccattcaatgtctctctcaaacaattccatttactcagtcaaaataagtgacttagcattatgaataacacagataacaactgaatttgaatattgcatgttatttcccaagctcataacaactgtcccaaatcataaaaatcacttttcatttctccatcattgtgcaaggaggatctccttagcccagtgaactgcaagtcctgtgatgctaattatcagcagggtttaattgaaggtttattcccctgccacaagattcttcactcaacttcactgtgcctctgtctgtctataaaatgggcattgtatctaacttgtgaggactgcatgcctagaacacaggggtggtggtggtttatttgctcagtcgtgtccgactctttgcaaccccatggctcctctgtccatgggattctccaggcaggaacactggagtgggttgccatttccttctccaagaacacagtaagcactcattaaactgtagcagttatggttgttactgggcagacaggatggagcaagcttttgccagatcctatgaatctttttctctgacacaccccttccccaatcctggcacccagcacacaacaaagggtacctctcagacttagcatggtgataacaatcccagtcagtgccctgtcttcctagcccccctgaagtttctatccatctctagagagacctgccagcagctcccccctacacccccaccctcaagggagtgcgtgtgtttgctgaactctggtgctgtgtttaccatctgggtggatctcatttcattgcctcttctcttgtagtttttggcgtctcggccattgtcctgcctggggcctgccccagtcccgtgctctgtggcccatcactgtgaggtcccttgtttcggcagcaggcttgctgctagaggcagagaacg

SEQ ID NO: 56600 - DNA, 1987 bp, Bovine  19866880805827
catgaggcgcctgaaaggctggttctcctctaaaagggcagggccaaacttcggactctgtcgggtcccattctggcgccacgagccacccccacgacctataagcaacgacctcgggagtcaccttgactcctagagtgccaggcacaacgtccacaccagacaccagctagccaggggagcagctacagaattaggagctccatggctgcagcaagtgggtgagaagacatgaggggccaagaaaaccgaagcgcgggcagaagcctcgcctggctcgggtgccgagactgccaggcgcaccgtgagacccgggccgctacttcccctgtccgaacccgcgccgcacgacccttacctgagggctataggcgtcggaagcccatgctccggccaacttctgcgtgaagccactgaacttataatacatgacgccccgtgtggacttcccgcagccactgcccgcgcgactgccccagagaaggaccccgccttcccgggtgtgggccgaagtctcagcctaaggaccctgcgtcaaaaggcgggctgcccgggaaccgcctaacttaaaacatgccctcttaagccacgtaagggaacaaaaagccgggttctcagggccaaaaaggcaaagcccagctctacggcggaaagccgccgttgcacggtgtgcagaaaatatgagcatccttctttccctcacgtttaaacagagtctggcagtgccaggacgccctaagaattgcgcaagcgcccagcagatctagccggaggctgagggacttgtcagggttgagaggacgggctcggggcggggagtggggcggggcctagggcggcaggggcggggcgggaagagtaccctccttccctccccgagagcccgtgcttccgggcagcctcctggtagttttttgaaagctccacctttaccaatcttaactcctcccctacttaaggtcacctcgtgaagcgtccagctctcactcggttggcccaggagtatgcacccgcagctaggcttctctagcaatctaggagcggtgtggaacaaataagaaaagttggaaacacctcctgcaagctgttggggtttcaccccaataatatcaatgtataaagatagtctcctgagctttatgtagaggaaatacatctacatttcctacgaacttaaggcacagggacataaattttgcacagttctcagaactgatttttactcttgcctaagctttatgggaactgattattcatcctttttgtgggctctgcgcttggagataaatgaggtggggagtgtaggggaggtggcccaaatatttgaaaaatctggagcttgagcctgaaagaacaggactacccctttcagttctggtagtatccttcagttcagttttaaaatgtctttagaatctccactacatacaatgtactgtataaaagaagtatacaattcatagtttcctgcctcctggaataaaacaaagcctgtctttgctttatcatctaaccagaggttttcacaagtgtgttataagtgcatttataatgcattcatgaaagcatgtggcaaactgatgggtgatactaacctgtatatagcattttccataaataaactcattttatctttacaacaatcaaatgttatataggtgctattattgttaggggaagcacactgactgaagccacccaccctggccaggcaccatagtaacaatttgcatgagttgttttaggacaggaagtcctggtaaggaataagccaccaccaactggaagagttcaggaaaggtcaaaaggagacaccgcatgtccgaccacctcccagaatccttctctctggcatccatcttggctgaataaggcgtgcaccaccaggaaggactctgagtcagaatgattggctaaagacagcccggaaactaatcccatcaccataaaacctgagactgcaagccatggtggcagagctgttctc

SEQ ID NO: 56601 - DNA, 1094 bp, Bovine  19866881399051
tattttcctttatttaacaacatgtatatatttactacctgtctacaatgtcctaatcacctttaaaactttattattaactcattaatactcataatgatgcttttgaaataggagcagtgtaatctccatattacacattgggaaactgaggcacagagaggttaaataacttacctgagatcacatggctgggaaaaggaggaccgaaaaagccaggccaggcagtctggctcccaaattcacacatttgacctccctgtccacattcttcacctctctttattctaaaccctgtggcatcacttcaataagaccctgagactcattttgtcacatttcacacccctattgtggatgggaattcagcctttttggaatatacttagggacatataggtgatttaaaagagaacatgatcgggactttgctggtggtccaatgattagaactgtgctcgccaacgcaaggggcacgagttcaatctctggtcagggaactaagatcccacgtactatgtggtggggccaaaaggaaaaaaataagacaaaacgtgtttgctgaatcagtctgactcaaattaccaagagccagcttttctaaggattgtcccgactatacccagccagcatggagaaagcttttcaagtgatgataccagcatttgccttcagaggtcccaggtctgggttctcaactctgccacagtggcccgctgagcaaactcacaatacaggtcagcagacagccttaaaataaacaaacatgtttgtgctgtgcccagttatgaaacagtgcatatccaatttggtagtgcaaaactcatgcaaataatctgctttttccgattcctgctgtgtatgagtctttgacttggccaactcaaattcctaaaatactaaggttcagaaagtctggtcaaagtttactagttaaatatgaaaccctgcctcctctatccatcatcactgcccccatccctaccctcaagccactttagcttttagacatatgtacactaaatgcctttttctttcaagatatgagtgaggtatttcttttggagtatatccagataatcggcaaatccaca

SEQ ID NO: 56602 - DNA, 1705 bp, Bovine  19866881495519
ttggggggcgggttgcggcttggggggaccttgctggaagtggagggtcctagggcaggggtcctggcccaggccgaggcctgccgccccagccagcgtacccaggcacctgcccaccccgagactgggcttcctctccccgcctctgtccctggagacctccaggctgtgtgacctccagcacgtgagcaccagtctggatgcaaacacttggatgcaaataagtgctcgcagcagggcgccttccttctggtgaggttaaggcaaccggcctggagccggaaggccctggagccaaggggatgccaagtgcttgcagcttctcagggcagagacctagaggatggcggaactaggaaaactgacccccttccaactccaccctaactgcactggcgtgtcaatccgcgttcaccccaaaaccaggatgaacagaacccacttccccacacctggaggccttgcctctagacaggccctatatgcagtgcagccaggctgggagaagagaccattagaggaggggggcttcctttgccgttaggggaacagggctcacagttcattgtcaccacaactcctcaaaggacgagatggtgccagtcagcttgctgttgatggactgttaactggttatgtgcctaatgcttttaaagttattattttcccaggcaaattctctagacaaccccctgttttctcagccttcagaccctcacagaaacaaagagccaaattgagttgaatctgagctggttgtcccctaaatgaacacaaacagctttctttagggaagccaatccattccgaactactcccagatattgttgggtaataaacatgaagaggatccctaactgttgtgggttgtttggagtttctggtggctttacaaccttgtgttgactctggtttggcgtctgtggatgagaagtgtccccagaaaagaaggctgtgttctgctttgtctggtgatggcatttgtgattgtcattatcacaaattgaggtgaaaatagttctctggctagctaatggaaagcaagaaataaaatataaagcactttaatcaaaaaatataaagcatctttggctgaattaccttgattgactgtgtaactcaagtttcttcaagtataaaatggggacacactaattgcacctcacaggtggggtaaggaacagttgtgattatatcttaaaatgctttgtaaaccattcagcaaagagcactatgcaaataacaggtgtctgctgctttttttttaaactcaagcaagtttcagattcccaaaggttttacgctgtgagtcaaattgtgatctcacgtcaactcttttgacctagagaaaaaataaagctgttctgttatgcacactgcatagctgttatttatcgtaatccctttactggagattccacagaaaacatattgtgacatcactgacatcactctctccatttctgagctgacacgtaaataggctgcataatttagctggagttaaactataaactggcagcagtgttgggataattcagccctttcctttgccctagaattctctaaaccaggaagattgtctccaagtggaaaggccacctggaaaccataaactgcaagggaacaataggtcgcaagctctattaaaaggttttctcattatttttaaataagtaagcagtttctccccttcaaaatatct

SEQ ID NO: 56603 - DNA, 1422 bp, Bovine  19866880647642
aacaaagagaagatgagccaggcggaggagaggtctgttcatcttcaaaactgtgtaaaaaagagccataaacttagtggctgaataagcactcagggtgcctatgggtcagaagttggtagctagctctctgctcagagtctgacaaagctgcagccgtggagtgggctgagctgggttctcattgggaggcttacccaccgaaagtctatcttcagaattggtgcttttgaattgtggtgctggagaagactctcaagagtctcttggactgcaaggagatcaaaccagtcaatcctaaagaaaatcaacactgaatattcattggaaggactgatgctaaagctgaagcaccagtactttggccatgtgatacgaagagccgacacattggaaaagaccctggtactgagaaagagggaaggaggagaagggggtgacagaggattagatggttggatggcatcaccgactcaatggacatgagtcagagtaaactccaggagatagtgaaggacagagaagcctggcatcctgcagtccatgggattgcagagagtcagacacagctgagcgactgagcaataagctacctcaagttgtcaaagactcagaactaagatgcctttgtcctgtagctgttggctggaaactactctcagcttcttcaggctacttgaagacccttaccatgtgaccctctctctcagtcctcacggtttcaaactctgatttcaggagagccttgtctcttttaatacctcaccctgattaaaccaggcccatccccaggtaatctccccttggagaaactccaagtcaactgattagtgacttctttcttaggactgatattccatcttcttcacagtcctgcccaaattcaagggaaagatatgccaggtgtctgcaccagaagacagggttctgcctcccacgaggattggaggctctctgtgctacatgagggggacaagagcactcttgggaagaactcctggtcaaattgccttagaaagaaaagtcagtgagaggcacaggctccattccagagcctccttgggccagctttgggaatttctccaagttctgggcactgtgtttgagagccaagtgtggaatctgctcctgtgtgactgtatccttcacaaaagaaagagacagaaaactgcgcagggctctgtcatgagtgacaccaactctgacagaatagacttatgaaaaacgatttttatgtaactgaaatggtctggttctggctccaggagatcaaatcctgtcaccaggacttgatttctctccatcactggctctgtcttcctttcgagtgaactcctggaaggtcaaaatttacatcctcccacctcctcttccaatagaaactcaggttatttctttccaacagtttcacagaattaacag

SEQ ID NO: 56604 - DNA, 1650 bp, Bovine  19866880824405
cgcacacacccactggggcaggagatcagagccgggcagccagactcgggccccttagagcctctgggccctggaaccctctgtggccccctcctccttcacatcttgcacttagggctgaaatgctggtgaatggatgacgccaaactcaccaccctcctctctggggatttgcccccaggatggagagaagagttaaaatccaagtcccatcctggctagccattctagtgcctcatctatataatggggacaatattaactccccagcctcagcactgagcaaaggaaccaaagaggcagtgcttggcatgctgtgagcacgctatagaagctactgttgctggaccatgaatgctcagtaaatgtttactaactagatgggtgggtgggcggaggatggatggatggatgggcggaggatggatggatgaatttataagcaagtagacctctagataagtaagtggaggtagatggatgggagagtggatatgcattcattcgctacccatccctgcatccatccatccatgcgttcttccatccaactctcggttgtaggggcagaaagtggatggataggtagacagatagacggatgggtagatgaataaatgcatgggtggatatctggtttggtgggtggatagaggaagggtagatggacattccaatgaacaattagatgaatgaacagatggagagagagatgaatgggcagataacttgctggatgactgggaccacaagcaaacacctaaattgcctccccctggaaggtggagataacaattgcttcagctaatgcctggcaccacagccatgaacaaggccgcaggggccggaacaccgcagcctgaacaatctgctcgttaattggctcacaaagcttttcacctattccaagccaacggggtagcagcgtgacatttaaggtttcctttcagcaatcacttgtgtgcctttcacagaacgcgctgtgcagctgttctctggcttgcattctcctccacaggtgccttcaagcccccagggtgctaataggtccagcttccccagggccaaggtggggggtcccctgaaatgttgggccccccttgccatctcctctatctggagctgtgccaccaatcaccttaatcacccttcagttagggggattaatttataacagggtggcaaggaagtatcagagaaagggtttccttggcaaccaagtttttaaacccaagatcctctgggttttaaaagccgcttggcatctaatttcccccctcaaaattagcttgaaacttttcagatgctgagatttttagcataacagcaggctagcacttatgtcagaaaccacaaaagatagatttctcccctgccagaggcaagaccctggcaagttgttcggtttcctctgccactttgttcttggtggaaaaccaggccattatgaaatgaccacagagatgtcgttttctgaactgcaggcagccaagctcccaacagcaacttgttttttggctcaagttgcttcaaatcctgttgagttctgctgtgagggctgaatggagagaccctcgcccccggcccctctttaggcatggccaaatggtctcgggctgtactcgctgacaacctgggcccatcttccca

SEQ ID NO: 56605 - DNA, 1744 bp, Bovine  19866881012642
agagaggcagaggttaggctgaagaccccacagagaggcaggttttattgtcaagggaccagaactttctgccaggctggtgagcgggcactcagacacctcagtcacctattggtcaccatgttcttacaaggtatataatagaaatagttcaaatggtcagaacttcaaaactgttctcaagtttttcaagcaataaaaaaggttgtttaaaacaatagttattgcctcttatccttttcttttctgttaaccggctagttgggattctgtcgaaaatgaagagacagttctgcaggatgggcggggtgggggggtgctacctctttgccaggggtgtcaccccatggaatattagcccgtccttggtggcaggaaggactctcatttgctcaactctctcccggtcatctccatctgcacacacgcacgccaccagcgaggggtcccaccaatatctaagcagtaaaatcctggtaaacaagagttgtgtctgacaaagacgcttgtgaaaacacagacacacaaagacactaaaaacgatggtttccacggggaagggaatgaaaatgcgaaaagagagaaggggaagaattctgcttctacgtcctaaagcttgagtttgtgttggtttgacagtttttctcattttcaccctttcgcagtgtcctgggagaaacctgggcataccgctctttcgtctctggtcttctggttatgggcctgttacgtgagaaccaatgtaaagacaggggtgaggtcatgcggctagtcctttgggcctttcctacatgccagcaggctgcaccactcagctggtgcagtgtggagccggctgaactgccgaagcatcctgcaagcctgagccacctaactgcctctggcagggctctggcaatgcaggcagggagcaccttggcgagccccttcctatggggaccttcatggttcaaaaaagaagagaaaaaaaaaaaaacacccaaaaactaagattccttcagtaacagttagtcttcatttcgggaagagcaaagcccaccttcctggaacttggggcctggagttaacttttcctatttcatttgcgatccaaaggctgtcctggcccagaggagggctaaacaggtctccttcaggagggaatgtagaccgaggtaattacctatcactagatgaaggcttccactctgcaggaggtcagccctggggagcctctctccagccccagcgtggagcccacgctctgcctgaagtcgaccgggatattccgacatttctcccttaaaagtcttgacacacgtggatagaagtttccatcaaacaagcactgacatatttatattaaaaaatagtgcaaaagctcaacatttatataaataactctaaacccctgctttgtagtttttttttctttacaaggtaatacacacttcctcagttggcactcaaaaattgccattttttttttctcttctagttcagaaaacaactttttttttgtaataggcctcttctaatacaaaaatactcctgccctcgcacatacagtttctcttattttatatatatttatatatataatattgcagatctttaaacaaaggttttgtgcaaatatgtctttaaagttaagtgaaatcatcataaacaaacaaaagaaagtaagcattcacgcacgcagctcaactagaaacagaaaagactagtgtagaagatttttttttctctttgccttcaagacaca

SEQ ID NO: 56606 - DNA, 1096 bp, Bovine  19866881082591
caaaaataaagagttttcataaatgtgcagctgggttccaccaagctattttaaattcacaagcgtagaaattagtctataaaacaagaactgagatgtacgttttcaacatgtggccagttctcatgtggaatttataactctctgagcaatgggagttcctgggacaattaccagtaggacagagatgataataaaaggtttgctgatattgtacccagtcaaataaatgtttcactcacccttcatgcaccccggaaatcggatgttgaatgctttttcaaaatcctcctcggacatccagcggcccagctggctgaggccgtttttggggatgggcaccgtatctctttgctctcgagtgatgatgaccgtcttgctttcaattctggccacatccctggggtcagtgagagccaaccagctgcaaagaaaaaaaaattaaaatacacagattaggggcttccctagtggcgcagtggtaaagaatccaccttgcaatgcaagggacacaggttcgatttctgatccaggaagatcctacatgccatggagcaactaagccctttcaccacaactgttgagcctgagcctgtgtgtaagatcccgggagcctcaactactgacgcccccacgctctagagcccgtgctctgcaacaagagaagccaccacaatgagaagccctggcactgcaaccagagagtagcccctgctttctgcaagcaaagaaaagccatcgcagcaatgaagaacctgcacagcgaaaaataaataagtaaataaaatttttaaatacacaggtggggattagagaagtgctggtattctgcatggcatctgctccctaggttccctcagccatggaccattcaggaagggaccagtgttctcatcatcatgttcttcccacacatggcaggtaccaagggcattaaggatgctgcatcaatgtggacacagccacgtccactgcgaatagtcggagggacactcactagaccaggagttcatgttttaggacagggcgtgtctgaccttcccttgaatcggggacctgtttgcaaagacagtttgcatgtgccccttcattagac

SEQ ID NO: 56607 - DNA, 768 bp, Bovine  19866881399144
ctgcctctgtgttttaccccccccccaaagtggagtgtttatgatttggggggatattagcagtgcatgaagcttgacacttacttatgtgaaactcagagtagcatgtgcgatgctgtcctttcaacatttgtgtcgggaggcattgctgggagccgagaaaagccttagctgatccaagtggagtggattgaattaatgacaactctgagagcaccagttttagggtaattgctttattgttttggagccagggtgcttataatatggttcctgtacaaacatgtttaacgtgtgttaatgcatttgcaaaccagagcctctcagcacaaccctgcttttcattaattgatgtcggtagcatggtacagtatttcaaagagctggccaagtataaactgtgtttccaatttccttcctttcctgtgtttggaatgccaatgttaatttgttcccatgcaggagcaggggctgccaactgcggctttctataaagggcttcacggtgaaggcttccagccctcactgatgcttggggctgcctggccaagtttcctgacactttgcagctaattctgggtgatatatggagtggggggttggggggcttcactgccgtgtagcggaagttcctggtgacagcagagggtgtgacttggcgggagagaacggctcggcatccacactgattctctttagacacggcttaaacccctgtgtctgtttccactatggttgcattttagctgtgtgaccttgagcaagtta

SEQ ID NO: 56608 - DNA, 2153 bp, Bovine  19866881812688
tgtgctgaagctggaatgtggatgtgatggctggagctccgcatctacattggatctcaggtgatgtagtgtagttgtcacaactgaggattaggggagtgctgctggcatctggcagagaaggcaatggcgccccactccagtactcttgcctggaaaatcccatggacggaggagcctggtaggctgcagtccatggggtcacaaagagtccgacacgactgagcaacttcactttcacttttcactttcatgcattggagaaggaaatggcaacccattccagtgttcttgcctggagaatcccaggaaccggggagcccgttgggctgccgtctgtggggtcgcagagtcggacacgactgaaacgacttagcagcagcagcagtagcagctggcatctggtgggtagaagtcaggaatacctctaaacatctataatgtgcaagacagccctcacgataaggaagtacccagagtcagaagtcaatagtgccaaggttgaaaaaccccgagggggacaagtgaaagcataaacacaataaagtgatatgtctataatcagaaaaccccagaatacttggggagcacagaggagaggctcttagcccagtgatgtctatgttgaaaccaaaagaatacacagtattggtgggcaaaaacggaacaaaaagcattcatcaggcagatgggatgctgcatgcaagaccgagagacagaagagggttggtctccttgaaggaacaagaaatgagtcagtgctgctagagcagagagtgcaagggcaatggtgagccatcgaaggttttgaagcaaggaggtgatgcagtcagatttcccttctagagaaacaggtaaggagacccctggggagacagctgtggtcattcagcagtatttaaagatctcaaagtaagatgtggggatcacaaacccacagtctccgacccacttctgtctgttccgctactgctcttgttttgggtctaggcaccgttccgtttttgtgttttgatgtctgtttgatacatctgacaaggcattaggcctcacttccccaagcctcctagcactgatcatggcccctgaggcttcttgattgccctcaggaggcaggtttgcctcctggacgcaggaacacagcctgccccctgccctctgtgcccctctgcagtctggctggtcttgccactaagcccatccctcacgaggccccagcctcaagaacaaaagccccaaaccatttccagtaatgtaatttcatgctcagaagtctttcaccaccctcagagccttttgattccaaaaagagcatgttcttgggaaagacaaaacaaagttcagcatttctgtttagttccagtaagcgctttgaaaagtcccagccctccttttgacaactccgcttcctttgtaagtgctgccaccagacctaattgggtttttttccctcttaaaaatgagtttctgttgctgaaaaacttaagaaaaaaaaactgttaattctctgtccctctctttttctttatcacttctattcttatgtgaccctgctcttgctactttctgaagccgaataactggggttgggaaggacaggagggacaaagagaataccagcttgggtgtgacatggcctgtaaaactgaaagtgggcacactcttggcttaaagggcatttgccctggaaacaagccaagggtccatcaacagatgcctacgcaaaacacggtatatatgtacaaaggaatattactcaggctttgttgttcgatccctaagtcgtgtctgactctttgcgaccccacggactgcagcacgccagtcttccctgtcctttactatctcccgtagtttgctcaaactcatgtccattgagtcagcgatgccatctaaccatctcatcctctgtggcccccttctcctcctgccctcagtttttccagaatcagggtcttttccagtgagttgacttttcgcatcaggtggccaaagtattcagccttaaaaggaatgaaattccttttaaatgaaatttggacttccctgatggtgccagtgccgaggacataggtttgatccctggtccgagaagatctcaagtgccatggagcaacaaaagcccgtgtaccacaactactgaagcccatgtg

SEQ ID NO: 56609 - DNA, 1058 bp, Bovine  19866881822648
ctttgtccccaaaagctgaatctaccatcagatcccccagtggcaagggagccatggacaggatggaatgcaattccattaactgcatagatgtccaatgcagctgaagagctaaaacccaggaataagaagtagtggctggagacctgtgggttgtccggagttttctctcccattctgcctcgtgtctgtacgaatttgggtcccagctttcagtaggttgtcagccctggatgtggatttcaacctctggagaaaacgatgtcattcttcagcaggcaggagcccagcggtcgcagtgactgtccgtctccattccactgccggttacaggtttcgtctatacctctgctgctgctgctaagtcacttcagttgtgtccgactctgtgcgaccccatagatggcagcccactaggcacccccgtccctgggattctctagacaagaacactggagtgggttgccatttccttctccaatgcatgaaagtgaaaagtgaaagtgaagtcgctcagttgtgtccgactcttagcgaccccatggactgcagcccaccaggctcctctgtccatgggattttccaggcaagagtactggagtggggtgccatcaccttctccgtctgtacctctaaggagattcaaatcattacagacgtccttagattcacatgggcgcctgccaggtatctgcagtgcttcatcccgcagtattagagaacattgggcaacatttggcgagcctgtactgtattttgtaataaacattttgaagattgtctcctaaaaaaaaaaagagagagagaaagatgaagatttagaaccataagagaaacaactcaattgaaagggtttaattcaacaagttctactgtttttactcaagataatattaaataataataaccaaagtttacctgtattactttatcagaactttattggtgtgtgtgtgtgtgtattcattttccaagtttgagatgtaggaaccacctctgagccccagtctcatcatctctagagacatgactgagtgattgctctttgtaatactcta

SEQ ID NO: 56610 - DNA, 773 bp, Bovine  19866881922998
aattataacttctgggttccaagtttcagattcatgagcattttgaatgctgtgggcacctgtgaaaaatgcaacgagccacaaacaagcaagcttggattctctgtgagctggcctgtggtggtaaattaaaatttcacatgctgaatacaattatgtaaagtttaaaaataaaataaaatttaaaaaataaataaataaataaaatttcacatgctggagggcacgtcatgtttgcaaaatacctgtatttaaagatgcacgtcaagcacttctgtgtttagaacatttttgcatacattttgaacacgcaaaacacagctgagcaaatgtaatgctttgttttttcctttcaagtgaaaatttcaggtgttgcttctgttaaaatgagtcttcagagcctccatttgcagagagaaagaaagagagagaaattaaatcacattcagtaggcgtccacctataaagtagctcatgtgaattattaatgatagattttggggtggggggaacttcttggactttttttgtcgtacttttaacaattgaatgcgatgctcatcagacgtctccttgtgagatgtcacattatttaaatgagagcacatctgacatttccagaagagcatgctaaattctgaaaagagaatgttcttctcactgatttgatgggcaccacttgggcttttcaaaataaaggttttgagcactttaattttggagtgacttgccttagttcaacacagagatttaaaatactctcaactacttta

SEQ ID NO: 56611 - DNA, 914 bp, Bovine  19866882256360
catctcagctgtgtgacgtgggcagatgacttaacctctctgagacttggtttacttttcggcaaaatggggataatacttcctactgttgagtcttacaaatacgctgtgtcactgcatggcccataggaagtactcgtccatgttgactactattattaatcttgatggcctctccccagtccttggcccactaatgcccatagccaccggtgaccttgaggatttataaagaggagatcagcccttggccatctcccaggcggtctccatgaagtcatctgcagacactgttagtcaatgacctaactctccaaacgaggcccaccccaatgaaatgcctgcctgctcagccaggttttaagaatataaataccaccatcggcaagattcaaaggccagggccgggtaatgactaccccttatgggcccttagtctaaggcatgttccagcttgctaggcggggcctggagcttctcttaggtgaggctgtagcagagagcctcgccttgatggagcatttcacctccacttaaggaataagaagcgcgcgggaactctgatgccggttctctcggccctcaggctctgcagaagtggaacagtcaatgaatggacattggccagaaatgcaaagaaacccataactgaatttagcttatgagagaattggaacagcacacccaccctaaaccatcactggggctgctccttggctgtgagcatcctgggctgtgatatgtattactggagctttttccactcacactgcactcttcaaacatcctgctgcttgtatgagatgctcaccaccacatgacactgaggtcacatccaaatgtccttgcataactgagattctcttgaaatgacatggatcagtccaaggcgtactagaagtcatggaatacag

SEQ ID NO: 56612 - DNA, 2875 bp, Bovine  19866880434026
aaagcatgctgcagtctgcaacaagggctcggcagcctcctgtgagtggaatgtaaaacagtttccaagctggggctgggcctgggtgtacccgtcagaggaggaatttctggtagggaggcccaggatgggtgatcctgggatggaagctgtgcaaggggggctggagtggactagtgagaagtcctcctaaggcaggatccactggatgatccatggtcagtataggcatgccactcagtgaggtcatgtttactactggggggtcccttgatagctccaggaggttctgggaactgttctagtgcttcagaggcaacgagggctccaaatttaatactctgatggggagctaacttcgaaggtgaaaactcaggcctccaataggatgaaagatactaattttgcacagagatttcatagctcccaggctaaaatcattactatagtcctccctccacaactggagtctgaggagcaaaatcagggtttccttgtatttctggtagcccttaagcaaccagcaaggtcttgttgccgtaataccttgatcacagttctttttggcaatagctggccagctccaatcagagctgtgtggacacatcttatatcagtgaccttaatgacacaatcatttatgggaaagaacttcataggaaggaaactcaagctttaatgacaaaggcacagcatgcatgcattatattattcttctatcagaacattaagacctatagaatctgaattctttatatacctccaaaaagacccagaaaaagaaacatagggaatggcacttaaaaaaacagagatacccagattacagaaatgtttcactcttaggaccggtggaaacaagtcccagaagactctgaggtctacttgccacttctaggggctgtaaaggatggagagaagcaaaccactcagccctggacatgtgcttcatccagaataagaataagcccgtgagctctccagcaggttaactaccttgccgtgagggcaggtatagggggttaattaccaatgaggcatgggctggtggctgcacacaatatccttactctgacactaaactctctgggtctttaaaacatgtcagactgagtatctccaggaagacaacaacaaaggtaggaggagtaaagtcactatccagaactaagaaatgccaaatgtctgctgtgtgaggaaggacactctgcttgacttgacctgtttgaatggctgctctctgggtctttatccaatgagaaggtcctcattcgtgccacctgaagcacgtgccccccagggtcatggagcccttcttctgcctcacacatggctcagagggagtggtcagcagttctctcttctcccagggcgtctatggaccttcttctgcaagtttagctagaacttgccaacaagaacctgccatcaagccagtaaaggccttttccaaaatccttggccaagtccttttgtttcgcctttatagtgtactggtttggtaaagggcacgacacttagaggaaatgcacaatcttacttctgaggaaactctcctagtgatgagctcacaggaagtacatttacgctgttagtctgtagaatatttactgggaccatctcttgacccataaacacacaagctctgggaatctgtcacatccccctctctgctgaagcagcctcccatgcccccttcaggagttctcttgacaaaccccctggacatctgcctgccacatccttacctgcagaaggccccaatgttctccactaggtagcactggccgccattgtgacagtagcttgggaagaggtcgcacactgactggcaggagccgttatgtctcacaaagccactgccacacacggtgccattctcgcttggggccaggtccctgcctggctctcctgggcggggcctgagggcaatgctgctgccggggaccatccccagagtatgctgcagagggacagcgtgccaccgactggtgggctggcctgtcccaggccccagaccaggcttctcagtgggcactagaaggtcattttcatcttccaggtctccgcctcccactgcatccttgtcctcctcttcttcctcctcttcatccaagtcatcatagaaggatgtggtagggtagaaatcagattcatcaaagggagtgaagtcatcgtataagtcaagcaggctccaggaaggggtctctcccccgggatcagggtggtgctctgaggtacctggcgacccagggaagctccccaggtcggcgccacggccctcaccatccaatccttcgaagtagtcgatgtcaattatatctgacgctgggtggggctccagtgtgccctgaaaggggtacgtgggtgctggcccgtgagggtcaggtgtgctgcctcccaggttcagccaaacctccgtggggctctccttggggagttcagggcctgggctcggcttgtcgccaggggtggggagggtggttcactggcctccgtagcctcgaaggtggctgcggacgtcgaggacggcccgagggccccgtcgggagtcgggagcgtggctggaagggcctgggtgtcgccgctgcccgcctctgcggtcactccgcccaggcctgggctctcggcctccagccaagctgtgcctgtcaccgccaccgacgcctccagcgcctcctcagccccgaccccagggcccagcaaggcctactcaccgccaggcgcaatccgagaagtctcatctttcccagctgctggtgggccggccttctccctcgtgtcgttagcacgcggctcccacgccgggacgctcttcaccggcgtgtctgcctcgacggcgctgcccgcctcaggcactgtgggagggagggag

SEQ ID NO: 56613 - DNA, 1879 bp, Bovine  19866880468557
caggcaagaatactgcagtgggttgccatttccttctccaggggatcttcccaatccaggaatcgaacccagggtctcctgcattgcaggcagactctttactgactgagctatgaaggaacccctgttttcagactgggatataaccttttatgtataattccatttaagcctcacaacacactaaaggtagttaatcctctattttccatttttatttaacaaatcaggaaaccaatgcttaagggaggttaccaagattacaccgctcactcgtttgactgcaaagtccaagcttttctgcccattatactctccctaggagaaaccattcctggagtcaaaatagagtatatctcattaggcaatcctatcttgttttttcagtaaaactcccattataaaatgatttacagggcttccctggtgtttcagtggtaaagaattcacctgccaatgcaggagacacaggttcaatccctgatccaggaagatcccacatgccttggagcaactaagcccatatgccacaactagtgagcctgtgctttagagcctgggaactgcgactactgagcccacataccaattactgaagcccgtgtgactgacagacacgatctctgtctacaagaaaagaagccaccacaatgacaagcccgcacactgccatgaagaaccaccctcactctccgaaactagagaaaagcctgaccagcagcaaatacccagcacagtcaaaagtaaatacataaaattataaaaatcttaaaatatgtatttaatatagaaaatttataaaatccattcaaaaatctaccatctagagacaaacactgttaataatgaattcttttctaggtacttttcaaagatagtaaaaaagtccagagataggttttttccctcttctataacagtaaatctctttggggtggggtgtgaatgcattaatcctcaagtgaccctcaagtttactgagtagcctcttttctggctgaacccgaacctcaggccctaagccagaatggaaagctgtattttcagatacaagttcctgggaaaatgtggaaaccaaacacggtcattttgctcaagttgggcctctctagtccaccaccgtcagatcaccagtaggaaatcgggaagtaatgaccatctctgacaaacaatcctgggacaaatacagtcaaatagagccttgtaggcaatgggttcaccggaatacctaatagttcttaataaaccgagtttggtagaaatcatgcgctcgctccaaaaaaatcactctgggaagtacctctcagcactcagaaagcaagttttcagtaggacagataatcccaccatacacaaattcagaagaatgacccaggattgacaaggtcaaatatgctttgctcgagtccagtatttcaaacacaccacctctcaccctgcttctgcctgtctgctctccagacacagcagaaacaccgaacatgtgagtctcaaaacatgtgagtttcaaaagacaaagtcaaggtaaagacagctagagctgttgcagggtctttaactccagattgcggaggcttttatcttcccatcaggaactcccaggagtacaaaagcacataccatccgagctggggcggagttctgcctctgtgtgaagacatctttaccctcctccagtccgtgaacatgtaggcagcctcgagatgcaggtcttattggcttcttaaactcaaagacttgctgcaagacagtatgcatgagacatcatccactgtctgtgaaaaccagccctagggtctcagctatagctctggaaggcaggcaagagagcgggtactaatcacctgtctccacacccatgtctcatctaattcaatgg

SEQ ID NO: 56614 - DNA, 5891 bp, Bovine  19866880558423
tacactaaggagcctaaaatacttgctaacttgaaagttgaattattcagtgagcttcacacggttttgatgctaagccagaagcctgtacacgtgattatcaactttatcaacttagtgattctttgtctactgttctgtgactgtggttagaacatgcacttgggggcagggaccaagacttagttcacttggaatctctactgctttgaacactggctagcaccaagtaaataaatatatgacttttaaaatgttgttttagtgatttagcataccattaaggatttctcaagtccttgtgcacatgtcatgctaagacataagttcccaggcatgaactctgcaatcaaagatgtatataacaattgaattaaatagtataagagagagcaccaaatagctgtggattaatagccaagttaaatgatgctgtgaattgctaaagcctagcagttttcaagaaaaacaataattggcctgaggtatattaagtaaatggtaggatttggaggacattggagggataaagacaagaacaaaagtcactgttttaagtattttcatattctttgaagtcattcattgcatcagacttggcaagagctgtcctagtctgctctcactgagtctctttccaggatcttggatccatacttcattcattaactaagaggccagaggtggtactagctgacttcctgaaacttttccaaggatgctcaccctaattgttctaattcatcactctattttcattatgtatatatctctgtcttttgggaagtacctttagcaacagaacattgaaatttaacacatttgtctttcaaagtaggaggctctggttctgaaatagtgtggctgtttctctggtcaaaagactaattcagtaacttttgtttttcttctttttttccctttcttttttttttcttaaagtagtatagttctgttcttctggtctgtttcccaagtaattggtataatattgataagtagtataattttggtgacagactattagaattgtaaaatcatatgtatttcattcagttaatcaatgggagcaaaagaggagcttaccattgttattatcttgggaattatgtacctgttaacaataattacaaataaggatcagttgagatttataggtatttgggtgtatattatacagttcagaagatctctgtttgaatttcttttctcaagtttcaaatattttgtaaatctgttttgcaggaaaaaaaagtcttcacctgagatgatgatcttgggtctttgttaaatatgtgttgatcccagttaagaatgagaaatgttttggaaaaaacttttcctaaatgaatcagtttgtgggttggtgaaaatgtcactatttaaatgtcagtaaatggatttttaaaaaaagaaacagtaacgagggattttctgtttggaattttagccagcttcatgtattgcaggtacccctcccacacaagccaaaccagcgtgcagacccagtgaccgcaggtccgcccggcccacccggcccaggccttccagggtccctcctgagctgctgggaggctcttctccatggaagactcttgatcctgggctgggcccttgccctttgtctgagctgggttgggtttctggttcgtcttcctgtggtgagcctgggaaccagaggaaaactattcatggtgacttccttgaacctcagagggatcttggcagggaggcctgggatatagaaagctcaccaatgatgatgaagaaaaaaaagaagaaaccaaagcagaagaggtattctcaaccccgggctgggggaccttgggatgatgacaatggagatgagactaaaggttattcctttgccactgactcacaaaagtcagctgtgccccccagccagcccaccactgtgggcacagaacatggactagtgtccagagacgacttgaaaggggtatgtgaaactgattccagagaagccaaactggtggctgagagctttgtctcagacagtctaagtattccttcacgtcctttggaagaagccccgaaaactacggtaaattttcagcccaaacagagagttgaggcacaggtgaaaggtaacaagtcagcaccacagggccaggagaagaaattgctgcaagatgagtgcatactgcaggctgcaccccacctccagacgcctgcagatgaaagccagacagtccgctccctcagtctgaaaggacccctgacagaggtttcttcacacaaagtagaaattcctttggaggtcagacccaaagagagttgcactcccatcatgaaccaagaggctgtgggtggagtttcaaaacccagtgcagcaaaagaactgcctgcttccatatccactgtgacagcaggtgatccattaggaaatagtctaaaagaagggaatgatgaaagtaaaatgactgaactgcagaatgacaaacagaaagagttttctgaaggagctgaagaggttaaagaactaaaaaaggaaagtgttcccaagcaaagacatgagaacagcatcttggcttctgagcagctgcaggacacagtgttagctcaggcccctggactagggaatgaaccatttaagaggatggcaggtgatggcaaaagcaggaaggggaagacaagttctgggaaggtgagagcaagttctgggaaggtgagagcaaagtctgagccaccgttccttgcagatagccaggacagcagagctgtctttgtgccaagtgggaggatggctactggggataaaagtgaggagttggggctggattcttcaaagcagccagggactgtggctgtgctcactgaagcaatagtgatgggggaacctaaggagatgatggaccctagggtggcgagcaccttgcaggcattgattcctttgggaaatgggtcaggcatgattcaggcttccagtgctagagcagaaagaggcgctgtagccacagacatgggggtcagcaaccagagcaaggaggaaaagtgtccttggatgggtcatgaggcagctccttggatttttgaaaagcctaaaaaaagaggcagtgaaggcaaaaccaaaaagtataaaaataattattccacacagcctgctagaatggagaggaaggaagaaatccttaacccgcctttcgtaaggaaggatggggttaccgatagtactccccatcaaaacaaggagtcggagcctactgtccctttgtgctcacatacctcagatacacccacagtggaagcagatgaccaaaagggtagaaatgtggaggctaattcttttgaatttggggctcttggcggaaataaaacaaacacaggcagggattctcctattactgaaatggctaccaagatgacagacgtgagttgccaagaccaaatcccgggggcaggatttgttccttcagtcctggctgaggagaataagacagatgtggccaaaggacacactgcagtggctgacaaaccaagtaaaaggagtaatgatggaaaaagcacaaagactaaaaatagtttccctgagaagcacactctggagaataagatagatgcaacaaaaatacatgttcccatggaaaccataggggaccacagaattgaaggaatgggctatgtggacgaaaatagcaatattacatttacctgccccagaactccaccagggttgatgaaaaagtcagtccccctagaggctcaggaaccagcagcctgtgaaaaaccacccacttctacttctcaagtagtaaaggaaagtgattcatttccaggcaccttgacagaaagtaagcaagagacagctccagcccagattcccaaattattagaggtagatagttacaacaaagaaggagtcccaaaggaacaaagacccgagggtccctctgctgttatgccctctatgagcacaggaggagttgcctcaactctgacaacagccatagaaacagttaacaatcattctaactgtcttcaggataaaggtgagcttgctggtgccatgaaaaatgaagcagggagagatggagagcatgtgataggagactctgagtccacgccctgtggtgcctcaaagcactcagtagaggaaaccacagagccagcagggggacaccttctttctggagtgctggcaaacgaacccagcctggcaggtgaggtcagacgcctagaagtatgtgcagataggagtaatttcccaacatgtccagtaaacaaagagtctgagcaaggttctgctccagtttcaattcctcacctactgggagacaaagcacaaaagcccagtttctgtgaggaccaaagtactgaaggtagagattccaagggcccagataatttgaataaggaggtagatatgactctctcgcttccagaaagtgaaaaggataaaaaggataaattggaagaaatcagtctggattctgacatcagagaaatggcgtatgtttccttggcaccaccagaactccagtcagatgtcttagatggcaaaattgaagtgacatcttcaacaatgatagatgagttagtagtaactgcttccgaagctcctcaactcccagaatccaaaggcaagatcttggaggcacctaagaaaatgacagaaaaatctgaatcaaaggctctgggagaagggaagaaggaagataaaagcagagtggccgaacccatgaaaggctacatgagacctaccaagtcccgaggactgactccacttttaccaaaatctaccatccaggagcgagagcgatccaagcaactcaagtccagtggtatgcacctgccgtggggaaatgtgtgtgcttgtggcttttggtcagcatcaaaaaggcaaagagcttgtgctttggtttcattgactctaatcatccttgttaaccgttaatttgttggcatgaagacctgtaactgctaattacatgttttctgcagccaaggcatgccttgtgtccagcttgggaggctggtgacctggttgcatgcctttttacccagcactgaaccttgactttcaggggaagttgaatttcaaacgatgaattgtttagcaggaagcctgtcaccatccacaatattctcaattaaacaacaaaaataatgtacctcctatgtgtacagccaaattttaaccattattttgtataaggattcacaggaggaaagaaaacatttcatgtccagctgtgttggggatttttttttccagtatacgtatgtagcttatgccggtgggattcaatatccaaattgcttttggagtaaatggaaatggaaggccctttatggtagcctccaaccagattggtaggcacagactttatatatttgtgtttctcatactgggaaatgatctctcaatgatggagctgtatctgtttttgttatttttttccctgaaaagtatacatctcatcatggcctttgaagttgttcacagcctacaaacgatgctgtttcttaatcactgtttcctagcttgcatgaggtagctactaactccagaaatgaaaacacgctggttggccttggggtagccagttaggtttttggaggggcttcatcatgggatggtgttctgcatggtatggacttgttattttgggtagagcttgtgctttgcatgaatttgtacccagtaaggaatgtgtgttctgtgagtagagaatgcttaaacattgctatttgcctaagacattctgatcttttccatttttgtatcttctttctattagctaccctattgtcaaggccagaaatgagaatgtatgtaaagtgcttccagctttcattaagattcccagccctctatctggttcattagttgtagcttctagaccctttcttttgtttcagcagtaatt

SEQ ID NO: 56615 - DNA, 1262 bp, Bovine  19866880607914
ctatttcttttgaagtaaaaccactctttatggacacgggtttgagcagactccaagcagacagtggaggacacggaagcctggcgtgctgcagtccatggggtcacaaacagtcggacacgactgagtgactgaacaacaacgacaaaagaggtctttacacagcttgcaggcacgtatgaccgctgaggctaaagcgaatttctcctgctcctccccagaaccaggctggaaatggcaacagacagctcagcaacatcttaactgtcctgagcaataaactccaacccccgctgtggaatatattaattttccacccccaggtgcctccccacgcactaaggacaacagctgtactatgacgaactgatggaatttccaggcttggcgaggttctgttcatcaccaccatttgtcctgttcatcataggattagcaacaggagagcgtccttgattactagaatagctgagggcatcacccagtgacattcctgtatgaaagaacacactgattcatattacttccatgcagtccccacagcaaagaattcctttttgcactgctattttggggagccttgtcctgtaaatataaaacccctgcacacacatgcacacacatattcacataactaagacctcgcagcatgaggctgaaggtaagaaagcctcgcttgcttacttacaggaactatccaggcagcttatattccgtcctgattgaatgcattttgggtctctaaacaagcaccagcaggtgctttacatttctatccaagtaaatttaaatctatttccccaagaagaatctacaccagatacctcccactgttagccacgtgatacagacagcatgatgcctgctgaagactagttatgtgcgccaaaacaagagaggacaatgacacagcacttaccatttctgttgtaaccatcctcaagagcaaatgtttctctcaatttgtctaaaagaagggtgaaccttaacatgattctcaatacctaatgcccccaaatttttgaaaaagagaaagcattttttaaacctttactattcgtcccaattaacttaacctcagcctagcagcacaaaaacatccagagtctccttatacttatccaaaaactatctctaaacatttaagatctctcaaggcttttttaaaaaacaactagttggaaaaaaaaaaacagttcaactaacctaggattcaagttcctcactttaacagatgacaaagaaccagagaaaacaaatcc

SEQ ID NO: 56616 - DNA, 1172 bp, Bovine  19866880611287
cagcagcagctccctccctccccatgaggggcagcagagacccctggcactgatgccccaacagcctgcagtactccaaaagccctccctaactgaggccccagccctgctcatgtaccagagaccaacacctaccaagagcccaggcctggcctggtttggaggctctcagaaattccttattcctggccaatgactacactggaccaatgaaaggagaggaagagcacggggagaatgaattctacccagcaactgaaaaggggagtctctttcctccccaggctctgtggatagatggagttttctcgggtttaggttttcctcctctgcccttgttgagacctctgatgcatcaccatggcttctactcaaatgtgaggaaaatgaagaatggagtgcacagtggcacgtcagccctcatgtcccaagaccgtccgcgtcctgcagatgccctctggtggggtagggtggggagcctgggagccctgggttccttcccaaacctcagctggcctgccagtcgtggggaaaggacaggaggcaacaactccttactcccttcacaaaacttccaggcagcaacagtgggcttcctgctcgcagccccagggctcagcaatggctgctggctctcccagggtcgggccacgggtctcgagggtgcaggggcgggtcagggctcaggccctgaaaggcaggggggcctcaccactttctgcctgagaactgggaaacggggcctgactggactgtgctgcgggcagccagcttcctctcctgccacttgagtgagggacggcagtgagtggtcatgggtgaggggtcatgggtctgagactgccaggctgtagctcagcttactgagtcctcctcctgggccagttccaccagggcctctctgtgcacagtgacagccagcctgccagtagaggggccacctcacaggagagggcagcagcaaggcagggtgtgccctgcacagctgggaggctcagtaatgggctccacgcggcccaagctgcagacccggaggcctcacctggatggcaggcactagggtgaagtagccaatgaggacgatgcccagctctgtggccatgttcttcatgatggaccagctctcgctgctcaggcctgcaagggacaacggggccatacggcaacacata

SEQ ID NO: 56617 - DNA, 1516 bp, Bovine  19866880656663
tttttgaaggctgcaataattctgtgaagaaagtcaccagcaggtcattaactatttactatttgtaactctgtgatgtaatatcaaccacactaaaatgagcatttatactttagaataagtgtctggagctatattccaccttaaaaatctgtgctcctttttcatgaagaaagacttcaaaatgatttctgaataattctgtaattccctttattggtgttgttaaaggaagcagaagtatctacagaacaaatattcaagataatagggtcaaaagcagagatttaagggtttgagttaggccatcatgataaaatgggaatataaaatattttctaagcatgtttgaacttgaagaaggagaacacattattagctcagaaaaaagtaatttcacttgcataatccaaacaataatagcagaaggtagttttaaaaaatcacagcagaagacaacccaccattcttgcacttacctttgttttcttctctgggcttggtggaagctccttgtttggaggggcggtgatgtcatttccagacacgcttccggtaggtggtccttcttctggtttggctactcctaaaggggggaaagttatgctaaacaaatgtttttaacactcattgtgaagacgcaagtctttgcagcgagtgacacaccactaactagcacttcatcctgacaaaatccacagaactctgcagctgaaagtggacaagacttccgccgtttccctcattgtgacgaaggacagttttagattccagcctgtccctgtggagaagcaacctaactatgatttgcacaaatgatcaatggaaggaaatagcccttgaagtttcgtttcccttccctggagactggcaaaggcgttctgtcaccctaccactaactcccagagcaacagggacaaaaaccacttctactggagtttatctcttggaataaagggtgctgagagatgggataagagccagatgattatccaatggtctccctttacttcctttccctgcaaagcaccactttatggaggatgtgagatgaacctgatctggttctagcggtgacccagatttccaacaaggccgaggagacccatgcaatcagatccagggccagaaataaagtctatggcctaaggctatgcccagcagcaccactgtggggagatgattccagatttcaataggctacaccagaaagcatttaaataccacgaaacttgtaacttgggtgtggggagaccgttctaactagcacaatctctagatgccacaaaagataagttggagtatagaagaataaaaaggctcaatgtgccccaaacaacaagaagagtcaaaaggcaaatgataaacaggaaaaaagtattgaactttgcatcaaatacacagagcttattaggtttactcctacagatcgataactgctataaaggccaacaacctactagaaaaaggccaaaagaatatgaacgcaatttacagaaaaagaaatacagatcac

SEQ ID NO: 56618 - DNA, 966 bp, Bovine  19866880682112
aaaaaaaaaaaaaataaacccaattaagatttgcctttcaaccctcaggtgttacctctaagcaggtggccctggtcaccatcagagtactggaaccaaggagaccttgttcctttagtgagtttattccaggcgcttggagtgaaaatgagcttgctcctactggagtttaattccattgcttttgactccagaaagatcccagtgccttttgacaatggccagggttttctgtattttcccgccagtttttcccaaaggaaactcattccaaataccttttccactgaggtctttaaaggaaaatggaattctggttcatactgtggtctcttgcaacctcaggtctttaatgtgatcactttcaaatttaaaagatccaggtggaaatattttaactatgctggtaataattctacagaatacctgaattcttaacactgttgtgtttcagtataagtggtgactttttctttttatgtctttgatctggttttgttcctgtaatacagccacccgattttgtgagggggggaataatacgtggtttttgtacaaaaatgtttctcagtgtgttatttcggaaaagtgaagggagggagttggggagactggaagaaattgatcaagaaggcctaatctccctctttttcagtgaataaatggaacatcatttctggaaaaaaaaaaaaaaaaaagaaaaacaccaatcagtatattaacccatatatatggaatttagaaagatggtaacaataaccctgtatgcgagaccgcaaaagagacagttgtatagaacagtcttttggacgtgggagagggcaagggtgggatgatttgggagaatggcattgaaacatgtatattatcctatgtgaaactatcaccagtccaggttcaatgcatgatacaggatgcttggggctggtgcaatgggatgacctagagggatgggatgggagggag

SEQ ID NO: 56619 - DNA, 1207 bp, Bovine  19866880752919
gctggtcatcttatcattattaggcagggcaataaaaatagctctctgcttttagaaaagcacaacgtgatgcaatgtggcaaaaacaaattgttttctgttcaagagatcagctaccaccatcatgttaacatcactatataaaaattaaaacttctaataatcggtaaaatgttaaatctctatagcaacagctcacctgtctctgtcagggagtaataaatatactacagaattttaagctacttcagttagggatattggatggaataatcataactgatcagttcttagctttagagaactgttttatttaagaaaaacccttccattaagtgaagtttctctctgaagttcagagccacggtatttcctactttactgtataaaacgtcagtgaaagtaaagggaaatcgaagacagaaccaagaggaaacagggatttgtgctcatagttctgtaattatttatccacagtgtgcctctcttcccgagttcaccttgaaactccgagtttcaagatggaaaagaaagcaccttttatcctaggcatctagtataaaaagggactgctcttggcgtcattatcacacgggcattctgctggctgtgctttgttccggatcatccgaagcctgctcctggtggggtcgacaccgacccagctcaaggagcctgctggctcttctactgctggtcctagacgcggactcagtgctggagcacagaagttcccgtcttctgggcaggaaagaagacggcatcaactctatgggagtacttagtaggcattttgtagagtacccttagtggtggtaaatgtcttacctttaacataaagtgaaaaccaaacaagtaaaatgaaaagtcaaaggaacccttttagttatttaacagaaccctttaacattttacctgaaatagaggaaaagatctgatttaaagtgaaaagccactggcacaggatcagagacagtccaacaatttcaaaatgagttaattctgaaggacgcccacagttgagagctaccgaaacaaaaatctacccaattaaaaaaaaaaaaaaacctacccaatatattaaagatgaagttcaccaaaatgaagcaaaaaacaggatttgtacaacttaacactagaaagagagatcaagttctcccttgttgagatggtagacgctttagattccgtttaataaaagcaaagc

SEQ ID NO: 56620 - DNA, 1961 bp, Bovine  19866881260244
acagaggagaaaataaaagttgagaaatcaggagagtaactccgagcaggctagttctgcagttcgctgaggccaaaagcagcctgaagaatgtcatgtctttcagagatttctatcccttgtaacctttttctaaattattttatcattgttactgttactagtaaaatataagaccccattcaattattctgactgactgtattgaaaattgaaaagagctgccagagaggtcctggtttagtccttaacattttacagcaaatagagcaggagtgcccctccacggaacccatgactttctctagacagagctggtagttggaccatttccctgattccaaccttaggttctttacatgatgcttgggcccttcatttgtagcaatggtcattagggttagattttctctaaatcggtgccaacccttaatttctaagaacctccttagctgatttttcatttaagcaatgtccttgtctccgcccacatcctaccctctgaatggccatttctctggagtataagagacagatccgctgtgcctttggcttggcttactctcttgagtaacatggtaggtctgtccatcttgtgttcctgcagacgccagcctgtattgattccttccctttcttggtggtgatagtgtgcccagcctccatggaagaggagctgtgtctgtgccacatgcctgtgtctgtgcctgaggggcttttccctttggcattcagtcagagctctggcatcagcctcctcttgccctctgctcgtcaggcccacaccctccacccgccctttcccatttgtccctgtgctcttacagaattctcatcctccagtccctaatggagctgatccttagtgatcctctgttctgccctcctttgtccagacgagggaatcaagcccagaaaggctcagtgatttgcccaagagcacacgtgagtcgaggggctgcctggagctggagcttaggcttctgacccgattgatttggccaatgcagtctccatctgctgccccatcctgttcagaattcacggggtgcgtcttagcccacagaatagctggattggactaagcatttgtaattttttataatttcgtttactctctggtcaagtattactacattaaatgcatcagtatttaatgcagtgaatccggaggcagacatagtttgtagtgtggtgtatttctagggctgttcatcctcaccggttcaggttggactgaggtggtttgactccctgtttcctgatcccgatcacaaggcaccctacatggccatttcccacgttgtctggaggactttgatcttagagccacatatttcctattagtagctgccaagcccactgctctcgttttctgacatctgcttatatggaagcatcctttggcgtgacttcctggggcagttcctgacctaccgctctcattgccactttcccatttttgacagcctgttgcagaggcaaagattcctgagaagcgggtctctccatccaagccggcttctgccccagctgtcaaacctggctccaagagcacccaggctgttcccaaagccccagcaactgcaactcttgcttcacctgggtcaaccagtaggaacctgtccacacccctgcccaagaggcccactggtgagtactgaatgtccctcccacgggaaccagtggctttaccccagacagctccagacagctgtgtagatagatagaaggacttgtgaaccagtccttcacgggcccattgaaaagtggagcctcaatctccacgtgaggttagcagctatgtgtatccagaataatcctgagtgaagggaactctcatgaattcccaggtagaatgtactgttcctttcttcgtaattccacagcacccagcactttgtgttcatgatctttgtaataagaaaggccatgtggaagccttgtcaagaccgtagaaa

SEQ ID NO: 56621 - DNA, 1372 bp, Bovine  19866881332475
ttcgctcaccgtggggatgtcacctccatcacctgcaccacctcgtgcgtcatcagcagtggcctggacgacctcatcagcatctgggaccgcagcacgggcatcaagctctactccatccagcaggtaggcgtgggggccacggggcctctggctgtcgggaagggctccagaccccgagcccgtcttgtccttgtctccaggacctgggctgtggcgcgagcctgggtgtcatctcagacaacctgctggtgaccggcggccagggctgtgtttccttttgggacctgaactacggggacctgttacagacagtctacctgggcaagaacagcgaggcccagccggcccgccagatcctggtgctggacaacgctgccattgtctgcaactttggcagcgagctcagcctggtgtacgtgccctctgtgctggagaagctggactgagggtgggccgtccccacccctttggctggggcgcttggttggcaacgcatgggacctggacggggggagtgctgagtcttgggaaagctgcttctgactgtcctgtcctgcctcatgactgtaatattaaatctgtttttttaaatgacatcagccaggggccttttgagccacttgtgtcttcccttggacgggctctgccatcactcacaccctcctggtgcctgaagtgcagcactgggttagaccttgctcagctcagagcggctcctgccaggagccacatgaagtcaaagttggggcggggggcaacctggcgccagctctagacactccttgcataagcaggtcggagtggcctcccaggagcagcaacgggcagacaccggccacagaacaggtttgtttattcgatagcaaagagctgaaaaacaggtcccacagaggagcggagcctgacccaagacccgctaccccacaatagtgcaggccaaggcaggcagggctaaaggcagcaggaatgagagacgggcccaggagacggtgtagtgaggaccaggcgggcacgcccggtcaggtcttgttgagcgtccagagcgggtccaggaggctgagggggtcgtcggtgggcctcgcagcccgcagcccctgcccgttgtgggcctgcaggaagtcctgcttgctcatgcgctgcttaccccgcagggagccgtccagggagaaggcctcaggcgtgagggaggccagcagctctaaggaggaggagggcggccccaggctgggggcctcagggaccggctgctcctcctcaggctggggggcctcgggcaagggggaagaaggggggggtggggaagaggaggggagttgggtggactctgggaggctgggaggaggcaggcctggggggctccacagggccg

SEQ ID NO: 56622 - DNA, 1174 bp, Bovine  19866881400018
aaaatgtccgctccaaggtcggctccaccgaaaacatcaagcaccagcctggaggaggccgggtgagtccagggagcttggatccctggcatgctggcccctgcttcatcctctgccacatctaagcactgttccccaggcatgtccttgcataagcccaaggggcccaccatgcaggggacagtcaggacagtgggttcagtgtcagggagtttcagcctgggctccacctcccagcaacaggatgcaagtgggcttagctcaggctttctcttctcctctcctagtctgcatattggggtctgggcttacatttttgtttggaggcaaagggttgtgctttatttacgaaacagagaatgcctctgagccttgcataggtgagagacattgggcaggaacctggtccattttgttccttctccttgcgcaggctaggcagaagatgggctgcctctagttccctgagctgtgtgtcttggctgaagagcctgtctggacgaggactagtgtcctcttatggccagggtgactttcttctatccctggctttcctaaataaaaggactgtggtagagtgtcatggtggagaaccatgctcttcacttgaaggactttctgagtacatccaccctagaattatttaactgctagcaaccatggggcttctgtgtgtgaaaaggtggtggcaagagtccaggttcagtgtctggagcagtgacctcctcatcccctgcatcgttctctaggcttaaaccgctgccaccgcctcccctgactcagagtaggacatttacattgtttcaatccagagctgctgaaaacattgaagggggtccaaaatgagacagaatccttgttctgttggaaggcgtttatggaaaactgggatgagggcctgagggttgcttgtgccgagagagtgtagctggcgtaggcagccaagtgctgcgctgggtcttgatggccttccccacttctgtgctcttatgcgtacgtggtgcaaaacttgctacaggtcttggtggggagttgaataactcagcctggtgatgaaagtattttctgttccaacatacctgagggtgtgacacttcccgtcatcaacactggcttcctgtgaccatggcagcttgacttggagcgtatcagaacatggggcccggggaggggg

SEQ ID NO: 56623 - DNA, 611 bp, Bovine  19866882039139
gtcagcgaacctgggcaggccaaggggcctcacctagtgggtggagcgcgggggccgctgcaggtgtcttctccgaggcccctcacctggcctgttgtccccaggggccccggggcggggcagttcccctgcctcccccgcgtgcagcagcagtgacagggtggcttgccacctgacccacaccgtgccctgtgcacaccagaagcccatcacagccctgaaggccgctgccgggcgcctcgtgactggcagccaggaccacacactgagagtaagtgtcggcaccatctcttgggcacgcggtggcccagcataggggtcgggggagggcatctggggtcagtcagagagaggctggaggtgtcttggatgaactgtggaagggaattcctgaccgaagtgtgatttggaaaaacccagagaagtcagagaaaaatgaaaatgacataatcacacgtatttgtggaatccagaaaaatagtactgctaaacccatttgcagggaaggaatagagacgcagacatagaggacagaactgtggacacaccggggaaggaggtgggatgagctgggagagtggcactggcacccagcgccgtgtgtggagcag

SEQ ID NO: 56624 - DNA, 1713 bp, Bovine  19866880155391
gcttttatttccatattctgggaggtgggtcatagaggatcctgctgtgatgtatgtcagagagtgttttgcctttgttctcctctaggagttttatagtttctggtcttacgttgagatctttcatccattttgagtttatttttgtatatggtgttagaaagtgttctagtttcattcttttacaagtggttgaccagatttcccagcaccacttgttaaagagattgtctttaatccattgtatattcttgcctcctttgtcaaagataaggtgtcaaaatctgatttctttattgctgttgtgcttgtaaagttcttccccagtttcaaggtctggtaaatattcacttacattttcttctacatttttattcttttaattattacttctattaaatctattggaaattgttgggtatgatgtgagaatttaaatggttgtttttgaaggtgcagttaaccaattacccaagcactatttacaggatattcatttcctcttcttatgaattaatggcatcatttttcaatcacagagtagattaggagagagtccttgggtccgtttttttggcttttgctctctgccactcacacatatgtctatgggttctcgtactgctcaaatctatacggtcaagaggtggaaggaactcagagttggggtgagattatcatcagtatctcggcacattaagtacatactgtctcagcccttttgaagaccagggttcaaaagctctgaaagttcaggagggaaatgggggatcaatccagacctctcggaggggcagaagtctttgagcagaggaagggcacttatgaagatgaatgtcctaagctagcatttgttgtaaaagcagaagaaagacacataaatacagtcttgattagaagagaaacccttggcttttcccccgtatctgaagtacccaagatgctcctgcaagaccagagtccggcagagccgtgtgaccgacgcatgcgcaggaagtaactgcgcagtttggaacgttggtctccagcctttcacctgcggcagaatctgtgatatttaccaattttcctttgaataacaagtttagtgtagattgtcaagtttctgggggggatcaacgcaaaattatacccccctcaagtctatcagttatgttttgtggaacttccttttcccactgggtagctggctccattagctatgtgtattatcagtctgattctaaaacatttcatcatttgagttatcaaaacagattctcttcagttattaagattaagctctgctcaatttaaaatttcaatcttatatttgatccgaagctttcctcgttgcctctaatgcaaacaaggccctaagctttagacgatctggggggaggggaggggagggtagacttggtcttctctttctctctcctctccctccctatgcttatgcttctggttgtggaggaagaagaagaaaagccaaaggtgaatatgcctctttgtgattgctggtggcaggtccgttgctccctgtggctgaccaagtgctcctgagtctgctctgggacagtgccaggcagcttcaggtggtccaagaaggaccgtgtggcttccttttccagtcaagccctatgtgactccttgtgcagcatttctccaatgcacaggtctctctgcccaacacgtggccatcttcctgcaagtctacacccccaaactcca

SEQ ID NO: 56625 - DNA, 1242 bp, Bovine  19866880354106
caggagtcttgagttgaatacaatgtgatataatatagttccaaatcagaggggtcagaaaggaagcaagataagaacagtaaccccgttcctgcctgcccaggtcccatgcatccctgaacagccgcctccctatgtgtggttacctgtcagaaagtcaacttaggtttctgtctgttttgtttaatcctgtttcccagtacttggcacattaatggtactcagtatctattgaatggatgactaaaggagtgaataaatctcacatggctaaccatcttagctttctagacagccgcatggcagtttatatcctgtcgtatatcctgtggaaatggcaatgacagaaagacacaaatgctgtaatgctggtttagaagaaagcttttagaactaactgcattattactctgtttactgaaataaaaatgcccagtgtgagagctgtgagtctcatttggggacttccagggaactgcagctgaggagacaacctctcagatagctctgaggaactgctcggtgcatatgtgggtggtcactataaatgtgatttcggtgaagggctacataaagcacgtatcttgttacaaggttgttgataggaggaggaacagacatcttagtttatggttttagtacttttctaagtatgggaaggtgaaagaatccaggtttataaaaagtttctcctgaaaatacctaacggtttaaaggtctcttctttcagttttcccagagcacagagtgcttcgttgctgatctctgccctgaactcctttcagggtgtgttaaaggtcagccactgcagtggctagtgacttgatccttgtagagctgatggcgggtggaagacttttttttttttttttaaataagcactaccaaaatattgataggctttcagtcagctcactcactcagttgtgtctgactctttacacttgttctgaatcttagatctaagaattatctgcatctgaaaggaaatggattgattgattagactgtgaaataaggtaaagaattttacattttatttattgctacagttgtagaacttgctggaacctctcaggggatttttagatgattgtatgattgtaagaagaaataatatttgttaggctttacctatattccagagtctcttctaagtgctttatgtgtattaacatttattcctcacaacaacctcatgaagtaggtactattattattcccattttacagataaagaaa

SEQ ID NO: 56626 - DNA, 760 bp, Bovine  19866880358249
accccattgactatagcctaccaggctcctccatccatgggattttccaggcaagagtactggaatggggtgccattgccttctccaataatacaacctagatgattttaactttctttttctgattaaaaaaatgtgattaattagaagtaggttatttgaagtttttctgatgtttaggtgtggtttaataatcttgcacaatgtcattcatctccttcagcaaggcatcctgttaaaagtggctgaaaccatcaagagttggattttggctcagtccaataagaatgatgacttacttcacaagttggtaagtgttcactttactttttggtcacttttcaggactccagtttcttttccaatgagaaaaatcaatgaatccaaatttgttttgccattgatttgggcagtgactaattttaattagaaattctgggctgttctctaaaaggagagtatccacttcgtgaagtgttaaaaaagtttgtatcacctaaggaaaaagaaaaaggagattcttcagtaactgggtatctttgcatatggactcagtagtatttcatagatcttctaagaggttgttagctactgagaataatatattctgatagttattgaagacctatttgttacattattcatgtcctgctgccatcttcctccaatgacaggtattcctctcagtgagttagaaaatagatccattagtgggatcttccctcttttcattaggaacttattatctctattccacagc

SEQ ID NO: 56627 - DNA, 1632 bp, Bovine  19866880417942
taaagccaagataaccttccaaccattaaatcaaggccaattctagaaagaaaaatgttttaatttccccaatttatctgtccaaaacaaatttttgaaggatgaccccggggatattctcactgcctattcctatagcccccataaaattttttcttgtaaagtacaaataaagcatttctgattttttcatgtaaattaactttggtaaaatgttccataaagactagtttccatgatacatttgtggactatatcaaattacagccacaattatttaaatgtgacttttctctgagtcaattctactaagccaaattttgtaggaataaattttatcatacgcagctttgatcagtgttagatttttttttttggctgcaccacacagcatgtgggatcttagttcctggaagggatggaacccacgtgaccaacctgtagtggaagctcagagtcttaaccactggaccaccagggaagtccctggccagggttagatttatcttgtgttcattatttctgccagtagcacacatatctatttgataactgtatatattttcataagaaacccatggaaatttatattcgccagtaaagttatgagcaactaccctcaggtagtccaggactgctatgctatgcactgctaactaagagttcttaagcactttcaatcacttgcatatgatctgctaacagtcctcagggtgggaggagcaaagataaacagagggatcaaaacagcagagtcttaatgaagggtctcaatgtctcattggtcagcctatatagctgtagtttgaatattatctgaatgacaaatcaaatgccagatgttattttctaatattctacatgtattgtttctagtattctacatgtattgtttccatcataaatatatttaaggaagcaaaaaagaaattacagatgtaccttctccaaatggttaaagtgtaaaaagttaaaaaccaaaaattaaataattttaaccttcttaaaatgaggctgagagctagctaactgaggcattatataattaattctgttctttgtagttaacttggtaaaagcagaaaatctgggtcttagatactgatttacactaaagcagtagtagctaggcattgaataaaaccagtggattccacacatgatgaacaccaatacttaagaatacccccaccaaccatgtctaacagtgtctaaacgaaacaaatcatgtccaaatgtcctaaaagctaacttttataatcttaaacacattaattgatattgtgagtactatataaacaggatgttttagtgagctgttattttatgttttagctggtgtttcgaatcctatttggggtatctctgagtttaaaagcacaacaaatatattttgatttctgaaaggacaattaaaatggtcacacaacataaaaattatgaaatgtatatatatatagaaataccctgaaagctacatgtgaatcgctgagaagtggcccctctttttcgatgtaatttatgcttgagtctccagcaattaggtgtacgtttccttccatgccctctcctgagctctgacaggctgtgctttctccaggattcaaagctttgcaagagtgtcaaatgccc

SEQ ID NO: 56628 - DNA, 1029 bp, Bovine  19866880431613
tttttaaagtcagccatgggcactatataaaatccccaacattatggaaatatcttacattaaggaaacaaaaaagatgtttgtttgtgttagatagtccatttataaacctgtgtttctcattagcactgatagcatgtaccatactaactgattcttgcaactgtctcacttgcaagcctgaattctctgaggggaaggggccatatgttttcatttttgtgccccagcactcaatgtggtacatagtgcatctcagtaaaagtttgtcacctgaaaggattggttgaggggagggtgtaaggtaagcctcagaaaacatgccaagttacttagtgtttttgcttcagttcagttcagtcgctcagtcatgtctgactccttgcaaccccatggactgcagcactccatgcctccctgtccattgccaactcccggagtttactcaaaatcatgtccactgaatcagtgatgccatccaaccatctcatcctctgttgtccccttctcctcctgccttcaatctttcccagcatcggggtcttttcagatgagtcagttctttgcatcaggtggccaaagtattggagtttcagcttcagtatcagtccttccaatgaatattcaggactgatttcctttaggatggactgctttttgcttagccttctttaataaggatggctttgaatgggttcctcccatagtactaggcccttaacagaatctttaattctgatgtaactcacccttttctagaagatttggtttcatagccctcaggacctattgagttctttaacaaagcaaatgcagaagcctgggaagcagttattagcggagggagattggtttaccactgtgatttgttgctatgtgtgtttattagccactggctctgtgattgtgaagtcagtattccctacactctgctgaaccaggcaatctggtgaaataagaagtgaggccaggccttgttcaagttccagaatctaattgcaaccacaataatagctaccatatattgga

SEQ ID NO: 56629 - DNA, 1220 bp, Bovine  19866880463592
cagtataaatgggaatgaagctggataaatttataaacatcatgttgggaaaaaatagccagttacaaaaggaggtgccatttatataaatatttaatccaccaaccagtattataaattgctgacggattctttttttgtttgtttggttggttttaattttccagaaggagaactgggcctctgacagtccttacggatcctccccatgtgtaaaaccattaaaagaatgaaacacaacaaattcaggttacggaaacctctgagaaggtagaaagggagaagatgtcaaggtactgtgtctggaaccacttatttcttaataaaaaaaaaaaaaaaatctggtacaagcatggcaaaatattaacatctgttaaatctacgtggtaggtctatgagtgccacactttaaaaaaatgtcttttccatatctgaagtatttagtaaccaaaaataaatttactatttatccagaactatttggttaatgatttgatatgggttttcctcatgtgcagaacattctcccctccgtgaatttggtttaattttaaaaaatggtgtaagttgctgtttctgatgggccatttcgttaccttatcattttggaatctgatgtcactgcatttacttccataggacattaactgcaaccttaaattaaaatcaacaaccacagtaagcttaagaaaattaaaatccactgagggtttaataagctagctgccctagaaaaacatccagcctcattttaacttactgtttaaataaactaaggaacaattatccaatggtaaagaacccacttgccaacgctggagatgtaagagatgtgggttcaatccctgggtcaggaagatctcttggaagagggcgcagcaaccactcttggtattcttgcctggagaatcccatggacagaggagcctggagggctacatacagtccataggatcacaaagagtgggacacgactgaaacaacttagcacagaccagcacagggaactagctcccacacgccgccactaagagtttgcatgtcacaactaaagaccctgcatgctgcacctgagacccagggcagccaaaagggggggaatcatgtaccaactaagcaactgtgatttctgaaatgtccaaagtatcagaaaacataaagtaatctttgtgtgcagatttaatctttctctcaactgtatacgtattattcttagtaaa

SEQ ID NO: 56630 - DNA, 734 bp, Bovine  19866880469425
ccttccttatagtgagtcccttttaaatttttggagaaatctgttacactttgataaacctatcattttcacaaaccattaacaaactgaacatactctgggaaaagctccagtacaagttttgtaatgaagctatgggaaagataaaaaagatgaaggaaaacaagctgggcccttaaacttatctcactggtacttgtgaatatatacgaataaatatgggtatgtatttctgggcatgaaggaacaatggccagaactaaaacagcgcaaacctgagtactaaaatcaggcttggagaaatgtctgctcaactatgcagagcatttcatcagggttcaccagagcttttccacctcagtaatctattactctgtattcctagaatgagaacagggctcaacaggtagattagtaatctaatgttacatgttattaaggatcacaacgaatttttaagcaatacctttgataaaactggtttcacattcagaaaaatttccacatgttcagtttactttcaaaaaattgaaactgcctttcataattctttgaaatatgcattttatgtcactgcaagatcacattaaactgcagtgaaataaaaaacctttaggtgaataaaaagctctgggggaaaatcagttaaatttcataggctacaaatatgaaccataaaaacaacatgctcctttatttttactttttactgtcagtagaagaaatgcagcagt

SEQ ID NO: 56631 - DNA, 1009 bp, Bovine  19866880481915
taaagtgcagaattgaagtttctttttcgtagggaagagtgacgatagtctgtcttgagtctgtttctatgccatgagtaaagttgattgttgaagtatttagagtacctcctgtgtgccaagtactatggtaaggtgaaaaaggaagagagaaaacaggttttcttctccaagagtttatttaaattataaatctacagatggtactctttattaacgttagtagatactcgctcatttccgtgttcctttttaagggcaccctgaaatggcgtgtgagagcccacgctgtactgtggcacctgtgctgcagcctcctctacacatcgcagacaaagatccaatccctgaggagcaggtaaggatgaaaacggcttttcttccctctaaagagtttaatgtacaaaccttacctccctttctctgtaattgacatggataattgttgaattagaattttccagggttcgatcccaatttgggaagatcccctgaaggagggcatggcaccccattttgagggcttctcaggtggtgctagtggtaaagaacctgcctacaaagtctggagatgtaagagacaacaggttcaatccctaggtcaggaagatcccctgagaaggaaatggcaacccactccagtattcttgcctagaaaatcccatggacagaggagcctggcaggctacagtccatagggtcacaaagagtctgacacaactgaagcaacttagcacagaacagttgttgaataattgtgaacagttgttgaatttatatttctaatcttcaaagatcacaacacagtgtattgaatttatatcatatctaactaatttatatcatatcatataactaagaacattagttcttagtgtcttgaattttaatccattgaatctaccagaagattttcctgtttatatctaattgtccatttcttaaatactcgaaagtgatgaaatgcattaaaaattagtacattggtaaaggtccttctgggatgcta

SEQ ID NO: 56632 - DNA, 854 bp, Bovine  19866880583809
cacactgttttagaataggatgctaagaacccatgtaagcctctcttcaacaagtgcccacattcgtgtccatagaaaacagtgcccacaatgtccataagttcatgggttccctaaagcccatgttctgtgggctgagcccttgttcaaggcagagaaatgaattctgcagaaaagttcaaagatttacacacctcgcagttctgggtggttatgagaataaaacctgtgtcagcaagaattcgagagcctgggaacaggttataaatcctgaggtctcaccagacattgttgccttggcaatttaagtcatcggatgactgaagactcttggcccaagagccacctggcatgaacactgcactctgataaatcaggtgccgggagaagctgatggtaccagctgtcaaactccagccactagcagcaacagacacttcagggtataaatagtttctgaagacactcatggcttgatggagcccacaaactggaaaagcatttgctaaacagaatgtaagcggccacaaggaaccagagcgggagcagaaacaagagtgtgtcgaaccatctggctttggcctctcctaatctcagaaaagctttagaaactgcgaggcatcaccatgggtgtaagaagtgcgtgtggctcacaccgagaagggtgagagacagcagcctggccaccaggcatggtgaaacccatccctctgcagaaaaatccctgggcctgtgccacaagccaaaataagcaattaaaacatgaaagcaatctcgtgggccacgctgcatttttcagcatggcaccgcatgggcaaagcctcagagaccacttgggaatggactgagatgag

SEQ ID NO: 56633 - DNA, 1279 bp, Bovine  19866880676863
tataaataagagtccaaaatgaatcgggaaggatgggacatggacctcacagaagagatcttgaaagagtggtagaattggggtaagacagagactttcgaaatggtgtatccactgggaataagtattaaggttaaaaaaaaaaagtacaaaaatgtgttcagtgtactatggcatcaggatctgtctggtgggtggttggtagaaaggaggaacacattgaagagttcaaatgggaaaaaacactcagattaagtaccaagaggaggaagaacctaatttctttattaaaggaagaaccactgtacatcttgggtatcttgttataacgtgatgaaagtggaagcttagaaaattagcgtgatgactctctatggactggatagaaaaagtaaaattttgaaagcggtaaaaccgattagaccattgccctttgtgtagggtaaggtagggaatgggattggattcaggaagacagacccagaaatagcaagaaagtgtcaatctagagagaaattgctgcacaaagaaataacaatttggtggcaatttgaataagggttgaaggagagaaaacctacacaaaattagagaatgttgtcattgatagataaggtcatagaattaactgtaacctggctgaaaaaaaaaattccacacttcatctataaagacaggcttccatgacataatactctcaagaagtaatttgggaggctctttagaaaaagtagcaaattatcatcattagataagctcatctaatacaatttcctcttgtttggcttaaagacttagagatgggaaatgttagatgtctgtctttaggtcttaatttagagttctggttttaccgaaaatagcaacatagaaaagtaatgaatttatttaaaaattaaggaccagatattgagctttaaaattttaatcttttaagataccgtaactttttaaaagttagattaaatcactcatatactaggtcatctgcttttgatgggcattttttaaaaatttatttatttttaattgaaggataattgctttacatattgtattggtttctgccgtatagcaacatggattagccatcagtcagttcagttaagttcagtcgcttagtcgtgtccaactttttgcgaccccatgaatcgcagcacgccaggcctccctttccatcaccaactcccggagttcactcagactcacgtctatcaggtcggtgatgccatccagccatctcatccttctgtcgtccccttctcctcctgccccggat

SEQ ID NO: 56634 - DNA, 1735 bp, Bovine  19866880726497
ttaactaaatcaaagtgagagaacagagggtcaggcttgggattccccagagtttcctttcctgctgtaattggggccgtgtttattcattcactcgtttatatatgcatgcatgcatttcttcccctgcctcatgccacagaggacctgtggctgcttaccaagaatgccacacttttaaaagaataagatggaagtacaaataaagagttacagatgtaacgggtatagttttttagttcaaaatatctctgctgtatttttataacaaaagccatagataaacattatagaaaatttagagaatattaaaaagatccacaaagaatattcatgattgcctagaaagatggtactgatgaacgtatttgcggggcagcaatggagacgcagacacagcaaacgtgtggacacagctgggcagcggggggaaggacagggcgggatgaattgagagcgtagaagggaaacaaatccattaccatatgtaaaatagatagcccgcaggaatttactgtgtgacacaggagctcaaccctgtactctgactacctagaggagtgggatggcgagggaggtggggggaggttcaggagggaagggaccgtttgtgtacctgtggctgattcatgttgatgtatggcaaaaaccaacacaatattgtaaagtaattatcctccggtttaaaaaaaaaaagaatattcatgattccatcatgcagaggaaactactggaaacactttaaaatatattttgtcactgtttctgtgccgaaatattttcatatttttgaaaagtacggttgtaacctccatgtggttttttaatttgcttttttacccaataatatattttgaacatcattttaagttaatacacttttggacttccctggcttttggtccactggctaaagttaatacacttttggtccactggctaagactccatgctcccgatgcagggggcctgggtttgatccctggcctgagaactagatcccatgtaccacaactaaggcccagcacagccagacgaataaatatttaaaaaacaaagtcaatacattttcatctacagcatcattttaagtgaaagaatagaattccattgtagggatataacataatttgtttaaagaatcatctcattaccacgcaagactttggaatctgctgctacagtctgacatagtggttggagaattctgtttcagatggatgttttggctctctcagctccataggcccatgccacgaaccaaggacaacaagcccaggaagaaaaaaagatctactgaacagttatcatgctactgactctatttcactcttctcttctgggcaccgaagaatgttctcattattctctgtcttccgtggcatataagagtttctagctgagttgctccaccattaattgtatgtcttcttaacttgggaaattcttcagtgagtgaacagtcatccatcttcctatggcttacttgaatcagagggacttgcaggatgctaatacagtgctgggtttcaggaaaaaaccatctttgcgaataaataaagcaagaacttaacagaacattaactccctctttgcgatgtgcccatgagtccctctaagaatgtgaggttaagtatgtatatcaagatccctctttagaggtgatccatgcgagttgttaccgcgagcctcatttcatttggtggagcagctgccagccagccgagcaaggcca

SEQ ID NO: 56635 - DNA, 1775 bp, Bovine  19866880748349
cattagtaattaagtcaacttaatctttttccttctctaaggacaatttttctcatttctcagacaaagctagactagaaagcataccattacatatatagattcaatgtaatacacataacatacacaccatttaatctagcaatcctacttccacgacatcctaccctacagaaataaacaaatgtgtagataaagctacaatagtaagagcacttggacttcactattttgattccttcccttctcctccttcctaccttccatatacataaacatatactgagtgtattctatttgccaatcgctgtttgttctgggtccctggatacaacaataaagaaaacaaaatttttattctctaaaagcttttactttagtgaggaaaggccaataaaaaacaagtaagcaaataatattgtcaggtggttatgtgttacaaagtaaaataaagcagggtaagctgggggttattgatggaatgagagtgttgaggaggtaacatttcagcacagacctgagtgaaggaacagaccaaggcttaggactagctaggggaagtgcgtccctagtagaggaagcagcctgtggggcaggaagagcgtgtttgagatagctgaggcaagaggcacagcaagagagctgtatgagtgaaaatggatgggagagagatttacggtaggaagtgggatgtgagaaacaaaaagggccaaactgaaaagggtcttgtaggccatacaacatctgatttcctactggatgacatggagatccactgaagggctcgtggagcagagacgcggcaggatcttttgcaaacagcatctttctagattcagtgtaaagatcagactatgaattaagaacagaattaagggagaccagaaaggatgccagtgcacaaacactggcagcacttgggtactgtatataggcagagacacaggccaagatcagggtagtaggcatgctaggggtgaaaaacaattggggatattttataaagggagaggtgacaagatacactgatggattggatatggaatatgagaagagaagagtcgaggatgattatgaaattttggcccgaccaattaggacagaattgtcatttactgagacagagtagtctggagaagaaaaagttcatgaataaaaagaacagcctagcattgagggttttcaatgtagctgagcaaatattttacggaaaaaaactcattaagccaattaaattccctgaattcaattttaaaatggcaaagctgatttgttcccaagttttttctatttctctgaaattattttcaagactattttctcctttttctggctctcttagcagcccccatggtggtcgtcaagaacaagcaccttatgaaaggaggcaaaaagagagccaagaaggaagtggttgacccagtttctaaaaaagattggtatgatgtgaaagcaccagctatgttcagtataaggaatactgggaaaacgttgttcacaagaactcaaggaaccaaaatcacatctgatggcctcaacgaatatgtttttaagtgagtctcactaatctgcagaatgatgaagtagcatttaaaaaattcaggctaattattgagaatgttcagggcaaaaactgcctaatttccatggcatggatcttatccgtaacgtattccatggtcaaaaagtggcaaaccatgattgaagctcatgttgaggtcaagactacggatggttacttgcttcatctgatctgtgtgggtaactaaaaaacg

SEQ ID NO: 56636 - DNA, 1554 bp, Bovine  19866880764703
attgaaaaaatattactgtccccagtttgttcctatctagaggaaaaaacacgggacacctgcagtgatttgtatagaaattaatgagcattttcagaggcccaggatttttcatgcaagataagtttgtgaattggaaagcttttatgggaataggtgtttcggtggttaaaaatggaaataatcatgccatgtttgcatttggtcaagttaatggtggttgctattcagaacgagttaaaatagttcctgtcatttactggttgcatgtggacatcagtgatacagaaggagttatgcatgcctcatatttccccactgatttacatgacacttgcttttttatctattattccagttcctcatttcattttctgtcaagtactttccgagctctaagcactgtagttttttttattttgttttttctttttcttttttttttttggccacgctgggcagcattcaagatcttagttccccaaccagggattggacctctgcccctggcagtggaagcatagagtcttaaccactggaccactggggaagcccccctaaagccctgtagtttaaaattagttactatttatagattctccaaaggaaataattttgtagggtggcagtaccttttataatacataatagccttattatcttgatgaaaaattagatttaagagaatggtgaattttttttccccaaagaggcaggtgataaactctctagttgaagattagaggaagtaggatttctggagcctttgaattatgagaggataagacctggaaactaggagaggaaaacattcagttggattgtaggtcaaaagaaattttcttagctaaagcatttctagcatcattgctgggactacggacatgtgtcacaattgttgaccctctctacctaggggctggtgaaacctacctccaagggcaaactaattgaaatgccgctttaaattcagcaccagtgttcatcctgcctaacctgaactaaacctggctagtcttcattttaagcaaataatgctataaatcatattatcaattcagttcagtcactcagtcatatccaactctttgcgacgctacggactgtaacacaccaggcttccctgtcgaccaactcctagagcttactcaaactcatgtccatcaagtcggtgatgccatccaacgatctcatcccctgtcatccctttctcctccctccttcaatctttcccagcatcagggtcttttccagtgagtcagttcttcgcatcaggtggccaaaggattggagcttcaggttcagcatcagtccttccaatgaatattcaggactgattgcctttaggatggactggttggatctccttgcagtccaaggaactctcaagaatcttctccaacaccacagttcaaaagcatcagcttgtcagcactcagctttctttattgtccaactctcacatccatgtatgaccactggaaaaaccatagctttgactagatggacctttgtcggcaaagtaatgtctctgctttttaatatgctgtctag

SEQ ID NO: 56637 - DNA, 1597 bp, Bovine  19866880837241
ctctctctcttgtgaggaatctttcaaaagtcatagtaagactagataccaagttgtatactaatatttttcaggcctgggcctcaaatatatatatattcatatataatactccagtgtgaacagcaatttcatgaaatgtaaaatgtattttttaaaatcacacacaagtatttataagcacagggttcaccagaagtctaaagcaaggagacagtagtatagaagtgtaggattaggggacggagttactcttccatagacagttctgattgaagttcttcaaaacaagcgatttttttttttttacaatagcctacacgtctactattgaatacatttaatatggaaaaataaaatgaagaaaagataggtactttaaagtgtttgggtaagatgctgtcacgaagcctactccctctccttgctttagagctctctagtgaaatggaggtgagtttgatggagtacagtcggtgaccactgaaaaacacgagccctttcaacaatgttgcaacaccgttagtttttggtttaaaaacacacacacacacacacacacacactcacaaatgctaaatgtacacactaccaaattctgcggtcagcttttccaggaactactggggaaaagtctcaatgctgcagatccccgagggtgcccgcacacccaaccttgtttccagatgactcatttcacagtttgttttgatcattagcaatgtcccttgtctgcagaggtgcagtgtagttacaagtgctacatagctgtagttttcaaacaaaaccacttataccattgtgcttaagtggagagtgtagttaaacaatactgacccttgcttactggccctgtattctctgtaaacaaggaggctgtttgaaacaaccgcttcagctctatttacagaagggttcccacagtacacacacaggcacagtggttgataggctttctaaaagctgtgcgtgtgccttggtctcttaaaaaagacagtgctcaaagtggaacctatgtgcaaacttaaactcacaacacagagtagctcaagcagccattttgctcccaagtcatctgaagaactttaccagattaagccagtccccagagtgcttacatccacttgcatttcttcttttcctcaaataagacttttacatgcaagagttgtttctgagcttcttccagccctcgttctctttctagtttatttagaatctgttgacaattagaacagttcttttagagtattgtggttttagcattacaattctattttttttttgcattcctgatgctgtgagtggtaaatctgtatgaaacagatgccaagattttctccgatcatttacatactcactttgcaagttgttttgctaagtcattatcacaggatcaacaacacttcagcttaaaatagaaactcgaaagaaataccgaattacttgcttacaaatatggggccagaattccaaggccctgttttatgcattatgtcacagccattccaagcacagcaagcattcctgggcagccaacatgcaggcaagtatttcttcttaatgcagcaggcagggggcatcctggtcagagatg

SEQ ID NO: 56638 - DNA, 1654 bp, Bovine  19866880939005
actttatctgaaggctccttgtaaatctttttttttttaatctttccaagcacttttagctttccagtttttcatttcaaaatgcaaaatgagaactcaattttcagatcactgtggaagggatggctaaatttcctaccagtatttagaagtactcaccatcctagctgacactgttgaaaggtattctacagttctattatttctcattgcttcttgccagatcagctgtggctgatgcactcccagtcagtatttctgacattccattgagagaatgtctttcacaaaagaaaaaaaactgctaccctaggcacaagatttaaaatagctaacaaagcatcatgcagggtacccagctggtagccacccctgcttatgagcatgaacatgcatttaacatgtgcacacacacacatgaattatcagaagttaccaaaaatgcaacagggtttggtcatttggagttaaaaacaataataaccctttcaactgcgaaaagggactcttggaggtaataagaggaaaaacaaacaaacatatgataaaagacgaaattgtttataaagcttgatttggaatatctgttcccaaagaagaagaaaatccataaatattactgtggcctcccgactctgataattgtaaaactattctctagacacagctctatggagatgaagtttttcccaagcttgattagttccatctgatccttttacaaacggaattacattttgtcaattcaaaaatagcataatgtcttagatatagacggcagcccaccaggccccgccgtccctgggattctccaggcaagaacactggagtgggttgccatttccttctccaatgcgtgaaagtgaaaagtgaaagtgaagtcgctcagtcgtgtctgactcttagcgaccccatggactgcagcctaccaggctcctccgtccatgggattttccaggcaagagcactggagtggggtgccactgccttctcccaaaccattagaatacaggttatcaattagaatgtatattattcataaaattccagtgcacaagcacctacttaaattattgtgtttaaaatattttccctcactgagataaagattagctgcatgataaatgattgtctaatgctgcagtgtccaacacaacagacactagccacacgtggcccatgagcacttgcaatgtgcctactgggactgaggaactgaattttttattttattttaattaaattacattttgaagatttagtacccccaaatgcaaaatattcattaatatttttggtactgactacatgttaacataaacaacaaaggccatttttatttagttgccaaaatgtgaaaacacagaggttgaccagtattctgtaaatctcattacagaaaatatgagacaaatataaacatactattatttatgcatacctctttctcctcaaatgatctctcaggtcaaaattaatcttccttccctgctagcatgttatgtataattttaataccgtacttatgacagtctaatatttttattgaccacatcaggtggctggcaggatttaagttcccccatcagggactgaactcaggcccaaagtggtgaaagtatgaagccttaaccactggactgccagggaattc

SEQ ID NO: 56639 - DNA, 1275 bp, Bovine  19866880974267
aaaatattagcagatacttacaatatgcaaaagttttaacacatccacaaacctgtaaaaaacagcaatgggagacatgttttaaacgaaccaatgaggaaacaaatagtcttttgaattggaaactggatacctacactttttctgagctcatgatctctttggcaatatgatggactttacatttcattccagtatcttcaccctgtggataagagtgcattaagaaagcatgaactcataaaaggataaggaagatcagctttgagttattcagatgtacattcaagctctgatacttacaggtttcaattagaacacatttcatactatataatgtctcaaatggcaaacatgaaggattagatgtggttattaaaccatgatacaggagaagctgaaagcaatcataatcctcactgttatcaatgccggattcatggagtaccctgaggaaccccagagccccagtggggcacactgttagtggcacaaaactgaagttacattctgcaggggaaatagacaccacatgaacttgtgttcttggggtgcaggcaagtaattttagttagtaactatttagtaggcctgtcggagaaggcaatggcaacccactccagtactcttgcctggaaaatcccatggacggagaggcctggagggctgcagtccatggggtcactaagagcgacttcactttcacttttcactttcatgctttggagaaggaaatggcaacccactccagtgttcttgcctggagaatcccaggggatgggggagcctggtgggctgccgtctgtggggtcgcacacagtcggacacgactgaagcgacatagtagtagtagtagtagtaggcctgtatcagagaaggcaatggcatcccactccaatactcttgcctggaaaatcccatggacagaggagccttggagggctgcagtccatggggtcgctgagggttggacacgactgagcaacttcactttcacttttcactttcatgcactggagaaggaaatggcaacccacttcagtgttcttgcctagagcatcccagggacggggaagcctggtgggcctgccgtctatggggtcgcacagagtcggacacgactcaagtgacttagcagcaggcctgtataagagtacttcaccttcagtaaagccattttaagtcagacaacttgagtgcagactggcaagtgctcttcagtagtctataaccccacatatcacagccataagcttttacaacttactgaaaata

SEQ ID NO: 56640 - DNA, 712 bp, Bovine  19866881140613
aaataaaagttaaaaaaataactaaaaatgtttcatatttggagatattatgcggtcttttttcccaaaatcagactctagttatttgtgcgaaaacatataatatgtcaaaaaactattagcatttttccaattagaaataatatatactttgagtaattgctttgaataaagtcatctaattttaagttatcattacaattctggaatatacatatttaccgcagaccataatatggacaagctttgtacttttatactgctttaagtgaaatcaaaagacgtatgatatttttaaatttagtccaattacaaacctataaatttctttcaagcagtgaaggctttgatgaaaatgtttaaatataagaaggcaaatacaggggagttatatctaaggatatccaagaaacatcatcattaacacttgaagatagttacagtcaaattataaagaaaataacacataagaatatttaataaatatttgcctgccaaaatctcccttggaattctttgctgttaggcaatattggtaatatcatagcaaaatctgatcatatacttttatatatttatagcaaacctataaaggatttataggcctcagacttgcttaatcacctttgtggtcaaaggaatacaaagttgtaaaattctgaaacctatgattccttagcagctccttaagttcttaaatttttaaatggta

SEQ ID NO: 56641 - DNA, 1997 bp, Bovine  19866881142516
tatgattattcaatattgtgattagtcttatatggctattaaattaattgtaaaatattccaaaagagcaatatacacaatatttcggcaatgatagtaacagttaacctaaatatttagtatcagtagtatcagtgtaactgcattttaagagaaacctccctttgaatgtaaatgttgtagttttccttttttttaattacttggtagtcttatataagatgttatttctgtatacagatttacttgcacttaatagacattctaatttaacattagatataaattttccacttgggactttgctggcagtccagtgggtaagactctgagctcccaatgcagggagcaggggtttgatccctgtccagggaactaagattcctacaagctgcatgatcccctccccccaaaaatagaatttcctgtttacttatctgttgatataatttgtagaaatccagagttatcacagaaacaaagttaaaggtttaagtaattttccctaacacccctaaaagagagcaataaacaacatataccgtccccaaaacacggctttaaaaaggcatttttgtcatttgaaattattattcatctcctggcaacccagaaaacctagtggaacccactaagaaacctatacatgcaagcacaggtaaaccaggtaaaattctggaattgcttctaaaaggaaaaattttgtgctcatggtaatggaagtattcaatctgtacagcagcagattttgaatataaacagcttcattcttaaacacgatattatcatggttattgctttcagcatcaatgatcaaaaacaattttgttattttaaattttggttttgtctaaaaactgttaaactgtgtatggggtttgcttatttaggtatcagcaaacacagaagattcctctatgagtggctacttgtacagatcaaagggcaataaaaaaccttggaaacacttgtggtttgtcctaaaaaataaagtactgtatacactactgctgcaagtgaggtaagaatctgaaatgtaaacatgaataatttggagttttattttatagtgccacctagaaatgattagtgtttgcctggtctatttgtctacacttttgctttactttcagagggggagatattactgttgtttttgacatgaacagtgtccttgttttgtacctaaagatactcaaagatattaggaattttccatagtgttaaaatgttaagtttgggggatatcatgtgactactgactacttcactaaaggcagaagtttggtaagactgggctatgtcacctttctgagctgtattttttgcatccataaaatgaaagtaatgtaattactcacttcccatggttgtagggaaataacatgaaatcagtgaatatgaacacattgaaaactgtctgctgccatgtctgtctgatgagtggggagagggtggcccaataaatattgttgaataaatgaaaagtgaattagttgctagaattaccattgttttatatacgtgtgtttgtttgaaattaagttagagcttttcagataaaaagttgcaggtctgaattctgtatcattttagaagtccatcttccttttttttctttgtaaatttaggatgtggcagctttggagagtcaacctttactaggattcacagttactcaagtcaaagatgagaattcagagtctagagtggtttcagttactgcacaaaaacatgctattttatgtattcaaagcagatgacgctcactcagctcagaagtaagtaatttaggcttttttttttcatacatgagatttcaaattgttactttaaatgattgattttaaaaataacctacttccaggcatgtgatcaacaaagaatataaatcagagatcccatttagaaagatttaacgtattattcaaactctttagaattattttaaagataggcaagagtatctggaatattttcaggaagcagagaggaaa

SEQ ID NO: 56642 - DNA, 982 bp, Bovine  19866881223706
cttgctgcatattatttttaactgctttttgcttgattttcattttggtgagtaaaattcattatccagaagtataaatattcaacgtatgttaattggtatgtgctgagagcagccagctttacagacctagtggtaatagaattgtggaggagaagagctgcaaaggcatggaggttgcagagttcagccacttcattttctcaagtgagggacctaagactggaggggtaactagaccccaggtcccacacggatctagaccaggtttcttcctgaggtcaagatgctgtgtcacagttcagacttgctcatatagatgatctcagtcaacaggaaagcagtcatgggaagttagtaatttagaaatccgcaatcagcaagacttaatatgaagtgaagtgaagtcactcagtcgtgtccgactctttgcaaccccatggactgtagcccaccaggctcctccgcccatgggattctccaggcaagaatactggagtgggttgccatttccttctccaggggatcttcccgacccagggatcaaacccaggtctcccacattgcaggcagatgctttaacctctgagccaccagggaagcccgacttaatatattggcctataaatggtaagaattctagttacctggaaatttctttcactcatctaaatacttccctcttccagtcagttaaatcgaggtgttactgactgtttgtgaaacttactcttttactagacccagtgcttaaaggaaaaggaagaggactgtcttaaccaatgtgtgtgtttattagaatgtttcagtttcagtgcatcgtttttaacattcccagatgttactctttaaagccttgatgaaaaccacaaagattattcttaggatgagaagtcttaaggtaaattctgattctgtgatctctgcaagtaaaaaatcagtccttaatcttataccttcctgctaagatagtcatgtttca

SEQ ID NO: 56643 - DNA, 1783 bp, Bovine  19866881319216
atccctggagagcctgggcttgtataatcctgtagcaagggtgatgggatagggcttgttggttttgaaggaagagaatatatgtgctgggaaagaggatagttcggtaaaggcaggacttggcaggacatcttagatagagccttttctcctctcagttgcaagtgtatataatgactgcttcggagaaaagtaaacagacgcacattaacaccctcatggtggttgtagcagggtgatggaattatggactgtgttcctctctttttcactgtttaccccttgaagcccatacaaaggtctcactactcagtttaaatattttaccacctcttgcttatagcttaaataaaacatccagtactctttttacagggttcaactaattttgtctagattcacagaggagaaaaacacgcactaaaaacaatgatgatcacaaatactatccctgctggtgatatttccttgggtgttctaattgtgttttcccaggatagctcagataaagcaaattcctctctgaccttgaatatggctaagtaccatgcatcctgccccagtctggattaccttttgttggccagatccagactctcaggttcttccaggaagtgtgtttccaaaaatttcaaaagcctacatatagagttcttttgtgcccagatagacagatttgagattaataacagctagagttctttatgcctttcatctaaagtctcacgagatgttataagtgaaattattctaaattctcagtttggttatcaaatctttttatttttgttgttaatagatgaagaatgcagttattcccttaaccatcagtcttatttatccccagcaggactttgtaatgaaacctcctgattctgcaaaccaagattattgtacaaacatgtgtagaaacttgccagcctgttatctaagctaacatattaaatactatagaatatttttgcaattaactatcatattttgctttaaagaaagtatattaattttcctctataggtagaataatatctgaagagagacacaccgagactgaacataagtttggggaatagcattaatcacaatgtatttctagaatgaatggatgactatttgattagtatttcaaagactttctaacctccaagcatttcaagagataagaactggatcttgagtatgaaatcctgcagaaaaagtaagaactacttgaaactagcaagagaaaactgaactgtgtccatgaatgtgtctaacagtaaatacctctgtcgactttgggcagttggcttaccctctttggttttcatttttgtcatgaacctgacaggatttaactaaaagcatagaattatgtagaggatgaagggatcatagggattttataatttccctcaaaagaaactgggagttctagagaatttcctggtggtctggtggttgggactttgcctaccaatgcagggggtatggatttaattcctggttgagaagctaagatcccacatgccttgagcccaaaaagcccccaaatagaaaacaagcaatactgtgctgtgcttagtggttcagtcgtgtctgattctttatgattcccatggacggtaacctgccaggctcctctgtccatgggtttttccaggcaagaatactggagtgggttgccatgccctcctccaggggatcttcccaacccagggatcgaacccaggtcccccgcattgctggtggattctttactgtctgagccaccagggtagcccaagcaatactgtaacacatt

SEQ ID NO: 56644 - DNA, 883 bp, Bovine  19866881326986
cgggctaatgggaggcaggggtgtcggggtgacaagcctcttctgttaagtctccgggaggaaaaaactaacaaaggagatgctaggttgctggtgtgcgcgtgtgcgaatgaacactagggggcagagtctgtccaggaatgggagcacctgtgccattttcctctgcgtttaaggatgatttttaaaagggcgagctggtagcaggaaggagggtcattgcctttagtagggccttagtcaatatgtttctaattgggctattaatctggaaataagtataaaataaggaacccagtgggtaggttgagagtgaatgcaatgtgaataatgaacataccactgaatgacttttttaaagcatcagttgtctcataatctttgtgcttctttaatatgaattgacttctgaccactactgggcaatttgtcataagggagtaggtctcagtattgagaaacaccaaataatattttaaaagttttctagtacattgtgtggggtgtatctgcatctggaaaatattaaagaaatatatatgcaaattaatgtgatggtacacatatactgacccagagatgcttctcctcacactcacttccactctgtctcaccaccggaatgcagcatgcactgcagagatggaaggaacacagctacacgctgctttcttgattgggagttaaccccggtaacaggactcagccatcatcaaggcagtgacatttggacatatttcaatttacagtggcctgaggagattcacttggttagaacaccacttactaccatatgactatatgttaataacactgtgttgcatatttgtaaattgctaagagagaaaattttcaaagtcctcatcacaagggaaaacaattt

SEQ ID NO: 56645 - DNA, 1101 bp, Bovine  19866881400544
gctgttctgcagggcaagagagagggattaaaaggcgatgaatttcagagatcgtaactcatgtggttgttcacagtagactggtctgggatggtgctcagatggtcctcaggatggtgcactgtggtttcccaaatgttaacaaaacaattcattggctacctccaaggagctccttgctgtggggcaggaaggaagcctgaggttcatagtgtgatcatacagtgtgttggcttcttgagctaaatcttcattctccccttctcgcctccttgaacctttgacccatcagtcttggttccaatctctaggttctagtagagcaagggtaatccctcttccacgtgataggtattccaagaaagctatcctgttgactggtcctcctcaaggtacacatccccttccctccaaccattcttcacggatcttgctgttgaagccctttgccaacttggcagtcaccttccttctgacgctttccattgtgtggtggggtccttcctaaaacatgatgaattgcaactggctgtcaccttgacgtcagagataaaggcctgtggagaaggagacacaaactctgtgtttcatgtttataaacagtaacatgtactcatagaagaatattgaaaaaacagaaaaagtataaggaagaaaaacgtaaatccctgtagtatgatcttctcaagattattagcttaaactttggtttaatttcttttacttttttcttctctgtatatttgttaatattttttgatgggtaacatataggtctcttcttttcatatttagctttttcatgtcattaaaacttctcaccacccttattttatttacctatttcctgagataataaattgtttccagttttccacttttataaataaaatgcattgcagcacatacaaatcttgtttgcatgtctcatttccttaggatactgggatggaattgcagggtggaaacatttttgagggactcttggtacgtgtggccagattgtccactggaagagacttatccattcctctcaatagcccccttgactggggtaaatgaacttgtccatttcggtgtgtcttcactctatccagagta

SEQ ID NO: 56646 - DNA, 991 bp, Bovine  19866881858802
cttgttccttatttgaccctaatgacaccaaggaggccatgttaaggcaggtgctcttgatgggattaatgactgtgattggagtaagatgaccagatgttcctttttttgcctttaaaatgctgggcctccacagcataaatcatagaggccaactaattacggtcaggggagtctgcaagttcaggataacttcctcatctcataggttttttaaaaagtccatacaacatgaatccaccaaaaacaaagaccagatgatacactgcacctcataagatataagagcatttaagtaactttccaaaggtcaatagattaaaagtgatggattcaaagccctgtgtaactaactgcaaagcccactttgatgcttttttcccataactttctctgtgcacagccctgtggatgggaggatgagtagtagcagggaggagtgggccgactaggagaaatacccagtgctcagatccatagccagccccagaaaatcgccagccttgcttccccactcccttcttcctcaatgaacccttcattccttagctctcccctccctcccccacagctcttatgttcctccaggctgctgcttaagaaggtttttgaacagtgcccttgagatctcaggaaaagagaaacaatctaaatcgaaaaagcaaataaacattgaaccatcttccagctgttctgtttgaacagacagaggaacccgaagcaaggcccaggagtgttaagagttccttttcaaagcacagctcagagagtgctcatgcttaataaaccaatggagtgagacagaatgtagagactggggaaagggtcattgcttgacagatcaatgccacaaacataaacagccaagtccacacacatgcaaatacagattgaggtgctgctcggggccaggaagcatcaactgtgtctctggaactttgtggttccaagcacgaagcctggctttcccacttggctagtcacagcatct

SEQ ID NO: 56647 - DNA, 2357 bp, Bovine  19866880340787
cttttatttttgtagcttttcagtaagtttgaaaccttccttttattttaaaatttagtattttagatagggagggcctttcagtgtatctcatctgcataccacaacaaatctaaatcaatcactgtttatattcattcgtttattcacaatagaatgttattagtgaaaactccaaataacttaacttagctttcatttcatatctaagaatctatttcagatatataaaaaggcatcaaaaacaacagtcatgtaattttccttggaaaataacataatttgagtcccttgggtgtaccttctcaatcacatttctctataatccctcaaagatgactaacatgttgaatgtatgtttttcattcccatgcatgtccttatacttgtatttaccatcatttccaaccacctgtttcccttgctatcccctactacagtgcctacaactctaaatccttaatacccagcctctcttaaagatctgaaaggccatagacacagtcatagctaatgaggtgtggtagaagtctctgaggaagagtgacctttcccaaatgaaaaggtaaagattttctgtaacatttttgcccttcataattttgcctttcatgtttccagcttggtacacagacttgaggctaaggtaactatcttgtcatcacaaggtgacaagaatgaggaagaggacttctatgcttcctcatgcaatagggaagaacaaacctgactctatagtagctctgttccttttactttaaaccttgtgctctgaagaaagtgaaagtgttggtcactcgtcgtgtctgaccctttgctcgtctcaggatgccctcatcgtcccattcagcttctcagctcatccgtcacccatggaaccaatccttagcaccaattccttgcatcagagtttctctgacacttgaactatttgaagtggctcttatttccttgactataagccggtgatactttttgacaagttgaactctcagtcctaaactaaaattcctgcacattcatcagacgagcattgtagcaggagatatgattgggacctgagataagtctgatcccctgggccccaccccagcacctactgtaatatacttcctgaggaaaggggcgattattcccattgtaaaatgcagctggcatgcatcctgaggaaagaggggagttcttaatgcttctcctccccagaccattgatttgaaggctccaaggcagaacagtcttgattcttcttggtcggaaggatgtgatgtttacatgtcagtttctcttccaaatagaactccttattacctccattctattctttctccaactgcatacactgggaggggataaacatcttttgagcttagattgctggttcatcttgacctggcagaagagagtgtatctcacttgggtgtgtgggactaggaggtggatgcagtaagtaggtttgatttggaagcagttgagtatgcttgagttgttcatgagattttgacactgacgatgtgagaaaaacagtgtgtgtggaaataccgcagtcaataaatgacactacatatttggggttttattttcgacgtctttatctccctcccttgccctctgccctccttccctcccttcttccttctctcttcttgccgcaagaagtcaattctgactccatgttggaattatttctttgacttgctttccattgcttttgctattataatcacatgtaaaggcctgcttcagagagttctgcccctctgcctgaccgttaaagtgccctagctcaggaccctgtccacctgtggatgtcaggaagaaaaaaattaacacatccccccgcctgaggcttgccattctagggggtatttgcaagattaatggcctttttactttgtttcctcacctccccccatccctgatctctgatggataaaagaacctggcatccagacccagataagagttatttgcagatattactctgcaatcttctcagtcagccagctctccaaataaagcaattccttgcctcaacacctcttggattcattggcctgacatgcggcaagcagagcgagcttggactcagtaaccttcttttttctgacaagagcaatcagattttcttttgagaaatcacctctgtcccactcttggttcatatagtttggtagtattaacactcggagaaggcaatgggaacccactccagtactcttgcctggaaaatcccatggacgcaggagcctggtaggctgcagtccatggggtcgatagagttggacacaactgagcgacttcactttcactttcactttcatgcattggagaaggaaatggcaacccactccagtgtt

SEQ ID NO: 56648 - DNA, 1889 bp, Bovine  19866880403518
acctatatacagtaaagtgtgtgtgtgtgtgtgtgcacgtgccatgcatgtgtaggcataacgcctgcagacagtaaatgctcaataaatgtatatatatatttactgtaatttggtttcttttgattctttttctgtttattgtcagaggtaataaaattaaaaataaatgtattttcttaattctaagcacttactgtaatggctttattttctatactaatggaggatggaaattttaaagtgtcttattaagtaattgtatatgtgaagtggtatattagttataaatataacaaacctttaaggaccaaagtttaacagttgatgtgtattaaaaaataatgttttgtttctcttgcttctttttttgggggggggggtggctttgccttctgttactttcttgtttttctcatatgttttacattagcgacattagtactgtaagattcacttaatgtatataagtgataaatatgtgcatagcattctagtggatgcttagtgcctgccctcagacatttctttgtatagatgaacagcagcacagtcagtcatccagtcaaactatatgagactgttctttttaaagacaagaacatttttatttttagtcttactgtttcctttgtttgatatgtttaggacagacccagcactcagtcagtatttaatgacataataaatctgttaacataaaactgagtgccaaatgaatacagattttctttgttataaggtctcatcctaaaagcctgatcaccataggcagacaataactattcaaacaacttaaaagatagtggagtttaagagaagttgagtaggagccttctgttgtaatgttttcagatatttctcttaggcagtgatttgtcttatgtttatttaacatgtagggaattccgaatgaaagctggagaataacaaaggtaaatgaacgatatgaactctgtgatacctaccctgccctcttggttgttccggcaaatatccctgatgaagagttgaagagagtggcttccttcagatcgcggggccgtatcccagtaagtgtgaagctgtgctgaagcttccccattgcttttgtgctgcacatagtgcagaggataatgaataggggagtgggtgcgggataaaaatagctacagcagcgggtcctctgtggggctattagggaatgagttattgagtaaaattaaaaccagaggaaagacttacactaaagaggtttctggagagtttgaaatgggtataagagagctgctcagaattgcatggctcttaacttgaagtcaaacttggctctggtattattcactatttctttatcttatacagttggtcatagtgataaatgctctcttcctttaaatcttggaatgaagaaaactgtacaaatttgtgatgaatttctgtattctggaaagatgagttctaataattttaggtacaaaaatgtgtagactctgaacactatagttgggcatttttgctgaactttaaaaatggagtttacctaagctcccttttaatgtattttttccctagagacaacacttttaattaatgactcttctaaatcaatatctgattaactaataagaccaagttttccacatgccagagttgacttgaaagaaaaatgatgattttttatagcagcttcatatttcttttcatggttcggctttgaatccagttagaatgtaaaaagaaagagttttattgagtaatgttttgggaagaactctagagaagcatgtcaaagggtgtgttgccacttttccccccattaaggttttgtcatggattcatcctgaaagtcaagccacaatcactcggtgtagccagcccatggtaggggtgagtgggaagcgaagcaa

SEQ ID NO: 56649 - DNA, 1098 bp, Bovine  19866880404532
aagatgaaaaataccttcaagccattatggactcccaatgcccaatctcataaaatctttatattcgacgcccggccaagtgttaatgcagttgccaataaggtgagatcctcttatagtaattaagattatagttacagtttcatgagtttgtcaggaggtagttcagtggtaaagaatccacctgcaatgcaggagaccctggtttaatccctggattgggaagatcccctggagtaggaagtggcaccctgctccaatattcatgccttgaaaattctgtggacaaaggagcctggaggggttacaatccatgaggtcacagcgagttggatgtgactgagcacgcgcacacgtacacagtgcagtaggatgagtttaggcttttcattcgctaaagatacagattctaatcctggctctttacttgatagtataacttaaaaaattttatttttaattttatattgaagtatggttgattaacaatgttgttttaggtgtacagcaaagtgactcagttatacatgtatcttttctttttcaaattcttattcctatataggttattacagaatattgatcagaattccctgtgcttattgatccttattggttttctgttttcaaaacagcagtgtgtacatgtcaatccaatttaattttaatctttttagtaactttaattggcttatttgtaaaatgagaatcataaaaactaacagaagtgttttaggggcaaaactcacctgataaactgttgttttaggagcaaaactctcccttctccaaactgggcaccaaactgagtttgtgagactgtagtctgcacagcacccttgtaggaatcatgcagagttctcagtgaccagtgctgccctcttctggcaggtctctgcctgtacgaactagtcacactgaagactggcagttagttgaagcagtggtcctgatttctgctatagaataaatactagcattgtggaagcagaaattctggtccacttggaaaaatctactactggagaagaaaagagaagagagacagtttagctttaaaaaattgcctctcagataagacaaagaaaaaaacccaca

SEQ ID NO: 56650 - DNA, 1833 bp, Bovine  19866880444444
ctggctcagggcaacttaaccacaacccaccgctgtcccacacgttcttcataaaacaagaatacacatgctcacctgacttcctcttgttgctgttattaaaattatatatgataacatataggaaggtacttaaagcactgtaatttcactatccatatctcaagtcctaccaaaacacaatttcatacagaagactgaagttccatgtgcagggacatctgtctagtttacacctgacccatgcttttcttcacttcatcttaatatttgcaaagtgctttgtaatcacggtgactgacttctagggtaactgcacaattattattaaataaaaagacaaaacaaatataaaagcacagagtactacagaatattaccactattttcaaagagataaatctacatctacagaatagaatgagaaatagttggtgttcacagtaagctacagctggaaagaagaaccaaatttttctgggttgaatctttctctgttttatgaataaaatattcttttgccttttggataaaatatgcctcttatctcaggtataaaatcacacctctttgaacactaatggaaaaaaaattaggaagatactggaacagtcactgtagttatataaaattaagagatcacatttttgaaaacaataaaacttacctcttaactaacaacaaattagtgaagaatagacgttcaagtttcctttctgacactgacagcttgggaaatggtttagagtcaagatgggcacaagtacaaaattaacagcgtttcattaggtccctgttaacaaggattattctggagagtagggacagctcacatcaggggcagagggacattcaaatgtgttgcaacaaatcctagaaacatggtcatactgcaactacacagagcctgtcacgaaaacacaggacgaaaatgctctggaatcaagactcgtagaacttgatgagtacgtcaaatgttgtcatgtaactctgaaaatatactaaaaacactgaaatacatactttaagaatccatttcatgtgaattatatttcaatacaactggtattatttaaaaacagagcaactagatagtaaaaccgaagacacacaaaaaaatcactgaagacagaactagaggacagagcattccagcaaaccccaaagccgccaacagtcacaagatctcgatgctatcgtaaggatgcgtaaggaaatgcagaaggaagcaacgcatataagatggactagagaacaagggaatcacaagagagtcttacagtttttattgttctgcttcctggttttagctctcttcctccagaactacaggaaagaacaggtcaatctaagaagtgcagctgaaaccgagaagggttctgtccattctaacagacaagttattagagaaactcacagattaagtgaaagaactaggaaacaaatagaaataaaagagaaaaaattagaaatgaagaccaaattagaagaaactcaagagcaaacgaatacagtggatattaaattaaaagaaacagtgaaaagtgaaatatataaaaaaaaggaattagacataaaaaagattcaagagaaagagacaaatgatgaacagaggcaaagaagagacaacccaggggtaatagcagtcctgaagaagaaagccaaaacaaagaaatgaaataaatactaagaactatgattaaagaaaacagtcatgatgcttttaaattgaaattcccaatgaaaacagcacacatgcatacctgataatataaacccaaaatatacagcatgaagacatattctggcaaaataactggacttgaaagaaaa

SEQ ID NO: 56651 - DNA, 1126 bp, Bovine  19866880447831
tcttagttattgcaggttgtctgtctgttgttgttaagtcactaagttgtctccaacttttttgcgaccctatggactgaagcccgccaggctcctccgtccatgggaattcccaggcaagaatcctgggatgggttgccatttccttctccaggggatcttctcgacccagagattgaacttgtatctcctgtattggcagatggattccttaccactgtgccgccagggaagccctgcaggttgtctgacagacatggaaatctaaatgcaatgatacagtacagtgactattgccattgttctcaaatgtgtccatctactctaacgtggcatgattagctatttttgaatgtattattaaaatgaccacaaaggacattaaaaaaggggccatctgctctctgttaaatgtagccctgaagtctcccctggattagtgaagcaagccactaaatacttcagtgggacttcaaaaagctgagttctccctaataatcactatgggatgaacttcaaaagcttagaggtttcacttggctcaattcccagaaaatcaagttatttaccaaatcttatttatgcaaactatacaaacacattttgatctgcagagtactaaaataatgttttaggaaaatgataaccttaaatgaaaagtctaccacataagaatgggaaaggtcaactttctctggtctgattatcttgtctgtctacattggtcaaatcagatacacacctattaccagatctgctattactttatgactatgaatctagaaaaacatacctaaaatttgactaattatgttgagtaataatacaaagggtatctcacacacacacacacagtattttagcttctctgtttctgttgtttggaattacaaggtggagtagactaaattatttttagctgtcaaccactttttaagacattttttcatctacaaaagtttctagtacagtttgggctcacaagctgactcttcatattaattcatttgaatagagaattcagacaaaggtattagagaattcagacaaagtcacataggtaactgcggtaactggtgttgcttgagtctcaaatatattttgtgtttattttatagactatata

SEQ ID NO: 56652 - DNA, 918 bp, Bovine  19866880472568
ccatagacagcagcccaccaggctcctccgtccctgggattctccaggcaagaacactggagtggattgccatttccttctccaatgcatgaaagtgaagttgctcagtcgtgtctgactcttggagaccgcatggaccgccacctaccaggctcctccatccctgggattctccaggcaaagtactggaatggttgccatttccttctccaagaaatatggcagttttacatattatcctacttcttcaacagtatatacattgtgatttaacacttctgtaatgattggggacaacatcatgaaacttcactagagcactgggttccagaaagcagaactgcttatgccatctggctttggggaaggtttgggtatgattctttgttaaaagaatattttgaagtttgaaatgagaaaaagagactaagtggctggaagaatatgagcactgtttttgcagcatagcctcaggagagataaagtgaattgattcagagtacagttaggctttggggactgcatttctgcttctgagaaggaggaaacaaagatgaaagagaagaggctgacatgggtgctgctctcctatgaatggcattttcctgtaagagaacaaatccaaatgtgaggtcagaaaaactcaagtgagcaccctaccctgctccaagctaaggcatgtgcttatagattcccaagctcacttttcataaacatccagagttcttcatgccctcaatgcttttaagtcttccaagtaacctcttattttgaactagaaatcatatttttaagtcaatttttaaaatataatcatggtacacttcactgctgtaataggtagaattcgggatagttcccaaaatattcccatccctctccttgtatgcaaactttctcccaggactcaatcagaca

SEQ ID NO: 56653 - DNA, 1123 bp, Bovine  19866880487468
tgggaaacattaatgcaagaacagagggcctggatctaaatgagaaaaagacctaatgagaagaaaatgggaatttaagtgaaaattacagggtgttgtggttttttcatgagtataaatgtgctgcagttctttaaagctgaggccctccttttaaagactgaagtgccaggtttaatgttactactccttgggagaaaattagggccccttgaaaattaaatcatcacttttacagtcactgccaagtttcagtttactgatagtagtcttgtggctgggatctaaaagagttactcctttcaaaactgtgcaaggcagtagctcaaagagtggataatccaaacctgtgtcttgaatatcataatctgtttctcatgataccagtggtactaagtagcattcttcagtgtcatggaaagggaaaccaagaaagcaagagtctgggtctcatgaggacttggacctggaatcagcagctttgactcccatgttattctgaaattgaaatctatgcatatgcatagatgaaagaaactcaaggaacagacagctatgccctgtatatctggtgatttggggacaatcattatttgcttgatcatttctccttgagggactttgttgtcaaattcccaagaaaatgctcccatagagatgcatttagaaatcctctaaattaaatttgtcttaagcacagggacagctattcttttgatgacaagaagttgtctgcccgcactgttctttccctcaggtttttctggatgaagttgttcagttgctgagtcatgtctgattcttcgtgaccctgtggatcccagcacgccaggctcccctgtgcttcactgtctcctggagtttgctcagatttatgtcctttgagtcggtgatactatctaaccatctcatcctctgctgccctcttcttcttttgccttcaatctttcccaccgtcagggtcttttccaatgagtctgctctttgcatcaggtggtcaaagtactggcatttcagcttcagcatcagtccttccaatgaatattcagggttgatttccttgaggattggctggtttgacctccttgcagtccaagggactcttaagagtcttctctagcac

SEQ ID NO: 56654 - DNA, 1877 bp, Bovine  19866880565941
tttagaagctaaaatggagaagggaatttccataaccaaaggggggtggtggatcaccccttgtcatggcacaggtctgcagtgaaaagccaccatcagaaatacactggtcttttcactccttacatgcacagcacatctcatcaatcctcgcggcgcttgcagagggagcccctctaagggggtgtttcaggagatgactgatagtgaggagagagagagaaagtagattcccctttagaaaaggagagacagagcagctacctctggcttcttagggcactaagcctccagccgggagaggccagacacctcccagcacggacactgttgacataaagttacaatcaccactgaagttggtttcatttcgcatccccaaaaccccaagaaaaagaggcagcctcagcttccttccaagtaggaggagagcaaaaaaaaaaaaaaaatgaaagaacaaggccataagcagacaccttccttgcagccgctgggatgtgaaggccacatccagtcttggcactcaggacagagatctgtcttctctggggctgggcgcctagttccctgtatcacccccagaaacacttaccaggagactgtgaagcatacaaggctgtattattgggagacttgcagacagattataaatttactgaggacaatcaaggcatttagatgcttttggccgcaaatgccagtgacacacacacatacaaacctcattcttctttccattcgagtgattctttacccactactccccacccccagcatctttctttcatgaaacaaactcccattgctgtcctagggaattccagagagaggtgaggatatagcaggtggaaaggaatggaaattaggcctgaaagcatgaaataaccccacaggctaactgtatccaaggataaaacaacaaacattgagcagtttaactgttagctgttatctctcatctggaattggcaccaggaagttgcagttctaggcatcccaggcaaaatgtgtgtgtgtggtggaacagaacagaaccaattcagcccccagactttctagaaacttcaccaccagagacccaggccagggatacggaggaaccacagagaagcttccaggggcctggctagaggatgctctctccccagagctccttctcaagctccctccaagaaagagttcgacccagtgccttcctctcctttgggctttttgaggacatttcagcttggatggccatttcctgttgctgactttcattagggctggcttgggcacatggaagctgttccgcgagtggacacgggacttctgaagccccaaggaactcagaaacggaggaagcttgcagggccacagggctgcggggctccaccttctacccagaggccatggccccagcagctttggggggaaagcccgcacaggccaggcgatcacctgaccaggactggcatcagaaaccaatgagtcaaggactactccctttggggtggggtgtgtctgcgcctctgaggaagaacttccagccagaagcctaatcacaactctcaggtcgggtactctgtcgccaggagtggcagaggacaaggcactttctaggacgaaaaactggaaacagccccttggtgcctgcacactttactgaaggctgcaagtcagcactctctgattgcagtgcctgcggaaagaagctaggtggggacagtgggggagtctgtagggaaaccagggagcaggcctctcaaaaacattccctcacccgtcttggggagaattccccaagtttttgagtgagggggctctcagggaacttgctctgttagggatgaccacttgtgttctcttgacccaaggagaaggggccacttcaaaga

SEQ ID NO: 56655 - DNA, 2237 bp, Bovine  19866880584206
caatccgagtccatcaccggtagacggatgcaatgcgacaacggtacaacggggtgtcattcagtaataaaaaggaactgaaacaatgatgataaaaacaaactgaacctggaaaacagtatgctaattgaaagaagccagacacaaaggccacatcccaagcgattccacttctatgaaacgtccggaagaggcaaaccaacagagattacggagtctgctagggtctgagaggagacgggaatgggcaggtagtaactactaacaggcatggggtttcttcccaatgttctgaaattaatggtggtgatgactatacaactctagatatgctgaaaatcactaaattatatgctttgaaagtgaatgttatggaatgcaaattatagctcagttttaaaaacattttttttttaagatatagtaaatcctacttgaggctctcaaaacctaaaagtatctttggaagttatccactgattatctaacattcaataaattcttgattggcttgtgtgcatagaaatatttactgaagatgtaagggtgattttaaaaatttagcatctatcttcaaggaacttctagtccaggaagcacttactaatggccattatcgcagtgttttgtatggtttattttatttaatcctcacaacagtaagcactagtaagtacataagttaagtactattatccctactttacagaagctgaaattaacttgctcaacttcacacagtaagtgaaagatctaagatttgaacccaggcagcctagctccagaccaagcattctttgccactaggctttacagaaaagcatgaaaaacctatttgagagtcacattttttaagaatggaaattgaagcagcgggagacactaatcaagataatttagaacttcatacataaggcagatgtgttctgaggaacacagaagtaaaacttgaaacgtaatcgttctacatttcttataaataccaaccactgaaaagtggtatccctcggcaagtggggtaagaaatttaactttctccttaatatcttctcagtgtttgaatgttttatgctattattttacaatttaaaaaaaaactaaaatggttcatatgtatgagaatgtatttgggaattgagctgtgcgttcattcaaatgtgtattttttgctaattatatcttgctgcccctgcttttgatggacttccatcctgcaggaagtgtggtaacaggtacacgagggctcctaagacaccacatacttgagttccattcagcagacgctgcctccgacccatcctcatgacagaggtgctttaagatggatcaagctcagacgtgtggaaagaagtgagcatactacagtatataaaagaacacatggccaaaggcatcatgcaaaagaacaactgttccgctgaacgccatcccaggctgcactcactggagaaagcatgtatagagacaggcgggacaggcaggggtcgtgtgttacctctttgcctctctgctgttcactgttacagaggaatgttccgaataaacagctatacaggtggtccaaaatggtaatgagaaaatactcattgaattcaaatgctgtaggaaactgcaaatcaaacagcaaaacacagaaataattaggacagcttcccaagcatgttcatccctgtacattggggggtgctttgtaaaacttcttaaaattaggctaaacagtattcaaaaactatatatttctaagctattacagtattattaatattaatatttgcttggttttcagcaaatatcactttgctgagataatttctcctaatatctccttttcttgtacagtaagaatctgaatgctgtgatcttgctgttcttctgtccatttatatcagttaaccctcaacttgaggctgatctgacttgtctttctctgccaagaatgaccataagcaacatagtaagatttttctttaaattttcaacagcatagtttttaggaattacacaaaaaatatcaatgtctcgagaaaaggagatgtgtggctcgtttaaaagccaaccttactcatcttttcaaggaacatgcactcaaaccatatcttataatccagtactttggcagcctttcttaaaagagaaaattcactctctttaactaggacaggtgtttgactggatgtcttacacaaacaacacaatttgggggtaatttatcaaggaccaattacagatcccaggaa

SEQ ID NO: 56656 - DNA, 1698 bp, Bovine  19866880612383
tattttcgaagcaatgactcgcctagaaagaatggcagtcatgaatggcatgaggatgtcagacaccctgggcacatccaatctagaataagagaaactggaaaaagagagtcttgctttgttttattttttaattcattaatttgtcagaatacaagttgaagtgagaaaactgttttaattcatgaaagcctagattttatttcttgtgagtctggtaagtcaacccgcaggtctggggaaaaagaactccaaggttgctatgaagagaaacttgatcttgaatcaaagaagcagattcatgtctaaaaccaagattggtctaaatttttctccttgctgttgcttattttggattcagatcttagatggagcttaaaggaaagaccagcagctctctgccgaaaagtgattttgaatgtactcagatccaggttgaaggtgttttccaggctgatgggtgtcttcttagtacctggagaaaatataggtgttcataattgttagaatttttgtttcaagatggcaaagtgcctaattttctatgtagttccactattacagtagtgtcaaacctcttgtaaacaagtgtttggtaaatgttgttgaactaaactggtgagcatgcattattgaagggacccaatcctttatatttctgtgattaaatgtacagtgcaccaactgtgaaacattggtctttaagatattcttttggttcaacattttaaaattacacttactaagtgtttaacatgtcaggcactcttctaagtgtttttttgagtaataactcatgtttcctcataatccatgatgaagtagataggtatgaccttatctagattggacagatgaggaagttgaggcataagatggagatattggccaggtcattcagtcatgcatgtggagtccgggtatgaacagagtgaatgaagccaccgcccatgtatatagtcatggtaaatgactacatctaggagaaggtaattatacaatgtcagactccagctcacacatgacccaggcttgagtttggaagccacgttcaatgagacatttgaaagtcaataatgattaggatcatcgtctgaagtgcagatagaattcagaatgaatgcctacgggccacaggttattctttgagacagttgccattttcccatttttttaaagatagaaagtgcttgaacatataggatctgtgagtaacaaatatgtttcaacttgcatgccaggggagattgatagtagttacccagaggactgcctaaaggattctaaggcaatattcaaactgggtgggaaagagggccatggtggttcattactgatatccttaaaattaaggaatccaaacctggaggatctggaatatagattcctggtgaaatgttgacttttcccatggaaaatgtatcaagaactgattacactgtgagtgggccctttatagaagaaatttaggtttacataagttcattggaacttaaaagcctcttgatgaaagtgaaagaggtgagtgaaaaagttggcttaaagctcaacattcagaaaactaagatcatggcatctggtcccatcacttcatgggaaatagatggggaaacagtggaaacagtgtcagactttatttttttgggctccaaaatcactgcagatggtgactgcagccatgaaattaaaagacactta

SEQ ID NO: 56657 - DNA, 2431 bp, Bovine  19866880692041
aattaccttatacctatttgtaacattactgcagtttttatgcacaatagaagtagtcccagtttttcttccattaaaagagatcagaatggtaaatataaatcatgctcatttacctcctctgtgacagaggcagcttcaacaacacagcttgctgagatttattgcaccagacaactgtttaggatccatggaagctgttcggggcgcagataagcacagcctaacctgagaaatgctaagtctacttcggtgtggtctggatgaataggcattcttcctggactatttcctgaatggaagtaatctgttttgcagtgggtctgagtgccttttgttacagacactctatgttctgaaccataagcaggaacttcaggcttcgatgccatcaagcctcccctgaaaggccagttaacagctgtgaaagagttagtgaaagcgtttgtcattcagtcgtattcaattctttgcgaccccatagactgtagcccaccaggctcctctgtccacgggattttccaggcaagaatattggagtggatagccattcctactccagggggatcttcctgacctagggatccaacccgagtctcttgtgtctcctgcattggcaggcagattctttaccactagccccacctgggaagcccttgatgacggtataacaaacagatctattcacagataacaaagtgttagtcattcagtcgtgtctgattctttgcaaccccatggactatagcccaccaggctcctctctccatggactttttcaagcaagaatgctggagtggactgccatttctttctccaggggatcttcctgacccagggatcgaatccaggtctcctactttgcaggcagtttctctaccatctgggtcactggggcatatacttttaatttacgactgtgaaaagatgcatcatataagttaggaatttgttagcatatataaactctagagaaaagttctaagaaatatatttgttcatatcagttagccttggatcatacacagagtggcgagatagtcattctgcttttgatacgtgtctatggactgaaattgattggtttggccccacggtctgtaagtggaatggttctgccctggagtttgattactaccaacctagtctaaagagagttactcacagacagggccaagactagaatgaggaaatcaagacacatagggcataaactttaagagtgaactcgttctcaagtcctacatttacccagtgtgagtatcttcataaattctacacttcactgtagtcccagtcctactgacaggaaagctgacatttacacagattcagaattgctaatttctaggaaaaagtaatctgtttttaccaatcagtcagtctctctgtttaatttttgtgtgatagagtccaaacaatatctgagacccttggtcagttggtattaaaatcctttgtaccaaaggactcattcaaaatcatgtggctagctataataaaaaatatttaacatttatcaagtgcttactgggagctagaagtggagctaagcattttacattttatcctccacatattcctattcccatggtggagatcacccacactgaggcatagccatttagataatgtgaccaggatcccaaagtcaccaaggtcccagagtcaataacagattcaggacctaacttcagagtctgactccaaagtccccattcttgaccctgctgttatggcaccaccatcctggccttttaccgggttatttctagtccctccctccatcctactcacctccataagctctggggtcatgaatcctcccttatgatgtcatctggtccagggagcctccctttctcccaacagcttattgtcctttcactgacttcccttccagttctttccaccgtgcatgctgaaaactcttttcctttgtacaaaaaacctctccccatcctgtttccacgtggcaagccactgcctttgcctccaacccttcagtgaaacctggttctctcctaagaacctttccttccttcttttcctctcaggtaaaagacggataagcttgatgtacctcaaagccctgatgtaccacgatgtaccacttcgtgtaccttatgtgtcagcgttatcttagttccacaccgcctctttcagcttctccctcctcctctgaaattcacaccattcagttttattgcctttaatacgttttgtcatagctgtctgccgctattcaggtcacttccacgctttgacagctgccaaggttatctcttcctcccatctactgtcatcaccccagcagatttcacattcctgaaggaaatgcttcaaacacgccagctcttagtttcatgacttctgatttcattagcgttcacctcagctcctctgagaactggattcccatggtctcacc

SEQ ID NO: 56658 - DNA, 2478 bp, Bovine  19866880734812
tcatgttctggaggtctaggaattcagcctagtatctaattcatgttacagggaagcctaacatccctttcactcgttaattccagagtcaactaaagttgacttttactcaggtcttttacttagtcttagcatcagcctttctaggtcctatatttgtggaattgatttttttacacagaatttttaattaaatgaagcacactataggaattgattcaccctttgccaacaaaggtccatctagtcaagtactttggccacctcatgcgaagagttgactcattggaaaagactctgatgctgggagggattgggggcaggaggagaaggggacgacagaggatgagatggctggatggcatcactgacccgatggacgtgagtctgagtgaactccgggagttggtgatggacagggaggcctggcgtgctgcgattcacggggtcgcaaagagtcagacacgactgagcgactgaactgaactgaagcatttccaagtaaagccttatagaaacgtgaagggctgtctgaggtataatgaggtttcatcagtagtgtgtttggacagagtctaggaccattatgctgaatgtttacataatgaaaacattggacggggaactgttattaaatgggttccaaatataactgaacatcagactgagactgggcaccaattaaatatactttctaggccccacacctaaacaattctgatttagtagaattgtggtgaggcttcataatctgctttttcaaatgcacagtcaatgattctgatacagctggtcatcctttaagaaactgtttccagcccaactcagagattctatagcaaagcagaaccatggttaggagcaacagatgacaagaaaaaacgtaggttaaaaggtatctgcaatccaagaagaggttaataaatttagggtaaaggacagccaatggcaaaatttttaaggaatgatttgtgccacgcacatctataaaggacaagtggaaacgctaggaaattgttccttccccaagctttcactgagaatttactgtgggttaaagtaaataaataaaatgtattcctcaagcctctgaaactcactatctagagttcggtattcaaggtattgaaacagccagcaacacaaacattaatgaaaaaagtggtataaactaatacaatgttaagcacttcttagaaatcatccagtacttgctgatatttgacaaaattaccatctccacatttttaagcactaaaggaacttaagattcaagtctatgtgtggctgcttctccgagaatcaatccttaagcaataagcatgtgaagacaaagaggacgtgacttcttttcacttaaatgtcttcaatctatacctaaatacaaatcaacagagctgatatgaaaattctggtgctacaaatatacagtttcccatttcctttcctatccataaccataccttcaccaaaccagggtctctgcttttgttcattacttccttccacatacactccacctgctttaaagtgtcccaccgagccttccccctgttccccagtcctataaaactttcttccatctccttcttacaacactaggatcccttggtaaaaaagcagagtaagttttcaccatttataggtatacaggcaaatgagtggatttaattcaaagatctaagttgtacaaaaaaattcagagttcaaccaactcacctttccagctacaaatggcatatcacccaagcataatcgataatgtggctgtacagcaaaatagttcctagaacccttctgcatggaagagaaaaaaggaaagaacttttactcatatgacggtaagagctgcctatataagactaacctgcaacttcacataactgttgggctcctgcttgttttatctctactggcattacggccagtgctcctcataatacttttcaacacacatcttaccccaaggaaaggctaagaaagaaaaaaaatagtacctgacaaaacagcagttagtgtcagtagagaaattctctgtgtgtctatatgcacgtacatacgtatacacacacacaaactttcaagagcaaagggtaattaatgcaatactgaataataactaatatttgtgcagtgctacgtagttctaaaatgttttcatattcatcatctcactgttagggttaaaatttagaaggtattacttatccccattttcccaatgaagaaacttagaatgaaacagattttactcatccaagattgacggaccacatggtttatgagtactttcacataaactatgcctagcaataaacagtaccttatggttcttttttcataccttttgtgggggttttgacttcttttttttaattctttttgtattgggaacacatgaagttgccttatcttcatagataagtctatttacttctagaccagtctgcaactaggaaaaacatgagagcctaaagt

SEQ ID NO: 56659 - DNA, 1735 bp, Bovine  19866880735379
atacctccccccagaagtgataatggtattgtcacatcatcctttatccccacctacctgaggttgttgtaagcctttgagtattgaacagctaatgagaaaaatataaatggtcaacagggtggtgaaatcaggcaggatgttgtatgagacatatactaaaaagtgacatctgatgtttacataaaatgcacatttaattgggtgtcctgtgtttttatttgctacaccaggcagtcttgcaacaaacagccatttgaaggacagggacagtaataatcccagtatgtccctgaaatgacagccccagggcagcccttgacagaacacatggaactgtcagccgtctctgatcccctgacccccaggctcaccccaatctagacggccttccaggttcttaagggaggacacagcaccaaatcagcaagttctagagtctggtatatcttacttgtatatcttgagtggtgaaaatcttcggggaacttccctggtggtccagtgattaagaatctgcacctcaatgcgagggatgtgggttcaatccctagttggggaactaagatcccacatgctgtggagcaactaagcccatgcaccataactatgagcccacatgtcacgactagagtccacatgccgatacgaaagagcccacatgacgcaacgaagacctgatgcaagtaaaagaatacagtttagagttggaccataaagaaggctgagagctgaaaatagatgctttcaaattgtggtgctggagaagacccttgagagtcccttggacagcatggagattaaatcagtgaatcttaaggaaatcagtcctacatattcacttgaaggactgatgctgatattgaagctccaatactttagccacctgatgtgacaagctgactcactggaaaagacactgatactgggaaagattgaaggcaggaggagaaggggatggcagaggatgaggtggttggatggcataatcaactcaatgaacatgagtttaagcaaactctggaagatagtgaaggacagggaggcttggcctgctgcagtctatgaggttgcaaagaatgggagacgactaaacaactgaacaacaattttaaaatatgtttttttaaaaaaggaaagtctttgggggatgagagaggtgggattttagaagctacctctaggtccactgcttcaggctgaatcttacggagtagctcctgagacgttattcagagaaaatccaagctccagtgtgtcctgtataacttctgctagccattctgccctggggactggcttcgattcatctcagcctgctcatgctctgcccaaaaatctaagtggctcagaagaggtgataatggcattttcttgtcttcctttattcctcatctacctgggctcatattaagcctttgaggattgaataactaacaagaaaaatataatttgtcaacagtatgatgaaatcaggccaaggcaagacatgtgaaaatgaattaacatgagcagggtagaatcttaattttcttccctcagtcctggcttttgtgcttgccacaagtctaatggaggccgagatgaaccatgccaatgcctgggatttgtgacaaaacaagaggagataaagagggatgaaatcatccatggaagaaggaagcaattaaccacataaagaaagtgaaacatcatcagtgataagcctcggcagcaatttactcaggtttgggaa

SEQ ID NO: 56660 - DNA, 1586 bp, Bovine  19866880771036
tctaaattaatgttttaaaaggttattgctattttttcccatttagctggcatcatttataactcttatttagacaaggtcctacattattttactatttcttttttgcacaaaagctagtatttgattgcggttagatcatcggcttctggttttcattagacaaacctgaaataccctattattaagattaaacaaaaaaaaatagttgttttcttattctgaaacctattattttgaggctactctgaccagaggaaaagaagtcagctttgcagaacctgacagagagctccttcaagaggagcagtataatctcatcgatgctgcacttgggtcgcttgtgtatatgggtcctttcctagaactgacagtggggaagagggataagttaattccttgacatttgcaatactttctttattaagaaagaactttcaaggtgcagcatatgtggtaaaatatactgtttattgtaatgcctgcatccctgtgaggtgctcctgaaaatttacaattagatggcacttggacctaagggttgtaagggtcttccagctctgtgttatttatacttcttggtatttattcaacataaggatcagactgagccattaacagttgagtggcagccacagtagcctaacaggaaaacaaggtcaagataacatacgcaaatcaggactcccctaactctcccacccattcacgtgggaacttttgcctcctcaatatctctctaatagatcagaaattctctagaggcatctcttacggaggaagagatgtatagtatgtatgtatgttattatagtaagtatgtctcttcctcctgacttattctgactggtccatgggacctcagtgacaaaccatctctctaggatgcctgcctcagccaagtgaagaggaggtgggtgccctcccatgagtgtgcagacttctatagctctaatcatatcaccctgtgatcatctcaagtttgttggtttcctaaactgggttatgagcaatgtgatgtgagggaccatgtcttttcaattttagatttgttgcatctagcccactacatgccgcatagtaggtgtttgcatgctaagtctctagcccactacatgctgcatagtaggtaggtgttagcacgctaagttgcttcagtcatgtccaactctgtgtgacactgtgagctgcagcccactaggctcctctgtccatgggattgtccaggcaagaatattggagtgggttgccatttctttctccaatagtaggtgtttattaaaggttgactagtgtcttctcagactagctttcttgactgtgccctcaccttcaccagtctcctctagttttcccacagattcccctgacaatagctggccccactggtaacgtcaaccagagcatgggcacccactgacatcaggggtctgtgtgggtcatggcccctctgccaatgcatggacccggactcaaatgctgcatcattttgttcacttattatactacctgtgtctttacaccaccacccttctttctaggacattctaagcatggccttaagaggtgataaggaaagcagcctg

SEQ ID NO: 56661 - DNA, 1994 bp, Bovine  19866880794081
tcagtgtttgcttgtttgtttttcttttttcttttagcattgtggagaataacttgtaatagaaaggaaaaatgtaaataaagtaaacaaagggatagagatgaaagctaccaaaaagctttccaaaattaacaacccatttgtataaacatgtgaaagtaaattactttcatttgcatgaaattactattttgggctagcgtaatttttcccaagccaaatattgatgaaacctagtaaattctgtcccttttaatctaagttgaactttttttttaacttctcaagaggtaaataaatgattcttccaaaacctttgcaattttatgggaaagtaagacagaccatgcaagagagacaagattattgccttaatttataaacagtgcagaattcagattgtttttcattgctatcgaaaacagtaccatactttcaatgcaacttgatgccagttctgattgtgactttcctccttgtttctatggtaacaaactttactggatcagcactatataaaaactttttgcgttgaaacaggctaggaaaacctgactctgtgtgcctgatatacatagtaggggctgaataaacatttactggatgaaagagtaaaaaaaaagtctcagccatacaattgcgtgctaatcagatgtggtgctaaaatttgcatatgcaaacatcttcatgggacagaacaaactttagcaaaacggtaaggtgtagggttgtttttgcttcactttagacccagattgtagcacaaagagagctaagttgaaggtttaaatggcttaattgtgcagcaagttagaagttaaagggtcagagtaatgttaagtaaatgaagctgttttggagaaaacctgtaatgctacattccaggtctccaaaggcacagtgccatttttgtgtgtgttaaatcagtttaaggccaaatactggtgtttgctgacttccagagcttccttatgtttccactctttgcaaagcaacatagccaagcacacgatatgtggtgcgctgcttctgagattttgcttggaaggtatttaaatacatgttgttttttgggttttgttttgcttttagctcataatttggtctgtttttttaaaacttttaagtttctggcatacatgcgtgctgagttgcttcagttgtgtccaactctttgctatcccatggactgaagcccaccaggatcctctgtccatgggattctccaggcaagaatactggagtgggttgccatctcctcctccaggagatcttcctgactcagggattgaacctgtgtctcctgcgtcacaggcggattctttacccaccaaactactttggaagcactaagtttctggcagttgaccatttacattttaaaagatgtatgaaaattatcatccaggtaaggtgggtatcttttgtgagatcaaggaaaccttttaacatggaagagtaaagtagtatgtgggtatgtggaccaaggtttttttttttttttaaacacattatcaattaacgcaacaaatatttacagagttcctgccatgtgccagatactgtagtaggcatacagtaaacagaagttcagctctcatgaagcttacattctagtggggaaaccaaaataaaagcaaaataaataaatgttagatggtggcaatgctgtggaataatatgaggcaaagaaaggggccagctttaaatagaatgatcgtgcaagcttcactatgagggtggcctttgagcagggacctgagtgaggtacaggagagtgctgtgcacatagcagatggaagatcatcagcagcctgatctaaaagagcaaagggtctgagacaggggcatccctggcatgttctaggaacagcaaggtggccagcgtggctggagcagtaagccagggagggagagatggaattgatgtcaaagaggtgttggattctggaagaggacgtgggaggcggattgtgaaggaccttgtagaccat

SEQ ID NO: 56662 - DNA, 957 bp, Bovine  19866880811965
tatgagaatgagatttcataaaataagccagaaattgtttatagccaaatagaaaagtaatccagatgtaggtgcccattgactaaaaacaagtcctaaaaatcaaaagctggggtgtgatagtaattggtcattttcttgtgagatcatagaatttcataaaatatttgcctaccagggagaagaaattccatactttgagtagtgtacttcactggatatataataacggacttttgtgagttttaaatggcagtataatatcttttaaatacacttcctaagttcctataacagatgaagtacaggtaatgccctactattaacttcattgtcaataataacattactaaaacaccacaccatgagaattaagaaaacatattgacattagatttttaaaacgaaatgctgtcatctctgacctgcattttgccttttcatactgttcatggggttctcaaggcaagaatactgaagtggtttgccattcccttctccagtggaccacattctgtcagatctctccaccatgacccgcccgtcttgggttgccccacgggcatggcttagtttcattgagttagacaaggttgtggtcctagtgtgattagattgactagttttctgtgcgtatggtttcagtgtgtctgaacattacccaccagatattttacaagggaaaaacattgaaaattgcttcaacattttcacatctcttatacagcccaaaatgagaagtctgacccagagataatcatcgacaagaaccaagttcataatttccgtattcagggcactttgaagggtttagtgggaagcaatcaagatgactaaggatacctttattcaggataaaaattaaggataaaggaatttttggtttcttgaaagtaagtatctaaccgtaatcctcacttacaaaaatgtctacattcttgtctacactactctggg

SEQ ID NO: 56663 - DNA, 1429 bp, Bovine  19866880817895
ttgcatgccttattaagcatatttatgttcctgagttttcccagaagccccttgaaaggttcttagaagttttttgcttctaattgtgccttagtttcttggaacaatgaagatactcgtttatctgctgatttgctgcaatgatgacatagcaggggtttatgaatattttaaaatagaaaaacctttgtattggacatatgaacactaccatattaagtattactttgagctagtggtagtcaagttatcctgcttaattaatgcatgttctaaaaagaaataatactgtatagattcatcatttaacatttaattaaacaatgtgattatttctctacaaagtttgacatctgtttcttaatcaggtacataataccctcttattatgctattatatttttctaagaaatcatagttcatatacattttattttctctacagtattttccccataaatataatcaggtcagaagttactggtattatgttttaggtattgtgtgttcagaggaatgttgacaaactagactacggtcagaagaaaaccaggagactggggaagaagatctaggagctgtgattagatgatgggaggatagtgacttgagacgttgatggctgttcccaccattaccgcccctcctccactcactgctccaactgccatgcctgtctgtccatcagggagggtgtccgcctttgtttccctgtgtctgtccggagtaaagaatgtccctctgtttctttagtccttcccacttattctgctttccctccccagcttgtagtgcgtggttggaagcttggatttagttcccgaggtctcttggaatcactgatcctgtgattttcaagcataatttaaactggtggtcagaatgctattaaattttacttgtgaaagatcagagtgtagtttttaatagtgtacaatagagaataaattgtgggctctttttcttttcagccaaagatgtaacttatatatgtccattcactggtgctgtacgaggaactctgactgttacgaattacaggttatatttcaaaagcatggaacgggtaagacttgctggattagatttttttgtgtgtacatctgtgtattgtttgtacatctttaatcatttttagttaaaacatttctagttaaatatttttctcagctataattatacagtattaattgctcagttttaatgttttttttttcccttcttttaggatcccccatttgttttagatgcttctcttggtgttataagcagagtagaaaaaattggtggtgcttctagtcgtggtgaaaattcttatggactggaaactgtgtgcaaggtaaatgttgtaatatgtatgcatttttttttggtttggaaagctttctattaaatagagccagtgtttagaaattgttttccaaaatat

SEQ ID NO: 56664 - DNA, 1731 bp, Bovine  19866880903849
tgaagtgtactgcttagtaacagtattttgggtatttgagcttctaattcttaaggacttcattgatgccagttttaagaggccctccaaccaatgtacgaagaatgaaggctaaaatgaaaaagaaatgtagtagaagaggaatgagagagagaagtcagtgagttaatttaggtgcagctaacgttgcttctaaaacatgtgcaccctctcaggcccaccttggcagggagtcaggaaacctgggtccttgctctcttgctctgctactaaatagattaagcagatttcttcctctgtaacatgaagacgttgaacaatttctgatatgaactgtggttttaaaaaagccaaaacacatttagggtttgccaagacctcttaatgcaattgctattatctttataaacactatcagtagaattataagcccataattcagcgacctctttattatcctgaacataattaacttgatattacaggttaggctgtgtcagccatttcttaataatgtcccctttccaaaggagagcgcttcttcaatgtgctttgtttcacaacactttctcctatttctgttacagaatctgcctgaagcaatgccttttacttagtctgtttggatgtctgtcatccacgctaggctcccttatttgagggcaaataccatgacttacttatcttttagactccttgcatagggcagggattgacatggggtagatgctcaaaacactgaaaaaagtgaaagtcgctcagtcgtgtctgactctttgcgaccccatggactatacagttcatggaattctctaggctggaataccggagtgggtagccattcacaatactgaaggaatatttaataaacttaattgggcaatagcatatggggcttcgcaagtgcactagtggtaaagaacctgcctgccaatacaagagacataagagaggtgggttccatccctgggtcaggaagatcccctggaggaggaaatggcaacccactccagtgttcttgcttgggaaatcccatggacagaggagcctagcgggctacagtccatggggtcgcaaagagtcggaacacgactgaagcgacttagtacaagcagaagcgtacgtgtcagacaccttttatttgccccatctgtttggatccatgtccacccgttttcaccctgttctagccagaaggttcttgcctttcaaggtagcctactgtgtaggactttctcttacttggcttcagaatcttgttcctcttccagcccttctagaaatgctgactgtctctgctattagccctgggttcctgctctagcccttgggatttccctgaatcttacctacacctgggtgattaacccttcacccactccacgaattatcctaattgaagcacaccacctatttcctgccaggaccctcactaatagtagataagagaaggaaatgatttcagtttaaaatgtgtcttgatactgacattattgagaataaccaccctgaattttttgataaatatttcaacaagtaaatccttgtaaaggctaagtgtttttgcatacgactgaccttcactgagtgacccatcctccaagtatgctgttacacattcatctcagtgtctacaccacaaatgcattttgcatttgactaaggaatataattacttatatttacatttggccattggtgtttaaatgtctttctcatgtcttataacct

SEQ ID NO: 56665 - DNA, 1333 bp, Bovine  19866880966858
agaatcattttgttcaaaggagggggtgctgtcactcagagatgcgtgtcaatatcagggattaagaacacctcccttgagcagtgaaccaaaagaatctctcctccagaggtggaagagaacatgccattctcattcaggaataaaacagcataaattataagaaattataagaaaagtcagtctttactttgagtaagcactcagtcacttttctatctccagcacaaaagtcacataaaatcattaccaaaaattttttaaattaaaaagatctgggttaggaccttagttctgccacctagtagctgagtgagcttgaaaaaattgtttaacacatctcagtatcagtttcttcctctgtaaagctacagaaatagtaagatctaattcataggcctggtatgtggatgaaatgagataatgtatagaaagctttggtgcaatatctggcattgggcaaaggttcaataaatgtcccctgttatttacaatccctctttctgctatggctgggcagccggaggggcttcagacactgtggatcaaatgtgtggtacatgtctgaaactcacctcttagaaggaatccttgctgtttcttgtaataaatgatatggccaatgaggaaatagcagtcagtggtatttgtgtctttccatggtaaccatttctatttacccctcttagctgaggaaatgaaggcaactgcagctgaattagttggaacatgccattcactttaccacaatgtggtgagaatagagactatcatgataaaatttctatgtgtcaggtcatgggcaatgtcagaatttggcggagaaaggggatagattaatttacatacaatgaaacttcattggctcattcttttatttcagtatactatttggacaagagtgtggcaaattttaaatatataagaagtataatcctctaagcaaataagtaattccagaatcttaaagtatttggaaactttaacgtggtaggggaaaaagataataaacaagtaaataaataagcaaataccaagtatttctagtttgtaataagggctataaaggaaataaataggattctatctcctatacttactagcagtatggtcttgaataagtctcagatccatggaataatagaatctgaagccatcttagagatcattacaaaggctttatgaactataaggcactaaacacatacgaagaatgattatcagtaatttataattgtaagcctttcctacctagtaatgtaagcagacattaaagacttctattgagagcccatttttctcctcagaagtacagtatgtttcttaaagacat

SEQ ID NO: 56666 - DNA, 834 bp, Bovine  19866881040211
ttttccctaaagattttcctaaaccgtcagatttgcttcttttgatccggcgtattaaagacagtaaagagaaatttagtcttgggaattactattttaaacaaaggcccaaaacagtggtgtctatttttaaagactcctccttcctctccagtaaccaagcgcaaggtaatttgaattctgtttccagttaagacagttaacttgattctactctacaattcagtggtctctcctttatacttgatttctatgatattaagtatacacaacatttcctttccttttaacccggtttccagttacacttttctgtgtatctgagatctgtactgtgacctgcctgaactcatggaaagttgacgacactgaaagagaattgttgtagttaaacatcctgatggcactttttgaaaacagcaatggaagaaaaaaaaaataaataagtaacagggcactcatcagatgtgatttttggcagacatttcacttggactgctcagggtatccccagaaatcacaaaccctcaaaggtgttcagggtatagtaaatcgagcaagataaattattttaatgttcaacttattggattcagttcctttctctgcaagtttttagtgacatggatttcaatctaagtgaaaggtcagctttgaagtaagtgtaaagatatttacaggaaatgaagcagaaagtgagctttcatgcattttcaaatgtgtctattattcaggggaaaacgaactgtgtcatcagtcaaaagaacaacagaatgcctaccttcttatattaaagttaaatgaatacctacaataccagtagtatgctattaa

SEQ ID NO: 56667 - DNA, 2346 bp, Bovine  19866881138564
aatgtcaatcgatagcaacaccccccagatttttaatggtgaagagagagtgccagctcccctgggtggtctgcgccagtgctcagctgaaacaggacccaagaagtgcagctgaaacaaagagcttttctcttccctcctgccctgatgctccatccagcacgttctccaaaggcctcaccctcccatcctcaggctctagggatggccatcaggaggcaggtacttgagctactccttcctgaaggatctcgctggggccatctgtaggaaggcatctgctcacacccttgggagcaaatctgaatgcactagcaacagtgagtctgtgcctgtttttctggaaacccaactcccattcttgactttatttctgttagaccattgtggtattgtgatttataataagaactatatatttggtctctattccagtttatggcgccaagctcctagaactcttggagcttcctaagtgatgagagtaataaaagtgtctttagtcatgttaatgaggcaacttttggatcacatctaaggatgggggatggttgcccatggagccaaacctgaggttagagagttggaactttaagtcccactcccaaataccctgggaggggagagggattggagactgaatccccatcacctatagccaatgacttagtcaatcgtaccttggtaatgaagcctccttaaaacccccaaaggacagggtttgggcaacttccagactgatgaagacatggaaattttggcatgcctagaaaggagatgagggctttgtgtcctgtccccacagtgttcttagtcattcagtcatgtctgatcctttgtgactccaggcaagaatactggagcggcttgccattttcctcctctaggggaatcttctcaacccagggattgaccctatatctgctgggtctcctgcattgcaggcggattctttacctgtggagccataggggaagccctgccctgtccacatactctaggcatctcttccatctggctattcctgagttgtattctttcatattgaactgataatctactaagcaaaatgtttctctgagttctgtgagccactccagcaaatcaatctaatccaaggagggagtgcttggaactcccaatgagtagccactcagaagctcagctaacttgggtctgaagctgggaggggcagtcttgtagggcagagctgttaacccatggggcctgacaccatcaccaggtgatgacatcacgacaccattatcagaactgagctgaaggacaggacacccagacagtgctggagaattctgtattggtttgggaatcaccctcactggaactgctgtcagaattgtagccatcagtggagaaagaaaaaggaatgggagataaatctttattattgtgattggaaaagatgctgttgctgggaaaagattgaaggcaagaggagaaggggatgacagaggatgaaatggtgggatgacagaggatgaaatggttggatggttcaacggacatgagtttgagcaaactctgggagatggtgaaggacagggaagcctggagtgctgcagtccatggggttgcaaagagtcgaacacaactgagcaactgaacaacaacctaacatgtagtatggcctctgttgctgctgcttagccattcagtcatgtctggctcttcacaatcccatggactgtagccttcgaggctcctctgtccatggagtcttgaactattctgctgcacattatattaacactaagcatgctccacagtgaaagtgccttccagatgtgtgcttcaggaggacccaattgagacaatgtacatgcacgtttgcaccacatagtccctttctctggggtcagggcacagcagacaggtgggtgcatctctctactcttctgccaaacctgtgcagctgatgcccccttggctggtgtgctctaagcagttaacaaacaaggaaatcctaatctttcgtcaattctcccttcttggcccagattatgtgacaaaagattctacccattaattaagttatagtgtttttccatttaaaaattaatcagagacagaaaatgctttccatcttctcccaagtgccagtggaatcattattatccttccagtgaaaagcagaaaattggcctctcagtgagtttatttagtcttatcacagatagttcgctttcagatgaagctttttagaaaactaaggctagttccagaacctctaggatgtctgtgactctgcattttgacaggaaggtgagcaaaggctacctttcgtcacaatgagaggttccagggtggatgcatggattaccaggt

SEQ ID NO: 56668 - DNA, 809 bp, Bovine  19866881140673
taaaggctctacattcttttaatccaactgtgttattaaaggactaagaggaaatatccataatgtagtttctgactttatattgcagtaggatgagaagcatcagatatttggaaagatgatagagttaaatgaacttaaaaaaaaaaaatctgaattttctgaatggagcactccacgttttaactttaaaacaaaacagtttgaacatatttcctggaggtgaaatacgtcttgactgttttgaactttttttttttaaaaaaagtaaatacacacacacatgcagtgttttatttatttaataacttgcaaccagggtcggtgaaatttcgagatacaaatttttacccttttttttttttttgagatgatcagcttttctctccttgtcacaaagagagctcatgtcactgcccaagtgcaaataacttcttcaggaaagaaaaactactatgaaacgtgcccaagtttgatgttctaagacatctgtgggcacaatggacattcagaactccccagtacacattattttataagcctttgcatattttgttttcaagttctattattattgtatataaaagaagtgaaactttttctccctaatattatccacaacctttgaaatgctaacatgagagcctttgaaatgagttttgaaaaaatcttaataaccaatatcatgatagatatgtaacactaaatgaattcactcagtcactgccctttaacagctatgttttttccttataacctttcatgttaatatttacaactgtattatagtgtcttctttggaatatact

SEQ ID NO: 56669 - DNA, 1018 bp, Bovine  19866881154397
ttttttctagtgataaaaatattaaaagtggtaatagtgaagagagtttcaatgcgtttttgttaaattttaatataagcaacatagggaagtgtaaaattttagcatggtaaatataagcccgtgagttcaccctagtaatggctctgggcttgccagcatccatgactctgccttaagacttaacagaattacgagcgaaatccatggccaaagaacacagcctccgtatgaaggcctataggctacatggaagttggatctggaaccttacagtctcagtggtattaagtacttcccaaatcaatcaattaaaagtaaaattagttcagagaaaaacttaaagtgatacaagacttaaggatactgaagaacatttcatctgtcaatattttcaaaaagaactctttccttaggtacactactattgtgaaatgtgaactttctctccaaatttatgtttcttccttaaaaaaaaaaaaaaaaaaaaaaacctcctatgtgtttctttgctataaggtcacttttttcctataaaatatctagtatcataaaatgaccaattttacaaaagaaccaatattatgtactggtgaggaagaaattttcactgacttctgcaagggcctgcattgtggtaagcttgttatactcctgttccagaaggtctaatttttcaagctggttttgaacatgtgtttgatcatgttgtcgttctctttccagggagacctgggaaacaatattaaatataacatgaaaatatagcatgataatctgacaaaaaactgaaaaaaaccaatacagagtataataggctacttgtcttttcacagaactacttagatactgcagagaaattctaggaaaacagtattaagatgaaaccaaagaaatgttaacaaatacaagtgaaatcttcttatcatatactatcataacatgtggttctatacactgataatactcttgacagtattcacgacacacaggctgcacacaaatacttgtaatttgt

SEQ ID NO: 56670 - DNA, 833 bp, Bovine  19866881169281
tggtaccccaagtcccgtgataggctgattctgcatcttctgcaggaggatctttttgctgcagtggtaacggagccctcagcaagggctggttcgagagaggctgggtgggttgggccgctggctgctgcgcttgtggctgctgctgctgctgctgctgtggctgcggctgctgctgctgttgtggttgctgctgttgttgtggctgctgctgctgctgttgtggttgaaccgtgatggagctctgctgcggctgctgctgggtgtaatgcaagagtgaaggcttgctctgggaaggcaacacggaaggcatctgctggttggcttgatccgagttaaaatggaacaaaggcttggtgttgccatgccggggctccatggccgggtgcgggttgttcagaaagctccggctgaggtcctgtggcttgggctgcaggagcacgtccagcggccctccctgggccgaggggctggccttgaacaggtagttcgccatgaccttcgactggttgccgccacccgtgacacccggcatgggggtgctctgggggctgaacggctgctggccgaaagaggggctagggattttctcctgcccgaaggggcctggggagggccctgccgaggaaggcaaggctggccagctagtgggctggtgctgctgctgttgctggtgcatccggacatgctgctgccggttggcagcaatctgtttgagctgctgggcgtgggatacttcctgccagctgggcagggcccgggccgctccggtggctggcgggggctgcgcctggctctgggggactgaagggatcggggatgaagcggagagg

SEQ ID NO: 56671 - DNA, 696 bp, Bovine  19866881173068
atgatgtatgtgtagttgtcaactcttagagagcacggacccatggtaggcaatcatggtcagcatcatcgtcatattattattattatcttctttgaatctacactccccaaagtgtccattgctcgtcagaacctataagaattgactgacgaatcagcgcctgagactctagtcagagactccaaattcccagtcacccagagagacaaaagcactgcctggggatggataagcaagcctcattcactctacaaggtaaagatttcatgttcttatttctctattccccttcactcccctaaacctacacatttaaaccactgcattgtgcatatgacaagcaggaaaactttaactgccttagagacttgtttccttagtggcaccagcatggggagccctctgggaccctggtcaccgcacacttcctgcctgactctttattgactattgctgcctctttatttttctctcagtcatcagtgaggaagttgcataatttaaaagctaagtgggactcactttcttgcaatccgaagtcatgcatgctattttttttttccccctgactgtaactcctttgtaaatgctgtggaaaattctctcctaaatacaaaatgattttgtttttttgcatcctggagtatgcatgagattggatttttgatattggatttccagttttactagaat

SEQ ID NO: 56672 - DNA, 2826 bp, Bovine  19866881202870
cagaatggcccttctaatcatttatgtcactcctttgttagaagtctcactgtgtttccctactggatgaagtccaaacctttagtctaaaagttacagtccttcaccattgggtctcctcttacttatatctttaagtcaggtttgtgtctcatttatccaatgttaaagggcagaattgaaccctggctaatattatgctgattactagccaatgcttaacattctgtaacccaggtactgcctttaacttagggtgaggtccattggggaatgggcttcccagatggtgctagtggtaaagaacccacctgtcaatgcaggagacataagacatgtgggttcgattcctgggtcgggaagatcccctggaggagggtatggcaacccactccagtattcttgcctggagaatcccatggacagaggagcctggtgggctacagtccattaagtcacaaagagtcagacatgactgaagtgacttagcacacacacaagcaccgctggggaacatatgaaaaacaccgtcttctcttagctcagctaacttattcctctatttacatggcagcctagggagtgaaggagcaacaacaaacaccgatattgtttccaggcagaaacacaaaagatcagacacattagcaagtggatttgagttctaactagcaaaataggcttcctctcatagaatcagtgcaatgactagacagtaatggacagggaggtccaaacagaaggttcaaaccctctgtccaggaacagaaaagtacttgaaaagaaggagcaacataaagaagccttataaaaattctcaagtggaaatgagaagcaaactttgccatctgggttacagagaaagagctgcaagggctgccaaatgcacgttcatggtcattggtgggaaacctggtttccccatataaagggaaaggattccggaacgtatgctgcacacagatggcaaagcaatttgcatttaacataaaaattttcccaccagaggaagagcagaatcagtcagaaatccctgttaatttcctctggttaaaacaacaaccaaaactacacgggcaataaaatatctggttgaataattcaacaaagaaaaaatatcttaggggcaattattacagacaagccactgtgctcagcaaaaatggtgttacagaggtgactatggcagatggttttctttctaggaacttccagctgaaaggagcagaaagatacattatacgtaggaagaaagctgagaggcgacctccagcagaagctctcaaggaaaggattctgtaagtgattttagtcactatgggatgcccctttcatggccttaaaataggcagacagaggtgagtggctatgttggtcaggtgagtagggggccagggcctgccgttctgggagcaaagtatttggtgccagagagaaatcccagaaatcacaccttgctttgcaccagcctgaaggctaaaaaggttaaggtataatttctggactgtattgctagtctaggggcaagataagtaacagaaaccaagccgtgggccagaacagagtctaaaaaaaaaatctaggcgctcagaagtgctggggtatctggctgggcaagaaagaggcatatccggaagaatctggaggcaggatatgggtgtctgcagcagttttccatgtggttgcactgatgtcttaagattttggagaatatagaacagaacagaacagaaggcctctctgccaggacacgtaggggtggttataaaggtttcctgaccccaattttccccttccggggcactgcttgatgaaacctgaatctcaccattctttgagtatcagatgcctcccattctcttccctccatcctttctcatatatttactgaatggacattatataccaggcattgtgctgggcttgggagtctctattaaaacataaataccccagaaagggcaaaaccttaaacctgtcacagactgagttctcactaactacttttcgaaagaaggcatgaggccactgtcagtgaacagctgagaaaagactgtgactgcaagccaggaggagggacagggcaggtaggggacagggggtgcagcatctggctgctgaaaggaggcggatcgagaggaaaagaggtctttctggcatgtttctttgactgtgcaatgttgttcagagctgaatctggctcagttctttggaaataagagatgctaaggaaaaaaacaaacaaaaaaaaacctgtccacgtccttgaagatgagttcccccacccctttatccactataaggagagggctcttattccggatgaggacctcggaatgactctttgtgaatcaaggggctggctgcacctgtgattctcttgatccatgagcaccccctggtcaggaccccgacatacgtggtcacgtgagttttgcccacgttaagagtacccaggtgatggatcaagtggggactgaaatatatccagcctgcattttgctaggctttgtactcagggtagggtgagggctgggggtgtggataagccctgaggaaggggaacatttttctaattttctcagaggtagttctgtctctggaggttttctaattagtcctgggggtgtcatgggtcactaaatactgggcaaactcagtcctactcattgcatgctaagtcacctcattcctgtctctttgtgaccctatggtctgtagcccgccaggctcctgtatccatgggatgctccaggcaagaatactggaatgggttgccatgtcctcctccagaggatcttcctgacccagggattgaacctgcat

SEQ ID NO: 56673 - DNA, 757 bp, Bovine  19866881247813
tttgcccaagttcatgtccattgcatcagtaatgaaatgcatgtatattatgtaactgtaaaaaaggggtatttatactttggccacctgatgtgaagagccaactcattggaaaagcccctaatgctgggaaagattgaaggcaggagaagaagggggtgacagagaatgagatgatggttggatggcatcacgaaatcggtggacatgagtttgagcaaactccaggagatggtgaaggacagggaagcctcgcatgctgcagtccatggggtcaaagtgtcagaagtgacttagcaactgaacaaatattctttctcttaataccataaacatattttcatggttctaagtagtttttcttaattattattattattatcaaatatttatttggctgcactgagtcttaactgtggcatgtgggatctagttccatgagcagggattgatctcgggccctttgcattgggagtgtggagtctctgccactgggccaccagggaagtccctcttaattattgcttgagtggctataatctattatttagatgtactgtaccttatttctcccctattcttggacacttctattgtttgtttctaaagatattgctgcactgaacagtttcattctctctccctccctccctccccctctctcatttaattggcaaatcctcagtagtagaattactgcataaattggtgtgaatatctttatggattgtgccacgtcttgccatattactaacag

SEQ ID NO: 56674 - DNA, 1380 bp, Bovine  19866881332286
cattatataccacataggcacatcaataataccataagagctacaaataagggctaggggaaaaaaaaaaaaaaaaaactcaaagaaaatggtaataacttaaggattggagaaaagaagaaatacattcagctgaaccatttgaaactgagggaaaaaaaaaaaactcaaaagtaggggaagatagtttcatattccttctggagttactgaggattttttaatatatacaccatatatacagtattccatttctattaaaaaatttcttaggacatagagcaaacattttgtaaaagagactatgtcttagggcttccctggtggctcggtggtaaagaaggcacctgccaatacaggagacgtgggttcaatccccgatgtgggatgaccccatatgctgcagagcaactcagcctgcaggccactactattgagcttgtgctctaggaggctggtagctgcaactgctgagccaacgagccaccaattacggaaggccacgcgctctagagcctgtgctctgcaacagaagccatggcagtgagaagcccgcgcagagcagctaatccctgctctctgcactagtgaaaagcctatgcagcaacaaagaccaccacagccaaaaataataaataaataaataaatatttttttaagagagagaccatgtcttatgtgaatgacaaataatacacaactggtgggaatctttttttttttttgactgctatttcccaaatggttaaagaaaaagttgttgagaattaagaaaccaggattttagtccattctagctaacagtagtatctgcagccttaatccccactctccattatagctccattatccgtgaaaagtaccgatttgactattttagtggttagctttttgatggtcagatacttctttgaaaatctcatgaaaactattccctgaactgtttccaacgtcaggaactttaaggtcaagaatcatgtcttgatggcctcttttagttctaacatagtccagagcttcagaaatgagtattctaccttttgaaatattcacacaattatctatacaaatactgaaaaatgaaattgtccaaaaggcatatgtgcatgtatgtgtatatatacgttaagtgttttctaattaggtaatcagagacttgaataaattttatttaagactcacagcttaaatagaaatattccaatattgtatttcatacaaccgagtcaaaaggaaactaaatccaacagctacacttattttacaaactctgggctatcactttgtaaactcaacaccccaattacagataaacagaaataatactctatcaagaaatattttcattgttttaatatcaaggacttttatcagaaacta

SEQ ID NO: 56675 - DNA, 1493 bp, Bovine  19866881371788
ttgcctatagaccacctgagttttgataattatggagatgatagcaagtcaatcaaaatgtctattcaatacctaagatcaggcactcggtagagcactagattacttcttaaatatctacacatggctgaaaagactaatttagaaccaacagattcagatggtactttggttactgtaatcaaattttgcagcgatctgcctctttgattcatgctcttatttaaaattctgcattgctctttatgatataccagctgttaaactgccatcacatccatcttcctctatctttggcttcccagcacagcatccatttattctttaattcaaaatacatgattgaaccttgaacaacacaggtttgaactgtgtgggtccacttatacaaggactttatccaacagtgaatactacagtacttcatgaaatggggttggttaaatctgggttgcagaaccatggatactgaggaaccacagatataaagggccaactgaaagttacatgtggccttcccaggtggctccagtggtaaagaatgtgcctaccaatgcgggagatgtaagagatatgacttcgatccctgggtcaggaagatcccctggagggagggtatggcaacccactccagtattcctgcctggagaatcccatggacagaggagcctggtgggctacagcccatagggtcacagaattggatctgactaaagtgacttagcacacacacaggtaagttatatgtgaatttttgagtgcatggaggaccagcactcctaacccccaaacccccacatgttgttcaagtctcacctgtacttactgagcccctactagctgtcaggcatgtgggatacatgagagaacacaacagatagtatccctgccatcatgctaatatgctagcatatgggaacagaaactagtagccacactaaataagcaaaatatataatgtgtagaaattataacacagcctatggaaaaagaaagggcaacacaaggtaagggagatcaagagcatgagaggagagggtcatggtaaacctctctgagaaggaggcatggtcaaagatataaggagatggcgcatatctgaagaagagcatttcagacacagcaaacagtaaaaactttgagtgaaaacaggtctaggaatgactgaggaagagcaaagagaccagcatggcaggagcccagtgagcaggagaaaagtcagagagttaatggagcaccagataatgaagggcctctggccattgtaagggttttcattttttacactgaataaatcagaaaatgattgcaggattctgaaaggagcaacaatcatgaccaaactcatatttttaaaggataatcatcatcctggcttttatataaaggactgattttaggggagcaagaataaaagcaaggaggccagttaggaggtctttgcaattatgtcgggcaggtgggttgtggggggcatggtgatagtggtggtg

SEQ ID NO: 56676 - DNA, 1117 bp, Bovine  19866881401298
attgcagccattctgactggtgtgaaatggtacctcatagtggttttgatttgcatttctctgataatgagtgatgttgagcatcttttcatgtgtttgttagccatctgtatgtcttctttggagaaatgtctatttatgttttggttttgaatatatattctaatctgccgcaggctcacagttagtactgaataagtggattaaaatgatcaagctccagatttgtagtatgtataacacgcctcctgaactggacagaaaccttgtttgtggatgctttcacagtaaaaatgtagatagatgagacaggacaaaggtaacgtcgtgtccattttcgcgagtgattctttttcaagaacacatagttgcacacggcttcatagctgttgcttcaaaaaaaatgtccatattgtaaggtatggataccattgtcaagcataatccaagcgatatatgtttactttccatttgaaagtcagtatgatatttgaaaaaagcaacataaagtagaaaatttacaagtaatgattaactcatatatcagatctactttcagtaacttgaatgcactcagggacttttggggccatcttatgtgacactttgctagactctgatccctatttcttcacttgtttttatagtccagtcctataaactcacactgtgctgttaaaagagcagacttattcacagatttccatgccatcacgatagccatatatcaatgcactggaaggaatagagaaatagaaaaagattaaattattactgcaaaaaattagaatagtattttttaattgaagttcagttaatttacaatgttgtgttagcttcaggtatatagcaaaatatatacatacagttatatgtatgtatgtatgtgtatatatataagaatatatgtttatatgtatgtgtatatatataagaatatatatatatatttatatataagaatatatatatttatatatatcagatcagatcagtcgctcagtcgtgtccgactctttgcgaccccatgaattgcagcacaccaggcctccctgtccatcaccaactcccggagttcactcagactcacgtccatcgagtcagtgatgccatccag

SEQ ID NO: 56677 - DNA, 1177 bp, Bovine  19866881451703
aaaaaggtagaccctaccctttacaattgagcttaagcgacccgaggaagggtgtctaggaagggctcttaggctgtcttggataccaaaaaacccccaaggtctggtgcagtttaattaaatgaccatccttcccaattagccatgaaaaacactgcttgtataactatgtcattatcacttcctgcctggattagtgtaatccatgatatgcaagccttctgtgctccagcatttcctctggggatttgcaacttttgcaaaactccagctttagaatgctggctagagccaaagcttcattactcacattactcctgtgccaagtgagcttcccgtgcttccttgacagtggagcgcacactgcgaacactctgcagttaggaggaggagcagagagcgcttccccaaacctggggctgtctcggcagtttaagcacatacttcctgcaccccaagcaaaagctggcaagtgccagccccagatgacatatgtgttcatctcctgttgcctgtcaaggaaaagctagatcccatagaaatgattcagatcctcacagggatcgacagggttctttcttccaactctacaattttgtttttctagaacagttatttcctgagggatttcctcagataggacaattgtctttatcctcataatatcatttttttttcaatcaaaaactcacatttttttcagaaatgaaagaatactacagatcaattagaaatatttcaaatgaggaaactgttgctgagaaaaaaagagagagaacatacttagacaaggtcacagcgaggattagaatccaagtctcttatctgaagaactactggtgggaaggaggggatgtatggctgattcatgctgatttacggcagaaacaaacacaatattgtaaagcaattattctccaattaaaaaaaaaaacaacaactgctgcgtcgtctctcataaatagttcagattccagtgacctgtgctatatggtccaccttctccctctacatttatagagagggccgtttctaactataagcactccagctcctcggtactgtaatggaaagggttatgaattccaaacaccatttctcattgataatattgctcaagtaaatatctcaaaatagattttcagcaccagagcaggaagacactcagaaaggaagt

SEQ ID NO: 56678 - DNA, 1556 bp, Bovine  19866881510997
agaaaaacagaggctccaaacagaaagcattaaataagtgaatgaagatgatcagtactatcgcatctttgtgcttcatggttaaaatcacttaagatgcacatactatcttgtctgccaaagaatgtcagggcgataacccataagccttatgctctttctctaacacaggggtaactaaagggggtactttgatgctacctgaacttctcatcagaagaaatatcctttattctagattttgagattaatttatcaaaaaaagattcattctaagaatcacccacttgccctatgaacaatgtaggtgatagtttaaaaattaaaaatttgaagggcagtggaactcccaccattacctgaaattctaccagaagggatgcgccctatctgaaaaacatgacccctccttaaggtttccttttgtatgacagtttggacaggaaaccgtaacaaaccaaagcactgaatgcatatactatgtgctagcaccaattcggagctgtggcgtttctcaagaatttaacgacaccgtctctgctcccacggagctcacaatctgatgaaaggagcatctaaacaagccagagtaatacatgatttaaggactacagaacatgattcctttttttttttttttggcttttaccgtattgctgggaacaaatgtatcatagttcttccactaaaacagggcagcactacacgacagaagtaggaaaatagcaagaaatatatagaaaaagccaatgtcccccactgaggctcacagttcagtattccacaatttcgcatacagtgaatcctgccagctagcatcccggactactacagcattcaccgaagtctataaccctgaagacggttcgctaaatagagtggggctgaggggctgaggaaggaacagagcctctcggagttaacaccagagcacaacaccagatactctggttgtatctcgtgatacaaacctggctcctccgcggggcacagacgcctggcgcagcaagcccgcccgcccaccactcgccacctgatgggaagggcgccgcagctgggacgcgggaccctccgacacggcttggcgagaacccgcgcggaacgtcacagacacccagagcttacaggagctcgacccccagaaacgagaacctggaaacaccagagaagcgcgcgaagtcacccactgcgtcccgcccatccggccggcccacttccccttcgcggaaggagcgggcgaccagcccgccgcaatccccgcggcgcgcgcgaggagcgaagcgcagggcggggagcagtcccgcccaccccgagagcgcccgcgggaacgtttccctcctgcaggctgcgaggcgcggcttcccccgcccctcgaacaaaccgtcagcagcagaagcgaaagcgagtccccgccccaagggagcccgcgccgcccccgcgctctcacctttcaaacctccccaacctccgcctccgcctccgcctaggtacccaagtccgggacaggcgacgttccccctccttccgggagccaagggaagtcccgcctctgggcg

SEQ ID NO: 56679 - DNA, 1048 bp, Bovine  19866881869507
ttcaaggcaatatatttggagtgtcacttcagtgccccaaaccagtgtaaaaaagtgaagaatcactcctggagagcagtggaaaactgctttgggaggatgcaccatttttacctggccagcaactattgcaaactcaagacagttgtatctaaaatacttttagatacagaataaacagaataaaaggtatcttagcagatttaaatctttaagtgctaatctggcatcatgaaaaagttaataacaaagttaatatggcctggcacataacaggtgctctataaatgctaatatcctttggtagattttttttttttttaaccccaggaagtagttgtcaaactagggtaacctctagggtcacccggaggatttgtgtaaaacagagggctaaacactattcgtaaagagctgacctgccaatgcaggagacacaagagatgtgggttcagttcctgagtcaggaagatcccttggaggagggcatggcaacctactccagtagtcttgcctggagaatcccatggacagaggagcctggtgggctagagtccatggggttgcaaggagctggacacaactgaagcgactgagcatgcacagactccatccccagggtctccagttcatacagtctgggatggggtccagaaatctgcacatgtaacaagttcccaggtgatgttgctgctgctcttctggggaccacacttggagaagcacggccctagggaatagtttaggtgctgtgggaatatgcatctgtaatttttcacatcagaaataagttacataggtcccagcttttaaactgtgattttctttttagtattttactaaagaaaaggggggaaaaaagtaacaccactttatatagccctgatcttttggtaagtctgggcaacgacttcccatgtggagtaaattaatctttcatgcatgctttgtgctctggaaaaaataaacagattctgttcaacatttaccaaatgcttcatctgttgctggtcactgtgctaataagcccctcagaaccagtctctgc

SEQ ID NO: 56680 - DNA, 2357 bp, Bovine  19866880352383
ggagaagatgtggccagagctgggcagcgtctgtaggggtggggaggagggggaagaacacccctgatgacctgatggccgactggaacgtggggaggcaggggtcctgccggagcctgaggtctgcccgtcacccagcaccagcccttctcccccatctccgatcacacccttaacaaaacaggacatggtgaggtataaacaccatgccccgttgttgcactcagatgtgtgattttgacctcagctccacctctgggacctctgggaccctggttctctcccagtgggtttgcttgtttgtcaactaggagggtggtgcctgccagctgtggctgttgggagggttcaaggagagatagagttggtggcacacagctggcactcagagccccagggcccctgtgtcataacacctgctgtgcccacagggggtctgctgcacagccctgctggtggccgtggtggcccggaagctggagtttaataaggcagagaagcatgtgcacaacttcatgatggatattcagtatgccaaagaggtgaggggggcctccagcacccagaacacaccctctctcagacccagcagtccaagcccccagcccctcctcccagagccctagggggtccatgtcccctgacaatgtgccccccacacccagatgagggagtcagctgcccgagtgctgcaggagtcctggatgttgtacaaacatacacgcaggaaggagtctggagccgcccgcaagcaccagcgccggctgctggctgccatcaacaggtgaggacctctgtgtgtgcacatgccgtgtacagccctgtctgagtctacacctctctgcagggtgtgagtgtgtgtgtgtgtccgtgtgtgagtatgaatgcatacccaggtcaggatgcccgcgtgtggtcccactaaacagatgcccacctggacatcacagtgactctgtgtgtgtgtgatggtttcgtctgcatgtttcagagtgcctgtgtgtctggctacctggttctctatgtgggaggtgggctcatgggtgcagccacttactcccaccccttcagttctctggcaacttttcctcattatattcttatctttgtgagtctctcctcccctcatcccacccctgtgctagggccgctctgacccccaccccttgctgttctttttaacccccaggttccgccaggtgcggctgaaacacagaaagctccgggagcaagtgaactctatggtggacatctccaaggtactgggatcctgtgagagggggtctaggagaagagggaggtaggggtggctggtaaggcgctctaggcctggaatcagggacgctggcacacacgggcactcaagaaagctcttgtggttgaaggaacaaacaaatgaataagtgaatgatgcaatagagcttctcgtgaaaggtgcagcttcctttgaagcttaaggaacttacttgtgcaaagaactccagtgtttgatgtgaaattatttccattatcaagttccctacatgtgggtagatataaaattcctttcaactatgactcttatacaaccataaaaccaaagcaaattgacagacaaagttcaaacacaaagtgcaaagcaataaaatgtgaattaacagcaccaacatacagacgagtgacattgttccgggaaaactcaatctgtgctgctgctgtgaagaggaggaaggtggccaggagcgccgggcaggcttgcctggtcgagggcttgccctccttctgctgggtctccttgactctgaagtgctcagggtcagtgatgtcgcgccccactggcttggttagcagctcctcttgcttatccggtagcctttgcttttttctcattagcccgcgacaactcaaacagtggccctgggccctgatgccatggtaaacacagccgcaggtgccgggcccctaaactgcatggcagtggcctagatctgccggaattggcaggtcgtgatttctaagattagccacctggccccaaacgcggaagtcaagagttttcatagaaagctcccacgccctgaaggacgaagctgtgaatcctagtttgagaaggcagagaaagcgctctgtgggttttaaagtcaggcggccatcaaggccacaaagatctaagtgagcacccactacgttctcgggtcaccctgatccaggggctgccttgggcatgtcaacttatcttctccaggcctgtttcctcagctgttaaaaatggaaacaggactcccatttccacacttttaggaggattttaaactgcatatgaggatcacgggcctagtcgctgggcaggggttgataaaggtaactgttattattga

SEQ ID NO: 56681 - DNA, 615 bp, Bovine  19866880424774
ctggcggaccccttgctctgcgatatctcaggcccagacatcccatgctcgagtctggaccccgtgccctctccctctcaccgggtcttgagtcctctggccctggcagagccaggcagctggggcccagggcacaccaggaagccccagccctcagcccagctttcactgcgcaggcacctgcggcgccagcactgcctcggcgtccgagcacatctcgtccagcgcctgcagcaggacgccgtgcgccgcgcggtagcccaggcccccggtggccgcagcgccgcccgccggccacaggaaagagagtgcgcccagagccgcgcccccggcggtgccctcgcctgcccacgagcccagcctcgcctccacttcggctcgcgtcaccgggcccgggaagcgcgtccgcttggccaactccccgggagccaggcccagcgcgcgctcgcgtcgggccagcgccgcgggttcgagccccagcgcccgccgccactcagctagctgaccccgcaggagtgccacgtcgcacgcccagcccagccctgggactggggccgccgccgccgccaggctagccagcagggccgtgccgccacgccccggcccgcagcgcag

SEQ ID NO: 56682 - DNA, 934 bp, Bovine  19866880596109
acattaagagtttctcgccaatgtgaaatctttgatgttgagtaagttgagagcaacgagtaaaggctttcccgcattccgtacatttatgtggcttcacgccagtatgaattctctgatgctgaataagtcgctcgctacgattaaaggccttaccacattccttacattcataaggttttttcaccagtatgaattctcttatgttgagaaagacctgatatagaacggaaggcctttttacattctttacatatatatggtttcaagccagtatggactgcctgatgataatttagtttagaattaagtctaaaggtttttccacattccttacattcataaggtttctccccagtatgaattgactcatgcattttaaggttcccgacacgattgaaggctttcccacagtgtttacattcatatggtttcaagtcactgtgaatgatctgatgtttaataaggtaagaatggagcttaaaagtcttcccacattctttacattcatggggcttctcaccagtatgaattctctgatgttgtgtaaattgataaactctacagaaggccttcccacattccttacaatcatagtgtttctcaccactacgaatccttttatgtctaagaaggcttgaggccctactaaaggcctttccacattccttacattcatgaggcttttcaccagtatgacttctctgatgttcagtaagtagatagctgtaaacaaaggcctttccacactgtttacatttatatggtttctcaccagaatgaattttcttgtgttgatagagacttgaatgatgaccaaaggcctttccacattccttacagatataaggtttcacaccatgatgaattttctgatggagacacatgtgtcggtagaaccctaaaagtttccccacattccttacatttgtag

SEQ ID NO: 56683 - DNA, 835 bp, Bovine  19866880780871
ccaagacgccagctcttctggtctggccagttggggttcctccctgaaactctcccacgcagctggggcctgcagggcctcctgctctggagcgcacaataataattgtattgtcaccctgcctcactccatccctcaggagatagagggtttcagacccaacttggcaaaggaggcagctgaaattcagagggggagatggtgtggctggaggtcacagagtgagaggatggcagaggcaggggtaaaattttagtctgtccgactccaaacttgaaattttgtccactgcctcaatccaccacgaaagattcttctctctttattataagacacctcagaggctcagagaggtgaagacgcttaggtagggtcacacagcacaccataagtggggctgagattccaaggctgggaggcaggaaggttaggggtcagtgctgaatgacttcacagtcactcactttctctctctgagctgcggcatgatgccaggtgacccagcctaggtgactgaggtactagtcattgttggcagtgtgtgtggggggaggtaccccatggggtccagggaacggataaaatttttacgaacacagccgctattttcctgccacaggtaaatctcatcatctattaggagaaacaaagtaagattacagctgtagctttaaataataatagaatataaataatatataatatacacagtcacttatattagtttatatacgggggatgtttagtcactctggtttgcccagagttcttatttgtttctatgttcagacatgggaggcagtggtcctgactggatctcactccatcacggtca

SEQ ID NO: 56684 - DNA, 1258 bp, Bovine  19866880793224
ctgtgtgatccaaaggaacccctcatcattaactcatcacaccacagacctgtcatgggaatgagaaaccctaataagggaaacggggcagccctggctgaacgaagaatggaagtaataacaaaaggcaagacttaagacagcctgatatggatctgtgccagttaaacaccaaaagctctaccagagaatacacaattgaaactcttccccatgggtgaccattcagctggctaagggcagagcaccctgacccgcttctttgatagctgtatattagcctgaaaaaggaaaactattgaggaaactttatccttttttttttctagatagaacatgaattaatcagcatcttggcttgcaaaaggaaaactggtgctttccaaaggtcttaagtcttcattctctcctctttcctcctcttatatgaatcctcttcatgcctttgaaagatgatgaactcaacctactgttggttttcctagtatataaataaaagcgaactgattgttcagtatatttctttgtgttattcttggacagatgctcaaatatttcccttagaggactccatcccttcactgctcttgatggaagactgagccacaggagatgttgagttaagtggttgatgaatacgatggtgctgattggaaatggcacagagggcagacgctgggatatttggcatcatcctttactggaacaggaagaactgagaaggaggttcaaggagggggttctgttaagtagaaagctttagggtaattcaggaaaagatccacatgacctaaacatcacaacatgtcaaggagaaagaccaacttacgtcagtcatggttctagaatcccaggaactaattagtgctccatagagttcctctattggtgaagcacagagtccagaaaagccagagctgcagaaggaaaaagaagctttagtccaggtgtgctgaagtgagcctgtcctgacttaaacaactgaataaaaagacatcaaaataataagaatgattaactctatgggatataattttaacttccttttctatacatttcccagattggtgaatgttttgcaacaaacctgtgttaactctgaaatcagaaaaataaaagtgaaagttgctcagtcgtgtccaattctttgcgatcccatggactgtagtctgccaggttcctctgtccgtggaattcttcaggcacaaatactggagtgggtagctgtgccattctccaagggatctttccaacccag

SEQ ID NO: 56685 - DNA, 1218 bp, Bovine  19866880824166
ccttttgtagaggttgaaagaggttgaaagggaggggcagcagctccaagcccaccacccttcttttttccttagccccacgcccttgctaaggccccactgttaaatgaggcttctcccctcattggactttacactcctgccaatgcctctgctcaagaaagagcgcccttggtgaccttgcccacctagagcatttagtccatgattttcatttagtccctcaatccattcgggattcttttgccataaggctcactctctgtgagttttgccccactcagcatggccttttcttaatcctgcaggtcctttggaaagcccagctcccaaagagtgtaacccccccggggaagacttagccggttccccattttcagctctgttggaagccagatttcaacccaacagtccctcccttactttaggcaatgatggagacctgggttcagtccctgggttggaaaatcccctggagaaggaaatggcaacccactccagtattcttgtctggaaaattccatggacgaaggagcctggtaggctacagtccatggaatcgcagagtcggacacgacttagccactttactccctttcttgcttcaaactccaccttgtcattttagcctggtcggaccccctcggctagctctccagcctcgagctcctcttctgcccttgaccctatccctccctgtccccgcaggctccttccaccagctcaggatggattcgaggtgttgggcgctgcggagttggaggctgtgcgggaggcctttgagactgggggcctggaggcggccctgtcatgggttcgggccggcctggagcgactgggcagcgcacgcctggacctggccgtggccggtagggctgacgtgggccttgtgttgaacgtgattctcgggttagatcctgaagatccgggtgcagtgcctgctgcagcacctgcagggcccacgccctacccgaccccagagcgccccaacgtggtgctctggagcgtgcctctgagctccgcggacaccaccgtcgccccgtacccgaccacccactacgacgctctcatcctcgtcacccctggggcacccactgagaaggactgggcccaggtccggcccttggtgctaccagatacaccattggtctgtgtgcgaacagacggcgagggcgaggacccagagtctctgaagaagaggaaaaggcagagaagtct

SEQ ID NO: 56686 - DNA, 934 bp, Bovine  19866880870834
attgcattcatcatgatacccctacagcagagactggaggctaggaatacatttcccacgatgacttatagctgaaattgaggctaggactgcatttcccatgagaccctgtggcagagactggagggtaggattgcgtctcccatgatgccctacagtggggatcaaaggatggaaatacatgtcccatggtgcagctattgaggctagagataaatttctcataatgttctacatcagaccttgtgatcaggacctcatcattaatggctcccaagtttttgttcagggatctcaattgcaagaaataaaatctgtttgagctgactcaagcaaaaaacgacagcattattggaagtttagaatccaggcaagagctaggtctctgggctgcgccagggacaagaaacagaattgaaaagctgggcgaaatcaatgttgtctcccttttgcaaaatctgcctctctgtgtcactctctcttactctgagtgtgtggcttccttcatggactgggctttcaccttacttttgtctcctcacagactacctccggcctcaaacacagtagccaaacatgcccttgaaatgtcaagtaccaagaactaccgtgtctggttatactattttgatgaacagattcttctctctcttctctggtggagtccagtttgggtcaggacgctgccgacaacctcctctgctacagccagggaagtttgtatcaaagccatgacatacagttgtgcacattgaaacaagcatctgccactcaggcagttctcatggtaggcaacccactcaggcagagcggagaaaaccacctctatgagagagatctcatcacaaggatgggggagcaactgaaaaagaaaactaccacttaaaatgttttactctgtaagcagggatgcctccatgtattctatctgaat

SEQ ID NO: 56687 - DNA, 1348 bp, Bovine  19866880996025
tgctggtgcccatgtggccgtcccagcaccgctcgtgactgaccgcggtctggttcctcagggagcgttagtgcagcagagttctggccgctgcacacatgggtgacgggagagtgggaacccttgcacaaatgtgggatgaggcctgcgtgctaggacccccggcacctagagacacagtgacatggctgtgggcggggctgggagctctgtggagcagaacagaagttaagatccaaataccactgtggtgtctggatccagttatagaaagtgagcccttgggaaaacctctttcttaaaggattccaccaagtgcaataagaaatagatagcccagccactaatttaggctcttgtttttctaaatggaatgttcctttaagaagaggtgatgagctcaccgcggattcttgcacacccactgataccgtttttaaaatcctcaccaatcttcacattaatcatggttatttgatctaagtaattgtcttagtgaaattttgaaggcatttgaaacaacaaaacaagggtgttgtagggacatgactcattcatgtagatgttagatttattagccctggaagtgttcttctagggcaggcgacacttgagagcagtgaggatttgcaaaagagctggggaaggtgaaactgctttgagacttttttctttcacttcctctggctgattagctgtgtactaattagaaggaagctgcctgtgtttccaaactttctttgtcctgagaggcagtgtacttgccatcaccaagtggaacttgggtgactgtgtaccctgggatccctgacagtcctctttcttcctaccccagcccatcctgagtccctccatcttggaccatctcatcaacaatgaccgcaagctgcctccagagtacaacctgccccacacctacgttgagatgcaggtgaggggaccgagccaggcctggggacccggggcagagagctcatgggtatgggtttgccacttctacttgcaaagagccctggtaccccgagagctggtgggagaagatggcatcaagagtcgggtctggctctgcccctcgggaaagtaacccccgcccttaagcctccacatccgcctgtatgactaggggctgatcattgccgtctggcctgatctagggacagcttggaagggaagtaccactgcaatctgggcacacagtaggtgcttataggctcagaggcctttgtcctacggccccctcagctgagtcctgagatcagggaccccattctggacctggggaccttcaaccctgttgtcccttcctgccccctcagtcactccagatcgctgccttcctcttcacggt

SEQ ID NO: 56688 - DNA, 794 bp, Bovine  19866881038791
tactggtgctgccaggccccgagggcaatgaggagcccttggccccggcgctgggggaggcagcacgggccgccctggcccgagggaccccgctgctggctgtgcgtaatctccgacccgaggagtcacagaatgaagcccaggcccgggatcagaccgcggccctgctggacagcgccgggttgggcgccgcggctctcttcgtgccacggaccgactgcctcagcaccgacggctgcgaggagctagagcgcctgcgagcggcgctgcggagccaggccgaggcgctgcagaggtaagcgcggagcttctgggtgggtggaagaggctggagctttatttactctatgcctccaccctaagatgttctttgaagtcagcccgcagcttgggaccaaccttaaagcgatgtctgctgaaagccctgctccagatcctgcccttgagtgcaggtcatgagctccacgaggccccacctcaagctagcgctctgtgcttttgtcatctagtccccatccaaggatcagctggaagtcccagcctgtcatccagcctgctcctgctagcactctgagctcacaagtcccgctaccctgccagaattctaggaggggcccggacctaaagcccaaacactgcccccaagccaaggtgtgaaggggggctgcatccaaactcatgatccccgtgaaatttgtacccgaagactccactctccagtcttcactttcctcctcaccatctgcttggttctcaagggatcgaagtctccagagagccacaccctcagtgag

SEQ ID NO: 56689 - DNA, 1101 bp, Bovine  19866881112386
aatttttttccataaaacagccctcagccttgtgggcggagaaggcagtggcactccactccagtactcttgcctggaaaatcccatggacggtggagcctggtgggctgcagtccatggagtcgcacagagtcggacacgactgaagcaacttagcagcagcagccttgtagaagaacgtctggtttaccacatctcccccgatacagtgggcttaaaaacaacaacaacaaccagttttatgtagatctataattcacctaccctacaattcacccattaaaagtgtttttcagtggttttcagtgtagtcatagagttgtgcaaacattaccatcagcaattttagagaatattcaggagggaatgaccacccactccagtgttctcgcctggagaatccccatggacagaggagcctggcgggcagcagtccatgaggttgcaaggagtcagacacgactgaagtgacttagcacgcatgcacaaagaaaccctgtacccttgagccatcccccctcaattcccctctcctcgaagcccctggcaaccactgtctctggatttgcccattctgatcagtacactgtatggtcctttgtgactactgcattcactcagcattacgtttacagtggctttctgatccgtgccaatgagatggtggtttctttttttgaaaaaaacatatttatttatttggctgcgccggcttgctcggggatcttcgatcttcactggggcatgcaggatctttagttgccatctgcaaactcttagttgtggcatgtgggatctagttccctgaccagggatggaacccgggcccttgcgtggggagctcgaagtcttcacccttgggccacccaggaagtctcaagctggtggttttccttggcggttctccgatctaatggtggagactgagcatcttttcctgtgtgcctgggctgtgtgtgttttcagggctccattggcctccagaggactggaagcctgtcccggaagaggggagagagagccagtcagagaggatgcccccggcctctgtcgctccattgtagtggtgagtaccaacatcaccccacataccctcttctc

SEQ ID NO: 56690 - DNA, 982 bp, Bovine  19866881177690
cgccttcccgaccccgtcggcgacccccggccccagcgcccgcaccgctgccctgactgtgacaaggcgttctcgtacccgtccaagctggccacccaccggttggcacacggcggcgcccgcccccacccgtgccccgactgccccaaagccttctcctacccctccaagctggccgcccaccgcctcacgcacagcggcgcccgcccgcacccgtgcccgcactgcccaaaggcctttggccaccgctccaagctggcagcccacctctggacccacgcgcccacccgcccctacccatgccccgactgccccaagtccttctgctacccctccaagctggcggcccaccgccacacgcaccatgccactgacgcccgcccctatccttgcccacactgccccaaggctttttcattcccctccaaattggcggcccatcgcctgtgccacgaccccccgaccgcgccaggcagccaggccaccgcgcggcaccgctgctccagctgcagtcaggcgtttggccagagacgcctcctactcgttcaccagcgcagccaccagccggagagccccggggagcgggagtgagcgctcctcttggctcactggctccttctgctgccagcccccgtcaataaagaggtggcatctctaagccaggctgtatggacttgcctcttccaggtagacgaaagggaagttgaccccgcattgggctcaaacttagaggcggaggaatcctttgtttgggggaaaggaaagtgtcatccataagagtttgcactgagtcccaaccatggacctggaggcgtggttagaaaggtcttggctctggtttccaccccacctattcatatggcaaaggttaaactgctagctttgtgtgctgctgaggagtgtggagacaagctctccttgtgagtttaaattagtgcctccactttggccattgactgtgtgtgtgtgtgtgttagtcagt

SEQ ID NO: 56691 - DNA, 1035 bp, Bovine  19866881218727
acgtgagaatgagcgcctccttaagtgttgcgcccgaggcacctctcttgcctcaccctagttagtccttgccctggggctactggatgcaccttcttccgtcaaagattttaggaagccagggctgggtctctccctcaacggtgaccttggaattccagctcccagtcaaatattatgagactccaaggccaaaggagttgccacaaggttacagaaaactctttaagtgttgttgacttaaggggttcggtcaaagacacacctgccagagactcctggcccacttttccacctgggtttatggtgccctcctcccagagacagaacaggaactcaggcctggccgcccctcctacagcaggtctcagaagcccaggcctccatccccacttccctttagcccaagaagtccaggccaccaccctcttagacccagcatccaactcacgaagcgcccgaactggatggagtctccatcctcaatgtgccagtcagcctgggccccgctaaggcgggagatgacagactggcagccgggaagtagggaccggaggagcccggagccggtaatgtggtccgcatggcagtgggtattcactgggagagagaggagggccaggtccgggagggcacagagaggaccccgggatccccagccttcaagcccccgcccgccctgagacccaggagtccgggtctccggcttcccgctccaagctgcggccccacgccctcagaccccaggagctccacactgacccgcatacagcagccgcagccccagctccttgaccaactgggcatctcgttgcgctgtctccagaaccgggtcgatcagaaccgcctctcgggactctcggtcccccagaagataagtataggtgcagctcttgggctcaaacatctgggaagcggggcgggtacagctgagagcacagaatcggacttccactcattgcagacccaggagtccaggcctcaactcgattgtcttcctaagatcccggcccagaaactccagaccccttccag

SEQ ID NO: 56692 - DNA, 2904 bp, Bovine  19866881275254
tgctgcgcctgtacctggtgccccgcgccctgctcctgcgcagcggcgtcctgctcaacgcctcctaccgcagcatcggcgcgctcaaccaggtccgcttccgccactggttcgtggccaagctgtacatgaacacgcaccccggccgcctgctgctctgcctcacgcttggcctctggctcaccaccgcctgggtgctgtcggtagccgagaggtgagggtgccagggcgggtggggatggagggtacctgaagcctctggaggagccgcttacaaccacgcttgccctgcacggtggtgcagatcaggactccccgggaccaagccgtggagaaagctatctgtccacactcttatgcagcggggtgggaagaaccgagacagaccagccccaaagcctttcgtccacttgcagcctccagtctcccccaccccaacctcccaacacacatataccctaggaagccccgcccttcctgcctcaaatctctcctgcctccggaatccaggtataatgcaggccctggggcctggctggccaagggttacacctgctttgaaggaaggagactttctgcctttccaaataagcacagatgcactggtaggtgctcctaaccaccccagggctgccctggaagaaattcccagctgcctgctggactctgacctgatgctggaactgtaccccatcagggcctccacttatctttgttgttgttttagtcaccaagtcctgtctgactctttgcgaccccatggactgtagactgtcagcttcctctgtccctgggatttcccaggcaagaatactagagtaggttgctatttccttctccagggatcttcccaatccagaaattgaacccacgtctcctgcattagcaggtggattctttaccactgagccaccagggaagccccatttatcttacagataaaaaaaattaggggtaatcttagccagtggttctgggaccagcagcatctcctggatttagttcagttgctcagttgtgtccgactctttgtgaccccatggactgcaaacacgccaggcctccctgtccatcaccaactcctggagtttactcaaacttatgtccattggagtcggtgatgccatccaaccatctcatcttctgtcgtctccttcaccttctgccctcaatctttcccagcatcggggtcttttccaatgagtcagttctttgcatcaggtggccaaaatattggagtttcagcttcagcatcagtccttccaatgaatattcaggacttatttatttaggatggactggttggatctccttgcagtccaagggactctcaagagtcttctccaacataacagttcaaagcctcgattcttcagcactcagccttctttatagtccagctctcacatccatacatgaccactggaaaaaccatagctttaactagacggacctttgctggcaaagtaatgtctctgctttttagtatgctctctatctcctgggaactggttgcaaatccaaattcgcaggccccacccatatctatggaatccaagactctaatgggcgggacccagcaatctgtttttaacagttgattctgatgctggcccaagtttgagaacctctagtttagtacatcgagcaaaggattcttgaggggaggtagagaatgggaccatctgccctgagatttctcctctctgagcctctgaaaggcggaagtccacaaacttgagtgtactttgggatgaagggggtggggcttaaccatacagattcagtccccacctcagggcactaacttagtggttttgaggtttctgggaccctggtgaatgatgctttctttgctctggcctaactatgggtcagagttagacacatcctgattttcagacctttctatgactagacctaaatatccccttccatgaagtgtggggaaagaagagaatcccctcgcccaagcctttttagagtcccatctttttagtcctgatagagccacctctaggccacatagactctttgtggaaatcagaaaacccactctttctctgggtggaggcagttccctgccagggactgacaagtgaacttcaggttgggtttcttccccctttcaacccctcaaccacattaaatgcagcagccctggtagcctagctgaaaccaaatgggctttggaattgacaggatccaggttcaaagcccatagcccacagtggttgagcattttgtctaggtcacacagcaaagaggaggccaggcaggcttgccaaagccaggcaagctttgagtgctttttttgagtgtgggtgtgtgctaagaaagagggtatcaaacaccacaggaacatcagaactaacccgctcttcccctataggcaggccgtgaatgccactgggcacctttcagacacactgtggctgatccccatcacattcctgaccattggctatggtgatgtggtgccaggcaccatgtggggcaagattgtctgcctctgcactggcgtcatggtgagtacatccattcagggactcctgtattgcacactgctcatcccctgggccccaggaaaccatggagccaactgaagcactcagggacaccccaggaaacatgggtgtctggacccctacagcctcactgcctgtccaggacacagtcgttgctgttgttcagatgctaagtcatgtccaactctttgcaaccccatggactgtagcatgccaggctcttctgtcctctactgtctcctagagtttgctcaaattcatgtccattgagttggtgatgctatctgaccatctcatcctctgttgtccccttttcctattgcctacagtctctcctagcatcagggtcttttccaatagtggctcttcccatcca

SEQ ID NO: 56693 - DNA, 2063 bp, Bovine  19866881296605
tcctgtgcggagcgggaaggtgcaccgtcacgtaatggtgccaagcaagccaccctgggcctagcttcaggagctccagccaggaacgcgggggcccgggaaacgtggacactgccgccctccctgccccagggccttagcattggggtgcgaggggctgagaatcgcgaatcacccaacggcgaaaagtgtcgggcgctgtgcaaataacgtgacttgcactgggcatcggctccctctgagcccggagtcccgcttccgtcctctctcgaggaaatggctacccttcccttgccaatgcctttaaggggagaataggaagtgggttcttgaaactgattcgcgagacggaactcaagctcccagcggaattctcgaaaagaaggggaacataaaaagagaaggctgtctcagtgatctccgagttaggttaactcctgcacgtgcttgaccccagtcagccaccgtaggccccgcaagccgcaggacactttcctccggtccttcggcctgtagctgtgcgcctgctcgccaactcgctggcctagagaacccacccactccttcctttccatctcctccgcagcagcccccgcgagccgcgactgcgcatgcgaactgacgcccccaacgtctcggcgtgggaggaggggatggaaatgaggctgggcccagcagctcgcgcgcgctccctccttttccctcccgtcgttgggcgcgcgccgggtggtgcagctccccagcatccgaaggcagctctgcagtggccacggccgccgagggaggggcccggagccccgcccccagggaggggccgtcctcaggtgagggggcaggggttcggacccagacacctgggtctcgggaaatggagtggggcctgcacgccacagttcccggagaaggacccatttggggtcctgatgcataggttccggaggggctgcattgccccctgagccttgggaggttacattgatgcccgaatgccatgatcccaaggggtgcgtgaaggctcggacgcttgcgacctcgagggagaagtccattatgggtctctggatcgcaacacacgagccacgctctttctgtgtctttctccaggtctcccctctcctctccacgtctccagctccactccgtggttgaaaggcagtgaacgcggcgtcaatggactgagactgagccaagagccgggtaaagctacctattgggtgtgtattaccgcacactgagcttgtaggcccctcccctgggacagagttgctgagcaaccgactttgggtcttaattgtataactccacccatccgcggccggtcccgcccacctgggcttaagccccgcctgctccgcgcccggggcggctgggagttaaagttgtagaggccccacccactccgccggaaggctcaatctcggggtctaggttccagactgcttctgggtcgggtttgcgtaaccccgcccactgcgcccttaggctccacccaccctcgccttctaggacccgacgtgatagctcctgctcctgaacaaaccaacccctgaatatgggctctcagtcctatccccaacagcctgataacccccggcgtcgccccctctcccggctaggtcctccctctaggtttctgggccacaggatgctggagcgagagacggagtctgcggccgggggcgccgagcctagtcccactgacaaggagcctgtgatcaaaagagaaggtgagggcgtctccacccggggtagggggcgttctccaggaattggggccaagagagtcacgtattgtgggaaccttagggtgacagtttgagggcccagggtgataaccatttaggatccctaaaacgcaacgttctggggaatcctccaggttgtctttgggggacctcagtgatcctctgtagggatttcagggttatcacttgggaggatcctggaaacgaacactttagtggctttgggaaagcttaggtctggggttccagagatgtaactctttggagcctgccttaggaggatgcatggcagtgggtgaggagcaggatcaagccatt

SEQ ID NO: 56694 - DNA, 878 bp, Bovine  19866881387753
cagggaatccagatgccccgatctctgttgggacccgctttgctattcatcaccccagacgtgggggcaggcggagcctcttctggtcaagaatgaaaggagagggactccctaggtggtccagtggttaacactccaggtttcctgtgcagggggctcaggtttgatccctggtcaaggaactaagatcccgtgtgtggcgtggcgcagccaaaagagaatgaaaggagagccggacagtcagaggctctgagtggaggtgagggtctgtggccaccggaaaaagccatttccacctggttcctcacaagtgatgggcaggaacatactctgatccttctccaaagccccaaacgtgaccttggcaagttaatagaaaatcatgttaaactggaatgaagagccaccccgaagggcagcgccagagaaggcactggttaaaaggagtgggccagcccgtcgaggaagtggcaggatgtgaaatttccaacccagaccaagttaaggaactgactgacctggtgtaagaaacacattgccactgatagtatcttttaccatcaatgtaaaacaaaaccccgttaggcctctctagaaccactgcttgtcagggatggcttctgagagtgtccacggacattcctcaccccatccagccgctgcgcctgccttcttgtccagtctgagtgtctcgtggctcctggccggcaccccgggactccaggggttcacgttggctctccccgccccatctctcccctgcagactttttccagggcaaacgcttcttcctttacggggagttcccaggggacgagcggcggacgctcagccgctatgtcacagccttcaacgggtcagtctccaggggcgggggg

SEQ ID NO: 56695 - DNA, 1313 bp, Bovine  19866881401543
ctgaactgaccctcagtatacctcagcacttgatctttttagccgaggaattcctgggaattgtagtccgagagccacaggaggattacagcagttcagtgctccctctcaaatgctaaattatgtaaatcccacacctcctccaggaagccctcaccgtggtaatcatgagcagggtagatcagacagtttcctggaagagtgaagatcttttcatgaactgaatggtacaaggtcttagcacagcctggggaaggaaaagtcagaggtcagtggaacaacaggttgagagaagctcccaaactgcttcccttcaggaagaagacaggaggataaaaatcactgtagctaaaccttctccctcattttctgtcagtagccaaccctttgtgtagaggagagcgaagggaattctaggtaagtggaacaacacacgcaaagacttggggaatggtaagaattcagcacgactgtaaaaaaggttgggataggaccctgaagcaccaagtcccgtcactctgggggtgctaagaaaggattctgggcagggaaagtggactagaaggtaagaaattgaagacatgaggcaaaggaggatagagccatagttttggcaagaagctccgagtcctaaactgggacaggagcaaacctctcagaatgttctgccatcttttctttgatctcatgactgtgttggggatgaataaatggaagattaggagcttcagagagaaaaagacagagaccaagatggaaagataaggaaagaggaagcaagaagcagtcctggggacgtggctacccacagccagctcactaggggctgtctcttttctctcatccagcgtcaccctgcaaggtggctgaatcctcccaatctagtgtcccccccattcacacacatactcaaagggcagctgaaccctgacactgtgaaactaaacatccttcccatagtgaaactccttaatgtaactgccccagcagctataccccaaatgtaacatcgtgcgtgcacgctcagtcactcagtggtgtccaactctttgaaaccccatggactgtagcttgtcaagttcctctgcctatgggatttttcaggcaagaatactggagtggattgcaatttcctcctccaggggatcttcctgatccagggatcaaaccagcatctcctgagtctcctgaattggcaggaagattctttactgctgagccaccagggaagcccaatgtaacatcaccccctagcaattaaaccactgaacctaacccctcctagcagctaaactccttgagtctaatgctaa

SEQ ID NO: 56696 - DNA, 1189 bp, Bovine  19866881422799
ccccccgagtcttgtgatgatcagaaatgtcttgtgttgtcatttagtctctaagctgtgtctgactcttgtgaccccatggactagactggcaggctcctctgtccatgggatttcccagccaagaatactggagtgggttgccatttccttctccaggggatcttcccggcccggggactgaacctgagtctccggcattgggaggtgtgttcttttccactgagccaccacggaagacccttaggaatgtccagcagcagcataaccctaccacctccccagttctcttctccccgctgggtcctggttcagaccaacaagaggagcagacctccgatcccccaggccgtgcacccgccaagtggcatcctgctatgcccacactccctgccccttctgcccacagccgactggacagacccagggaaccaagctaaagctacttctcaagttcttgtttcccttggaaatgaggcagtcctggatctgtggcagccctgctgtgggctctggccatagaaagtcacgtagagtcaggggtgggaggtggtgcagggctctatgagggcagatgaagaaagcctgagggcagaggtgggaaagtggaggggaccacgggacccgcgagccagtgggagctggagaacgcggcgcccatggttcctgacagctttctgctttcctctccggtgctactatgctttctgcactcagggtcttagaataaatcctttaacttgaccaggctcactgctcctactccttgcagtcaagtgacacctaattacaggtatgtgacctcactatacaacacttcctttctttgagcctagccttccccattagtaaaacgggtaacgagacccacacactaccagctcgtgaggattcaaaatcacacaggatagcagcaagatggcggcgaccaatgttctgggacaggtgctgaggtgtggagagatccccgagaccctcgacatggggccctcacactgaccccctccctctgccaagcactcttaccagttcttctcggtgaggatcgtgtgtgacagctgcggccgggccatggacatcacctggctccgaagcttgctcaccaaggactggaagctggggtggcctcggtacccagggagcagggagaagagggagctggaaccaggtcctggaaagttagaggtta

SEQ ID NO: 56697 - DNA, 1311 bp, Bovine  19866881574755
cctggcggggtcctggttccgtcctgctctctcggcttaccccctaggtgtgccgcctcccaacccaggccctcttacctgagcccgggatgagtaacctccccccaggcaaccctggccttgcccaaccgggccaaatcagcgtccgctgtggggcgtgacacccgcccctgggtgcgtcgtcacccacagctgccaaggagggaaagggcgggagtcatggttccctggcagttcccaggagaaagtctgtgtttgggatctgagacgggggagagaggagagtactgaggctcacagaaggggtctactcaacgctcagcatccagtaaatattgaatgagtgcaggtttggggtcgggtgatgctggatactaaatagaaccagtgctggtcctccaagaggtcactttctggtgggggagaaagatatgaattaaataatcatccaaattgttatttccagccaagacaatgatggaagaaaaggagggagctaaaaggaggtgtggagtccagaagtagggggctgataagtgaagcatccctggagatgtaaatcactgagttgcctgataaagacttggaggtttaaacagtgaagcaggtcgggatgggggcagagcacatggtaaagccctcggtgggaagcaacatggaccattcaaacccagagaggagagcagtgaccctggagctcagaaggtgaggggagtgagagggaaactgaggcacaagagccaggcagggtcacactgttccaggcatgccaagccctgcagagagatctgaattaattttgagaaagatggagaatgtttctgggggacacaattagatttgctttttgattcagtctggcacatgatgcaaaaacttctcaagaaatgaattcactaaacccaaggaattacccagcaatgaaaatgggccaactactggcctgggcagcaacgtgaatctcaaaaactttatgttgagctcaagaagtcttaaacaaataaagataccatgtgactccatttctatgaaagttctagaacaggcaaagctaatcagtggtgatagaaatcggggtcattttaggaaggtattgccccaaaagagtaatagtaagtagcccctcctgtcttcatctgggtggtggttacacatataactacaaatacgtaaaaaaatcaccaaaccatatgctgtatatttatgcactttactgtatgtacactattcttacaaaaagaaaggaaagggtctttcttgacaatgcagtggttaagactttgccttcctatgcaaggagtgggattcgat

SEQ ID NO: 56698 - DNA, 1040 bp, Bovine  19866881852913
acaggtgacaaatccagtcccagctcctcagcaacagtctaacctcctctgtccccacagagaatccaggcgatgagcgccacatcagaggctgtggcatccttcctggctgcccaggccccaccggattccacaacaaccacaccttccacttcctgcggtgctgcaacaccaccaaatgcaatgcaggctcaggtaagggggcaggggacctggcataagacctacctaggactgggggcagagaggtgcattcaggctgcttgcttatccctccactctgctttctcctctggaaaaaaaaaaaaaaaaggatctattaagccctttctcaagaaagattttgtgggaattcaaggagaccatcaaagcctcaccaagacctgtgctttatgcttctacatctggaatccttctgctgctcaccacgctggtccccgccatcatggcctctcacctagattgttgcaatgaccttgctggccctcctgctaccctacattcaacacagcagcaagagtgattttttttttaatataaatcaaagcacgtccctcttcctcaaacatttcaatgccttccgcttgcttttaaaatgctgtccgcaggttctcttatgctctctgtaacccaacatgtgtctgcctcatggcctttgcacatacagtaccctccaccaggaacacatctcccctaggagtttgcctgtctggctatttctccttcatcaggtctcagctttaaagcatcattctcaggaaagatgtccctaactctgccctcctaagtataatctagatcctttgtgtttctctgtctctgcaaacaatgattggccaacaggactttcgatggtgatggaaatttctgtatctgtattgcccaatagagtagcctctactacatatggctattgagcagttgaactgaattttggatttcattccatattcattttagtgtcagtgtaaataaccacaggtggctagtgcctatcatatgggacagtgtagctctattatctatttattatttctttt

SEQ ID NO: 56699 - DNA, 473 bp, Bovine  19866881926142
tagacccaggggtccccgggccccacctccctctgatcctggagtctcagcccccagcgcctcctcctcccttagacccaggagtcctggcccccagcccctcctccttcaagactagaagtctctgcctctaccctccactcaccgggcaccccccgaaccacagcatctccgcatgcaggaccatgagtccaatgccagttcctgccagtgccagtgtccagccagccagactcttctcctgctccagcaggcgctttctccgccgcagggcccccaggcccgacaccagctccccgcccatggctcccggggtcttggggcccagccagcttcctgcccagggtcccctacctcgcagcacgcaaagggcagccacagtggcttgaggcccccggcccgctctgctcccttgctctgggcttgtgctttgaggcacagcagagtctgtgccctctgggaggtggtgactg

SEQ ID NO: 56700 - DNA, 4033 bp, Bovine  19866880399791
atatgcggatgtcactttgttgactattcccactcacttgattcttaaggtctttgctcagagtatttagaaagcctttggtggtcctgggtcttagggtccattatcttcagtgcccatttcgtcagtaagcaaacaccagaaaaattggtgccctctagtctcttgcagcaataactcaaacacacacacagagaaacttccactcaaaggaaaatataaaggacatgctgccaaagactcattaatgctggatgagcttggggcggtaggaggaaaataaatccaaccctgatttattagttttcatgacttgatttgttacttcttgttgaacagaccctattttctcaaacctagcagcttagaaatttccttggccaagaaattactggggcatatcttctgtttgttgtggaagataatcatatcaggcttttttcatgaatgggtgttttcagctctccatcttgatgggttaaaattaatttttcatacacatacctgaaaggatggaggattatgggaggtggcagaatgactgatagcaataatgctaatttttaacattggacactgtattcatcagggtgcttagttgtatgtaacagaattctccaagctaatttaaacaggacagtacttgttatgtggaaaaggcaatggcaacccactccagtactcttgcctggagaatcccatggatggaggagcctggtaggctatagtcctggagtactagaagtagacacgactgagcgactttgctttcacttttcactttcatgcactggagaaggaaatggcaacccactccagtgttcttgcctggagaatcccagggacagaggagcctgttgggctgccatttatggggtagcacagagtcggacacaattgacatgacttagcagcagcagcagcagcagcaacacccttgtaactgattccaaagcatccaactttgcccctagaaaatctattctccaccagcagtaaaagtgattctcatgaattatgtcattttcctgctcaaaacactcccgtggcttcctatctttcttaagtgtatatgcccatgctcatacaatggtatcctgtaaggccctacatgatttagtccgacttctaccccagccattttggcctccttactcctccctaccgatgcccaagcatcaggcttactcctttgcctctacttgtaaaattcttgtctcagatggttataccaaatttcctctgtatctctggatcatatgtgactttatcaggagcactcttgactatcctataaaaatttgtaatcctccatccagcattccataaaaacctttctcttatttttcttcatagtacttattaccatctaaaatcttacacactcatttatttgctgccccatgatctagagagttgctctttttcactcttatcctcaattgctagaacaggcctgccacattacaggccctcaaatatttatttattgaatggataaatgaccttagatctttttttaggcaataagctccttaaaaagagctaaagtcaatattatgtggcagcctggatgggaggggagttttggagaatggatacatatatgtatggctgaatccctttgctgttcacctaaaattatcacagcattgttaatcggctataccccaatacaaaataaaaagtttaataaaaaaaaagaagtgaagtctactttgcgtctcccaggtcactttgtagggtacctgcacagagtctgttaatttttctgtcatgaataaagacaatgcttaagcaaaagaatgagaataagattcaaaggaaaataaaaaataaaaacaaaccataaacgtggttatgcttacctgttctattgcactctttaatttgttcatgtggctttcaaacagaggaaaatgtgaaaaaaagaactcattaaatttgttactttcatcttcatctttggataatgaaaagattaccccaattgcaatcttctttttcctcacaattcctgggttagggccacagctttcatctgacagattaaagctttcttctatagaccttaaaaataaatgttttttttaattttaaaaatatgaaaatgattaaattcacaattcaatctccttggtaattaaatgtaggcaagctaaaggtcttgcagtgttttatcaagtaaatctaaaaattcgtatcaattatgtatatctttgagaaatatattggctattcctttatattcatatttttgtaagaaataatagagtcagattggaaacgtttttgttcaattatggaaacagtgacagacttaaattttggggggctccaaaatcgctgcagatggtgactgtagccatgaaattaaaagacgcttgctccttggaaagaaaaagttatgaccaacctagatagcatattcaaaagcagagacattactttgccaacaaaggtccatctagtcaaagctatggtttttccagtagtcgtgtatggatgtgagagttggactataaagaaagttgagtgctgaagaattgatgcttttgaactgtagtgttggagaagactcttcagagtccttggactgcagggagatcaaaccagtccatcctaaaggaaatcagtcctgaatattcattggtaggactgatgctgatgctgacactccaatactttggccagctgatgcaaagaactgactcattggaaaagaccctgatgctaggaaagactgaaggcgggaggagaagggggtgacaggatgatatagttggatggcatcaccaactcaatggatatgaatttgagtaaactctggcagttggtgatagagaggcctggcatgctgcagcccatggggtcccaaagagtcagacataactgagcgactgaactgaactgaactgaaaaaaagtaagtaaccccagtgtaaaaccaacctaaaagagcctgaatttcaaggtttatagacgagtctaatctcttcactgttctagaatctacttctcccttttgattccagaagtaaagtcaaagatgaaggaataaagggagtgaataaaaaaggaatcaagcttcatcatctttacttatacttaacacagatttaaaaaaaaaatttcaagaatgaatgaatttgcctgaatagaaacatgaaaaactagaatctcaaagcatgcaataaatggatcaatgaccaaaacagaagagttaaaactataaaacccttaaaagaaaatataggataaaatcttcatgacactggatttggcagtgatttcttgcctggaaaatcccatggatggaggagcctggaaggctacagtccatggggtcgctgagggttggacacgactgagcgacttcactttcacattcttggatgacaccaaaagtaaagcagcaaaggaaaaaaataaatccggcgacacagaaattaagaactgccatgtatctaaagtggtttcccaggtggctcagtgataaagaatctgcctgccagtgcaggagatgtagcttcaatccctgggtcaggaagatctcctggaggagggaatggcaatccactccagtattctcgcctgggaaatctcacggacagaggagcctggcgggctacagtccatagggtcacagagtccagggtcagatacgactgactgaacacaaacgcacgtgtaccaaaagacgtatcaacaaaataaaaaggcaaccaatagaatggtataaaatatttcaaaacatgtatctgataagggattgatattcagaagtatataaagaactgctacaacaatacatctgattaaaaaatgagtaaaacacctgaacagacatatctccaaagaaaacatacacatggccaataagcatatgaaaacatcatcactagctattcagttcagttcagttcagttgctcagttgtgtccgactctttgcgaccccatgaatcgcagcacgccaggcctccctgtccatcaccaactccccggagttcactcagactcacgtccatcgag

SEQ ID NO: 56701 - DNA, 1549 bp, Bovine  19866880417455
atgtaattctgggaactgaggtattaataatgtgttttcctcttttttagaacaaccaatttgtaatctttatacaatgccacgaattggagagcctgtctggcttacaatgatgtcgggggactccaagaaaagaaccagctttgccatcgtttcatgaaggagttcactttttctaatggaaaatgcttcaaaaaatcagtatggccctcgctctctcccatcctccctttcttccatctatccatccatctaggctatcttaactgtcttagctgttatttataataagtgaatatctagattgtgatcaagttcagttacaaaaatgaaagagttaatcattgcctttggaagttttcatattattaatgatcaagacagaattataaaaggtaattaatataattaaaagatatagaagaaggccaaagaacctgatgttgagaaacagtaaaaatgtatttgtgtattaaaactcctgacatcttacggaactgtgtgaggcttctcatttttcataattatatctatatatgcagtttcattctctagaaaacaacttaaaaaatatatagataagtgccagaattccaataataatgttttcagtatggtactttatcatattgctttcttctaatcattcatcaaattcttagactctagatgagtaatttaaatgtttatattctctaaacaaagttttgttaatactttctttcattttccttttcagtaattgggaaatgtatagacctactgattgattcataaacactgaaaagaatccatagtttttcaaataaaatggcatttttgttttttaattatgagtcaaaatagctccttatgaatgctatctttattttaaggagttttcttttaactagtacaacaaaaatttattaacttttgttttcatcttggtgatatacctatcctttcctctattctttctttttttttttatgacgatggccatataccctctctgctttattctgtcactgctttttgcttgaggttttatgaaagcaggttagaatctgataggatgcattttgttttcagattcttgccagcacttattactgcagttttgaccaatcatcttgcctgggttccaacagtcatgccaaatggacaaccacctataaaaatatttttagaaaaacattcctctcagagtgtggacatgttggcaaagactcatccatataatccactttgggcacaactgggtatgtattctgaaaacccttacctaatgcattatacttagacttttgtgtaactatctggagttatttcatagcaaaaataaatagagaaaaattaagtgctcttttttccctttcctttctaaagcacttcttccttgttgttacatgactgctaaattgtcttatcccaatcttatgtataatattgcttatggatagagacttgcaactgcaacaaaaggagcagaatttactactaactttggagtcttctggattttttgtatttagtactttgcctagaaagaatgaatgaacaaagt

SEQ ID NO: 56702 - DNA, 2950 bp, Bovine  19866880432556
actgctataacagtgttcaaccacatacgacagatacaaggaagctgagcttaggcagataagtcacatgaatgaaaatcaagtttactaatgaaaagacaaatttcagtattcatctgacacgaagtcctgagcctgacaagatgctatgtgctaaggaatacaaagatgaaaagttacgggcctcagggagctgagtctcaggccaacaggccccaaaatctcataatgtgaaaatccaatgtcatacttacatcttttgttaaagataatactctaaggtttgttcttcagaagcatgaactaacagcagatgatgagccaacagaaaacatgatttcctaagatatgaaactgcctgctttaattctatcttttccataagcaagtgtataattatctccccaaaggctcagagaaaacaagtggcatttgtctatcacaaatggcaaaaacggtaatagcaatttttcactgttgtttagaaaccgatttggcttaggatttaaaacagtcttaaaaaaaaaaaaggactcattctatccacccagcactccaatatataagcgatagtcttggtcaagtgtgatagtttctctgaactctaagagctgtgatgaccaggtaaaaatcaaaatgagcaaacatcacatttacaaagaatggtaatatcaaaaacaatttttgctagaaactaacacaaacattgtaaatcagttatactccaattaaaaaattaatttaaaattaaaaaattcaaatgaaaactatcatttctaagttatatgagcaaagactaaaaggctcagatacctctggagctcatctgtagaatcttgagccccttcctcatcttttgtctgctactgatgaaatgatattaaggagctaccatttactgtgtacctactatgttccaggtataaccacaagaaatagccattattatcctccacttcactatcagagaacctgaggctcaaaggagtaacttgtccaagatgacaggctaggaagagcaaagcagggatgtttatctgtgcctgcctagctcgctttagttggctacccactaagaattcagatcacaaaggatctgggaagaagcactttccgaaagagcaatgaaagttgaacctagctctaggtcatctctagatcacaaaaggaggatgggtctactctgggtggacctgaatactaggtattagttctgtgagccctctcagtatgtttggtatagccattccataaagaattcttattctagactaatatgaaacagatctgatcatcttagaatctttccaactggaaagactccatcacaccaagtctgttttgaatcaaagcaaacctctctcctcaggcaaggcccaaaataaggggtgttcaaggagaaggggcaagaggcaacttttgctcttacaacggaaatccatttcgtgtcagcctgcaagacaggaattatgataactcacgctgccccagggaacatgcttttggttccaaaggaaagctaggaagaaccaaaaaatctaggataccaatggtatcatcagtggtcaagtgtatttcctggtcattgagagaatactctttaaatgcacttagatttcttccaacatgagatgactgctttatacaacttaataattgtaggtgcatcttccaattctgagtttgtaatgagaaagaaactatgttggaaataactacaaatgatcacaaaagattaaaatatgaccagctgatagactgttctgggacttcagttaggttctaaacctagtgttcttttcacatcacattgctttattaggagatattttgtgggataataaaatgggttgatatctagttctgtggctgcactatagaaaaaaacaacaacacaaagacaaaagaaatactccttttttgaaacaacgcatcagttagggtctaatcaggaaagagaaaccacttcaagtatttacacaggaggaatttaatacagggaattggttatacaagccatgaaattgctgagcaccaaagaggggattccctgggcttccctggtggctcagatggtaaagaatccgcctgcaatgcaggagaccctgggtttgacccctgggttgggaagatcccctggaggaggacatggcaacccagtccagtatccttgcctgatgagtcccatggacagaggagcctggcaggctacagtccacagggtggtagagtcagacacgactcagagactttcactttcaaataatcaaaacaaactaaccaaactaacaaattaccaaatgagctactattataataaatctcttaagaaaaacatcaaattttgaatatctgcttacagatattcaagtgaatttgtgaattacaagtcacaaaaacaagcaccagtttacaaaaacaagtaaacaaaattactttaatatggttgtggaaaaggaaagggagaaagtataatccctgtctccctcagctgaactattcaagagaactagtaagggctttttaccccaacaaaagtacttttcaaagacgcatcgaaattaaaaacaaaaaacaaatcagatatttcttcagcagttcccttttttcagatacaaaataaacactaagttcaaatataagaaaattatatttttcaaataatacaaatattataaatacttgcaatttaaatcccttttccacttctagtatttgaaatcctttggtgaaattttaacagatctacattggtaagaacatttttaaaacatacaaaaccattttacctatatttccaagtagtccattaatgactgtattattatcggcctttaatgtactgttgtcctgattaatgaattcaagactgtcttgaagcctaaggggaaggaggaaaaaaatgaataccaaatctatgtttatgctcttaatggcaattctttgtata

SEQ ID NO: 56703 - DNA, 722 bp, Bovine  19866880449564
tatccattcatctgctgatggacatctaggttgcttccatgtcctggctattataaacagtgctgcgatgaacattggggtacacgtgtctctttcccttctggtttcctcagtgtgtatgcctagcagtgggattgctggatcataaggcagttctatttccagttttttaaggaatctccacactgttctccatagtggctgtactaggttgcattcccaccaacagtgtaagagggttcccttttctccacaccctctccagcatttataatttgtagacttttggatcgcagccattctgactggtgtgaaatggtacctcatagtggttttgatttgcatttctctgataatgagtgatgttgagcatcttttcatgtgttttttagacatctgtatgtcttctttggagaaatgtctatttagttctttggcccatttttaatcaccactttgaattggtcctgttgtgccttgtgtacagagaacagaaatgtttactataaaggcttctcaaatattttaaagtgatatgtggcattcttttgaagtgatggaggcctgagccagtcacaggatgacagcattgtgggaacgagacactgcaggcacagtctggccatcatgcctatccctggaacactctcgtccagcagccccgacctcctccagcctaccaccagcatgttggatttttctaatccctcaggtaattggtg

SEQ ID NO: 56704 - DNA, 1961 bp, Bovine  19866880460874
catttgataaaactcaccagctattcacagtaaaaagttggaaaattgaagaggaggaaacattaactttttaaataccatatgtgtgcgtgtgtgctcagtcgtgtctgactctgccactccatggactgtagcccaccagattcctctgtccatcggattttccaggcaagaatactggtgtgtgttgccacttcccccttcagggcatcttcccaacccagagagtaaacctgcttctaacacattgctggcgattctttaccactgagccactggggaagccctaaatgacatatactggaaaccaagagccaatattggactccaactctacagttcccattaccgtccaaacaacggacattatccaaacaatgtcccttcactactgccgtgaagtgctgcttggaggtccttactaggactataaggtggaaaaaaaagaaataatggattagtaaaagaagtaagtaatggagagtcagagggtcattgctggcagatgttatcatagttgtgtcttcataaaatccgggagaatcaattgaaaaactcccatgactagtagagggatctagtcagatggagcagaataaggtatattcgtatatgtgttcagatttttaataccttttaaaacggttaagtcacaactactgatacttaccgctggtgatagtgctttgaaacatttacattttctaggttacgtgttttgtcggggttttaattttatgtaaataaatttgtattgtatttataactagaaagaggaaggtaataaaatgaaaaataaagaaaagaagaaaaggataaactttcctttttatgtgaaaaccttacaataatatacttccacttggccctcccttcctttcgattgagttgtacatttactgctacaaacatgatgaactccataatgaagagttgttatttttgctttaaatactcagttgtctcttaaattgtttaggaaacaagaaaatatattttatatctacttattacagacctttgttcttttgtttagagccaagtttccatcaggtatcatttctcctcagcattaagaacttccttgaacatttctggtaatgcaggttcactggtgataaattctctcagcttttttaaaaattcaaaatatttttatttctcatttattttatagagatagtttttctggatatagaattcttggttgatttttaatagcatatttaatatgctatatattttttatgttttcatgttttctggcttacatgacttctgatgattgataagtgttcattcttatcattgttcctcttaatgtaacgtatttgtgcctttcattgtttttaagatgttttctttggttttaagagatttgattatgatgtgcctggatgtggtttcctttgtatttatcctggttgaggttttataatcctaagcttttggggatgatgagttaataatttttaaaataaaatttagaattttagtcactattttatttaaagtttcaccataatctctttcctttccttctgggactctaattttatgcatactagtctgcctgatattgtttccaggtcatttccctgaagctctgttcactttttttcagtctattttctttctgtgtttgcatttaaatggtttctattgacttgatttcaagtttattgaacttttcttttgcagaacccagtcttaacgactacctggtaaaactttcattttatagattatgtttttcagttctagaatttccatttagttcttttttacagtttccatttctctgctgagatggcatatctgttcatttattatgtccatcttatcactgaaaaattcttaaacatatttataataggtgttttaaagtccttatctgctatttccagtaactgtgttatctctgaatctggttctattctcctggctatatatcatatttt

SEQ ID NO: 56705 - DNA, 755 bp, Bovine  19866880619428
ctgctggaaatttttttctttgctttccataggagaatgcagccttttaatgtaaatacatttgaagtatattaatttataagagtgttatagttatcaaatttggaataaaaacttatttttcaaacttctggatatggatggtggtgataagttgcataaccttttgaatgtacttaatgcctctcagttgtataaagtagttaaaatggtaactcatatgtaaaatggttaacttgatattgtatgtaattcaccacattaaaaaatagctctgtagaatctaaatctttgatacaagctagtgagtttacactcctttagctaaaattgcatgctttaaaaatatgctccaaattttagattatgttggaatggctaagtagaattgtcaaagtataatgttttggaatttgccattactttgtgttgtgcattttctgacctcattcttggttccctcctaactgcagtgtgtaatgcatcttgaagatcggttacaggagctgtacttcaagagcaaaatgctgtctgagtacctgagggggcagatgcgtgttcatgtcaaggagctaggagtggttctagggtacgttcctgatttcttctctggctttgctttttcattgcactgtctttatttaggcaaggaacattcatcaaaattgcctttttctttttaaattgttgtgttgttagaacctgtacagtattatcatctggattgctctctacaatataaaaacagaaccttg

SEQ ID NO: 56706 - DNA, 1134 bp, Bovine  19866880631144
tatgggtgcactagccgccatcctcgcctactggttcactcaccgaccgaaggccttaaagccaccgtgcaatctcctgatgcagtcagaagaggtggaggtgagcagcgtgtgagcagctgggctgtgggaagtagtgggcaggggacaggcatcttgaaggtagaacccaaacttgtggcttatttggcctcagatggcccagagaaccttggtttcttccctgggcagccagccaggaagctctgaagcggccctggacaggctctcctaccagatgcaccttctgcctctcccagtagctgaaacccggccagagactgaccttgcccttgccctgggcctctggtttacctgcttctcggggagggggccttggcttatggtggcctcagtaggaggcctaagcatgttctcaagggggtgctgggtaaatttcctccaagattctccctgtgcccgaccctggtctggagctgggacccagaggggcccgaccgcagggccctgcccttccagagcacacaactcacaggcagagccgctgagggaagaagggatggcagcccggcctggacaaggggttccaggctcagtctagaaggacctgtaagatttgtttcctacgtttatggaatttattttgccttttaaaaacctttgaaagtaaaagtattagtcactcagttgtatttgactcattgcgactatggactgtagccctccaggctcctttgtccatgggattctccaggcaagaatactggagtgggttgctaggctctcctccagagaatcttcttttagttattttgaatagttagtgtacagttcaaaagcagccaaaggacatagactgataagcttccacctttttccctttgcctcccagttctcttcacctgagcattgtgttagctgttttccacaagcaaacgtatagacatctgcccatgatttaaaatgataatacaccacgtacaccatgcaactccttgcttttgctcttggcggtgtatcttgtaggtaccgatcataagcatgacagagttttgtctggtgggagagggcacaggccgagataggagtgggacctttagagcatttttccagaaaatgctttggaaatgtgtg

SEQ ID NO: 56707 - DNA, 893 bp, Bovine  19866880676956
gttttttaatcctgtaactttctatgtccccaaaatccctctgtgatttgcaatatggatgtaggtgcctgatcacatgttaaaacacaccacatcttggtcagacagaggtgatgccattattgacaaacaggtcaccaatagggtgagcctcacagattctaattatgagagcaactttgtttttgtttgcatctattcttttacaattgcttggtggggattgctctttgtctgcccctggataaaacttaggcacccatgccttttctggttcctctcaggtgagtcccatgggcattgtaagtcacaaactcaatcttaattcagaattacaagtgtaggtccaaaatatgaatgtgtccacttcgttgagatttccctacccaggccagggctggctgcaggctgggtgggaaaggtgtgagatcatgccttcctacctggtggtcctccccttcctccactggctggtaaaggtttctgccctctcccaccagatgaaagtagggagggagaatggtttggggcagatgtttacaattcagtctgttgtttcatggacacttttaggaggtttgttaaagcaggcagtgcctgcctttggttgtctgctccctgcttcacatgcgcttatgtctctggtatatactttactgccccctctgatttgagggcgggtactggcctttgggtaagattcctctttaagacaccattcccatcaccacctgatgtaccttctgtagactccgtgttcagtttctgggatttattatctgattttcagccacagccgtcttcacctttcttattgggaaccccgatctttaaggaacatgattgtgcttttcaaatagcctcattagggcctgagttagcttgggtttcag

SEQ ID NO: 56708 - DNA, 1773 bp, Bovine  19866880679829
ttaacaacgaaggggctccttcagttttcatctaagccagatctcagtttacaccagctgctaagtcaattcagttgtgtccgattctgtgcgaccccagagacggcagcccaccaggctccgccgtccctgggattctccaggcaagaacaccggagtgggttgccatttccttctccaatgcatgacagtgaaaagtgaaagtgatgtcactcagtcgtgtccaaccctcagcgaccccatggactgcagcctaccaaggctcctccatccatgggatcttccaggcaagagtactggagtggggtgccattgccttctctgacactagctgctgctgctgctaagtcacttcagtcgtgtccaactctgtgagaccccatagacggcagcccaccaggcttcccgtccctgggattctccaggcaagaacactggagtgggttgccatttccttctccagtgcatgaaagtgaaaagtgaaagtgaagtcgctcagtcgtgtccgactctagcgaccccatggactgcactagttcaaggtaaagccaaaaggcaactacaatgttacagagctcacaactgtacatccaagaacatgactttgtcatagagtcaagttcaccacacctggctgctactgctctgcagaattctctctcagagaagctccttatcactcaaaaccatgattttatggtgtcgaaactactgaatggccagagttgttattgtttttgcttttttctcaagttgggaatctccaatacatatatgaggtgtcttggaagagcaattatccaataaaggccccatctgggtctagtattccctttctatacagtttactttacaaatgaaggtcagagggccccagttgcataaataagttcttgctttccaaggagctctctaaatgtgcacctgctgtagaaaagcacaagagaatccttgttctgccacccttaagggtgcacacagtgactccctcaaaaattttgagtacaatggtgctcttttgctaattcagaaggaaaaaaaaaccctaaaatgtacatttaaagaccattattctaaattatgaaaaagatttaataaataatcacaagaacactaaattttatattctttcagtccaagccccctctttaaattttggtaacacaaacaagctagattttttataaaatgattttctggattgtaaataggcaattacattaacatctagctgagcatgaaatatttgcccaacaaaagtttaaagtcatatgcttaaaaacacatgaaaagttaaaactggcactgcaggtaaagctgcaaatgtgttttaaagccgtataaaaaagaagttcctctttcaaagtatgacttaagttcctctatctgaattgtctgtgaagaactgccaggtaaaacacatagtttctttatggtcactgtacattatttacatcttactaggagaagatttggagaaggaaatggcaacccactccagtgttcttgcctggagaatcccagggacgggggagcctggtgagctgccatctatagggtctcacagagttggacacaactgaagtgacttagcaggagaagattaacagcaaattttgctctgtgccaaattcaatcttttttccccagcacttcaaatatcagaccaacagaaattactactagaaaaacacgaaaacagtattggtcagattcttttcctttttagagtcattcactctacaaatattggttacctaccatgtaacaagt

SEQ ID NO: 56709 - DNA, 960 bp, Bovine  19866880689095
gctcacgtattgctgaagcctggcttggagaattttgagcattactagcatgtgagataagtgcaatccctgactaaacaaagagaagccaactctttaaggtaaagataggcatgacaaccaccaagactggaagtcactatatgatgttgctgaagatgcagttcctaggaatgcagtttctttaataattaaataagattttttaaaaatgtagtatccacagtgtccagcatacaatataaaattattagacagatgaagacactagaaaatgtgaccataacctggagaaaaaccaatataaaaatatccaggaatgatgaaactaggagacatgaatttttgatatttaagtaaattcagggatttaaggtctggcctttgaactattttaatcccagcagctgggatacagcagatcctcagaaagattatgataaatagattaagctcagggggaaaaaagtatattggccaaaggactaaaaaatattacatgttttgtgtttttcttttctcatagtatgaatgtgtctctgtgtacacgtataaatataatttggtgaggtagacagtctgagatggttttatgttgacttggccttctccaaataaaccaccagaggatattctttttctgtctccatctacataaacgtgaagctactatgaggagaataaattagtatgagaagttacacaaattatagaagccacattttcaaatttagagcaaagattaagcagaacctgagatttttcagtgcttatctctactgaattcccactttcaatatttcattcaatctttttcatggatcatttactccttaagtttcctcttagtctttctagtcatggcaacatgaaattaatcctttcacagtaatgcattctaggctggcccagtccagtatctctacaacagggccggtagggaggcaaggtctcctttgt

SEQ ID NO: 56710 - DNA, 1298 bp, Bovine  19866880753534
tggggctggagggcttgttcccgaacctgtcctccagtgtcccttctggggtctatgaggaagggggtctctccctaagtgtcaagagggcagcatgggcagcctttaccttgacgggtgggcctggggaagcttatttggggagggggagctcctgcctgggttttttctacaccctacttgcttgctctgctcaagccaccaactgtagacagcaccagtcctgggcaaagaccaggcagaaagggtcatgactttagatgcaattataaataaaaattcttacaccaaacctgaattttagcaaagacaagaatccacagagtatgatgtagtcatagaaaatgaaaaacacatcttgcccagagataacgtagatcctcgctgccttctacataaaccaatgataactgataagagatttagcatttcctcagactgaggtacatatagaggtacatctcctcacagaaatgctatcaagcccagggttcggatcagcttggaaccacctcaatcataccatgttcctgtacgtgctcctggcttgtgcgtcatgggtcttggaaagccattctgccccgatgaagataatcagtgggtctacccaggacaatcacacggcagtctgtgctgagattgagaaagaactcatggctgacaacgttacatacaaggtaagtctgggtcttcatcaaatatcactttactctcagtggccctctgtgtttctaaccaacttttcctgcttccagggctccttcgaaaggcctcagaacaccagtgaggtaaggagcagtcaacccatggtcatttctgaccccacttgaaagggaaatcccagggcagagacaagaacaaaagttgttgggtcaacaaatctggggagaaagttgggagtttgaagatgaagtctctggctcaggcagcagatgaaccagaagccaggttttgccgggctctttgatcactatcccagagcagccccatgcctagggaaagatcagaaacccactgcaaacctcaactatccctggttaccctggcctgaatttgagtccagggttccatctggccagggtaactagggatggatgaggctgagggtcagtggaccctcaattcaatgccctcaaccctgtttcaggaactctgctatgggaagtttatagagggcttcatctccaccctgaataacatctctacgaaacacaagaatgactgtcacatagaaaaagtctgtaagaacatgaggcaactcaccgaaatctgcccaaagctaaagtaagtgttcttag

SEQ ID NO: 56711 - DNA, 1215 bp, Bovine  19866880824999
gaaatggattgaaaagtctttgtaaaatgttatgtaaatataacatttaagaatgtctgaatttgcattcatcataaataaaagtaaaaattggacagaaaacgttttcaaaccaataaggattattatgtttaaagaatctgaagttatgtagctataaagttatgtataagttatgtatcatgtctgtttcagcaagattctgtattagttttcatttaagtctaatttaattgtgattttgtccatcagttattgaataaggcagtccaccttgcctcagtatttgccatacctgtttactatttcaaaaataattaagtacaatgtatcagttatgtttttcttttatatttaatagaagttctgtgaacattgagaatatattacttttagtggtacacagttcttaagaaaagtcgatttttttacaatgccacttgtgatatttttagcagcttgctacaatatcattgtaataaaaataaagtgtactcagtgatgagagagaaaatattgttaaagatctctagagacaggaaaaggctcagtcataaggtcacatgcttttcattttcagctgcatcattctgacttgttactttcaagaacaactataatattgctacattgtccattataccgagaagaactttccttgaacttcacatggaggttgagtaaagctcttctatttgttttttgaagtactctctcagctcaggtctcttagcctttagggtcggtgtcagcaagccattttgaactgagaacatatcagagtggatgtgaatggctttaacctaaaaaccaaacgcagaatacatctttatcaggagtataacacaacattcatagcatacatggtagaagtagacaggcatgtgggaatagaaatactgacataaaaacaggcctatttaaaaagtcagagttactgtaacagcctgtcagcttatttgatatatctgaaagccacctcatccccttcttactccccaatttagccagtcaacagaaatgaatgaggtcctcactctgtgccaggcaccgagggcacaaagaggaatcacgagtgcccctacccttggggagtgcatgctggtatccagcagaggaggcacagtgggcaattattagagagaacggaatactcagggaggaagggcacctaactcaggggaagccttcccaaattagggggagtgttaaagg

SEQ ID NO: 56712 - DNA, 1261 bp, Bovine  19866880893635
tcccacagtcccactgggggccctgagtcagtgtacccgctcgatgttatcacggccactttccacgcagtgcaatctaggaatgcctgcccgtgtcacagcctcagccctgatgtcatctttccagaaggaagacgcgtggctgcccatgaacctcattgtcaaacccctggacttctgtcctctgtgtgccgacttcaatgcccacaggccaccctgctggtgtggacctctcctgtggctcctgctcctcctttccttctctcccaggaccactggccagtctcttgcccagctatcatgcctctggcccctaaacactactgccctggccttcagcccttcttctcagataacagggccctcagatcctacagacctgcttttccatcccctgggtcctcaccttgggcacgtgggcagtagctctaaccctccttgcttacactcctcagcacactgtataagccgcctcctcttcaccatgttattgctgttgtttggtcactaactcgtgtcacctctttgaaaccccagagactgttcccatgggactccctagccaagaaaactggagtgtgttgccatttcctcctccaagggatcttcccaacccagggatcgaacctgtgcctcctgcattggcaggcggattctttacttctgagccaccagggaagccccttttcaccatgcctattcctaaacctgtttgcgcccaagacactctccccctaaactatcctcttcctccctccggcaacctgacttgccacctgactctacctgccctttcagcacgcactgggagcgtctcccaggaaaagtctctggtgccctgtgaccactgagctggaataagtggttccttgagattccttagctctgaatttcctccatcccagcccggatggtacaatgggagggtccactgcttgctcccctacaggactgaaaggcgtcagggttagatgaaaggaccagtgggagggtctcaacttcctcctcctcagcacagggcttggtgcagactggaagagtttgttgactaattgtctgagctgtgacaactcatttcgaggaggaaagtgaccttccatctcagagaggccacccagccctttgcctccctggccacaagcttagcgacagcctgtggcccctgcttcccaccacacagcctccagggcgctgcctgacacagactctcactcgctgtggcaccttcccctcttcccccttgagcgttccctgttagggc

SEQ ID NO: 56713 - DNA, 3652 bp, Bovine  19866880979040
ccgccctaccacgctgtcaccgccgggcctccgaggaagagtggcgttttctctcgactttggaggcgagtgttcttttctaaaatcttcctctctcatacacacaaacgcacacgcttattcacttactcactcactccgcgcgccctctggtgggcagaggggcgggggaaggagaaggaaaggaactaatacagcgacggggccgggaggtggtggcgcgggggtggggggcagacccggaagagagaatgctgagctggccgggaggcagataccgcccgcagccaaaccggtgatctcccggcatatccccgcggtgtagtcccttctgcggctgctaggggccgcccgcgctcctggtggtgcccacacggggcttttcctgcctgtgctcgcttttaacattcctttgcacacacagttcctcacccctgaagagctcttccctccctcatcccttagttcccagctgacaccttccttgactccatccagatcaaacctttttggagtgatgtccccttactaagcacctcagacctcccctccctattaatagacttgcgcctatgattcacgtctgccatccacccaggctgtggcttccttaaggacaggtatactaaggtgcttagtgacgtccgactctttgctaccccatggactgcagcccgccagcctcctctgtccatgggattctccaggcaactgtactggagtgggttgccatttccttctccaggggatctttccaacccagggatcgaacccacgtctcctgcattgcaggcagattctctaccatctgaaccagacagcacagtatatatcttgctcaccgttatacctagtgcctgagaaaatgcttggcatctgaaccagtgcagcactctggagccagagcctgtgttggaaggaggcaggccagggcaccgatacagcgcaggcgcagcggaggaagtttattagagagccagggcgcaaacacatatttacacggaccgcgcggggacgttaaaagcagcagaggcgggaatgcgacgttctgggagcggctcagacgagttccaccttgggcattagggtacaccgccaccacgtcgtagccctcgggaggcttgacgcgcgccttggcgtggctctcgcagtagagccgctcgtccagaaagaagtaaccgcgctgtttgaggttcaggccgcagtcgctgcacatgaagcactcggggtggtagagtttgtcccgcgccttgacgatagtgcccctagtgggtgatcggagaggacggcgtcaggggctgacagctccgtaaagcacggccttactcagggcctccgacggaggaccctgggggcaggtggggaaggcaggggaggtactcacacgatgccgtggccgcagcgcgtgcattcgggcagcccctgcaggccactcagcggagcgcctagcttgctggccgtgggcttgaggttccgaggaccgccaggcccgggccgttcccctgaaagacagagagcgatttgcaagagcccattgcggaggtcagaaaaagcgggaaacttcacttctgtggagtgcggggctgcgccctacttccggagccacccgcacagagattggggagggggttagaagggcgtgaaaggaggagctgcgatacaagtggagtggtaatcagaaagccccggtgcagcgaggggtgtgaggaggcgcagagaacacgtgttgttgttcagtcgctaagtcaggcgggacacgtgggaggggctaatggctgggaagcaagatgttgggtcgcgaaagcccggatgggacaggttcggagggtggagtttgctacttcaaggagtgggaaggcaggtggggtaaagaaaagagtcctaccgccctcgcccgcctccagcatgccctgcaaatagcggaaggagcctgactgcttgggctccgcagctgcaggctcggctggctcccgaagcatcctgtacacctctgagcccaggtcgactccgcagtcgcgacttctcggaaggcctctggctgggtcagtgctggacgaaagagatacacgaagggacagggttgcagtattagccttccccctgccagttcagggttctggtgaggtttcatgagtcagaatgcaaccagctgagacccaaggttaagggtcaagatgggacctggtgtgagattttgagggatcaggaattaagatgggaactgggtagggcatcaaaagtcctgcctctgtactacctgtggggtggagacacgtgcagggcacccatctgggccagtaaagtagcctcactgttgctgccattgtgagggactgggaggcgaggtgactgcccgtaaggagatcccaagcctggcctgccgtcttctggcccaaggccggtggctgagggccgcctgcttgtcagtggactgccatcctaggagagagagaaaacggaggcactgggagaccctctgtggtacacccacctatgcccagctatgccaagccttcttgggtgttggctggctactcttgctcaggcatctctgggctatggtgtctagtcagggaacaggtttgtggaggaaaggctgagccttgggcctggttcaacccctgaagaaatgagaaatgcttatggaaagtcagacacaaaagccctgaatccttgagactcaaccttggctcatgagccctgtggtggttctgactcccagtgcccatgtgggtggtgtttgggcaggaccatcccaagaagccttttaaggccagcgtgtctgttgcacagtgtgtggcttccttgcgaaggtggtcctggtgccaggtattttttacctgtcagaaccgcgctgggtactagatgggcccatggctgggaatgcaaaacaggaactcccgttctacagccaggaagggtcatcgatcattgtgtcccaggacccttcggcaggagcaggaggtttaaaggtaccattgtggtacttccctggtggtccagtggctaagactctggggtcccaatgcagggggcccagatttgatccctggtcagggaacgttaccccacataccacaaccaagggtttgattgctacaactaaaaatccagcaagcaatgataacaaagctcaaagatccctcatgctgcagttaagacccagtgcagccaaataaataaatttttttttctttaagaaaaggtaccattgtgaggtcagcctcctctaggcctgtattttcacccccacttcctgcttcccaggcaaaaaatgggtggccttccatagatagagcagatgaggggcagaaagcaggccagggctcaaagctccccatcccacgaccctacagccagcctgatgcccatgacagagtcatctaggggagggatgccctgaatatgcctcctcaacccaagagaagagggaagtttctttgcaggtgcaggtctgaatggggactggggacctttgtccctgcagtgctcagggctgtgttgcctctagtttgtaggcacacaggcctgtcctcagcagtatgacaacaggcatgcacactctcacaatacctttagagacatacccatgcaggaaggcaacatacatggatcagccagtccacctacatacacctatcacacagagtta

SEQ ID NO: 56714 - DNA, 2166 bp, Bovine  19866881009788
ttcgtggtttgtcctagtttcagccttttttttacattcagttcagttcagtcgctccgtcgtgtccgattcaacttaattcatttacattgcagattccaaacttttgttgattatctcttatcagctaaggtttcttctctttttgtctacattatggccttatgccgtttttatgcctttattgatattttagtgtttccagaaggaataactaaatctggtcaatcctccagattaaatatgaaatcctgagttaattttaatcatgttgcaaattttctagattccaagacagaattaaaacaattatatgttaaatagaattctgtgggttgctcaaaacctaaccatttatattttattgtagtataacgtattctaggtttcaaatatcaatcaaatatcaaacaaactcagatacagctagtttgttaattagagacagtctatcttctattttctcatacttttcacacatcaacttgataaagctactaaccaaggacattcatcatatatttaaactataatttcttaaaatattgattatgataaaattgtttattccctctaaatagagtagaaaactcattcaacaagcatttaaaattatattatgtctcaagcatggaataggaagataaaaggcagtgcttattcttaacagctttagggcctagatgaacaaatattatactgttgtttcgagtcctgtgacagtgccatggaactaccaggaaagaacaactcatctagaaagagagaagagcagtcaggagaggcttccaaaagagatggcacctgaatctgtatttgaagaagtagcggaagttactaggcaaataaggaagaaggagggaaaagtgtttgttaagcatcttccatgttcttttacactatattttaagaaaattcctgtattttctacctagctaatttgattttcagctgaatacattaggttgatttattgttttaaaattttatatttttagtttccagggactataattttttatagcagctgattacattatggattcaattacctcttgtctctaaagagttatttaaagtttactatcatcccttcaggttttgattcttttgtttggtgcatttgtgatctctcttccatggcattggtattcttcaaagatttgactgttttcgattgtctgttcatatgtgtatttgagaatttctgtttatatggcagagaatataaattctgaaaaaacaacctacctctggagattttagaagagtgatgagatattctggggacttatgttctgagtggggatgttctcctgtattttctggggattgtaggctacacgggagtgcatgcaagctcagttgctaagctgtgtctgattctttgtgaccctatagactgtagcccaccaggctcctctgttcattggattttctagacaagaatactggagtaggttgccatttcctcctccaagggatcttctctacccagggatcaaacccacatctcctgaattggctggcaggttctttaccactgagccacctaggaagccctaggttacatgggggcactgccctatttggttagtatccacactggaagtctcctatatcagaattcccatttcagagagccattatgtatcttttccctgggattaacaagtatagcataatctatattttttaacttttctgtccctttgctatccgtatggcaatctggagttacttcagactcttctgcttctctctccggctccaacattgatcctaaggagccaaaatgaagtcttagttcactttgctaggcagtaattcctagggttctgacctggcagcaagcactaagttgccagtgttccaatgtaagaaagggatgagtagggggccaggtcatacactgcctaaatgtagtgcttaatccatcgtcttgacaactccttcagggtcccatctattatagtatttcacatttattgaccaagtgttttgagttaagtgtatctccagagctactcttacctcttcagtggtttttctctgctcttcatatatttatcagtccgatctcatctgtctttaagaattcctcaggcttagtgtagtaatgacatccttctttgttttcaaaaataagttcaattacaccaaaat

SEQ ID NO: 56715 - DNA, 969 bp, Bovine  19866881082896
tttttgtttttcagtttgtaagaatcttgaatattctcatgtacctctaagaggatttgaaaatactttcttaatgaatctgtagactcaaaatgtgtagtgcatttgaagtatactcttttcagactgaatgatcatttgtttatgcctatacatacacatacatatacatctctgtgatcatactctaactgtgaatatattgtatttcctcattttcttcaagggttgatgtatttagctatgttagtctaatctttagtctgtgttatacaacattttctagtaatatggtgctatcaaataaattgttgaattgtattattttacaaacactggataataattcatatgcagccaaatggtatgaagaatactcattatgaagagtaattatatgaaaatcttttaataatgatcttaattattttcaaaatagtagtaaatgaaccattagtagtttggaattgctcaggattgtcttttatgcttgtcattttaaagcaagcatgttaactcacagaaaagcaaaattgctacacagaaggatttgctaggttttagaaaactatacactataatttaataaattgtattcacagtggttattaatatagatccggaatttgatgccactcaaagtcatctttcctgttatataaatgtcaaaacaaaaacagtaaaatctaaatttttagttttgtataaaaccacatgttttagaaaacactttaattgtaacagtaactatgttaagattgctttatggttctgttggatagagacagacacaatggaagcatctcttaggatgatctgaaatcatgtctttgtttaaaggttgtcctattgatggtgactaaggaagaaatactatgatagcatcatggtgtactgtttcatctgaaagatagctcattgggtatgtctcttaaaggcagcttcggaaggacatttaaattcactgtc

SEQ ID NO: 56716 - DNA, 818 bp, Bovine  19866881120302
ttttccttttcgttgggtgccagatacggaccagaatttgttcaaaactcgggatgcagcttacataaaactcagtatgggttttctgttcaggcttggtgctactttattttcatgaaagggggctcagtgttgcccatttctaggcctattcagcgtggatttctgagggttggttcctggagagcttctggcagcactggcaggcatacaggccccacttactctgtcgtcagcaagctctgctatagggatgtgatgggaggggggatatgcagctggttggtttttcccacactgggacctgcagtccttcttggaggctgccgcctcccaccctgaccctgattagatgaccttttgtacacctaatacaaattagggttcaggagaaatgggatggggtggcagtttaggttgagtggtctgggggctgcatgggagtgcctagctgtctgggccagcagggtcgtcagcccccttctccatcagaagaggactttgtaagcccttggtcacccagaaaccgatctgtgattctttgggctctgcctccagattgggattcatggatagtctcagtctaagccagatagcacattccagagaaatgacagctggtattcatgtaatgaaggaacctggctgttttttcctgagtgctataaagcatgaaccatggccaatatcaccaatttgaaagaaaaagtgaggtttctcccttccctgagtttgttatctgatctctgaggaggcatgccactgcaactggtgatggagcagaggacaaacggtgacccttgccccccaacttccag

SEQ ID NO: 56717 - DNA, 956 bp, Bovine  19866881127649
ccccgccctggccacttcaggccaggaagtccaagctgtacccagaggcccctcagagggagggggaagccttggcaggtcagactgctggggagggctggagaatgctcaagaaagcaggcaggtgggctgccaattcttggaagggctcattagtgaaaacccccaagcctgaccacctgggggaaaggctcaccgttccatggtagctgataagggccaggagattccacagttcaggtagttcccccgcctccctggcgttctgtggtcaccattaatcatttcctctaactgtgtatataagagctcttttgccagtgagcccagtgctcagagagaaaggctaaagtcctcaagaggatgtggctgcagaacctgcttctcctgggcactgtggtctgcagcttctccgcacctactcgcccacccaacactgccacccggccctggcagcatgtggatgccatcaaggaggccctgagccttctgaaccacagcagtgacactgatgctgtgatggtgagtgagggagggagcacaggccatgcctgggccaccctgctggcctggactcgtcctgcctgtcagctcgataacagaatattttcctttcctacagaatgacacagaagtcgtctctgaaaagtttgactcccaggtaagatgcttctctctgacacaccttttcccaaaggcctctgccctggggactgactccattttagacggacccttacagggttgtccactttctctctagccagctggctgccagaaggagggttgcttagaaggccttgcccctgtggcagtcatgtggactcctttactaactgagcagccatggacagacctagtgttcaagggtatcgaggtcaccaggggactggcgggggttatgtcatgagacaggggctgtgggcttgggacactcactgtgccctgagaccaag

SEQ ID NO: 56718 - DNA, 2323 bp, Bovine  19866881300602
tgtatctgggcagatttctagagctccttctcctgcagctccctccttactctttaatatcctgccccacaagttcagccacctcagtaacctctatctctgatctctatttcctttactcatctactttgctctgtttgggctccacttccttctgccttattttggaaaatgccctaggaaaagaactttagtgaaagtggaattcacctcttgtgtttcctttctctcaagaatgaaggttgtttgatgtccaatgcctgtaatcagttactgtaaatgttttatctagctttgtatttgtttacagtggagaagttagtttattaccagttactcacccatggttggaatctaataaaattttaaaagaagaaaggaaaatagggagccttaattcagaatgtggatgtgatgccacaggtgtctgagactctaagctggagctgaaaacagctgggccagtggggcctatccctttccagtattttctaatccggtgtcagaattgaaccgaataaaacttccagttctggccatggtggcaggtagtatcagaataatactcctgccaaaaacaattaagaaacttggatgaaatataaaggacaactctttgaggacattggagaacaactaatgcaggtaagaattgaaggattatgatccttgagaaaagggaataatgtgtagtgagtttcacatttaccctggtttttcccctgaagatttcccacattggtgtgtggaacaactggaactttcatacactgctgctgggagagtaattttgtacaaccatctagaaaaatggttggaagtaacaactatagctaaatatgtgtatatcctgtgacctagcaattccacttctgggtttatattctacataagtgaatgtttatttccactaggaaataagaatgtacgtgtgcaaatatatacaaagcagttttatttaaaataactaaaaactggaaacagtccaaatgtttgccaacaatacaatggataaattatgacatattcaaataatggaatacctacagcaatgaaacagaatgatagaccaccaaaaacagcaagatggggcactaccacaaccataatgttcaatttaagaagcagacataaaagtatatagtgtataagttcgcttttataaaattcaaaatctgaaaaaaataatcaaagaagaaagaatagtagtcaactttgggaaggtttattgactatcatcaggttacaagggacattatggaaatagtctatatcttgatctaagtgatggtaatatgaatttacatgaatttgaaacacattgggctatatgttaagcagttttctttttgttgattgtgtgtgtttgtgtgtgtgtgtgtgcactcggttgtgtctgattcaggcaagaatcctggagtgggttgccatttcctactccaggggatcttcccaatctagggatcaaacccacatctcttacgtagtaccacctgattatatcttaatacgtttttaaataaaagtttaaagtggccctggctgcacatgccattccacgcctgctggcaggagtctctgaagttcaagcagctttccagtgggcagaaggaggccctgcctggccagcacaggcttccatgtgaattagtcatccccctcccccagcctttttgtttttttatttttggccacacagcatggcttgtgggatcttagttccccaaccagggctgaacctggcctctcagcagtgagagtatggagtcctaaccactggttcagttcagttcagttcagtcgctcagtcgtgtctgacgctttgcgactccgtgaagtgcagcacgccaggcctccctgtccatcaccaactgccagagtctacccaaaccgccagggaattcccccaccccagcctttggaccttctgtctcccagacctccattactccccctggctgacttttcagaggcccaaaccccactcccttaactgaccactaggaggtgagatacccttctgcaggttctctcagcccctgtgactcatcatcagttttcttgtctgtgtcattgccccctcccctgccaaaaaagaaccccattagctctgtcaaaggctgttgtcagactcacctcagctctgtgtctgtccctgggcaccgaggacttggcaccgagaatgtgtcagcaattatttattgacctactgaaagtaagtgagggtgtagaaggcttctgaattagccttaggctgagtgatcctattgtaaagaaagcagataggcctggctgcccctcagtaagccagggcagtcccgaa

SEQ ID NO: 56719 - DNA, 1782 bp, Bovine  19866881401685
ctctagtgtgtctctgtgtagctgaccagtctttgcccagaacctggttcaggctgtggtgcagagtgagtggggcttgggtacttcccctttggggttgggaagtgccatgaagtcctctttgccctgatttttggcaagccagcatgtgtgtactcctcattccagctctactatcatctcagtggatttctgagcaggaaaggaagtttgtctcatgcacacaggaccctaggactgtgatgcccaggttgggcttaacttaatgctccccagggaaagagtctacccacacagatgttttatttcattacagattcctcccaggggcacaggtcctgacctgatgcccccttttttttttttccatcctagctgattatgtggagatccttcttgcagctttggttgtatagacattttcctgccagtttccagttagttttccatgagaattattccacatgtggatatattttttaatatgtttgctgtggggggtgaactccatcttctcctattctgccatcttgattcccctcccctgaattatattcctaatagatcttttttccccccttaggtacctcttcagaagactatcagaaatgccacagaaaagtgtaaggactaacattttttaaagttgttgtgtttttaatgctttttgttctcatggttatatagcaagtatgattattagcccagaaattcaggtgtttgtttattcggtatttgttgaggacttactatatgccaggactgttcttattaccagagtatattttctatctctccatctgtctgtctgtctatctgtctaactatataattgttataacaaaattgattaaaaacaaaattcctgccttaattgagtccacattctagttggaggatattaacaataaattaataagcaagtaaatttataccatgttatatggtaataaatgctatggagaaaaataaagcaagataggggactacagagtattagggtagagatttgctcttttaagtattgtggtcagagactcaccattgaaaaggtagtatttgaacagagacataagaagtagatagaccaagctgtgtgattcattggaaaaaaaaagaacattccaggtagagggactagctggagccatacccaagggaggaaggcttgggctcctggtgtgaagtgaggaggagtagtgagttaggagataagtgagagaatcaagatgccagatcatataaagcattttaggcaagtataagtgaattttaaggctgttgaatggtttagaaggatgatgtgatatggcttatgttttgaaagaatcatcctagctgctgtgttgagaacagactatgataaggcaaagaattagggaaattatagttaggagaatactgccctaactgggcaagaaatattggactatggaccagagtggcaagagaagagatagtgagaggtcagagtttggatgtattttcaaagcagggctaacagaatccattgaagggctgaataatgaagtatgaaactattcctgaggatggtcgtgcctcatgatttacctgagacagtcccagtatgtacctgctattgtgacataatctttaatatagctgacttttactctcagaaaggtcccagtttggacaaatcatcactgtaaatatagatgtataggccaaagaaggggagaagtgaagttgggtcttgagagtgtctgggacccatgagttgtctcgaatttttaccaatttgtgctgcaggtttcaaga

SEQ ID NO: 56720 - DNA, 755 bp, Bovine  19866881458987
tgtctcctggctggaaaattcaacgtttataagtattctaagaggaattaaggttcttctacaacaataacaaaagacaaacctctggtttaggactcccaccacttataaaatgaacttggaaatttccctactggctcaaatttcacttgggctactgtttttgtgttctctcattacgcagtatgttagaaggtccggcaggaaacagcccccaggtacagaccttatttgtgcagagctctgcatacgtcccttcaattcctctcttctgggcccaagagggcatgacttctgcgtcgggcacgacaatgcccaccaaaaaggcctgtgatcccaccagaggaaaacatagttatgacaaaagtttttaaagtggttatttgtggtccaccattaaaacttatcttggtattctcagactctactcttttctaaaaatatgtaaatgcttatgaaacatttccactaacatatcacacattcttgacagaaatattcttgaatatttctgatatatttccctaactttgtaaaagattgattaataaaaaataagcttaaaggagattaaaaatcagtaaggttagtcctgtatgtacctttaattctcatgacaaatttaaatgagaccatctttaggatactaatcaaccaactctacaatcaaaaacacatacatttctaagtatttccagaccattttgaaactgattcattaatatgctcctcattcattgagaacacaattttaa

SEQ ID NO: 56721 - DNA, 1275 bp, Bovine  19866881817704
cactcagacagacctggtggagacagaagggacagagagggtaactgactgggacacaggaaaggactaagggaggacttgctgaccactcagcagaaaacaaatcacacagtaaacctcgatctaggattattaggctggccaggtaatcacagattcctggcccacatctcagatggaggagcccaagggacagaagagagcccagctggccactcattactgaccactggtcctaatcatccagaaaggtaatgacgacagtcctggaggtgtatggcactctcccctcaccaagattagggattagaggatcatctgagcaggccaagtactgagatgggccgcccatgccctgttgtgcatgattccctcaccagaccacactgtccagctctgcttactaggataattcctgccactccaactcacattgagctcagggcatgagctccctgactgtggtgctcaagaccacagccgggagtctgggagagccctaaccacagaggcaaccaaggaagctattctgtgactccaagatctggctgtaaagcaagatatacatctcctgcaatctcaggactccaagtgggggccaggctctcccatgctgatttaggggcttcaactgtgctctggagctgagaattggaagggaaactccaaggccatttcttttccagcctcttcttcccacagcacccacaacctcaggcacaaacatccactctagccatgcctgaggacccaggagccaagatgctgcaaccctgtctccttcatggctgcatggtcagggacactaagggcttacaatccagagagaaaaaaatgctttccagaaaaagccacattgttagtgttatctccctgcctccccactccacatttcaggggcaagaactctgaaagaaagaggtaaaaacaacctactgctctctggggctgtcctatctccctctggctaattataaggttttccaaaggaaccagatgttgatggtgggggctgggtatagagaacaagactggagagcaggagatcatctgggcgggctcattctcctgtggtgcaggcacaacggccagttctgagctacaggcccaggctgggaggcagggtctgggaaagacagccacagcttctggaggcagtgagctcaccgggcacagctccagcccggctgagttcaccaatccctccctagaggccactctgctcccagccaagccaagcccagcccagtcggccacaggggctaaaacgcctcg

SEQ ID NO: 56722 - DNA, 1644 bp, Bovine  19866880575224
tgttctgcctatattttcctctaagagatttatagtgtctggtcttgcatttaggtgctgaatgcatttgagtttgtttttgtgtgtggcgttaggtaatgctctgttagtaatttcattcttttacatgtatctgtgcagttttcactacaccacttactgaggagatcgtctctgctccactgtgtttttcacctcctttgtcacagattatatcatcaccctttctttctaacacacctaaacaaaaagaaagctttatacatttttcttttttaatcctatgatccttccatgaaagcttttattcacttggcatttcttgaaaactttagcctttagccacatatggtttagcagttttcccagggctcagtaaaagtgtatggaaagttgcatggccttcattttcgacgtgttgattactggttcatcagttgtgacagatgtaccatgtccatgagggtgtgagcagctggggagctaagagaagcagcgaaaagctacgcgtgagctcctttctttaaactccactctgtttttctgtaaaccaaaatgttccccaaaatagcctatgaactaacacatgaaagtaggaagcaaagacaaaaagtcagatgctgcagtttggatgttttcagcttgttttctattatttgaagttttaaatgagttgccttgtgaaaagtaggacgttggaaagatttctgcacccttatttttgcttcgtgagctcttaagttatcatcccttaatatgttcagataattgttacttgctttgtaattaaggtgaagggcagacagatgctgtgtcaggaaagaagcaaaggttttcgaagcttcaagctgtggccccagacaagtaacacccctcgagttcctaggagtgctgtctagacttttgtggcactttagaatccactgatggatttcccccgaacaattagagtccagggcccatgaaaatccatttccaaaccatctcattacactgctatggtcttctacggttgagtgtgaaaaattcaattttatacccacagcaagctgtgcaaagccatgattcagtgacaatgcagagcacattcaaaacacaggaacttggtccccagggtccggcctggtgacagacacccctgtgcttagagaccccccaggggcctccctctccagcccaggtcctccggccccttccctctccacccccaggcagccccctcgggaagcccccacctgctcgggagctggagttcttcccgcccgtgtcagcaccacatttccgccctgggctggagctggagatccgatttaaaaaagaaagtcatggacctggcccttgtgctcaactgcaggccacatattttcctttactttgcctacaggctggcagctagcctgttgctggttcggtggtgctggtcaaatgcaaggcttctgggttagaaaaccccgttactcccacacaggagatgtgtgggcactggggtacggccctgtcaccaccttccacggggccgtgcagggctgcaggtgggggctgtgtgtgctgcgctggctgcacagctggggacagtgaatgaggggcctgggctcatcaacagctcaggagggaagccctgggcccgtaggagaccctgcctca

SEQ ID NO: 56723 - DNA, 1293 bp, Bovine  19866880607392
ctgcccaggctcaccagtcgctgtgggctggacccagcagggtgtgggcgagggcaggaatgccagggcggtgggaccagcatgctcaggaaggtggactcagcttccccagggcagggccggcctagcggtctcagaggccctgagccctgggctgtgggcaggtgaggcggcctcagggcctgaggcaggacttggcctccgactcagccatggcttctccaccccgctatctccaggttctgagctgcacctgagagagaaaactctaccccagttggaacacagaccagagaactcgtggaataaaagcagggcatttaatggcgtgtctgcaaaggcttcattgcttcctgctcaccccctgcgacagagctcagagatgtgtgggcattttgagaaaaacctactttcctagaaataaacactcacctcagcaaatccctaccacccactacaacgcaagcccgtgtctgtgctgttggctcactcctagccttcaaacacttcaggatgagaggctccagcgtatctgaaaacatcaacatttcactgggagggacatcgtcctcggcccggggcggaatctgcggcagggtggacgctgttctttgaagagccaggctgccttcccagagggtgatatcctatgtagtctccactgacatgcgtcactggcgtggacagccggctggtgcggagccgtggcccctccccggtcagtgtcctgttgtttggaaacttcatggttctgtctttctcggagcagcctgtgaatggggccacctcctctctggcctccagccgagccccactgccaccgtgtgccttgtccgcccgcaccgcacgccctgctccctgcatctggctggctgtgcgtgcacacatccaaattccaagacacacaaaaactccaaagacaaaaatatcttaatgcattcgaatatccagtttctatggagacagaaatcaaagtgaactaatgagaggggtttaaaatgttttttttttaaatacttctagcctgatgctttacatttctggagtgtgttgaagtgcccaggagctggttattattccaaacacactttgctaaaaggcaaccccgcattctaatgagatttgttgatgacagctcattttcattgctgtgctcttgctgacccttacaaatgctttgattacacagtaaggtggcaattttgaaacttctgggctctgagaaactctctgatccttctcacacccagacccagggcggggcggtcagcatggggctgtgggcacagattc

SEQ ID NO: 56724 - DNA, 1881 bp, Bovine  19866880896656
ctgaaatcacaggtcaaacttaatgggcattttcagcctatctcagggccagctctataggaagtgtacattctttaagtgttcagtgaagtttacagtgtttctcatctcccccaagcatcactgtaagcaacctgaagcctgtgggaaccaccacagtgcagtccacacagagggtggtggcgatggtaataattcagaggacgggcccgacaggaaacgtgactgcgaattcacgtgtgggttctattggtgtcttctcggaattgtcagcaagaaagggacttactatacgtgctgatgactagcaccagtttggttgtgcagacatgggtttaggtgtgatatcagatcctgtcctgttaactgcagactgagacacgcatggtaacgtggtacttggagcacgtgcagggattgtgggcagggacgggggcggtgggctcagtgtggggatgcagcaggggcttaccttcctctccggagattcgaccactttccagtcggtgagcttcagctggtgcaactcatcgaacttcatgctgacatcctgaacggacagctgcagcatgtcccagtagccggccagatcttgggaggtgggcctgggcatggcgctggggtcctgccggacacatgcacagttagagctgtggagacctctgggcagggcgggggaaggggctgcttttcccaatgaagggggtctgggagaagcctctgtaattagaattgggtgcacatgctcctgagggcccatgaggatctagtgacagtttacatgagtgtttgctgacagttaaaaaaaatctgtgatggaattccacctgagctatttcaaatcctaaaagatgatgctgttaaagtgctgcactcaatatgtcagcaaatttggaaaactccagtactggaaaatgtgttttcattccaatccccaaaaagggcaatgtcaaagaatgttcatactacctcacaattgcacttatttcacatgctagcaaagtaatgctcaaaattctccaagctaggtttcaacagtatgtgaaccgagaacttctatatgttcaaggtggatttagaaaaggaagaggaaccagagatcaaactgacaacatctgttggatcatagagaaagcaagagaattccagaacatctggttcattgactacgccaaagtctttgactgtggatcacaacaaagtggaaaattcttcaagagatgggaataccacgacacctgacctgcctcctgagaaacctgtatgcaggttaagaagcaacagttagaactgggcatggaataacagtctggttcaaaagtcaggaaaggagtacagcaagggtgtatattgtcaccctgcttatttaacttaaatgcagaatacattaagagaaatgccgggctggatgaagtacaaactgaaatcaaggttgccaggggaaatatcaataacctcagatgtgtagatgacaccatccttatggcagaaagtgaagaagaactaaagagcctcttgatgaaagtgaaagacgagagtgaaaaagctggtttaaaactcaacattcaaaaaacgaagatcatggcatccggtcccatcacttcatagcaaatagatggggaaacaagggaaacagtgacagactttatttttgggggctccaaaatcactgcagatggtggctacagccttgaaattaaaagacccttgttccttgaaagaaaagctatgactaacctagacagcatattaaaaagcagagggattactttgccaacaaaggtccatctagtgaaagttatgatttttccagtagtcatgtatagatgtgagagttggaccataaagaaagctgagcatggaagaattgattattttgaa

SEQ ID NO: 56725 - DNA, 1685 bp, Bovine  19866881132891
caggtggggctagtggtacagatcccacctgccaatgcaggagacataagagacgcaggttcgatccctgagttgggaagatcccctggaggagggcatggctacccactccagtgttcttgcctggagaatcccacggtcctaggagcctggtggggtacagtccatggggtcacaaagagttggacacgactgaagctgcttagaacccaccccaacttatggtgcttcaacttatgattttttttgactttatgatggtgtgcaagcaatacatattccgtagaaactatactttgaattttgatctttttccagtagtcgataaggtatctctcgtgatgctgggcactggcagtgagctacacttcccgtcagccactcgtcatgagggtaaaccgtggaagctctcacagccattctttatccagacaaccgttctgtttttcattttcagtactgtagctagtaaattacatgagaccgccaacactgtcttataaaacaggcttggtattaggtgacttttgcccaactgtaggctaatgtaagtgttctgaccttgttagaggtaggctaggctgagttacagtgtttggtatgttaggtgtattaaatgtgtttttgacttacgatgtttttagtctatgatgggtttatcaggacttaaccccatcatagattgaggaaaatctgtaaatatttattctctctattgttcctggttttcaaaggggcctttctatcctttttttggccaaatagcatttattaatgacacattccggacctggactgactcttgacttttgaagccaggggacagaggcagtttttcacaattacttggatgaggtcaagaatactcaatgcttaggaaatttagagtagtgtagacatggaagttgcaaagttgtaggtgaaacgtctctatggggtcaaagataaagaggtgaaatttcgtgttgcaaaaacgaaagtgactaggcttggcactgatttggcctcttccccttgtaacatttcaagttctcagatgttgaggttgagtatttttgtgtgaagagctgtgctctctgatgagaacacaggcctgggagaagcgtgggaggacaggtgtgggaggatgggtgtaagaagtgctcttctctcaaaaacgacagcaggtctgctcagggatgctgctgggagcttaggatatgatccgtgcgtgtctgtcttatcaaatctgtcaggccacaggacgggagatttcagaaggtaaaggatagagcccttggtcagaaggcccacggctttccagtcctgcagcagcagaggatgaagccccagaggaggctttggaggcgtgcttaaggtcacccactagcatgacctgttctggagccttctttgttttgttaatcatttgtgttgaaccttggtggatttttcctcttggtggcgcaaatttgacatttataaggatgatctattataatttagttcctagagttctgtaaaactgtaggcctataaagtagtttcccttcattcagtcgatggaacaataaacactatcccttcttcttttagtctctgacaaagctcccttgagctcatttgaatgaaagggattgaggcactttccgtgaaaagggagatagctgagcccccctgcacccgcttccagcttcctttcacct

SEQ ID NO: 56726 - DNA, 853 bp, Bovine  19866881402437
aaaagccttcagggactagctggtgctccgtctccctgaccggtgctccgggtgctctccatcacctgcagacactcaccctctggacacctctgtgccctgttgtgcttcctctcagacttcctcacctccttcctcctctcggggttcctgctgcagctcagtgcgtgtcagactcggagctgagcgctggtctgtcagcgctttgagcacaggagccctgtcgcttcatctctgctccccacaagcccatgttcctgactgttagggtgtctggtcttactgtcgaccaaggcagttgttataaggtacgcttcaactcagaggtgaagccacagccattacgtgtaatagaacagagtgaaaatggatatgaattgcacacaccatctggtgtctgagactgtcacaattatgcatttatgcagaatgatataaaatgcacaaatgaaccctaatttgcaaatttcttttttttttagattatgcaatatctgagttttaggcattcagctggcactgaaacaattttacctcattacttttctcaaggaataaataaatattctttgtttctggtcactggacaatttaaatatcagatttcaagtttactatgtgtagataaagtactgtctattttctcgccagtaaacttaagcccgtttgttgccttctgaagcatgtatgagaggtgaaggtgcacatggaatacatgtacttgaatgctgagaagagtcaaatcagaggtgttcctagtaattcgtaataaaccaccctgcaatactgggaaggatggataaggagaaatttaacatgaggccaggctctgacattcgtcttccctgttaaa

SEQ ID NO: 56727 - DNA, 605 bp, Bovine  19866881540846
ttgtagaattcccagtgaggaaaatgggattctgttcaagagtgtggcaagaatggcattgatgtataattccaaatgggaaactttaaatgaattttctgtagtttagtgcctacagagaactgtttgactctgggcaactggctatatacttattaatatttctcctgattttgaaatcagttcaaaacctgagtcattctataaccatttttcattgacagtcttgtcaatctaaataacagccttatgataaaatcatttagaatgctatgatgtctcagcctaacctcattgtctgtttatcacttcttaatttgtatttgtcagatttttcttacatggaaaatgcattttaaaattatactgtaatgtatatgacataagattatttaaaatagtagtacttctctccccaaatgtcagtgtgctggaatgaacacacacacacacacgtgaatataaccacaggtcacttgcatagaaacataagatgagtgactttggattcactttcttaggtaattttttaaatttatctattttttgttttcatggggggtccagctcaattaaacctaagaattacatacctaacattcagg

SEQ ID NO: 56728 - DNA, 1574 bp, Bovine  19866881566289
cagggccagccctgctcccggtccacatcccatggggccaaggaatttctgcccacatgaaaggtttccctctgagtgtttaagtcctgcaccagccccagggcttaggacaagtcggcgaagaaggcagagccggaggggcagagcatctgtggtgtgtagtttccgcttctagcacagtgatgatgctgagtagctgcgacagttgaatgaatagatgcatttttttaaagttattgttgccttttactggctcaaccctactgacatggaaaaatgattcctgaaaaaaaaaaaaacaacgccctccaggggttttacctggactgtccactcctggacagatggaggggtgtggctgtgagaaactgcccacaaaaccatctactgtctctattttttaaataggggaaggatatttctctaaatgtactgctcacatgaattctgtgtaagaaatttcttcctctcagagagtctggagagctggcacactctctgtggtcggggtcacaggggctcctcatttgtgccccgacggcctggacgctcagaatcaaatttatttcgggtcacagaaaatgtcttcacaaatacacacctgaaatgctgacgtaatgcattctgaccgggctcttttatgaactgatcatgctcaagtcagagtatatgcctgccatgcatctgaatgacctcctgaataatgagacccctcttctcctgacgtccatgcatttcatcactaaccgaggctctgagtctcagcacaggctgtgtgagtcctcctgcatgaacatattacatctaaaaacagaagagtgagagaaaatgaccttctgtctccagaacctcctgccaaaggcatccacagctaatgggccctgtcatccatgaagaataaatagatttattagtttactcagctggaaaatgcttgctgggaactgccagtggtcatctggccaggaatttaattcatatttcctgtcaccatgaagctaatatgggctgcgatatggccattcaaatactgagatattttcatgcccttaaagcaagagaacccaaaaacacaggggcacagggggcagaggtcttggggggagtgaaacagcagtgagagttagccattcattaaagagtggacgcagttcctaagaaatgagatacaagcaggacagcgagtctcctctgactgggagcttcccgactgctcttgtcactgggctgtttctctccttgagttggtcagtcaccctcagaatctgtggacgcaggctgtccacgttagacgccatcccgcatggctcttttgctggacaatctgagtctatttgagatcaatttgagtctaagatcatttttgatctttgactgttgctcttctttttatgttttatagcatccagcacaaaataggtagaggcagtactaacttttaaagcactttttccatatttgagaattttaaatactttattctctctactactcagaaagtacatcattattctttcaaaagataatacagtgaggataaaaagataagacacaaactctggttaattaaaatt

SEQ ID NO: 56729 - DNA, 1425 bp, Bovine  19866880293620
tgagagatgaggaagctatccttgttgataatcttatcccaacaagtaaattttatctttctcacctctgaggttcaaaacaacccagattcagctttgttccttgaggattgggttgaaattgaggaaagttatgtccaacctagatagcatattcaaaagcagagacattactttgccaacaaaggtccgtctagtcaaggctatggtttttcctgtggtcatgtatggatgtgagagttggactgtgaagaaggctgagcgccaaagaattgatgcttttgaactgtggtgttggagaagactcttgagagtcccttggactgcaaggagatccaaccagtccattctgaaggagatcagccctgggatttctttggaaggaatgatgctaaatttgaaactccagtattttggccaccccatgcgaagagttgactcattggaaaagactctgatgctgggagggattgggggcaggaggagaagggaacgacagaggatgagatggctggatggcatcactgactcgatggacgtgagtctgagtgaactccgggagttggtgatggacagggaggcctggcgtgctgcgattcatggggtcgcaaagagtcagacatgactgagcgactgaactgaactgattaagttcacctttcggttgctaaagttgttgtgggatggttaaactggcttctgactgatttagaactttctttagtatgaaaatttctgactctgtttctctcccttgccataatgtctaagaatctacttaaactatgctgcttctaatttcatgagctggtgaacagatgaccatactttgtataagagtgattgagtgatatgatgaaagaaaccaatcaacaatctgatacatattcttgcaaatttgattagctatttatgcatgctcagtcacgcccaactcttgaactcttcagggtcctctatccatgggattttcctggcaataatactggagcaggttgccatttcctcctccaggggatcttcccaacctagggatcaaacccaagtctcctctggctcctgcattacagatagattctttacctctgagccaccagagaaacccttagttgtttatactagtgcctataggaaattctaccttgatatagctaagttaattctttttttatggttttctagttcttatgtatccataaggtgtttcactgacaatacaggttgccaagaccatgtactttcatattctctatcttccctgttttatttctcccttttcaagaatctgggctctcagaattaggttcttgatgtctagggtattaaaggaccaaagagagtcagaaacactgggaaatgaggctgggactgccagcctggtaacctaagccatttaaggaaacgagagtgagaaaccacttcagt

SEQ ID NO: 56730 - DNA, 1630 bp, Bovine  19866880621176
tagaaagtatatcactttctgcatgggagaaggaaatggtcacccactctagtgctcttgcctggagaatcccagggacgggggagactagtgggctgccatctgtggggtcggatagagtcggacacgactgaagtgacttagcagcagcaacagcagtagctataacgggagaaggcaatggcaacccattccagtactcttgactggaaaatcccatagacggaggagcctggtaggctgcagcccatggggtcgctaagagtcggacatgactgaagtgacttagcagcagccacagtagctataatacccaatttcctttgaagcaaaaggttaagaataataataaatttaaaaaatgaactggctagaaaacaattcaaaaatcatggcagatatcaagaaaaatttcttctgactacctgaaggcacatttgagtctgccttgctgttccctagaacacactatagcatctaaattttttggccatgtgcatttacaaacgttttcaaaatgtctatgggatttatcctggcagctgggatttgagaccactttgaattttgtttttgttattttcctgataaaacttaattttttactgcatcaataactgtcaagtatgaaagagaaagatcaggtttagccatgacagagtttcttcactcaaaatgaagcataagcaaaactcatacctaactcacaatatatccacagtactgtgatcacgggatcacattctgtccccacctccagagtaagaatgctcgatgaagcactagtgtttaattaagcacaatttttaaaagctggatcaggctgtactagacttataaatgcaatatacttaacaccataaagtttgctcataatacatatccatgaggtaacaagcccttttatagtagagtattaggttagctagaatccaatttatgaaaaaacctcctgtatattctcagtattgtacatactgatatgcaataatgcatttcaattccatcctgacacaaaatctcttgggttcttttttgttctcttaaataagtatcataaaacattaataggagtgcccttctaggtctctattcaaatgttccttgatttgtagatttcattaacaaaatcaagaaaaaaattttagctagtgttaccaaataggacaaagctgttaacttctgctttgcgaaaatctgcataatggcatttaaaaacaactttatctaggagccttgtcaaaagcagaaatgatctcttttcaggactaggcctactgtctttttaataagcaataagatggatatttcagcgcacttggagacagaaaccagtcaaaggaatattctactcttccctttactccttcccctaaggcagtgcttttaaaaaattcaattacaatatatctcgcattgcatttcagtcctcttgttgaagaggaaaaattctgagtaatatacgatgctttttccagccccaaatctgagttggcatggcctttcggtcttacaaagcagatacagaaagaactgcctacaagctacaactacatttgaggatcaaatagggacttcttaaaaggcaggactattctgatcattttattacatactctgaagaagaatt

SEQ ID NO: 56731 - DNA, 2189 bp, Bovine  19866880630748
cttcagtatcatccagagtttgctcaaattcatgtctatcgagtcagtgatgctatccaaccatctcatcctttgttgcctccttctctcctgccctaaatctttcccagcatcagagtcttttctaatgagtcagctctttgcatctaacataattattcaacagctgtcatgtgctggtttctgtgataaataccgatgttataagcattaacagaacacattctccatttggatttcaaagtttacagggaaaagtatatggaaaaaaccaagaaatgacaatatggtgttttccaatcaagacaacatctggagggaattggtaggattggacttttattccttataagaactgggtttgatgcatggcaggttctgtcatagcctagtatatttatctttacatttttagtaggtagagggtcacaattttggtaaattagaagcattcacattttagtagcccaaggctggtagagtgagctacaaagaagaagaatttaagaaacaaaaaaggcattaacaaaaaaaaactactggaaagaaatactgaggaaagtactggagtagggtataaaggcaaagattaaagaaaagataatcagaaaatgatcacataaaggaactagcagagatggtctggactggagaataaggacattaaaaaagacttttaagaggctacagggattttaaaaactaggacaagacagatgtcatgtataatttattacctagaaaactgttaagttagaatggatgtaaaattgcagggtaggagagtcaggtgtggaaaaagggtggcccagcaaaagttaatgtgctaaagcaatatgctttcaaagtcagttagtcaagattattgagaataataggaggtggactggacagttgtggttagaatttatgggcttgtaataaaaaagaagagaaaaaggaaagtcagaactttttctttcggaaaaaatattgaggtttataaatgttagaaaataaagaatagaggcaatctggcctgcaggttaaaacacatttttagaaaagaagaaaggaaataaggttaaaaagaaacaatgaccactggagactcttaacgtaatcaagcaggaacctatgggggtccccctcccagagccgtgtcctccacctgcctcttgtttgtagaaaggctttggtctccgactaggagagtgagctgaggcagaaacaaaggaaaagcaagtccaacacagtcttttttcatgattattaaatagagcaaactgatgccctggtttatgaccccaaactgttgagataaggttctatggcttcaaccagctggccccaagcagacttaaaatttatgatactaggaggatcatttaaaaacggaaacccctgaaccatcacaaaggctctaagtaaataacaaaatgcctcaacccttgcttttgctctcttagaaagaagggagggatcacaagaccatgatttactagcttgctttgcaggaacacatagatcagtcacaatccccagtgatgcatcgaagcacaagatggagatttgaaactgatgccttatcaggaagctgaaaccacaaaaacacactgccttcctttaccatttttgtttttaaaacccttgcacccggtcagccagcaagatggatttcaaatgagtctaggtctcccatctttggggttggtacctcctcaactaataaatctttctttggtgcaaactccaacatttcggttggttcatcctcctgtgcctcacattaacttctgtttgacgatggtaatttggagatttatttttactttaaaaattctattgtcataaactccctaagaaattaattttaaatgttttctttataaagtaatatactctcagttttaaatatccacgaaatgtaggaaaatcaaccatagttccaccatttaattttaaaacaatgtactttttccatttttcttcagtgcatgcttttctttattctgactttggcaaatcttgatgaaatcatctaattaggtttaatttgatcataggacaaagtttataaatataaatactttgtaaaatctttttttgttgtttttggttttttttaattttttttaaattttattttatttttaaactttacctaattgtattagttttgccaaatatcaaaatgaatccatcacagg

SEQ ID NO: 56732 - DNA, 1501 bp, Bovine  19866880649889
ccatttgcaccatccatataaactggatagccttggtacagtttcttaaatacgtcccagtgctcacatgggactcatgcattttattttgtaagcattctaaatctttgctgatactcttacgactgaatttgcttgtctggatgtacttcctccttgtgtttcacagcattttcacttacgttcctaacagacattttttacattgcatggcagcttattataggcttctagaggtagctaagtgctttatttaccattaaatgataagcttatatgggaagcccactggcatgaactgtagagagtcagcagttttgctggtaagtcaggctgtgtttgagagctctgaggaggctaaatattttattcacagagtaattcagtgtatgtctgaggtttattccaaaagtatgcctatcaggaaaatgctgaatatatggtattagcaaaaggaaagtaattttagctgcatgtatctctgccaaagtgacttagccagcaccttgtaagatgaacttttaaaaagggaacaatgtaactgttcacctaaagctaaagtctgaattctgtatcttgaagcacccactttttttcccaaattataggatgaggaatgtttcatcatctcagagattggatagactagttatctaagataattttgtgtgctttacaatcgctgtgacttccagggaaaatcgtattgagtttgaagtttaaaatctctctctttgcacccacgtgaaaactttgggttgaacagttaaatagtcttatctctgttattagctaaactgctaaaaaaaattgcctgtaatttctaagagtatattaaataagaaaataattattctgttctcaagttcatgttatacatttggagagaagtattcaatacctgtactttacagaggaggaaaaaaaggcataaaaaactttcctaaaataaatattaactcttaggttttattcatgggtagttaagtttttatctgtaggttaaaaacaaagctcggtctttacttggttataatttggaatcccttcgggagctttaaaatgtcctgccatctggatcctagacccagagtttctaaattaattattctgagttatgttcttgccattcagtgagtgtttagaaaaggaagctaagttgcagattctagatgaccccttcagtctcctgatatgctcctaccatttgtcatgacacgcacagttctaagttgtcaatagagaagggaatccaagaaaaaagttaactgttaaaatgggaaggagatatgttactcatgagcttttttccaaatagcttatataagctgtgctacagaatcattgccttatatccatgactaaacaggaagcatgacatcagtaaaatctctgaggagtctgtgtaccaaaaaaagattgattggcagtatacaaattaatgtaatattgggacataattctctatggatctttcactgtctgcttttaaggagaggca

SEQ ID NO: 56733 - DNA, 3892 bp, Bovine  19866880673704
aaaagggatcgccaaggaaaattttccacttaaagtgagcttacctaggagatatcagctgacttttgtgatttagcacaatagactgaaggtgatgagagtccataaacctcactggccctgggaaaccaaactcttctaactggacttaactgaagatgtttttctaacaaatgaacaataggatttttgttttattttaaccagttgtgtaccaacctatatattcattctgtcccatatccagagtaccagtttcccatccttaattagcacaaatcccacgaactccccctttccagcacttaaaaacttttgacttttctccatcagtgagtccattactgggaagttaatagatctaactgcaattttttttttttgctttaatgatttttatcttttgacaggtgagaagcaaccagaatagaatcctcagtcaccccacgctcaagccatatggactgaattacttcacttgtacacaggtgccaaacttcctcgggcattacctttgcttcttttgtactcgtgactgtcctccaatgtctaactgcttatgaagctcagttcctgggaccttttctaggaaaccttctctatatactctgctactttaggtgctgctttgtctgtcattctgtttttgtactctccacacatttaatggtatttactggctcagcagactccctgctagactgagattttttaaaacaaggaaagttacttacccaggtttttacacaccaagcctttggcatagtgtttagagaagtatttctcaaaacttaatgtgcatgagaattgtccagagagctaattaaaagacttctgagccccatttccagggtctgctttagtaagtaggggtagggttcaagggtttgcatgtacagttgatccttgaagaacacaggtttgaactgcgggttccactcacaagcagatttttttcaataaatacagactacggtcccacacaaactggtggatttaatccatggatatggaaccttggatacagagggttaactgtaatgttacccctgggttttcatccaagtcagggtcgatgtccctaaccccacactgtaccctaaccgcccccagcatccttaacccctgcactggaagcaaagtcttaaccactgttctgccagggaaggcccatggatccttctttagtatcgatttctaaaaactgttaagaacacaaaagacatttttatgacagcagaacccagaaggatgtggggttaaatggctaactaccgaaatggtaaattatttcacaaaaagataaattaatagtagagaaatgtatgagagatgacatacacagagaataaaaatacttcactctggtaacaattcagcagaatttaacatttctgttgaattacaaattataatttcttaaaagctgctgtagacttaaagattaactccaagttttaataattttttgaactatgcaccatttttaaaagtaacattgaaagctaaatatatttttaacttaaatgtaatattaggaaataaatcttcttcttctgattttttcttgatagttgtttgcaccctaattaacaatatttaggaaaattttaattattcactagcatgaattaagaatatttctaattaatattttagattatatatgaatctggtagtcaataacctagtgccaagtgttctaaatgttcacacaagtattatttctttctgagagtaatttattttaaacagaaaaattttatagcacatgggaagtgtgattatagttccctgtaggggaattatgtaacagaaaaaatacatacaagctgaaatttaagtctgttttcaaaaatctttcaagttgagtgctgtagaaacaaagcataaaaaagaaacaaaagtaattacctccttctaacagaatcattcaatttgatactaagtaataagtacatggaacataaaaacaaagtcaaccattgtttgggttgtcaaccattctaatgaagtgtactaataatccaaattgcaagtgatttttaaataggaagctgcaagagctattcatgtttagtggggcaacgaaataaatggtattaacttataaagagtgacttttatctgatcaaagcttcagccccatgacgtagttccagttcatagttccatgaactgaaaatgttcttgaacttttagaactaaaagctatttattgtgtttacatggtgggaggttatagtaaccccaggagagaactgtctttgttgtggagtaggactaatcggacaagcttattctagtgacgttaattacccaatttctgtaactaacttgacttgttctgattctatgaaccatgttttagtctttgaaggctgtgggaaccaatacagcaaactgagtggcttacgcaacagaaattttatttcttcacagtctggaagctagaagtccaagatcaaggtgtccaagattggtttcattctgaggcctttctccttggcttctccctttgtcatcacatggtcttccctctgtatctttgtctactcttactgttcttataatgacaccagtcatgttggattagggcccaccactatgacctcattttaccttaactacttctttaaagaccctttctccaaatgtagttattctgaggtactaggggttaggacttcaatgtgaattttagggggacataatttagcctgtaattgatcccgacatcctttggactataattagaattcttgtaaagaacagattgaagagtagaatgtgcttagttgaggcaatatcagtttctttgcctttaggacattgatatttctcaatggctcctctgtctatggagttctccagacaagaatactgcagtgcgtagacattcccttctccaggggatcttcccaacccagggatcaaacccacatctcttgcattgcaggcagattctttaccatctgagccaccagggaagtccaggtatttctcagatatttctgacttaacaatctatcactgtacatttatcaatgtgaatccatccctgggagatgtatccactcaaggttctcaaccaatctggattttgagtctgcagagccctatgcctgactttgtaaaaatcatcatttcctattttttttccacttgaagaatctactaccaaaattagggtgctagcctaggttccctagagtcttccacaaacaaacgagaaacattacccttctgccagttggttgggggcaggcactgtctctgctaagcagagggaggaaaagatggaagtgaggcaggcagtggaggaggatgtacaaatataggtgttactgaggtgccatagctttggaacaatggagttataagtgctcggtcttttaggatattttcatggaggccttgtgaattattgaactttggaacagtccatctggggaaatgaagggagaacttacctactagcaccctcttatgcttcaactctgatcaaagttcacccttgaagtagggttgccagatttaaaggtgaaaagccatgcagtatttgtaacagaattacacttatttgttgtttctctgcagttcaaatttgattgagtgtcctgtattttatctgaactctactctcaggatattaatacccacacatttccaggcagctgcagggggagccagaacctccacagatcctgtgcacaggcacgaatatcagtacgacagtgtggtgggggtgatggtggcactgacagcaatagcaatgactcctctctgggcccatagggcagctctaaccactggccaggaggcaaaataggaagctgagatggtgatggggagggtgtgggcaggagtatgcaggcaggctacatagaaa

SEQ ID NO: 56734 - DNA, 1830 bp, Bovine  19866880748868
tggaatttctttggaaggaatgatgctaaagctgaaactccagtactttggccacctcatgcgaagagttgactcagtggaaaagactctgatgctgggagggattggggggcaggaggagaaggggacgacagaggatgagatggctggatggcatcactgactcgatggacgtgagtctgagtgaactccgggagttggtgatggacagggaggcctggcgtgctgcgattcatggggtcgcaaagagtcagacatgactgagcgactgatctgatctgtactcttgacactactattttcaaaacaaataatttgtttcagtaagatattttcctttggttaaggccattagtggtctagttaaacaagaaacttttctctgataatgacaaagagatattgtaaatagacacatgtattttatttttaagagctaaaatgcagttaaacctcagacccttagggaaaataaaactaagcctgttatcaggcactggagattttaaagcagtaagtcaggtcaaaggtgtttagtccacaatgaaaactagacagtccccaaatgacaatgttgctgaagacgttcagaatgaagcagatgagtttttgttgttactattcttggaatttttgtttgcatttgtttttgaaggtttaaatacatgatatctcacttctttaaaaatgcatttagttgtcatacatgataaaacttaaggcagaatcagatatcataatcccagaaagaagaaagaaacaacttctcccatttataaagttcaatttcaagagtgacatcaccaagatggagacatgggagacttcagtctctatttccctttctcccttacaaagtaacaactagacagctatccatgaatgaaaacagctctgggagagctctacagtccacataagaaatttcagcaacatgacagaactaaagacttgagaataacagcacaaacaagggaagaagtcagcttgttttgcctgcaacaccctattccctaagttagcactgcttggcatgaaactgaactccctagctacgaagagtgtatagatgttgaagtataagttctgtctttgctgatgacatattcctgtacgtaggaaatcctaaagactaccaaaaacctgtcagacataaaaaacgaattcagtaaagtttcaagatactaaattaatgtacaaaaatcaattacactgctatacactaataatgagctatttaaaagagaaataaagaaggcaatctagcttatatcatcagaaacaataaagttcttatgaataaatttaaacaaggaaacagaagatttatgtacaaaaaatacagaatgttgaagaaagaaatgaatacacaaataactggaaggataccttatgttcacattcagaagaattaacatcattaaaatgtctatactatccaaagtcatctatagattcaattgcaattcctataaaaattccaatgacatttttcacagtaacagaaaagcaatgaaatacatatatataactataacagactcaaaatagacaaagtattcatgagctagaatgaagttggaggtatcaaacttcctgatttcaaactatattacaaaatctatagtaatcaaaacgtggcattaaaacagacacatagaccaatggacactggtataaaaatagacataacgacccatggaacatattcaagacctcagaaataaattcacacacatatggtcaaccaatatttgataaggaagccaataattctctacgggaaataagattctctgataaatggtgttagagaaagtagatattcac

SEQ ID NO: 56735 - DNA, 1661 bp, Bovine  19866880782371
cagcagcagcatcttttactttcatcagggaggctctttagttcttctctttctgcctaagtgtggtgtcatctgcatatctgaggttatttatatttctcccagtgatcttgattccagcttgtgcttcatccagcccagcatttctcatgatgtactctacatataagttaaataagcagggtgacaatatacagcctcctttcctgatttggaaccactctgttgttccatgtccagttctaagtgttgcttcttgatctccatatagatttctcagaaggcaggtcaggtggtctggtattcccatctctttcagaattttccacagtttattgtgatccacacagtcaaaggctttggcatagtcgataaagcagaagtgtatgtttttctggaactctctttcttttttcaatgatccaacggatgttggcaatttgatctctggttcctctgccttttctaaatccagcattaacagctggaagttcatggttcacatacttttgaagcctggcttggagaattttgagcattactttgctagcatgtgacatgagtagaattgtgcagtagtttgagtattctttggcattgcctttctttgcgattgggatgaaaatttgagttaacaagtcttgctcaatatcatgatgatcatccagaaacatttcaaacagactcaatacccaaagccatctcccaaaacctccacagaacatctagagtgacaatgtcattgcttgtcaagctaccacatatgttattgccatttaacatgtatgggatctgtgcaaatggaaatacagtctacaattaaaaatactatgtgccacatgaggctgtcaattggatatattctactctcaaatatagctccattgagctccacttagtgcaccataatgcttcccataaccatcctttgtgtacctccaaaagagacttgctggtaatattggatcatgggttccattccagctttctttacatgtgttccatgcacatttacatttgaaatatttaaagggacaaataaagttctaacatacttggcagaaggcagcaatctgctttccatcatatccaggcagctgcctcagcaatacatcctcatgacttacgcccacacagaatactgatgttctgctgtttggcatatgtactcaataagactctgtggtagaatttctctcaggtcaacccggaaataaccagaatggtaaacacagcctgtaaacaatgaactgagtgagagccatagttagctgcaataggatgattcacaagggcatccctgatggcttagctggttaaaaaaaaaaaaatctgcctgcaatccaggagaccagggttcaatccctgggttgggaatatcccctgtaaatccagtattcttgtctggaaaatcctgggacagaggggctggagcaggttgagaggagggcgctacagtccatgggatcgcaaagagttggacacaaggatgctgcatcaattctcctctcaaattattcacatagagtccagttctccttctttagaaaaaaaaagatgaagaagtttctcacagcatccaccattagtcagccttagaacttagagagctttagagtataattctcttgttcctactgcattcttccctaggatatgtt

SEQ ID NO: 56736 - DNA, 797 bp, Bovine  19866880796155
aataagaatagaaaattatgggaaaatagcagcttcctggatactacttacaggaaatggattaaaagcttcagtgaaagcaatacaagcaagcttgagtctttagagaagacaaaccataaaaagagaaattggccatcaggcttgagtaaaagcagcttgacctttgtataaaagaactaggatattacaatattttaaaataaggaaaagcatttcactgttcactaaacaacttttacccacatcactttcagcatccatctgggatatgtttcatagagaaggagagcactcagcaatttccccagtagccaagaaggtactctactttcatttagccactgcgccaaatccaattcaaaaagattgagaagatgggcacaaaaataagataacagtagtccttgttcgtttcaacttaatcttttaggtaaaaaataaatttttctaatgtaaaacatgaatcaataacagcgcttcagacacttggccttctctcccaattcccatctctctcagtccatcataatgatagcagaagacctaccacctaaagattaaaatttcaaaagaaatactacatccaagagtgtttatgaaataaaacggtgatattggcttgagaggcttgttcttgagtggagaaagttgtaagcgatagagagtggaaaacttgtctagtaaattagtgtttaacagttattaaagcattttcaatgaattacttcataacatcctgaaaactgtgctgagctagtaaaaaagggggttatcagcatttcaaaggcaaggga

SEQ ID NO: 56737 - DNA, 793 bp, Bovine  19866880798449
tgagtgtcatggtacagtgattaaagagtcagtggaaatttggcatttttccttaatgtgtacattgatcagaaatttgaattcctaaactgggttaaagacattcaattcctaaactgggttaaagacattcacactgggttaaagacagaggtaagatcaataaacaaataaacaaatgtttattaatttgcaagccaagcctaccaggtggctcagtggtaaagaatccacctaccaatgcaggagctgcaagagattcgaatttgatccctggattgggaatatcctctggagaagggagtggctaccaactccattattcttgcctggaaaattccatggacagaggagcctggtgggctacagtccatgggattgcaaagagtcagacacaattgcgcggctttcacttttttactttaagccttacataggatgaaaagagccataatctttgccttttagaagtttgcaatctaaataaatagatataggtagataatatgtgttatttattaagatatgagttcacaattgaataaagcagtatatcatacttgccaaagaatgatacaacaaaaataccatgagagagagaaggtgttctatcatgctgggaagagtatagaaagctatatcaaagtaaactgaaagagttgtacttgaagaacgggtggactttgaatatggatgaagagaggtaaaaacattcttggagataaagaatgagaacagtgtgaacaaagccatggagtcaaagccattttcggaagagagagaaaatcagttt

SEQ ID NO: 56738 - DNA, 2558 bp, Bovine  19866880803902
tggctgggcagaggcagatgagctgggaaactggctttggccccctgagggcaacttagcagggttggtggggggaggagaaaatcattgattccttctctgccactcaggtctgcccatgtgagcttgtcttcagggaggttctcacgcctctgtaccagtcttgagagccagcttcctcctggggctccagggtggccctgggtccttcatactataagcagaagtttgtatccatgtctgtaaagacatttctctggggaaaagggctaccatcacattgaaaagggggctgtctatcctcagaacagttaggaatgcctgctcctacacttgacaggtgaggaaaactaaccagagacccagtgagtagaagcagtttacataaggatgcaagggagtggcaaggtagatctaacagtcagatctcctggctccttctgggagttctcgatgcctctctggtcaatcacttcctgctccacaggtcaccatgttgtcttcactttactaataaatgaagttgtaacttctatttactgagtcctcatgtgtgcacagcacagtgccctttgctttacttagtctatttgttcgcaaaacagaatcatgattttaccgactaggcagccaaggctctcccagtggagagggaaaggttaatcgcttgcccgaggtcagagacagtaactggaggacagagagggcacactcaactgtctttctttctgggcccaaagcagggcttccccctctctgcagtgttctctgatgggcccagcccttgctggtcttcctgtctctgggaagacaggaccatggcaagttcttcataggtaaatgattttggttcagctcttggtcctgctacttccttggtgactgcccttgggcatatttacttctcttctagctctgcttgtgtgtgatgggaatagtactatccaaatcttggggattttaagaggattaaatgagataattaacatccattgagtcatttattcaacaaatattggagaacctaccatgtattgggtttccctggtggcgcagtggtagagaatccacctgccaatgcaggagatgcaagagctgtgggttcaatccctgagttgggaagacaccctggaagaagaaatggcaacccactccagtattcttgcctggaaaattcctacacagaggagcctggtgggctacagtccatgcggttgcaaagagatggatacgactcagcatgcatgagcatgatacttattagaacctaatcttaactaattaaacttgcaatgacctatttccaaataagatcatgttttgactgtactagggattaggatttcaatttacgtttttgagggatacaatttaacctttagcagtgggtaaatatcttgtccactgagtaaaagtgggcttcccatccttaccttgtacattgtcctccattcccagaagctctgctgggagtctctgattccagaactcccagtttcaagacctgtacctagtgactcatggtaaagaatctgcctgccagtgcaggaggctcaggtttgatccctgatctgggaagatcctctggagaagaaatggcaacccactccggtattcttgcctgggaaatcccatggacagaagagcctaatgggctacagtccacggagttgcaaagggtcgaacatgacttagcaactaaaacaatagcaacatgacagtttaccctggtggcaaatgctagaatcagaatattcttttatttcctccctctgctgtcactgtggaagtcttgctagtctctgcttctcaggccccagcaccgaaaccaggagcctttcccaaagccttttagctttgtttataaatgagatctgcagtcaactgcacagatctttcctcaaagggtcactggccagatcttctgactggtcctttaatgactcatctgatgatttctccaggactgatttggtttgattagttcagtgcctaaaactcatgcaggatttttcttaggaacttttgcttccttttgcagtagcttctatttggatcttgtgttgcagtttctcatttctctgtaaatctgctttctgcccctccccccacacactctttgtgtactggaaattcctcacattttctggtccactgatgctgtgctttcctgtttttctctctgttttggatccttctttaaccatatcttttctttaaaatagtggtatttagatgggaaggagatagatgtacctgtttgctctgccataaatatatggtgtatggtgttgatctaaactagagggtcacaaggcttttccttcagagggcctgagagcaaaatattataggctttgttggctataaggtctctcttgaaactactcaacactgctgttatggtgcaaaagcagcctacacaatatgtaaatgaatgaaagtggctgtgtttcaataaaatttgacttacaaaaaaataggctgtgggccaagtttgacatatccctgaaaccagtggttctcaagtttatcatgcgtcagcatctctggaaaga

SEQ ID NO: 56739 - DNA, 2963 bp, Bovine  19866880832918
tttagtccagttgctttttgatgaccttcctgcccttggggctataatcagatgaaaggtgtttatgctgagttgtgtccaactctgtgaccccatggactgtagcctggcaggctcctatgtccataggattttccagacagaagtaatggagtgggttgccatttcctccctccaggggatcttcctgaccctaggattgaacccacacccctttgcagtggaagtataaaatcttaattactaaaataaagttaaaaatgacatattatactgtaaaatcataaacagaatttattaaccagtacttcagttctaagtgccatttttagctcattaattctcttagggcaccataggaaaagttgtaagagcccaccatgcatgtgcagttttccctggtcactctcatggtaccctttccaatgcatatgttttaacttgctcccctatcccaagactggcaaccttctttctctggcattttcagattagacttcagggtacagttgaagatgagaaatagcctggacctaccttaggaagcagcttataccacctcttctgtctcaaaggttcagttccaagtcttgccagaattatggtgttcaaagtcctaacaaaggatttgctatcagagatgttttcttggtgaatttgaagttgaatcagactcttggcatttacttgcaaaactctcttgatgccagaagcttctagtctgtgggaaagggataatgtggtctcagcctcataaactctgatatttaaatttaatacaatataaactcagcaagttatattagccatatttaaactgacaggtacaaatagaacttgtacacaaatactgaaaaataaaaagcagttacccagcaggacaacaaaacagtgattttggttttgtaaacactactagaaaagacaagcctgttaaaccacataactcatagatttttcagtagaacacctctttccttcaagaggggatgccctgatgaatattgggaatgcactgagacaggaggagttaaagatgaaagattccatgcatgttattatgtttgcatgatatgactcttgtaaaggaagtgagtagaataatacaaataggtatatcattgtgatattctaagtctctctgctatccaaaagtccacttccacacttttgctgctgctgctaagtcacttcagtcgagtccgactctgggtgaccccatggacagcagcccaccaggctcccccgtccctgggattctccaggcaagagtactggagtgggatgccattgccttctccgcccaccctaagtacaggtatataatcctaaagtgttttaaaattacatattttgaactcaatgctttgaatatatttttgtgcaaggagcagcttctgtctgtggaaagtaggatccgttatttttcattcatcaggggtcatgttttaattctagcctggctatccctgcacatctctagcacatgcaggttattgctttacatctttcttgttttctattctgagtgtaaagtagaaaatcgtgttctagtattgatgagattccaacatttccccctagatccagaccagaaaaataacacattccagagagctttaccataaactttagattttctgtgtttctaaattatctttggtagcacacccagcagatctttcctatattgctgacttcctaggtagcttttttttttttccccgccttcatttctgggagtagagaaacactaacagcaacaaatttaaaaactgttcttgccttctaaggccttctaacccaaagctgactttaaggtccatttctgaactttactcagcagagtctgtttgtaactcagatccaatcattggttgaatttacatgtgtgtgctgcagagctaaacagaaataattctttctttcatgctcagcagaagcaggaatatcttgagagtataaaaaggagaacttcttttcatttctactcctgctgccccacctaatttgaaagaattagttctgcaactacccccaggatatgggccgacctgtatattatatatacttttatagaaaaaataactgtacagcaattcttaaaaaaatctgatgttatcatcacttatattttggatacctgatgtcaaaagttttcccctcttgcctgctgcttgacagtactatctacatgcacacgtattttttaacaaatacatatttttataccatttgctcttttcctttttgtttttagcttaaccttagagcatacacattttcctgattgctatctgaatttcatgcagttttcagtggctgcatagtgaattgtccattttattgatatacaagtaaatggtttctggctgatttaaccttaagattaaatctaatttgctgttacagaggatgcccagaatgaagatacatgcctgcctaaaatacgtgtgataaatttatttttatatagtaacaggatgcgcttctacacattgctttagtatctctggtgtcctgacccactatagtgtatgacaaatcactctacctttagtgatataaagctgcaacaaatttatgatccttatggatttggtggtcaggaatttggaaaagaccctgtggagatagaattctattgggagcctctgctgggaagactagctgggggttacttaactgatgcttctctctagaagttttgccactcatatctctggcggcgggcctgtgataattcaaatgctgggctcagcgaagaactaactgctggagtgctctcacacaggctatccacatggcttggacatcttccaatgtggcatctcagctctgaaagggaacatcctgcgaggaaaccactggcgcatgggtgttccatgtgtccaagcagaccaagatgctacacaggaaactaaatcatgtcaggctttgtagggcacaggcttcttttggat

SEQ ID NO: 56740 - DNA, 2693 bp, Bovine  19866880848098
agggttttgtgaataatcaaataggctaggggagaaattggtctccaggtatatcgggtcgggaatgtggcatatactcagatggctgagatgggttttgcctgcaatttggggcatctttctctaaatctctcatttgatgatgcaggcagatgagattatttcctcccaaccttgaaactctggatttcctgagagagctcacaatgtctaaagtggttttttcctcctcatcaaacttgactaggtacctagtaccaacttctttcagtttaacagctaccatggaaaattgttatccatttttatgagccaacaaactaaacctaagcctcatgtgtacacaaattcatttgaaagaaaaggaaaactgacaacttgttacctaccattttgaacaggttgtaatatgttttgatgataatctgttcaaaaaggaagttaataaattgtttatgataaaactaaagtgaaattctgaataaattgttgcaagtaatcacttttaggtcaataaggcatttgacttcagtatcctcttccttcccacgaactgattcttagtgaaaaggagaaagggaaaagagttaataattaatttgaggatcttattttggtaaatagaaaagagatgattcagactactattttcttttatggattgggagatagttcaatgcattttgggatgctgtagcttgtaaatacttatttgtataaaacatgctagaatgttttctgggaaatatagacacatggatttacaaactgatttcaatatttatgtttctcagactagcatatacaatttgaaattggttaatgttggaaaattcatatgtattatacttttgaattggatgtccatatctgatatctgtgccatttcaggctgacttcctgttagagttaagggtagagccatgacttggtcaaaatctttgattctggaaactacaatcttctggggagaaaagctttaatgtctgtgctaacatacatatatatgagtatttttggaactattactcgggaatggtaatgatttatgagggtagcacaaagttagataactttttcaatactatctttcctaaacatttcctaaaattgttgctgttatgtggtaattaaatattttaaattttatttttaaaaaacctttttattttatattgttttatagccgagtaacaatgttgtgacagtttcaggtgcacagcaagtaatttttagattaatccaagatttaagcaaatttttataggattatggaattaacaattccaaaatgtgctgctgagctggtaaatatgaggtggtcagggtctctccatccatgatgctactatcctccaatcttaactcaagtctcacaatggccatcagaggggtaagaatacgtatccatgtaaacctatgctcatttggggtttatacttgcttgtaggggcttcccaggtggcctatttgtaaaggatctgcctgtaatgcaggaaacacagttgacatggattctatccctggatcaggaagatcccctggagcaggaaatggcaacccactccagtattcttgcctgggaaatcccatgaacagaggagcctggcaagatatagtccatggggtcgcaaagagtcggacacaacagagtaattaaacaacaacagcagcaaacacaaacctgcttgtggggggtttgatattctctataacatataactttagagcatttttatcacactttacataacagctatatattcattagtttatgtgtttctcaatcaccttgcaaagtaaggaaggtattttcacccttcttttaaaagatgcagaatctaaagatcaaaacacatcaatatcttggctaagtttatctaggaagtttaaagggagaacagagggtggaatctgggtgcactgccctttcagttcagttctgtcgctcatagaccatcgttttttctactatcatctgagcagtagtaatgggtgtattttaacttcaggcactaagaatctcaagtgagagaatgacatagctctaacatatgatgttaataaaatcttatgactaatagaaagttattgcaggcattatgaaagatatgaagccaaatattccaaaatttctctcaaactttagtatcttattttttgttcagccaaggatgtgctattagtcattcattgttgccagaatgagcaacttcaaagaaactgtcagccgtctggcaaggctttcctcccaacatggatccagtgaatctatgccaggctatttgcaccatctgttgggtatgagtcagtggaaggatgaaggttggacagctggagctgtcagctttgaaatgccacttactagggaaataccagaattcactgcaaaaagcaccaaagcaaagtcccttactaatccaaaaagaagactagttaaatatggtggcatttctgaagaaggtcttctctttccagacactcatgtccctttttttatcctacctaacctcttttggcggagaaggcgaagggaccccactccagtactcttgcctggaaaatcccacggtcggatgagcctggttggctgcagcccatggggtcgtgaaaagtcggacacgactgagtgacttcctttttacttttcactttaatgtatggagaaggaaatggcaacccactccagtgtt

SEQ ID NO: 56741 - DNA, 1691 bp, Bovine  19866880905048
ggccctactgggcaagactctggggccagtagctggaaacagctactgaaacaatcttagcatgtttccaggacttgaacaggtctcttacctgctacatcctccagaaggtaagcaaagccaccattgcaaagccagaaagtggccagaagatgtgcaagaaagcagctatagatgaagcttgccttcagggtctagacaaggcacccggcaccttgtaatgcaagggagagaacttggtggatgagtaagcaccatgggccacatgtctagctctccctgagaagctccaagtattgtaagaatttcaagttctaactgatcttacaatttattgtgaaggcatattcaaagtaggaagatagcatatttttttataattctgtttgcttcatctgtaactttcaaatctttagatatatggtatatcaatctttatttttaattgcacctctagcccagcagaagttaagactaggaacagacttgtcttttaataaagactccaatatccctgagcatgattaccagtttttcatttcactgtagcatcatctctatcataagctctaaaagaataaatagaactaactacgtatacataatacatcataaaagccacaatatgcatgcaaagggcaaacatgctgcatacatatattatctgataaagaacagtaaagagcacaaatgtattattcatgacatgaaatgcaatgattaataacctgcaaagctacattgcttcctacctgtggacataaaatgattaattttttttaaagtatagaatgtgactccacaagctatattaactaaaatttaataacttcaacagaagccatgaaaaaagaacagcagactaaaaaatgaactgaattgtgttctctcagtttcaaaatatatatatttacaatcacatttttcttatttattaaaattgctaaatcaaaggatatgtagatacaaagaacacacaggtgtaacttgagaaagttcaaacactgaaagagggattttgccaaagtgtctttgccacaatatgcttctcttcaaaatgtttgcatgaattctttacagaacagtggatcaaatggaccacagtggaccaacaagagaggcagagactattttgtactaacatgtggtatgtgtccgaggacctgacttttaatttttaagcgtatctctgcctgattctagagctataagaaatttgcttgaattgaaaggattgagaaaactaatgttcatgaagtgaaacagtctttttagctggtgcccaaagtcttacacccaaatggtccactaaagtaatatacagatgatattttaaaaatgaaatatttaatgattcaaaagaatcactgagctgagcctaaatttaaaaaactaagatcatagtatctggtcccatcacttcatggcaaataaaaggggggaaaatggaagcagtgacagattttattttcttgggctccaaaatcactgcggatggtgcctgcagccataaaattaaaagacacttgctccttggaaggaaagctatgacaaaactaaacagtgtgttcaaaagcagagacatcactctgccaacataggtccatctaatcaaagctatgtttttttccagtagctgtgtttggatgtgagagttggaccataaagaaggctgagtgccacagaattga

SEQ ID NO: 56742 - DNA, 925 bp, Bovine  19866880936250
gcattttttcacagaattagaattaaagaaattgacaatttgtatggaaaaacaaaagaccacaaatagccaaagcaatcttgagaaagaaaaacagagctggaggaataaggctccctgacttcagactatactacaaagttacagtgattatgttaaatttttaagaccttggtaaaaaaaaaaaaaaaaaaggagaatccacctcacttctactattctgaagcaaatagcagatctaattaaaaatttacccaggagaatgtcagtcagacaaaaacttatgaagaaaaactacaacataaaaagtgaaagcaagcataacaagcaaagtaagatgtaaaggtatgcctttgaagctacattacaggaagcaaaagaaagcttttaagcatatatataatggataagcaaaaagatcctactgcatagcacagggtactatattcaataccctaaaataaactataatggaaaagaatatgaaaaagtatctatatgtataactgagtcagttttctctataactgagtcactttagtgtatagcaaaaactaatacaacattgtaaaccaactatacttcaataacataaaattaaaaaaaagaaaactaagtaaaaactgctttgctctcccaagaaaattaaatagactcaatgagagataaactcacataaaatggaatatgacaggggttaagtcaaaaaaagaatatgagagttaagccaaaaaaaatctttttttaatctccaaggagttttaagtggtattagaagctatataagcttagaagctattgaaaagaaaagtagaatcaacatgtcaaaaatccaatcactgctttggatgagaggctttaaaattcacccagaatatggggtaagggaaaaatatgagagacattgagaacagacagaagaaat

SEQ ID NO: 56743 - DNA, 1675 bp, Bovine  19866880994100
ctaaaatggaaaaatcataggggatcaatagatatacccaatagccagctcttgaatgtctcaaaagatgattttcctttgaatgacttattatcctaacattggccaatagttgtgaggtttgcactgactcatccatacttcattcagtttcctatttggccagtgacatatatttgtaaatagtttgcaatcattagtactcaataactttactgttgatttgttgttgttgctacacacagttgccaacaaaggtctgtctagtcaaggctatggtttttccagtggtcatgtatggatgtgagagttggactataaagaaagctgagtgctgaagaattgattcttttgaactgtgattcaaaataagacttttgtggcgaagactcttgagagtcccttggactgcaaggaaatacaaccaatccatcttaaaggaaatcagtcctgaatattcattggaaggatgatgctgaagctgaaactctaagactttggccacctgatgcaaagaattgaatcatttgaaaagaccctgatgctgggaaagattgaaggcaggagcagaaagggatgacagaggatgagatggttggatggcatcaccgactcaatggacctaagtttgagtaaactctgggagttggtgatggacagggaggcctggcgtgctgcagtccatggggtcacaaagagtcggacatgactgagctgaactgaacacatggttgacagtaaaaatcatggagtcatgtaatagctgtgtatgtgtggttttgtttgtttgtttgtttgtttcctctgtgtgaagttaattggactatgtagaaattaaattctctccttggcctgaaaaaagtcctttttatcatctcagcaggaaactcattttaggctttttaaacatacttgcatgattttgatgagattatcatcataatcattattattatccctcattaagtgcctggaatacaaggacataccatctcaagctttcactatttttaaactgcaacaattacagcaaattctgaattccaagactctttgcatcatctgggttaaaatgcttagggtctttggttaatagttgtcttcatctttatagagacatgttgataactttaaccaaccaaatgagactttgttaaacacacagacacgcaactaacagctgctttgggaaatatgtataatgtatgatatttaacagatttaaataatagatttcctttagtttaaaacctgtttttagtctaaatagctactatactgtacaaagaaatataacttggagcagtattttccacaccgactagggaaagagcaatctgacacccttatttttcctggactccctgtgccagggtctctcttctttaatccagactgcatattgccaccaatataatttcagttcagttcagttgctcagtcatgtctgactctttgcgaccccatgaatcgcagcgaccccatgaatcgcagcacgccaggcctccctgtccatcaccaactcacagagtccacccagcctcacgtccatcgagtcagtgatgccatccagccatctcatcctctgttgtccccttttcctcctgcccccaatcccttccaacatcagagtcttttccaatgagtcaactcttcgcttgagggtgccaaagta

SEQ ID NO: 56744 - DNA, 1099 bp, Bovine  19866880996259
gaatcaaaattctgtatattaagactactaggatttcttttttgttgtgtgactttaaagaacctacctaaagggtctgtctacagagagattcgccctgcttttataatttgactttttgtacttcataattaatcactcaggaattaacacattccctcaattatctcctgaatacgatcctaatgaccattagatctttccttctaagccctgctttgacaagatatactgtctgatatcttattggcaatgtgtttgatctctattgtgttgacaagtaataagttcagtaccagttatgtgtcctgtttctgtgatcgcatgtgccctaaaatcatgcatttttgtattaacctcacctctagacacatggtcttctaacctttattattttttttctttatactaaatttctcacttattttttcatattacctttttatatctttataagcaaattaaaatattctagtgacaaaaatacttgagaacttgcaaggtgaatgctaactgaaacaattcaaagttgatcttaaaaaatattttcttaaagtaaatatgaaatctaatattttatgctactataattgagtcattcactcccaagcttactgtatattgtttctcatttaaacaataggagtttaaattttggcacagaactacaaatgtcacaattcaccagcttgctgtcagctacattaattagctacattagtgttctacattatgattcatatgaacacaaatcacaatctgcaaatgtaattgagctccaggtaacaatcttcttactacaaaacattcaggagttccgagctcatgtaaaactgctatttttcagctacaagaatgtatcagtgtaatacttgttacaattatcaatttaaatggcaccatgtggtaaatttaactgcattaattacatcttgtttgtcatacagaggatagtgccatttattctagtttcaggtgtgtacagaggaatgtacagatttatttcctctcccagaagatgcattgttacttatgattttttaaaaattaacattataagacaaaataactgtgaagcaccatagagatacataagata

SEQ ID NO: 56745 - DNA, 693 bp, Bovine  19866881008001
agactttgggggaaatacagatatgttctctttccaagatatgtcatagttattttttaataacataaatttttaatgtttgaaataggaaagtatattttttttgtgatatagttagcatcactatttttttctgtaacagatcatgtaggctttctcttatctttttggctttataagaatttcctttcccttaataaatctaagacagcaaacttattgcttgattttttccttgactgttctccaactgctgacatcatcatattccttttggaatgtgatctgattttctccataattgctaaatgaagcaattatcttgtgtatatgcctttttatttaaacagttatacctttaacaattgtgtcttgtggattttatacatgcttttaaagagctaaagcttggctctcctaggagacagtgttttgtttttcttgttgacatgtggggaaaatatactttaacatattctattttgagaaggagtcttttgcctgtagtcatcctgccaaatgatgtaggaattttctagttattgtcctcatttagttaaccaataaatatttattcatggcctattatgtgctcaacatgttacttgtagactattttagatgttttaaaggaaataattgtaaaatatgattgcagtctttatacacttgcacaagttagctattaaaata

SEQ ID NO: 56746 - DNA, 635 bp, Bovine  19866881018677
tttttctttcttcttttttttcctttccccttcctttctctcctccttctctccttccatcattttttttttttcttttgatttaacatctcattagctgggtcagtcactgttctaggcactaaactttttatttaaatttaccaacagtgctggctgttatgaaaatatgagacactataaagcatcctcattgggtgggtagcactgcttaattgtgcagagcatggattcaatctccttgaaagcacttctgccctgactatgatatttgctattattgccaagtaaattatgtctgtgtctctagcacatgaaaatgtgcagaatacagtacatttgtttggtgctttattgctgaaatgctcatgaccttggctgaggacaaactgatagtttttacagataatattcttcctctgcctatgagtctctagagggaagagaaaatgtcctgtggaatccctgggaattatcaactcacttctgagatcttaagccatcccctcactggcttcaaagatgccattatctcttcagagatgatcagattctatgaatatagcaagttttctcgagactgtaatatcaattttggaacctgactacatttttagtattctgacctcaaagtg

SEQ ID NO: 56747 - DNA, 1047 bp, Bovine  19866881125311
tgaccatttctgcgccaggtagttcttggtcctttagatagatgaataaaatacagtcccaacctccaagactatgtgagtctggtggggaagctcagagtttcttgtgtttacagggtcagtttaattgctagtttgaaaggactttgtaaaccatgtaatcttagcaggcagtgttgaaaatgaccacatgaggtgtactagtttagttctcaagagagaattttgtaggtaaaacgaacaacctccctccaagcctgatttatctctgatatgtgttaaaacctgagacatctgtgtagatcaaactagttgaataatcactaattcctgctctgttgcctttttgctctatattatagccaaagacagtttgtaggctgatcagagacttttgttaaaggcttgtgctaagatagttgtgctgcactgcatttcaaagttgcgtcagagtattcaataaattgatttttctgtcccttctatttctcattctagaactctgccataaccagttacacgcggtttccattctatagtggggaaagcctgtaccttgagtgacagaggcaggcttttgaagttttcatgaaatggtgtgttgacttcctctttgttcattggagagggtaggatgtgtctggctcatctaatttagacacgtgaaagtcagatcccagttctacttttgaaaaccatctgggctgctttttattctccaaacccaggagccctcagtgaaatcaatgggcttggcaggctatgtctgtgaagagatgaggttaccttgttgtgtgcaagacattttttctgaggcctggacacaagaaaaacaacttcctcgggtgataattttttacaggaaaagagacattttgagggcttctgtggagtggttgggatttattagaagataggacatgttaaatatgcttttaaaaatgatgtaaaagcaagtatgtgttcaagtattttttagttttaactgacctctaaaatgaaaagcttaggacttaagacaccatttcttttctttttttttttttt

SEQ ID NO: 56748 - DNA, 2893 bp, Bovine  19866881165084
aatgtccaataatcattcatcttccctctaccagttccgctttcaacgtcccccatttcagtttataatactgctttcataaccaagcacttcaccgtaaacttcaccattatttttctttcttcaagcctacattctctttcacttcaattacttgcaatgtcctgacgtatcaatcctgattgaaaataaaaaccctctttcttctaaaaaaaaaaaaatgcatcctcttcaccctggagcctcagaaggaaagtatatgtgctacagaaaaacagataagatattcacctaaccagttagatgaggcataatgaaccttggcaacaaaatagtaacagataatgcaggctgttcaacttcatatccaaatccaacatcatatctccaatgtgcaatccctcctcttctgactgccactgttctcattcatctgctctgatgtggatggtgtaccttcttacctggacagtggtagatgcctattaactacgccaacatctcacctctacccacagcactttattctgggtgaagattctagatgaatatttgtttcagtcatgactatagactgtaagccaccaaaacggacttgggctaaatgaagcaggaataaaattgtacacagaatgtaaggaagtcctcaaaaatcagttggaaggctaaagaaacaagctttaggaaactgggcagaaacaaagaaggccagaaagaggggaatacagtcaaggtcatgtttcaagaagagtcggggaagggcacagccattgatattatgccactggacactcctcattgccccagttggatacattgttagtatgatagtttgctgtaggttactacatcactctgctaatccctcaagttaaaaaatttcatgggagtttataattggcatatggctgagtcaaggccatgtgtctctggcttcaagtagggagaagaaatgtctgcctcctctttggttttcatagtggaagacagacctcagcctccaactagtatctcataatagggacttctcccaaaacaggaatggtgactggattctggatggccaaaagcatatgagtaatgttaaccatcacctttaaacgaaatcctcccctttgaatccacattcctaccatcttatttaaaggaaacttttacctttgaattcacattcctcaccagagagactggtagaaggaagatgaatgattactggccattatttagctcatttgctcctggtgttagttcattctgcatgctacctatccatgtattcttttccctcccccacctcctatcctcctcttcatacagtaataatatattttcatagtttaaaaaatcaaagcaataatcacttcatcccccaaatcctttccagccttttaactgattcttcactgaccattgttcagtcccattacaccttccagatacttcttcctgctagtagtgacccttccttactctacctgtacaaaaggtacaccaccttcaggacccctgcaatcaaattcaacctctctcaaaaatcttccttgttcccagataatctgtctctgatctcaacctaaaatacttacattcttcttaatttatattttaattatttgcatgcactctatctctctctctttagattgcaatccaagaacagaatatgatttatttttcatgtctttacaaatatctttaacataggtgccaaataaatgcagaactgacattgcaaatgtagcattcaaaagcagacctaatacataatacttcacaaaaggaagctgattaccgaactgctatggaacaaaaagacaaggatgatataataatagaaatgttctctactttaagaaagcttgatgtaatagaaaaatctgaatttaagaaactctctctctttaaacatttacctaacaaaagtgtacagtttaaaaaagatttacttctaacctttaaaacgtaaacttgcttggagtataactgtggtgttggaaaaaaaaataaaataaaatataatttgacttgcaaaaatatgttattttaaataactattgtataaagaaaggtgcacatacacataaatacaaaggataaaatccttttatcaaactcctactcttccaaaaataccctctctggctctgagatctacaagtaggcagcaagaaacaaaacaaaacaaaaaaatagagctggtttaccagaaagctataaatgatgattgaaggtttggaaaatgatctattaaaggaggtcaagaaaatggatattatccagtttgaagattaaagattgatttgggacaatttaacaacaatctataaatacatgaagggctctcacacagggaataatcaccagctactcttcaattccaatttgggccagaacaagagaaaaattatgttatctaaaaggaagaattcttgatagtaaaatcatttaataggaaagtggagtgctaaggagagttgtgaactcttgctccctgtgagatggctttaaagtgtggctcaaaacacacatcctgcctagaggtaaaagaatgcatgagataacctttcatagtcttttccaatgtctagagtcagaagttttaaatttatttcccttttataacattttactgttttataagattccctgttttgcctacgaaacactgtattgaaagaataattttaggacttggttatattccaattttctcccacattcatcttaaagttctgccattttaatgattactttctggcatctatttgagtgttaaacattgggagaaggtgagcaagaacaaatgcaatataaattttgaaatatactgtagttagcttctatattatagttctggataaaacaactatatactgaacttgataaaagaaca

SEQ ID NO: 56749 - DNA, 1504 bp, Bovine  19866881260836
aaatgctatcaaccaaaaacaaactgtccccaccccaagacccttccagaatgcatttcaagctgacacatatttactgagtgagtatttgaatggctgtcttagaatgttagaaatgactctcaagttgaaagtgacattgactatacccaaaatggaatattttttttccttagagaagttcatgccagctaagccttttattgtagaaaggttggcgttaaatcacagggttaagtcaactttacctcctccaattttggtgcttcatttttattttggacctcctgcatacttaatggtggtagtagagctaatattaaagatgggctggggttggatttcatttgctggcttgcttcagctctccttttattatctctggttacctagcaacagataatgttgaactagggccagatgatgccatctaggctcatccttctgctatgattctgagtgtttattcattaaccatatttctttaatgttcatgcaaaggtccatattagtgtgaaaaatgggaaagagtgatttggttaatgaaatagccacatgttatttgaatctctaatatagtgcaagcttgctttaaaaatatgcttagtaaacttctttgtgtgtgtgtgtgtgtgtatatatatatatatatataatttgcagaaaaaataatttggtggtgacttactataatttaaaaagaagtgaaagtgatttctctataggtggtttctttcaaatggcaggtttaaaggtggctgatcacagtaaggaactaattgcctggttttaactaggctcactgctgtaagagatcttgaaaatatttcttctcctggtgtttgtatcaccttgagcttcaatataatgataccatactctttttgtattgagccttatttcaacagaaaatgtgagctattttcactttttgaaaatcagaattagtgtaaaaagtttaaagcagctaaaaaaagcttttcatcttttaaaaattctgctcagagaagtcagcttgttttattttttaaagttaataatactgtgactttagcttctctcgactatttctgtgatattagtcacttttacttcataaatatgattaccagtgcaagtggagtataattgcatgaatggatttatggagaaccatgaggatctcaaaattatgtaatctaaattctaaaattaagattatctagttttatcactaactcttcaatctaaccaaaatttaaatttagaattaataaaatcaatgtaaaataaaatgttcatttaaaaaatgacttctaatttaatccaacaacctctatgtttattatgtttatatgactgatcaagacattttaggtctttaggtcttgcaaatatgagaaagcaaagtccttgttttcaggtaacttatgatttatgaaagagacaatggacctctaagagactagaaccaagatagaatggaacagaaatctatgcagatataaatacatgtacatactag

SEQ ID NO: 56750 - DNA, 741 bp, Bovine  19866881308587
ctcctgtggcttaaaatacaatggtttgaaattggtggattgtttttaaaggtttttttttttcccttctgtttgagatagaaaggcagaattttactcaccagccccaccctcatccttctccaaaataaaaggtcaaattgcttcttctctatttttaaagacattgctttaaaaaatcctgatgtaaatgcataaagactgttaatataatggcctaaatggcatcctcctccactccttctctacaatgaaaaccaaaagatctaaaacttcttaaaataaagtatattcagatgctaaagaaatgaactttaaaaaatctataattgaatatatatatctataattgaatatatataattgcaaaaattgtcactgtaatatcatatacctcatggaatagtcatttggattatgtgatcatttattttaactcccactcttcttggaatagatataattcaagaatttatatatccagaaatctctcaggatcactaattctaccaaagttagaacttatttaaatattgattataaattaaaattaaattattttaaaccttctaggctaaattagccctggtagcacctctgttcaaatatataatgttatttaagggatttttttccttagtatacatactagccatatgcaaagttttttttaatgaaaaactaaaagcatagactcagttctaaaaagggaccatagttaaacttcttaatgctatatat

SEQ ID NO: 56751 - DNA, 1031 bp, Bovine  19866881402726
ccttgcttgttgaaaagtggtttttatttttttaattcttatttcatttatataaattaataaagataaattacagaatttatggaaactatgaaaaggaaagctctgctcttgttacagccagttgtcttagatcaggtgagcagaattcaggtagcaaagattccttgaccaaacttcagtcaggcgtctctgaactcttcccaactagactgtgccttttgggcttatgttttcatctttgcattgcccagttttagcaagagttctgctaagtcactttagcatgacacccccacccttgataactgatacctaattcctcatctcctaaccctgttacctgatcactctgccctgcctgcagcaagaatcctgttaaggtggtttagctggatggaattcctcctcacctcagaggttttctcttaggaaatttatacccactgacccttgccctgctccttgtctgtaaatccccacttgtctatgctgtatttggaataaagcccagttctattcagaagtcttttcccccttagtgcaccagttcctgaataaaacttttgtttatttttttacaactttcactactgtccaactactctgattttctgggaataactcagtacatatttgtcaaacaatgttcattatgtccttaatccatggaattaagtagtattagtaaaccagtcccactcctgctgttgtcacgttgcacttacagggctgtatttgcctttgatgatgatcatgaccatgtgttaggtgtaagagaaggaagggacatgaaaatgagaaagaaggtcatcttcttattataataaatgccatttggaaatgggtaaataaaccaattggtattgcataaatcagcagatgtcaatgcagaatagttggggatgtgttctctgtccacctgcttctgtccgctgggcttgactcacatcaaaggcctggctcactccagagctgtcttggccttaagggagaacagaaaagctagagaggtcagtaagggtcaagaa

SEQ ID NO: 56752 - DNA, 1346 bp, Bovine  19866881415138
acatgagtttgagtaactctggaagttggtgatggacaaggaaccctggtgtgctgcagtccatggggtctcaaagagtcagacacaactgagcgatttaactgaactgaatacatatgatgtttaaatttgcttgaaaatgttaaaactttatttattgttcaagaccctattatgtataggtgacaagactgaggtcaagagactttgcagttctcctaagcaacacctagttgaagaagtagaattcaaatctcagcctttatctctctggcttcattctgaataatgacaaaatcaaagttgaggatctatttcttcccaaatgtcctttgcaaatctctataatttcaaatgtcctttatttgataatgcctggcttttttctaccttgagttgcccaggagaaagcaattgtgataattatgaaatgactgtacaaattcactgcagtgaagaatgaaaatttcagatagaaagaatggaaatgaccagtcctaaaatcttatcacctcaacttcagaaggactgaagctgaaactccaatactttggccacctaattcgaagaactgactcattagaaaagacccagatgctgggaaagattgaaggcaggaggagaatgggatgacagaggatgagatggttggatgggatcactgactagatggacatgagtttgagcaagctccaggaattgggtgatggacagggaagcctagagtgctgcagtccatggggtcacaaagagtcagacatgactgagaaactgaactgaactacttcagaaagtgcttctaaggtctttactgttaaagtccagtactcaatgctggatgcaatatatgggattataaaaatgtgctaaaataatcattaataaataaatttcaggagtgccacatataaataggaaataacattggtagggtttagtcttgaaggcaaggattatgaatgtccacttgatgatacattaaaagaaatgagtgatgtcaaaaatctatatcatagcaatataaacattattttatttattatagatgttttattatttcttgtaaaacctttgaaaaatgttatattatagttttaactattaaataacagtagtactgagaatgctacttgaattttgactctatacttttctggtaagactttatattaaaatgttcctatttgaaactttaatagcttgttaatccaagagaagactaattcattggagggtgcagaacaggctactgccttttcaaagccccaaatcctttaaacctcttttctccttcattttagaaacatgaatagcatgactcaaatctggcaggcagtttttttgca

SEQ ID NO: 56753 - DNA, 1976 bp, Bovine  19866881618042
tgaagagttgactcattggaaaagactctgatgctgggagggattgggggcaagaggagaaggggatgacagaagatgagatggctggatggcatcattgactcgatggatgtgagtctgagtgaactccgggagttggtgatggacagggaggcctggcgtgctgcggttcatggggtcgcaaagagtcggacatgactgagcgactgatctgatctgatctgattgatatggtaaagaatgccttaataagtgaaacatctgaactttgaagaaagaagtgatggctagtggctgcagtccagaggcagtaagaagtgttgctatataattaggtgccaactctcagtgggaaggatgagaatccagaatggcatagcttagggagcagaacttatctgtgagaaataagggaggcgtaattactgtactaggcaactgtttcttcctattgaggactaagataatagctaataaatcatgactttcttagggatttgactgatgtgtacctgacaaggctattcctccatttatataacaaaacaattaaatgctggcaaacagagtggaaattataataatctcagagtacatgaaattttaaaacgcactatgcattttgataatcattagtagaatcctccttggatgactcttaggggaaaagtgtgtcatttcatacagaaagatgatttttatggtcattaatgaataataaaaatttctcaaattttttttaatggtcaagtttaaggtctcaccaatctattgagtcaactgaaatcattttgaaagtgttcagtatattaagaacgatgggattaataagaaattattattgtttaatatatttaggacagccctactgtacagttagctctcatttgagaacaaatacagcccatcagtgctgtggacagtgatccacagaaatagcaataaaagtttcatttatcctggcatccgacaaagttcagggtttcagtctccaaggggaaaccaacacatttgactgttcacctcaactaaactgaaccagaaaagtaaatctgctttgaaaatacagtgttctcaagttgagtctatgtgacatagattattcttgctcttctggacaatctctgccgtcactgtactctattaacaaggggaagggagaatggcctgaaatcacatcttattcatagacagacttttaaatcatatttgtcaagggcttcactatgttacctttagaaattgtcaggcatattaatttatactcacatatgaggctgaattgaataacaatctaactagccattgctgacaggaacactgtttgtacacaaatgagaccaatgtacacaaaatagaccaattgtgggaaatccctaggtgcgggagtttgtgtccctactctcactgttctagttcacatttatggaaatggaatgttaatcgacttgggattatgtctcagtagaaatgttcatctctaatcaagagtataaactgtattgatactttgcttcattattttctttgtctcctctcagataggatttataactggttgatcattctaaaatgttgaagttagtatccagagaggaaatagaaatacgatatacactagaacacatgaaatcagcatgtgaaaatatgatcagaatactataaaatattctggtcaaaaagactctagccaaacagatgtcaaaagcaacagaatcctgtgcaattaaatgtaaaatgcatgaaaatctattaataaaaattaaattgttagctctgtagtaagttgagagattgactttagttactgtttctcttaattttgcaaattgaagcaaaatgaacaatttgtgctgggaaattcctttgttactatgcactgtgccactagatagagaaatgctataccatgcgaaaaatcccgaagtttatttattacttgctcagctgtagccgaagagggatgtaaggataag

SEQ ID NO: 56754 - DNA, 1903 bp, Bovine  19866880356909
aagggctgagcatcgaagaattgatgcttttgaactgtggtgttggagaagactcttgagagtcccttggactgcgaaggagatccagccagtccattctgaaggagatcagccctgggatttctttggaaggaatgatgctaaagctgaaactccagtactttggccacctcatgcgaagagttgactcattggaaaagactctgatgctgggagggattgggggcaggaggagaaggggaggacagaggatgagatggttggatggcatcactgactcaatgcatgtgagtctgagtgaactctgggagttggtgatggacagggaggcccagtgtgctgcgattcatggggttgcaaagagtcggacatgactgagcgactggtctgatctgatctgatgaagaactgtccaggctgtgtaacaaattctataaatttagcagtaaaaccaacacccactacaatcccacatttcccgcaggtcaggggtccagctggttctctgtttagtgtctccccacgctacagtctgctgttgtggtccctcaaagagttgactggggaaaaaccagtttcccatcccttttgagctgatggcagaattcatttcctgtctgcaggactgaagtttttagttccttgctgagggctgctttcaactctcagagccacatgcagttcttaggtcattttttcagacatgaccacttacatcatggcttctcgcttcttcagaggcagcaatgcagagagattgagtcttctgtggcatctcttatcgcaagggtggtattccatcccctttgtcatggaatgaaaaatagttgtggaagtcacactccatcatccttgccacactctgtggaagagcattaaagatatgactaccagatgtgaggctcattttaggccaataggatgtgacctctcaaatcactgggaataatgaatatttgataaaaggtgttaaaactggatagtcacttagaaaataaaaagggtgtatatttatcccacatcatgtaaccaaataatttccaatggattagaaattcaagtctaaaaatgaaactgtttgagtactagaaaaaaatatggatgggaatgaaaaagccttttaaatataacttaaatttgacaaattggttatttcactgcattaaaaaagacttggcaaaatatcataagcaaagtcaaaagacaaataatcttgggaaaaatatttgcaattcacatgacagacaaaggactcatttttttaatataaagaagaaaattctgttttttgttttctaaggaaagaatacaaaattagtaacacagccaatcaacaaagtatatgaacatgcaaatatacttacttatagtaaaataaatgcacattgaaactgttttaagatactcattccttacccatggggttggcacagatctaaaactaacatgctcggctattgacgaggttttggagaattgttaactgaatggaagggaatttagcaaaatccaacaaaattgcagatgcatttacctttctattcagctatatcacttttggaaacatcacttcaaaattcacatcaacaaacactaaccagtatatttctgtagttattcagaatacattaggataaaaataacccagaagtccagtgatagggttgaatagactgtggtaacaaatggctaaattaagtatgaaataaaattatgtgaactatggtgtgaataaaatgaaaaaagaactcttgtattttaagtacaaaatgcaaggtacaaatagtacatatgtcataaggtgtgcttttgtgtgtgtgtccagaaaaggacatttgcacatcgtttttacaaaacttacccattgtataatactttttgtttatattaaacctccttgaaa

SEQ ID NO: 56755 - DNA, 703 bp, Bovine  19866880655900
ttcctttatgaaatactaatgatcatcagccaaagatcttaaaatagaacccagcttcagcacttctatcatttcccctgaagtgtcatgcaaagaattctctgaataattgtttcagcacttggcaccatgtcaccagtggttatgaatatgcaactaaatctttgcaaagctgcagtgaaaaaaaaaagccatcaaaatcttacagtacattcagtacctttgtattgtataaaaaggaataataaaatataagaaaaaataagtcaattttattgcaatgaaatgtataacaggttaggatctgtatagaagtatctcaaaatgtagaattacatttgagtgcaatgtacataatcaatgacacattttctttttatgacatgtctactttttaaaacctattaaaatctggaagacattcttttataattaagcaaattaaattctctctgttcaaccaataatcacaattgaaggaaacaaaatgtactaaaaaggaagataagagttttacatgaaggaagaactaacaccaaggcttaattgaacactcgggggccctgcagcatccaggatgtttcatgctggtgtttctagggaaggctgtatctgctcatgactgcaaagctgaaagctgggcaaatggcctgctgccatttcgtctgtcctggatgacactttgccgagacactgggacaaa

SEQ ID NO: 56756 - DNA, 1296 bp, Bovine  19866881079847
cccgatcccagtctccatggcactctggtggtacagggtttgctgcacacatttttcatgtgtcaagtctgagacttggacaggatagagagcttgccaaggtcaggtctggcaattatgtcttctgaatgggaggcccacactacatagctattccttgcaatttgtgtgtgtgtgtgtgtgtgtgtgtatactcctaagagatgcaaagccagcttcagcttttgcaaatagttaagagagaaagccaacagaggcaggtaaaacctgacttcttaaacacgatgtgagggtgcttatgctccaagcagtgtgcaaacttgagtccaagaatttccaagtcaaccacatcaagaatgctgctgacaaatccttcttgaatcttaattatttgttcagtaattggtggcatttgtctgttataatttgtcaactgaaaaagcaaacaacttgaactcatttgtagaaaactgcatctggaaagaccaacagagtaatcatgagggaaatgttgctggaaaccactaagcaagcgattacaggaagaggaaatatgagctgtgctttagtctgtgctgttgagcagtcctgggaaatgccagtggccaatgagaaatcaagttgaaatgcacactcagccaatcaagtagcttatcatatgtggaaatgtgggcgagagaaaagagagcaagagaagcagggaggggagatgcctggggactctaaatctctgaggcaagagaacatgctgcctaccagcaatgggcaggtggtgtctgttgctatttagctgctcagtcgtgtctgagtctttgtaactccatggattctagctcaccaggctcctctgtccatgggattctccaggcaagaatactggagtgggttgccatttccttactcagggaatcttcccgacccaggaattaaacccgcatctcttgcattggcaggcagattctttaccactgagccgccagggattttcacaaagaaataaccagcaaagagcaagtatattccattgaaaattaggaaagactacagagcaatccaattgtaaaacacttccttcttttttccttctgcaaagcacccttcacaataaaaggcgatggaccccagaccatgccacatgttttaagaaatagagcgttagagccttcctccctccatcctcccttccctctcttcaccctctgttcttccttccatgtgtgtctttggatagccctctcatttcttctctccttccctccctccatacttcaatttatttttccagccatccatcca

SEQ ID NO: 56757 - DNA, 864 bp, Bovine  19866881100059
aaccctgccttgaactgggagcccgtgcttgttgagaggcattgcctcctcctggacccaggatgcctagtgctctgaatttgtctcaactttcctcagcactctgagctcactgtacaagcagacatatccagtctcactgggcagggaaggagtaagcctggtagtcccagagttaacacattgtacagatcaaagacttacatccattgttagaatctgctctagaaggactgagaattagggtgtgggttttttgttttttgatgtccgaaactgataaagtttaacttaacaattaaaaaatgtagttatgttttacattcctaaagcatgattaaaaaattcacattgcccaaatggctttcagctatgactgcaagtggtgacattctgctcatggcattcagatttctatctttgaatgccatggtaatcacttgcttcctttcaaggctgtcgtgtctggcacgaaatggaagaatttaaaataccacctcagtgggctcacatccaacagagctggaacttttgaatgtgcagttaatgactccttgtgggatatatgtcaatgagacagtgagacaagtggtaactgacagtaaaacataataataagtaaatacttctaacagaactatagtgtaattcaaggctacagataagaaatttgagatccactcactcatgatgtagtcagattagataaatttggctccccttgatttatttagctccaaaccagtgcagatcctccagctggccctcggccctgaggatacacagggacaagcatcaggtgccagcactggggaaggagttctgcctcctgactgcccagccccagtgtgtgtaggcacagag

SEQ ID NO: 56758 - DNA, 1138 bp, Bovine  19866881224820
ttaaaatagtgttgtattaagttattttcataaattttagcaatgatgttggtaactcactcatggtgaatattttaaagaaatttcagcctgattaatatttgcttgcaaaacagtcacaagaacacgtctgtcaataaatactaactcaaaaaaagaactgaaacctttcatagaggggaaccatttaatcactcctcagacaagatcacatttatgaagctctttcaatccttcagtcaacatggggcaggtttactgagttgcagcagtaaaaatttgtttataaaaaaaaaaatgtgtagtaacctagaaactggaattctacacctcactgctggattttctgggttttaagattatttttaagcatgaggaaggaaaactgaaaacatcaagtattaatcgattgagaatgttgtcaattgtttgaacagagtcatctgctttctaattcaagctacagtaaatgaacacaaagatcattacagaaactagcattttgaaggcagtgtgcctaaatatgtaatttctgaaggcatttttgccctgagaatgtgtactttcattgtatttagaaaatgaacatttttaagtgaggaggaagctgatgaaataaaaaagaaatctctttttgtgactttattttaaaacctgatatacttgatatattaacttgcttcctcagggcccttcttcaaatagattaatgtagtagaaacccaactggttgtgccacaattcagtttgggcactaaccatcagggttagcacagaccccacaagttaaagggcgtgctcccaagcaagatgctctgtacttcagatgccaggcacacttcaggtatctccaggctacctgtgcttctagctgactggccataagtttgggagtcactgtgtagtcccctaaggcttaattatctcctataatgactcacaaaaatctggaaaatgctatccttatgattacagttttattataaaggatgcaaaccaggaggcccagtcaaatgaagagatgcatatgggagagatcaggcagggatgaagaatctccttaccttctcattaaatcaggccacgtcacactcctattatatcgggggtgctaacacattttgttcaaaagctgtta

SEQ ID NO: 56759 - DNA, 1496 bp, Bovine  19866881234074
aaaaatgttagtttagccagtgctttgctgctaatgttcaagaaaatctttaaatactgggcaggttaaaaattacagagttcccttgatttgaaattttacagattggtatgattcttaaagttttcggttgagaatttttttaattgaaagccaccattatgtcatctatttagaatagtcaagttgaagttcacaagtttgttcagccctagattatgctagtaccaccaatttcagtgtcctaacattaggtcgtgtttcctctattgtgcaagttaacatttggtgtgtagtggctatatatgagcagtagtatatttaataatttaaatgtatagaaacatttctttcagtgttctacttgatttgttattaatgtaaatttattatcaaatcaattacatagtcatccaggaatattttgaataagcattaaagagcccagactgaaattttgaaactgagatttgaatattgtcttcacttaatgttactactcagtgatttcaactctacagtggggaaagtgacagtctgtaggtttactgtgagaaagtttagttaaatgacctctcagggttaagaacctattaaaacagtatctggtatgtggtaataactttgtggatataatatgttatcatcaaccatcattattattagcactgagtaatttatgaggtaaagacaaattgctgtttggtatctgtatggcaaaatcaaagtttatctttatgacttgcattaatgtgtagtgtgctttgcaaaccatctcaacgtatataccatctaaagtaggatcatttagtactgagcatatctcccatgacttattgtcctgtttttcccctttctctctatataggttacctacatctcatacttgctttaatgtccttttacttccggaatattcaagcaaagaaaaacttaaagagagattgttgaaggccatcacttatgccaaaggatttggcatgctgtaaaaaaaaacaaaaaatgggaagaaaaagaaaataaatttaaaattttaataaatataacaagagggataaaattggtggtgatagtgtcccagtacaaaaaggctgttaaatagtgaaccacagtagtcacctatgtctgtgcctcccttctttattggggatatatgggctggaacagcagatttcagctacttatatgaacaaatcctttattattattatttttttttttttgcgtgaaagtgttacttattctttcacttgtatgtacagagaggtttttctgaatatttattttaagggttaaatcacttttgcttgtgtttattactgcttgaggttgagcctttttgcatatttaaaaatacacaccaacagactcccctcccaaggaaaatattaccaccatttgtaggccatgtaaccttcaagtctgtgctatttttttgtccctgtatctaactcaaatcaggagctgtattttttttaaacaatttgcttttgaaa

SEQ ID NO: 56760 - DNA, 4209 bp, Bovine  19866881273318
gctgactgaatggatatgagcttgagcagctccaggagatgatggacagggaagcctggtgtgctgcatacagtccacggggttgcaaagagttggacacgactgagcagctgaacagccagatccttacttcccagcatttgacagtaaagaataaagactcttcaggagctaaattaaagcttggaagctattgttagatcttaggtattttatttatttattggagttttggaatttttttcccccaaactttaaacttattttgtatttgggtgtagccagttaacaatgtggtgggagtttcaggtgaatagcaaatagcatatatctgttctccccccagatcttacgtactttaaaattttgagtgtttggatcctaactttaggatactctttggtaaattatttagaatgttacagacagaatacaataagcagaatgactagaaatttatacaggcaggtactattacttattactcactataagataaaaagtgcttcttttagttcagtgtttattcataacctttttcttgattaaaaaacaatttccgttttgagtgaaaaacaaatgcactatgtttaagagtcttagggtagattgttttaaggtaataatcgtcaatttatattattcttttcttcttcttgaattggtttaaattacttggtttgactttaaagtggttttggtagttacattaatatatgttaatattaaatgatgctaatgtttacgtattctgttgtttagggaacagactttggaaattagaatgtagataccatttgatgtatttaatctctattccatttcagaatctcaaaactttacaataattacaaattgtacttctgagacttggagttatgttccctcttgcttgcatcttacctttttgcagtagtagtttaatttccctgtcaatgtgtcctcagtttttccccctctctctttccctgttaattttgaaaattttgccgcctacgtgtttaaaagcttctaatctgcctctcttcccttagagccagcaggtttattttttgttttgcaagcctgctctgcctccttacagtatgacatctgatgctggaggggtcggtcgcactttcaaaaatgagtcagctggtacatggggttatcatcactttttagctcttctgtctgagagatacaagtttggaagcaatcttggggtacttacccacaaggctggtggaaaccaggtgtgtcacaaaggtgatttgtttgctccctgggggagagggtggagtgaaatttttgcatttgtgtcactgccaagtcactgccacctccagcatgccccaggttttagttctgatatcattttgtgcataattgaaaatgtgaatatactgcaaagatctaaaataaatatttgagctgctggactcctacatttttttgcattctttcccttggaccactgcaatgagggataattttgaaagtgataaagaagtgagttttttaaaactgagaaatacgggaaacagattttttcttttctggtggctctgagtttaagattcttttgttaaaagttgtttggaatttgaagtctcaagtcagtgataaatttacaaatcaagtccttgtaatatcagtttgaaaatttagcttttgacctctaaaaaatattttacctattctgtgaatttaaagtgttgaaatcagtattatgctgattcaccttaatatatgttgactgatgctggttataaaagtgaatagagtaataggaatttattttttttaacatgttgggtagggtaggcagaattggttcatgccccagaatgaaaataaaagatttcttactgtcttagaattttgaatatttctacttaaaatagcagcagtatattgaaaaagtagaaaaaaactggcaactgtttatagctgaagtcattcattgttatccacagcaagatttttaatgccctggaatacaattgacaggtacacatgctgccagtgtattttcagggaaagctactttcgttgaaatgaggtaatcttgatcagaatggtaaatcagacttcagtgtctcaaaattcatgaggctattaggtttaaatttgtattatctacagcagagattggcagactttttttttaaagggccaggtaataaatattttaggctttgtgggccacgtgtctgtaagtttctcagctctgctcttgtgatataaaagcagccatagacagtatgtaaatgaatgagcatgcctctgtgccagaacaagcttataaaaataggcggctgacccaggccttagtttgtcatcccaggcagtagtttgctgatactttatctaaagtttgggatcacgaataccagtgcatacctttgatattgtgaataactgatacttggctgtagacggtttcatagttgtatgtttttattataaatatttgactttgtaaataattatgatttgttacattggtttgtatgttggtacctaaatagtgtttagtttcctttccttaaaaaaatgaactgagtttttattagtctagcccttatgataaatgtgttgtatggcaatctgatcggatcactttttcctcatgttgaacttttaaaattgttaacccattaaatcttggtttcaaatttgtcttccaaaataaaatgtttgctccttttttgaaatatggaatattttgcttaacttttctcaattgcattttacagatcatcaggagaacctcaatctgacgacattgaagctagccgaatgtaagtgtaacttggttgaggctgtggtgtctaagttgctctagattgctttaaatggtatcacattttttgaaaacaatttccagttaaagagagtaatactttagaaagtaaattggaagataggaatacacatgtctcattttccctaccaaataaatacctctaaatcttggtaacatattactagatttctacttctagacagataattgcatacccctggattcttacatatttttgctcccctagaagttttagtctgttagtgtgaaagacctggaagcacatcatttcatttatggtggtagaaggatcccaggatggaacatgaacataaagaagtaccagtgtactcaggtaccttgatgcaatagggacctaatccacatggcagaaaacaggggtgatcagggaaggctaagttaagtcttgaagtgagactgggagttagctagcacatgctaggcagaaacatgagcacttacaaagccacatagtaaacgtaagaagcagtaggcagttgaggatttttagattatagactaaccgaaaggtggaaagttaaaggagatgagactggataaaaaggactaggtgcttgcatgctttgggaacggccttggcctgtctctcataggtatttgggagtcagtaaagaatttgctaagtagggtaaccttgttagatatatatatttttagtaactttgctggcaaggaaacaggattgaagagaaatcatatggtaggaagaccaaaatttagtcaatgaaagcctaaataagggcagtagtatattaggaattcaagataaacttttctggtttaaagaaaagtatttagaaagtgaagtagttaagacttcagtgattagttgtgaaaatataagaagtttaaaataactagagatggtgattattgaagcagggctttaaggtaataaaggttggaattaaaaatataggtatagggatttctcttgaataagagcaaagacccgtatgaatgtagaagagggaggtaaggatgagtgctggtgctgctgctgctgctgagtcagttcagttgtgtctgactctgcgtgaccccatagacagcagcccaccaggctcctctatccctgggattctccaggcaagaacactggagtgggttgccattttcttctccaaggatgaatatgtaatattaaatgtattggtaggtaagaatggggaagtcaaagccactgtgcctaaagtgtcaattttcttagtaaattaggtcagctacaacactgtgtgcttctggaagaagtggtttcattgttgattaagcttgggacatatagacttaaacctgaaaattgtgaaaaatcctttagaatgatatacattgtgcatctccaagaagggattataaaatgatttttcaaacatatg

SEQ ID NO: 56761 - DNA, 1493 bp, Bovine  19866881300575
tgaaaagtgaaagtgaagttgctcagtcgtgtccgactcctagcgaccccatggactgcagcctaccaggctcctccatccatgggattttccaggcaagcgtactggagtggggtgccattgccttctctgcgaataggtgttagagtttgtcaaatgctttttctgcatctattgatgtcacatgagtttttcttcttttatctcttggtgtgaggaattacattaactgattttctaatgttggaaccagccttgactacctgggataaatcccacctggtcatggtatatagttatctttatacgttgttatatctgaagaagcattattgttaatattgctgttattatgtttaacaaacattgtaccagtggatcaggagaacagtggctaggagagccaggagccctcagagactgagtcaggtatggtagtgaacagcagaaaacaacatagcagagtgaggagcttccctctgaatcaacagacaaacgtgtatatttaagaatgttagagcggagtactgagaagctgttttctatgggaaaagaattttgaaaagccttcaggatctgcactcaagctacaccaaaactctcatgcagggagagcaggctcccctggtctcgttctcagccttggggctagtggagcaggagtgctctcaggggtggacagaagctggccagggtgccttggacctatgaaaccagggtcccatacatgggacaggggactgggctattctggcacccctgcaccctgtggtctgaggaggatgccctggtgttcctggtgaaaccctgcttcgttcacagtgcagactcactgggggtgggggcagaggaggtcataggatttgaaaaagagaaatggaaaactcaattttccctaaaagttcattaaaatatgaaatggaatgacagaaaatatgagttggaaacaaacagttccatattattctagttttttcatagttccatgttcctgcatttgggctagaaggaaatattcttgattctcagaatcctgattctcagaatccccacacgcaatgtgagttccctttccccttttccttccttccttcttccctgtctctgataaaatcatgatttctagacatttttttaaactgacatccattttattatgatgtatttcatctttcagctccatgacaggatcaaagaaagaaaggtatattttgaaacaacctcccttctcttttgaagagctatatactgacagtttaaatcaaggtcattcttttcctttgaaatttatcaagatgaactctgacccatctgctctgatattcaaaatcagctttcttttctaaccactgaccttcatgttagagcaaaaaggaaaactttttccacttcattttaagtcacttgatttagcaccaattgaggtcttctcatctttcaaaggacagtaagatccgttctgtgtaggcttcgatttgactcagcattcagag

SEQ ID NO: 56762 - DNA, 829 bp, Bovine  19866881403229
aatgtagagtgttatgttctactgttgctacacaatcactttgaggaaacattactataaaaataaataagcttctttatccactcaaagggagggaaaataacaaggaagccctaagcacacccacaaaccttttccaagaacagttgtatttgtccccaggctggcaagaatgctttgctaatgatatcaaagccttttgatttatctacaagcaatctgacttgaacactgaggaaaaaatactcattctgttccacttcaaattaaaacaagctattttttgaatactgggctgtctttatttttctttgaacacaggggaatatgctgctctgagaccttgtactatttactctctggctgtggaacagcagcaaaacacactattaatctctgcactggaattttaggaaagacaaagtataatttcatttccaaaaatgatcatccatttctacttcttaccaagcggaataaaggtataggatttactctcctgtttgaaacaaagaagaagctgggacaaaatacaatttaaaaaactggtttccaggcactggacagaaagaagctgtgagaggggaacagtcaaggtgagccccatgcctgcccactttattgtctgaagggtggggctgcagacaggatggggaaccaggcagagacttcagtctccccagggcagtgggggacagaactgagggtcctgggagagaaaggctacggcagtgtgagggcagagcacagagagggctgcccagaggccagctgctcgggaggccaacggagtgtcccctgaggcttccgctaaggaaatgacccaggg

SEQ ID NO: 56763 - DNA, 1209 bp, Bovine  19866881530197
caacagtaccatgggctttgctttcttaggtggccagtcggggctcacaaagcccagtgtgcttatgttgagtgacagtcctaaagtgctgctgtgacttggactagcactactcttatttctctgttgggtggatgacgtttctctttgaattttgctacaggacatggactgtgggtgcagcgctatcaagagaagaaatcattgtttgatgtccctgagtctgatggcacctctttatccccagtcccagctgcagtttactcgtttttgaccatgataatagttttgcaggtaacaatactaagtttcgtatgccagatggtttacctttctggtgagaacttcaagtcaccatagtcttctaagaacttcctacagattctgcatctgggaggagcacagattcacctgatgaatgtgttgccttttgtgttccgcctgacttatctaaaggaccttttctggggtgtttttcaagttgaaattctcctttactgttcttaagattcttaggttctgaggggttggttttttgatcagtgttttttttcaatcagttacttctttggaaagcccatgttttattttagaataattttaacatcaacagactagttacaaaaaatagtacagagagttctcacgtgtctctcaccaaatgtgtcctaatgtaagtgtattacatttccatggtacacaatcaaaactgagaagccagctttaagactgccacgaacaaaattccagacattatttagcttctactggtctttccaccagagaaggcaatggcaccccactccagtactcttgcctggaaaatccaatggacggacgagcctggtaggctgcagtccatggggtcgctaggagtcggacacgactgagcaacttcactttcacttttcactttcatgcattggagaaggaaatggcagcccactccactgttcttgcctggagaatcccagggacaggggagcctggtgggctgccgtctctggggtcgcacagagtcggacacgactgaagcgacttagcagcagcagcagcagtctttccactgaggtgctttttcttttccaggagtcatttcaggatatcacattgcagtttgcagcactggttattattattgttgttgttgttatcgttagttcccctgcctcccgaacaagtcctcgtcattaactgagaaactatggc

SEQ ID NO: 56764 - DNA, 936 bp, Bovine  19866881579620
ttctctcgtggagcgcaggctctagggcgtgtgggcttcagtagctgtggtgcttggcctcagttgcccctcagcatgtggaatcttcccagaccaaggatcaagcccatggaccctgcactggcaggcagattcttaaccactggactacctgggaagtcccctcctttctttcttatgacaagtcaaatgcaaatcttattagggttcccttgtatgtgtcctatttgtcttattgttttcaaaaatttcccttggtgtttgattttaagtaatcttaccatgatttgtctgtgtgcaaaaatctttttgtttcttcttggaattaggctgctgaactgtgcagattaatgtttttaatcatatttggcaagttttcagtcattatttctgtcactatctttttttctgctcatttctctcttctccttctagtgttccctttatgcacgttagtctggttaacaatgttctgcatttctctaagaacatgttcatttttattcactcctttttttctgttttttggattacataatttctatttctctatcttcaaatttgctgattctttcttctgtctgttcaaagttactagagtaaggctctctagtgaattgtaaaatttcagctactgtttatttcaattacagaaacttcatttgattattttaatataactttcattttaaatcttaattggtattcaatatttgatgaggcattgtcattgtactttcttttactttctaagcatgaattcctttagttctttgaaaatacttataatgctgctttgaggtttttgttaaatctgacatctaggcccttttgggcaatttctgtttcctacttttttcctgagtgtgggtcatgttttcctggttctttgtatgtcttgtaatttttgattaaaaactggacatttcagaaaat

SEQ ID NO: 56765 - DNA, 1401 bp, Bovine  19866881596118
atacagtcaaaaaatgaaagttcatccaagttcacagaacttgtatctaaaaatcttttatttaatatatacagaactcatagcctaataagagaagacaaacatcccaattaaaagtgagcaaaatatttgagcaaatacttcaccaaggaagatacacaaatggccaacatgcacatggaaagatgctcagcattataaatcatagggaaaagcaaataaaaatcacacaaagatagtactacatactcactataagtgcaaaaatagagggaactgattacagcaagtgtaggcaggctgtgaagcaaccagaactcctcatacattgctgattagaatgaaaaatgaaataaccactttggaagagattctggctatttcttaaaaacttcaatatgcccaatccctatgacccaaaaattcaactcctgggcatttacccaagaagaatgaaagcaaatgctcacagaaagaaaatgcagaaacattcatagaagcttatttataatagacctaaacttgaaataacccaaatgcccatcaagaggtgaacagataaaataatggtgcatccatatgacaaaatggaggtgaagttgccttcatgggaaagagggaatttattgctagaagaggcaagaggaggtttaccaagaaacatgaagaaatttccgtggatggatatgctcataatataaatttagcttgttttatcagcctcatcaatttgtacaatttaaatttgtacagcttaatatcagtttattatacctcaataatgccaactataacatagtgagttgtctgtctgagctgaggattaaaatgtgacagcatgcaaagacactaaatgtttcatgcctcttttgattttcattctcctcttcctctgctcctcattccccctctctccatattggagactcagtaaagtacaagaagaatgtattttcctttcctttttgtgggatctgacagagtgttctgaatgccacagatactacatcaaagctgaaacaactatgtcagtgagagctcattcattatattggtttataataggagtcacagagtaagcaaaacatcactgttaggacttagtcttttattaaatcattttaatttaagaacttatgtttcctttttctcacttttaattcctttctgctgacttaacttccttaaatcctcatcttcatttttctttccatttctacatctatgctgctaggttctattggggcttggcttgaaatccttttaaattactcattcttcatctattttccacatgcttgtcaaagtatactttaaacaaataacatttaaccttacaaaatggtgctaatatcttattcactgacatacagccttttgtaccatacaattcattcttct

SEQ ID NO: 56766 - DNA, 979 bp, Bovine  19866882038000
atgcgattctcccatgcacgctgaccttcccctgtctggggggcagctcccccagcacagcacataatagtgaggactgaaacagaaggcaacacacacgtatgaacaggcagcactcaggatggaacatgccccacagcaccagcgggaccccaccctggtgcttgatcagtgatatcagaacaggataaagtatagctctggaagttgcagggaaaagtggaaaacagcactattggtcaatgtagactaaagattggtaaggaatgttaatactgtaacaatccactctgccagagtttcccccaaatgaagtgctctactcagcaaagactaagaatgtttaacatctttcactagcagagcagaccagcatgatgtgtactttctgtatctgatgtttaatgcagttgttcttgcatctgggtatcttttacttgacaaatactttttcttaaaaagcagtgtggggaggagaggagcaaggaaccatggctgctatggtagctctttgcagtgggctagggaagagaaagttgacacgttttacaacagctgttgtctgcctcataaatcctgggattcatgcagtgctgtggagaagttgttcacaatataaacaggtaaccagcaacagggacctgcctatcccaatggaaaatccttataaggagcctctgaaaaaatgtatcttgtatgaaaaatgtgtagatcataagaatctacagcttttatcccagtttatttctccatttactggatgcatttatggaaggcatataacaggtctttgtgggaacaaacaaaaagaaatcacaaaagcaattaagagagctcaaatttttggggtttatgccaattacatacaaggatcctgcctatctcaaagaccctaaagtttgtaacatcaaatatagggagtaaattatataaagttatcatcaataaatgtaatttgcaacaagaaaaaagttatgtg

SEQ ID NO: 56767 - DNA, 1626 bp, Bovine  19866880404394
ggaaagaagtacgtcaggctgtatattgtcccctgtttatttaacttatatgcagagtacatcatgtgaaatgccagactggatgaagcacaagctggaatcaagattgcaggagaaatatcgatgacctcagataggcagatgatgccaactttatggcagaaagcaaagaagaactaaagagcctcttgatgaaggtgagagaggagagtgaaaaagctgctttaaaactcaacattcagaaaatgaagatcatggcatctggtcccatcacttcatggcaaatagatggggaaacaatggaagcagtgacagactttttattttgggggagctccaaaatccctgcagatcatgactgcagccatgaaattaaaaaatgtttgctccttggaagaaaagctatgacaaacttagtatatttacaaaacagaggcattactttgctgacaaaggtccatctagtcaaagctatggtttttccagtagtcatgtatgggtgtgagagttggaccatggagtagggtgagcattgaagaattgatggttttgaactgtggtgttggagaagactcttgagagtcttttggactccaaggagatcaaaccagtcaatcctaaaggaaatcagtcctgaatattcattggaaggactgatgctgaagctgaagctccaatactttggccagctgatgcgaagagctgactcattggaaaagatgctgaagctaggaaagactgaaggcaggaggaaaaggggaccatagaggacaagatggttggatggcatcactgactcaacagacttgagattaagcgaactccgggagatggtgagggacagggaagcctgcctggtgtgctgcagtccacggggttgcgaagagtaagcataactgagcaacatgacaacaacaattaatgtggggtggggtgtgtgtatgtgtgtgttggtttcaggaaaagaaaagtttggggttttaaataaatcaagaatttgcggcaaaactcaagaagaactttaatcatttgtgctgtttctgttgttggttagtggctaagttgtgtctgacgcttttgtgacaccctggactgtaacccaccagctcctctgtccatggggttccctaggcaagaatactggagtgggttgccaagcccttctccaggggaatcttcccaacccagggactgaacccacatcttctggtccatttaccaatgaaccaactatgcttgtgctcaagagagtaattagcacccaagtggagtttgatacctaagagtaagaaaaagaagtacagagagaggagttctgatcaagagaaagttgttgtctttaattttggataaagaacaagatggaaaggtggaaacataggaaagatgtttatttgatttttacggagtaggcactagacctcataatgtggtacaagctgggaaattatttcacctgcaggacaggtgtaacagagcagggcacaagaggagtttctacctgttctatgggtttcaagctgatatttccctagggaagtggggacgccaaggagaagagtgtgggtggtacaaaatcactcactctggttggtggaaatttcacggctaggcagaaatacactg

SEQ ID NO: 56768 - DNA, 2370 bp, Bovine  19866880443752
acttaatgagttcaataagcccatactaattcttcagagtagcgcagttcttaaatgttgtttggcttattcaattggtccaaagtccattttcgtgccctgttggattctccctagttccagggtccttcactaaaatctgtcaatatttatttgactttgatggtgtgctcataatccttctcctttccataaactcaacatttcttatgaataatttaaaaattttgtttccaattcttcttcatgacatgccttcatgggtgaaatacagaatgctcacgccatgcatgcaatgactatagcttatgaaagactggatttgtattaatatccaccaggtcagaaaatatcttatgttctgaatgaggaaggaaaaccagagaaacatcacagagtcaattgattttagaaacagtggtgaagataaaaatccaagaataacttagaataagttgaaaggaaattgtgaaaaaattacttccccaaacctgggataaggagaaggaggcagcagaggatgagataagttagatagcatcacccagctcaatggacatgaatttgggcagactctggaagctagtggaggacagaggagcctggtgcttcagtctgctgctgctgctgctaagtcgcttcagtcgtgtccgactctgtgtgaccccatggacagcagcccaccaggctctcccatacctgggattctccaggcaagaacactggagtgggttgctgtttccttctccaatgcatgaaagtgaaaagtgaaagtgaagtcactcagttgtgtctgactcttatcgaccccatggactgcagcctaccaggctcctccatccatgggattttccaggcaagagtaacggagtgggttgccattgccttctccagtgctacagtctatggggttgtaaaaaattagacacgacttagcgactgaataacaacaacaacaacaaacctgggatgccgttcactaggttttgagcttcttaagagcagtaccattgtcttatactgctccctctctctctctttttaagcctccatggtgactaacagaattctggacatatataagagctcaatggatatttgtgtattaaaagccttgattgaggctaaggtttaaaagagacaatattagcatttatctgtaggaaattcattacatgttaaaggcagtacaagtggaaaatatatacagactcataaaaggagttcagaagcggaggcttttttcttaagatattgtttactctaaaaaaaaaaatattgtttactctaagggaaaaaaaaatccaaaaccagtgaggaactatctacttgatttaagataataatttaaccctcccactttaaaaataaggagagagtacaagaaattgcgcaccttgggaggacattcatctagaccgaatccctcagtttacagatgtatagaggactcagcaatattaacttctctgtggtcatacagtgaactgggcactaagctgatttccatatgttacgcttcctgcctttctcctgttgatttatttagtaaataaataatgtaaaatatactccagtttcctgatgtgtacaattaaggaagaggcaaaggaactgctggaaacggaaagcatgtgcaatagccaagaggtggaagccacccctcaactggtgaatgaacggagagaccaaatgtggtccatacacacgacggaacattatccgtcccgaagaagggggtgattctgacacatgctgcaacatggaactaagtgaagggaagtaaactagtcacaaagcgacagaatctctaagactccactcatatgaggtccctagagtcgtcagattcacagaaacagaaggtagcatggtggttgccagggactgaggggaggagacgtagggtcttgttctttaaccgtcgcaatttcagttctgcgagataaagatgttctggaggttggttgctcgtcattgtcaatatacgtaatgctagtgaactggacacttagaagtggttaagagggtaaattctgagtcgtatggttttttttttttttaaaccacatttaaaagaaaaaaaaggaaagatgagacaaacacaaaatgacaagagagaaaaagacaaagagggtgcgatgcaaaaaaaaaaaaaagcgcaaagatcaatacagcatttcccagccacagagctcctcaccacccacccactagcctcccaagccagcctgtcttctgattcttagttctgcttaactatgctaaccaagatcactctgctattcataccagcaatgcctgctctgctggcaaactcctgatcccaattcctacacacacatacacacacacacacacacacacaca

SEQ ID NO: 56769 - DNA, 773 bp, Bovine  19866880453770
tctattcttgctaactgggccggccctgtgccaagaagggtatagaggggattacactgtaggcttcacattgaatgactccttgtccccctttgtcaccccctaaacagattgaaagtatatctgaggatcagaatgagttgagacaggaggagtagatgaaacacagccagaggatgttgttcttttcatttctccaaatcagcctgtttatgatactgtcacccacgttctgctcttatatctcacaagcccaccccatcccatatgtataacagtcatcatttctcccctgtcagatcagttaagataaaaagaaaacacatttatctggggagaaaaaggaatagtcctagctttgaaaaaagaaactaagccagaatcagcaacaaataccagctcaactagaaggttcggaggcagggataaagggctgagggcgtgagagaaaagtcctgctgctttccctagcccttggcccgacatgttctggactggggtcctggacacaagctgccacatgccccatccctgccctcatgctggccacaccatccacctggtacttccccttgtctggcatccataaagcaggtggggacagccagcgccctgccaggaaggaaaagggcttggtcttcgggactctcaaagggttgtggcgatccgtcctagagctggatgatgtcaacaaactccttcctgaggggcaggcgtccctggtaccagctacagctgccatcaacatgcttcatgcagacataatgctgggc

SEQ ID NO: 56770 - DNA, 1156 bp, Bovine  19866880461680
taagtctgctcaatgagcgggaacttttctcctccccagtgtcttgtagatggccaccagctgggcaaactgcaaaagagaagcaaaggtttcagtttacccagacagcttctggaacagacaaaatggcaatccattgaacaaatatttattctgcatttgctccactgagggctttgtgcaaagtgctctgaggatataaaagaggtgtcccaccctctattctccaggaacatatgcttctgttggggaagggagagagtgagctactattcattcagtgcctactcagtgttaatgatatttcatttaatcctcatatcgaactgatgagatagggtctttatcatcttcattttacatatgaggctcaggaagggtaggtgactgcctgaagccacagtgctgcgaagaaaggtatagctggggttgcaatttgggtctgtataactttaaccaccatcatctctagagatggcaagtgatgaagctggatgggggaacaaggggcccagtcttggaaatttgaatgccaaggaaaagaaatcatggaaggtagcaaagacagacgctgtcttctggactcactgctcatctaagaactgaactcactggatccttcacctatgagaagccccagcagctccggggaggaggggtgaagtgcacgtacttaagtgtcagggtctgcctttggcgaacatgtagcgtccctggtgtcccctgcccacccctctgctttataagtggagaaactgaggcccagagaggttgttcactcaaggtcacaaagtagttgagccagactcatagccagacccctttagtcctaacccgtaactcttccttctccttcatgcagctgcctttcaggctctaaagagaccatgctcttcccacaggaaactttccagttcagtccgttcacactcattccccacctccaacacacacccaccccagagcactagcagcggcagtgatccagcatcttctctctggtgctactgggttcacactctaagccactgatacctggaactgctggaaggaagagttgccagatcaaaccgaccttctgtttactaaagaagggaaagatagaacatgtttcaaaagcccagttcctgttttcaatcagtgatgttagcacgtg

SEQ ID NO: 56771 - DNA, 1430 bp, Bovine  19866880665878
cctggtaggttacagtccatggtgtcgcagggagtcggacatgactgaagcgacttaacactcatgcacgtagtattttaaatgtcagaggctcttaaattaaaagaaacttgaacagagagggctgagtctagcataaaggaagaaagtgactgcagtcctcccttcgcatcctcaggggattggttccagaaccccttccccacacatctatgaatactcaagtcccttgtataataacggtgaagtattttccgtacaaactatgcccatcctcttgtataccttaaatcatctctagattacttacatacaataccttgaatactggagtgggttgccatgctgttctccagaggatcttcccaacccagggattgaacctgggtctccggcattgcaggcagattctttgccatctgagctaccagggaagtccaatattaatgtaaatgctatgtacatagctgttgcatggcaaattcaaattttgctttttggggggaactttctggaatttttttccccaaatatttttgaaccccagttggttgaatctgtggatgcagtatctcaggtacaaagagccaactgtgctggttattgagggcctgccacataccagatactgcctcagtgctttctacttacattgtctcgtttaatcaagataattcgcatgtacacttcgagctcagtgttattgcattgatgtttcaggccagaaaacagactcacaggttaggcagctcataattacttccagaatccaacctagatctgcttgaatccaaacagtcacatcacataaaactgcagtttgtcagtgaggcgttttcggttttttggtgcaaaagggggctcttgctgatgaccccgaagtcccctcatatacatagtccctttctgagacttagacttagctgaccctgtaaacagcagcctcccaaccaggcacccccctgccttgtgccctctctgcttccccactgaagctcttagcagccagtcattaagactgtctcagggtagttattattctgacacacacgtcctccagctagcaggatgacagaagaagctcccatggaatttttaatgctagccaagcctcttacttctctctctcaccagttttcttcatgtagctttcccctcccaagactaggaagacggacatgacatataatagaaagagctagaaggcaggagacctagtacaaagtaccaactactaaatactaatactgaccctaatactaaattgtatgctcttgaatgtcacctgctcttgatccaggtttcctaattcattagaaaggagattggattgtggttggtggttacatgggtcatcctcagggcttactgcgggaagactcaagcagaagatacttagaattctctgtatatgattaaacagagcagct

SEQ ID NO: 56772 - DNA, 1715 bp, Bovine  19866880735701
caggagaggcagcacgtcccctctctgcccctaggcggcagtggagagcagaccaaggctcagccccaaacccagccccttatctcaaagaccacgtattaacatacactgaggaactgtcaataggatgcccattcgcacagtccgcagatgttgctaaggcagttaattggacgttattcatttgcttctctgggtcctggaatcttgacattttaaggtgggaggctacagaatgtccacgaccacgccccctcaaaaaaaaaaaaaaaaaaacaactgatggaatgagtcagtattttatcaaaagcattggctggagaattcacccatctggcctcagcaatctggcctcctagacaactgcggaaataaataaaaccaaataagaaaatggggataacaactgctactatttattgagctccatatgccaagctccgtgataagcatatatatatattctaaaatatatatattccaaaagtctaaacaacattcctttgcaatttcttcaagaagggaacattttcatactttgggagagtgatttttttcacaagaccctaaagtcatttgatatagaggcagatgaattaggtgggtggtgaaactgaatcatggctttttttttttatggatccaaaacgaaatgatgactacagagtaacatgatcaatttcctatgtgtctcagaaattatcttttaagactgctaccaagggggcttcggcagattttaagcagtggcagccttccaaaggaatatttgtagtcaaggtgacttcttttttactttttcagaaaagcagtgtttatttgttttctgaattgcaaaggccatttatctttactgcagaaagtagaaaatagaaaagattgaaaacaaaagcacaaattattcttaatgtcctgttattgctttgttgttcccaattttgctgctaataaaattatgatgcaataatattctcctatatatctatttctcgcacatctctgatttttttcctcaatacaaacttttagacatagaacctctggatcaaagagtatgtatatgtttaaagctttcaaaactcattgccaagttgattagtgaagatgttattttaaggtgaatgaattattaataagatggaattttttaataggtttatcgtatttgttcttttgtgtgttgcctatttataactttggcttatttttcatactgaaatatttagctttttcttttttcttttttgtgaggaatgcttacatagtaaggaagccaaccctttgtgtgtcttgtcattttccctaatttgtcactgttttcaatctcgaatgatttttaaagtcatattcttttactttcagttagccaaatgtatagatctttttctgtgtgttatctttctttctgggatacctttttttcctacatactttggccatgccacgcagtttataagatttccgttcttgaccaggaatttaacccagccacagggcagtgccagctctgaatcctaaccactatgccaccggggaattccctttgttggtataatttaaaagccttttcctccatggaggtaattattcattaaggagatctctttgcagggaacaacaggatttgggatatatttgttatatataaatattggtatattgctttgaaagtcttctttatagttacacttctaatttattcaatcatttttttt

SEQ ID NO: 56773 - DNA, 1906 bp, Bovine  19866880893658
tggttatgaatttggctgtgtttggtcttagctgctgcatgcaggatcttctgtgcatggcacggtttccttgtagtgcatggattctctattgtggtgtgtggtgctcaggtgtagttgctctgaggcatgtgggatcttagttccctgaccagggatcaaacccatgtcccctgcactattacacattcttaactactggaccaccaggagagtcccttatatccaaatttaatattcttttcattgcactgttttgccacgatgttttcagtaagttgtttatagatgttatctcagcaaagattcaacacttaaaggttagaagctacaggattagtttatgagaaccaggaaaagatcagaggcaagccaagagcatgtctgggagatagaaaagttatgagagttaagcaggaacgagagagatgcacgcccctctcacgcaggacgggagcaccacagcagagagtgcagcgctggggggatgtgacgcctgggctctgcctcctattcgcttcaggacctaggatcagggacttatcattttccttctttcctgcagagggcttccctgatggctcagacagtaaagaatccacccacagtgcaggagacctgggttcagtccctgggtcagggaagatcccttagagaaggaagtggcaacccacttgagtattcttgcctggagaatcccatggacagagcagcctggcgggctacagtccatggggtcacaagagttggacatgactaagtgactgatactccttggtggagaaggcaaacgagttgaactgaattccctctgaggtgtcctttcctgctctcacatgttgcaatttcattatgtgatgggctccaaaccataggtagttctggaaagagaatccggtattgttatggaagaagggtaagcttcccacagggtcacacgtgaaatgttgtcatccagagccaagaagaatgttctctctcactaaagacctcagaaactcagaaaaccaggcagcgctttcgtttgtttccatctccattacttctttatcacataggaggatttggttagggactttcttttcactctttgttagaactatgagaggtaggcttttttgttgttggctctagatccatatctatgtatgtacccatatatattaaaagctttaggagttactgatgaaaggaagcatttctttgtttctttctttctttatcactcatttgtttaaattctctcctctctcttaagttccaaatttggggtagtaggtgagtttaggaaaatgttcctccagggactgggtgctcctcattcttgaatctcctggggaaatactgtggtctgagaggatactcattcttgctctgacttcagttcaacccgtcaaaagacaactaggtcacacctggtttctgttatgtttaaaaactcggccaccaggttgcccgcttgagaccaaattgatcactaaaataaacgtaaccaacccgtcctgacccaggtttagaaaccccagggtacaaatctgtcttttttttttttttgatgtgctaaaccacacagtcaaacttgtgcatatgattattaaagagttgcaatcataactcatttcaacaaaaagccaagctaacttaagacagatttaaataaagtcatgagctctgcacagcccatttcctcaggcctgagatcaagagcaatgcacattcagtcataccacccaagtgtcaggacacaacctgcaagtttctgtgaaatgtctgtgtttggtgttatgtcacttgttctgttttgtctggatggtactgagtgtctagatgtttggaaacatccagatcatagacctgaaaactttcattttgacgggctatttggcattataaccaagaagcactt

SEQ ID NO: 56774 - DNA, 1323 bp, Bovine  19866881061719
ttgttctttatagtttatgtatcctagaaaacacaagagctccacaggcacagccagcctatccacagaaactcaaatgcaccaaagtttagcaaatggagaaaaagagagacgccttcagattcaacggatgaagcgatggaaacgagactttggaaatctcgtaaacttctagctatttacccgagtcatgcagaaaggaagcgaaaagcactgaagatcccaagcacactcatggaggtaagcagggggtcgggagcgggggagaggggcggtttatctgagtctgggggaagaaggaggggagtcaggtttgatcttgtggtctttgtttctcccctgtccaccccacccaacccccaggcctattgcaccccgcattgtgtaatacttaaaaaagaaaagactaccaaaccacccagaggatagtcgcactgaacttgggagaggcacaattcttttgtacactgttgacaaacagccctggattcacaagttatacagagaaacgttaagtgagtgttacaagcacgaacaggaacaggtgaacagccagacagaggcgcggacactgcattggaagaacagagtccagtcagcactgaaagaacgcagaaacggcaccagtgggagggtccgctgcttccctccccgctttcctttctttccttgtttatttttggcttaaaatttctgctttgaaaaaaattaactacccattgctttaagaagcttggacctgtttgggccctactgcaatgccattacagtcgagaatatactgtaaacaaccttggggggctggccgctgaggcggggtcttgcttgagtccggatccttaagtgttccactctggaagacaaaaatgcaaaagagataaaaaacgaaactccaggcagattcccaagagaaaccctgtggctctgtggcggggctgcagtgggatccactgggacctggcccaagggcttcaccagttctgcaaacacctcaagggggttctcagcctttggcgtattgctgggacctaagtgaaggcaatctggggctgagaaccactttggcgggtagtgtctgagacccttacccccttttcctttcccttccttctagaccctttctagaaacttccaagagcatctggcttcttctctgggggctgcctgagggccagctaccctgggactcaccgccggcttctgggggaaggatcagccccagcaccagcgggggctgggccaggtgacggcttaaagcttcgcgctaactcctgcagagttggctgactcaggggtcagagccactctttgggctgggctgga

SEQ ID NO: 56775 - DNA, 1491 bp, Bovine  19866881480383
ctttatggagaggactgtcgaggtctttactcatcattctcactgaggcaactcttaatttccttcctgacttaggcaattcttcttaacttgacccactcttcattttctttattcctgtttcctcacactctctatcttctggtgcataatttctttcctcttgaatctacagtcactgtgcacttttatgagacatttccacgttgtcctctgacgtattcttaaatctgtggtcatgttctgttcctaaataccctcttcctattatagcaaactctggttcattcttatgatctagttcaaatatcaactcttctgttaggtcctcctcactccatctagcaatgaacaaaatcagtcatccctgcccctcttcctatagccctctttatatgcatctatttattatagctgatatttaatgtatcctgtttcctttgttgttgttgtttggtcattaagtcatatccgactctttgtaagctcatggactgcagcatgctaggctcctccatcctccactatttcccagtgtttgttcaaattcacgtccattgagttggtgatgctatctaaccatctcatcctgtctcctttactagactgcaaatctttcaggacagatactataccttttcatctttgtacacttaaaatactcatacagagaaggcactgagaaaatgttttttgaactgattctcagtaaagaagttaccactctactggcaataaaaaccaatctcatcaaaggcattgagtcctcagatgaaagcagaagctgatggtcacaactgaattttatcatgcaaatctaattaaaaaaaagtcttatagttaacagaataaacagaaaagtcatgtaattcctttttatttaactttgagaaaacatcacttggaatcagattagtgaggaacgtccttctggtgctctggactgattctctggacacctgggttctctttcaatccaccttctgacctgctgtaggattctaaaggagccaaaaagaatctgccctttaatgtggaagtgattaatttcatctttgacccatacatgctctatcaaatttctattttttaagagctctctttcctgtatggtgtatggaaaaagcattacaagaagacaaagaggaagcaggacaagtagataggaagctacttcaaaagtctaagggaaaactgatggcaacctgaaccaaagtgaaatgagatgatatgagaaattctggagacagaaaatatttgatttggtgtcaggctgaaagtgaaaagtgaaggggcttccctgctaggtcagacggtaaagaatctacctgcaatgtaggagatgcaagtttgatccctgggttggaagatcccctggagaaggaaatggaaacctgctccagtattcttgcctggagaattctgtgcacagaggagcctggtgcgctacagtccatggggttgcaaagagtcggacacgactaagtaaca

SEQ ID NO: 56776 - DNA, 1777 bp, Bovine  19866882052154
atttactaggaatctattctaggaattatatgttagttgctttcaagaacatctcatttaactctcataactacttttgagatgggaagaagggcattcatttttgagatgaggaaacagagactcagaggaaaaactggcgtattcaaggtcatacagcaagtgagtgacagaagcaataatcacgtgctagtctgaacccagagttgtcggccctgcacagcactatctccctctgctcgttcattcttgccatcttcattcccaccattacgaaaactgacttgacgtgtatgctgcgtcacaagtttcttgtcccattttccttcttccactgagaaagcgcgtgaagttgtgagcgctagttccatttcaaatacttcccgccccagttcctgtgaactgcccaggatggggccaggctatttcctttcctctctggtcctggaacagtctgttccaggaagttgtcatttgtcctgtctaagtccctggctaccctcaaattgctcctcagaggcactcagccatcctagaactggatcaccgaagttcatctccgtacctctgccccagttccttactgtgcttcatcagcttgcttccagagccccgctcaacattcatagctcagcaagcccctcaggcaaaggacatgtagcacatcttatttgcgagtttaagtaatagtctacgcactgctctatcactgctctggggatcttgtggactctgtaggtctttgtccacgactctaaacagaagtaactggaataaaaaatgatcccatgagggtcctcgcttgtgttggtgagctgtttctaccttgctaccagcaatgttttcctgatgcttcctcccagcttcccatctctaaatacctgccaccccagtcttaaccagtggtggaagaatggtctcagaactgctcgtctcagaactgcttatttcagtttaacagtaaaagactggttaatgataacaatgcatcgtaaacccttcagcaggaaaggagaataaatgttttgcggaccatttgttttgtgtgtggcagtttttagtttttaaaaatcaatactatttaatggaaacaacttgaaaaaaaatctgtcacagaatttgagatccaattaaaaaaaagtttaatgagaaaagaggtctccttctgtgaggtatgtcccagaggcatagacaataatctctcatttggtacgacgtcttgcattttcaaagcacatgtcttgccttatatgttccttacaactctgtgaagtggccaggataggctgtgctgtccatttgactaatggggaaagaaagccagagcagctaaataatatgctcgaaatcacagagaagttcacaggagctaagcctaacactagtagtttatatctaggtacttagatgctgccaagtttttaaattcactcatttattttgtgggttttgaacattgatattgaaggtataattatagattctggctgtgtttatctgccacttcctgcacctgcccgttgaccaagttggctaatgaccctgttttcatgccttctccccacccccacctctccaattatcttaatgtcttttcctgaaggtaatttgccctgttggaaatctcagtttgtgtttcctggctccaggtcactgacctctcttggctgtgccacgtcctacagaacagaagccaaggtggcaggcaatggagcaggctttggtggcagccaaggtggcaggcaacagagccttcttgaggatgagcacattctcc

SEQ ID NO: 56777 - DNA, 1198 bp, Bovine  19866880163510
aggagagtggaaaagttggcttaaagctcaacattcagaaaactaagatcatggcatctggtcccatcacttcatggcaaatagatggggaaacagtggctgattttatttttctgggctccaaaatcactgtggatagtgattgcagccatgaaattaaaagacgcttgctccttgggaggaaaattatgaccaacctagacagcatattaaaaagcagagacattactttgccaacaaaggtccgtctagtcaaaactatgttttttttcagctgtaatatatggacttgagaggtggactataaggaaagctgagcaccaaagaattgatgcttttgaactgtggtgttggacaagactcttgagaatcccttggactgcaaggagatccaaccagtccatcctaaaggagatcagtcctgaatgttcattggaatgactgatgctgaggctgaaactccaatactttggccaccagatgggtataactgatttattggaaaaaaaaaaaaaaaaaaccctgatactgggaaagatttaaggcaggaggagaaggggacgatggaggatgagatggttggatggcatcatcgattcaatggccatgagtttggacaggttctgggagttggtgatggacagggaagcctggcatactgcagtccatggggttacaaaaatttggacatgactgagtgactgatctgaactgaatttgcataagtgcagctgctgctgctaagtcacatcagtcatgtccaactctgtgggaccccataggcggcagcccaccaggttcccccgtccctgggattctccaggcaagaacactggagtggattgccgtttctttgtccaatgtatgaaagtgaaaagtgaaagtgaagtcgctcagtcatatctgactcttagcgaccccaatgactgcagcccaccaggctcctctgtccatgggattttccaggcaagagtactggagtagggtgtcattgccttctccaataagtgcagcaagaatggtaattgataacataagcccttttgagtttgctttactggagcatttataaaaaatctcaaattaaaggctcttgatggtaggaagccaagccaagaatataataccagatttcatcttcagtacatatagatttgagtgaattcttactctcgtcttcagtacctatagatttgag

SEQ ID NO: 56778 - DNA, 2825 bp, Bovine  19866880350388
gctggaccctgggcctgggaataggcaagcaagggcctctcgacttggcagcaagctttgacgacttccccgcagggtccccaacacaaatgccagctcctcggtcccctgccatgatgataagggggcagggacaactggtgtccggtcaggcctcctgatgaccacaactcaggaagcagtgcttttaagaggcttccaatcactgccctttctgaacgctcttgtgtcctttcccaaccagcattttttcccaaagtggttcctctccgtccgaaggcatggctacacttcctggaatgggggtggagataagccttcagagcccgagtccagagaccactctgcacagggtgcccgtgtgccctattagaggggagcccgagacagacacccctcagtgttcagtacttccagctgaaaaccccacagtgttcagtacatccagctgaaaaccccacaggagaaacgtccctggtggctgatcgttattataagaggtgagtgaaagaccagtggagcaggaatcctgattctgccctcgagtgcgggacccttaccttgtcactcgcctctgggggcctctgtcccctgcacgttctccagggttgctacgaaacctagctgctaagaacactgccctgcgtaatgaacccaagacgatttacggactgaaccaaaacagtgataaagaaggacaagaggggatatcacctcttacaggtgagaggaggggccagcggcatctctgaggggtgcccaaggcagaaaattccctccagcgaaaaagaaaaaaataaaccagcagcaaacccggtcctggcatcaggaaaggaaggaagggctgcctccggctggtacacctcacagctgtggactgcagctggcaaaggttcagtggcgggcacggggcacagcctgcagagatgctgcatggcccagtgccttcccaaggaaacacctggccagccggcctgtggtccagccccaccagaccacagccggacgctgctgcccccagtgggaaacaggctcctcagcatctggtaagtgaaactgcggctgggatctcagtccctccctggggatattaaccccaggttaggctccaaacaccccctcgctgaagtttcggggggcatcagacctggtacagtccccttccaacgggtcccctgagccctctcagtggtgacttctggactctgcccactatctatccctgggcactgggctagaaccaaaggatgccaggatgtggcccaatcagaggctgagatccaaggagaggaaactcaggattggccccgatcctctccgaacgtgtctgccccctccctccggcaaccccacacggagctcacccttcccccccaacccctgcacgctcccgcccctccacggcctcttaccaaaggctttggcgacatctcctggacacgtgcagcctccgtccttcaaaaaggggaagagcagagagaggaggtcagtgggagctgggccaggccattgcctgccccctccatctccccccaggggaatgagatggtatctgctggcctggccccctccggccacacccagcagagtccaggcccagcactccccttgtgaccaagccggaccgtgtgggtagctctgtcaagtttacgattaacctccttctctgaacttttattccttttcttgttcaaaaccttgttctcctcaagactgaggagtatcaggaaaaaagagaggaactgcaacccagcaggaccccatggggcccttcctgggagacaggccagcccccgtattgtctgctcaagctcctctctgaagtacctagataatagtatttgatgcacagttcctgagttgctttgcagatatgaaagtgaaaagtgaaagtgttagttgctcagtcgtgtccaactctttgtgaccctgtggactgtagcctgccaggctcctcttggccatggaattctccaggcaagaatactggagtgggctgccattcccttcttcaggggatcttcctgacccagggattgaccctaggtcccttgcattgcaggcagattctttaccatctgagccaccagagaagcccctatttgatgcacagttcttgagtcgctttgcaggtatgaaaacccaccaccaaacagaagatgttaactactctactaatatttgatgaccatgagcacatagctccaggcctcctggaacttaaggaccaataacatgaacccctgtgacatcaccctgttccctcaccgtcaaccaatcagataattgtgcacaagctgatcacgtgaccctgcaatctgccccccacactccaacctggcttttaaaagtgctttgccaaaacccttccaggagcttagggttttttagggcacgagccactgtctcttgcatggccctgcaattaacctttctctgctccaaactccaatgtttccatttgtttggcctcgctgcatcgggcactccaacttgtgctaatgccctccctcaccactgcacctgctattcccaggccccgtcagtcatgtttcaggccagtacaccccccgccccccaaccccgccgcccccaccacccgcccacgctcccccactgggcatcagtactccacttaggatgcaggaaccactgagcaggcaggatcggggggctggacctcatctccaccagccctcgtacaacatgcctggccactggccatccccacataactagcattcagtcatcccctctccccgctgctcgacatgaagtgaaacttatttagcacaagagcactagtattttatagcctcaaagga

SEQ ID NO: 56779 - DNA, 2537 bp, Bovine  19866880352306
catggactgcagcacgccaggcctccctgttcatcaccaactcccagagcctactcaaaactcatgtccaccacgtcagtgatgccatccaaccatctcatcctctgtcatccacttctcctcccgccttccatctttcccagcatcagggttttttccaatgagtcagttacacatcagatggccaaagtattgaagtttcagcttcagcatcagtccttccaatgaatattcaggactgattttctttaggattgcctggttgaatctcaaacactgcttcattgcaattctgatcaaaaggcaggggtgggggttcaatttcttgtttttatgaatatttactgactgcaattacctcctccatcaagtgcatcattcatgtctggctttcctgacccgggaggaccatggggtcacaggcaaggatttatttcagaagcaggctctccataaagggcacgtggccaaagctcttcatgtgaatacagtcacacacatggccgtgtgtcttgttgatgcttcaaatttaccgcatatttttactttctctttcaaaggtgcaacccctctatgcccttcacttgacttgccaattatttttaaattgctttatctttttatcaaaaccagttctccacaatagggtttcaaacttataacctcaaaagaataaatagggactggccctggcagtctgtggttaagatgcccaagcgtccactgcagggaacatgggttcgatccctggcagggaactaatatcccatacgccatgcagtatggccagaaacaaagaagattaaatacactcatgctcccaataagaaggtccctagcatggcctgacttaaaatatgtgtgcacacctaacacacacacacacacacacaagcgtgttcttaagtctttctctcacttgtgaatagttcgtgactgctcgtgcgggcttctgcaaatgtcacacctgtgtggtcagtgatgaggcctgactcagaaagcctgcgctctagggacccccagaaaacaagctcttctcctcccaggatgtccacagatgtcaagatgtccacagttaacaggactgcatgatgtgcttgggagaggaaaccatacatagcaccccatctactcactgtgccagggtgggatttatgaaacagacaacgcatggccagcaggcagggctacagtgtaaccagtgcaacccaacgtcacacaacaccttagggcaaaggagtgtgcccccgactacatttacaggtaatctccaaaggaggttcaaagcatcctttcatgttctcaggaggcagagacatgcatgtaactttcattcatgaacaggcacagctgcagggaggtttttttttttaaaacatgcaaatatttcaagggttccttgttttgttttccaagagtgttgaagtcttttagtagaaaaggtatcacatgacatgagtgatgattcgatctgtgaactgtcagcatgacctcttcttaaaaacagctgcccagccctaaaggaaggggcagtgaaaacaagcatgtagtggacagaggggactaatcgagcaccaactatgaacaaggggttcttacaaatttcatttttctattcaagcaccacaagtaccagaagttgatactttgtaggtggggaaaaacaaagagggaggctcagaaaggtgggatgacttgttcaaggtcacacagctgtaataatggatgaatgagattagaaccctagttaagagtcaactctaaaaatgtctagaagcatacatatcaaaacattagcagtggttatcttaagatggcatttctatagaagcaaaaacagaaatgggacctaatcaagcttctaagcttttgctcagcaaaggaaacataatcataacaaaaagacaacctatggactgggagaaactatttgcaaatgatacaactgacaagaccttaattttctaaatatacaaacagttcatacgactcaaaaacaaacaaacaaccccatcaaaaaataggccaaaggcctaaatagacatttctccaaagaagacatactgatagtcaatagcgacatgaaaagatgctcatcatccctagttattagagaaatgcaatcaaaattacaatgaggtacccctcacaccagtcagaatggacatcattaaaaagtctacaaatgacaaatgatagggtgtgaagaaaagaactctcccacactgttggtgagaatctaaattggtgcagccactatggaagaggatggggtttgggaggttcctcaaaaaactaaaaatagagttgccatggtgatccagctatcccactcctgggcatacatccagaccaaactctaatttaaagagaaacacgcacccctctgttcatagtggcactattcacaatacccaagacacggagagaacctagcctggtccgttgacatatgaatggataaagctctctccaccacacagagccaatagtacacagccttaaaagaaggaaatcatgccatctcagcaacatgg

SEQ ID NO: 56780 - DNA, 1772 bp, Bovine  19866880407578
ccccttttatcagcattatttaggtggatttaacacttaattttaaggcaaaaatgttgaggaagaggaattaatctgtaattaccatgcattcatacttgggatttttttttccttccttttagctgtgttccagatcatctccctggtaatttaccctgtgaagtacactcagacctttaaccttcacctcaaccctgctgtcacttacatctataactgggcctatggcttcgggtgggcagccactattatcctgatcggctgtgccttcttcttctgttgcctccccaactatgaagatgacctgctgggcaatgccaagcccaggtacttctacacatctgcctaaggtggggaatgagcagaagaacatcactgctgctgagatagattccagagaaagaaactgttttcccccggaatactttgaacctgttttggggacaatgttcatatcattaaactatggtcaaaatgctaaaataatcttgggaaagtgtttcttaaatggtgttatagtttcatattcatcttttttatatatgttttgtagtgttaagtaagacttacttcttttaattaattacctgattattaagttggctagaaggttcattcaggcttgcccataagactcatgggaaaacctgaactcactttttggccaactcaatactaatatgccaatgtttccttatatctagcaataccattgatactgcatttgtaaaagaatatgagtatgaaagtaaccacataatttataaggtaaaaatgagaaggcttcaaagatttgagtaaatctggttaggtttctgtttttcccagatggaatggattgggtctattaaggactgaggagaagaagaagatactggtaaaaatcgtcagtgactaaatattctaaaagaaacgcaaaaaaaatttttttcaagcctttggctattcagagaagcaaaattggctcctaaatgcatgtcatttgtgagaatttctaatgaatatcatgaataattgatttggggctaagctttccattaacttaatatgacgtctaggaaagtattctttcatggccaaaacctgttgcagtagtatggcctccttaagcagtgaaatcttaagatgaaattttctcttttaaagtggttcgtagggtgggggtgtggtagaaagctactagtaattctgtgctctttggtgtctatatgctctagaccagagtagactggatgaaaaaatggactggtctaattcattatgacctttaagtagtaggttgttcagtaaagcattaggagggccattcccatcacaaaagtaacattaaacagcctaaagagaagacatggcttgaatttttcatctttggcttgatcgggctctaatcatgtagacacagcttctgatagattgcaactgtaagcaaaaacttaaatatggttaaaaacctggtttcccttggtaaacagattaaaaatatctgatgtaaaacgtttaacaggataattcaggaatgtaggatttctctgacttgcaaatatgatatatcacatggaatattattatttttttactattagtacttacataatgaaaaccaattcattttatatatcaaattattttgtaagttgtaaaaatagcagttgcagttttattatgaacttttctcaataaaccaggtgatcttatcttgtttctagtttgcagtttttttggttttgcttctcccctcattcccccaaatctgggggaagggaatttgt

SEQ ID NO: 56781 - DNA, 1748 bp, Bovine  19866880459092
cgggctgctgcggggttctgggggcgcctgccagtacagggcaagggcgcccagaggaaggccgtcagacttccttgcagtcacgtggcactaagcttgtggcattctgggcacctgtcttgtgagtacgcactgatcttgaaaaagatcccacatggctactgaaaccccaggaggggtacttgcagtgaaactaggagggagacggtggaggaacgaggggagggaagcttcttcatggatcagtggtttacagtctttaaagagagtacagtgaggtttaatgtgacaggtaatagaccctatcagtctcttaatttagattgacagttctttgaataaatttgaactgggactagctgaaatccttcatttgatcaagtaggcagttaaatgaattattatgctccccccatcccctttttgttacggaagttatcaaacatgtacagaatagagtatggtgaaagtccacgtccccatcgccctgcttcaggaccaacacacagcccgtcctttgaaaacaaatgcccttatgtggtataatttcttccattagtatctcaatgtatacctctaaaaagtaagacttaaccccaacaccattatcatacctaaagtaattataacttcttagtaccattaagatagaaagatgttgtaatgttagttttttaggttaataagtgaaataaaagtttcacttattaacagaatagtttaagtcatatatctctgtaatacctagtttactaatttctagtttactaaaagtatgcttttgaattattctctatttgcatattgtctcatattgagttcacagactgtcttagttcacattaaaaatattattttatccagaaactttaaccctctttaagtggaaatttacaaaagtctgtgaacatagtcggcttatataaggtactccaacaaagaacagagtaatcactttatatagagtgtttactccacaaacagaatcagcatgtctcagggatctgttggaaggggaaagaatttgtaaacttttttatctgccagtgagcaccctggtttggagggtggagtttttggtgcttgcccagagaggaagcagtgggcaggtgcaaaaatagggcattgttatggtagtgagttcattgtccttacacagctgatgaagtaacacatttgcaggttcctctgcttcatcctccctttgttctcttgggcaatgagattaggctaataagcagatttctgctgtttttataataatttttcaaaagttggccataaatgtcacacaaaaattccagtagtgtcccccatttggtatttcaagttgctgcatgtgctaccctgtgaaacatagctaaacacctgcgtgtccttgtttagcagcaaaggaataacaactctttccaccttaaaaattttgttattaattctattgctacaaatatgtagaattgactttttaatgaagagaaaagaatattttggttattaatactctattcagtacatcaaataaaaatgtaagatagccaaagaaagcattctgaacatcacaatgcatttttgaatggagctggtttttgcagaaaagtgatttaaatccttgtttcagtaagcctttatttgaaaataggaaattcattttcatgggagtgcctctcggcaggctgtgagttgtgtttttcttttggcttctgcgtcaacttcaaattttagtttattcccatgagattattgttagt

SEQ ID NO: 56782 - DNA, 1979 bp, Bovine  19866880466845
tttgcgtgacttctggcagttcactggcttgtgggagcatcccagcctctctgcccgtctgctctcaacttgctatttcagactgtgattattagattcccagcttgccctcactcaagactgcatccagatctcttttaccaaactcttctcccaaccaacctcaattctcaaacccttatcctatatgaggttatcaagaaaagagctcagagtagacttactacaccaaaatggaagcacctttcactctagattttaatcctgagcaaaacattatgaatcaaagaacaacacatctttaaaggaacatagacgagatggtgattcagtcccatgatttttcctaccctctccgcaaatcttggcttttttaaagaaataacctctagaaaagaatttaccaccttcctaagattcaataatcattcttctactccctggtaggaaattcatcaaattcatttatattttaaaattagcttttaaagtagaaaacacatctttttgccacatccttggagactagttgttaagactacgaaattttaaaaattgaatcaactataaagtcatgggtcagtttatatcagaaaatgaaatcataggccagttttaagattcaacctgtatagaatggggaaaatactattaactcccctctggggttggtctggagtcttaaatgggttcccccatgagaagtgattggaacagtctgatgtataggaaacactaaataaagtgctttgttctgtgtggttattggttgggaggtgttattaggaccagggctttgagttttctgctcacccagtatgaccatacactttcaaccaggttgctaaaaagtcactagctagtaaagtgatgaatcatttccaattacaatccaaatcagcattttcctttgtacccaggactttgttccctagcaccactcttaaagctgccagcttttgtttctttgcaagaaagatttaaagtgcttttctgtttcaccattcctcatccatcccatgacagcccaaacaaagtacatcacatgtacatgacatggaaattttattttccaggaacaattttggttacattttgacatagcacttagacttatgagagtaagacaaagtctctcttatttatttaacaagtccttaaaaatacttccaaaccttatttatgaggcctgatcaaatggcctccttattaagatttaatctatttcatttaactccaatttataaagaactcttcaggcatttttattaaacattttcatggtaatatttagagtctattactattatttagcaacaaaggaagacatttatccttagaaaatgaagtacaccacccatccactgttagttcccttgcatttatctcatggatttttttttttaattgtattcccttatttggcttcattgggtcttccttacagtatgtgggatctagttccctagtcagggatcgaacctaggccccctgcatggggagcaaggagtcttagcccctgcaccaccagggaaggcccctcatggattttttaaaacaattagaacttgggaaggaactgggtggatatgagtcagcgtactgaagtagaaggaacacaacatttgtagttagaggaccgggttttcgatcccagttctgttcctcatcagttgtgtggccctgggcatatacatcctttgacctttctgagtttttccttatcgattaaatggaaatgacaattcctgcttctcacttcctcccataggtattttaagtcacggaggtgacctgctatgtagaactgtgacaattcaaacttgccccaccaaccttgccctcaagtctcctgacttctccaactgggtctccactggccccccacacgctcaaggggttccctagcacccttacctacatgtcgccctcttgattcagaagggaaatatgcagaataaattaccatttattcttat

SEQ ID NO: 56783 - DNA, 1562 bp, Bovine  19866880562277
ctcagcatccacaaggggaggtcatttgatgcctggaagtggttcatggctggggatgactttctttggcctgcttcagcctgcttgcggggcactgcctgatcccgtgccatttccctaacggccccatgaaatagagttcattattatctccattttcttaaagaggaaaccaaagcttagaaagttgaatatcttccttaaagtcaccggtcaccaaatgccagaagtctctcccgggtctctgcaacatcaacagtcaatcatcagttgactgcccagcagtcagagctgtagtctaaagtctggatgggatgtctctaaatacagagaaataagcaaagcctgtcctctcttccgtctttgaccggctttttatcagagccttcccttcatggcatatccaagaagtcctgcctagaggggggtaattcccttcttcccagaccctaaattgaataaaagaatctaaaacccgtccctgacatccctgctgaaagctgtcgacttgaccgtgtgcctcgttcggagggcggcggcattcttccagggcgagtgtaaactgttctcattgaatgaatacctgattaagttaatggtgctgagccagggcgaggaggagcgatttggcagccgaattcctggcagctcattcaacgtccttaatgttccaccggcttcgtgctgggccgcctgtgagcccccgggaggggccgccggtaattactcagcgttttgattgaaaacagctgcaggtagcgcgtcatcccattgtccgtttcgctggtgattggaaatgactgggggcatcttggtctccactgcgcagcctcactccggggagcgggggttggggatgcggggaacaaggtagagagtagggttcccacttgctccgcttttcaaaatgaaccattcatcttttgagggtcagaactcagccacccattcagtgactgtgagtcagagccctaattttaaaacaaacgtttatttcagggagaattcttatcttggctgatccttactagctcctctccctgttctttctatgcttgatttaagctggtttcaataagatcactgtccttgtaagcacgtattccttccagtaaatccaaagaggatcctcggcattcccctgggataaatgggggacaatctggacatagttttggatcatgggatgtggatttttaggggttaaagaggctgcagcctagctctgggaagtatgcggggttcataatctcacatgagaatctgagcttagaaatggaatctctcaggccagatgctttttagttacccagtattttatgtccctctgtcatgagattcactttcgatccaacactgcatgatcatgtccagaaatttagaagatccagaaacactttgccttttagaagccagcttctaagggagaccgaacagcaatagacagacacaggatgagaacagtcagccaatgaagaaaggacagcagcccgagcgtcccacagggttatgaaattcaatctgcctccagcacagggagctgaccgtctagtgagaaagat

SEQ ID NO: 56784 - DNA, 1433 bp, Bovine  19866880663306
tccccttttctttccccctccggcccactacccgcttcctcctccacacaaacatacatctcctttgtgtgccctgaatctttagagtcaatgctggctttcagggcataggaaagcccatgaagacctcaatttttccatagcagcaaagataaacctgtaccagctttatcacatataacaaaatttaatcttcctgagtcctacttcctcaaatgacagataggctcatccaaaggtgttaattgcttattaagtcttaacaaccatttatatgttagcaatcacctatgatatcttgaatcctaggagcaagacttgagctgacaaaaacaataggtactgagagacgtgaacgtcctgttaagaggctgaaatttttaaaactgtctgcttgggctttttaacatgagatttccaatcatgtcacagtttccaatttgaaatactcgccatttatctgagccttctagagatttctctgatctgtatataatttaagaggagaattttattttccgctgtaaagattgattttgttagtcaaagacatcagcagcaagtttaaatttgcattttaaatttagaatgatttatttccaatgaaaagtgtatcactgctgcagttattctaggagtgactaggggacaaataatttatattgaaagactattagaaatgtgagcttccctctaaaggaaaagattggcacccttgacttcatattttaaaacctctatatgacaagagactgcctaaacgcaattatgtgacaaacagcagacctggagaaaatacttgcaacatacataatcaaagggtcagtattaagactgcatgagaagctcctggcactgaatagcaaatggcaaacaacctaatttgtatggggaaaaaaaacaaccctcagagaaaagtacaaatgacaaataagcacagaggaagcttaacctcacaagtcagagatgtgcggatgttctctttgtcagattggcaaggttaataagattaatatttagtgttattgctggcaaagggtactgccagttgtcagtaaaaattgggagagtcaactggcctcagttctctgtagagttatttggcaacatttatcaaaaatttaagtgtctttttgacatagcaattctcccaaggatctatctggcacaaaaatgtacaaaagtggagcctgttatgttaaaaaatcttaattgtagctttctaatgatgaagttttagaaacaatctcaatgttcaccagcagaagaatggataaatgcatcaaattacagccacaccacagggcttcccaaatggttcagtggtaaagaatctgcctaccaagctggagacacgagttccatccctgggttgggaagatcccctggggaaggaaatggtactctctccagtattctgccgggaaatccca

SEQ ID NO: 56785 - DNA, 1663 bp, Bovine  19866880736389
caccagcatggacacagaggggatgctggcttgagagggatgataaagggaagttggagcagttacatggaggtatctgacccacaggtaattggagctgaaagcaatgttcagcaaagagaacatatttggattttttcttatagacattgcactttcttccatgaagggcttccctttggctcagacagtagagaatcctcctgcaacacaggagacccaagttcgatgcctgggttgggaagatcccctggagaacggaatggccacccactccagtattccggcctgaagaatcccatggacagaggagcctggtgggctacggtccatggggtcacagagtcagacacaaagttgaagtatttacatgaaggttcccaagaggcagatggagctgaaagcaacattcaggaaagagaacgtacttgcatttcttgtgatagacgttgcactttctcccgtctgtcatcttatttcatctcatagcaatcttttggaaatgttatcatcatcattcccatattatagatgagggaaatggaggttcagagaggtgaactgtctttcagttcagagatttcagttcaggttcagagaggtcatggagctagtgaagaaaatgagctttgttgtcaacagggcgctgactgacttttttgcatttctgcttgtccagtaaacattgtattgcctctttagattatactcattcgatgcctgcagcttccagcagcctcgcttgttgtctttcatttgctacgagggtcttaaataaaatagctggccaatttttgtgcatttataatgtgcagattttcagtggggcctgggtattctaaagaggttaaataggaaagggattgatttcatttgtaatgagtaattgtgagtaaaataagtaccgtgctccacattcaaagaagccagaaagcttctattgataactgtggggagaaagcagataatacaaacaactccacattttaaacatgagcgtatttgaattttatttttgaatgcagatgtgattgatcatttgttctgcaggcaaggctttagtccagttaggggggaaaataccagtgcacttgtatcgattattttctagaagaagttttagagacttactaatagtaaactttctaagcagctgagacttgaaattcctcattagcggaggtgaggcaaggagtcagactgttgcacacatcatctttgctgcagttgactggcacctgtgttgcctgaagtaatccaggaaagaagtcaagggaagaaagtatgcgtttttaatacagaagaaaataccacctctgtgaaggaagtgggggaggagggtccttctcaagagagaatcatcacttcagcctccagtatttattggtcacgcagtgggtcaggccctggtctgagttctttgaatgtgtgaactcccaacaagtctataagggccgatttgttgtttattcccaaggtgggtgtccaactctttgcaaccccatgggctgcagcccaccaggctcctctgtccaggggatttcccaggcaaaaacactggagtgggagtgggtagccattcccttctccaggggatcttcccgacccagggatggaacgcaggtaggttctttaccactgtgtcacctgggaagcccatgtg

SEQ ID NO: 56786 - DNA, 1658 bp, Bovine  19866880829588
aattttaagaaaatgccacctaaagtgtatatagcattcagctttaataaatagataaagtgatttataattagctttatatcttttcattaggaacataagttgtgctgggcccagttttgctacaattagcattgtgtttatatgccagatactacagaacaggaacacttatttcccttaatgttaacatgataaagctggtgattaatgtttttgatgttcaatcatttgttataaaatattgatataaaatgccatggaagtaaaatagatctatttacatagtgagtaagctcagctctgccagtccagttatgagaggtgatattttagcatctcccagtcaagtcatgagggtacacttagtatactgaaagtgtctggacagttcattaaatggtgctgaaatatcctggccaagctgtcctccgtggacaattaaagcagcctgcttacagtagagctggcctaactgggggcacttcatacattagtttgcatcaaattagggaggctgctagagaatgacaggcgggaaggcctgtctaatagcagagtcctaggggccacacggaagccctgcgttctaggttcagctcagccaccaaccaccagtgtaaacagccttctaagacttgagccctgctgaaaaccctgaaaagactttctttaagatcccttctagccgatttttttttttcttggcttctgtttctcttcatatcacttttctaatgctttttttctagataacatttctctgaagatagaaaaaacatttccagtgtctgcttagatagggagatagagttagtctggtttctgatgtggcctaattttagatttgattctttacccagactattttgtttgctcttgaatgaggaattctggaaagtaaccggagaggtttgtttagactcagctggaacatttcagagaggaagacagcaggtattttcagcagatgtttgccatgctgtggattaaaacaaaacgtgagactaatatattctgaaagtgggtctgaaatcccagtgatctttgaaattcttacgtttcagaggctcttggttattcacagcaattcagaccagattttgtcaacattttcaaaaccagaggttagagaattatatgctacatcttcagggatcgtaggtatttataccatctactgccaataaaagctttctgtttctcctgattttgccacattttagcagagctctgtgttctttgctagagggcacccttattagttaggattcaccaacacctgaatccttgatcccagagaacaatcctaatacaagcactctgtgagtactgaagtacacgttcctggaaatgctgtaatcctgaatgtcgcatcccattagggtcttaaagttgtgagcagtgatgagtgtgattgcaggccccagctcattcatcactccttggaaaagccttctctaggcccgcttcggagaaggcaatggcaccccactccagtactcttgcctggaaaatcccatggacggaggagcctggtaggacacagtccatgggggtcgcacagagtcggacacaactgggcgacttcactttcacttttcactttcatgcattggagaaggaaatggcaacccacttccagtgttcttgcctgg

SEQ ID NO: 56787 - DNA, 530 bp, Bovine  19866880831487
caaggctcaaggcccaacttcagctttccaagacagccagtggtgctcagagatctaggatagggaaatggagttctctaggctgaagtatgaagcatgctgtgacctctccctgcagaggaatgagctattcctttaacctcaaccagccagcctgatttgggactttggcagcacttactggatcctggcatcatcaagaagcccaaaggaataattgcttatttagtgcagatggcagaaagaaagctcaaagctcagataggagacccactctgatactctgctcattgtctccagtagaatttccacagcacttaagacaacgtgctttccctttgcttggtagaagcaatgtcagagtctgcgggcttgagatacttgtacaatatgagaaaagggaagggtgtccctgaactaatagtcttagaatatcaggaaactcaagaacagaacccagtcaagcctcaaaggcctggggcatttagttagggtatggcaatctctcggctcttcatgtaaccgtagcc

SEQ ID NO: 56788 - DNA, 1459 bp, Bovine  19866880833457
cgggttccttttcctactccgggggtcttccgacccgggatcgaacccgtgtctcttgcattggcaggaaggttctttaccccctagtatcagttaggccttcatgatatctctggattcctaatatcagttgtcaggtaacattccatccacctgcttcctttttggcagagctcaaaatttggtttagaatctatttctacctcaagtgacgtggggaaggttgatcccggccctagcccagctccaggggcaaatcctgacgcatttaagctgacctcagtgctcctatttctcttgcccatggatcatttaggactgagctgtggcccattgtgaccaataagttgagagagaagatgttctggggggctcctgggaaaggtttcctcactctgaaaagagacatttaggaatacgcagtctcttcttccttttgatggtggttgtgtctgcccaaagaggcggcagccatcttaatccatggggagagtgagcccaagcatgacgatgatacacccagggtggcagaatcgaatcagcatctttgatgaccttttttcaaaccgatgaatttagtcatcttggacattttcttttgtggaacactaaatttcctggtagtttaagccacttccagttggttttgtttctttcttgcaagcaaaagcattttgatggagacacacactattgtctagaaatgcctgtgaagatcgtattagtaactcgggcgcctggcaaggttaagtaggaggcacagctgtttcctcctctttccattctaggtcattcctccagcctctggaagtagtcagaggcttatttgtacagcttctatccatgccagagattgttgctcagggttttgctgatgaatcctggaaacaagaaccagcttgtatgagctctgtcttttcagacgggtgaaccatccaaccttctggacttcaccgtccaaccatctggactcttagatgctaaagctccaggatctcctcagtcagtgatccctgaccgaggatcagtcccaacatggtaacaaggttgtggccccctccccagtcagaggccaccagcagccagaatactcaggaaaaggagatatgccttaaaaccccatgggaatgtgagctccatggaaaagtgagctccatggatgggagcagttgggagagacctttgcagtaaaaatgagtggaattcaaagtcaggaagtttgtaaatcatggaatcccacactacatgggatacaattcagggccctcatccttgaacacagttggttgtgatgattcaaccatattaggataaacggccaatatcttcctaattttggatcctgcaggactaacagtgtgaggagagtaatactattatttggttgtattatgtaaaagtaatacaaattatagtagttcatataatcagcgtattatttgtgcctaattaccatgcc

SEQ ID NO: 56789 - DNA, 1483 bp, Bovine  19866880843745
agcagcttgaactaagacaggtatattctagaatgttctaaaagcattgactggaaaggcagatactattatcaaagtgtggttaaacagatatcaacaccttcagtgattcacagagttactatggtttcctaaagaaagggggaaaaaagttccaaattggcagactggcataaatgatgcataatgagatatccttttgattgcctagcttagcaaatgggtacctttgatgtgaatgtgtgtaaacgtgcttttgacacctgtgtgcaaatgcataaagcaaatattgtgatgccaggctcagcagaaattgccatagacacaaaaaattcccaaacaaacatttagcgtaacaactctaccgaactaatcacgctgttcccattgactcatctgaaacaggaggagatctcttttgtctgcacaaaactagtcatgcttcccttctgcatggttacatctctggcagaagttcctctgggcctaacccacttttttaagcatggccaatgttgtgtactggttaatgggaaaggagtatcatgtacctcttaaaaaccatgaaaaggttgggaaaaggagaaacagtcgcaagtcattcgattggcagctgggagaaaagtaagccacaggctcagcagttgagtctgtcactgacctctgggctcattcagaagatcctggaaagaaacatgctaattgaccagacgttcagactccccgaagctacccaacccaaagtcaagccatgttctgggagttccagtgatagctgctaaatagattctagctgggcaagatcatgccttaaggagaaataatatgagttggcaaacttttagatgaaggaccagatagtagacattttattatggatgagtgaaaggtggacatgttcaccagttacagagtatgatttatagaggcagactagcatggtgattatgaacacggactctaaagcctgaatttagatgccagctccagcacttccttgctggatgaccttgattaagcaaattactaaaccactgtgtgcctcagtttatctgtcgataaaatgaggataataatagaactcggggcttcccaggtggtacaaaggaaaagaatcagcctgcagtgcaggagatgcaaaagacacggatttgagccctgggttggaaagagcccctggagaaggaaatggcaacccactccagttattctggcctggagaattccatggacagaggagcctggcaggctacagtccatggggtcacaaaagagtcggacacaatctagtgactaaacacaatactagaagtcagtgttgtagcttgggtggtcctatagcagaccctggggaaagaactagggtgcacgtgataatttcagatgagatcccaggaggcacaagtgaagaaggaaggcaagtgaaatggagagaaggtcatgaagagccatcaaagaggaggttgttcctgagggcaatggg

SEQ ID NO: 56790 - DNA, 2254 bp, Bovine  19866880881642
cagtacataatacaatggaatactattcagcaataaacagcaacaagtcactaatgtatacaacaagacgatgggtctcaaaaaatttatgatgaacaaaaggagccagacacaaaagaatacctgtgtgattccaccgacaagaggtagaacaggttgtaactaatttatgttggaaaaacatacaacctggttgtggagtggggtgggtggaggtagggaaaggagagtagagaatgactgcagaaggtcatgagggaactttctggagtgatggtaatagtctaaatcttaataagggttttaaacaggtacatctatttgccaaaactaagtgaaatattacaatttatgcatttcatcatatgtaaattttatatcaaaagaaaaaaagaactgtaggcaaagactgagttctagttaatgatatgcatagtgaagtatttagggggatatgtacttacaacttactttgaaaggcataaaaaaagatacactgatagatgggtagaggggccaataagtggataaatatgcaatcaaacaagaatgttaaactgttaatagcagaatctaggtatttttggtgttcaatctaaaaatcttcaacttatctgtacatttgaaaatctttatagtaagggattgagaacataatactagtaaaaaccccttagggtcaaggttcagaattcaaatgaggagccataactaaaatgaaccatcaaatctaacacatttcatgcaaagtttgcaactgagaaacctgtcacagccagtaattaccaagtcaggtctctattcaggcttaaggaaatctttctcaaagcccaaaatgtaaaatgggaatccctgataaatttgtttcctcctcaggctccaaagcagttaaatggtaaggagggtacaggtgtgagaaattcgtaacttcaaattgattacaactcactccagaaaaatacctggaagcataaaatctcacttctaaaaggtatgattactcactcactggagatagctgtccctgggcaaataacaatccaggcaatcgcagagtttaagagtgtcaactacaatctctttctcagcaatctagattagaggcctggaatcagggacacaactcagaataaatatacctggaacctaatcccacactggtcaccctggtctcactctcaatgccctctaaatagtcagagtttatttataatgacattcaaaatgaaaagttcatttgggctacaaatcaatttctcaatgttctctgatattttatatgtatatataagtatcataagttcaaaaaagactgaaggtgcccgggttggcatcctgtggctaaaataaacataaaaccacacaaacatcccatattctgagcagaaagacttaataaattagaattcagaaatgtaattaatactttctttgaaataatatacatgtctgtttttaaccttttttactttcctggggcctatgttatatttgggcatatcaaaaaaaaaaaaagaatgtgttgttccactcttagacatgtagttgatataaaaaacataatattcctgcaatgcatcctatggaatttacccatcctgaatcacacaaaggtaagttctgtaatcaacatttaccctcgtgacaatgttttataagattctcaacatgattacaggcatgggctagggtcaacctgattcagctgtggactgatttgagattatcacctcatctctgcctatagtttacatgtggtatttgctttgtgggtttcagtgatgccatcgttcctgaactttcacatgtctaaatgatttttgttgggagaaggggaaaaactgaatttaataagtaccaaggacctacaaattggctgaaattagataaagccggcctgcagcttgaaaactatctgaacgtcataaaaggcccaggtgggcggtagttcatccttgataagaacaaatagccacaatgaacaaacggctctgaatggagtagagggggcgaaggaaggcagccagcaaacagaagaatgccaagcaccgagcaaactattaaccaagaagaaccgctagaaaacgtttttttaatggtgagatttcttttagattatctcaaacgtttcaggttatagaagcaaactggcaaaacatgtcaacatctacaagaaaatctgtattatcagtatcagttaaccccatttttactgacttccaagttcttaattcattgattcagcaaatattta

SEQ ID NO: 56791 - DNA, 2042 bp, Bovine  19866880949353
cctgccctcaaccccacccccagcaaattccagggtgagatccagacccctgatctggtgggggcgcctgttcctgcccttggacaagatttctcaggacctgggagggagacagtaagggtgagaggggcctggaggcacggcgagacgggcgcctggatccagtgacagctcgttagcccctctgctgctgtagccaccgcacctgcaagtcggtgagctctcctcaccaggaacatgtcacatacagttatggctgcccttggtggcacgggtgattccctggcaggcagtgttagtgactaaaagatgctccttgttgtgtgagggttggaattcctccttctgctgacttgttctttccctgtggtctttctcattcttgacaatgtcaggaaccgttgtctccaaatgtggggctgttcacatgtggcgcgtacagaggactgtgtgtgtacgcgagtattaccagtcttaaccacgcaccagcaagcatcactcagttgtcagttggggacgaggcgagcatcctcgtttagtttccacggtcctgagatcgccacctcacgctttgacatgttgccttgagattaagcaggtgggctttgcatattgcccacggaagttcctgcaacacaaacctcagttttcctcatgagaacactggagcgtggaattggccctcccgagctgggttcccagttttcaggatgtaaagtgcaggacacactgtccatttggtgttcttgttccttttccaaggccgttgtccggactggtccttgtgcagaacttccctccagatctttgcttatgaaaaagaacacttctgaaggggtctgagtggacagggacccatctgtggagcaggaatctcagggtggaatgaatctctctcagtatctagcactttcagactcatgaggctgtgttgagtaacccccgtctctgttggtccagactcatcctcagcccccagtccctgcccctgagttcagggtttccctttgtcattgaacaagagagggtcatgcagttggaggtgagaattgagggagtagcaggtaccccctgcctcggggtggccccagcccctgttccacagcaggctctgacctggaagcaggtgagagacctcggcaggcagactcccgtcatctgcgtgactgcaggagcctggctggtttgcggtccaggtcctgtaggaggagcgtctcctgccctccctcccctgtcaaatcccccaagtgggatgacccgggactcccagttctagctgggctcttagcgtgaccttcgccaagacttaggctgtgataatcaacctgcctgggccctattgttcatttcgagccagtgatgccagctcctctcccagggacattgtgggacatgaaagggcaattttgataccatcaaatcccattagttaagtactctggggggaggaaaaaagggtcactagaagccaattgtagattcctttgtaacagcctgacgcgagtgattagaatctgacctttcatcttttcaactgcataaaagacggaggcccggagaatactcggatctgtaatctcagatatggttaatttttttctgtcagccggaaagaaaagatcaggggttgtgtgaagtgcaggtgatgggggtggggacccctgcgtcggggtgcctctgcctgccggccccagtgccccaagagctcgctctgctgtcgaggacggccccggggctcgcgtgtgctgggtgggtgcctgccctcctgagagccctggcccccggggctagggcatgaggactcggtgtgcggggcctcgccagccttccaggtcttattctcccaaaggtgccaggtgtgccaggtgtcacaggcgtgtgtaacagccctgaactgctcccggctgatgatttggacgtatggtaggtgttcaacaaagcagcgtttccttagagtagtgcttacatggtttgcagcaagacagtaatgaatttaggatgaagaaacaacggttcttccacctggagagggtttggaaatg

SEQ ID NO: 56792 - DNA, 2608 bp, Bovine  19866880972013
cgaagtggggtgggaggttgtcagctctaccctgaatccacttctcagtgacacacagagttgtctggatcccttctatcagggaagaaaaacaaaacaaaaacttggctttctgagccgcacagaccaccacagagccccgttctctgcctctagactgttgtacagaggtgtctccaacacacggggcagacagtttaaagcacaaagcaaaacagatttctttctgtcattaagagagctctctggaaagagatacctttcctgtgataaactcacagaggtgaacacatgccctcaggagcaatggctcagtggctggctggcggtcggccagaataagcacacatctgctcacactcagcggggcaccctgggtgggtgatatttaaagtaaaacacagcatctctagtgaagtttccacagcagtcacttgataaattggtgatttgataaactggtggttttgttgaggtagagagaaagacaagggcgagagaagggtgaaattgagaaaaagaacattttaattgatgtaaaaagtggaagctgtgagcttgctggtcagagcagtcgtgatttaagtctggaaaaccatattaagctggactccaatttctagggcatggtagacctgaccttataatcccataaatttgaaagtggttatagacattcacttctcagatagcttaaaagcatagcctcttcttttaaggggcatgtgatgttttaaaggaagttacatgggtctaaaactgacaagggattttaggacacattcattttttattgacagtccagctaaaaatgtagttgtgacaggatgttaaaaaccatcagctgaccatgtgtcccttcccttataagtggattttcccattcgggatgggggacatggttgggtaaaaccacgaagatgccacacccaaggttccattgctgaagggttgatggtttccagtttgttctacaagtagcagtaaaccagctgactcttcagagttcagaagagtcatcttacagtcagtctgcaggatatttgaggggaaaagcctgattctaatgttcagttactctaagggacatacttctcctctgtgagagggatcccattggcaggaatcagtcacatggtctcacacagatgctgtaggatggaaatcagtctaattgtgtgccccagaggggaaaactcagatattggtagtctgccatggtaggcaaggttggacaaaaataaaaagaaggcaagggctttgatagaaacacaacccaagccctaggtttcatctgtcctttccttccaagagatggacatcaatgtcttaggtccttattaattgtagagagaacctcgcccccatgagatgtatggcatagacacagggaagagaggaaatatccctttcttcttcagaatagtctttgccctgtgactaattagacatactgtgtgtgtgtgtgtgttaatcacttagtcatgtctgactccttgtgaccccatctactatagcccaccagggctcctcagtctgtggaattctccaggcaagaataccggagtgggtagccatgcccttctccaggagatcttccctacctaaggattgaactcaggtctcctgcattgaaggcagactctttaccatctgagccaccagggaacataagacacaaggggaaatgaaaccagggaacaaaagacataaggggaaatgaaacaatcagtggagaaagttatttgaaccatgtaaatatctctatgtatatctatttgggagaaggcaatggcatcccactccagtactcttgcctggaaaatcccatggacggaggagcctggtaggctgcagtccatgggtttacaaagagttggacatgactgagtgactttcatttttcactttcctgcattggagaaggaaatggcaacccactccagtgttcttgcctggagaatcccagggacgggggagtttggtgggctgctgtctatggggtctcgcagagtcggacacgactgactcgacttagcagcagcagcagcagcagtgccacctgggaagcccatcctatgtatattttaccacagaaagtttcagatgttatggaaaacagcatcctcaaaaaactagatacagaacaaccatatgattcagcaatcccacttctgggatatatccaaaggaaatgatggaatcaggatcttgatgagatgtctgcacctccaagttctttgcagcagtattcacagtaaccaagctatggaaacagctcaagtgtctgttgatgaacaaatgtatgaagaaaaaatatgttacatacatacagtggaatgttcagttcagttcagtcactcagtcatgtctgactctttgcgaccccaagagtcgcagcacgccaggcctccctgtccatcaccaactcccagagttcactcaaactcacgtccattgagttggtgatgccatccaaccatttcatcctctgttctccccttctccttccttcaatctttcccagcaacaggatcttttccaataagtctgttcttcacatcaggtggccaaagtattggagcttcagcttcagcatcagtccttc

SEQ ID NO: 56793 - DNA, 732 bp, Bovine  19866880976390
accttttgatgggttccccctatttctggtagagcatccgctcattctgggaggcagtctggaagccacttgtttatcaggttaatgacatcacacccaggttagatctgtttatcccctccacctccctatgaactttgtagcactttccctactgcggataacaacctaggtgcacatcaacatgcgctttcagtgttatttttaaaaacacacataacgctcacatgcatcacgatgacataaatcatgtgataacactgtggtgactttcaaacgatgtagcgatcactcaataaacaaattcctaagcagctgctcagcacctagaaaggcaccagaacctgttaggatgggagcaggaaaaaaagaagacagtgtccctgctaaaaaagaatttatgacccagctggaaaaaaataatgctcacccataacaaaattagaggacaaaatcatattcggttaagtgcaaaattgcagagtacagtcaattagcaagctagaaggtttattagaagaaacagtagcttaacaacttttcttactataaagccatagtgcaagttggcttaaacatcaaatctggtttcccacaactgattagcctgaaaatggtttagcaaaacactaatcctttaatttaacaatctataaatgcagtctctaataagttccatagagcccttccttggattcatagagacgaggcaactctaacaggttatccaag

SEQ ID NO: 56794 - DNA, 957 bp, Bovine  19866881015202
ccctgcaaagatgcagagggcagaagcggggcgagggcattgagaaacatctgtaagtttccttttccagcataatggattatttgtatacacttactcctgatgtgctgcgattcacggggtcacaaagagtcagacacgactgagcgactgaactgactcttggcagaacttacataatatctaaacccaggaaagtcatggttataccttagtagagatttgggcttgaacagatagcctgagggtcattcagaagacactgcctgaccctagaggtgtcatacacgcccccctataagcatcttagaaatgctgactcccctaactagaactaggtagtaccctcaactctctcccacatgctccctcctggcccgtatcagcggcagcatccggttttgaacacaaaggacatttgttccatgcaatcatcgtataaagctggtctctttctattatgaataatcatgaaattgagggtgaaggagaaaggcaactccacatttgaagctacaaaaaaggctgtgattcgtttttagtctctttattaagcagcctagtctcagttagataatttgcagcaaggttctaccctggagcaagtttcctcagtcatgttaaattcatggaggaaatcctcccaggatttagaactgaaatatagacagctttagtaacaggaacgttgatgtaaagagcgggttaaggcagtatgttctaaccatttagggaaaaaatgggtaagatgttactaataagctctgctatatttttatcctaccattttcttcatctgaaggaatattgagatgagcttttaaattctgaatgattatctgacagattccatctttagggcaaattattagcaagggttttacttctctattacttttactcaaaactcagaggacacacgcttaccggagcccagatgaggaaataaaatctgca

SEQ ID NO: 56795 - DNA, 1397 bp, Bovine  19866881022619
atcatggcagcatcagatcccatcacttcatggcaaatagatcaggaaatagtagaaacagtgcctgactttatttttctgggctccaaaatcactgcgtatggtgactgcagccatgaaattaaaagacgcttactccttggaaggaaagttatgaccaacctagacagcatattaaaaagcagagacattactttgccaacaaaggtccatctagtcaaggctatggtttttccagtggtcatgtatggatacaagagttggaacataaagaaagctgagcaccaaagaattgatgcttttgaactgtggtgttggagaagactcttgagagtccctaggactgtaaggggatccaaccaatccatcctaaagaagatcagtcctgggtgttcattggaaggactgatgctgaagctgaaactccgatactctggccacctcatgtgaagagctgactcattggaaaagaccctgatgctgggaaagactgagggcaggaggagaaggggacgatagaggatgagatggttggatggcatcaccgactcaatggacatgagtttgggcggactccgggagttggtggtggacagggaggcctggcatgctgcggtccatggggttgcaaagagtaggacacgactgagcgactaaactgaacttgtcgtcaaccagttaggcagctggggctagttcaagtactctgtccagactcaggacctgttttcagttcaaagagggaagtggatctgcagagggtctaattccagggaggaatggctggtttcaggacaatatgatgctgacttgggtttgcctttgaacttcaatatggcagatagatgatgctggcagactattttagaagagaagtatagcctctgtgatgaatttgaacataataaatcatacagtaagatgaaatgatgattataataaggacagcaaacacattagctaacatttacaaaccaaatgactgtccagcaagagcagcttttcagctctactcaacaatacttacagtgtttagagtcctgtgaatgagcccaactgtggctaaaaccagtcatccaacccggcttgctttcatcccgggagctggcgccactgcttgtctcactatccggggccagcccttgtccatatagtgctttgtgcaaagtagaaaaggtctcctcttcctcacaatactttcccatctattagaaaagcactgtaatattcagtaaatgtcaacagtcaatatacaaatccttgggatatgaactttgagtggtgtcccttaagttacaagtagcacagctgtaaagagaagccttgggatctacttgtttggggcatgagaataagtcttctttcagaaacatagccggtctggatcagtggtttga

SEQ ID NO: 56796 - DNA, 1721 bp, Bovine  19866881088816
ttcggagaaacagttatattagaaagaggaaatgattccaaagccggggtccttggtggtggttttaccgtgcttgttgaaactgttaagcgtactgaggcttgttctctgctttgaccacaggatagcataaaagacagctttaattcttcttgcccacttaggacaaacttccgcattttcagggcttccctggtggctcagatggtaaagaatccgcctggaatgctggagacctggtttgattcctgggatgggaagatcccctggagaagggaatgtttacccactgagtattcttgccttggaaatcccacggacagaggagcctggcgggctatagtccaaggggttgaaaagagttggacgcgactgagcgactaatgtgtcatctcgtatcagcattttcatagagttgcgttgctatattaaagccaatctgctctggttcagtcttagaggcagcagggtggggaggcttggagtgaagcagatttgaattcccaacagtgtccagagctgtgtggtctcaggcaagtcactgagccactctgagcctgtttcatcaactgcaaaatggaggtaatagtacagcatcctgcaggagttttgcaaaattaaagttttagatacataaagaagtaaagtacagaagctgacatatagtgagtcctcataaatgtttgggggtatacagaatagaaagtgaagtcgctcagttgtgtccaactctttgagaccccatggactgtagtctgcctggctcctctgtctgtgggatttcccaggcaagaaaactggagtgggttgccattcccttctccaggggatctttctgacccaggaattgaacccgggtcacccgcattatgggccggttctttaccatctgagccacctggtcactcataaagattgttcaggaagttaaaaaaatcaaaagataaattatgctaatgttaacctacccacattatggatgatagtttgtattcaggattagatgcgaaacatcttttaaaacatatgcagagtagataaattaatattcacatgccttgagaatcttaaattttctatttcctgacttctggtgtaaaatttgtaataaactgtgtaagttttctgtatgctccgttttcctttccttttatttactttcagtgaacaaataaacccatagcattttcaaccatactgataattaaagctgcagggggatggagcaatgaaaatgaaacattaactctagtgatcaaagggaagccagaagctaggagatgatatgatgaaggttccagaagtcatttaggctactgatgttgctgggatgttattacatggttatctagtgggcagtaaccaatacatatacatatatatgtacatatatataataataatatatataatatatatatggcataactacatcacccttttgctaaatcgaaattggagaaattacctagggcattcagctattctctggacaacatactatttcttaattacctaactagaaaactcgtgttcctctggagaattcctgggaggcattatagacagcctcttgtggtagaggccccagagtgactctcccacaggaaatcagttctcaggtcctgatgtggccgtttctcccttcctgggtcccctccctcctgtctcttgctactcccactcatactaggggacttcccacccggcttccagctctc

SEQ ID NO: 56797 - DNA, 968 bp, Bovine  19866881136004
tgtgtgtgatggtggggtgacagaggtactcaatggatgtcagggagaataattataaaaatgtgaacccatacagtatgacagtgcatgctaagaagccaaaaaacggcgactcaagagtaagaggagggacttccctggtggcccagtggctaagaccccacactcccaatgcggggggcctggcttcaatccctgatcaggaaaggagatcccatatgctacaagtaaggcccagtgcagccaaatgaataaatacaataacgacaacaacaacaacaaagaaccagaggaaaagagaagacgactcaagcaccttcttggcgggacccctcatttcacacatcaaccaggctggggaatcgcaggtgtgcagcacagagaccaaagtcaatgccaacacccaggggtggccttgtggtggccttgtcccttcttcttttcaaccaggctgcccccctcaaactggcaacagagtcttacctcgaaggcagagaaaggtaagaaaatcttctgtcttaggcttccttttagagaggtcagaaatctgagtagctggagggggtagcaaaggctccactatcttgactggagttgtgctgggactattcggctgggattgagcaaacttcctttgtgcttgcagcctgggcctggaagagcaagagaaaattaaaaagaaattaaccagagatcagaagatacagatctacgtgcagcaataaaatcatgacacaaaagggaagaaagaccctttgtttcaagcaaattctttgtttctaattaaggttctgtatatctctcacactctcataaaccacaagcctgctttaaagggcaataaatttgcttaaaaggctgtgttttctaaactgacaatatacaccatgatcctgtgtgtatgtgtgtacacaagcgcatgcctgtgcaaaccacgtgtgtgccgggtatttcaaaaccagcacgcc

SEQ ID NO: 56798 - DNA, 1419 bp, Bovine  19866881142964
atggggccgaggtgtgggtctgagctgaggacactttaaagtaatcaggctgtcaaattaaaagcaaacactttctcagcatttctgaagactgaaatagtgaaaagtgcattgccttctaagtatatcagagttaagtcatttctgccttgtagttctggaagacaggaggtgtgcaagtacgggaaggcccctaattctccttctaactcactgaatctcaaccagggaaaattctgtcccccaaaggagaggactcttgagagtcccttggacagcaaggagatcagactagtcaatcctgaaggaaatcaaccctgaatattcattagaatattgaagctgaagctccaatactttggccacctgatgctaagagcctactcattggaaaagaccctggggctgggaaagactgaaggcaaaaggagaagagggcagcggaggaagagatggttaggtagcattactgactcaacagacatgagcaaactccaagagatagtggagcacaaaggagtctggcatgctgcagtccatggggttgcaaagagctggacacagttgaacaacaagggacccttggcaatgtctggaaatgtttctgttgtcacagacatgggggtggaaggtgagatggggctaccaagcattcagtgggcagagggtaggggtgctgcaaacatcttacaaagcacaggacagccccttgcctccaacctcgcactccaacaaacacttatcaggcctcaaatgtccagagtgctactgctgctattccctgctctaacaggaagcagaaatgatcagctgcgacagaatcttccatctttcaaattggttcctgggcttcctgggcccccacaacacccttctctcccacaacctacagagatgctactcacagtgtggtccacagaccagcagcatcagcacctccagtgagcttcctacagatgtaggacttcaggccccagcaggtcaacgggactagtatgtgcatttcagtaagagctccagggaactcctagacattttccagtgtgagaggcactgtgcaagtgcccttccccttctccttcagtccttcccacagggctgtctgtccttctcctgttcactcatcattaactctgcactctgccttccaaggaagcagatctagtaaaaagcagctctcctctccaacacttttttccgaaaactcccctccagcagaggctctccctggctccctgcaacaccagttcattctatagcccttttaggagaaggcagctcatctcccacagtgcctttggctagtcaaggagcatgccatgtggagaaaaacatcagaaggcaaaatcattaaatttaaaaagaaatcttgtaaaagcccaaagagaacttttaaaaacatctaaaagtcaaggtgtt

SEQ ID NO: 56799 - DNA, 1999 bp, Bovine  19866881146988
tgctcttttagtcacatcccaccgacttgttttaagaaatgctctcacggctaacgactggcagagtggatatttaagggcacttcctgctctaacatccacatgtctgcaactctagtggtcagtgtaagtataaaaaagtccttatggtgtgctttttaaggaagaaattattcactgggtccagagagcatggagtgaggaggtgtcagccctctcaaggcagcaactcactgctcctgcttctgcactcacaattttgatggtttcagttttagcaggcaccccgcttgcatctttgcgtttcaccaagactggagcacaaaatagcagttctgtagagaaagaaaagcctcactcaaaagaaatatcaagttccgtgggccagcctgtttcagtcccacttaagttctttgagcttatttagtagcaaatggtagtggtgttgcttttccggaaatggctctctgaaaggcaatttgtcttgcagtgcagtctctccatagtaaagctcatcttaggcctttcactggctctgtgtttatcttgtggagaaagaggctgtcgtgttcaggaatgcacacagcagaggagccagaagtgacacaataacagagtttgggagcctcccctgaaaacgtgtgagcgagtttttgctgtattcgacagttgaaaggatgtagggtgttgacagtcctggcagacccaacagataaaaactgctgcttggatgtggcagggaaccagcgtgtgtggtagggggggtggttacagatttgtctaccttccttctctcagggataatttaagaagttcaatattattttatcatgttatcaaaccgctaacctaagtgtgggggaggggatggcaatgcagaagacataggtttgatccctgggttgggaagatcccctggagaaggaaatggcaacctgctccagtattcttgcctggagaatcccatggacggaggagcctggcgggctcccaggccatggggtcatacagagtctgacacaacatttttagcgactgaacaacagcgacaaggaaaccaagaggaatgtaagagaataaaaacaaaggaaagataaatgaaggtaaaaggagaaaatctcttgatcaccgccacgtgatttagcttagtaagttcctcaaagggaaagagctggaaggttcatcatagtgaatggtcacacctgagagccagccatcccctggcactttgtttgaacagggctttacgtgggaagagggggagaagaaaggaaagggtatgtgatgttttccactcctgcctgtgcctctaatcctcagccctgcaaacctggaaacgtcagtcagtgtggcttccaggggtcccttcacttccacagcaacttctctgagagggaaggcgtgctgactgcccgcgtcatttttcagtttgatcagctggtcctgtgtctggcacgaggtggacgccgccccagcacgggaccggtcttctctcacacatcagtgtctgtggtggcacagacatctccagctgccctggaggtcaaactcgatggtggtggttttctccagaggcacgcatacagatctggtaatagagacatttacagtcacgtgcttgataattttctgtacggaaatcctctcccacaatgtggcatgcttttcatcctcaaagcctttgagactctgttgtgcttctaaatgagatcagcggcttaacctttctttgcttttgatgcaaactcataattatgggcagtctgcagagtgggaggttcgcctcccttctctgtcctcactgggatgacacgaaggcagctcttgtgacgagtgtgccattagggtgtcagcactgaagcacttgtgagaaacatttagtggcagctctaactcaaccctcatctcttctgagttcctagaagtatgtgttttaaaagtaaacctgagcaccgaaggtgctgagaaaagcaccgttatttagatgttcgttgacagg

SEQ ID NO: 56800 - DNA, 1810 bp, Bovine  19866881219278
tagtgttgtttgcaacaacatgtgtggacctgcagattatcatcctacgtgaagtcagagaaaaacaaatatcatatgctatcacttatatgtggaatcgaaaaaatgacacaaattaaagtatttacaaaacagaaatagactcacagacttagaaaacacatttaaggttgccaaaggggaaaggttagggggaggggtaaattaggaggttgggattaacatacacaccactataaacaaaacagataattaacaaggacttgctatacagcacagggaactctactcaatagtctgtaataatccgtatgggaaaaggatacatgtaaatgtacatctgaaactaacacaacattgtgaatcaactatgaacctttgtgttagttgctcagtcatgtcggactctttgagattccacggactacagcccaccaggctcctctgtccatggaattctccaggcaagaatactggagtgggttgccattgccttctccaggagactttcccagcccaaggatcgaacctgggtctcctgcactgcaggcagattctttaccctctgagccaccagggaagacctatactctaatataaaataaaaattaaaaaaaaaaataggtgaagtttaagccagtaatatacactaacaccattttcaatttttactgtaattagtacattgaaggcaaatagtgctgctaaggagtgtttggctgtcttgataaattaagtagcccatctaaacccttattcatatttaatttggctaagcaatctgtttcctcatagacggtaccaaggtaaagttcagttcagttcttgtgtgtcttagcaggatttaaattactgagattttactgtggagactgaatcagcatgctgggttgaaatttctgttgtgaacatctaattatcccagttacaaggatattgcctttagaatgttaaataacattcacttcatggtttcttttacttttgttcagcaaaagattcaaaatcgacttcattatattggggatttgaagttatattttaaacaattcatgattgacaatttgcccacgggcatctcttttatcttaaagttagacgtttccctgaggccacacaaaagtgtcaagtggtgtaaatagtatttcatcactgtatgtgtctcttttctttctttttttctctccccttcctttctccctccctcctccccacttttctttcttgccacttggccttctggaataggaattgtagcttgttttggatacattctataaatgctgctttatagaacatccagcctagataccagaattggggtggtaattgccagtttgggtcatctggttcagattttaactataccttgatcggagcagattccctaaataaagtcacagaaattcctgaattgtttacaatgcaaaacccaccatatccacataggatagacacagagcggccctgatcattataaaccaccctcaacaaggtgaaagcttttcccaggtgtggctgagaagaacacctcagtccaggttcttatcttggtcctctctccttggctgctcttctacaatccatcctggctcaattaattggactgtttgattcacaagaaactgttctcttggttatctgaataatatctgtaagaatttttctgtctctgtctttacgcctcaaagtgaaactttaagaaaatgagagatttcactaactgggtgttatcagataaattcatgcaaatacttgggagttgcaacccccaaccatgtaaaaacgtttagcaattacagattataca

SEQ ID NO: 56801 - DNA, 1153 bp, Bovine  19866881277477
ggtttatatggggtgttgtttacactggaagtcaaatgtttatcacaacagaggtgtgagtcgagttttacaggatatatctttagacagatgtgtgtatatgtttgatgtacacagacatacacatgtgtacacacaaacacacacctatatacatatgtacagatatctctccttcatgcccaagctctagggcaggaagttctgtctgttctgaggtcccttcccgtctctacagagtgtgagagtgcagagacctttaggttgaccagatgcccaatggggacatggcagaggatttattgtattaagtatgagatgggacaacatgctgagatgctgctcacttctaaagctgctctgattttaagagagacctgtggaagatggtcataggaagtcaacaataaccattgaggattgccacgtgtaccagtcaccaagcttcagtaggctgtgttgctcggactgtctggtgcccgtctgcccttaacttttttccctgagtagggaagtcgagctttttctcactatagccaggagagggagtgggagttggtagtccttgcatctttctggagctgatttttccctgactcttttctctgctgcttctttttgtccccactttggggtacaggggctggagcagattttgttatgctgggaggaatgttttcgggccatactgagtgtgccggagaggtgatcgagaggaacggacagaagctcaagctcttctatgggatgagctcagagacggcgatgaagaaacactccggaggggtcgcggagtataggtatgtaggggtgggaaggggagtgggcacagcgccatcactggtgaggttacattcccttgcttcttacaggaatgggatggaaataggtctcagagagtacaagtttatattatggtgacttcccttgtagctcagctggtaaagagtccgcctgcaatgcaggagaccctggttcaatccctgggttgggaagatcccccaggattcttgggcttccctggtggctcagctggtaaaagaatccacctgcaatgtgggagacctgggggatggaagtaggtctcaaagaatacgagtctctctatattatggtaccaggggaaagacctgggaaacacttttaaaattaa

SEQ ID NO: 56802 - DNA, 1046 bp, Bovine  19866881285797
tcaatttttaaatattattaaggccttcaataaaacttgtgaggtttctgtgctttgccctgggatatcactatgcccaagtcagacccagacccatggggcctagaactgagactctggtgcaaaatagagataagtatagagaccattaccacccagtgtggtaaggaaagcagcatatgttacagtgttggcagctatctggttcttaaggtggttggtaggtgcgtaggtgttcatttttatgactatgtttcataacttacatacatgtacacatatgtatttgttattttacatgtgccaacttttacatgatttaaaaggtgacgtttagaggatgtggaggcagccagggtgcaccccatcataacctagtgggtgccatatgaaaggtgtaaccggaataatgagtaagaatgagccagagaaggggagacaggcaaaggagagaggtctcagacaggaggagaaacgaggagaggcctggatgaggtgaggaggggcaggacctgtctgaggaaggcagagtagtctagcgtggctgagtgatggtggccccgagcaccggcccagatgctaaggacttcgtgagccagtccaagaaacagagctttatcccaaagacagtgaggagtcacggaagcgtcctgagctgagttacaggattagatccacgtttgagaaaaatcacgcaagctgcagggtgtttagtgaactaaagggaacaagactggaaacaggaaaatcatttgagacacatttgtttacttacacattttacaaagatcagaaagtttgaaaacgtgcaacactggtaagagttcagagaggcagagaatctaaatcaacatggcgtccttagagggcaatttgtcaatatctatgataataaacaattcatatacctttgacctaacagttctattgctacaaataaatctggcaggtaaatttgcacacctgataagagatgtatgtatgagatgttcactgaagtacccatagtataaagaggacagctcattttagaaatgagttagatg

SEQ ID NO: 56803 - DNA, 767 bp, Bovine  19866881378073
ttgagaagtgaacttgacataaaacaccaggctttaaagcagttcttcgatcttttgggcacttccaataacttcctgcttcctggcacttcctgccaggatccttctgcacttgtctcaaccttgtatttcaagaaaagtgcaggtttcaattgataagcactattagagccatgctaatactactctggatatgtgttagctgtcatcctttatgttataaacattacaattttgttcaattctttaatatctccatatgcaaaccttctattaaaccaaacctttgatctccccctactctgaatgtcttcctatgacctgttgccatggagatgatcacatatgcctcatgtaattatgtaaacagcagatagttcgtccatcttatctcacatataggctgtttcatttttccttttctgctggtaagttttcatcttagcttaggtgaatttacagcaccatgcttaaggactcaggtgttttaagtcaacaacaaaattaaatttctcttgatgaattaactagactcctcctaattcaatattcaattaatttgaaagtggaagagaccatctttaacaagctggaacccaaattcacaaagagatcagagtttctattttcagttcaattatctgaaacttaaaactgtcttattagagttaagatgataaaaaatacgtattttaaaaataacagttattccctggaaatagaatctggagaatagtagatggctgctataatagctcttgtgtatg

SEQ ID NO: 56804 - DNA, 823 bp, Bovine  19866881384500
aaattcagagtccttttaaaagtgttcctgaattcataatagatttctgttgtcatgcattctctcagtaaattgtcaataaaagtgcacccactcttaaacttgaaaaggttcaaaaccatggttctagattataattttttgactacttaatttgaaatgaaggcagcgcaagtgaaaacatgtctgaaggtaattgttttgactattactgagtgttcttcagtgatatttagcctaaagaaatctaacatctgaattattctatcagcgtagagaatccttatgctcatgtgtaacattccactgaacctgattttcatctcccagcattgcaccgtggagtgtagggaaatgcctgtccatccagtgggtcccctcccctgtggacaggacagttcctaagggggaggtggggtcggccccatgggagccggattccggtgttctgacctgggctgtcgggggacaggagatgaagagcagttcctcaactttgctttattcctgtgtcctgttaaaatgcagatgtcctgttagctagctgtactgggagctcaacctggtgctctgcgacacccaaggggtgggaaggagcaccaagagggaggggacgtacgtatacttatggctgattcatattgttgtgtggcagaaaccagcacaatattgtaaagcggttttcctccaattaaaagtaaattttaaaaaatgctggagggaaaggtaacacaagctactgagggcggaaatgagcttcgttatgtagataactcttttattctttaaaaaaatacatgtatttatttacttgactgtgctg

SEQ ID NO: 56805 - DNA, 1026 bp, Bovine  19866881423735
gggctgtttgtaatgaagtggtgattaactggaacgctgttgaaacctctcctgacctcgaaccactctaaatgatgtcctcttccttctttgtctgcaaagagaacttgcttgatgaactaatttgagctaaatgtccatggtaatggtatcacagaacctgagaattgggagaaagcttgaatctcacatgtagggaaaaacaaattacccatagtcccaacttcatacaaatcaaacatccttcattttccctttcaatccttgtgcatacataatttgcagatcgcttattcaagattcattcaacacagttataatcagacataattttctagtctgccttattcaacttgcaatttatcatagcattttccatgttgctacatagtctttattcttttaattggctgcaaagaatttcataagtgattgtagtataatttactcaatcattgtccttttgaccaacataaaaaccttgatgtgaatcttctttaattgcaatgttttaattgttctaaatcaaggtcaacaaactgtggcctaagagccagatccacccaccctgcttttgtactgcctgaaggctaatgatagcctttagaggtttaaatggctggaaaaatttttttaaaaggatagtagtttatgacacttgaaaattacatcaagttcaaaattcagtgtccataaattaagttcattggaacaaacaacacccattcattgacacattgcctgtggctgctttcatagtaatacaatggtggagctgaataattgagacaaactgtatgacccacaaagctgaaatatttattatttggccctttacagaaatcatctggggaaatctgttttaaatatacatcatcatccctttcacctcactcagcagtcatacctatggtcatttttctactgtcaagaatctcttttgctatctttctagctctcattattcatttgttcaacaataatttgttaaaaatctgctcttgctaagtacctattctgccagat

SEQ ID NO: 56806 - DNA, 1608 bp, Bovine  19866881450296
aatgtcaacttgttatcttgaaccatctgagtcataagataatgtcgcctgttttttaaggaaaaccaaagacagcttgtgcttccctagtggttcagtggtaaagaatctgcttgccaatgcaggagacatggggttcgatccctgggtggggaagataccctggagaagaaaatagcaacccactccagtattcttgcctggaaaatcctatcagaggagcctggtggtctacagtccatggagtcacaaagactcagacaccatctcaatgttactcggtatcagccacccggcaggcaccagcccagatatctcctgcacctggtcagtgcatctagctgatatatcaccgtctgacacattgctgtctgtaaacgcattagctcagggttctttcccctgccagccgagctcaacctacactccctgaaagtcaaaatgcttcatcacttggcctctacatacttttccaggctgcgttcctgtcccacctgttatcccactggtgctgagactagactaaactattcagctcttttgaatgtggtttgcatcccctgtcttctcacacctggacctttgctgaaatgtttcataatgtctgaaagtgttttcttcttgcctctttgcattgtggctgtattcacttgacctaaactttcttccgggtccagcttagatctcctcacttgcacaaaatcttccacaaatctcccctcctctgttaaagtgaatgtcttcttccattgtaattgagagcactatgcaccagcacatagcatcagggggttttcgttgctttccagtataaatgcctgcgttataatagttcctcctttgtacttatcattatctagcatgctagatgtttacttatttatttcttcactgtctgtaccaccagaaagtcctgggactttatcatcttttttattggctttttaaaatgctgtatccccattgcctgaacagtgcctaacagatagtaggtgctcaataaacatttattaagttaataagtgaatgaatcataggagcctagaggtcccagattgcccccatctttccatcacctcagagtagctggcaaactgctttgcacatgcttctcaaatccaactgcattcaagagccagccacctggatctggctatgtatatctcttctgctttgaagagaggatgtggatttaactgcaattatacagctgtggtgccatgaagcaggcaaacacgatggaggatgagtcttttataggaaaattctaggttaatgggcaaccctaattgcaaaatctaattaggaagaggaaatcagttaaattaagaatccttcatgtaagagaaccaaataagctgttgggcaaaatttttcattcctcattcacttcaatcagcttcctcagagaagatggcaagacagcaggacttccgtaagaggattttattggcccaaaaactagactctcatgactacagaaaccaagaagaaaagaaaacctggcctttggtcaccagattcctctttggcatgtgtcaggaggaagctgccatgtcgcctcgcttaagatcgaaaggattatcactgtgaaagcccaggctctca

SEQ ID NO: 56807 - DNA, 2550 bp, Bovine  19866881527265
atatatacacatacatatatataaatacacacacacacacatatatattacacataccttgtaggatcttttttactccactgtggaaagtactgtataggctgtgaatgtctattcccaatggaacatgctttctgtcctggatacaaaaaatgagctgatcagggatggggtgttagagcagatttaaaggcacagagaccagtagtatgaatgagcttatggaaatacttgtaccaattcctaagggagtaattacagatagactttgaagctacttaaaaactggcagcatcatagatttgtataatcaccctagtagctgcactagattagcctaatatagttctggacacataaaagatgtacagtaaccacttgttgcattgagctgaagcttaagaaggactgaggcttagtgcatgtaagaggggaggagcatctaatcctttttcagaaatgaattaaatttcagtgttctattatcctcttttagagtttgaagtctattttcctaaggtcgatgcttaaaggagaagctgagtgtgtagcagaagaagataaaagaagaggttataaagaaaatatctcacatttatagggaacttactatagaacgaatattatgatgatgacttaccatggcattgggggaataaaatgaaactctggacctattagctttgaactaactctgttccttaattatgaaattaatttctaatgtgtcttcatagtatttcaatatacctgggcattttaaaataaagcaaagcattttagtttgcttttatactagaaaactcacgataaaacaataaaggattcattatgtcaatgaaatgtaggctgtgggtacagccagactgatgttgatttataaagaaaaaaaattgatgggccaaattttaacatggctttggacattaatcacaatagtcttgaaaataatctattgcaaccagcctgccattctcctctgaaacaggaagaaaacagtgttctgggggctgaacaggggagaagggcttgctcattcatttatttattcaaaaaatttttgttgacttttattaagtgccatgggctgtgctaagcacagaggatacataatgactaaaactaatttcttcctcccaaggagctcatgtctagaaaggaacacaaatacataaacaattagtgtttatagaatgtgaaaaaatcttaatgggggaatgatcaagtgtaaggaacctaaaggggagcatcaaatctagtcttagggaggaaagggagagacgaggagggcgtctaaagcaaagtcctgaagaataacttagcagggaaccagaagcaggaacaggaacattccagggaaagggaaagaaccaccattaaacaaagccccgagatactggctgtagacaggaagacacaaaaacagtagtggagtcacatggtgaaataaggtgttgatgtgggcactcaggccatgttcccaagggcgacaggacaaaaaccattcatccaagtggtgtcagtaattgaaaagactaggacattagacacacgaagtatgtctcatgagatctgcggcatgaaacccactactttagactcataacttgcacttgtattacatggctgactgtgtgaaccaaagaaaatgcatactaaaaactaacgtttaatgacatgtccacatgtatataagtgtaggcctatttactattgagctgcacagaaactgagcttaaataactctaatcaatagcgctttaacgagttaagccaattttcttttttcactctgttagcttctaaatatctattatcagtgaaatgtcattaactgttcctcagctcacagctcactggcagattatatacaagttaaaaacaaaaatcctatatattatttcccaggatctggggttcttcccatcacttcacacgctccatgttgaaataatttatgtgtgaataaatcaaacaagtgcattattgtgtagttaaacaacagcagcctaataaggcagcgagtagattttgaaacactaattactttggggaggagcatttttatgcaagcacgcgtgctttgtcactcagtcatgtccgactctttgtgacccatggactgtaacccaccaggctcctctgttcatggaattctccaggcaaggatactgcagtggattgccatgtccccctccaggggatcttcttgacccagggattgaacccctgtctcctgtgttgcaggcagattctttactgtctgagccaccaggaaaacctctacatttttatggtgagacatgaaaagaaccacagagtaaaagcctcctaaggaaaggccagagaatatctggattcgtgaaaacaagagggcttatatggttatttaaagggttttggttgctgtcattttatatcaggctttctgttctctttttgtgagtgtttttacactaaggggagttgtacctttagcaatgaaataaattgtgcagctcataacaattagaacaaaaacaataaatcaaggaaatacagtggcaaagg

SEQ ID NO: 56808 - DNA, 1155 bp, Bovine  19866881537103
atcttgtgatataccataacaagaaagtactatgaaaaaacgtatctgtgcacatatgtataactaaagcactttgctgtacagcagaaattaacacgacattgtaaatccactaaacaataaaataaattgtaaaaaagaaaagaactgggttcgaaaaaacttataaaaagagaggtaaattatctagtggtcagtcagtaagcaccatgttaattaagaccaataaagacacataattaccatatagattttccaaaagcccaaatttaaccctaaagcttctagttcttttttctatacatctatgtttcccaacgataacagacacacattctcatcagtaaaggtgtaaaaaattagtaaaataccctcctcaaaaggtagggaagttcaaaaataaagatcctagataaagcaatacaccaactgatttgcaaataatagctgactatggcgaaatgttcatattgtggatttcaactctcacagcagttttctcctatcaaggagagtagggcagagatgacaaatatgataaagagaaaaccaactgtgttgtttttattttttttaaatagactctgttaagcagtgacatacaccttggtttaaaggtctcatatggtatgggacacttgatgatatttagcagagacaaggagccgacaccctatggcgttgatctggattttactttgtatagcggagccacttctcagatcttcgcagctgctgctgtgcttttcccactgattctcaactattcttctagaaagaaggcaccaaaagctcccaagagaacacagctctcccaacacaccatgtaactcttttctgcttccccatctagagggtcatcccattacacttaccataatggtgtgttctggaaatctggaccggaccagcttcacgaactccacaaaatgctccgagtacccattggccacatccaggcaaataaacttaacctgtggcacagcttccaggatgttgctcatcttttccagatcatccttcccactgcccgaactcacggctacatgctgtaccgaataaaccaagaggtataagacaggaatggtaagtggcgttcagaggccagaccctgcctccatccaccctctagttctggggacagtaccgtgcccg

SEQ ID NO: 56809 - DNA, 683 bp, Bovine  19866881553422
ccccccgtccctgggattctccaggcaagaacactggaagtgggttgccatttccctctccaatgcgtgaaagggaaaagtgaaagtgaagtcgctcagtcgtgtccgactcctagcgacctcatggactgcagcccacccggctcctccgtccatgggattttccaggcaagagtactggagtcgggtgccggctgattcatgttgatgtgtagaagaaaccaacacgatgctgtaaggcaatgatccttcaagtaaaaataaattttgtaaaatgtgctgcttagatattattattactgatcaagttcacatatgggggccactctcttttttctgatgttttcagagtagtgaggcttctttagtccagtcatatttaggaaatgtttctagaaaagggatttggggcaagaaaaatataaaaatatttgctataaattttccacttgtgtcttaagtacagtatacaaatatttgttgtctgtagaggtgcttaattctttcttaaagtattgacttttccaaccagaaattttaccagctatgaaatttgcatttgaaaatttcttaaactgtaaaaatgtgatattttatactggttgaattataggctgaagactttaagtgacaagtcaagagaagctaaagcaaaaaacaaacccaggtaagcatgtgctgtt

SEQ ID NO: 56810 - DNA, 881 bp, Bovine  19866881989895
cttattgcatcttcattcacgcagcccctgaatcaaatcagatctgggagcttctcccccaggccaaatggaaatcagccaaggatcagatccagccttcaaaaccgtcctcttttttttcccccctcttcactgtcacttccttaactgctattagcattttacccaaacctgatgatgtgttttgagtggggagagagtttccattaactctctgtctcaccatcactaaatttagccttcgatgtaaagtctcaagttctttgccctaaaaatagcttggggctgaaatgggagcagaagtgaggatcagtgtcagctgtgtgtcctcagaaacccatggatgttaaaggtcaataaacccccctggtcctgcccccgcttggtcttcacctccaccctctgggggttcagacacattactgctcttcccaatcagaactcacccacatcagtgaacaccagagagcatggtctggaggggtggggggcaggcgctactcactctctcaaatgttttggaaaactgaccaattttcctttggaattttgaccttgtagttatttttggtgggggagaagaaaacaaatacttatgataggcttcttgtcaataaactctatacataaagtgctttatcaactacttttagtaaaaatgctaaacgacaatggttgatattaaatatatcctttcgagggcttccctggtggctcagtggtaaagaattcacctgccaaagcaggagacatgggttcgggaagatccgaatgccgcggagcaactaagcctgtgcagcatgactattgagcctgagctctaaagcccaggagccacaactgctgaagtccccgtgccccagggcccgtgctctgcaaca

SEQ ID NO: 56811 - DNA, 779 bp, Bovine  19866880821111
ctccatatgattatcgcagctggatactgcttctgtgtgtgccctcagacatgtcaccgcccctctgtgggcaattttccagtctgtaggatgcgggaggtggtggaccaggtgctcctcggggcccttccaagccccacagccttctgatcctggactgaaaataatgacagtggtgcgagggcttcctgggcctatcagagcctggttttcaccgcttccattaatacgcacatatttttaacatcttccgatgccctcaatttgctttctcactttcatcctcatttctattgccccctgggtcttgggacctaattttagcgaaggtcaaatgcagtttcttgggccgccccaagaaagaggtggatacccacctctgcagagcagagcggcagcgggtgcttcaggccttccctgctgtctgcttttgcaggagtggggaccaggctgggccgggccaggcagggcgagggtgcagggctctctgcctggcaaggggtcgctcagctcgctgccacatggaagcctggccggcaaacactagactctgtgtccttcaagaggctcagagcttcaagtgatctctgcttcaagcttctcacttgtgatgggggagccgaagttccgggaggggttaggataaccaggccaagattcagctaaaatccatcaggcgattcagcaccaaaggagaatgaaagcacatgcagtcactccctgtccgcctccaacagccatcaatggcagcatttccatctggcactgggaactctgca

SEQ ID NO: 56812 - DNA, 760 bp, Bovine  19866880415801
catgacccatctatgttgggtggcacattgcaaaacactactctgagaaaactatattgataaaattttgatttcaggtatagcattttaatgaaaactttaaataatatataaagcagctcttggggtgaaagaggggacaagtcgatgttttgtatgtggttaagaggtataaaaagtgcttcacctgttgtgggtgaaagaaaagctaaaaaaaaaaagaagtcattggtcatcaacggaaatttaaacctgagagtacagaattttcaaaaatcttatttactatttcccagaggaatatgaggtttgaaaatgagatgattgtgcctggagaggaaatgggtgtgggttttgtggcttccagacagcggaagggaaaatcattgtgtctcagggaaagatcctgttttctcaggcttggaatagtatcaaccaaagttgatagtacttaaacaaaggcaagaagactacctgactatcggccttttatttctcctccttcaggtcactccacaagtaatttcatatagagaaaggcagaaggaaaattaaaggtgactcatctcttaacctctcaaagcctgattcaaaatgtcatgaaagcacctaagagaaatgaaaagaaagaaagcctgtacaagttaagaaaagcagaacaggaaaggagtctgaaaagtcactgcaatcatcactaatacattggacatctggcaaggagatacttttgcagggggcaactgggatgagaactctaatt

SEQ ID NO: 56813 - DNA, 4828 bp, Bovine  19866880456336
ggtgcagacatactaatgagattactaatttttcatgtgaaggaaaatattttcttgataggtatgttgttgtatctaaatcaggtcattctaaaactctgtgcttctccaccttaaaaaaaaaagctttgttgaatttctgacatgacaaattaatataaaaacagtaactattatgttttgtccttgattcaaaagcataggcagaaaatttcagatacataaaaatgtgacaatgtttttagggaaagtatctaatttttgtcaattccaggtacactgagtcatgtcacatttatgttgtgccagttcagtattttttcacttagtttctatcaccagattgtcttttaagagctattggtccaagatagctttatggcattaaatggtgagaagtttattagccaagcttgcaatttcacctaccatgcctttagatgtctctgttctcaaacaggacctaaaaatatggcccatttttggttcttttccttgtcgtaactgtgagaaacttcgtctgtaggcacttattcctttcaacttatattcatacattcttccagaaatcagggacatttggcagctctctaaatctactctgtgctcccaggctattcactgggacagcctttccttgctcctgcctcagcatccgaaacagcttatatacatgaggagctttattttagtgcctctgtgatagcacaaggactacagtgaaactaccgactccggagggtccagaggcactttaatttcagattcctaaagtctttaactgacctttaatactttgtttgccctccaacttcttttcctatacaatctcattgtggtgagaaacactagtgcagtaaagctttcttccttgcctttgtgttctatctcagctgtggctttccatgttgaaatacaataatttgatgcctctccttggtctactatgccaagtcctttatgggacaacagtattagagcctgaattgaggagatatcagtggacagggaattgttaagggtaaagctataagatctggtttggagtgcttcttgtgcacaggcattgtgcaagcattttatattcattgcctaacaagtcttttttttttttttttctttaagagacggggtctcactatgttgcccaggctggagtacagtggctatttacaggcgcgatcctactactgatcagcactggagttttgacctactccgtttccgacctgggccggttcacccctccttaggcaacctggtggcccgcccgctcctgggaggtcaccatattgatgccgaacttagtgcggacacccgatcggcatagcgcactgcagcccaaaactcctgagctcaagcgatcctccagcctcagcctcccaagtagctgggattacaggcgcgtgccaccgcgcccggcctaacttagtcttcataatcacactctgtatattgagagggtatgatctctgggttgtcatgggcattaaacccagacaatcagaggctccccgctctctctcctctgtccttggaatgtatgatccacttattcttctacatcaggagccacttcagggtttcagtcttgagagtaatgtgttgttgagaccatctgaacgatatatgtcattgaaatccagcaagtggaaccagagatttagtcacttatagccacgtaagacaatgcctcatataaatgttcccttgctcattaaaactgccacttaccaatatggaggtgatctacctctttcttccgtctgctctttttctccgtatatgggagtcagtttatgattacatctggagagctcctgtcaattggcaaggcagccagaacaccaaaggaatgagtcttgggaaagaagtatccacaagagaaatcccagggaggccactgacctctatgtagggaagtctgacttgtattttaggtgtttgggcgtcaccacctgaaggcagggatacccaggaacacctcagatttaatgtgtttattttaatgcatttaatgaagaactgtgtatagcatactgcaacagagaagaaaaatacacgactgaaacatggaatggcctttcactgtggggatgccagctagaggctgaagctccagttaaaaagttggaagaagagctgaagttagacaaggattgctctgcaggatttggagctggcagacaaggttgggggagcagggtaatacactggggaacataatgtgggttttgcaaatctaagaaggtaaaagatgacatgaattaggtctgaatgctatgacaaaatctgattgagatgcttggaggtggaatccctgggaaagtagagggagtgaagagggggatattatggtgattgagggtgaaacaaagtggctcatgtccttagactctaatacagagaaaagcaaaagaacagcaaccaccccaaccagtggagcaatcccagattcaggaaacacctatgttgaaagaatatgcacccactgggcttatttatatagctgttacttcaatagatataacagcctggatgcataaaaacagctactaccatagtgcccacatgggaagacattgcccttaagatagtgacttggttaatgcaggaactaacatgtcttgtgttggagcaatccaccagattcccaactggtaaaggaaatggcaaactgattacataggatccctctcttcaggtagtttttgctgtttagtagctcagtgatgtccaattctttgtgaccccatggactgcagcatgccacatctccctgtccttcaccatctcctggagcttgctcaaactcatgtccattgagttggtgatgccatccaaccatcttgtcctctgtcatccccttctcttccttcaatctttcccagcatcagggtcttttcaaatgaatcagctcttcacatcaagtagccaaagtattagagcttcagcataagttcttccaatgaatattcagggtttatttcctttaggattgactgatttggtctccttgctatctaagggacttttaagagtcttctccaacatcacagttcaaaagcatcaattcttcagtgctcagcattccttatggccaaactcttacagccatacatgattactggaaaaccattgctttgactactggactattttgacaaagtaatgtctctgctttttaatatgctgtctaggtttgtatccctccaagagagtgtgctaaatatgtctattttgtgtgggtatattatttggcctaacctacactttcccctgtcgccatgcagaccaggctgccaccatcaaggaattaaagaagctgaaaaaaaaaaaaaaaaatcagttgctcagtgatgtttgactctttgcaactccatggactatagcttgccaggctcctctgtccatggggttaaccaggcaagaatactggagtgggcagccatgccctttctccaggggatcttcccctacccagggattgaacctgggcctcctgcatggtgggcagattctttaccatctgagccaccagggaaggacttccaatagtgtatttaccaagtcagattggatggtgaatattgacgcaggcatttgttaattcaaattgttataacttctcaacttgtagatattccacaaaagacatgaagcacttagtatcatgccatgatccaattgcatgctttcaactaatttaattatggtgatgaagatgcaagtgaatgttacaataatgcacatttaacaatatttgttccattattatagtccttgatgatctgaaatgtgagcacagcagtagatgccattttgatttgcactctcggacaagtaaaatagttgcatgtcaaccaggatgagaaatatagaatgcgttaaaccaatcttgtcatttaatatctgatgaattacgagtgatcacccttcctgaaatatgtcagtttcttctggtagcacgcaaggctttgtattcatagctggcacaaattgctgtctcaatgtatgctcaatttaacaactgtctgttaaagttatcaacacattccaacatccattgtacaaaagagccccttcatgcattaaggcagagggattatcaaaacggtgcaggaaagggaaataccctttggtgcaccttataaaactgcacatgcaatagtttggaaagtaggcatttttatagcatgggaatatatagtataaattttgatgtggcagtaaaatttttttaaaaagagcgagagcaaagaaataaaagtctttccatattgcacacatgctaacccctactttctgaaaccataaaaagcttaaaatacccagcaggtgttttaaaacttaaattaattgccaacacattattattaatttcagaaatgctgaaaaaggaaaataaaaaatatgtgttgacatagtggtacatgggctatttgaaaacaaatataaaacctaaataggttcatgcatcatgctaagtcgcttcagtcgtatctgactctgtgcgaccccatagatggcagcccaccaggctccttcatccctgggattctccaggcaagaatactggagtgggttgccatttccttctccaatgcatgcatgcatgcatgctaagtcgcttcagtcgtgtctgactccgtgcgaccctatggacagcagcccaccaggctcctctgtccacaggattctctaggcaagagtactggagtgcattgccatttccttctccataaataggttcaattggatatatttcattcacaaaatagcaattaatagtatacttgctgctgctgctgctgctaagtcgcttcag

SEQ ID NO: 56814 - DNA, 859 bp, Bovine  19866880497421
aatgaagaaggaaaaagagttgggtaagacaggataaatgctaccacatggaatgccattttgtgtaagaatggcccagaaaacagagtgctgataaaagaggaagtagccttttcacgtgactgagtgtagaggctcctatctgttagttcattggtcaataggtccaatgtggttcatttactccaacttttcaggccaaaaaaaaagcccaatttaaaaagttggtcacatcccaaaccataacctgttcattgtatctttatgatcagcaccatcttttggtctagtacatttaacaataatgacaacaaaaataaatatggaaagaagagaggtccccatctgcacacggttcacatatgagctgctatgttcttcataacacatttttagagccttgcttaatagataagttatatctgtatacttgccaaataaaaatgcaatatcctgaataagtacaaattcaatttaccttgtattgtatgggaaagagggctccccaggtggcgctagtggtaaaaaatctgcctgccaatggagaagatagacacgggttcgacctctgggtcgggaagatcccctggaggagggcatggcaacccactccagtattcttgcctggagaatctcatggacagaggagcctggcaggctatggtcaatagggctgcaaagattcagacacaactgaagtgacttagcatgcactcacacacgtatgggaaagaaagtagaaaccaccttagacgggggttgttatgaagaactttctgcttctgtgtttttaatattaaaattcctgaaattttggacacttggactaatcatatataaaaaaagatagtcagatgtg

SEQ ID NO: 56815 - DNA, 2387 bp, Bovine  19866880517260
aacatattcttttgatcttgtgtgttctctgtttatttttaaaagaaacattttgcccttgatgaattcttcccatttctgacatatatccatcagtgaattgaagtctatatatgataaattgttgtatgttgattctttcagttaagaactcacttgaaaactagccatgaaaattgtagtatcaggggttactcctcaagatatactatagtttaaggttcaggattctgactaaattttgtgagaaactgaattagtattttttatgaaagttttgtgatgaggatactattatccctccctgactcttttcatatatatcattgttagattttgtattgaatctcaaaccagagcagtatttaattttgtaaatggacaagttttcagttgctgaattgaaactttttcagataatgagtgctaacattaagacccctgttatactttgcatttcagtcagcttatggagaataagattaccaccattgaaagaggagcattccaggatcttaaagaactggagagactgtgagtattttcaattccaaatttatgacgacgtaactatatttttaataatacttgcatttccaggaccatgtctttaatttcatgtcttagtctgtaaatttacaaaaacaagaggttgaattagtgatttttaaactaatttaaaattagacattataaatagtactaatttgtgataaagttcaaaaacagacttactttcctgacacgtttacttccttggttaccattgctttggtacttagagatgtacgttttttcttattgttgatctagtttgttttatttgcttatgggaggaaaggtggtggttttatttgcattaatggggcattataaaacaaagttttgctgataattattttagttcccatgatgttgctatgtgtgtcattaatggcattggaagaaatatttaaagttcttaatgttataaagatttgctttctgatatttaacacttgtggtgaatatttatttcattattttatattagctttctaaatattctttttgctggaaaaagcatttaaggataaatggaagtaagaattactttatcacagcatgtcatataacattaattgttgtttttccaagaagatcaaatgtggacttcagaatttaaaatgtatttttttttaaatttcagacacaaagtcttatggattgatatatattacttgagaatcattattattttaggcctatgtgtatatgtacaaaagacagaagcctctgtctgaaataattaagataaaatacacaatttgttacttgaaatatgaattatatatctccatatgtcttgataattcaagtttagtagctttgcatttctaaggccaaataatggctctattaaaagtaccaacaattattttaataagttctcttgtctgttttaagaggcactgtaggtaaaaataaaaattttatttaaaatagtgagagatgaagttcattttgggtatagcacatactgattcactgggccctagtacaaaagttaattcagtataattgtaagtaaaaaaatgacttgtcaacttctaagttatttgtaaatagaagctacacttataacttaaagttaaatacagatatatctaatttatttataaaaattttctccatgaacaatattacaataaagggatatatttgtggaactcaaaataaatgtaaagtcactacttaaagctagttttgggaaggaaataaagataaggtaaacatttggttacttttataacaaagttcataagttcataatctatctcagtatatacaaatactctgaaaatatttattctttgatctcttttgtgactacctcactactagtgagtacttgacaaatttatttttaattcatccattgaaactaagcattaatataatttaaatgtttgttaagatgaagagataatttaaaattatcatttaaacattaatagttttttcatcaataacatatttattcatgtatatgtgtgtgtgtttaggatttatatatacatgtgagatatatatgtctgtatatttatgtttttttttcttgaacaactttgaccttgaaggattctcagtggcttttcatgaagtctctatttggtttattttgtaattttaagtgttttcagaaacactgaaacaaaacaaactttttcattatttttcaagccactttggagtatcgtttgaactttcattttgaaaaagttaacttttcctaaaatttattaaccagataccttatgatctgaaattcaattaaagttgtaagtaggtgctattttttgactttgacttcccctgggagtgtcacttcatcttacaacaatttt

SEQ ID NO: 56816 - DNA, 1566 bp, Bovine  19866880544345
aagtgatgcttttgaactgtggtgttggagaagactcttgagagttccttggactgcaaggagatccaaccagtccattctgaaggagatcagtcctgggatttctttggaaggaatgatgctaaagctgaaactccagtactttggccacctcatgtgaagagttgactcattggaaaagactctgatgttgggagggattgggggcaggaagggaaggggatgacagaggatgagatggctggatggcatcactgactggatgggcatgagtctgagtgaactccgggagttggtgatggacagggaggcctggcgtgctgtgattcttggggtcccaaacagtcagacatgactgagcgactgaactgaactgagctgaactgagttgaggctcctggactcagtggttgcagctcctaggctctagaacataggctcagtagttatggcccaaggacctagttgctccagggcatgtgggatcctcccaaaccagagattaaacccaggtctcctgaattggcaggcagactgtccaccactgagccaccagggaagccctaccagatgaccttgaataactctttggacttcaattcctttaattataaaagggaaaaaataataataacagtaataataatagtatcttctttctgggattgtataaagacaacataaaagatacagaacacttggaatacatccttggcacacagaattcaataaatatttcttgtttcattttcattaccagcattaacttccagacttcatccttttgtgtctatctttcattggagggactgatgttgaagctgaaactccaatactttggctacctgatgtggagggctgactcatttgaaaagaccctgatgctgggaaagattgagggcaggaggagaaggggacgacagaggatgagatagttggatggcatcaccgactcaatggacatgggtttgggtggactctgggagttggtgatggacagggaggcctggcgtgctgaggttcatagggtcacagagtcggatacgactgagcgactgaactgaacttcctattattctaggagtccctcctgagtatgagtgtgacttgttcatcctgtccccagcatccacacagaagaagtgcttcctaagtatgtaatcaatcagtgaatgggtgagtcagaacctcaccacctatttacattttccagttacttgagagtgacgaatggggacttcattgtgctgaccttcacaagctctgaggaaatatttttctccctttctactgaagcagtcaaggttaaccttcacttgttaggctctctgccaagaagaaggcacaaaagagtacttcaaccaacttatgaaggcacagtacaagtaaagtccccacagagtacctgagggcacaaggcaactgaagctgaggcggttaactaccgggctaggggctccacagtcctactcagggcatcccatcaaagcgtaagcatcattacagaggaaaacccagagcacatgtggatctcactttaatccattatggagaagggaagattta

SEQ ID NO: 56817 - DNA, 2439 bp, Bovine  19866880674774
ggagatagtatataattgggctaaacttgtgggcctctctgatagctcagtttataaagaatctgcctgcaatgcaggagaccctggtttgattcctgggtcaggaagatcccctggagaaaggaaaggctatccagtccagtattctggcctggagaattccttggactgtatagtccatggggttgtaaagagttggacacgactgagcaactttcactgacacttgtggaataccaaatcagtggctgttcggaatgggagaattgtttagtggtgtgaaaaaatacatgttgaacttatcattaaagggataaattatatgttaccttttatgatgtccagttggtttggatgtagaaattataatgaatgtcttgatataaagctgtactaaaaaaattatcaaagtaaggtaggatagtgacctgtactatttctgacacttttattgaaagtcagagctgcctattagtgagtttcttctaaaggtcagaaatacacagaatggtatatgcagctctcaattatgtgcccacacttaacagagagaagctaattaccttgaccatatgcttcctccctttttcactgggagtctctcatgttttgcctttgccctcttcttgtacacattttcttttaattgccaccttactatcaaatgaaaggaaaatattgctgtagggttgggtggaaattatagggttttcaacattccccagatgggcgtggctccctgacttagggactttgctttccagaatctaagtttgaaggttgtggcccaattcttaactcagagatctatgaacaacagcacagcatgtggcttggaaaacaggactttatacaaaagccctggagtaagagaaggacctctggcttcctattaatagttcttcagctatgtggtcatggcatgtaaattcactcagcttcaactctaaagtaagttctgtggattagttaacctctcctgtctgctttagttgtaacttcttgcatctacagtgtagatgatgttttaactctttttcgaggcttcttcacccccatccccatccactcccaggaacgtgttaggaggaatcttccattgaaatgtacattactatcattcgtgttcacctttggatcttcccccagatcacaggcctgattcctatagacaaaactctgccttattcgtctttagacatcaattctttgcataatgtccagctcatggcagacactcattcaagtaactatttgtgtgtgtgtgtgtgtgtgtgggagatagctaaaaatcagtttatagttattttctctttttttaatattaatttatttattttaattggaggccaattactttacaatactgtattggttttgccatacatcaacatgaatccactcaagtaactttttaaagaagtgatttaatgacatcaatcattcaaacaacagtttcaagcaacagtgaaactaactcattttcctgacctcctgagtctagtactgatattgggaagacctagaaaggaaaagagtatatttttcacattgcacacataatggcatgaacattaataactaagatgattgaatgctaagtgtaaacccataagtgaaattatcttactgaataggtgcaacaaacctctgagataggtatacttaataacatcactttaatgacaagaaaattaagacctagagttacataatatgcttaaactttcacagctagtgaccagggaagcctgaattatggttaatctgacaccagaaccattgtttaaccactgtggaattctgcctccaggccccaagctttataggcaactagtcagtgagttagggttccaatcttaaacctccatttccagcatgttctgtcagtcttcatgaaagcaggatctgctcataatagctaaccatagttggacttatctgcttgtaggtttttgaaagtgggcaaaacttaattcaataaaagttgcctttgtaaaatgtgagttaatgaactttggatataccaaattcaagactcctctgaatcagtttcagtcactaataacagcagagcatcactagttacaaaagagtatgcataaataggtggctgatgtaatcatgatatttccattttattagaaaaagatacaatcaggaaataagatatggtgaaatatttccagatgattaagatacttggataatataataatggctccagatagatcttaaaagaagaaatggggtgtcaattgaaagaagtatatatttgcttgtgttttatgtgcctgagtgtgtgttttgtatggaaactaataaacaatatagactccacatatgtgtgggcatgtctaaagagtgcctgagatgagctaattgtttatcctttccctttgtggactatcaccagaatatcttttcttatgtcttaca

SEQ ID NO: 56818 - DNA, 2620 bp, Bovine  19866880702140
gacaggggagcctggcattctgcaggcattgtgtagcagagtcttctgacttactgacaacaacaacagcacagtgataatggggaccctgaacttgtaactggggcagtgtcctgggccaattgccaagttcctcaaagaaaaccctgtgttaatggaaacaagaaaactggagccaatccggatctctggaatgaggttgctgcaaaatgggaccagatagaatgtgtgttgggaaggcacctgggtgattcaaaaaatgaaaggcctgaagaaactatgaaaaaactatcaatccaattataagagtacaccaacatatgcataaaataataatggaataatagaaataaagaaataaatttgattgaggaaaaattataccacattcactgtaaatacagaagatgttcaaaagaaaagaaagaaatgagaactgaaatcatcaaggcagggcatatggggaaggtggagttagagggatgccttgaaagataaactagtcttgatatatgagggacaaaaatttataggaagttttttcatataaagagtgaaacttattagacaatattagtgttgaattgttgctttttttgaggttattgcacacagaaaagattatttaagattaatacaattttaaaattaatatttaattgactaaaggttacaaactgacaggcttagcctttttttgattttacaaaccatttagatttaatttacaaatttgtgatactatttatatatccagtaaattttaactattacttttaaaggggattttacatcttagttaattaaatcccattaaatattttaaaatgcatttattcatttaatacattttgcttttcttttatatgcagttcagtaatctgaataacaaaaaagctctccaggaacttaaccaattcttataaacctaaataaattacagacataaacacagtaaatctaaaattatcataaacattatattatttccaaaacatggtagaattatcttgcttcttttaacttaaaattataagcttaaatcaattatttagatatacattttttaagatatcctggagatttattttttaatttacttatttttaattggaggataattacttcacaatatagtgttggtttagagctcaaacacagtagttaggacacattttaaaactagaattcaatagcttaaccagtagatttgtgattttcaactgggagtagtattactgccccctggggtgtatttggaggtatgagcaggtgcttcaactgtcacaatgcctggggactaccacaggcgttacgtgggtggtcaccagggacatgggaagctcctatagggagagatccaaaagcatgccccttgagtgcattagataatgttgtagtttggattcttacagaagctgactctgaccgatgattcaaattcaactaagttatttggaagttaagaaaacactggtaggtaagtcagagtgagacaggaggggaaataaagcaattgttcagtcgctgacttgggtctaactctttgccgtcccatggactgaagcatgccaggcttctctgtccttcactattttctggagttcactcaaactcatgcccagtgagtaggtggtgccatccaaccatctcatcctctgtcatccctatctcctcctgccctcaatctttcccaacatcagggtcttttccaatgagtcagctgtttgttttaaagagtgctttatcaagctaagggtaacctgagcataacacaactgtgtgaactcaagagtcaacatataacatgggtctgtagggtatcttaccctggggatgagagggctgggttctgacacaccaacttcattgtcattgattgagggctgctccaggaggcaggtttcccacacttcaggcaaagcaaagagaatccaccagagaagtctcctaagggcaaaaacaaaagccagatgctttgtgcttatttctgtttatttgtttgactcttcagattgtagcacattgaatggaaatcaaatgagtttaaatatagggatttgataaattgcctctttaactttcctttgatctttaattggagaggaatcacgggaagaaagactgctaatccaggctctgaggcatcagagaacttgatcatctagagtttgatccccatttgcctcccagagtaaacaatggtggctttgagcaagcgagccccagaaaaattaacaagaccttggaagagaaaggtaacactggtctcagtcctcaagaagtcatttctgctcattggcacctgttagactgaatgtgctggtggacggtgatacaagtcatactccccagcctcccgcagtccttggaaaaggctctggggccatgaatctcatggaaaagtgccaatgaggaaaaaggaagatgagcagagattacaaatgtaaagcaacatttattaaggtctgctgctgctaagtcacttcagtcgtgtccgactctgtgcgaccccacagacggcagcccaccaggctcccccgtccctgggattctccaggcaagaacacgggagcgggttgccatttccttctccagtgcatgaaagtgaaaagtgaaa

SEQ ID NO: 56819 - DNA, 1878 bp, Bovine  19866880813698
tcccctttctgacttattttacttaatatgataatctctagttgaatccatgttgcttcaaatggcgttattttgttattatttatgactgagtagtactcttgcctggaaaatccccatgggtggaggagcctggcaggctgcagtccacgggatcacaaaagagtcagacacaactgaggggctttgctttcacttttcacttttgtgcattggagaaggaaatggcaacccactccagtgttcttgcctggagaatcccagggacaggggaccctggtgggctgccgtctctggggttgcacagagtgggacacgactgaagcgacttagcagcagcagtattctactgtgtatgtacatatataacttctttatccattcttctgtttgcagacatttgccaagacagacaaatgccaagacatgccaagacagacatgtcttggctaatggccatctaagatagtgggaattctttgaaacgtgtctcctagaaacagaacaatggtttaggaacaacttattattctcttgctctacacacatacttctttttttaatcaaaaactttaagatttggaaatttgaagtttataaagatattcttattggcttgggaaatgatgaaaatacagtaatatcaataacttctcccactgagaacaatcaatcagattgtcatcatatataactcttgggcattttgcctactatgtcaactgtctcaggattctagcccaggtggtagctttaattatctccattttttaaaaatctcctggcaaaggaaaatctttctaattatttaataattttgattcattctgggataaatttcagcatgttatattttgccatcagtaaaagctatgtgctaatttcattttaattgtcactctttaggaggctgttaagaccaaggaatgttacttagagcagaaacttacagaatatgaattgaaatcaaatgactaaattcttaaagaatatattgatttttgcatttcattgcattcttattttaacatatattacatatgttgttgccatacagtttttgttcaccactgtactccttaaaaatttgcctggtatgtggtaatatgcccatcaaatatttgtaaaaattgttattgaatgaaaaaatggatatgcttcattccagatatagtgggtgtgtgctcagtcacatctgactgtgaccccatgggctgtagcccaccgggctcctctatccatgggattttctaggcaagaatactggagtgggttgccatttcctcttccaggggatcttcctgacccagggatcgaatttgagtcccctgcatctctaccactaatgttttctcctgctttgtgctggttataaaaatgcttcctaatgttttagattgtaccagaataaaaacataacaatttaaaaagtataaattcttacctggactcacttatcccaaatggtggtgaacctaataatttaagataaagtgttatgtagcaagggaaattgtgccaatctagctcttcttaagcatcatttctcacagtatgtaggtggttagagtgatatagaaaaagcacttttaaaaagtatggcttgacttcacaggtttccagtgcaattatttgaagagatttcagtttaaagaaattcactctgtaactattgagagctttggcagagcacatttcgtatagaaggatttatataaacctgtttccatagtacctaggctctctgaaaccttgctttagaagaaaacaaatgaaatatgcaagaatattaggtgatttccatcaggatatgttcactgaacacgctttgttaacactgtgctcttcttgagaatccaggaagataaaaacactgat

SEQ ID NO: 56820 - DNA, 1682 bp, Bovine  19866880886834
caggagttttgttgcaataggaaaaagaaaagagggactgcgggctggaaaagtaggattcagagaagcagagagacttctgttttgttttttaaggttagtcagtaacaacatgttaatatgctgataggactgatgcaagaaacaaaaaattggtcatagaactgagggaagaatggctggagcaatgtcttttaagggaaagttgatcaaatgtattaggagagataatagaatatgttgaattgatataataatcctgatgtgggtagatgaaatatgaaactatttatattttctaagtgaaataggtcatcagcagaaagtgagaactgggtcaaaagttgctgggagagagaagaaaagtagacataatttttccgaaaagagggaaactaatttgactaagacatgttttctaaccactgaggtctactaagacctctgttttttgtttttttggactcatttcaacaaaactctaaatttaacttaatcaacatttactgtgaatgataaggatcatgggcagaaagcttctgagaactgctttgatataaaggccagaaaggttggtgtttgacactggttacaaaggcatgaccttactctgggaattctttagtactcattagagaggcattttcatgactcagatttagcatccacttagcattcatagtgagctgagacctttaatggaaaatataaacaaccattctcccctgcttttatggagttttataggctaccctgtgtttctgtcaagtgcctaataaagacaagaagaacttgttctaaattgctattgtaacaatgttcttactgggattttgttactaggaagtttaagaagtactttgccaataaattcaaatatacctaataagtttacttcttaaattatctaattcaataaagattacttcatcttgagacatatgccttcctggaatccccataatgctaatgacccctcattcatcgtctttaatttcttatgagaaacatattacattttcttcttagaaatctttatcctgatcagagagtcaattaaagagtgattaatcttatttcaaggtaggaaaatttctcaatttgaattgcagttgtagttctactttcaaattctttagtatatgaaaggggacatagcttacataagcctcattatcaacactgccattttacaatgatgtctgcatttaccttagtaacatggactgaaaaaaattcatatattctctttctttctctatttgtttaatgcaaatctcagtgtttcttttccccaaaaatatttatattcattgaataaaaagtggctgaggtttcttaactaaatttataaatatctttattctctgaatttggctttctattactatattagtattcttaaactgttttgcttacaatccttcctaaattccattgtgacagttctcagacattggtattcttttgaagccctatttcttttgtatagatagaaaaatagctagaaaacaaggttaaagcctctttccacctacaagctttgaaataacaatctgaaagtgtcacacaacatctggctggtggcttcctctttttagttatattaatatagaccatgcaaattgatgctatagtattaaataacagaacctgaattctggttttgttgcaccttttca

SEQ ID NO: 56821 - DNA, 807 bp, Bovine  19866880984357
tgacgagaatttctgtgatgctgccaaaatgttcatggacagaggagcctggcaggctacaatccctacagttgcagagtcagacacgactgagcaactaaccttgcattctttccattggcaaatgtacaccataaaattggaggctactgcattctgagtgtctgagtcaggatagtggagaacagagcctgccaagctggcttgtgataaaactcacttgcatttatcataacagaaaatttgttgaggtttccttaactagctctcagctgtctaggtgctgcttttttggtggattagcttccgcaagacagggtgcttcaaaagacagaagagctagaaatagtctatggtatagccacaacatactctgtcccaagagtggtggcaaagggactccagtcccacccaatttcctaaacctgtgtgcattgcaacttaaaaatccacaccaatctgaaagcatatggatgccatttatttcatttcctttgcagaagagtactttaggaaacacttctcactttccccacccctctgtcttatcatttgaaggctacagaggaattaaattcatcttgaaagagtgtttatgaattagattgtgaccattacttaaatgattaaatactcaagagagataatgcaacccagagaccatgtcacaagagggaactgtggttatcgtcaattactgttcattttctataaacatggctatgagccaactttggaggggaaatgtgcagttggtaaatgacgtatttggtatctccatctgtttctttccttactcctttagca

SEQ ID NO: 56822 - DNA, 1286 bp, Bovine  19866881003315
cggatactggcacccatgagagctcattccttccttccaagctaggttttgcagaatattactcctggggaagctacttaatgggtcttcccattttctatagaatttttctcccttaaagaattgcccacttaaatatatagtcatttaaatttagtcaatgaagatggagtgtcaggtcccattggtcactgtctgtgaagctggaaaattatcacaaaataatggaagtatatacaaagagaaaagggaacttgctaagtaaagacaacagatgaacattgtcataaaataacactgactctttttttggaactatagattaagatgtccccaacaggctgttttaaagtgccttcgcattctgagaaaaggtcacagttgtgatggatgtggttgctcctttcttttgtcatggtaaattaacagacttcattaggtgaagtgtgataaataatgaagcaatagaaaacagttgatctagatctagagaagcaaggagaagtttcaattctagcattgaaatcatgtttattagccacatacatgatcttggacaaatttctcagtttctttaagtctcagattcagcactataaaatactaactctcaatctcaagtgttttggtgaaactgaagaagatataaatcctacatatgctttaaagaaacaattacaaagttcaccatgatttgctgattaaagtaggaatattttaatttatttgtattttgtgctttacagacaatttatccatttctctcaacaccacagtgaactaagccaaggaacattacatgacttgcctgaggtcagaaaacaaataccaagctgagcctgaactcctcttgtctgcctgattctcaagtgcaacttctgtagtctcttcaatatatcatgtctgtagttgtctaacttttaaaacgcctccattgattttgctttcgcaaatcgttcacattataatgtagactgtaagggccacaggttgaagtgcaggatgaggagtgaaggcagaatcttggaaccagaaagcactgtcaaagtcatctaggtgaactctttgccttatgtaaagctcaccaaactattccagacacattgtcagggatggaattaacagctctgctaactcctctgctgcctagccatgcttgctacccccagagttcctccttacatcatttgaattctctccaactgcaatttatgcccctctcctcttattgtggcctcatcagagagggagaacagatggtcaccatcctcatataatcatactgg

SEQ ID NO: 56823 - DNA, 1693 bp, Bovine  19866881089006
ttctgtatgtttgaaaatgaaagtgttagtggctcagttgtgtccgactctctgcaaccccattgactgtagccccccaggctcttctgtccatggaattctccaggcaagaatactggagtgtgtagccatttccttctccaggggatcttcctgatccaggaatcaaaccctgggctcttgcattataggcagattctttgctgtctgagccaccagagaagccctctgaaacaccaggatagtttaactgtatgtaaacaaaatgttccagttcattcaatgtttcctctgcactgtattttccacttctttatattcatttgattaaactttgtgaaatttcaaattgaactgaatgtcatcaaattaaggaattatggttctttttaatttgtgtgtagtttttacctgcactgcccatgggtacacagagatatctgtcactgagcgcaaaacttgaaaaggcattcacatatgtttgcttgatgctatgacaataggcactgaggatttaaaagtggatggtatttatttcactagactgcaaatcttataacaacctacagtgtatatgttacaaatgatttgtggaaatatgatcatttgcaaataggcacattaatctgcaaatggccacatcaacccagaaccagttaaggctcttgaaaaccattaagactattagttttgtccagagataagcaaaataaacaaattcttgctgaactggaatcagtcttgctgcctttcaaaaccctctaaaggatgatgaagcccaaagctttcactgatgttttcttttattgttttgcttactctgctctttccaaatcagaggaacttaacattcgaatcactaagtaagctttgcagagaccttcactcctctggatgacttagaaaaaacaataataacaataataaaagcttaaaagattcttgagatttgggctgtgatcatttggctttgtgcaaaaagataagataaattttatctggaggcatagctggaggcaatttagattaaaacaaattcagaataaaagtaactacattatttacctttcgataagctttattttacagatttgagcacatctgagaggctcgatctgcttccagtaaaataaaagtcaaaatatatctaataagaacctttgactttgctttgaattgaaagactcacacagttgaaggagaggagaatccaactagggaagactggtgtctgtatttccctttatatacagcttgctaaattttagtctttttgacctgtttgttttaaaaaaacaaacatgtgataggagtatgttgcaaattaaaaactgatttgaaagaagtttacaagctaaaaggagaacttgtatttgataggtttaaagaatttaatccgatgtagcatataagcccccctccttaattattcatgacattctcctgcttgattctacagatctaccctgctgctgctaagtggcttcagtcacgtctgactctgtgcgacccgatagacagcagcccaccaggctcccccgtccctgggattctccaggcaagaacactggagtgggttgcaatttccttctccaatgcatgaaagtgaaaagtgaaagggaagttgctcagttgtgtctgactcttcacgaccccatggactgcaacccaccaggctcctccatccatggga

SEQ ID NO: 56824 - DNA, 824 bp, Bovine  19866881132823
tattggggcttcaactttagcatcagtctttctagtgaatattcagagttgatttcctttaggattgagtggttgggtctccttgcaggccaaggaactctcaagagacttctccagcactatagtttgaaaacataatagaaaaatagtgaaataatttaatttacttaagactggcagtgaaatcataataggagtctagggttatttagacaaattcttataacattattttgttttccaacatgtatatggtgtcctttactttaagaaaatttccacttgaggatttcagagatctacttgataggtctatctgatacataaacatatatatatatttcttacatggacatatttgtgatatatgcatatattattatatttgtgcgttttatctcatatctttttattaatttatagtgataatttgtcatatctaatattaaattttacacagatacataatatgccagtatagatattttatttttcttcaattcttatctttatttatggttattcgttaaaacttattaaccctctctactcagataaggaatgtgaaaaaaaatactcacagcatttaaaaaccttacaaaagaacctctccactttaatcacatacgagatggattcataaattgaaacctgcttaattggcaattaaaagctgtaggacaatgttgtctctctgtatttgcagaattaagttccagctgttttgaaaaagcaaccagaagattgagagaaactgccaagtatccggagagaaactgggaagaagagccgcattagcttctgtattctaaagtcatgcatta

SEQ ID NO: 56825 - DNA, 2551 bp, Bovine  19866881139990
ctgtggattttgatatctgcggggtgtcttggtatcaatccctgaagatatcaagggagatctggatatgtaatatccagaagaaaaacttgagaacaagaaaaagacatttcatactctaagtaagtgctgaatagttaatagataagaagtaatcactaatttttaaaaatgagactaggtgcacaccagaggatactgggtctatacatcacagatcactttggttgtttcactgacaaggaagtgatttttgtaactgacttgaattgttaagctaagcatttatcaaaagtacaggcataaagtatagatcaatagttgtaaacagcaggggtttgaactgtaatataagcaagaacttacaacaatcagatgtatccaaatcctggttgtatctagggagttaatgaaccaaagctcttacaggtatgcaagatagagtagatgaccttttgataggaacattacagatccacaattgggcaggctatttagctgtctcatatgtaaatagcctttaaagcagagagtctaggaaatcattaattccgttactcatccaatctttcttgagaatctgtatattcattcatgtgataagtactaggcaaattgtggctctttttagacaatcacaatatcatatctgtaaatatagtaactggtgacacttaagatttttctcactcttttgtgcatacattataagtcgcattctcaaacacctactaaaaaaagaaattattgcatattgttactttttagtagaattggatgggagggggaaaatttcaaagaaaataagtgtgactagttcaaaataggaagagaactacaaatccttaaagaaatggactctacaatccttaaagaaatgaaaaaaagaaagttcccttattaagaatacaacatccataaccacattctgctgccaaacacatgtgtacatgtgcagaagggcacaaaagcactctaacctgggccatgtgtaggatttacacggcaatctaacacaggggcccatctgcttgtgaacaatgaggtcatcctgctgtgtttttccggcactttattgactgtgtaatggcgtttgatatcgctaagacatggctgttctagaagcactggtgcattacagcagagaggtgcattgtgtgtgatgagtcatgctcaacaaatttgtggtcggtctctacacagtgaggaaaaacaagaacaagatccagtaacagagacctgggaagcaagaaagttctcatcacaggcacaagggcacctccgttttgtgtaagatggagaaggcttaagtacactaagttttccacagagttccagtaatcttcaatagttcaagtcctggatcaaatgttagtctaataatacttccaccggagaaaaggcactttcatctgtgagtcactttgcagaagggataacttctaaacattggttaccatgaggtttggatgcctgccagaaaggaagttcaagaaataacatgaccaaggcaaagagttcgatgagaaaccttcagaatttttggagggaggagaggaaaaacaatctgaaacttgagtagatccagaaaattagttcatttatgtaacccctggtgattggcaagaattttctggctttcacaagccaatcctcaaatcagaaaatggacgcatctcaagggaaatgaatccttagaaggaaaagtatgtgttcctcctcaccactccatgctttttaaagagaaaaaccatagcctgctaccagaattgtagcttgacaaagtaaacactccctcaaaactcccttctttctctagggtgagatgcaagcatctttctaccacacctgtgaaacctccacagtctggctccagcccacttcctacattgctttcctgccatcgttgctttccatgtccccataccccagccccactccactctgcacagagctccaaggagccttcatcacatttcagcctttggcacatgttttcctctaaccagcatctctacccttacgcgcttgacaaaattccgctcttctctcaaaatacagctcaaatgttcttttttatggaaggacttccctgggcagtcccaattcaccccactttatgaccgattctcccactcatcatttaataaaatcaaggtgctctttgcacttgctctgtaccaggaacaattgtaaaagagatttttataaattaactcagtgaaacctcacaataaccgcatggagtaactacgaatattatctccactttacagtggaggggggcttcccttgtggctcagctggtaaagaatccgcctgcaatgtgggagacctgggtttgatccctgggttgggaaggtcccctggaaaagagaaaggctacacactccagtattctgtcctggagaattccatggaccatatagtccatggggtcgcaaagagttggacacaactgagtgactttcacttgcttgcttgctttacaggtgaggagagtgatgcacaggagaataaagatctgtccacaatcataccacatatacaa

SEQ ID NO: 56826 - DNA, 1712 bp, Bovine  19866881142178
gaagctctgtgaaggtgacctttggagccggagtgggactaattagcctatttacatgaaacccatgatggagcatgatatttaatcacatcgttttggcaaataattagaagataaatcactcaaacaatggtgctactgtatttgaaaaacacagcacaaatactgttgacagcatttacaactgcacccattcatttaatttttcatttaacagaaaagaaagcagaaggcagatttgtgcaccagccaatctagtcttcaaattctggcaagggttgagcttgggcacacaccaatcttgcatgaaataggactctgcttctcatttatagtgaacattgaaaagttataaaatgtaatatgtggtttggggtcttttcttgttaactgacggtaaatactagcctttgggttatgtgggaaataccaatacatgtttacggtctgcaaagggttgcccagaaattgctgtggaggcagtctcttcagattttgcaaccccctctgagttgtttaaatgttaagaacaagcctctttatgaatgcttttattctgaaacatttatctttgaatgaaagcaaaataaaatactagggaaatggttttaagtacatgtatgctgttcttgaatgccctgtccatccgtatttacaaaagattagaagaatcagaaatttaatttttaattaaaagttaatgagcttaaaagctaaggagtttaaattacggtatatgacacatatactttcataatggcaagatcatttcacagtttatttcaagccaaaattaggccagatctagtctgtatttttggctttcaagtcaaatcacataaatgtacgtgtatacacatacacacacacacatatgaatttgtgtgtgcctgtcaatgagcttttttctcaaaattggttttgtaaggagtcaagtgatacgataggtgtgtgaaaaggcatgtgatttgatctggctgctgagtgaagccttgaagtattgctctatgttattaaataagcaagaaattcatcatcagcaatttgcatggctacattggttctaacttaaaatggttccagggaaggataaaattatactttttcttactgattataatttatattgtggagatctggaatacctggctcatttctttaatatgtatcccttgggatactgctttcttaaagagcaattttcttcccatgatttttacaagttaactatgaaccatgttacatcatgtttgcccaaggaatttaatgatttcttcacatagccttatacctcaaaggattataaatacttaaatgattaaatctaaaacttacttttcctggtatgattaaactagcatgatttctttaggattccaaatataggtgataaagctgaaactggaaatggaaactgagtctcagaaagactcagcaacttgcccaggggacatagtatgtagcaaaataattttctgaacatggatttgaattcatttcttccatgtactgtgtaggttctaggtttggaaaagttcagagacttactatcatggtccttatgtaattactagaacattctggaggtccagttctctctccctaaatatctctccaaacttagagacatattcacacacaaaatatcaccccagtttcacccctacccttggaagattgaaacgcatgtctaggacatagcaggacaagag

SEQ ID NO: 56827 - DNA, 2085 bp, Bovine  19866881175455
agaaatcaagaaaacaatcccatttataattaaatcaaaatgaataaaatacataggaataaattttaacaaagatgtcaaggtctatatgtgaaaactataaaacacttattaaaactgaagtgaaagtgaaagttgctcagttgtgtctgactctttgcgaccccatggactgtacatggaattctccaggctagaatattggaatgggtagtctttctcttctccaggggatcttcccaacccagggattgaaggaggcaccaataaatggacagatatatcatgtttgtggattggaagaattaatattattaaaatgtctatgttacctaaaccaatctatggattatatgcagtttctctgaaaattctaatggcatttttcacagaaatagaataatcttaaaattagtatggaatgacaaaagatgtcaaatatcaaaagcaatcttgagaaagaagaacaaaggtagaagcatcatgattgctgatttcaaactatattacaaagctacagtaatcaaagcaatatgttattggcataaaaagctataaataatcataaataccaacagaacagaatcaagaaataaatcttcacatatgcagttaactaatatttaacaaggaagccaagaatactcactaaggaaagaatagtttctttaataaatgttgctaggaaaaatgtatacacacatgcagaagaatgaaattactaatagatccccacttacacaactcacaaagatttagttggaatggattataggtataaacataagacctgaagccataaaattcttagaataaaacatagagaagaagccctttaacatttgtcttggcaattttggttatgataacaaaacaaagcaactaaagccaaaattaaaaagtagaactacagcaaattaaagtgcttctacagaacaaagggaacaatcagcaaaatgaaaatgtaacctacaaaatgagagaagatatttttaaattgtctatgtaataagggatcaatgcctccaaatgtatgtatacataatggactcatagaactcagtagctaaagaagcaaagtaatgctattaaaaaaaatgacagaggaactgcatagacatttactcagggaaaacatgcaaatggccaacaggtacatgatgaggtgtccaaaagtactgatcatcaaggaaatacaagtcaaaatcacaatgaaatattacctaatacctgtaagagtggcaatcatcaaaaacacaagaaaaaccaagtgttgttgaggatgtgaaaaaaagaaacctatgtgcattgttgatgggaatgtaaattggtagagccactactgaaaacattatgggaggctcctcaaaaaattaaaagtagaactagcatataatccagtaatctcatttcctggtatatatctaaagaaaatgaaaataaaaacagggtatcctaaaatttatatgctaattataccaaaattaaactgaaatttaaaaaataaatggagcactttataaactaaatggtactttcactttcctttggacatctgagaatatctctgattattacaaagtaaaaccatttttgtgtgtagatcaaagtttcttctattcctactcctccttctcctcctcttctttctctttttcttcttcttcctcatcccctgccccatgccttcctctttttcctcttctttgatgatgtatgtacctttctgtcctatgccaaaaataaagaaacaaacaaaaactcttctatctcaaccagaggttaaaaaaaatcatatctaagcaacttatcttaacaatcagcaggacatttgtttgaaaattttacatatggtgaaatgaatgaaagttcctggaactttgtaaggtgtgactcagattcagggaaaaatatttaaataactagtaaactacttatcttgctaggcatgaagtatttcacaaacacacacagaaaaacaaacaaataaaaacaaaacaaaaaacttttaatattaccattctaatatcataactatgtgcacaattagattttatttcatcattctagaatttgctttctggg

SEQ ID NO: 56828 - DNA, 1148 bp, Bovine  19866881201796
atgacagaatcccaaaaggcattattctcaagagggaggatttatcgtattgaagtaggacaaaatacggattagaattcagtgctcaagtaaaaaaagcttcaagggtcacattaatctgaagtttgatctgagataactccttccactgcagagatgatgcctagtgctttgcaaaataagggtggttgatggataatatctaagcttccatttaaatctatttttaagctctatgttcatctttgtagtaatctttgattattaggtattctttattctgaaaacaatagtttggtctttcataggataagttaaacaggtatttcttcccatggagatattaaatcataggacaaataaaaggggtcttggaacaataatatttcatattaaaaagcaaaagcacaaaccatgcaagcaggcatatttgcaagcattattcagtgtgtatttgtatattattaaatatttccctcaattccacaaaatctggaaaagaaaactataaagaaaccaaagcattctttattacctggcaaaacttaatcaaatacccctctggaaaagtggttcatcagtctcttaagaatattatagcaattgtctttgaagttgccagctcctcctcgatagctggcaaaagagacaagataatacttcatttaagcacaatctttattgtattatcaaccgcaggccctgtgacctgtgcaccaggaagcagttccccctggctcaccaagaaaggcaagagaaagtgcttggaaccgtagtgataaatgggaacaattcaactgctcaggaatttgaacctgctatttagtgagatctacacaagaaagttgttactgcttaattgctaagtcctgtctgactctttggaacccggtgaactatagcctgccaggaatttttcagaatattggagtgtgttgccatttccttctccaggggatcttcctgacccaggggttgaacccctgacttgtgcaagtctcctgcattgcaggcaggttctctaccactgagccacttgggaagcccaagaaagattgaaggcgaaaggaaaagacagcaacagaggatgagatgttcagatggcatcatccacggaatggacatgaatttgagcaaactctgggaga

SEQ ID NO: 56829 - DNA, 536 bp, Bovine  19866881245620
cagtggggaaaaaatatccagaactccctgaaataaagaaagccttctggttacaacgtgcgttgctagggatttatttttccccctcctttcctaagagagtaaaatcgcacagatatattgaagctcttggagttttgtgagcgaagtgtgtactcaagacgtcaactgagcacggtgttaagtgcgtgactacaaagaaagggttaaacggaagggggtgggtcggagatggggaaggctggcgaaaaggttcacaagcaccattttccaacttacaaaaactttgaacttttaagcacccaaaaataaacatgtgtgtgtctgtgagctcaggcagatttatttcggtatttttttttttttttaaatcataatgtctctgtttctctctcagtgctttaaacactgagcagtcccccctaggatcgcgtggcaaaagctgcagcaaggaatcggctgcgctgtttacgagcagcgttcaaagcagctctcttgtcctccacccactaccaacgaccgtcttcgagcctggg

SEQ ID NO: 56830 - DNA, 1648 bp, Bovine  19866881246284
gagcagtagtgccttgaggagctggggaaatgctacaaacacaagggtttacctttccgaacacaccccaagatgatgtggctttggaggagtccggcagccaagaagggcaggcttagccagcattcctgataactatgggattagggtacctgccaactttccaccagcttctgtctccagataaagaccaaaactgttttaccatatataagaaaaaagtccacaagaggaactcttttataatttttttggatttcaacaaaatttgcccaagtgatgtttctgctgtttttcaagttaaaatccaattctcacacttgaaacttttgcttagagctataaaatacatttggaaaacaatgttaatataatattaatatggaggaaaattgctatttattagggttaaagaaactttgtgtggatcattttattgccttgttaagaaaaaccttaaaactttgacaatatgtttacttcaacacttatgtattttcaatgttgatgattctgtaaactgaatatgggaagtttctgatttatagattgactaatttggtatagattgaagaaacagattttaaaaagtgaacatcaccctgcatattcactgaattcttaagttcttacttaaaatgacttaagcaatttttttttttttttttttgcttttcaatgatagtttaatgctaatttttgtgatcttctcaaatgcagtttggaaatccccttgatcacagctatgactaatttatttttaattgcatgctgacattgcttaacttcctctacattttggcagttttctccattcttttcagcaagattcagcaagattatttcagcaatcttttcatgagaaaaaaatatttactccaaagtgaaaacaggtttctttgtgggtgtcctaatatatttgtcactttccagttctagaatattttggcattgaaagtgtctatctgacctttatagaagtttctgagagttattatgttttaatattatttctaagatcaagttaaatttatttaaaatgttgatttctgcaaatactaatataaggagacagcatcaagtttaactgaaaatacatatttagattgtgaatgtatttatgcaggttgatgaagctaggatgcaaagggacaaatgagactgtgaaggaatatgtaggttagatattaagaattccatttttgaaaatgaggagattcaaactcagagagtttatgtgatatgtccaaggtgagagagcaacaaaacctaatgtttgcatccaacactcatgcttgttctactattccatgttgacttgttactttttggcatttctgaatgaattccatccacaaggggaaaaaatttgaaatggaataatgatgaaagatttctgtggctttgagacaatgaacaaaccaggcattagtcagtcattttcctacctcctcccacccatcttttaaaatttggtcaaagaccaaatttattttttgtttgttccagtaatcttgcagattgttctagggggaaaaaaggacaagtggaatgtaaatagaacatttgattcttgatctgatcaagaggcaatgtacggtatagagaaagaggaaaactacacacataaaataaggaaaatattttt

SEQ ID NO: 56831 - DNA, 1061 bp, Bovine  19866881313573
accctatggactataacttgccaggttcctctatccatggggattcatcaggaaagaatactggagtgagttgccatgccctccgtcaggggctcttcctgacccagggatcaaatctgcatctcttatctctcctgcattggcaggcaggttcttaccactagtgccacctgggaagcccacacacatatataatacatatacataattatgtatgaaagtatattatataatcatctgcatatatacataatcatatatgtatataaatatattcataaaattcatggaccttaacattttgaaaaacttagcacacaactaattcttaaatgtattcaaattattattcaagtgattatgcagttcatctagaaagtagtagttacaccataccttataattaataccagactgcctacacagaataaaattaactaagtttgtactctgactaattttcctttcagcactgtcactaagaaatttaaataacttcaacagtaggttttgtaatactcttctactataaggagttggtggaagcatctagttagtctttgaggcagtttcactgagcttgtggaaatcaatgtaaatatccccaaatactattgtaagtgcataaaacaaaaggcattgctatactgtgacaatgatagatttgtttctgtaattcattgaattattttgatgagaacattattattttgtaagccctcttcacattactataagatgggcaatttttttttaaattattagatcacatgaaatcagtggtgaatggtggacagtaacataattattgatatacagagtttatgcactgagcatctgagaggttctataaattacaagctgtgagatcttttaataaaatacctaattttttgtaataggctgttacccaaaatatcagttcctaactattggaaactgtaattgttacccaataaggaaaaaaagtatcttacagatgctattaagtatcttaagacaggatatccggattttccctttgggcagtaatcataagatcctttctgtaaaagaggcag

SEQ ID NO: 56832 - DNA, 2173 bp, Bovine  19866881379026
ttgggagaaatatcataacctcgatatgcagatgacaccacccttatggcagaaagcaaagaggaactaaagaatcttttgatgagtgtgaaagaggagagtaaaaaagctggcttaaaattcagcattcagaaaactaaaatcatggcatgcagtcccatcacttcatggcaaatagatggagagaaaatggaaacagtgacagattttatttacttgggctccaaaatcactgcagatggtgactgtaaccacgaaattaaaaaatgcatattccttgggaaaaaaagttatgaccaacctagagagcatgttacaaataagagatattactttgccaacaaaggtccatctagttaaagctatggtttttccagtagtcatgtatggatgtgatagttggactctaaagaaagctgagcactgaagatgcttttgaactatggagttgaagaaagctcttgagagtcccttggactgtaaggagatccaaccagtccatcctaaaggtaatcagtcctgaatattcattggaagaactgatgctgaagctgaaactccaatactttggccacctgatgcgaagaactgactcacttgaaaggaccctgaggctgggaaagattgaaggtgggaggagaaagggacggcagaggatgagatgattggatggcatcaccaacttgatggacatctgtttgaataaactccagaaattagtgatggacagggaatcctggagtgctgcagtccatggggtcgcaaagagttggacacgactgagagactgaactgaactgaacaaatattagcttccttccctctccttctaagggtaagattaatcataggaacgatacttctgttccactggtggaatccaaggcatcgctagttgggagagttgaaactccactgtcagccaatacagtatgtcctcaacacacaaacaggttctgctccgagagcacattcctaagtccacatctttcattaagtccaacaaagttcacctactaacaaaatctgccatttggtactgtactataataggtttataatattgtacttttcatacaaataatatataaaagcaaacagaaaaaagaaaacattaaactatagtaccttgaaagtacagtagtaccagttacatcaccactgcttttatgcttgtttctggacatcctgggcttgaaatagagatgctgtactctatatagtacagtatacaaaagcacaaccatttataaaggatgcatgcatctgacactttactctggacacctgaattaacttacgtgattagacatgtgaactcatgctcatatctttgaacgtctgcaccttgaagagtcatatgtaggggacttactgaatagtctggagagtggactgaccacaataaagtgagcaaaagaaagttagggaactctattatctttcttaactaatttctagaaaatgatctgttttattcctcaggcatatagcatgaacatgacttttcgtttttcataactcctagaaaagcctagtggttccagtgggaaccatcaagcggaattaaattgttatgtttcccagagttagaaaaaaatgaaggaaaaagtatatagaaaggtctatttcatgtaattctgccattacactattttcaaacaatcacttaagctctcattagtatagcctgggaatagatttctttcattctgacattgcctgagcctaaccctcaggttagacaccattgattttaacttccattgctctgtaaaacacatctgggtccttaattaataattcgctatgttagagacaaatttgctattgcatgaacatgcctgattgaaaacacagacataatgctcataaaatgttgaaaaaaaaagtaattgcaagtgagattataaattactcttggctaaaagcaaaaagcaagtatttatctttggagatggaattagcctttttttgttgttgttgttatctgatcaatgcttattaatcttcccagcctgactctctagttggttagggaagttaaaaggagaccctactttgttcacacaatctgttccacatttctacctttcttttctgtctgaaattcttataagtatcactattgtttaacacactaaggttgaatctatacagcaagccagttcaa

SEQ ID NO: 56833 - DNA, 797 bp, Bovine  19866881388842
atagcctatctttctctatgtattcacttgttgaggattcctacacaaagatctgggtgatgtttctcaaagattctagaccatgtgctgtgactcaggcaaagtttatttatattttatatgaattctgctaacttcataatccctataaatttctttattttatgggccttcttaaaaatgtaatattttagtgtaatattatctaacatggccacagaagagcagaaaggcatctagcattgtcctgtctaccatctggtcccactaaacatactgagtggcaaggaactatgagaacccaaatgtctacctcattgaccaactgccatgatcttgaagattagatgtaaaatgggtgaaatatttaaatagcaatctatattaatagcagaacatattgaaattgcatcccttgctaattgactactgacggaagtaaccatttggctcctattgagcaaatgctgtaaactgtctgctgcaatgaaatacaaatgtggtgtattggtttctataacttcttccactgtaaaattaaccttccatcctatctttcatttataaggtggaaactcattactttgaaaaattcaatggaaacatacaaacctctttgggaattacttgactcttaaaaactaaaccaaaatacacaggtaataaaagaaagtcttgttgctgtagaaaaattgcttgaataagaattttggtgtattattgtttttcagcaaaccaattatagaggctaaaattggaacctaagtgaatagctatttcatgttgctgaaagtgaa

SEQ ID NO: 56834 - DNA, 1088 bp, Bovine  19866881613513
cttgcctggagaatcccagggatgggggaggctggtgggctgcggtctatggagttgcacagagtcggacatgactgaagtgacttagcaactatagtactgaaatcttagtgatttcaaacatgtatttattgtcttgcagtttctgtaggttacctagcttgccttagaagggtcttctgttttgggttctcacaaactgaattcagtgtggtagctaggactgcagtgtcatctgagtttgactggggcatgatttgcttcctcaggctcacatagttgttggcaatattcagttcctggcaggtagttggactgagggccagaagtctccatcagtttctagccatgtgagacttccccaaacagtgacttactccttaaagttggcaaaagacagagtgtcagaagaatgggtttataacttacaggacataatcacctacacataatcacatacatctcctcactgttgccagagtctgttggttagaaacaagttacaggccatgcgtctactcaacggaaggggattatgcaggagtatgacaactagaaggtggggatcaccatggtcacccagagtctcctcatatagtttttctaccaagttttctgaaaggaaactagtttgaaactagcatctccagttcaatgggcatgaacttgggtgacctctggaagatggtgagggacagggaggactggcattctacaaccaatgggtttgcaaacagtaggacacaactcagctactgaacaacaacagcatagcttttatcagaaagcacatgcttataataagagtaagatgaagttttaaaatctggtcaatgagaatttgatacatggctcatttgagttgagagtagggagctgtgtgtgaggctaagtttgctgtacagaatatgtctactttccttccacactccttacggtatgagggcacattattaaaatatttatacaacttacataactgcatctagaaattatgtatttgatgtaatctattcagccacattttatttttactctttcttttaaaagcatttttggcaacatgagctcacctgccttgcaaactt

SEQ ID NO: 56835 - DNA, 1104 bp, Bovine  19866881633361
atttttttcccgcacgtctagagaaagatccctccaattgtttaaagctttatttttgaccacaggccaagaaaaatgcttttctcaacttccctcatttatcatttttgtactggatcttcaaacaaatacccttatttctcctgtgatattaacttatttatagtaatgacaatatttatgtagtggcatcacccatgaacaccatagaatgtatgcataatattgatagagtgctaaatctcataatctcagtaccaatccttccctgacatgcggtcttgactagtaaataaaggagccactggaaagcctactagcatttagtggcaaggcctcagcaataggtttgcaggcaaagggggctctgtgtgtgtgttttgaaatctttgactaataagctatttatggagcaggatatgtaagaacagctttgtaaagctacttaagttaccctcagatcagagtctttttactctttttctaactgctttatagaactgagttttttcaaaagcacttgacagagacattcctctttttggccctataacttactgcggatatagagatgtgagtatcttggaatacgcctaagcgaatgcaatgggagtgattaaaagtttgggaagtagttcataaaggaaaaccagggaagtcaaagacaactgaagaggaaaggatgcttaataaatcttcatgttcttacagatatggtgtactgatggaaactgtgaatatatttccttttttctcattgacaagggaaaaatagtcatgcggaagctgaagaatgaagaaatgatatcagaaaaaatatatatttatatacatcatgtatatatatataatgtatattttataaatataaaatacataagaaaagatatagaatcgctctctaaagtattttttaaacatgataatttacaaaatttaattatgtgagagttggactataaagatggagaaggcaatggcaccccactccagtactcttgcctggaaaatcccacggacgaaggagcctggtgggccgcagtccatggggtcactaagagttgacatgactgagcgacttcactttcacttttcactttcatg

SEQ ID NO: 56836 - DNA, 741 bp, Bovine  19866881791625
ccttgcttttactgaaaccaacaaatggcataacatttgtcagaaaatgggatattttatccattaaagacataagtaggaaggagtcaaagaaacccatgaggagcagtttgtcggttctataccaaggtatataagccagtttgtacaatgaggcaatctgttctttctacacagagcatgtgaattattaatgaccctttcgacatttcatttctttgtagcagtcaagtaggtcttccttgtcacatgcttttgttggctataaaatgaaatgcatttctcctactgaggacacataagagaaaatcagaggttaaaatgttgtttaaagtctatagcaaggcaccatatgtttcaagcaaaattcagacagcaaatcttacctatagtaatcatctgtgggcacaattggaaagattcttcacagtaaaactccaaagtgtatgaaagataatttttttgacatttgtttcctttttcctacacatttcagggatttttttttctccacattttttaattaactttattgttctttgcttcttcaagatttcttaactagcagtggtcatgaaggtaaattgcattgttggggaaattaggcatggtgcctcccacctctctcagccttatttctgatgcttgggtagcttttcttctgtgtatactaactgtcagttctcttgtgtcctgtgcctgctcctgtctgcttggaaaatgcataagaaaatagatggt

SEQ ID NO: 56837 - DNA, 692 bp, Bovine  19866882081364
attctagcacttgaaaagctttatagtttcttgatcttacagctgagagagatctcaatgacaaattcaaatatttcattttgcagaagaaagaattgaaatccctaaagatggggtgacttgactagatcccagctttatcttttgagatgcataattaaattatttaaaatgtgtaggttattgtcaaatgtattaaatttactgctttttctgtttctttcttctggcattatttatgaaatttactgtgtaaaaatgctttggcttcattatacctacatatattaatgcatctgaaggaaattttatattcaggtctattagtgcacaatgtaaattgaaaacagactctaaatggcccactgctaaattttttacaaacacgataggcccagtggaagcaggcagctgcactgacattctttctagggcaaaggaaaaaacaacactaagaaaaaatatcctggtttggtgttcctccattgccagatttattgacctgcaagagaagtcagtagctgttttgccccagtcaatattaatttctagggtcaataaatcctggtaatgaatggagaatgtgagtcaataaatgctcattagatgtgctcacaaaatgtgccacatataaaagaaaataataatcaatcaaccttatcaatgtttaaatattatttctgacacctttt

SEQ ID NO: 56838 - DNA, 2112 bp, Bovine  19866880352956
tcacatcaggtggccaaagtattggagtttcagcttcaacatcagtccttccaatgaacacccaggactgatctcctttaggatggattggttggatctccttgcagtccaagggactctcaagagtcttctccaacaccacagttcaaaagcatcaattctttggtgctcagctttctttatagtccaactcgcacatccatacatgactactggtaaaaccatagccttgactagatggacctttgttgacaaagtaatgtctctgcttttgaatatgctgtctaggttggtcataaatttccttccaatgagtaagcgtcttttaatttcatggctgcaatccccatctgcagtgattttggagcccccaaaaataaagtcagccactatccatttcggtttttgtttgtttttggcttcccctcgcagcacacagaacttccctgagcaggggtcaaacctgtaccccctgcattggaagcacagagtcttaaccatgagactgcaagtgttaagaagtcccattatgttcattttgtagatgcagacactgaggcctcgatacttgtgtgcccagtgtcatgtaggcaggaagcggagaaaccagacttggtatttgaggatgtttgactatatgcttttgttcttaatgcctgggtatcctgcctgagctgaaaaactcccctcaggaagtcttgctgaactccaaatgatggggagccctggggttctggtcaccctgtactttttaggggtaaagacctctagacatgcagggtagagtcaagagggccttggggcagccaggctgagccagaagaatcagatggtgaaatattccccatgccctgggcttcctgggtcagccgcccagaaaggccatgtctgtggtgtactgccctctttcttgacttgctccacagccaaaaatctcaggaaagagagccagaaagggcgggattcaccccatcagtttattggtgtgaagactgtcttgttttaagtggagctggctgccccggaaggatgcaccttctctgtctgctagtctgtctctctacttccactctcttctctctttctctttcagcttataataattcctataaaagaacagatagtcagcagcctagggtttttgatgccatattcctggaacagttgatgcaactagattcattcgcctcaaactatctgggatgaaggaacagaggtttttcttggacagtttattgtagaatggtattttgatgctatatatatttttcttaaaatgtattctctagactacatttctggaaaatgaaatggaaagataaaaatacaattccctttataaattattagaataaacgtgttaccattactctgccagactgctgtaaaagtttcaaatgcttgctcttgactgctgtatttaaaaccacagtagaccagtaacggacaacctgcagcttagtcctgctacgcactttgagtagccttggtctagacgactggcggtgggagtgtggccacaggtggcaggtgtgtctcacggtcgacggtttcttcgatggacatggcctaaactttcagtggctgtcattgtcaagtgatggtgaccaggatgatgcacgggagtgtgtaagagctatccctcctcccccgcagtccatgttactgtggcagcaccatgtagaaaggagggtccaggcttgaggctggttgatagacactgcagagctcccataaataattgcctcgaggtttaggctctgggaggaagactcagagtcagtgtcttatctttgtctctgattggcatattggagggttatttggggaggggaatggagggaggccatgggcccactccacacaagcctgcctatcacggacctgagaagcatgatagcatatcagatcttctctccccttaaccttgtcagcctgccttccaactcagacagtgccagcagttgacaagaggaagggaggatgatgggaaattcctctcctggcaacagggaatgtgttacaggggtcccctgagggaaaggagcttgctctagaatcatatctgccaacaccttactcaaccatgcccgagaacaggtccccattcac

SEQ ID NO: 56839 - DNA, 2743 bp, Bovine  19866880424365
ggctgggccccaagggaaagagctgagacctacctttccgttaacaaaaatcttcaaagaatgagtatggaggtatgaagttttttacactttgaagcaaagaccataacaacaatgatgctaataatgctagtcaaagcgcaggctctagcagagcactcactagcatcccccatctgagatcagccccccgttcatttgtattgtcttttcatcttggttctttattgtgtccccttactgcctctcatgcctaaactagtgttatatggctatcaacaaaggaaatgtgttttattatcttaatggtatacaaatttaacagaaagttaggaaatggggaggaggaagtaagcatgttttaccatagatgttggtgggcactggtgtgggctctgagtctccaagagccacagtggaagccaccctgtcactcaggctgcctcgtgctgggagtggacacatgtgagagctggctgcatggatgggaagggaagatcccatgttggagacctcagtcctgcaaggtgctgaatgctgggtctgtggcaataagttgtatttcatgggtgggatggagaggcagctgttttttgtttttgttttgtttttttctcttatctggcagaaaagtcttttgacctaaaggccaaggaccagtgtcaactgcagctgaggctaccagccatgacccccatagagcactcaaaacaaggaaaagccatcaccaaagatgagcagaacttttcagcccttcctcaatccttgatgcaaaaaggcacaggccagttagtgcgcctgaaaaccagaagtaagcagaggaggcctgaccttctggagggggcgctgtgtaggtttacaggacactgggcttctgagtcaggatttctgcaggatcctgagaacccacccctgggctgacccaaccagcccagaagcagaggcgaggacacagcatcctagattagagggggcactggcaggttcatggcagagctctccccagcactccgacacacagacacccactcactcccgctcccttcccccaaggcctcttgctaatgagagcagatttataaggctgctcctgggacagagctgctcagctgtcaacctggcttccccccaggttctcaatggggcctccaatttccagagccaagaggcagggtttgactcactgaacattcgggaactgctgacatggccagatgccgtgcaggattcctgggacatcaggaaggacaggtccagcccctgaggggctcccagctagtggagagtcagacatgtgcgcaaataaccttcagacatgccatagttgacctgcctgccccaggccagacagacatccccaggaggctaaggatgtaggtccaaactccatgaagggccgtctcacacggtaccaagtaagtgggctctgctcagcccttaactgagccccactcacatgtaagcaatttgttcagtaagaaactgggacggtgatacacaaactactacatacaaaccaaataagcaaaggtatattaagggtatatgaagggaaatacagtcactattttgtaatacgttaaatgaagtataatgtataagaatattgaatccctatgttatacacctgaaactaatataatatggtcacccaactatacttcaacttattttttagaccactttttatttcatattgaagtacaaccggttaacaatgttgtgatagtttcaggtggacagcaaagggatatatatacatgtatccaggtggctctggagaaggcagtggcaccccactccagtactcttgcctggaaaatcccatggacagaggagcctggtaggctgcagtccatggggtcgctaagagtcgggcatgactgagcgacttcactttcacttttcactctcatgcattggagaaggaaatggcaacccactccagtattcttgcctggagaatcccagggacagaggaacctagtgggctgccgtctatggggttgcacagagttggacacgactgaagtgacttagcagcagcatgactattagtataatcttgtctcagtgaaagttaaaaatgcaactttaagtcatgagaaaactgaacaaatatatatattaatttagttatcatgagataaattatataatattataaagttttttgaaggctcaattgaattagcactcaaaaatatttatatatctaaattacttcatagaaatacctaccacagtagaatcactctataattttctccattaagcaataagccttgaaaatagttaacaaatatagaaaataatgtgtaagactttataaaatagaaacgcattcatataaattgactcatcataatatttataatattagagatcatacttaatgaacattattcaaacatatttcagcttaagactagcagatgaggctaaggcaatgcttttccaaacagaaatatcaaagtgaaggctgtttcttaaaggccaataattattttgaccctttaagccaaattctaataaataactcttcttagacataactgggatgttaagggaggaagggacggtatctattgtccttaacacacagaacagtgcttgtgcataaaaatgtattatttttacagaaaattcttaacctgagatttttgtactctaaatcattaaaaaatttaatatctttaacagtcaacatatatcttaaaaataattcaaaatttatgtcact

SEQ ID NO: 56840 - DNA, 2160 bp, Bovine  19866880521708
ccccaagggacctggctgcctagcttgctagcccctcccccatccatggtcccctcacctggtaatgtgccagggtgttgagtctcttccagtcattctcaatcttagtggtgatgtcttcatcctgcaggatcatcctcgccccgcttccttgtcgccactctgtagggggaacagttccatctcagacaggcccttgggcccctcccatgggaccctgaggacccctgtgcaggcaagtgcacggcaccacctcagggtgcctccaaagacagacaggtgctcgcagatgctcccagaggaggggtgcagaagcacagggggaccctgattcccaggtctggttctcatcccaacaaactatatgacagacataggaataatgtcacctccactgcccacgtgttcctggtgggtggccacatcggcaagaagtcaatgctgattaaatgaatgaagaaggcagggggcttccctggaggctcagtggtaaagaatcgtcccaccaaagcagaagacacgggtttgactcctgatgtgggaagatctcactctgccgtggaacagctaagtccagtacaccacagctactgagcctgtgccctagagtccagaaactgcaaataccgagcccacatgccacacctactgaagcctgggcatcctaggtgctctgcaacaggagaagtgactgcaaggagaaacctctgcaccgcaactagagaaagcccacatgacaatgaagacccagcacggccaaaaataagtattaaaaaaaaggcacgtgaggacacttaaggacatactaagcaaatgcaaggtggcatcaccagtgtcacgtactctttgcttgactgtgaggtcttggagctaacgagaccaagacggcaaattccaccactaggcaccctcttcctattccaggggtgcgacttggacccaaaagccagcaggtgggccagtcttggcagagagattgagtaaatgtacgtggaggggccagcaaaacctatcctcacacccaagaacagccacaaagtcgatgtggagaacagcatcttggtgatctatccgacacctaattttctttgatgccataggtgtacggttacctcccaccttatcctcatgggtcccagacacctacacacatgggttccctgatggatcccacatgggggaacaggagactgtttctcatctgccaaaccctcaccgccacatgtggtacaaatcacgtggggatggggacacgcacattcctgtcctgaaaagttcgcacatggagacccaggtgcaagccagacacagaccagctctcgtgcacgaatgcatccacatccacacacgcacacatgctcacatgcacacaccagaaaggaaaacggccttctcaattcaagtacaacatgtgtgtctgccaaaaagccaggaatctggtttccaagcagccatgaccccactcagcgcctcacagatgctgagattctgaaacgggtgagagcaccgggtttttgcggcgtgcgggtgggggctggcgtgagttaccctctgtcctggtctaaccccgccttggattttttactgtggctccacagacacacatttcggcttctctcccctgttctctcctgtccagctgagggaacatgactgattccttcctgccttgtgcacttggcatggccagtgctgcagatgagaatccggcccaggaagggagctgcctgccttcagcaggaacagagatgttcctaacagccacgtccatgcctctagctcccgagcttgtctgctgcctggtttagagcttcttgtagcaacaggctgtcccaggaatgaaaacatgagggtgccatgtgggttcactggagcagaggagcctccagaggtctctggggaccagctgtcacttagtgctgttgacggcacggctggactcgatcacggtggtgagggtctgggggcaggtggggtggtatgtaaaagggcagatgccccactggggcacctggtcatcagcattttgtttgtttgttgtcatgttgtctgttgtgggttttttgttttggattttatgcaggtaggtatgagtgcatgttttttgagtggttgcagtggcgtgctgcagtccatggggtcgcaaagagtcagacagga

SEQ ID NO: 56841 - DNA, 3485 bp, Bovine  19866880535308
tatttttttaaatactatattaaaaaaaaattgtggcagagcttccttcaaggtgacaagtggaaaaggcagatgagtcatctccaatccaaggacagtgaacagtcttctctgttctcctctgggcagagggtcctggtggtcacctctgcatatcctctgggtccccacaaaatctatctccatagcccacatagctgggggagtatgactcatgatgacggtagaaaagagagaccctgactccctagattggcagttatcagtgcattcgcctcattctctcccacacaccaccactgcctccatccaagccccacgggactgccagctcctccaggcagggaccatgtgctctgtgatagcttcaggccccaatccagagatttccacacgcaggtgcttgatacacattgaatcaagccggactggattagctgggaaacagtcgctggctgtgctgcgacttggatacaccaatgatggcagcagttcatggaggtggagaggcagtcttctgccaggcaacaaggacagagaaacagactagaaggttgaatcaatagtggggaagtggcctcacttgaggagtgctatcaatccaaaggaaatatcgtgcaacgtaaagtgttgatgggaatttataggttacctctttggccacgtgtagtttagaggtgctgccagctgaattctcaacacgtggtactggccttggagagccatgaggcttaaatcaagtgaatgcaagggctgtggtgcagatctcaaagttcaaaaatccagaaatgttggggagggagggcccacaggaatcatctaataaaccttgcaccttcagaggaagggagcattggcagaaaaggggaggcagatatggagtgaataatgcccgagtcccaggctcctgcctcccacaccagcagcccctccttgctccatcctgctgtataaggaaaagtaatctggaataagacacccatggactgtaatgaagagctcagggatggagtctctggaggcctgcctaggttaaagctaagtggccacctaataccctacagagtccaagccagacttcagaagaaaataaacaggcctgggaaggcccaggtccctcttttctgtccagtgccccgacctggactcctctaactcactgccccgtgccccacacaaacagggaaggaacagagaggaaaacacatgggcacagaggcagaccaagcaagaaggcagaacaggctggaaggaggtcccatagaaatagctcttgcccctggaggacttgcaaaccctgtgaccggtactggggcgaggggtggggaagggagagcaagaaggcatccttgtagtagaatccttacctgcagggcccttcagtccctctttctgcatcaagacggagccccacgttcttcctcagggttcaacccaagggggccgggtagcaggtggaggacacactgccaggaggtgggggaggggtccttatcactgcctgctccagattcagctaccaacctccatcctggttccagcccctcacagcaagcaacatgagccccagcttagggtcaatgggcttgaccacctgcactttcccccagagctctccaggcaagggagcagataggatgccaagctgaaggcaagacccccccaggggactcacggagtctgtaagagatgactgggttcctgctggctggttaccaacacatctgtctactctgtcaactggggtggggggtgggggtgtggcagctgccttttcagcctttcacccattccctccagttctcagaggatgcagtaaataaagcacacagagcagtaaactttagtggacatgtgggttctaatcccagctctactccccaccagctgttgtgaccttgggcgaggaacccaaactctttaactctttgtgtcttcacctgtaaaaggaagcagacacctcctctctcaggctcctggtgagggtaaaggaaaatactgaaatcgatgtgcagatgagccagggcccatgagaagtgtttcatgccctttcttctttagtaaatggccattggaaggcttggcagtactctcaggagcccctttaccaatctaagacatcatgaggaagggaaacgggagcaaatgataacatctggggacaatttacaagccagacactatgctcagtggttcataaggatctcccataactctcttgttatgcaatatgcataacctcagatatgcccccgacaccatcctaatggcagaaagagaagagaaactaaagggcctcttgaaggtgaaagaggagagtgaaaaagctggcttaaatctcagcatttaaaaaacaaagatcatggccactggtcccatcacttcatggcaaatagatggggaaaaaaatgaaaacagtgacagactttattttcttggactccaaaatcactgcagacagcgactgcagccatgaaattaaaagacacttgctccttggaagaaaagctatgacaaacctagacagcatattcaaaagaaaaacattactttgctgacaaaggtcagtataggcaaagctatcgtttttcctgtagtcatgtatggttgtgagagttggaccattaagaaggctgggcactgaagaattgatgcttttggactgtggtgctagagaagactcttgagagtcccttggacagcaaggagatcaaaccagtcagtcctaaaggaaatcaagccttagtattctttggaaagactgatgttgaagctgaagctctaatactttggccacctgatgcaaagagctgattcattggaaaagaccttaatgctgggaaagattaaaggcaggaggagaagtggacgacagaggatgagatgtttggatggcatcaccgactcaatagacatgagtttgagcaaactctgggagatggtgaaggacagggaagcctggtgtgctgcagtccatgggattgcaaagagctcgacacaactgagtgactgaacagcaatgccaacaataactttctggattgtaagtgagggagctatggctgggctctcaaccattagtaagaggaaggcatgaagaaatggtgcccaaggagggaagccaggactgcctgtgggctgctcactgactctagccttgtgcctggactctgcctgagggcagaaggtgcagggctgtgaggcttgctctggtcacttctgtccctctaggagctgaactgagattaagcatgtttgatgatggatatttgttttggaaattacctaatgagctacaagattgttatctggcacccaaatggtattatcataactattacaaattaaattaggccacctttgctaaatcacacaaataataagagtaattgcaatggtaataaaccagaggattccagcccacttggttcctcaagatgttcttgttgatttgtgtattcactttggaccatgtgggctggaga

SEQ ID NO: 56842 - DNA, 1078 bp, Bovine  19866880715498
atcactggaaacagcaaccagcagaacctgacccacaggtgtgttagttcatagaatgattcgatacaggctgccaaattaaaaattcaagagtgtaaaataaagagtcaaaagcaagaaaggaataagataatgtttttaagtggtgtggaatttctagaaataaatttgctgtcattaaattttaaaactcagtgaagactactatttcctgcaagaatttgcaggattgttggatagattttccatctgaaaaggaaaaaaactaaatgttagatgcatttttttaaatttctttaaaaatctcaaagagctggcaactaagaaatgatgagatcaaaatctatatgacaaagggaatcaagaatcctgaagttacatttgtcctgatggcatttgtcaaagtaagagaacttgaatctaaagtttactcaaactcacaaagcttagaagacgaaagacaaagcacaaagcccaagacctcccaacatggagagtctgaaagtgaacctctttccataaagttaggaagccaaaaggttatgcacaaggtaagtagggataagcccagcttaccctcctactcccagcgactgtaagaagagttgccttggcacaaaggaaagcaggaggaaaaaaatgaactgtcattgaaaacctgtaaccacaagtcagatttgcagcccacttggattgcttactaacctcaaacaattaattcagcttaaataggttagtaccaatagaacccactggcatatgaaagaagtaaacaaagtcatctctggaagaatggactttattctggggactcaaagaaataccacaaataattacccataaaagtactgcagcttagtcaaaagtaaccaagtacacgatggagcgaaacactaataagcagaaactatatacagcaggaacagaccttcaaaggcatcatgtattgaaactatagtgatacattatagaaaaatatatgtattcttcaaataaataaaaggctagctataaaaatctgcaggctaacagaaaactatcttccaagtgaccaagaagattgcttctgctgctgctg

SEQ ID NO: 56843 - DNA, 1646 bp, Bovine  19866880719381
atactgtgggggtctgattgcagcctcttcgggacacggggacaaggattgctgggcaaagaaatgaaaggaccacaccagactaaggctatgcccgttgcaatttttccaggaggaacataagggagacagctacaaacaagcagaaaaatagttttctcccagacctcacttctgccagcacactgctttatttaagagaggagaaggaaaagaaaactctccctttacacacacacacaccctttcctgtggtcgtgccttggcagtccctcgcacaatatgctctaaattaatagcttcggggagataatggtttataaagcagaagtttgtatgcaaccagggaaaatgctctgctcctcattatacagctatatttttcttttgcagtcagattatgggcaaacaaggttaaatgcacacacagacacacacagaggcaaataggcttcaattttctgctctgtgacccgccgcctcaaactcccttctttgactttgctttgatgatttttcttgcttccatgtttctcctgtcctaaccgccctccttatcttctccggctcattatactttgctgttgctggtcggttgctaagttgtgtccaactctttgtgaccccacggactgcagcatgccaggcttccctgtccttcaccattatgcttggtccttgtttattttcttttcccctttttcctttttctatttctgtgctttcttggttttcttattcttcattctttttttaaagaatttttttgatgtggaccactttaaaaatctttattgaatctgttacaatattgcttctatttttatgttttggctctttggctaggaggcatgagggatctcaggttctccgaccggggatcaaacccacacccctggcagtgaaaggtgaaatcttaaccactggaccaccagggaagtcccttattcattctttgcctttctctttgaagcaggagaatggcccagtcaaaaataaatttaaaatcatagaatgttagggaaaaaaaggtgtctttgaaatcattctgatgccaagaaaccgaggttcatgaacgctaaagggactttgtcaagatagcatggtttctgagcgcttaggattggggtccaatcagccctctcttaactcagttccctttccactgaagcaaactctttctcctaaggtctggcatcagttggtaagctgaggggctttctgttttgggctgaactgtgttcccctaagtgataattctgtgtcctaatcacccgtcctcattgtacctgtgaatgcgaccttattgggaaacaggcttttagccgatgtaatcacgttaggatgcagtcatgctggaagaggccaggtcctaagtctgacggcccgtgtccttataagaaggctctgtaaagacataagaacactgagatatacaagaaggccatgtgacatgggggaggggctggagcaaggcagctgtaaaatctaaggatgactgatgggctggcaacttcggagagagacaggagacctctccctcagagcctccagcaagaatcaaacccaagtttggacttctcgcctccagaattgcgagagaatgtgtaagtcggccaccgggtgatcatgtgttacggcagctg

SEQ ID NO: 56844 - DNA, 1490 bp, Bovine  19866880778010
ccactcaggctaaatgagcaggaggtttatttaaaagagaaaaggcagggggatgaggaggaagggggcaggggagagggtgagctacaactttggccaggaataaggaaacaatctctttccaatcaggaacaatggaccctgagtcagtatgtagacctcataattcctggactgactgagtcttgcgcaggtggccatggtcagggttggggaagtgtgttctctggtgagaggacctgagagttggtactcctgcctgactgcccttcactgggaccggagctctttctgagaacagctggcacttggaagagctggagggaaggaagactctgccctctcccccaaggactttattggatcttggaggtggatttagcccagtgggaggtgtatgctcatttagataccatttcaggggatgcacttgtaaaggttacaagggcatggtctggaaatagcagctctcccaggataaggtctggacagggcatttcttgtattctgaaggctgcaggcattcaactcaggtggtggaggaagactcagtggcagagagaagcagattaggtgggtcagggacatgcccttggaacagctctgcagagtcattctgtaaaggtgtgcagagtcaaatgcaatccttcttttttttttttttttttctggccatgccatgtggaatgttggatcttagtccccagactgaggatcaaacccatgccccctgcattgggagtgcagagtcttaaccactggaccaccagggaagccctcaaatgcagtcttacctacgggcagtcaccgggaaaggccagacctgcaagcctttcagaagagggagcagccttcacccagtgctggactagatgggatccagagtctaactgtcttatttccgaaaggtcacaagaactccacaatgtaccccgaattaccgtgggagcaaccctactcttccgttttacatccaaaactgttcctgcctgactttccaaatttagtggagatgcactattcttcaggggagagaggaagccagagcatcctaccctgaataacattccaatgccccaggctgggaccctgggctgtcagggtggctggctgagccctagtaccatgtcaatcctggcagttggcaggtgctactctgaaagaatgggctggggaagaacaccccaggacagggactgtgtaaaagctactgggaggcgattctggaactaaagggactaaatataagacggctttaccctaggtggaactctcaagtagagaccatcttggctctgcatctccatcaatatttattgagtcccagctctgtgcaagattccgccacgagagctgcatactgatgtctgaccttgcagtctcagtgaaacaaccgacacatgaacgaagggaaaggcggataaaggctaaaggagagaggggaccgtgatgagacacctacagtgtcatttaagagttagaggctcccc

SEQ ID NO: 56845 - DNA, 1778 bp, Bovine  19866880782510
agcttgtaagtgaacgggagttctgagagagagagggacccggaacctgttttttgctctgtcactttctctttcctggccaggtgggagtcagagacatgcagtttgggggtcaaggaccacccagaagagatggaggaccggttcagcatgcccctgatcatcactattgtctgcatggcatccttcttgctcctggtggcggccctctatggctgctgccaccaggcgcctctcccataggaaggaccaggtgaggaccaagcagtccagttcaccggaggactttcaccctgttattcccatattggagaaaagccgtgggccctttctgataggcagaggtcatcatcccttacaggaaatggaaatttgcctgaagaattaaagaggcggcaagggttttggagtcaaagaagacttgcgttaagccctagctctgcctctgattaactgggtgaccttgagcaagtcataatctctgagcttcaggtttctcatctgcgtagtgggaatatccaccttgcagagttgctctgtggatccattgctgtaaatgggctgaggcatacccgtctaaccagaaggtttatcatctaccttcctaggattcccttgtaacagttccgcccagattcagggttctcagccctggctgcacactgtggagagctttacaagaaatccccctgcttagtttcctcacaccccaactgaaacggcatttctgggccactgtattcgtttaaagcttcccaggggactgtcttctgccactgaggttgtatcccgggtaaagaaggagagaaagctcccttcagatggtttccacctgcagcgggagggcaaaagtttctgtacacatcaggttcagccttagagaagtcctagtcattgggcctgatgaaatgcattttcttagagttcttccctgttcagagaagtggtgaggagggaccttgagaggaaggtttgatggggaaggagtggaggagaggagatgggagaacaaagtccgtctctgctgacgttacagatttgccaccgggggacagctgggaattctagggatactgggcaggttctcatctcaaacttgccctgaagcaagccagccgtcaggattggcctccaggaccgcctggtgtccacattagctaaattggggttcctgaattataggggaacaagtgccagtattaaggttagagcaaggctgactactctcaaaaactacccttttttcttgggtcacctctgtcactctagcaacgactaacagaggagctacagacggtggagaatggttaccacgacaatccgacactggaagtgatggagacctcatcagagatgcaggagaagaaggtggcgaacctcaatggggagctgggggacagctggattgtgcctctggacaacctgaccaaagatgaccctgaagaggaagacacacacctctaatcggggctgccggccatctccgacggtgcagagctccagcccaaccacctcaagtgccatttgtaaggggaggaggaagacccttcttccccttagagggaaagactggggaagaagagcagacttggagggtcccttcatcccagtccccacaggccttaatttttcccttttcaagctgaacaaatcacattctgtgtagaatcctcttgtagaataacccactagtgcctgagtgcagtgctgctgggagaacagggaagagccatagaaggaactcttcgagaccatctacagcctccattcacagacaa

SEQ ID NO: 56846 - DNA, 2370 bp, Bovine  19866880835896
ctgtgccccctgcattggcaggtggatttctatctactgtgccccaggaaagtcctggactgagtttttatgcagctggactctctgtgcaaacagtgagtaccatctttgagctgcagacctatagaaagttgaccttgggagaataaatttatgctcctgatccagactgctgacttagttgtaaatgaagcattcaaagcctccgctgcagacgatacactgagaatttctggaggtgagaccggaaaacagaccccaggtgatgtttaactcacaggaaagcctctgttctcagcttgggctgcacagaggaatcacatgcccgaagagctttaaaatccaaaatgcgtgctccccaccccagagtctgagtaaactggtctgagtgaggccttgacctagggatttttaagaactcccccagggatgctctgtgcaggcatgatggcaaccctggcactatagctttgagagactgaaacatcctgtgttaagaaggtgactaactcgtgagtttgcacaggactccccagtctgaaaactcaaagttccatgtccccttcagtcctgggagtgctgggactattggccatctaaaaaagatttgcatccacattcaactaaaaaccaacagggcacagagcaggaagcaaagcactgagcctaatgctttcccagttaggcgccccctccccaccccagtgccagcttcctccatcgtctcctttgggaacccgcagtgctgctgcagggtgtggctgccccagggctccagtcctgatttcctgataattcaaaaagcatttcctggttggcctgaatgtttctgtttcccattccctcccacactatatttaggcacagcagacagttcctgcctgggcctgccctacccaccccgggtgtctatcccagcccctggaacctagcaggataggcctacaagatgaagggtctgatcccaggggctaggcccctgccatccaggggggcagcggagtgcccaggtgggtgctgtcgccacccccatggcccactctgacttggggggggtgcccccaggctacactgcttttttgtttatcttacaagctttaaaatagtatttccccatttccttttccttaggcctggctgttctaagcttcctgtatatgcatcagtctacagcctcagttcagttccgttcagtcactcagtcgtgtctgactctttgcgactccatcgactgcagcacgccaggcctccctgtccatcaccaacttccggagtttactcaaactcatgtccattaagtcggttatgccatccaaccatctcatcctctgcgtcccctagaggctgagaaacccaacagaagagtctatcaagtagccccactacaattacccacactggatagcaaagtttcaggcctgaagggctgcctttagtctgtcaaacacttcctgtgtgttaggcactatatttattttgttcgagttcacagcagtatcatgagatgacaagagtctctatttctgggtcaggaacctgaggctcagagaggtaaacaacttaccccaggtcacacagcagcagagctgtcacctgatcccagatggactggctgatagtctgcgtgtctgcatttcccaaactttttcattattgcccttctcaggagactttgtagtcatttttttcccctctaatcaggcgctccctcccgcatgaaattttaataatatagataccctgcgtatctgtgtaggtactatatggctacataatacacaaacagagaagactgttttcctcttcaagaaccactgcatctcctcgggagtggtctcactcctgttaagaaggccagcagggcctgaagtctgactgattccttcctttagtgttggatataggtagagaagtgaagtgaagtgttagtcactcagtcatgtcccactcttctcgatcccacagactgtaacccaccaggctcctctgtccatgggatttcccaggcaagaatactggagtgggttaccatttccttctccaggggatcttcctgacgcagggatcaaacccaggtctcctgtatttcaggcagattctttatcttctgagccaccagggaagcccaggtggagaagaagggtaaatccataaagaaggttctcccaaacgaatcttccccaaaactccagtgtgaaaagaagagctggttcataaaaagagctcgatgtcaaacatgtctgcggaaagctgaaggtaggaccatcccacctcctggagagtcgtcttaccaaaatccctgaggagctacttagaaacgcacccattttatttttacaccaatacatattaactaaagaccacaaatgt

SEQ ID NO: 56847 - DNA, 837 bp, Bovine  19866880892313
tgatgggtggtgcagagcccacccagagtagctctcccttcattcactctttccctctacaaagtccttgttgtaacctgagctttcatcttctctctccaccttgaggacagcatctcagacagctgaggaagcagcctgagacagggagcatggagtactgagacatgttctgcaggagcccgcctggcccagcccacccccgccggctggagaaccttctgtcagcagcagagacggcctgctgggggagacggcatctccacacagccagactgtctgtctgttctgatggtccaggagggatgtgcgcagagcagcagccaagagccttctcaggtgtaaaacctcccggaggcactcaggagaggagggctcctggcgaaacgtgaagaacaagcactgtgctgtgtaaatacatttgtggggatggagctgttcctgggcccacgggggcccatttcttgactgtgtggcaggaattgtcttcgttggaacgattgacagggccagtggggaaagctaagcagcccttgatttcttttcttgcgttggcacatttaactaatgagcgggagaacaggcctggagaggcaccgaagctgcggccacaggtggccttggagcggaaaacttgctcttctcgtcgagtggaaaactcctgtgtggtccatctccacgttccagttctctggtccaagtcctgtaggatcttcatttcctttcacggggcagacaggaaactccctttgggaccaacttgggttggggtcatgttgtttgaccgccgcagttaagaagctctgtccagggctaagaccgcatgcttccgataca

SEQ ID NO: 56848 - DNA, 639 bp, Bovine  19866880920108
tgtgtgagtgcgtttgcatgaaagagagagtttagccgtgttgtccactgccttcagactgccagtctccctaggattaagggctttagtctggggatatctgctgcagcgcttactcagtagctgaggcctgagtgagtgctggtgatggatggctcactgccgccctctcctggtcagtggctattttgcaaacacccctaggaaccagaaagtgaaagcaagcagcatggaaaacttgggtttacgatactttaatgctacctattttctgcagttgttttctttcgggtgtccattttgctggaattttccaagtgaactatagaaaagctggagttttcaaacagagcagggttttcctgggattgggcttgttggacaaggtgagaaagacactgacgcttgcccagcctttcctccggctctttttggctgaaacttggcaggggtgtgtttggtggtaagccttcttttgccataaatgggaagaggaaagccctgcatctttacctggcagcagggctggggagtttgtaggcctaaggaaatgccaggtagaaaacccaagggatggtttgtgggacaagccaaagcaagagtcctattcttcatctggtatccttattccaaagtctg

SEQ ID NO: 56849 - DNA, 1250 bp, Bovine  19866880935712
aggcaattttttttatttgttcttactgtgtttagtcattaatttagtcattaagtctgcctcttttgcaaccccatggactgtagcccaccagactcttccgtccatgggattccccaggcaagaacactggagtgggttgccatttccttctccaggggtcttcctgacccagggatcagacccacaccttttgcattggcaggcggattctttaccactgagctaccagggaagcccgtattttttatgtatgtatgtattttgctgtgccaggtcttccttgtgggatctaacctgacaagggattgttacctgaccagggatcgaacccagccccctgcattgggaacctggagtcttagccacgggacataccagggaagtcccaaaaaggcgattttgaactacttgaagtgtaggagatatgcccttcctatgccactttgtaaatttcctaaaaatttacctgtggacacacaactcccactgacttggggttcccattcccttattgaaatgtcccttcctcctctgattatcttttttaatttttttcaattaatttatttattttaattggaggctaattactttacaatattgtaatggtttttgccaaacatcgacatgaatcagccacaggcgcacatgtgttccccatccagaactcccccctcccatctcccttcccattccatcctcctgatcatcttttttaaagcccctgaatcctaggctagaggggcctttagtgagcccttgacctctggggtccttggtgaaatccgactccaagaagagcagggggaagacacagtcgaatttctcctctcccaccccctgagcatcttcctgtctcctgtcctgtgccctaagcctcttcctcccccaggtctctgacacctgttagggtgagcgccgagtctccttccatcctgggatccccctccagagcccacacctgtatttgttaatcaagccgctgaggatgcagtaattgcccggcagaaaacacgggtgcagatgttagggagcgccggggcaaaagcactaaatgagattcttgttttccaaacagagcccgagatttaattacaggctttccaagtgcttattaaaaacccttctttttttcccttattgttttcctgcatggcgcatattgaatcagccactgctgttgtcttgtttttggagcgttcataagaagaaccgatgggaaaatgcaaacacagatgacccaaaca

SEQ ID NO: 56850 - DNA, 1288 bp, Bovine  19866880941971
acaggaaagcaagggagtcactcctgaatctcatctaagtcatatttgtgagggttattctttattgtacatcatttccattgctgttttccaagagaacaagcctcagataaagttaagcatagtttaggacacagtcctgaaagagctttaatgggagagggggggtgtatttgagagttaaacaagcaaataagtcaataaattaaatttatacaactgccttcgggtgctctcagacagaaactggctcctgatccataacaaggacacatcaagtccacggttaacataatagcttttcagtttcagaaatgtatctgtatctgcccaggaccagactgagagatcactataaccaaacagatggcactgaaatggacctgattatgtacaaagatgtaagattcattacagctcaatgaggggaagaaaggattacccaataaatggtgttgggaaaattatctagcaatttggagaaacagtaatttcagaacctcactttatgttgtgcattaaaataaattccaattgagcggaagagttaaatgtgttttttttaacatcaaaatctcagaaaattagaactgaatattttgccaacctctagagaaaagatgattttataggcttagatgcaatacaaggaataaaaatgagcaagatcgctaagcttgactacaaaagtgtaaagtataaaagtaaacaagccaccaaaaactactacagtgaatgtagcaaagaggcattatttggtgttcaagacctcataagtatcaatcagaaaaaaaaaaaaaaaagactaaaagagagaaggaaaaaagaacaaaagatgaaatgtaactagaaaacaaaagatttgagatgttctgttcccatagaatataaattaaaacatcaagttaccatttccttttaaaaattagcataaatttaaaaaacaatatctctgggacttctgtttctggttaggatgtagaaagtcacaattgactggggagcctgccctagcaatgagaacaagctaagccatgatttctttttttttcccttctgtagcatattagagggacttccctggtgttccagtagctaagattctacattcccagtgcagggagcccaaggttgatccctggtcagggaactagatcccacatgccataactaagagtctgcacgccgcaactaaagatcctgcatggcacagctaatacctagggcagctaaataaataaatattaagaccattagagaactaaagatgtaaagaaacctaaataaa

SEQ ID NO: 56851 - DNA, 1628 bp, Bovine  19866880951851
gaaggtataaaatggaagtagagtgaccaactctcccagttttattactgaaagtcccacatccctggaaatcctttggccctgagtaaaccgtaacagctggtccccctcggaagggagacagagaccttccatggtggtctagcggttgagacctttccctcccaatgcaggggcacaggttcagtccttggctgaggaactaagatcccacatgccacacagcacggccaaaaaatttaaaaaaagaaagaaaagaaatggagacaggagaagagaggagaggaagccagggcaaatggatctagcaacctccttgttgaggtgaaggtcagctgtaggtggacagaggatatgtgtaaaaatggggtgctcagtcgtgtccaactacttgtgactccatggaccatagcccaccaggatcctctgtccacgtaattttccaggcaagaatactggaatgggttgccatttccttctagactcttcctttggaaatatttaacccaccatgccccccgccccactgtcactcccttcctggttcctcctgggcagtggtcatctgtctccaacttgtagcctccacacagcccccccagcagggccacacttcctcctcacctctcactgaccccgtggagggcacgctgggattcggcttccctcggaaagatccagtgcatctggtatctcctcctggttcttgtagcacaggccccactggggctgtctccaagactctgtgtttaacccgttcttgtcttgagtgccagcacactccctgcatacagaaaccccatcgctcacatcctgcgccccctgaccccctgctgcagcctggaactccgaggcggggtttattgttgttcagtcactcagtcatgtccaactctttgtgaccccatgaacagcagcacaccatgcttccctgtctttcaccatctcctggagtttgttcaaactcacaaccattgagtcggtgataagagggttttggggcagcttaagctctgaacaatacgactctttgggtctcccctagaaaggaggcctctaacagcccccaccccactccggccgaggcagaggcgggtggggcactaatgttgttccaccaatgccacgcgtccgccagacccgcgggccaccagtcatgctcaatgccgcctctgttgtgaggttgctcgtgaaaagccctgtgttgcggctcccggctccagcgaggtcctgatacaaggtctccattcatcctcctcggccacacaggcagcccctgctccctgaggaaagttgcctggggtcggggtacaggatgcatgttcctcccagttctacagaggccaagtaaatgatgcccgggttctctctgtctgcccagtgctgcctggcagctgctgcctgagaaatcctgccagggtctctgggtcacaggtgggcctctggggagcccactgtctcagccaacagccatccaagctcctggcggccacgacatgaaaggagaggacagacacaacaaagcaaataaatgcaacttccttggttcatctttcaatgagcaaagggaagaaaaactgctgtcggcaaggtacctacccctgccgactaatgggatcagtcagatc

SEQ ID NO: 56852 - DNA, 805 bp, Bovine  19866881026963
agcctgactctgaaccccttggtctgcactggtatggccagaaaactcctgtaggcacctttgtgccggccgaaagatggccatgtctgaaggggcaatgaccccaggtgaggtttcttaactagggaacacagcaactaaagacagactccagtctactctgtatctatcctgttctgattctaccctatcatcttgtttctattctattccttatgacctgcccatgaatgtgaggaactgcttgattaaagagaatgaagtcagagagcgatatagaagaaataaaggagaaggaagaaaaaaataaagagaaaaatgatgaaagaaacagagacttgctgtatatatctgaaaagaagagggattatgtagaatttacagaatggaacatttctagcatcccagtctttggagcacagccccccagtcctgggtgatagagtttcccctggcagaagtgggtggtggaggtgcctggggtggtgctcttgggcactgaagctgctccaggcaggaatatctgggtctctccccagtccttccccaggggcccccgagcacggcagggcagggcagggcagggcagggctcacctcctcactgtacttgcccacgtaggagaagatctcggagagggcgctcatggtgttgaactcattcatatgcatccgggactgctcagctaggtacgcgttcatgtcctggtcgctgatggcgggcatcttcccgatgtctgagtaatacctgtggcggcatgggagtgaggaactctgcgtgcgtgtgtgtgtgtgtgtgtgtgcgt

SEQ ID NO: 56853 - DNA, 740 bp, Bovine  19866881078390
tgagttatcacaaacgtggaagcatcttagagactgtaggacgctcaggaaggttagactttcttcttgtttccagggatgaagctcctgcatcagagtccctgctcagaaccaggaaccttcttttgcgtacagtgtgcctttctgggggccaagctgcctaactccccgcatccctccccactccctatccctggcacccactatcttccagcagtgctgccatggtgaccacagctgctcagggggcatcctttcttccccagaaagatttgatgaactcaccgtatttactggctgaggtcctggagacagtgggagttgttcactgcattgtaggctgtcacttgcttggacactaaggccaccacagaaccatctggcacctaccggggaaaggcaggtaagggcctggtcacagaaactgccacccagtcaggacgaacgtggtccttggggacaatcagggcctcactgagaaccaggggatggaggaggctgtcagttttcctttgatgaaacaggacagatctgagtatagaactgtagtccatggtggggctcactcttggagtgactcaggcaagagcctctcaccagcaccctctgtccttatgcttccctgggacagcacccagccttaaactccagggctcacctaagaaaggcttttgctcagggtctttgcccatgccctgcaggaagcgcacacccagcatgctatctccaggaaggtcagg

SEQ ID NO: 56854 - DNA, 1709 bp, Bovine  19866881196243
cagcccgagtcctctcctgaaggctcccatctctgcgggttggactggagtagggtagggtgaccccagctaagccctcttcccttcccgtccccacaagcaacaggaaggtaccacttcggcgtcactgcaggagtaggagctgcgtatttaattcctcgccacaaaagactccattaaaaccctgatttatcaggggagtgatgtccaagcaggaggaggcagcgaggggcactgtgtctgagaacggacgctactgcatgccccactgtctcacacacatgcgctgggcaccacctccatgtacacccagaccctcacccaccccgagacccctgccccatccctgcgtgtcagtctgtctttctcgtcactctgtctctcacactctaatgggaagctggctcctttctccaaagatttcatatgctttgatttttgtgcaggttccaggctgattggaggttggagaatctgtaagaagcttaatgtgatctttaaaaaataaaaagatgccctctaaaaacttcaggttcaggccacccgcaagcccgtcctggctccgacctggtgttgggggaggaggccactccagcccaggacttcaaattctctttttggaactagtcgggtaagccaagactctgcctaaatcaccaagctatactttttcctttaaaatgttctggaccatttctaacagctttgagtctcttggtgttctcaacgtgggctctctctacatggtgagactgcagaatccttttcagggggtgggcagggggggaaccagagctggtcgggctgtgtgctctgggtcataggtgctgtcaagtggccctgccaatccgggctcctgcaccctctgcctgaccctgcgacctgcgccctttgtgagtttccgtctcagaactttcactgcatacccaccccccgcaaccatttcccaactgcatgtctggttcacagattcagacaatggccttccaccccccacccctctcctgctccatgtggcggcaatcagagccctggcccctggacgtctgcctttcattagcgaccagactgctgtgagctcaaaccagaacatgcttattccattaaaaagaaggaaacctcctaaatctataaaaccaaactctcaccctcaaaatgtcttaaatcgaaaacaatggtggaaggaactctggaccacgcactcctcctgcatgcattctccaaaccattcccttccaagagccttctgggcccccctccgggccccctcagcctggccatctgtgctgctctgtgctgccctgggctcctgtgctccgggccacgtaggaggagggaagttgatctccccaggcagcatcacagctttatccgggctgtgagaccacgaggcagaggctgccacctgagtttgtgcccccacaccgcccccatctcgacatttctgcttgcccctggagttcacggtggccccacaggaacagctttgtggagtgcttcagggcatctggacaggcagtagtggtcccatcgagggacagggttcccagtcacaggccaagccccagctccccgggaagttcctttccccatgtccatgcctctgggctatctcagagcaaactgcctgggggtctgttctgctaggtcattgcttctcaaacattcctgtgactaggatcactaaaatagttataaagtgtcagttg

SEQ ID NO: 56855 - DNA, 1182 bp, Bovine  19866881326441
accccaacctggacagacacacacctcactgtttatggattttaattctataggaagatcaaagtaacacagaggacactaagaaaggactggagaaaaatagattccgggggcccctgtgcaattctgcgttttgttccacttgttaagtggtgtgaatgatcgctcagagagtgtttccgtggatggtgacacacgggagtctcaggttagcagcttgctggtgggtagtgatgattatttatgtgttatatgtctgctttatagtttggggggtctcttgagtaacccatatgctcatttgcctgttttatgtgacttcagagcaacattttataattttgaatgattgtggaggctagggttttggaatctttacatttggaggacttttttgttgtgtgtgtgatgctgttgaggctgagaccttacttggttaaggagatgctggaaaggctctgagtcagggttgagtcctagctccatccccaacagtcatgtgaccctgagcaaagcatttctctgagcctcatttcttcatccatgcactgaagagagcacagagcctgccttccaggactaaatgcagtagagtatgtgatatgggaaagtcttttgcaaagttctacacaagtgctgagtattaccctacagttactattccacataacattgttttcatgggaaagtacagtttgccttttaacaattggatttacagcgtagtttccaggaatgcatttgtctctaaagcagtcttgggccaaaagcaacacaacttgaccccgagataaaatgcactgaggcaaaaggcaggaactggcccagcaggttttcaaagaagagaaagaaaactgcccccagctatgatgctcatctcgcccatctgccaagaagtcctggtattggatttctccagtgaaacagaaaaaaacaggatgtacatgtgtctgtttatttctttatttatattaaagaattggcttacgcaatcgtggaggtttggcaagtccaaaatgtgcagggtgggtcagcaggctggagacctgcagcagagctgacaatgtagtttgagtccgtaggtagtcggctggcagaatcccttcttcaaaggtgagggtggtttttttctatgaatgtcttcaactgatgggataaacccacccacactaggagggcaat

SEQ ID NO: 56856 - DNA, 1272 bp, Bovine  19866881344906
gtcccgggagctgtccattcagatgcagtgattttatctattatttatcccagggctttcagagaaaagatgtctcagtcatgcaaagaagagaagcagatctttgaagcagccctctctgggtcatttcctttggaaagaagaggcagtccagaacaggacagccgaagtgtcttctgtctggggccagagtccctgtgtaggagatctcaccgctgaggacatgggctcagcaggcattcagttacttaagtaccctgactgtcatcctctgaagacccacagtcctgacttaattaaagccataggtagatggggaaagcacaacagtccatcatggttagcaaagcccatcagctgcctaaagatactttatgggcacaagacatggagcagaaagtgagtcatacaagacgctacaaagtattgagagagatataattaagcattaaattataaagagagtagtatatgggccttatacacataacattgaacaaaaaaagccagacacgacagttttttattaatccatttatataagaaaaaagcttccctggtggctcagacagtgaagaatctgcctgcaatgtgggagacctgggtttgatccctaggttttgggctgatcccctggagaagggaatggctacccactccttttgttcttgcctggagaattccatggacagaggagcctggtgggactacagttcatgggactgcaaagagtcagacatgactgaatgactaacgcttgatcttttatacatatccagagtacaaattccatacaaagtagcacaaagctgggttaagtattaaatggcagacatttcaaagctagttaggcataccaaaagtgtgcagttgcacagagatgataagacaagttattttctatcttggtcagtaaatccagtagagttcgtacatggttgctgctgtaaagcaattttaatcattagtacagtagtaatattgactacattttagaattcccctttctttggagttagctaatcttaaactgtataagtctcaagagtatatcaacacaatatcttaattactatggcatctctagaacaatatttgcccacaatcagcagtagcagctttctcagccaggatagaatcctttaatatgtcctctacaaaacttgttattgataagtgttgttgcattatcccaagttttcagaagataggcaataaaatatgtttatttctaggagcaatcttactgttaaataaagtgctacattttag

SEQ ID NO: 56857 - DNA, 1010 bp, Bovine  19866881344957
cagaatggaataaaggggagaatataaaacaatgcctgcattttgggcttagtttgtttactggctgccacaagccaagacaaagaacgtaggcagtggaactgatgcgaagaaaagatggagagactgattttggtcctttggtcatacaggacatacagggagagatgcacaatgggcagttagaaacagggatctggagctaaggaaagaaaaataaatcagaaaaataacattggtagtgaaagatatgagagagggtaagctattggagaaggcaatggcaacccactccagtactcttgcttggaaaatcccatggacggaggaacctggtaggctgaagtccatggggtcgcacagagtcggacacaactgaagcgacttagcagcagcagcagcaagctactggaagaggctggtttgaatgaaaagaaaggaaagctgagaaaagaacctacatttaaaacagggatgagggaggaagatgaggcccccaattagggagactttgaatttgaatggtcaagtgttcactcaaaatgtgccaacgtttagtcaaaacgattagaccgtggattgagcagccggacccttgaggccaagcctttctgggaaacagtgaactagaatttcctttatactttctgtaaaggtagaagattcagaagttccaattcttcagctgctatagggattttgtgaacatgaatcaagtttcacgaatctttttggagaagggccgacatgcgatggatatgagtgatcctaggagacagaagcccagaggactcccaactgtctacatttgagtacaagacccaggagactcttaaacacagaagtgtttccccttcgattcaggatcaatactcacttttcctcatgggccagatttctgtgtatttgtattaaaaaggaagaaaactcagccctgagaattgtgattcacctaagtgtgagctctgaagctttggaatcatgactagggaaattgccacctcacacat

SEQ ID NO: 56858 - DNA, 1151 bp, Bovine  19866881374020
ctggtgggcatcctgccgtctgcattcccacatcctgctgctgacttggggcccacccgtttctatattgagacactcctcgctataaagaacgggagccgggcacaaaagaaaggccctttcgagaaggctgtcacatgggccaacaaagggcaggaagtggcgggcggtggccccgtgtccgtccccaagcccagctcacctggctgggctgtaggccctttgtgcaaaaaatgtcaggcccaagccccgaacttcctgccatttgtcaggctgtgccgtgacctggagttcaccgaaatgcttgcggctcccaacaatacacacacgcatcctttggaaaaatcctctctccccgctcctccaggcagcagtggtttttttatggaagtggctgggatgggggtgggatggtccagggctgagaaatggaagtttcggtcgtatttctttcttgaagaagcccagctcagacagggcctggaaagggcagaatcccaggtatgggacaggggctctggggtctgaccccatctctgctcctgatcagcttggagccatgagccctttgcgggggggtatctgtttctgtgacctattggattttcttgtgtcccaccagccaggtgctcccatcccacctgcctcccttgaggctctaggattttactgcccaagaaagagatgcaatcagtgtcacgaatacctgtctgcctacagagaagcaaaaattcagcctgtgtgtctgagacctgagacagagctgaaggcatggggtcaccactgcccagccagccatgcatctggctcccaggctggatctggtgagaggagactcatgaggcttctccaggcaacaactgaacaaagacatccacccctcattccactcgaactgttttcacctggtgaggagctgcagacaggcttcagaacactgggacaggtgttaataaaatagtcacccgtcccctgcgaactgaagaaaaagaaacaatgaattttccggtttactagatttatccgtttgaaagcactgtccttttattctgagattatttctgaaatgaagaagagaaacgcagtgaatttttccatcctgctgctgctgctgctgctaagtcacgtcagtcgtgtctgactctgtgtga

SEQ ID NO: 56859 - DNA, 1318 bp, Bovine  19866881379031
ggaaaaggaaattatacaattttcattctggtgaaagaaaggtaatggtttgtcaagagcatcttttttcctggtaatgaattctaaagaaattttaagaggaaagcgttacagacatcctgatgcaaagatatacatactaagtgttttcaacagatcttttaagtaaaaggaagaagtgttcttcaaagacctattttaaaaaagtaatccacctgctttccacactgagtatacaacataaaaatataacttaagtcttttctgtgactaatgtggttctggtatataactttatgtaaagataagtctgagtatcccagcagaacactcattatttaataactctggtgagaacctggaatacttgtattttgtgttgtcatctcattgaaaacatacctattaaactttgggtagtggtttatcatgtggcaagactgacacattgttgccacatggagaagtctgacctgcattcttgcccagctaaggagctacttaccaggcaggtagctgcgaaggtgtggtcacaggcagatttcagagagaaccttgactcataccaaatttgaattaacctctgactgaaacttccatttctacatcatagccaagctgagttcattttaacctggacagttaccaggcgtagctgttgtcatccactttgacaatagaacttaagtggaatattgggttttgggtgacagagttcccagtggatctgtaaaataaaaattataggatgtggttttagttattagattgaattaacttactagatagagtttagtgttagccatccgaacagtgaaaaataagaaaataatgaaaaactttaatttagaatagtttattttaagccataggccataggagctgttgtttctggatggacctcttggattatgagaatcaaatcatgtcaccagtaaaaaggaaggttcttgatttcttcttcttcttttcttttctttttttttttttacatcaaagcaatgtattaacagaaagcaataatttgaggagtcctgttcacagacggcgaccacggcaaccccccttcctgcgggtgctgtcggaagggatgggggtgacatcctcaatccgcccaatcttcatccctgagcaggcgagggctttgagcgctgactgggcccctggtccaggagtcttggtcctatttcctcctgtggcccggagtttgatgtggagggcagtgatgcccgtatccttgcacctctgggctacatcctgggcagccaacatggcagcatatgggagaggactcatctcagtcagccttcaccttcat

SEQ ID NO: 56860 - DNA, 2513 bp, Bovine  19866881418752
gatggagaatctggtttggggggaaatagaggaaaatgctgtctcactgggaaaagatgtttgcttctttcctacccagcatttggttctttctacccagtgggtttctatcatggccaccgtgggagaggccagcctggattactcctttgctgattctgggtctcattccaccagccaggtttagacagagacagcagatacattctggaagccaatcaaaggctataagccacaggcctcttggggagcgagaaggtgactggcaaggaccagagagtaaaaatgaggcttggtcaagaggaatgactgtggctctgtccagagacagccttgacaagctctgggctggttcagaggctccttctttgggtgcatctagttgcccagaagctagaacaacttgccctggcttgctcgtgccactagacacctatgtcaaagaccatattgccgtgtgtctgtagtggtcatcttcttcccacatctttgctggtcttggatgctatctagttaattcagattctggggctgagagaggagagagagagagagaactcagcattgacttgaaacaatctgtgccagagagattataaactcttatttcggtggcacactggtttccctaaacttcataaaaggccagaaaccgtgaatctgatgactggacgaaatccagggggaagcacactgtcatggcagtggggagaggcgcagcaatgcttatgaaggggggcacagaatattcgtgtcataggacaagatacaggtttaatctagtctagatgcaagcctgttctttcccttctcgataaggaaagctaacagaaagtttatttaaatcacttcttgagcttttatctttttgacaatatactggagaaactttgaaaaaccagttccagctgatacacatatatgtattttttgaaaatgtaaatacaacagccacatgttaatccacccccgcactgctttgagtgaatatacttcgaaaaaaacctttgttaagagagaaggcttttttccctctaaacaggaatgtaaatgtctattttactagcttttgtttttctttaatgaaaaatgaaatacgagacaggctgatgatgaagtatttgtcttgcagactgggcatttttatttttaaatatgatcctcatcccctccccatgaagtcccagcacgttacaataagggttgtagtcaatatgcactggttgggaagagactctctagtcatagaggggttttagaacccagtccaatcttttatttttttaacagaagaagagtctgaagcccagaaagataaagtgacctggtgaaactcatgtatttagtgacagaaaacaggcttaaaacctggactggaagactgtccagtgctctgtgcttcaggaagaaaccaacaaattaaggagagtgataccaaggacagatctgcagcaagcgtagggagagcatgaagacaaaaacaggaaccttactggtctgtggcttatttagatctaagacttaaatgaacaattttgttctgccaagaatagttttgaatagtctctacatataggactaaggatcaaagggaacaagatgggaaggcacagggggcgagagtaaagcaatggcttccatcattgtcattagctgattaactcaggtttggtgaaaatcctaccctgagtcaaaggaggggattactatttgctccatgtctttttaaaaaaattagtgaatgttaaaagagtttgctcaggagactgggagagctgtgtcttggtggacaggggtctaaagtacactggaatttactgagaaacttgtttgtaaagattattacttattgctgttttcttacaaaagtatattttggaaagttgtatactgtcaattaaactgcttttgtctaaaaaaaaaaacaaaaaaccacagtaatctttcttggagtcttaatcccttcttttctcagtttcctttctcggtatattaccatattcaaattctttctagtttaagaggaaaaagaaaaccctctcctcccttgactcaggtcttcactcacactatcatcctcctacctctttgtacagctgtgtatatttaaatatctagacatttatggtctcaatgtcatcactcatcagcctaccgcagtctgtattatattcacactccattgaatgcttccttttgtgatcaacagcagcccccagcgtgctaaagcaaagggacagcttttcagtctataaattctgacctctcattccatttgatacttttttcaaattcacactccttgtttgatcttaggtcttttagatcttatggcatcactttactctggctgctgcttcttcttcttcttcttcttcttcttcttcttcttcttctctctctctctctctctctctctctctctctctctctatatatatatatatatatatatacatatttctcattctgctttggggtcatatcttcaagttctcttctcgcacagtcaa

SEQ ID NO: 56861 - DNA, 919 bp, Bovine  19866881488705
aatactggagtggctatttccttctccggggatcttccacattcagcgattgaacgcgtgtctcctgcttggcaggcagattctttaccactgagccacctgggaagccattcttgtctatcttgtgtttctccagaatcttccttcccaccagtcctccgaactctctcttaatccatgctcctttggacctttcttactctttctggctttctccctcttttctaggtttctgttgtatatatgatcttagtcttttggtctaaacccccctgctttctccttgtatctaggctctttgattctaaccatgcattctcctcattctatcaaaagacctgagaatcttggtggaaatttctcccttcagaatgtatgtatgttcacaggaagtgggggtggggggacaaaccgaggcaggtctaagtgatcaaaaggttgggggagcagagagatgcagattaatatattaatgcattgtcttcctatgtgtaggttgccttccaatactttgcacattgtaaacactcagttactgctccttcccccagctcctttctttgcttctacttgttttaaggtgatctctctcctagagtagaatagctgtccaatttctagagatctttctgttccatggcttcccagggaacttaccatccatcacaactcctgaagccagacaagaatgcccataagcggtcagggtcctcgcctccttgtcctaagaaacctcaatcaagagcatggaagtggttttagaatagcatctgtctccaccagctgtgagctgatcagagggagagtaaaatttgtcacaaaaaaggaagcattgatttggctgtcaaacagtcagcaagataaaaaaggctactgatttgagatctcaccactctttgatggggctaaatttccttca

SEQ ID NO: 56862 - DNA, 1048 bp, Bovine  19866881530235
aaggataggagagcttgatttagaccctttccggccaaggaactgaaatccatgatgtcaagcagaacttgcaagtcaaagagtccgagtgttcccagggcccccagtgggtccccagttactcagggactcctcacttaggcttggtacaacactgaaaattcactttggatgtcctctgttattagatcacaccagtccctccagctcacgcagcagctgagtcatggtattttacagattcttccagagccagagaaggggaagggagtgggggagagatgcagaaaacgcaggtggcctgtcccaattcagacttaatcagatcagttaagcagaaacatgggcctctgacaaaattaaattatggtttcttcatgccctaatgggaagttcattgccccaggctccaggaaactgttccagttactgccttggccattaagtatccattctaacctctctgggcttcattttcttcatctgtaaaatgagaaatttaaaagaaaatttttctctgtgtcccttccagcccagacttatgacctaaaacaccagagtttacacttccgcctgggaaaggatgctaaccccaggtttgagcatagcatttagtgtcaggaaacctgaggttacgtttttgactcaaaatatgatgctttgtcatttcattggcctccgtttcctattctgtaataggaaagggctgtaaccaagattaaataagctaatgaatggttctcaaacttgaccttgtatagatagcatcagatgctggggcaggggggcggggaggggaagcttatgaaaacacgggttgctgggtcctactcctagtacttttgacttactaggtttgaaatggaggctaagaatttgcatttctatcccatcctcaggtgatgctgatgctgctggtcccaggatcacaccttgaggacctctgagctcaagtgtttaaaagctcataatagagtatgaatctaagctgttcaggctcaatctaaataggaaaggtttactaagtgctaaaaatgcagccatgtag

SEQ ID NO: 56863 - DNA, 1662 bp, Bovine  19866881735337
ggagggcagcagaggactctggggagcggtctgggcaggccaacaagcacagagcaagccgcactgcagggagggatcctgcagcccactgggccacctgtcctagactctgagcggggccccagctcaggagagagccgagacgggtgctgggcccttgaggaacagaatgaagtcactggttcctgtgtcagttttctggaattagtcaaagagagctttgctagtcctcagaaaagaggtctgaagtataagagggaaagagtcactaaccatccactatgggctgaactgtgtctccccaaaattcatgcgttgaaacctgaatccccaacgtgactctatttggagacaaagcccttaaggaagtaactaagactggatgaggttcaatatgatccaatgatccaatatgactggtgtccttgtaagaaaaggaagagacaccagatatgctcacaagaggaaaggccacatgaggacacagtgagaagagggccatctgcaagccaggaagaaaggcctcaggaaaagccaagccttgaccttggacttctagtctccagaaatgcaagaaaataaaactctgttgttaaagccaccagtgcgtggtatttttgttatggcagcctgagcagactaatacatcatccttcattcttactacaatccccacactagagcccagagaggggaagttacttgtcccaggtcacacagcttgctcagaactagaaagaaaacaaaggcctgctctcagttctgtgctaattctgctccaccagcttcctcacaaaagaacaaaggacttgctccgaaaagagtcagcactacctaataaatacacacacacacacacacacacacacacacacacacacatactcaaaagcacctgaatttttaacaaaggagtaaaaatccctaacctccacagctctgagagctcctaggcaggaatgatagagcttcttcattctctgccacacaaaccatcatggtgagggcttggtatttacttggataaacaataatctcccctaaatggcagccagccgctgagggtcacctgactgataacatttgcagttgctacgttactcagctcctaatttgctgtcatttgttacttggagctcctggaattccctgcaaagccaaaggaggcagacaggaaaccacgctggctggagtgggcaatgctagattcccagccaattacaccctggccccatgagtgtcccagccagggtccccagctctgatggacagcaaactttccccgcaggctcccttctccttgggtcacaaggggaaaggatgttcacaggagtagaggagacgcagacgtggccccaggcagacagaaggtggggggcagaccagaaagcttccattaaggatcctctaatgtttaacaccgactcaacggacatgaatttgagcaaactccaggagatagtgaaacacaggaaagcctggcctcctgcagaccatgcgattgcaaagcttcagacatgacttaacaactgaacaccaacacatttagcatcagtagccagaactcagacaccacgtggtgagtggaaaagagcaccaaatgtgaaacccaaagacctggcttttgagtgcaggttctactgaaaatagctgtttgccttg

SEQ ID NO: 56864 - DNA, 1367 bp, Bovine  19866881782401
aaagggctgggatcagggaatctcctactgtcctggggcagggcaatggcaggaagatctcattaacgcctttccacaaaggggaaaaataatatttcagcgtgttccctttgtgtcttcaagcggtgataaggtgccaccaaagtgccagtctgagctgcgttcaaatgaaggattattctgataagatggagaggggagatgctcggggcaggaggaccctctggagggggccgaggctggcttaaggttattaaacaggaaatgcctggtcgcagcggatcaaggggaaattacacattctgtcacatttgcttattgaatcccagttctattgcagctcgaaaggggaaaaaataacgccaccccatcaacctccttgtagctcttattagattttgcaacctttcaatattaaaatgctagtgccggtggcaaaattccttgtcagtttttaatatcagtaagggattgtggtattaggcttaagggggatggaaatgggaggggcaggggggtacagaccgtccgccgagtcccttgtgtccacagccgcagccgtctttgcttctcagagcgccttgcaagcctagtagatcctgtcctcacactttgagaggaggctgcagagatgagggtgaccatctcaggggggaccacacgcgcctctgagcttcacagccagagtcactgagccccacactcaggtttatcctgaggcaccccattccagtaactcagtttatccgatggcaccccactccaggactcttgcctagaaaatcccatggacggaagagcctggtaggctgcagtccatggggttgtgaagagtcaggcatgactgagcgacttgactttcacttttcactttcgtgcattggagaaggaaatggcaacccactccagtgttcttgcctggagaatcccagggacgggggagcttggtgggctgccgtctatggggtcgcacagagtcggacacaactgaagcaacacagcatccgcagcagcagcagactctatcgttaggtgctgctctaacaagaggccacagacggggtgggtgaaacaacaggagattattgtctcatggttctggaggccagacatccagaatcaaggtgctggcagagccacactctctctgaaacttgtaggggagaaacttgactggacttcggtagcttctggtgtttgtcggcatcccttggcctgtcgatgtatcaccgtaatcgctcttctatcatcacatacctgttttctgcctcggtgtcactcctttcctcctcttaaagggacatcagtcgtatcagactacaggccacctactccggtatgacctaatcttaattaatcacaccaga

SEQ ID NO: 56865 - DNA, 922 bp, Bovine  19866882159556
ggagccggttgatgtggaccatgtctgtcgtgtctttagtaaatcactgctctgggctccaggtgaggggctggtggcagtttcctcagggagacacacgttttcagttgcatcattttcaggaactcttctcatcagttcagcttttttatttgttgttctaagctggtgacttacattgtctttaccagctcttaccctgagttctgaccatctctcaagtgggaaaatgcctggcaaaacatcaatttcctctgaaaggagattctgaattgtccatgaaatgaaagcttgttcgctgaaagagctttaatagaaccacagccccgaggttgcagctgagtcgcttggacttttggtggcatcagggacaaaacacctcagtgtcagcgtgtgctgcgttgatgtgccagggcaaatgctcggctgtgcctggggatttacacatggactcacatgcacagacccatgggagctgggaagacaggacttagtggaaagaggaaagtctgtcttaaagggacagttattttccttgtcacctgctgctgaaatgagctctgggttagagtagggaaggttgaatccagtcccagctctgcctcgatattgctgtgggtccttggggaagtaacttcacctctctgaacttcatctgcaaaatggatatggagacctctcagttcagttcagtcagttcagctcagtcactcagtcgtgtctgactccttgtgaccccagggacggcagcatgcccggggttccctgtccttcaccaactcccggagcttgctcaaactcatgtccaactagtcagtgatgccatccaaccatctcatcctctgaagaagaaggcagttcttctcctcttgccttcagtctttcccagcatcagggtctttttcaacgagtcagttcttca

SEQ ID NO: 56866 - DNA, 1165 bp, Bovine  19866880490515
ggtaaaaaatgttactgtagttggcaatattataccttaataaaagtaaagtttattaagtgtaaatgagtatctgaattaaaccaagcttgaagttgcaatttttcaaaatacaggaaaaataattaccacttttagtagccagagtcccactaagaaaatagatatcaaactgaaagagtgctgagggaatgaaagagttaatgatcaaagaactgaaaaaaatacaaaatcattaccactcttaggtctgaaggcaaaaaaaaacaatgtttgaaatggaaaccagatatgaatcaaagtgtccaattggtgtcaaaagactggagttaaattattcactacatcaaaatgatagtgtcaaaattctttacacaaaataaagattcacattcaattttcttattaaaaattcagccaataatgtttacccattaattcaacaaatatttgtcaagcacctactataaaccaatctgaagtgcttaaacattgggtacaagaatcattgttcttgcatttagggaacttatagttgagtagggaagattagttattaaacaagtattagcatatataaacatatgcatagatcatgatatatactgcaaaaaacaatggtgcaatgtaagttatttcttcctaagatgtttgattgtctcaaagctgccatagcttttgatagtgatttggttggtgtaagcctttgctgattgcttgatccatattcataatcaaagcaacttccctgtactgacaagctctgctgttgtcagcacggttgtagtctaaattgtattctgaataagttaatgaattttaataaatgcttttcccaatatagtttccatgaagataatctacttcattaatttagtttaaaagtttaaaaatttaaaccacaataaagcataaatgtataagatttgaaattctctttgaattcaaaagtaagggatgtttggggaactattttaagtaactcagtacatgttgctaattacagtaattattattttgtcacatttattaccttcatctttcatagcatgagtaattaagtggcaaaaacaggttttatattgtgatcaaacactattctgttacatctaccctactgatgtcttcaaagaaagtgctgtcacagttttaccagtaaagaact

SEQ ID NO: 56867 - DNA, 1470 bp, Bovine  19866880520965
tgactagcaataaacaaatgttgactgaaagtgaactaaaaatactttacttttatgtaattggttattgaataagaaggacagtcttcctcaaaatttaatgatgtcattaaaatgatataatcagagggtacatgatatgaaatatatgaatgttacttacggatattacatatcaaaacatccattaaccattggggggtttccctggtggttcagtcgtaaagaatccacctgtcaatgcaggggacatgggttcgatccctgaatcaagagtttcccacatgccatgtgcaccactactaagcccaagcaccacaagcatgtagcctgtgctctagagccccggagtcgcttcagtttttcactgaagcccttgtggagagcctgtaatcctcaacaaggaaaacccctgccatgagaaagccacacactgtaactagagagcagccccgactctctgcaagtagacaaagcccacacaaaaagcaacaaagacccggcacagccgtaagtaaaattattaaaagatttagacataacaatttatgatatgacatatttaatttctttgtcacgaaatatgtttcctttgagaaatcagtgaaaaatacatgtaagggtgctatctaaaaaataatagccaatgagataactaagctgttgtaataattttaaatctagttacttcaatgtctattttaaataagaacattgatagaagactaaaattattctttatatgccccaatttttattcctattatttagtagaagtctaaaatataggtataaataaaaagataataaaatatacatatatatgaaattatatagtgaaaatattaactcttctattaattatatgtcattcatagagtgacagataaaaattttagtaatatttaacatgaatttccttaaaagaggcaaacttaaggcatttaaatcaaatgctaatattaaattagtgtatctatttttatttgaattaattaggatacaaagagtcttatttatacagtatggtgacatctctcctgtggttaaatttttttctgataaaagctttagcactttctcctttcaaagactataactgaaaaattacaacaaataacaagcctaacaaaacaacattctgactatattgtcatatttattataaaacacttggctcactgcattttggcattttatacaactgattctgacagtgattaacatggtttgggcttctgcagtttcacccaagagaaataaaacaccaaaatctctgcaggtgtgtaatgggccagagatttacaatctgttctgcaaagtcagacttcaaagacttgaaaaaaaaatcttaaagttggcaatgcctctatcatcactaatatttaaggtgttttctatatttcaaaaggaactgtgtagctaattgcaaagatttcatctccaattgacttctctgcagctctcctc

SEQ ID NO: 56868 - DNA, 1566 bp, Bovine  19866880891317
ctatggttaataagactcttggaaatttttatttatttatttttttaatgtttatatgcataaggtgaaaagtggctctaagggagtgggttacaaccaggaaggtttataagacagaatggtaatcagggcaagaacttaggctgtagcatcaaatggaggaaggggagcatgacagagaaactcaaatttctctgacttcacagtagatttcatgaccagcccttatcctatgtaactcaaatacatttttttttaactgataatacatagtttttgttcactggaggtgtattagggtttatttatttatttatttttaattgaaggacaattacaatattgtgctagtttctgccacacatcaacatggctcatataggtgtacatatgtcccctccttcttgagccttcctcccacctcccaccactcaaatgcatttttataggatactgtacactagagtatctcaatctaatataattggcattttaaactgggcttttctttgctgtaggagactaatctatacactaaaaactgagcaaaatccctggcttctacccaccagacactcagtagcaacccctctcccactgtgacaatcaaaaacatctgcaaacacatccccagaggagcaaattcacccctttgaaaatcatcattgtaaactattctgagttttgtgttctagattcacttatctaagaacttgttggctaaaccagggcaagccttattaacaaaagcatgtcatatcagttctttccaaagaggtaatataacgcaagtccagggaagagatttttacaagtaacttgtatattcagactttaacaaaatgaagagcagcgaagttgacagattgtgcagcagtgccgttggtaggtgtgagtggggtcaattaaaactgtgtgagctgaatatgcattttcatgtgcctaatgatttctgaaaatcatttgctgtgatgcattaaactagccaatttaaagagtgattgaccaaaggaaagaaattgcatagccaataaaattgataacaaatttgggataaagtgagcactaatcttagaaaagctgtttgtgtgtaacatctgcaaggaatattcattatgaagacatatccactgcatgctgttaagtaaattgtaaattaagagtataatatacgtgtagcacaaaaatggataacttaagatttagaagctattttagtgcttggttaaccaaacattgatttcaatgaaaaagctgcaaataggaaagaagcttgtagacagtgagttgtgcttgatctgaaattgggcacaatcaacttcaggttagcatttggtcacttttgaaccactttatagtgtgacagtggtgttatgtaaactcaaacaaacattgattgaaaagtccaaagggacctggcacaatcttttcaccagcacatcttcttttacagcctcattacacttgccagtgattcatgggttttaggcttgactgagaagggtggaaggggctaaggaactcagtatgctatatttcaaccatgcaaatgagcatatttacctg

SEQ ID NO: 56869 - DNA, 1140 bp, Bovine  19866880906941
acggcagcccaccaggctcccccgtccctgagattctccaggcaagaatactggagtgggttgccatttccttctccaatacatgaaagtgaaaagtcaaagtgaattcgctcagtcttgtccaaccctcagcgaccccatggactgcagcctaccaggctccttccgtccatgggattttctaggcaagagtactggagtgggtgccattgccttctccgggttcacctctaacagatgtctatttcagtaaattatgtaagttgtcttctttctcaatatacagagactatgaaatgaccttatataaaactttatacaagaaggattaaattatttggaagttctgcttgagatgatcccaaaaacccattatttgactaaaaatttaatgcctccactgcgatacagcactgtgtaacctagggactccataaatacaggatgaaacacagactttgataagacttagtactcaggcagaaaataattgttgtaactcatgtacaaattaggatattatccatgacaccatgttggcataaatgatttacttaaagtatgtaatgaactcaaagaagatgccctgagaacctgagaatcttcacatgaaacacttatattcctcatagatgtgtgtatgaattgtttctaactatatttctttttatattgtaattcaattgtctaagtgctactgcaaatgtgacactagaaaattcacaactgtataagactcaaaatgtgaaggaaacacctttacacatatataatgacaataaatgtataaatgatataaacaaacaggatacacatttcagctcacatttttaaaactaatagaacaaattgaaacctttttttccttgccaagaatgtgcatttcattatgtaaaagattttaatgctgatttatatgtgaacataaaaggaaattattaaggacagtctttcattaggtttttgaaaagtagtttctaaatatatgcatgtcagtttaatgaaaagagtgatgatagtaatttctaaatgacctacagatgtgtttatatagcacctacctatttctactgggcaaatttttttcatttaatttcacatatatcaaatggcggagttcaggcaattgcagatatagtt

SEQ ID NO: 56870 - DNA, 1884 bp, Bovine  19866880906942
catggtgtatggataatatcctaatttgtacatgagttacaacaattattttctgcctgagtactaagtcttatcaaagtctgtgtttcatcctgtatttatggagtctctaggttacacagtgctgtatcgcagtggaggcattaaatttttagtcagataatgggtttttgggatcatcttactgcagaacttccaaataatttaatccttcttgtataaagttttatataaggtcatttcatagtctctgtatattgagaaagaagacaacttacataatttactgaaatagacatctgttagaggtgaacccggagaaggcaatggcacccactccagtactcttgcctagaaaatcccatggacggaggagcctggtaggctgcagtccatggggtcgctgagggttggacaggactgagcgaattcactttgacttttcactttcatgtattggagaaggaaatggcaacccactccagtattcttgcctggagaatctcagggacgggggagcctggtgggctgccgtctatggggtcgcacagagttggacacgactgaagcgacttagcagcagcagcagcagaggtgaaccaatgaggtcattttaattgaaatccgtggggcagtgtatggaagccaattctaatgcaaattgaatactaacttctatttaaaacacctgtgggttcaattgataccatttcatgttgaactacactagaattaaagtttccaaacaccaatctttcaatgctagcaattcagaagtctcatttgaaatctcattttagcctttatctaaatcatctacatcttaacatttatggttttctactattgattatgtaaaggactgtaaggccttgattctatatttttatatggactgtagaagcacttgagggaatcttcatttgtgtctttggttgctgtcatcttcattgttttatggttataatatgaactgacaggtagtggaaatataaagggattcttgaagttcttcagcatatgcaaaaatggacattgaaatgtggagacttgtttatgtaagtctattaacagctttttcagaaaaacatgctgtgtgtgtctcattagagtggcattactgttttatgactaaaagggtagattttaaaaataataatcaaggaaacactctatagagtgttctttctatagcatctttatttttttggaataagtttggaagtacatgtaattaaattacaattaaatttggaagtacatgtaataaaaatgattaaatgcacagtatgataacaatgtacatttatttctcatttttagtttacctttgtttttaaaatcatgctagttatctttgaaggtgaaaccacaaactgtgttttcaagacatgtttttcctcagtagaattatgtcatggagaaacactatggatatccatcaaagtgaaacctacaaggacataagagctcattattagtgaacattgtaaccttcagatggcttcagcatttctgtcataaaatggcaagcggaatgagagactgaagcacatcacacactcgaaattaacatcactacataaattatggctcttatacaaatctaaaaggatctattttttactttaaagcaatgaattattacaacctccagtctttgtgataaaatgtttcagtgagttcaagttcagtaagatcagtgctggcttcaggtggacattattgattgaaatttgctaaagcatcctggcagatacaatgctacaactttagtcaagaaaccaagccaaggaacacatcgtggttctgatgcttgttctggatagtatgcttgttcctactgcaaaaacctagaaaaaacagaagatatcaaatgtagaa

SEQ ID NO: 56871 - DNA, 1235 bp, Bovine  19866880955358
attacttgaaggctatctaactgcaaaaagttacttaaagaccattacagaaggtacagaaaatgaaatctgttctgaaagcaggatattgctaacatatgaaatacttgtgtttgtcaaagcaagtgacaccacattttctaaagaagaatatatttgatcttcaattcactgatcttatatccttgcatatatatttttttctgtatgaatagatataattttaaataccatgtgcttgtcagatccatgaagtgacttggagaaggccttattttcaaaattatcttgtcaatttcattgtgacagtaacagaggcaggtagcagcagttttcttctgattatattaaaatctcatctattatttagtttaaagctgacagcatatattaaggcttaatgaaggctttcagtaatttcagactaaatttatcttccccaattttatacattttttgtcatttgagggttataatttgatcaaaggttaatttcaagaggagtttttccgaattattttaacattgaataagtagagcatgaatttttgggaaatgtatccatgtgaaactatttttttaggagaactggaatgataagacaggtattaagaaaagcgttgactttttttagtagaaaaatgtaattaccgtctttatccatattctcatttagcactcatcaagtctaacctgtcgtctctcctccctgccagtcatcctaattcatcgactatagattgttttaatcttagtggaaaacatggaactttaatgatctgtgtagtagtatcaaatttattgcatagataaatataagaaaaatatttaagtgaaaaatatgtttaagggctaaacattttgttggggtcttccctggtggctcagtggtaaagaatccacctgcaatgcaggagacaccagagatgtgggttcagtccctgggttgggaagatcccctggagaaggaaatggcaacctactccagtattcttgcctgtgaaatcccatggatagaggaacctggtggactacagtccatggggttgcaaaagaattggaaatgacttgacaactaaacagcaacaacagcattttgttaacaaaaatactgactttagtttttgtttttttctttaattttttaacagaagtcatacttttctatagtttcttttctccaatagttttcttccattggatggtatcaacgatagaaaatgtttgcagccact

SEQ ID NO: 56872 - DNA, 1934 bp, Bovine  19866880971447
agatgaaatgattatctgtcagaaatgttgtaactgccccccccccaaaaattaacaggtggaagagtgcggaggtgtttaaaatatctattaaagaagtatatccacactcctaagattttagacatgttcatagatatagtgagacaggtaagtagacagacagacaaaactagcataatttatctttaatgacagagttttaaagtagatcctgctccttctgtgactctaaattattttgcaagccaagcattaagaataagagtctgttgtgaatatgactgattataaaaatgaaagaatggattttaacacgttgtgtagtttgaaggatctgctcttctctgctctcttgtagtgttcactggcaaatctttgaccttggactacaataggtaatgtgtatgcagcatgaaaaagtctaaaaggaaagagtgaacaaaaaacaaaacagaaactgagtttattcacctatcctcttcaatctgacatttctccagtctctcttgcaactctcctatatgcctttaaaaacaacattactttgtaagtggagaaatattttcttcaatgtatgtattattaaagatgaaggagcaagtagcataaacagatagcttaatactggaaagtgtttccatgtaattgtcaggctagagtaaaagttaaaagtgtgctgcttgtcccttaccctttttataaagatttatgaagatactctttctttacaacagttctcaaaactttgtatgccagcatactaatacaactttaccaaatagacgcaatatactgatacaattttacccaatagatgcaataataggtctgctaaagcaaatatctttttgaaaaacaaaatagacatctcaataaattggtgaatcatttgaggtagtatataattagacttaaatatagacaacctgcagacaattttccttcagtgattcattattttgtcttatttagatgatagacaggaactaggatttctgtttgtttgtttttttttgtaagtacctcatgtgcaattaatataacagacattctaatctgaatattttgaatatttctagctctgccaaataataaactcttttgattgattttaattaaagtaatgaaataataatccatttagaaaattaaaacaataaaaataatgcttggttcttaaaattttcctcttagatataaatttccattaattttaaagcttagcatttttttaatcttagcactgcaaatgattaaataaacatattattttgcttctaaaatattcataaataattaggtagatctgtctttacttattgatggatataatccttagaactcaatatattattgtataaaaatccatgtagtttagcaaaaacttacacgtattctagacacataaagaatgaatacattctaatctaacccaatcagataaatgtagcttgtatgtgagtcctcaaagaagtagaaaagatgagtctttttaaaatttcctttcattataatgattatttataattctagattattgtaggattgatcattcagtataaaagttagcataacactatacaccaattgataaagtcacagagctgaacagaacagattacaggtcagctacacagaagccagacgaagggcaatgcccaggcaaacatctgcttcttcctattgcaattaaataacgggggcaaacctcaactgtaaaggtctaagtagctgaattctcaactttctgtgtattctatacttaccctgccaatattaaaatcatctaaaaataatctgaacacttgcctaacccttatactgccaaataaacctctgaaaacaaacttgcaggaaaggaaaaattccctatgccttcaaccagaacctccttagtcttccatttgttattcttcacaaggagatttatt

SEQ ID NO: 56873 - DNA, 3026 bp, Bovine  19866881435183
tgaaacagcatgaactttttaattgtctcagttttaagtgttcattttatgttgaatacattatacaaagaaaatgtaaattaaaggaccacaatctgtttttctttagatgtatagtgagtgaaagtcactctgctatgtccgactatttgtgactccatggacagcagcctgccaggctcctctgtccatggaattttccaagcaagaatactggagtggattgccattctcttctccagggtatttttctgacccagggattgaactcaggtctcttgcattgcaggcagattctttatcacctgagccaccagggaagccccactttaaatgtataaaaatatgcaaatatgtactcttaagaactttttatagaatgctagacttcaatattcaattgaatatttaattatctgctctctttacacgttaagatttatagccagacaaaatgttgagagtctagaatttattttaaaaaaactaaagtagcctatctttttatctgtcatctaattttcaaaactattccagttaatgatatttaagcaggaattaaggagattaggaaatttgtttaagaaatacacctgaattctaatccagctctatatgaatttgaaattcatactcttcacacttttttccagacatggtgttttaattaattatttactattgcatggcaactctaaaaaaatcctaaagtgcaattaacaatttgaacatatttagataaaattatgatttgcttatataaagttatcaatgaatctatagtctgaggttttatgcttttatgaaatcataaaatttcaaagcacctaatatcaagtgcactttcaaatgatatagtaaaattagtcattcatcttatattctatttattatagcattattctatattcttttatttattatttattttgcattttcattttatgttctaaattgttaacctgaacagcaggcctaaatctattgttcaacatgaatttctataatttaatttgagattaaaactcacatttgtgtacttgtgtgtatttatatgcaaggttataacagataaaatcaaataaagtaattttccctgagttccagcaagtaggcatgttgatgtatttacttcatttattgaattgtatttctgagacaagtaaattaggttgtgattatacatgacattaaaaattttactatagatgcttttaacagtcccctacataatgcagtccaaatacaccaagagtaaacctttctttggttgataggtttttctttatttgatgtttttggtttcattggaataaaaaggttaatcctttagatcttctcacaggaaccaggcaagcagctcatttatttttatgggaaaaaaacttttcagtcttgttctgtttacctatttcctaaccttattctgacatcccaggccttttacttgccatctgtaaggcaagtactcatttaaaattaatccactggaacctatttgcattgaaagtgaagcagtctgttatgctagaaagatcattgaactgggacaaaaatgtctagtatcaactgcactaccgtttagctaagagaccatggagatctacttctatccattttccttcatttttccactatctggaaaatgaaatatctggattaatgtctagatttccttaggcccataacattctcgtggacatattaaaatttaagaactgatagtctgttttatacattcactttaatataaattaatagaattagtttcaggaaaaatcaatcatatttgtaagattgcattgtatctgataaagattttttacaatcaggttttaggtcatgcttccaaatattctccagctttattttttaacttaaaactatgtaacacataaggaaacctcaatcaaagtaattattcacaaacttgtgtgaatagccatgatgcctctcttgacattgataattcatataagtgcactttgacataataaaaggaacactttctaaacctctattaactatttaactgtgatgagctagtttttcagtaaagaaattttcatccagacccttataaactattttatctttcatgaaatatttttaatacttaaaaggtcttcatttaatagccctcatgaaaaaccataaaatgaaatgttgaagactagtttatccctaaaaacaaacaaacaaaaaaagaacccatgagaatcaacatagactggtagaataatgcaattatagaatttattatttattaaaaagttatagaagatttgagcagtcagtttctaacttttctgcttgatgaataagacaactgatgcctatgtggattaaatgactaagtgacttggatgaggtcatgaatctgtttaaaggaaaaatcaatatgtagcactatatgtgcacacacacacacacacgtaaacacacaaacaccaagcacaacaagtactttaaagggagaatcactagatttgactgtgttatacacaaactggcactctgccatgtaagactgaatttttcaattatttgtttagaatcatgaatatatatactcaaaataaataatagacaatacaaatttaaatagctttataaaaacacaagaacatcagttgtaagtcaaaatacagttagctacgtttgctaaaattatgtacaattaaatagtcatctttcattttgttttatattctttcatataacacctggcacagaaagacctgggataacaaagtttttgacttgccttaattaaaaacaaataagaactgctgccttataaaatacattggccaatataaaattactaactagactttaatgttgaacagaatctcatagacatgatgaaaaggatacattcaacccatgcctttaaatacaaacacatatgtaaaagccttggaacccctgaatcagaaatgttttgattcaggacaacagactgtgatgtattactgaatgtcattgctagtcacagcactggggcatgtaggaataaagat

SEQ ID NO: 56874 - DNA, 1192 bp, Bovine  19866881459209
aattactgctacattttcacttgcatattgagctactagtttctcatgcaatagcaatgacaattatttcaatagtgtctatcatatatgtgtattaatactgtatctatctcatatattcaaagcagaattttatcaataaactggacagttaacttggttaactatttcattgtaaatattattcttcaaaaattatgccatttaaaatgcaacttcaagaaatgactgtattaactattttactgaacacagtgagatataatgaaggatgtaacaatcatggcaaaaatgcattaatattaaatatttactgcataattcagtcttattggacacagctgtcgataaaatatgcccttactgttgacaagtagctcctgtgttttgcttgtagattagcttgcagccctgctctatattctttatcttcatcactgcaccagtcctttaattaggcagtgaaatcttctgcatagtgattaggaaatcacagttaagaaggtgttacaaagagatgtttctggaagctactcaaaatagctccatgctttggaaatttctccatgtacagtatcaaggaaacgtgtttgcatttcaaaagcaagtgacaactgaccttcagtaatcaggtttactaaacttttaatcctcaatcctgaaatgttgggtgtaaatagaaaaagttttgaaccatggttggcaaacaatggcaacttcattatttaatctgtgaaatgaggtggttaaccacttttgtggtggaatgcaaatgggttttagattctaagagaatacttgaacttatacaaataaatttgctactattgcatgccaataaaatttgaaaatatatcttataaaatggagaaacaaatccattttcataattatactattaccagtactttaaagtgtgatactttataagaagtactgatttcagaatcaaattttttcatttcagaattcaaagatataactgaccaaggtaaatgacataggactcgtgagtcaggacatatttacagatagttttattattatggacaaattatgcttgttattataacatgtaacattcaaagttattgcaattatataataccaaggaaggaaaaatactgacactagaaaaataagtttaagacataaaaatgacccctccgtttgttatttttatttctttcat

SEQ ID NO: 56875 - DNA, 1975 bp, Bovine  19866880367752
atttttaaaaaatgatcccatgagaaaaataatcatcttataactggatccctttgttgtacgcctgaaactaacacagtgttgtaaatcaattgtttcagtttttaaaagtactgtaggataaaattcagaaagaaataccaaaaccaaaacaaccccgcccccctcccatggcctaaccacaaggggtgcagtgaggatgaagtgacggggccctcccttgaggaaggggtaggtggtttctgctagactactaaagtaatatggaaagcggtattggcgtattggttattggttggcatctgtgaattcactcagcattcaaggtagtaataagaactaatacatgcaaaaagagcttttatctatatcctgtttgatcaagacagctctgggtggtaggcagggtagaatgctgagtagacctggtatgaagaaagttcaatgagtcatctgtggttgcacagacagtaagtaacagaaccaggacagaagtccaggtgttctaactataagcagggctctgttcttcagtgactcctctactaagtagaaagctgtgaggataaaaaagagagtgagacagagctgtgactctaggggaaaaacagttgggaatctggtgtatggagcaggtagcccaggaagggatgaggcgggtggacagccctgcgcctggtggaaggagcggtacctgggagatgtcctcagccagggcgctgtagaggcggtgcacagagtaggcgtggagctcctgggcgcccccaatcagctggatcaggttggccactgcatcatcgcgcacataggtgcctgcctggaggagtgaatgtggcttggtcagcgtggtgaaccctgcccgctcccacccagctctcagcccagcccctgcctcaccgtcgtcagcacacggaggatggtatctatgtgccaccgcttggttggggcgaacctaggggacatcatggctcttcagtcctggcgatgaccctccctggattccaccctctctacctcctgggcacccatcccctcacctctctgctgccagtaggatgccagaggcacagtcggcccgtagatcaggggggcaggactccagaaagccctgcagctcctgggtcatggctcgtacgttagagctattcaccagggccaggctcagttccagggcccgcctggagaagaaacgtgtgtttagacaaggtctcccaggtcaccccatgacattccttggggctcccctttcccaggcacctgtctccttagtcccctttctccagctgctaagctggcccggtgcctgggccctctactctttgctatggttcctctgccctgcttaccggctgagggaggcatcaggttcccacagacattccaccacagtgggccggtgccgctgcacggcactgtgatcagactgcaccagcttcagcaaggacgtcagcgccacgtatctggtcagagcacgagggtccttagcataccctggccgtcagccctctccccacccgtcctgctctggtatggaaataagaggctggtgaatccggagattctggaagaaggagggcagagggtcaagggctcagtggcacagccctgccagacacctgggcctattacctaatgttcctgtcactgttgagtaggaagcggccaagaatgttgacagctagaacctatggaaggcagaggttgggagtcagggaaggagcagcctgctcattcagcagtggggagtgcatggcacagggtgcccagggtggggagaagaaactggagaacaggacctgtctccctggctggagtgggtggggaggggcccaggggaggggcctcggggacggtacccttaggcccgcggcagagcggatgtccatgatggtcaacactgtctcaaatagcaccgcgttgcccgcgtttcggctggtgtccgtgtttgtggctacctgcgtggatgggagagaag

SEQ ID NO: 56876 - DNA, 3793 bp, Bovine  19866880431711
tggaatcacaccaccttccagcgaaatagaggccttgcctccacaaatgttaacctaggggcggttttgccataacagttttctaactgggaccctctttaacaagagatgccctattaccagttgcccgttctatcttatgttaagaaccaagaatgaggtggagttgaagagactaacccaatcctctcctttccccagagcctgggtccttacaacgtttctaagacagccttgctgggcctcactaagaacctggccctcgaactggcagagtcgaatgttcgggtgaactgcctggcacctggactcatcaggactagcttcagccgtgtggtgaggaaggggagtcctgcatcccactgggaattctaaagggcatcttctcaatggaggagcccagctcctgggtcctgagctcccaaccactcccaccccctgccctgggattttccaccctccccctccataccagccatgtgtccagaccagatccccacactatcctttcctaaggtgcacagtgagactgaggaattcagatgccactcaggccatttcatatttccttaagtggatgagacctggggcaacccaccaaaatgcctccttaggacctgaagagaatggagcagaagagggcagtgggtagtgactgggagctgggaaggactgggaaatgaagggggcacctctccatccttcctctcaatagatgtgagggcgggcaatttgtcctttcactgtccctcagaggaagtgattttcctttttcctgcagttgtgggaggatccggcaagacaggagagcataaaagctacctttcagatcaaaaggtaaggctgtcacaggggaggctgaggagggataaagatggaaaggtctggtccctcgaagcccatagcttgccgtctctcagtcccgcagacaacacagccatcctttccttgcttcaaatacacagacttcacaagtttgtgaacagagcgtcactacagtggtgtgtgcagggagtctgcctccttgcaaaaaccaaacacagaggcatccaggtttagcagagcagagccctgggggaggccctgactcctctctccacctgggtgtttgcctccacctctgggtgtccctaaggatcagggaccaaaaccaaaatcaaagcgtgcttttttagtttccctggaatcaaaagagtcatgtttccaaagttcaggttgatgatcctaccattcaaatgaaaggatcctaccattcaaataaaagtctccaaacttcccttgcctaagaaaactagcctcttcccccaaaaggtcaggcaccttcatctggctccctgtcctctaagttctctgcctctttccagtctctggcttccgggagctctcttgtctttagctcctccaccttgtcccctcaaggacatgtaccagcaatgcctacttgaggagggagatgctctcaagtgctcctaaagccattctcatgtcaggcatgagctgcaggcctagtccattaatcagtcagggcattgtcatccttgagccacagtgaatgatctggccccgagcttttcagtcttggatgcgcattagaatcagctgagtagttgtgaaaccacagatgctcaagcgtcactcccagagattctttgttaattggtccaaggcaggacctaggcatctttagtgagggaaggggagggaaggagaagttgagcctctcagatgacgacagtgtgtagctaggatggagaaccactaatccagtccttctaggtttgaagtacccactccacccacctctagagcattctgtggcagttagattaaagtgttccctaactatgcaatcactgatacaaacactgagaattagcacagtctcacaaaatgactttgagacaaaaatagattcctgaaaaagttgtctgtgaattgaagctgtacaaatggaatcattttaaacaaatcatttactatctcacagactgtctgatatttaaatagtatgcacacatgtgaaacaaattattggaagaatgaaatagccaggttatctatataactttggattttggtgtcctgagttctctaaaaaacaaagtatccccatattatatgaatataatgtgtggtggtttttgcagagtacagtattaatgcttctattgaattataacagcttataataatggtagccctattttatggacaattcactgatcctgaaaaattgcctgatactttagcaaattccattccctgtttgatttttactcctttcctttttccctgcttcccaggataggcaagccagaggagtgtgccggcatcgtgtctttcctgtgctctgaagacgccagctacatcactggggagacagtggtggtagctggagggagcctatcccacctctaaggacgtggagagcatctaccagggcagagattgggctccaactccagagtcctgttcccgaatcaatcaactggcctttcccacctctgcctagcatactgctacccttaaaccataacacccccctgccacacacacacacacacacatacacacacaaatcaattatgccctgtgaaaagctccagcattctctgctatcaaggtgtggtcttaggaggattcacgctattgctgtagccttggacaaagacatcccttgagagaacagggcaggcctgctgagagggcttagtctactgtggtaaagagcaactagtattattttctaggcatcagggaaatttgagggaggtgggacagaaggaacttggagtggaaggaactgagttggaaattaacaacttgcaaatgaggtgcaaataaaaaggagatgatcacgatgctttgagtcaatgtgctcatttttcagtgtagggtgcataggtgtgatagccgagcacagcgttaagtctgagtggactggattcccctagtatgttcccagatgctaagtctggatcctcctaaccctcctccttgtctccaggacctgagcgtaatgctgagggtggaggtgtttgcagagctgccagctgggaggaggtggcacgggaattcccaggtgctactctcggctcacacccgcggggatggtgccaagaacatcgcagggatcaccgaggctgggaaagcgggaaaggaaggtcgaacttccccagatgtggccaggtcctctcctagcatcgcccttggcccgcaagttccttccttcgagggtcagagaggacgagccagacgcgtcccgagcaagcagtgaaaagggaggagcctggcaaggatgaccccgcgaggggtacccaggcccacaaacaaaagaaacaggttctgctgacggtgcccgaggagtggatgacacggaaagtgaaggcgctgtgcccccgcccgggagatagcccgggctccaaggcgacacgcacagggcgtcgcacgcgggagccggcgggaggggtgggcgcgagcgcgcgcagggtctcacgcggcccggaggcgcggcgcgcatgctcaatcaggcacctctccgggcggggcgggagacccggcgctccgaggcggggggaggagcgctcgcgcagccgcccctgacaggagcgggctccgcggctgctgcatcgctcagcgcccgggccctgccggagccgggtctagcatgtgccgcggctccccggcggcggtgacggcggctcctctgcagcaacagcggcagcagcggccgccatggccaagtccagcgcggagctcacccgcgagctgcaaggtacgaggctgcggtggt

SEQ ID NO: 56877 - DNA, 1685 bp, Bovine  19866880582172
cctagtagaatcgggatttgtaaagaatgaacaaatgtatgtgttgggagccccagtaaatgcaagataaacaggactgtttagggggctggtactccctttgaagtcacacttttctttgaaagaatttattgtgtgactctaacaagtggaaagagatatatcattgatgaagtcctcaagaagatcactacaccaaatacagtatctggtttcataatctccagtctaatcatataagggccagatctgaaacctagacacagaaaagacctgtgattactggaaggcatttgtcaaacagctctgatagataaaatgaggaaaatagatccttccatactcataaacgtggccattgtgctcccaaagacgtctgtgactcagcttctgatggccagggccactgacgtcccacctacaatcttagcccaacccctgtttctatttcagtcgccattgaggcaagtacagcattagtgatctcagccttaattcatcctcaggctcgagcatgaccactccttcctacttcccacatctctacccctgccgatccgcaggaacatggggccagccctcctaacacctcctttcttgcaggctgacacagcccatcagccagggcctctgttagcttccaggcctggactctgaaaaatcacatgtccaggatctaggtcagagctcaaataggtagagatcgtgctgactgtggacggatatcttagtcacatatctgccccagggagtctctggtcctcacacaaccaggatcatgctctccctttccccagatgctgttgtgaggcttggtgtgactcgtttctttgttcattatgttcctcacacacttgacttcccactgtaagctgaatgtccggagtcctcatgtctcctcatgtcaagaatttaccactactgtcttttaatggtatcggacatatttggccgattacgtgaagaattcctcagcctgtagaaaagagggctctctgacagattctcctgctttatgtttaactacagttgctaccacattcaccaaaagaggaacctgtaaatcctctgctctgtttgaaaatggacaagatggcccagctgctgtccatgtcatctaaccaaacaggggtcaactggtcttattaaaataagacctccctgtttgacagttgccattgtgcatggtttctttacattaaaaagaaactgctcatcccctccttattcataattttagtatttagaatttaaaaagagtttcaaaaaaagtaagaaaataattcaatagaagttgttaaatttggagatctgatttccaaattaaaagggtttccaaaggtgaaaaaacaaacaaaaggatcaaaatcaatactcagagaaaacattatatttgaagaaagattacagtgaatacgcccaaagttccaggcaaaatcaataacaaaagcaacaccatgacatagtttcataaaatttttaaactataagggaaaaagaattctgcaagtttccaagtagaaaaagtaggtcattttcaaagagcaaaatatcagactagctttggctttttctgctgctatgagcaatgcctgatgacactatgctgacatcttctatggaagggataagctgcgactcaggaataatgggccacatcaagccattgtatagggaggcaacag

SEQ ID NO: 56878 - DNA, 3144 bp, Bovine  19866880583018
gatcttcctgacccagggataaacccaagtctcctgcattgcagacagactctttaccgtctgagccaccagagaatctggactggtgggggctgaacctgggcagtgggcactgggtgggcttagaagggtgggcccaggatctgggggtcctactcagcctccctggatctctcacccctgtggtgccctcactcccataggcatcttctgctgtgggccctgctctgtgcagtccatcaagaatggcttggtctacatgaagtacgacacacccttcatttttgcagaggtgagagctgtgcgcctggtgccttcatgggcagcctggggagaccagggcactggcgttggtcctaggttctccaggcgtgccccactgctgaccaactacctctgtgaccttgggcaggtcactcattctacaaatcttagttttcccaactgtaaaaagccataataatggctgccgtgctttctgtgctcaggatcaaaagaaataatgggtatgaaactgctttataagtcatggagtcagcaagtgagtgcaagggattactgttattaatgcccaatgcactgtgaggagcctcccagatcaacttctttcctgctttctggccttgtctggctcagcttgaaaagtctcccagtttcactctgccaggaagctcccaacctttggatccggccttccctgcagttcctaggatccgggaaggcagctggggggtcatgcccgccctcagaccctctggctcattcattcctggctcacacccctcacaactgccctcctgacaggtgaatagtgataaagtttactggcagcgacaggatgacggcagcttcaagattgtgtatgtggaggagaaggccatcggctcactcatcattacgaaggccattggctccaacatgcgggaagacatcacgcacacttataagcacccagaaggtagcagctccccatcccggccagctctggccacaaccaagggtgccttccaagcgcccgcccagccagcagcagctgtaagctcacccttgaccctcaacccccaggctcagaagcagagcggaaggcagtggagaccgcagccgcccacggcagcaaacccaatgtgtatgccacgcgggactcagcggaggatgtggccgtgcaggtggaggcgcaggacgcagtgatggggcaggacctgatggtctccgtggtgctgaccaaccgcgggcagcagcctccgcaccgtgaagctgcacctctacctctctgtcaccttctacactggcgtcgcgggatccgtcttcaaggagagcaagaaggaggtggtgctggcgccgggggcctgtaagtgccccgtccccagcctgtagcacccgcctccatggctgggtagcccagggctggggacatggagacctggggaggctgggtctggggaagcaggccttggtgacaccaggcctcttccctgcagcggagcgtgtgaccatgcctgtggcctacaaggaataccgggtccacctcgtagaccagggggccatgctgctcaacatctcaggccacgtgaaggagaacgggcaggtgctggccaagcagcacaccttccgtctgcgtaccccagacctcagtctcacggtagagcagcgggctgggctggggcagattggagggcaaggcgcagggcactaggccagaagcagtggtgggaggaggtcagggaccagcctgggctcttgggcttcagttcccttttctggaaaatcaggtctcctttcccttactctggggtggcttcagctggggagtaggttggagtttcctctctggctttgggtgagccctccccccagaggcaggaatgtggggtcagggcggtcttcattctaaggagctttccctccctttctggtgggactgtccagtcccataaatttggcccgaagctctgataatgggggtctctttctctctcagttactgggagcagccgtggttggccaggagtgcgaagtacagattgtcttcaagaacccgctgcctgtcaccctcaccaacgtcgtcttccggctcgagggctccgggttgcagaggcccaagatcctcaatgttgggtgagtgcagcccctccttctgccccagccactgcccttgccagcctcctggctgcatgggtcccacctttgtccctctcctgctcaggtcaggacggtaaggtctgtcacttggggctagccagcaacacctcctgcctgagttcaagaaggcctgcttcaggcagtgctcctcggtgtccctgccctgccttgctggcttgttagggagctaaaacctcaaataggaatcactagtaatttgtcactactgtcgcccagcactcaagagttgagcaggcactttcaggaatgtaagctcatttggagacccccaataccctttaaagtacattagagataatcatgatgagcttcaggtcctggcttcatcactcatgggctgtgtgctctatgtatgatcttctctatgcctcagttttctcacctgtaaagcggggataacagtaataacctggctctgagaatcacaggagacaatgcatgtaaaggcctcagcgtggtgctgggcacagcatcagtgctccgctggtagctgcccccctttacagatgcggcagctgagaatcacaggagacaatgcatgtaaagccctcagcgtggtgctgggcacagcaccagtgctctgctggtagctgccccccctttacagatggggcggctggtggccacatctcccagagggtctcggctcctaaggggcaggctccactcctccaccacagtgagcacctcacgcaggctctcgagctggttgctgggctggtgtggtgagcagagtgaacagttcctaaggagagagccctgtgcctcaggccctcatcccacctgctggggcctgatcccaaggggaggctgtgtgcccagcaagtgcccaaggtcgtgttcccaggccatgctgccacctctgacatggactcacacatgcaggaacagggaaagcagagaaggccagaggctgacctttaagatcagctttctggtgacaggagcaggcattttcctcatccaataaagagcacccgaagg

SEQ ID NO: 56879 - DNA, 1099 bp, Bovine  19866880638664
ttagtttttgtccctccgtcttaaggcacaaaggaggaaactgcaggtagggctaatgagggttgggaattagtgaagaaccatgggaggcgggatggagatcgcgtactaggatactgataacttgcctcagtcaaggaactgaggctagtccaggatgctggctcagaaaggcaggcgctgactgaacacgctcccacctttggttcctgaaggaaggctgagatactacatcttggcaacaactagccaaggcttacagtctagtttctgggaggccccatttcccacaaaaggctaacgcttttgtgctgtgctgtactcggagtagcctacgttaggcgctgggagaaccgggtaacttgggatgaaggatggggaacagagctcattccaaaaaaaccgagagataaggaggccaagatgctgctaggccttctctaagaccgcgggggtgcatacaaacagcgagacttcggacaaaggcagccctgaagtaaaagcaggtaaggaaaagtctcctgacggggccagccccctgctctcaaagtcctcttgggcctcccccctacctcccggcacccctcgcgcggagccccgaagctgtcaaccccctccaggctcgggaaaggcgtggttttccttcccggtttctcccttaaggcacagcggccagcccagtaccactgcgtcttggcaaggctggtggtgctcccaccttcactttaattagcatcttcttctcagtttggggctgcacacaggcaagttgctgcttctgccgctacggtcgccgatgcctctccccagcactccgccggcaggaatcacttctacttccgggtcacagccaggctccacccctgcctcgcattccccctctcccttctttccaaggggttccggaaaggctcaggaatatttctgcgtttcgtttcggtagcgtagtgaaagaaaaaaaagaaagtaaaaaggcagccagcttagtcacagcagagatgacaattctgagagtccccagtgagttggggctagtaataagagggcacggaacgaactactcctcccatcatgccaaggggcagctccgcgcgtctca

SEQ ID NO: 56880 - DNA, 801 bp, Bovine  19866880640285
tctaaagaaaaggcagggagggtgtgggggcaatggtctgacttagaattgtgtgtctcagagaagagactctgagcgagaaaagcccttcgtatgtaaacaatctagagagagaagggttgggtagggaagggagtgggaaagacagagacagagccagagggaatgagagaatctaaaaggagagagggaaagaaaaagcaagagataaaaccagagagggacagaaaagaaagagaagggagaagagaaagaaagacaggagaaaaaaacaaccagggggaaggaaagagaaaaaaggcaggtcagaggagtgaagaggcagcgaccaaagccggaactaggccaggcaggtgcctcaggtgaggagctgggagaacaggaatgccaggctgaggtccaggagggccacggctcccaccaccagcgggttggcagctccctagagagatggggaaaaggcagtctcagtgccggaggaccaggcactacgagtcccacctcctgccttggctgaggtggcaaagcagaagggtcccggacacccttcctcagaggagagcagggatatctccaactttggctttggattgcaaaacagccctctactcccaggcagagccctgccttccctctggctccctcaagtgagcccatcccccgctcctctcccctccctgcagcacgtggcccaggcagaaggtgcctggccttagtagcagacgttggcagcaggcgcctttactgcagtgaagcagagagggatgaaggggtgagggatgtggttgctaggaaacagga

SEQ ID NO: 56881 - DNA, 1568 bp, Bovine  19866880684619
ggtcaactttatggattgtgctttgagtccaattctttctgtaataatttccaagacagcccttcccctttaaaaacattcagcttatattaattgagaatttactatgtattcagcactatgttgaaccttttacatgcattatttaatcctccaacaccttgtgagctaggtactgtaataactacccccattcaagtgatggggaccctgaagctcaggaggttttagcaactctcaggccacagagccaatgtttggtggagctgggatgtgacttgagatcttgcttagggttagaaaacagaacattcataactccctgtgcctcccagagttcctgggaggtggctgcaggttgaggaaaactttacatcaacaaggtgctgagccccgggtctgactaacccctcataccaggtttccagggtttgcctagccaggaggtcacggtgatgccaggtggaagaggctgatcaatgccctcccaatacacgccgccatcgctggtctcagccacgttggtgaaaatggtgttactctggattgtggccatagcattggggttggtggtggcagaggtgccaggggccaccccaaagaagccattctcagggttgatggcccggagtcgacctgtcgagaggagaagtgaaaaaaaggaaggactaaccaggaagagttgagaggctcagtcttggaaggtcttgctcagctcctccctgccctgagctagaccctagatctgaggggaaaggctctgcatctccagggtagggggctgccaggaggcaaggggggggttgggggcggtcgttcaggaaaatgttctcactgacaaagttcaccctgagcagtgaggggagcgtcgaaccagaacccagagtatgatctgagggcctctcaccatcactgtcaaacctcatccaggcgatgtcatcccccacacactccactttccagcctggcagtgccggccgcatcatggccaggtttgtcttgccacaagcactggggaaggcggctgccacatagcgcttcttccccgctggattggtgatacctaggatctgcgagttggggagagagaggacaaggaagagagcaccagacagaggtcaggaatggtctgcctgggaaggacagttaggggtcgacagggaggaccaaggtttattcactaattgggtacaccgcctggccatggggcctggggtggcagcaaggggaagccccccaacagtcagcagcttcaggccaaaacttcaggcatttgggctgagtccttggcctccagtctggcagtggagaggcgaggctgaggctgactggtcaggccctgcccctggcctgcccccttcagatcctcaccagcccctcaccagcatgtgctccgccagccagccctcatcccgggccagccgagaggcgatgcgaagggcaaagcacttcttgcccagcagggagttgccaccatagccgctgccgaaggagatgatctcccgctggtcaggcacgtggccaatcagggttttctctggattgcatggccacggctcaccggctcc

SEQ ID NO: 56882 - DNA, 2046 bp, Bovine  19866880790880
ctcctggcattaccgctcctgcctcttgccccagctgcaccctcagccgactcaggaccccaggggcgcctccctgaggatgtgctgctcaaaggtaagcagggtcagggcgtgcttgagaggactctgccatgctgcccttctgaccctgatgcctagacctgctcttgaagctaccactcgggaaaatgcctggctctggggatgcataagatccagcccctggctgcagagagcccaagtgtctacttggctcctgatgtatgcagcccctgggtaaggctggcatataagtgaaactgaaggcaggaagttctccaaagagagggcagtatgtgggggtagacaggagcccagaagggtcctaaccaaagccccatgcctccttggcccctgcagagctggagctggtgcagaacgccttcttcactgatcccaatgatcagagtgcctggttctaccatcggtggctcctgggacgaggtgaacagtacagaagaggtggggattggagccaagaaggaatggaaggatatttaaggagacctgagactatttcttcccacagctgatccccaggatgccctgcgctgcctgcacgtgagccgggatgaggcttgcctgactgtctccttctctcggcccctcctcgtgagtcctgaagcttttgctgaagggtaccatggatggtgggcctggtgccgttggagtgatggtctgtctctgtcccctgcaccaggtgggctccggcatggagaccttgctgctcatggttgatgagtcacccctggctgtggagtggaggaccccagagggcaggaaccggcctagccacatctgggtatcccagggttggtgggtggagtcggggctgggacagggctggggtgggacagtcagaaaagtggtgcagcctgggctttctcttaaccctgtgctcccagctctgtgacctgcccgccacctccctcaacgatcagttgccccagcatacatttcgtgtcatttggacggcaggtgatgcccagaaggagtgtgtgctcttaaaaggtgagccagcctgcagcctccccgctttgcagcagcaccccccatccctgtcttcctctcacaggtgtcctctcctacccctgctctgtctctcaggccgccaagagggctggtgccgggactccgccacggatgagcagctcttcaggtgatgagcacagggaagcacacagacaggagcagggctgtgcactctgggcagctgggtgggatgccgggggctcaagtagatgtctcagactggctactggggatgaccagcactgctcccccaccctgcccaccctcaggtgtgagctgtcagtggagaagtccacggtgctacagtcggagctggagtcctgtaaggagctgcaggagctggagcctgagaataaatgtgaggcccgattcccctgagctcctgcttctctaaggagggcccatcctagacaggctccttgctaggaccttcctaatccccgccctctccccagggtgcctactcaccatcatcttgctgatgagggcgctggaccccctgcagtacgagaaggagacactgcagtacttccaaaccctcaaggcaagttgggtccgcgggagttggcacgggggcagcccaacacgcagagggcaggcagctgacacacagtccctgtgccctcttctccctgccaggctgtggacccaatgagggcagcgtacctggacgacctgcgcagcaagttcctgctggagaacagcgttctcaagatggagtacgcggaggtgcgcgtgctgcacctgggtcacaaggtaagggcgtgcgcatgcgccttccccaccctcgcccgctggcccgcctccctcttcctcaggaccccggcagtgtctatatctgctcctcaggcctcagccaagacacttcagcgtcccccgctttgccttccatctcacatgcccttcttggacgtttcttccttaactcattccatgcttctctccctggggcagaccccaccacctaacagctga

SEQ ID NO: 56883 - DNA, 1499 bp, Bovine  19866880799352
cccatcagtgtactgacaaatgctagcttggcatccaagatgctgctcaagagcctcttcctctgtgaagcccttcctgatgccttcccctgactcatccaaattgagcccttcctcctgtggcccattgcctcctcaatagatccatactttttgcctgtcatatctcaatgcatttgttctgatcatctctgtgggatttttgttctatatgcacacacctccctgaggggcaggagctgtgtcttagtccccagtgtagccccaacccctggcacagtgcctggcacccaagagatgctcaataaattattgccaccttaatacatgagcagctttggggatggaaagtgaagtgccctggtgacccttctgttgtactcatccagaccaccatgttcccaaatgtcttcatgtgcggcatccagacaattgctcctttcccctggcctcaccagggaatgactaatgtcttgtttgctcaagatcagcgcatggcacggcccctcccacaggatgtggccatatgggctgaatctcggggttgggggtagttacgggcaccaggaagatgccttcggaatcagtccagcatatctccacactgggaagcccctatcttcaggaggcttcgtgaccgggatgtgacactgtgtgctattaagcaattgtgtccgtttccttgtctccctgttaaaaggtggaactttgatttctaaaacctacaaggctcagcatgatatgtaatggtctttaagggacacgtgaagatctccattctgttgtattcaggttggtgggcgtggatgagggtatgtgtgtgtgtgtgtgtgtgacaagtatagccccgtgttcttccgtatgtgactgcaaatgtccttaacaaatgtgatgtggagagcgacgtgagaccgggtgtgtctccctgtgtgcatccccaaggctgaaactgtcatggtgtcatggtgagtttatgtgctggcacctgttcgtgtcaagactgtgtgtgagcctgcgagtcgtgggtgcgtatgtctccatcgcctcccggcgtgaatgtgtgtgtgtgcatgcaccaccgcagtgtgtgcctctctgtgatgctgggtgtgggtgtggcaggaggggaagatgtatgtcactgtgtctgcgggggtcctgcctctgagccacccctcagcccgccctcctcccctggctccgtggctccttcccaaccagtggccctgccccccttctccctcccaaccggtctgtgcaagtggggggagctggtgcttcggcccccccacccctccccatccaggccccataaatagcaccagagccggagccggagccagcgccagcggctggagcagcaagggagtcagggccagggccagagagccggagagaggagcccccgactagagtccaggtagcccacccttcatccctcgcccagccccagcccagcccaagccggcccagtctccatacaacattgcccccggccc

SEQ ID NO: 56884 - DNA, 714 bp, Bovine  19866880804484
tcttcttaccttggtggtgagccccaggtgctttgcttgatgcctggagagaatctcagtgacactgacagctgtcaggtgtgcaggacctcagtgtctgggcagctggccactcctctctgtgctttagctcaggccatgcctttctcctcctcccaggacacacccaacagatcgccatgctctctttccagccatcactttgttgagtcgtcaaagccccataccaggtatttaaagacaccaaatcatattgtgtccatcagactaggcctcttaaacacctttgttaccatcacagtgcacagtgacctctgtgactttctacagcactgtactcatttgcttccaagaccactgttccttttcttgtattttgtgttaaccactgttcattcagtcgtccaagtcagaaacctcagaatcagccatgattcttcctctcacttcttccacatccaactgtcaccaagtcctgccaaaattatatctgctctgtgtaagctgacctcctcctcatcccactgttactttatcttacttgaggtggtcatggatcttgcctggagtagagttgtagcttcttttctgctgttgcttccaaactaagctgaggtgatctttccaagatgaaaatctgatcaagtccatctcattgctaaaattcaacaatggctctccatcaacttttttcttttttcaaattttattgaa

SEQ ID NO: 56885 - DNA, 1416 bp, Bovine  19866880813426
ccaggagcggagcccatacgtatgctgcggatcgaggtgagctgtccccctgcacacagagtccaaggcctgagtcctgcgtctgatggcccaggccccctgtacccgctccttctgcctccggagtcctgccttcttgcctccatttctctaccccttccctcgatgcctgagtacccataggctccctcagcctggcctggcctggccctgtggcatgtctctcagacagaaaatgaaattgtcacctctcctgacagggtgaactggacctcccagaagtcagccgccgagaattggacctgctgattgctgaggaggatgaagccatcttgttagaggaacgtcggctaggtaggacccgcctggcagtggacggtcagaccccaggcactggccatctgggccgggcaatgttcacatctcttctgtgtcctaagcttgatcctctcttcacagaattaaaagaggagccctgggccccagagcgggagatcacagtacccccgccctcgcctttagctcttgtagggtaagggcaggagccccgggccaggtaggggtcagcgctgggagggtgttttcatcctcttgcccatttcccctcagggtggaggaggcagcagagccacttcccagggaggtcctggccccagaggagctgaagccggaggtcccacttcccggtgagtacctactaaaccagggtccttcctgggggtcctggcacagctgctgcagacaatgccctgtaacccaacttgctgaagggaggaccctctagcttctcacctgggtggctttgagggcaaaaggtgtggacctagactgttgttgcagaggtgacacccccgctggagctgcgtccgccacccatcccagtcagccctgaggtgagtggtgcccctccacactgcctcctctgccagagctcctcacccattttcagtttcctcaaggcccctgctggcttccacaggactttgtccaagtttgtacaaggtagcctggtccacaccccattttatccagcctaaacttcccagatgggaacctcatacagtggaggctgcaccccccgagtccccacccaagcccttcaccagggcacctctagggattgggagtgtggggcctatttacagtccaccaggacctcaggaaaaagagtaatgggtagccttgcccccacctcccctccccattcagtggaggaggcccccagtccccccacctcccaggggcccaccagctcgccgtcgccgccgccagttgttattctgggatgaagagactcagatctcccggaaggaattccaggaacaactgcaaaccagagcccactgcagggagtgtgtgagtacaccccagcctctggagggatggagggaggcaggtgcatgctggccatctaaa

SEQ ID NO: 56886 - DNA, 3243 bp, Bovine  19866880829623
ttgaagttgtatattaccgcagcataacctagtttattctgactgagagagaaacatattttcattcaagaagcatcagatggtctgtgagacaaacaaatcaacaaaaaggcattcttgtccattttagatcatcagttccaagaactaagggagtatgcttttgagaacaaaatttgtacattatcattgccatgcaagccaaagaagtgtttggcaagccttggattatcaactttcaatagagccccagacatattctctaccttaaaaaatcactagtcccaatttagaggaagtttaaagttgttgttcagccgctcagtcgtgtccagttctttgcgaccccatggactgcagtatgctaggtttccctgtccttcactattgttttaaatagtttaaagttacaaaatgctaaagagagatgttaaggacatataagaagttaaaaaaaaaaaaagaaagaaagaaaatgggagcactttggagggaatcatgagcagctgtcaggagcgtttttacgtaaaggtcaaatcctgttgcgtaccgggggtctctaggcctgtcctcctgcactgctggttgccatacgggcccgcctagtgctttgacctggggaccagcactgtgatgttctcctaacttgtgttattctgtctcagatctcactcacatcatcccacatgcagataactttacataaaaatgcaatgagtgagggatcatgactctttttaatatattcccccagagggacttccctggtggcccagggttaagactccacatttccaatgcaggggatgagggctcatccctagtcagggaactaagatcccgaatgccttgcagcacagccaaaagataaaaaaatattaaaaatgacaacaacaaaacatatgttctcctagagcagagggccccaaaaccactgcccccgccccaggccacacagcaggaggtgaggggtggaagagtgaacaaagcttcacctgtgcttacagctgttccccaaagctgttattaccctctgagctccacctcctgtcagaccagcagtgagactagattctcataggatgcaaacccgaaaggtaatgaggttgaatcatcctgaaaccattcccctacccagccaccccatccagccacacctccagccctagtcagtggaaaactgtcttccaagaaaactgtccctggtaccaagaaggttcagacaagtgccctagagaaagtgatcaaactgggtactctagttccgctcactttagcgtaaaaggaagtgccaatgttcttccaccagctggttgaggtgccttaactagcactgaacaagttgactataaactccttagatatgagttgtattttattcatctgtgaagagcacggtaattagtgaggagcctgctttggattcagccagattccagctaggatattgattccatcacttaataactggataatcttggccttgataagcttaacctctctaatcttgtttcatcatctgtaaaatggggataataatgcctgactccattgacttgttgtggaaattaaatgtgacacttctttgtaaagctcctgatgcagctcaaaggtctttgttgagagcttggagaaacagtggcttccatccaaccaagagagtgtgatctcagaagagactgtattttatttcagtcactcagttgtatccgactctttgtgaccccatggactgcagcacaccaagcttccctgtccatcaccaactcctggagcttgctcaaactcatgtacatcaagttggtgatgccatccaaccatctcatcctctgtcatccccttctcctcccaccttcattctttcccagcatcagggtcttttccaatgagtcagttctttgcatcaggtggccaaagcactgaagtttcagctttagcatcagtccttccaataaatattcaggactgatttatttcctttacgattgactggttggatctccttgtagtccaagggactctcaaaagtctccaacaccacagttcaaaagctttgattctttggtgctcaactttctttatactccaactctcacatccatacatgactactagaaaaaacatagctttgactagatggacctttactggcaaagtaatgcctctgctttttaatattctatctaggttagtcatagcttttcttccaagaagcaagtgtcttttaatttcatggctgcagtcaccatctgcagtcattttgaactgttttagtctccatcaaatttcaaggagaattcctttgccagaggctgcaaatgctatcatgctgaggttgaatagataatgtttacctcaagggaaaggattggtttccattttatctgcattgtttgaatttttatatgaattaaaaatacatgacattaaaaataaatacagtttttttaaagggaaaaaaatgttgagttagcagggttgctggcttatttgctgaatcttttagctctttcaagggacagcaagagcaacaaacagaacatactaatatttatctatattaatacaaaacactaataattgggcttccctggtggctcagctgtagagaattcatctaccaaagcaggagatgcgaaagcagggtcagaaagatcccctggggaaggaaatggcgacccactctagttattcttgcctggaaaatcccatggacagaggaaccgagagaagcctgctgtctatggagttgcaatgagtcggacaggacttagcaacatttagttgcaacaacaaaaagataagtatccatattaataagggagtcccaatcctatatggacctgaaggtagaaacaaagtacaataatccttcacagttgcaccaaatctttgcaagactttcatttccttgtactgacagtttccacttcccatgattccacttataatttttggattttaccatggtgtgaaagtaatacccacttggaatttttatcttttttgagctaatggcacaagacactctcctgtgatgctgtgatgctctcctgtgagcaggggaacaagtctaagctccgagacaacacggtgatcagcagagtaaacaaccgaaacgcaggcaaccattctgcttttcacttacagtacagcattcaataaattacatgagatattcaacactgtcataaacaggctttgtgttagatgatcccgcccaactcttggccaaaataagtt

SEQ ID NO: 56887 - DNA, 989 bp, Bovine  19866880851266
gccccagggtgcactcggtggagccgaggaaggtgtcgttgcggggactggtggatccgtcctcggcgtcaaacacatggaactgcaggggctgcttctcctcgaagaagtactccagggccagtacgcgggagaagacggggctggagcaggagcgcagcacctctgtgcgctccacctgcggcaggaggggagcccacctctgggaacccgggctgctttgctctgtcccggaccgcccccggtcttgccagctttcctcaggttcccatgccccagagactggctcctccctccctgggctgaaccccaagcttagggtgctgcctgcccctaggaccatcagccatcaggggctctcatagttggaagcagtgccactgcctttgggggccatctcaggaccccataggaccctgtgagctttggtccctgtgaaatgctttgtgtgtgtaacgatggcacccgcatctctatggttacccacacagactggaagaggcccctgagagtcctgaccatccctcgtggctgcccccacccagcctccttcctttgcgtcccggaggtctgtgaaggagaggccagccactctcacctccacccactgctcatcggagtggagcttgagcagcacacaggggtggggcttggtgagtgtgtctcggtcgaggaggccgtggcaggacacccgcagctccactctcgaggcccccagtgtcatggctgggggctcgggcacccaggccatctctgggtcggacatgtctctgtggggacagagcagacactggccactggaagggggacacctgccagaggagggggtctgtctctgggagcctgggccccacccccttaccctgcttcccaaggccctggcatctcatggatcttcttccccctgacctcactcggcttcccctgagctctgagcctctcactccagtgagtgctcttgtcacccctgctggccttgtatgcgtgga

SEQ ID NO: 56888 - DNA, 855 bp, Bovine  19866880917784
ggaagtcccaatttttctcattttttaagacccttcagagagagcaaccagtcttccccactgtggcttcatgtcatttctcagcccatgtttgcctctttatacttttccaggggtctcttttacctggtagccctggatttgtcagtctgaagccacaggcaggagggacgtcattcatgtgagattaaaaaatgaaggggattgtcacctgatttctgggctgtgtatcttgttctcagggacattgacaaggtggatgaactgatggctgacatcacagaacaacaggaggtggcccagcagatctcagatgccatttctcggcctgtgggctttggagatgacgtggatgaggtgactgggcaagaggggtcagggaatgttgaaggcatgggaccagccagaaggaatgcccaagagaattgtggggcaggtttggggggaactccaaaagtatgtttttggaagtagaattttcctttgttctgagtggcctgtcctcccgtatccaggatgaactgttggaggagctagaggagctggagcaggaggaattggcccgagagttgttacacgtgggtgacgaggaggaggagcccccggtcgcactgcccagtgcaccctctacacatctgcctgcggagccaggtgcccagggctcttctgtcatctcaaggacttgagggtgggatagacaggggggaaattattcctcatccatcctgcctcaaaggatccaggcagagagggttactgctacagttgcataggttgttaactgcataagggtacctggctgaaggggaatggggacttgagatccagcttgtccttcaccccacaaaccatgta

SEQ ID NO: 56889 - DNA, 2418 bp, Bovine  19866880976349
ttctgtacagttagggggaaaggaagaaggagatgtcaagggtgaaatgtatctctaacctgataatacccaacaattcttggaggcttggtctataaatacaggcacccaatgcctagaaatgcctctaaacatagaagttcctcaatacatattttttgtgtgaattaaagattagataggacacatcttccatccatctttttactccagctattactatggcaaccaatagcttgcccctgtcacctgagagtaccagcttgcaggtatagctcctatcttttacgcctcttgctcgggggcgtctttgctgcagcactgtggaatacctaccattttctgacacttgtgtaaagctggaagagtgagggaattaacagttaaaggggaacttttgaccactgggggtgagggtgagtagacgaatatcctgtctctggaatcacattctgtatggctccacagaaagtgctgggacaatgttccagttgttcgaggtggccaccagctccacatcacttgtttggatggcttttccgctttcccatttcactcttcccagttccccatttttgtcccctgtggttgctctccacaataacctacctgcatcatctcattcttttttaagggtttgattttcggcggtgggggaaggccactctgagacagattcctacataaaatgtggtatagtagaattagcactggacaaggacccagaaaacctgggttccagacctagctttctcaccaatctcaaatgaagaggagtgtttttattactattttcagatgtacatgtactgacaggaaaagatctccaagtcatttgttaactgaggggaaaaaaaaaagcaagtcaagaaaaatgcttgcaacatggtctgacatacacaaaaagggcaggcatgcgtgtgtgcaagctcagtcgctaagctgtgtctgactctttggaaccccagggtctgtagccctccaggcaactctgtccatgggattttccaggcaagaatactggagcgagttgtcacttcctcctccttcttcccaaccttgggatacaaccggggtctcctgtgcctcctgcattgacaggaggattctttatcactgagccacctgagaagcccagccatatgtaccatatacaggttaataaacttagacaaaatggtgggggatcacagcttactatatatttttgtatggcttgaatcctttacaaggagactgtattttgtgtaatttagaaacaacaagaaacgtccgcttccaaggccgttgagtcacgcttgtgaaagtggagagcggaagtcaacgctccacgaatacaaggtgagaaagaggagctgtgctcagatgtgcgcgctaggggatcggggaccaaggtcgggcggtcgagagaccggacccgcgggagggagggcggctgggtctttgtggtcgccagggggcagatgtgcggagcaacccaaacctacaactacccacttttccccgggcaggacttcgcagaaattataaattccatcccttagctgcagttcagacagatccgagggttttcagagtcgaggggagcccccccacctctgccccacgaggaaagctagcgctctgagcagtctgcaggcttgttcataccacatttacgcgcaacaactcttttctccgcccgcaccacacctcccggcccccacccgcagaggggaaattgagtcactggaaggcgaggccagagtctccaggggaatgtgcgccaacgccagtcctcagggccttccagatgctgggaggagggggagggacctcaggaaaatacacagagtggggtgagggcggggggagcggctggctgggcgggagctgagccagacacatggagaaacgctgcccaggatcaaaggaaatatgacatttgaaaagaatgcgcacgtctgctagtgctgcggagcagggggcgggggggctgcggggtgcgtaggcggcgtgtcggggatggtgagctagagcaggggcagggtctctaccccttcccgccttgcctcggcttcccacggccctcggtcagcctcttaggtgcgggttggcagtccgtctcaggatgctcctcactctctctctccttgggtctctcctttctttatttccatgatgaagctggaagggaaatgtaacctgaggcgacaaaccaaagcgggggtaataagaaaggaaaaaaaaaatcaaaccaggccacctccccgctcggcctcggaacattcttctctccccgccggcctggcttcttctccccgcccctccggcgtcgcggtcctgggctcgccgccggggcagctccgcacgtcactggggtcccccggggctggggggtccccagggcgggccggagggagggcgggaggggagggg

SEQ ID NO: 56890 - DNA, 1138 bp, Bovine  19866881034331
agattctgattcccttgtccctgctgtgtgctcccatcacatccccatcttagtaaaaggattcattagatcatacagtcccctcctggataccctccaatgtctttggcccggggtcctgcttcctccctgcccacctcacaggctttcccactgcccgctccactggcccctctcaactcaagcccttggtgttcatattcttttcacgtggaatgttctttccccagcacattaaaataactggctcattctccatcttcagcctcagctaaaatgtcagatgcttcccctccctctcctgcttaagttagttccccccacaggttatttccttgagagcaccagttacagactgtgattgtttccttgtttattgtttttctctcctaagctgtgagctccactggggacctcatcttcttgtccactcgatcattagcatctggagcagttccctgcacccagtgggtgctcatttaatttttcttgcatgaatgaatgaactgttatcttcagcccatatacagagtcacttctctctccctactgtagctcccatcccaaatctcaaagtatttgagcgtgaaggacttcagctgaatctttcttttgttcgaccccctggaacccctactttgctgttaatcactgtcactgccaccaacacctcagggggtgacgtcacccacttcatctgccaggcggctgtgcctaaggtttgtagaagaccaggactcagaggtagcctggatactccaggagaaaaagccactaagtagaggaggcactgggggtggagggagggtgagatgagaagggagcgactgcagagacaggcacttggggagtcgcgggaagagggtgtaaaaactactgggtgtggagtggttgcctgagccagccagctgccttactgtgtgctctgtccaacctcctgtgttcagagtttccagctgcagctacaggcccccagtggagacactgttccagcccaaggtggccctcccatgacccagctgctcagaatcctcaatcctaacaaggtgagctccaggagcccctcgaggctaagacctagggcagggaggagtcatctgtgcttaccctggtcttcgctctcctattcctaggcccc

SEQ ID NO: 56891 - DNA, 1621 bp, Bovine  19866881126380
aggtgaagagggccttaaagggactatccgtcccttcgaatgatgatatagaagaccaagaaaagaaaaagactggcccaggatcacaggatagtgacacccttgacccaagcactttccactaaaacaattgtggggaaaatacaagaacattccctttcttccaacagtggaaaagattctgctaagagggctgctgacttgtgaaggatttttgaagaggggaggagtgaagaggaaggggctgtcacacatctgcacacactcacatacacatacgtgcactcacaatctcacacagacacccagtggtcccagttccagccttcagtgctctccagaggggctgccctggggttctggttgtagccctcctgtctggctgtctcacttctcctctccctcccaaagcccagctgctgtcattttgtgccctgccaaggaggagggaactgcagtgacagcaggagtgagaggcaggacagagtcgtggggcctggagagggatggagagagagacgccaagaccaggtgaccaggaaggagtcccagagagagagctgagaagcaggttgaggggtggtgagagcctgggggagaggcgggaagaaccaaggagcagaaagagaaggtttgtgggtcacagagccactcagccatgctgggaacaaagcgacactggccgccaggtccctcactcagcctggagttgcctttggccctcacacttctggccctgagggccgggtgggcccaggaggggacagagccagtcctcctggaaggcgagtgcctggtggtctgtgagcctggcagagctgccgcaggagggccagggggagcagccctgggagaggcgccccctggaagagtggcatttgctgcagtccgcagccaccaccacgagccagcaggggagatcggcaatggcaccagtggagccatctacttcgaccaggtaatccccctaccctgcaaagacctggagtcactgtccaaacccactctgctgctaaggaaatggccctgctgtgggtcccgctgcccgtctcctttcccttcactcccaccataccttccttccctttctcatcatttcttttaaatctgtccattcttcctgtttagtctacttgccaccccttcctatccttactcactgccccttcccccaatgccgtggcttctcggagccccaagcatccccgagccccactcagcagggtctgcttcccacaggtcctagtgaacgagggaggtggctttgaccgcacctctggctccttcgtggcccctgtgcggggcgtctacagcttccggttccatgtggtgaaggtgtacaaccgccagactgtccaggtgacctgaaccctaggccctgtcccatccctggctcaggagggggagggaggaggggagcgcaggggacccacaggcagacctccattaagctacatcctggggggccaggagcaagggtgggggagggcctgcttagcagagattgggaaggaggcacagagtgcaatgctggccacctctcagtcatccaggagggcgcactgagccccagcttccagagtgtctctctggggcggagaaaaggagggaagtggggttc

SEQ ID NO: 56892 - DNA, 1023 bp, Bovine  19866881152819
tttttcatgattagcaatcctgaaactgggaggtttgagtcaagcagacttaagggaggaagtgattcttaaatctgcttcccaagaaggtggggcctggttttggaaagaggacaggaagggcatttcaagcacgtgttatgacaggaaggtgggtgagagatagccaaacagacttagctggctggcagagactgaaccaggtgcctgtagagataagagcagtggagccaagacaagcctcttgctttaaggcaaaaggatgtgtcaggagttatatttggcctcctgtgtgggataagtgggaagcaggcaggtgtctgaggccacagtctgaatgatgcttgaggaaaggattttactcccttctgtgcagagaaaagagcaagaataaccgagtactgacctggcccagacatcctatttggggcactcaccacctatcatgattgcacggtgaggaccagtgcattcagtgggttcccacagaggtcaagttgcttgcccaaggccacacagctgggaggaaaccaagtgcccctaacactgcgctcactcaccgagtttgtgattagtctctctaactaatatgtataccctctgatctcaatcctgtgctaactgaacaccaatcaaccaaagtcagatgactaaaactgctgttgtcgataacagaagagggcagggtgggcgcaggcaggaattccacccagtagggaatggggaccacgggaggcagagttgagagacccaccgacaaactctagtagaggcatgtcagggccagacttgggcggtggggtgaagaatcctcactggggagtgaaggaaaaaatagactgtgaagagaggttctgtgaccttgaagccaatattaataacaactaaattctttacaaccaggataaaaagaaactgagattctgcccaaggtcacacagtttgtaagtgatgcagcctggtctcatgctgaaagtcagggtgcccttcagaggacaactgaaatcaccctttatatacaca

SEQ ID NO: 56893 - DNA, 813 bp, Bovine  19866881159065
ctcaaccccatccgcgggacataggacccgcatctgctgcagccctgtctcctgaataccctcagcatctccctctggacacagggctgcccaggtgtcaaggcccagcctggagctctggcccctgccacaccaggtgatagaggccttgaccaacgtggtcaggtccacaggtccaccccaccgggccctccaaagatccgtggctgatctagcccaggagactcagacctcaacccagtgccatggagaggggacccagacctccaaccagaggcccactggtcctacccttcccctaaccctccatactgtctttacaaggctgggcctgcacttttggggggaggggggtaagaaaagcattctgggagtttcttggacctgcccattccctatctccccctatttatctcccttttcttccatcccctatctcctcgttcttatctcccttttgcaggtggcagattttggcctgtccacatttcagggaggctcacagtcaggggcaggatctggggagtcagggtgcaccccagcctacttggccccagaactgttggctaatataaaccagaaagcctccagggccagtgatgtctacaggtaaggcacccactccaaacatatatccaaacatatatccccaatttctacacctgtctggatccttcgaagggatgctgtatgaaaagggatcttgccagcagttgggtcaggcctcagctttgtgtctactgcagctttgggatcctaacgtgggcagtgctagcccggaagagaagctgagagtaagacagactctgggat

SEQ ID NO: 56894 - DNA, 1227 bp, Bovine  19866881229059
ttggcgtctctgccccagcctttcccagatgcctgagagagtgggccagctgccctggctgcccacggaaaacacagctgctgtacaaggtacactgggtctaccactcagctccacccacagcccttccagcctaggggtgtgtggatgaggacggtggacgagaaggaaccgaggggaaagaggagcacaggggctctgggtcaggtccctggagctccagggcaacagacagaggtaagttgagttgctgagtgaattctgctggccttagctggcatcactgactcaatggacacgagtttgagcaaactccaggagatagtgaaggacagggatgctcggagtgctgcagtccatggggttgcaaagagttggacacaactgagtgactgaacagcatcaacaactgctgtaaaagcaggaaccagtatttcttgagcttgcctatttcatgggtttgtgttataattttcctttgtttccttgtcttgagaggtggtacccagactggaatgaaagagtgctctaggggccacgaaaatgtggggggataagcagtgcagtccatgtacccgtattctttgtccctacctctgaggaggctgtgctctgtttctagaggtcacttcctggggtctgtgtgcggctgtgtgtatgtgtacacctgtgtgcactgtctggactcctaaaccccagctcagcatttacacttctagggcaaagaccagtcagaccctaaatagcaaggttgcagttggttaaagattcatctcttgtaatggagattgtcattcattattcattgctgatagctgggccccggagtccctaagtgctcaaggccaagtccaacccgtcccagccccgcccctgcctctcactccagcttgttctgaatatcctgtcccgcctgctccagtagcgccccgcggatgaagttccggggcacggtgacacgctcggccacgttgctcagcatcttgttgtgcccttcggccacccgcatggccacggggcataattcctgcgtcaggctgaccatggactccaggatcacctagtgtgggacgaaaggaggccagagccccaaggaggtcagggctggccccacaacggaagagactgcagcatgtctagctcatcaaggtcacagggcaggttagcagcagagccttggacactcaggcctccccacatccggtcagtgttcctgccatcctacca

SEQ ID NO: 56895 - DNA, 845 bp, Bovine  19866881238685
cttcctgccattactgctctgcaagacggtgagtgctctgttctcttccaaccctgttcctcccgggccccagtgccctcctcccctgtctgtccccgtcccgggctgacttgcactcctcccctcaccagaagcagggctgcacagtggcagagaagtcttttgcagtgggaacactggcggagtccattcaaggcctgggtgccgcgtcggcccagtttgtgtcccggctgttccccgtgctattgagtgcctcccgggaggcagaccccgaggtacgaagtaatgccatctttggactgggtgtgctggcagagcacgggggtcgccctgcccaggagtatcctcagtttgcaggagggggggcctgaatgtggttgggagcgtggccccggggttcgggaggagagcggtctgcccctgtgcctgttccttgactttggaccagacacttccccaaactgctggggctcctgctgcccctcctggcgcgagaacgccatgatcgtgtccatgacaacatctgtggggcgcttgcccgcctgctgatagccagtcccacgaggaaaccggagccccaggtaaggttggggggcatcaggcaaggccatggaccctgctgcagagcgtgtggggccaggggccaaagtcttctgtgtgtccaggtgctggcccccctgctgcatgccctgcctctgaaggaagacctggaggagtgggtcaccatggggcatctcttcagcttcctgtaccagagcagccctgaccaggtaaccccgatattggagcccttgcaaggggcttgatgctccagtctcattgatgggcagagttagcatcagttg

SEQ ID NO: 56896 - DNA, 724 bp, Bovine  19866881247933
cctggttcgattcctggttcgggaagatgcgctggagaagggataagctacccactccaatattcttgggcttcccttgtggctcatctagtaaagaatccgccagcaatatgggagacctgggttcaatccctgggttgggaagatcacccggagaagggaaagactacccactccagtattctggcctggagaattccatagactgtatagtcatgggctcacaaaaagtcggacacaactgagcgactttcactttccagatcagctgtacaaactagaccttccccaggcctaaggctgaaatgttatcagactgtgggctggcttggatgtggttaggcatgtacacctcttgtctctctgcctggggctgttgctcccagcagcagagtcctggaggctggatcagctacaagatgaggaagactaggaacatgtctgagttccaagaggtttcctgggccggcacaaggcagcgctcattgctactcccacacacaacaatgacacactccctacaaaagacactgagacacacttatagtctaacagggcttccctcaaatacccagccacccacagttacacctaagttccacctgtagcctcagatataaacacaacaaattcccagggctacaactgccaggtcctaggccttgggttcttggtccccctttaagcaacgcccaccgcccccccaacccttccgtatccacgg

SEQ ID NO: 56897 - DNA, 1318 bp, Bovine  19866881248154
cagttaaccagatgcgaagaaaggaggaagaggagaacttgtgggcacgttttgcaggccaggacaggcagtagggacatcacttctgctcccattctggctttataactatgtcacacagccaacacccaatggcacagcagatagtattcctgacagcccgaaaaaaaaaaaaaagaatcaggggattttggtgaacaatggtgtgtctctaccacaaaagctcacacagaaagccttcatctctcaacaccaacttctctgaagtgcccaggaacacttaccccgctggctcctgcctccctctctgatccagtcgaatctcctgccaccagccccctcactcaccctgcccccatcccatgggccttcgttcatttcctgaatctcaccaagcccatgcatcaccccttctttctgcctggaactttgtctcaccagggctgagccttccttgtcatttatatcttggctccatatcccctccacagagacctttctgtgactgtcttctgcaacattgtccccatctctagacacttctaagacgttgtcctgtggagaaatagagctgagtgtttccagaaatgaacgaatacacaaaatatcaagcaacatgattaaagacaaatcctcacctctgctggagacatcagagtgcaattacagactatcagagagaaagaatgacttgaaagaacttcaaaagtattacctcagcaaaaaagaaaatgaatcggagaggaggaatagaatgcaagaggcagtagtgggccaaaatagcaacaaaacacgttagcaaatctaatctttgattgatggtaaattataaagctatattgagaggttaaaagcatacaagaatttaaatactagacaactatgatgtggaagttaggaagaaagattgcagagggaaattaaagcatgctatatctttagtggaggagaagaatcaccagtttcattaacttttgacttatatagaaaaatataattaagtatgcatggttttaacctagccacaaaaaatgggtatagaaacagaagttactgcttctgattaatggaagaaccaagaaaactttattaatccaacaaaaggcaagaatggagaaaagggggaaaaaaaagagaaacgtggggaaaaaaaaccttggtaaaggtaaaaaaaaaaaaaatccaaatacatcagggattgcaaaaaaatgcagactaaagtcaactattcaaaaatgaggtgtgtcaggacttccctggtggtacaatggatagaaatccgggggcatgggttcaattccccggtctggggaagatt

SEQ ID NO: 56898 - DNA, 831 bp, Bovine  19866881380572
gcagagagccctaggaaggccaggctgcagccttggcagggccccggggcactgcagccctggatgggcaaccatgcctgtgaacccagcaggccccagaccctggctctgtccctgctcttcaagagggtcagcccgagctccctgcagaggtgacaggctcaggaggatcctggggaccaagggctaaggaaactggagagcagaaggagacatccaagggcagagatgtaggagcagaggggcttggaggggaaagtcctggcgtccagggctttacaggggcaggggactgggagggctatgcaagaatgtcttttcctgcagtttctcctctcttcccatcccccagctgaggagagcgcccccaaccatggctgccagagccccagcccagcctcccaagatggagaggaggaaaaggagggggctgtcttcccagagaggacggtttctaccaggaatgctaaggtgagagccagcaaggctgtggggagggacctttgatgaagcaaaaggacaatctaactgacccagcttccttctttgccagctgcaggaccctccattaactctgaagcccccaaagcccgtggctgtgcccaggggccgccggcccccacaggagccagggggccgggaggaggtcgagactgggggtgcagccccaggaatgaacaaaccccggctgcagctgggctcacagcaagaccaagaggagcctgagatccaaggtgcgccacctgctagaggggccggggcacctctggggcctcgctgcccctcccctcgggtctcttcctgggcacaggatgagtggcagacaaccag

SEQ ID NO: 56899 - DNA, 1234 bp, Bovine  19866881496374
ctttccttctgaagtccggaacccccctcccccaagtgccctcatgcccaagggcggtggtggcttctcactcttgccaactctagggtgtgtcgccacctactattgctttcctgtaactctgctccctttgcaagtagagcctccattaaacttgtcctaaattattctgtgcaactgtgctgttgaacagacacacctgacagatacaccctctgaggataaaggcacaaagaacaggttgatgtggttgttccacagtccagaggtggagttcgtgatggaaacattcatttggtgtggtgtgcttttcagagccagtagccccagcaaagataagctcatgtgtgagatgaaaatcagagaagattttcatcgggaaaaccattatgaaaactagcaaagatcttatcgtcctgtctacccttgctaatggcacagttattgatgagaaaaatgaacctgaaatgaacccgaactcctcttctggggagccgtggttttgaatagccctaaagccatgtaacagaaacaaattccccaaactacagaaacttccaaataaactgaaagcactgtaaaggttgaataaggacagaagctatccatcatttaataaaagacatatacttagtaattaatagctccagctgcaaaccatgtaagctggccagagatccattggcctggtggactgagatgagatgttcaatcacgtgagaagaggaaaagtccagggtcttcccaggaaaaacaaaccctgccttagaacccccatactaacacacatttcccccacccttactacatacacggtgctggatcttggcacatagtcagaaacaagcagtttttaaaaaagttttatttattttgtggctgtgcctcgtagcctgcagtatcttagttccctgaccagggatcaaaccggtggcccttgaggtagacgtgcagagtcttaaccactggaccgccagggaagttcctagcctcctgacttctgtccctgcctttttggtagaacccagagtaactggctgctttggactctgattgttagggtttgccctgggtaggtcctgggttggtcctgggttgttcttttccatgacatggggaaatcctcttatatgtgagctaattctactctagatgtaacattttccctcctcttatcaaaccccagcatctgatatccagagcaaggctttttctgcatctcgaatcaaatcta

SEQ ID NO: 56900 - DNA, 1639 bp, Bovine  19866881507707
tttaatttcttttgccttagaagactgatctaagaaaatattgctccaatttatatctgacaatgttttgcctctcttctcttctaggagttttatggtgtcatgtcttatttaagtctttaagccactttgagtttatttttgtgtatggtgtgaaaagctgagtcttagagacagaagcacgccctggagtcaagggtgaaaagtgcactctagaccaaagaaatgactgtgcaggaggcatgaggaaaggaatatttgcaactacagccacacaatttatagcacataaacagttgtttgagacaaacagcttttgctatgctgataaatacgccctacacccaacaaaactaaggtctcagccaggagaacattcacacctgggaaacagccaggagaggaatgcctacaacctaagctgttcaggtttaggaagtgacttggcaagtccctcactgcttgtgacatctttcttccccatcgacctgtggtggctccaaggccacctcacacccgttcaccataggccttaagctgggcacaaaagtagaccaaccacttgctgctccgtgggattcggaaaaaggcttaggtctaactgcaagtcaggcgccctaaacagggcctggcgattgcccttgtcatgacgcaacctcctctgctagttgaagcacccttgttaccaggctcggtgctcggagtctcctccccactcattggtccatggggaagcacctccgaggaacctctgttacccgggcgaggatgagagcccattggtccagacacctcacaatccctccaacctccccccaccgcctgcagggttcgtcccattggttcgctcgctgcctgtctcgggagccccctgttgcctcggactagactacttagcgccccgaacgagcgcccccaagttgaccctgttccccattggctgctctggagaccgcgccatctaatgaggagcgaagtgcaaagcaccagagcacgcgctccccgcggcgggatctaggctgcaggagcggaccggcggcggccgaagctgcgcaacagtcagctgccgggcctatctgcagaggacacccgttctccttcggaccgggcctgggctgtagctcggaccctcttccttcgcgaatcttggcatctccaacctggaacccaacctgcaaggctcccgttaagttcgaagcacccacgtggtgtgcagactggctcagggctgacgtatatccagtctgtctccatttacttatccccttaatcatttatccacccatacatagttcatcggttcctttatttggcattctgggtccacctgccacgctacctgtccacatccttctctccaacggtttgggaaattttgtaccctgaagaatttggattgacatctgaacggaagtggtgtagacgagggtgaaaccctggagggaccatgttctattatcccaatgtgcttcagcgccacaccggctgcttcgccaccatctggtaagggcgggcccggccagggtaggtgctctgggagggacacccaggggtcccaacctgagggctccccctccctctacacccctcattcttcttccaggcggcagcgacgcggggctgccggtggtaagcgcga

SEQ ID NO: 56901 - DNA, 1648 bp, Bovine  19866881516272
ctatagatgctgatgtttgacaaggcgtacaggaaatatagaggacaaaaaatagctttttcacaaatggtgttggaacaattggatatccatatatgaaataataacttcgacccacacttcacaaactaatacaaacattaactcaacatgggtcttagagctaagtgtaagacctaaaactatatcattttagaagaaaatataagagaaaaatctctgtaatcttgggttaggcaaagatttattagaaacatgacccaaatgcctacaataatcatctcttctgggaagccctgaccctgaccctcccagacagttctttttttccccactcttctatctgagcactttatatatgatattcatcaaatcatattgtatctgtttacatctctctcctccattgaacacaccaagaatgaagatcacatcttaattattttaatatctacaaagtttgataaatgttacttataggatgtctctaactctgagcttaatcagggagaaaaatttttcctagaagcctcccagcacatttcttgatgtctcattggccagaactgggtcataggttacctctaagcaaatcactcgttaatggaattaccatgattttcctggaccaattacacttcactcttcggggatgggcttaccttccccagggagctgtggctgtttgggtaggctggctgcagagaacttgcagaggtatgggggtggtggaattagtggcataaaccaggctgcttcattttccattgtgagggtgtaattcaccaacaacctagacttatacctagatttcagaaggaaaaactaccatatatcactatctttgaaaataaaaagaacaacacagctctgctacagtaggaagagtgaaattattcatctgaaacagcaagattctgcactgggctctttataactttttagataatacatctatagaaaaagcttggtaagctttattgcagaatcatttacatcaactcgtacaattttgaatatttattatttttcacagtagccattgttttagaacatatgttattatataaacattcttcacaaatcttaaaactaattgaagcatagctatctttatagtaaatgctagaagaagaaaaaaaaaaacaccaaaaaactagccagtgttgtggatccctggagtttttattttcactatgaatatagcagcttagagaaaatagggtacaagaaaaaaaatgtgtaaatgtttctaacctaagcaatctggccagcaagcatttcactgagaaaaactggcttctttttttaaaggaaaaattcacatttctgattttatgtgtttttatcatttgcttggttctgttttgttagataggatcttgtatgtttcttccacactgtgaactgctgctgttgctgctaaatcacttcagtcgtgtccgactctgtgcgaccccatagacagcagcccaccaggctcctctgtccacaggattctctaggcaagaatactggagtgggttgccatttcctttctccaggggatcttcccaacccaggcatcaaacctgagtctcttgcattgcaggcagattctttaccgtctgagccaccagtgaagccctggatactataccagggcaaa

SEQ ID NO: 56902 - DNA, 810 bp, Bovine  19866881589752
gaatatctgcctaacagcttgattcctccctcacctctgccctcagttctgggagcactcctgctcctgccccatggatgggaggagtgatgattcccatttgttaacctggcttcaaggcctgtggtggctggtgttgcggtgagcctattattcctttgtatctttaggtctgtcattatgacttcatgctccagaccacctggtgactgaggatccttccccggagcccctggtggccagaccactcttgtgctgtccttctgcccactgaaatcttgcaggtccctccctgcttgagtgagtgctgtgttaaagcaagggcaggagctgccctgaatatgctcagagtgactggacattcatcacctgggggatatatataagatcataatcccatccttggagctggcttcccttcactttatccaccactgtgtgcctgtgctaagtacaggaaaatgagactcaggaggcttttattgccctcgtatttagcagcccctcccctgccagagcaaagttctagggtgggagtgagggagtggctgaccttgtggtgtgacagaaagcatcctggaggagcaacatgaatataaggacccacatgccacatccagcagccccaatgcctagtaaggcttccaccgccaaaggccactgtctcctctttaataaatcaagcattagattaagcacatgagaaggccaagtgtctcatttctatttctggccttcagacaccggtgacagtggtgacctcaggctgggacgggaaggatttgccccaaaccctacccaggaggccct

SEQ ID NO: 56903 - DNA, 722 bp, Bovine  19866881611785
acttaagagacacgggtttggtccttgggtaggaagatcccctggagaagagcatggcaatccactcccagtattcttgcctgggagatcccatggacagaggagcctactctgtgtgatcccatggtctgtccatggggttctccaggcaagaattctggagtgggtagctattcccttctccaggggaatcttcccaacccagggatggaacccaggtctcctgcattgcatacagattctaatgccttttaattcaggcctgggtttgagggaagaaagcttttctgtggggcttcccaggtggcgctattggtaaagaacctgcctgccaacacaagagacttaagagacacgggtttggtccttgggtcaggaagatcccctggagaagagcatggcaatccactcccagtattcttgcctgggagatcccatggacagaggagcctggctggccccagtccatggggttgcacagtagcggacaagacaaacgacttagcacacacggcttttcagcagaagggccctctgctgggcacttgtgggattgcatggtcgaggctgctagaattgcttgctgccgcaaatgctgagaagtaggtagcctttgctttctttcctggtcacagccctctttcaaggagaagtgatccttggaaaaatggatatgtttactcaggtaggtgtttttacatgtgtatagatgcatacatata

SEQ ID NO: 56904 - DNA, 681 bp, Bovine  19866881620549
tatccttctctatatatgttgtggtttgtaaatatgtccacagttatttgatactacttcttcaaaaggtgaagcctaattctcctcaccttaagtgtaggagatacttagtgacttgctttttaaagtatagaatgtggcagaagtagtgatttgtggtgtctgagattgggattggaatgacattgagttttccccctcattctgggaccacctgctctggggaaagccagctaccatgttgcgaggtagacctaaggagaggcccatattgtgggtaactgaggcctcctgccaacagctgtaagattgagccataaagaaattattgtaatagattctgagactggtgagggcacaggctccatgatgtcaaggttctgtgttcctggaaatgagcagaggacagagcacataatccccagggacatttttctattgacaaagagtacctcagagtttatatagtaggtaagactagtcccagagcttgggttatgtgggtggttgcttacctttgctgccaaaattacccttcaggataagaacacttattatctcaacttctgggagtgcagctggcagaaagtcctcagcaatcaacacccttcagggatttctgaagagagccaaagagaaccccccattccggcaacccacgtccagtggttggtgaatgaa

SEQ ID NO: 56905 - DNA, 1109 bp, Bovine  19866881627196
ccccgggaacttagaccccatgctttacactgaaagctgtcactgatagtcctctgagagccgtgaggctggagtgactggggcagggcccaaggcaggaggtgagagggggtaggtaggaagctgaggaaatgtggggcttagcagtgtcaggagtcggaaaacaggcaaagatacagcagctatgggaatgaggagttgggttgccttctctgctgagagctggcaagggatgcctgacagtgtaagagctgcagggtgggagggctgagaactgggggtgtgtgtgtgttgcaggggggaaatgagcgcagaggcaggacccaggggcaggatccagcagtgtccctactcacccacacacccaagggaaccttatctgcaccccctcagcctatcctgtttcctggagcccacatgtgggaggcgggctctcacatgcctggacgagttagtgatgggaagcagcagggtgagggagggctcctggaaaggcccaagaggagccccaccttgtccctccctgtttctgcctcaccctctgccaacctgacaggcacaggacagacttaggcaacttgcccactgccgctttgcctttgggcttccccaggcccctggagagcccccaaccctgcacccgcccagctgggtaagtagatctgcccactagaccttactcccctccactcacttttgccctgcggtatatacatatagggaatgaggccggaccaagaaggagaggccaggtgagaagagtggaggtggaggcagggacagcctgggagtcaggactggggaggtggcctgacagagagcaggggacatgggttacaagaagtagtgtttgagctggggctggggttctggtggggggtagagacagaggcccccagacagaacagaggcaggctgcaggggagtgagggacgctcagtcccttctcactagcatcaggcggaacgtgggcttctgccccacctgaatgcgccccacggctctttccagcctcccggaaggacagaagaatgtcagtctgctaccgtcctccggggaacgagacgctgctgagctggaagacctcgcgggccacgggtacagccttc

SEQ ID NO: 56906 - DNA, 1281 bp, Bovine  19866881724742
cgccttgaaggagaagcacattacagatatggcgtgccctggatgtggccgccccgacctcaccgatgacacccagctgctcggctacttctccaccctcgacatccaggtagggcagtccctcggactcgggatgccctgggctttgaacaggagccttgcccacccgccactttggcatcctgtccccagcttcgagagagcctagagccagatgcctatgcactgttccacaagaagctgacggagggcgtgctcatgcgggaccccaagttcttgtggtgtgcccaggtcagtggggtgcccagagttgctgaccggaaggaggggtggggagtagcacgcggtcaggccttagatagctttatgctcttgcacccacagtgttcctttggcttcatatacgagcgtgagcagctggaagcaacatgtccccagtgtcaacagaccttctgtgtgcgctgtaagcgccaggtgaggcacatctaaccttttggaatacctgctgagccactgcaggtgctgtgttaggctcggggtttgctacagaacagaacagacaagctctccggtctcaaagagcttacagactagcaagggagggagggggcaaggttgaggaagggagtgagaacagaagtatatacatcacccatgtgttctatgaagaaaacaaataggagtctgaggtcaggaataacagggtggacctacctggtacatgggattgggaggttagataagtcttctctaaaatggcttgatttaggaacttccctggtggtccagtggttaagaatccgccctgcaatcaggggttcagtctctggtcgggggactaagatcccacatgctttgaggcatctgagcctatgcgccacaattagagccccagtggcttgccacaactaagacccatcaaagccaaaagtaaatcaatatttagaaataaatgaaatggcttaatttaagctcaggcctgaaaatttaaaagtcaactatgcaaaaagtattcgagagagaaagaacaaaacacagaaaggccaaaatccaaaaaagtgttgtatgtctggagcctcaagagcaagggcgagagtgccaggtggtccgagaggagctggctgccaggtcaggagaggtcatgatgaggccgagtgaggagggcattggcctttcattctctgttttggctgtgccatgggtcatgtaagatcttagttccccagttagggatcgaacttgcaccctctgcagtagaagtgggagtctaagcaccggacc

SEQ ID NO: 56907 - DNA, 1241 bp, Bovine  19866881771060
gtgatctgctggtcctaggataatccacgccgggttttccgattttcaggggggaaattacactggggcccatgggaatctgtttcctggttttctttccctcttcgggggctgtgccacagttgtacccacagactcccagaaagcactttccatcctgctctcatttagtccccagataacctatttccagtttcttttgtgggggaaaagggctcttcagttccatttctggaaatatcctgctacatgttttctttccacatttcggaggcaaggtgggaaacccactggatgagaccaatggtcctcctccaagtccaggaagaggtggggacaaacggtggagcctgggaacggggtggtgtttctgcgccttgaggaatggggagatccagctcctaagcaggcaagggagtttctcggtgtccccctgccaaagcactgggaggtggggacaggttgaaactccaagtctcaggcccctggcagggaatttcccaagccagttggcctgattggatacactcatgctaagtccctctgtgagctagaatttttcacttcctttgggattccaggggtggggtgggggtgggaggggtgctacagttcctatctgacagatgaaaaacctgaggctcggaaaggacatagattcacaagcagccaatatgaggttggagcaaggtcttctgggtacatggtccaggttccgtcgccctgcagtatgcaagtgagatagtgagttgaatcacaagagactgctggctctgttgattaaaaacagattattcgcattttcgtgtatttcaatctaatgtgaaagacaagtggaggcgctttgctcactgctgtctgctcctcctcttcttggataagctccccaaaccccacattccaatcttgcctcatgttccccctccccaccaggagctggccgcagacccagccttcctgaccactgtgctgtgcgctctgggtggcttctcactgctgctggtcctggcttcccgggagcagcgactgcagcgctggaccgcgtcccctgtcaggcctcgtgtgggcagcactgcttgcactaggccacagcttcctgttcactgggggcgtggtgagcgcctgggaccaggtgagcaggtggagcagggcaatgggggttcctaggcctcaaacatgcacccaggcctggaggagcagcataagcttgcaacttcccgtgcctctctcccctaggtgtc

SEQ ID NO: 56908 - DNA, 3222 bp, Bovine  19866880488874
aaaaaaagattatctatgtgtgtacaactaggttaggttgatataaacggggagaaaattgaatacttggatttgaggaacttctaaatgaaactcagacgtcattcattatgagtatgttcttttgtgaaggaattaaagctctttgacaaataaaaacataaattcagtactagcatctcctatatatgccagttcccatcattctgttattgtagagaactagaattatggaaacagattttgtttcttttaaagctgcagatgttattaacaaatataagcacacttcactgtttgatagattaatatctgagaaatcacttataatttaaatacttttataaagtgcttaggaaactggtttaatcgaagaacacttttaaagcaagaattggctcaatttatttatatgtatgtccatccataccatgtgtctcaaagtatacttttatcacattctcacacaatgtgttccagctaacctcctgacagttttgttaggtggttctctgagtgtagaaattgaatttgcgtgcctatgtttcagttatgaatcctttttcatagatttatcctacactgactctttactgactcttcacttatgtctcaaccagtcctcatatatttttagaaatacaggttgtagtttctttgcaactttgttgctgtcagatctactggtgcttttgattaattgcatgaaaagtgacagaacgcctctattactcctttccaagtgtcaacactctcttcacatgaaatatgtttttcttatcctcaagaaattaaatgaccttgccaaagttatgacatcctttagccataaagcgagtattacagtgaataaataatatgaccaccatcttccaataagaatgctgaaagctcaggggaaataaccctgtttatgaacctgagccttgccattttcacttttctgtccccttcccacccccaccattttagtaccattcatcagtgtcttttgcctgggctacagcaattatttcttaactagtctctaactgctcttcacttcaacatggcacactcatacattgtttttaatgcatatatgagcacaataataatattatcctgccaaatattatcaaagtttattttcaggaatatcatggattttaaatccctgcatgatttagccttggatatcttgctggcttaattagtggcactttgtctctccatactttgtccacagtggcctttaagatctattctctaatttgggggatataaggaacttcacatggtattgcttctgccaagatattgtccaatcctcaacctccctccacagcatcacttgtatttgtatatattcttcatccatcagaggtcagcttggattccactaagtgcttccaccttcttgagactagacccttgcccttcttacctgccattttgttgttgttgttccgctgctaagtcaatgtatctttgtggccccatggacagagcatgccaagtttccctgtccttcactatctccttgagttagcacaaattcatgtccattgagtcagtgatgctatctaaccatcttatcctcagccactcatttcttcttttgcctccagtcttccccagcatcagggtcttttccagtgagtttgctctttgcatcaggtggctgaagttttggagcttcaacttcaacatcagtcatttcagtgaatatttgggcctgattcctttaggattgatctccttgatgtccaaaggactctcccaagagtcttttccaggattgcaattcaaaagcatcaattatttggcactcaggcttctttatggttcaactcacatctgtatataactactggaaaaatcatagctttgactatatggatgtttgttggtaaagtgatatctctgctttttaatactgtgtctaaatttgtcatggattttcttccaacaagcaagtgtcttttaattttatggctactgtttccagctgcagtgattttggagcccaagaaaatgaaaactgtcactgtttccactatttccccatctaattgccatgaagtgataggaccagaatccatgatattagttttttgaatgttgaattttaagctggctttttcactctcttctttcaccctcatgaagaggccctttagcctcttcactttctgccattagggtggtatcatctgcatatctgaggttgttgatatttctcccagcaatcttgatcccagcctgtgattcatccagcctggcattttgcatgatgtactttgcattgatgttaaatagacaaggtaacactatatggtgaacatttcttacaaaacgtgcttcactggagaagggaagggcagaccacttcagtattcttgccttgagaaccccataaacagaatgaaaatgcaaaaaaataggacatggaaagatgaactctccaggtcggtaggtgcccaatatgctactgtagatcagtggggaactaactccagaaagaatgaagagatggacccaaagcaaaagcagcaccccagttgtggatgtgactggtgatgaaagaaaagtccgatgctgtaaagagcaatgttgtgtaggaacgtggaatgtttggtccatgaatcaaggcaaattggaagtggtcaaacaggatatggcaagagtcaacatcaaatattttaggaatcagtgaactaaaatggactggaatgggtgaatttaaatcagatgacattatatctactactctgggcaagaatcccttaaaagaaatggagtagccatcatagtcaacaaagagttgaaatacagcgatctcaaaaatgacagaatgatctctgttcgtttccaaggcaaaccattcaatatcactgtaaaccaagtctatgccccaaccaataatgctgaagaagctgaagttgggtggttctatgaagacttataagaccttctagagctaacaccctaaaaagacgtccttttcattataggggactggaatgcaaaagtagggagtcaagaaaaacctggaataacaggaaaatttggctttggagtacagaatgaagcagggcaaatgctaatagagttttgtcaagcgaatgcactggtcatagcaaacaccgtcttccaacaacacaagagaagactctacacatggacatcaccagatggtcaacaccgaaatcagattgatcatattctttgcagccaaag

SEQ ID NO: 56909 - DNA, 1457 bp, Bovine  19866880646869
caaatagggaaaggagtatatcaacgctgccatattgtcaccctgcttatttaacttaccatgcagactacatcatgagaaatggtgggctggatgaaacacaaagctggaatcaagattgccgggagaaatatcaataacctcagatgtgcagatgacaccatctttatggcagaaagcaaagaagaactaaagagcctcttgatgaaagtgaaagaggagagtagaaaagttggcttaaaactcaacattcagaaaactaagatcatggcatccagtcccatcacttcatggcaaatagatggggaaaacagtgcaaacagtgacagactttattttttggtggtccaaaatcactgcagatagtgactgcagccatgaaattaaaagactcttgctccttggaagaaaagttacaaccaacctagacagcatattaaaaagcagacatcactttgccagcaaaggtccatctactcaaaactatgcttcttccaataggcatgtatggatgtgtgacttagattatatgaaagctgactgccgaagaattgatgcttttgaactgtggtattggagaagactcttgagggtcccttggatagcactgagatctaaccagtccatcctaaaggaaatcagccctgaatattcattggaaggactgatattgtagctgaaactccaatactttggccacctgatgcaaagaactgactcatttgaaaagaccctgatgctgggaaagattgtaggtgggaggagaaggggacaacagaggatgagatggttggattttagtaccaactcgatggatatgagttttattaaactgtgggagttgggaatggacaaggaggcctggtgcgctgcagtccatggggtcacaaagagtcagacacaactgagcaactgaactgatgatgatggcgggaaaagttaaacacatatatgttaaaatgaaaacaattcaagggaaaaaatatcattatttcaacacattctgaggcactttataaaattaatattgctaatcatttggggaatacagtatttttcactatggaaaataaaatgaaaatcactgtgcttgcttgtacaatctttagtcaagaaaaacatactgacttgcattgaggtttaggttctgataaaactacataattcgacccagtggcctttcattaacaaatctattgcctcttaagacagaaagtgaaatgagtaagatggtatcacattctaatgaaatgtgtaacatttcatcaaatatgcttttctaagcattcactaagatgtaatcaggtgaaaaaaaaagatgataatatttttatttagtgtgcttgaagatcaaacagcctcagatcatctgaaaatatatatgtttttttattcaccggagaaaatttcaaaggtgactttgctggaacaaagaagatgcaagacagggaacacaa

SEQ ID NO: 56910 - DNA, 1726 bp, Bovine  19866880701358
tattggttaaccttatggcacactcctgttctttatgtctgccatttgcgcaaggtggagtgatgaaaaggttatcaaaggatgcttcagtagaaccaattacttcctcttctggtcttctctcctactgatcatcttatctgatattgataatatgttacctagtgaaactgaatactgcagctcaagtctgttactttactgtacttactgaggagcagactttatgtcattctcatctctttcccttcatggtgatgggcacaatacttggaccattacaggtgttcaggaaatgttagtcacactggattaaaagtcagacactcacaattatttctaaactacaagaaaacaatgatcaatgtcagaagaaaaacttctgtggatacaataatatttctaagcactgattaccaggtgtctttctactcctttcctaaaaatcagaagaggtcaattcccaataaatgggttgaatcatgtttaaccaaagaagctactgaattaagcaatgatgctcagcaggaagattttaagtggatttgcaaaaatgataaaaatcccagagacagaactgccaaattcagcaacttattatattaagagaagaatgaacttgaagagagagtgcacgatggctgaaggcatatgtttaaacagccgtatattttgctgagcactgccattcacagtttaattggagcatcaagataaaaactctgcttacacctgagtgcttaaagtaaaacactaaaatggctagcatatgctcaagatgattgagacattcatcttcttgggcgtacatctctctctggcacagaaatacaatatggaatccagggcactgcactgaactgaaggcaaaagtcagaaacaaattccagatggtactgatacaggtgaatggtaagtactttttacaccaacaatcttcctgaaaaccacatccttctttccttcacaatccattcgcagaaataatgattgtattatcaggtgggtctacacaggctgggcagaaagaaaaaagaaaacagctataaactgtggttttatattttatttttaatggagggaattcctttaaaatgttgtgttggtctctgctgtacgacacgaatcagccataagtacgtgtatgtgtgtgtgtgtatgtatcccctccttcctcagcttcgctcctaccccacccctcaccccacccctccaggtcatcacaatcagcatgggctccctgcattatacaacagcttcctactagctatctatattacatgtgggcttcccagatggtgcagtgataaagaatttgcctgccaatgcaggagacataaaagacatggattcaatccctaggccgggaagatcccagggcatggcaacccactacagtgttcttgatggagaatcccatggacagaggagactggtgagttacagtccataggattgcaaagaattggacacaactgaagtgattcagtatacacacataacatgctctgggttcatgtacctcactacaactgactcaaattcattccttttcatggctgagtaatattctatttatattacatttcaattcagttccatcactcagacgtgtctgactctttgcgaccccatgaatcacagcacgcccggcctccctgtccatcaccaactcccggagttcactcagactcacgtccatcgagtcagtgatgccatccagcca

SEQ ID NO: 56911 - DNA, 1224 bp, Bovine  19866880901470
caaagcaaagcatacatatgatattattgttattattataagtggtattttataaaatgttaccaatatataaatggatgtttcaatcaatatttgacatttatattgtaatatgtaagttccagtccaaagtacttcaattgaaatatttgacattatttttgcatattcagcttatctttccagtttgttagattttttaaacccattcacatgaatgttttctaaattttataggcacctcagaattcatttaccccatcatataatgggattctctttcttatcattataaaagggataaaatactaaaaaatataagaaagcagacagaattccaaaaagatatatattaattgacagaagaaaggagggcttcttttttgttgtcatttttaataaagaggttttaaaagaatcctcactaaatttggggaacttcatctaaaaagccaatttccccatttctatttgaaaagaatcaagcaatcaaaaaatctacattgcaggcaaaaactgcctatttgtatcacataaacaagtagcgggaaaaggatatttctcttcacttttgaggtattcaataatagaccataaaacatcaaaggatttataaattggcatctctgcaaatcatgtatgtctcctgaacaaatatgctttaaataaagacaaacaactgtaacataataaggatctgtgcagatcatcttttactaccccaggtgctcagaatattcataaggcagcaaatggagcacttctgtttttacactaaaatttagtttatctgaaccagcatgtcagactggctgtcagcagaagagatcctcagacattaatgttcttagtactgcattaacacttgaaacaagaaacataagagcttatatgtgacatgtcaagactgctttggaatgatttcctatagtagacaataaaaagcccaaatgacagtactgaaaaaacaggtgtatttggggaagagattataaatgaaacagaatccatcctgctactttctactatttagaaaacaaacaaacaaaaatctagtaacatcttacagccttcaaaggactttataagaacaaaccctttcacacatatttttaaaatatgtgatattatacaaaaggtattggtgcctgtatctcatgaaaagcatccatgaaaccacccaattcatgctttcaacttgccctgaatatattcccgaaaaat

SEQ ID NO: 56912 - DNA, 760 bp, Bovine  19866880925080
gataatttcagcttttaatttaatgactataagtacaataatagttccaaatatatattttacctttatgctcaaaagctcacggcaattttatcaatttagaaagttttccatccactacaaaaattcagcaatctctgaaatgcaattgcttgataagataataggtagccatgaaaattataaaagagcttaagaagggaactgaaaaaagcatgttgtattcaattgaagtcatggccagaattatagtgcagtttttaaaattagaattttatctggatatgaatttcagaaatatttccataagtataaaattttaaattaaaactttaaaatgaagctatttaccctttctgatttagagttgaagaaaatggaggaaaaaaataaagatttgatcagaaaaagcagcctagatgtcagatgaaatactactatttgagaacctaaaacaagtatattgcacatttccatccatacctgtttctttcctaactattgcagcgccactcacctgctagtctccatgtggagtcagtggtggacacgttagtcagctgcagcctgtccccagccgtccgtgtgtgctgacataccatggctttccctgcaattgggttaagccttgggaagtgaacctgcaagtccatgggagcagtcttagtgttagaaaggccagggagcctgtgggcaagtcagagtactgaggaaagagaggggatacataatcaggtggaaaaacagggaatgattgagt

SEQ ID NO: 56913 - DNA, 865 bp, Bovine  19866881018487
tagttttcttttctccttatgactccaagacaaactgaaagcaatacaggtatatactcaaatgtaggagtttctagttacatatttgcagcggtagtggacttttaagtgtgacttccagttgtggctggggctagatttgtttcacaagcctccctttaaaatgtttcaaatgcacaaagcctgccttaatgaagcagaatgaacttgtaacagattgtactgcttgttcgcctgcttatttaaataacctgcaaagacagtctataatacagtcaattagcactgactaatgattatttaaagagtcactgatggatacctggctagtgcatactccgttaaagcctaatgagcaatgacaagaagttcttgaacatttcataaagttggtagacactgtattcacttggaacttcccaggtggctcagtggtaaagaatctgcctgccaatgcaggatatgtgagtctgatccctgggtcaggaagatcccctggagaaggaaatatcaacccacaccagtattcttgcctaaagaatcccacggacagaggagactggtgggctactgtccatggggccgcaaagagtcatacatcacttagtgactaaaacagcaacaaatttatactcactactgagcatttgctaatgtcttaacatcttcagtttccctttccttcaaaatagagatattctacttaatctaacttttttgtgtgtttttaaaaataataaaataattcaaaattgtaaataagaatgtacatgaaaaagatcttatctaccctcaagactagacataggctatatctttttcctttttttaagtttattctaattggaggataattgtttcacaa

SEQ ID NO: 56914 - DNA, 1564 bp, Bovine  19866880615321
aaaattttgtgtgtcccagtattaacttggccaaattaaggttcccaatctgaacaattctacttttagctctccaactttacttttcagatgaagacagtaatctgtccccctccccactgcgggacctgtctggggggttaggaggccaggaggaagaggaagaacagaggtggctggatgccttggagaagggggagctggatgacaatggagatctcaaaaaggagatcaatgaacggctgctcaccgctcggcaggtgagtaggttcattctttattcgtttgccaaattgatactgagagctttccacgtctggagaactttgcaaggcagcagggatatcagcagtggagaaaagacagacaaggtttctgttctcatggagctagtattcttgtgtagtaaataattttgaaaaactggaatgtttataacaaaaatagggtgatgaaatagaaagcagaaaacaaacaacattagatagggtagtttggaaagacctctctaaaaatataatgtttccaataccagagaagctttccaggcagagagaccagcaggggcaaagaccctgagagtggaacatgcctaatcatggccaaggagaagaataaatgtgactgtgacaacaaggtggtatgcagagaagtgatatgtttggtttatatttcagtagattactttggtttcttagtggtggtaaacgatagaagcaagaccagttaagaagctattgaagtagtcaggtaagagatggtggtggcttgaaccaaggtgaaatgagttggagaaaccagatggattctggatatatttaggaaacagacacttgttggggaaggaaggaatcaaggataaccctgagtttttgacttgagcaattatccagttgatgctatccattgggattcaaagactgaaaacaacaaaaaagcctccagagaactaggaccgagttttgggactcagggcaggaaggtaacgttactaaagcatttgtccttgaggatcaaggatctaaagctgaaagtctggagacctgagaggaggcagtatgaaaggctcctagagactgtgcccatttgactcttttctcaaggcctgctcttcaagaccctgctttccgtgtccccatttcccccctccctcgttccggcagaactcccttcttgatttgctgacatctccatatctccctagcgagctctgctgcagaaggctcgaagtcagccttccccgatgctgtcactacctgtggctgggggctgcccggcccccgctctcaccgaagaaatgctgctgaagcgtgaggagcgggcacggaagaggcggctgcaggcagctcggcgggccgaggagcacaagaaccagactatcgagcgcctcaccaagactgcggcgcccagtgggcggggggaggccgaggggcctcccggggcgagcggcggggagggcgggcggtggccccagcccccatggtgcgctacagcagcggggcacagggttccaccctctccttcccgcctggcatccctgcccccgcgcctgtgtctcagcggc

SEQ ID NO: 56915 - DNA, 1646 bp, Bovine  19866880740842
tctgtttctcatgggttgatgttgccctgcgtgtgtgtgtgtgtgtggtttgtgtgctcgtatcacttgtgtgtccatccgtcagcccatactaactcatccgcctgtcctcatcccggctggacctgccctgcctgtggttgacttgcatgttgccatttgcttctcagttttctacaagtgctctcagaagtggtttcactccctctttccttccttgaaaaacgttatattgttgccttctatgattctgcattctcctggttttccttcttacctctctcacctatctagatgtctcttattggttctttttccagctagtttctgaatgctaatactcccctgggtttaatccttctctttacacttttatgtgcttgcaaggtgatttcatccccaagcactggtgataaccacagatgtgcctttagctgagctattttatgaaatacacagtcatctcactgatcctaacaggattttaattaactgtgataggaaagaagctttgctcttaacagaaaaatcttttaccagagatttccagagaaatcttggggttgtggacaaccagctgtacttcttggaaggctcctgtgtttcttttgtttgtaccccaaccaaatgtctttctgacagacctagtgcagatttaattctctgtcgactactagaaatatttgtacaatttgtagaattctacaaatagaaatatttgtagaatttgtagaaaatgtcatgcatctaaaaggtattggggaaaagtttagggatgaagagaatgttgactgataattctagaagtgatttaggagatgacgggaggtgcaattggcaagtgaacgttcattggtaccaaggagggtagaggggatgttgacactggatttatcaagtgttttcttctttataggctggttcaagacatagagtcagcggatgtctcttctttgtgtcctgaagagcctggaggtctgtatggtttagggaaatatgggtggagtggctggaagggcctagaaagtagtcctttttggacctactttaaaacttgtctgctggaagatgtggcagccttactgtctttggggatccccccttttggctttgtcccccatggccccttctcatatcaccccacatttctgtcaccccaaacctatagcgtcaccatcgtttgtgcctctgctttctctccagaacacccgggtggtgtttgaagttcctgtggctgcagctgcacatgtggtcttgccgtgttccccaagctcagcctgggcatcctgcgtgtggcgccagcccagcggagtgactgcactcacccgccggcaggaggggctagaagtggtgatatccccaggggccatgggtgcttatgcctgtgagtgtcaggagggtggggcagcccgcgtggtggctgcttacagcttggtgtggggcaccccacggggccccttgagccaggctcatacaataggggctggactagcaggcttcttcctgggagttcttgcagcgtccctgactctcctcctgattggtcggcatcagcagcgacagcgacaaagggaacttctggctagagacaaggtgggctggacctaggggtcccaccgtcggtaccacaagctacagccaggatc

SEQ ID NO: 56916 - DNA, 1597 bp, Bovine  19866881032962
ctgccatcaccccactctcagcttagattcttgctcttgactctttgcctaatataaccaaggaatttccatttccccacccatttacagcccaaccaggtcattgcctatgtactttgacttctgctgggcataccttggcttgaatcctgtcacttctgtggccaattagggcagacatgggttgtaaagctctggaatgtgtatccagaaattctgacattttaagttggaaactgaaagatctattaaatacttaatataaagatctgttaaataggtggtattttcatttcttttcctagttcacacagacatgactttgtaagagaaatgaggatgtggaaagtgagtcactagctacataatggggactatgtagtaggatctggtaactgaaaagatgttttcctagtgatgaataaattcatctaataaatacttggaaaaattaaatatataattccctaccacattctccaaagtggttatccaagtttagaaaaaggcaacaacaacaacaacaaaataaacaattagggggactggacaaaggaaataaaaggtgctgctccgtgctcagtcacttagtcatgtccgactctttgcaaccccagggactgtagcccgccaggctcctctgtccatggaattttccaggcaagaatactggagtgggttgaagggtgatagtagagccaagattagataagatcataaaaatgcaaaccgcccacttttgctagaagctatgcccaggaacctgaaaatgagaacacggtggaaccagccaactaactgagggtaaacgagaaaatgtattacagattgtccagtcagataaaggatgcaaaagggaataaatgaacatttaataaccttcaacttctaccatttaagtgggttggaatggccagaggcagactggttttcctgcctagaatatctgtgaaagctgaaaaatatatagaaaccatttggttgagggctgtgagaaagtgctgagacaacagaagtgagaggtagctaagtttctggaaaaggaagaattcggagaagtgagagaggtattgtaatcctgagggcatatgtttattttgacttgaagggaatggtggttgggaactgataatctaggatttatatctcctgaggcagttgcaagggaacagagaaactagcagaactttttggtggagatttgacaggggtaagacagttgctcaagtcagtttctcacttaccatatttgccaaatactggggctgcatggagcagaggacaaaaacacccaaggagaaagtctctagaagtagagcattttagcagacttgagaaacagtgattagagttgggatcgtcatgcgtattatagaccaggttttcagtggaaaattctagagggcctggagcaaaccaggggtagattgagacttatcagaactacagcccagccttgactcagcacagctcctgagtagaaaaggatgatttgtcaaaattatctgcttagtgcagggcaggataaacttgctcagaggaagctaacaccacctggagcctttataatttctctaggcacaatgagcatctttca

SEQ ID NO: 56917 - DNA, 1735 bp, Bovine  19866881149206
ttggtttaaatgcaagtttggtttaatagcagaaaatcagttaaggtctaggaaaagaaataaaatttatattaattgaaagaggagaaataaatgttattattcctagttggtatgattttccatgtgcaaaaaccaaaagaatgtatggatgacttatcacaattagataacagtaaagtttctcaatgatatacgattaatatacaaattttaaaatatcatttgcaatagcataaaaagtaaggtatctgaaattaaatatagtaaagcttgtataagatctttattcaaaaatttataaagatattaaaaagatttagatagataaaagtacatacttttcatgtttagaacaactcattgtcataaaaacttcaaatcctcccaagtagatacatacatatacaggcattgtgtatgtgaaatttgaaaagtttatttcgaaattcatttagcttttgaaagaaacagtggtctctctctctcagaattcactatctttattgcaggactcagcactcaggagcagctggcttgatagacaggtggaagggttacctgtaggttcagttacggtacagctgggagacagcaccctatggagttagactgcttccagcaggatgcggcacacaccttgatccagaggacactgtggtgctgcctctcccaaggccaggaaccaagggcaatagatagaagtttcccctcttattggcatgtctaatacccactgaaaggagtcttagtccctgtccctacaatgtgggactcagaaggtctggagatcccagtgcctaagacatgaatacttctatcagacaactagcaataaagtagaagctgaaactgtcccctggctgatctgaggtctcatgcccctgaaccaacagaaagaggaagtggtcactctactagacaaagagattgatccttggagcaggcaaacagaaggcataatcagagtaagggctgggagtcagagggagggtggctagttaaggcaggggccacagaagatcagtccatcttgtctaggtttgttagtcggactgaagtattccagaggctttgggccacatgaggatcctgagcagcttcagggggaagagttatcacacaggaactgctaaaatgttttccagaaatgccatccagctccttggctaagctcaggtagaggactgggactgcaccttgtttgctatcctgtagagacatagaggaagtgaagagtaaagccaggcaagctctaacttaccgggacgctgagcagcagagccctgacccaccctcttcaggcaccgccagcttctccactacccaccttaaagaagaagctgaggagccagaagaggaagcgataggaccaggagaagtgcttcatgattttcgtgtacacaacgcccgggtccacagagttcacggtcacacctgagaagtgtggtgcgtggtgaagtgagaggaggatggtgggaaggaagggttaagtgtggttctgcagtgtgcagtaaggagggatcctaccacttctgtcgggtagaggcgacaagagacttgggggtggtgccagagaagtccgtgtttcacaacttacatgaatggcaatgcccaagccagtaaggacatagaagtattagaaagcatggggtgatcttcagggggaatatgatgggtggtgttggaggagagggaagttgtggatgatgagaaagttggaaaagaatgaaaa

SEQ ID NO: 56918 - DNA, 1692 bp, Bovine  19866880397128
actgaaacttcctttcaagtagaataactctagttcatctaaattgccttacttcactacgaggctactgcacaaggttgctttttatttctgctatggagtaatgggacttaacgcttctttttttaaaacaaagctatgactggaaatacaagtgagtttaatctgtctgtaaaatctgcttagtctacacacaaactaaggaaggacaactgcgaataccttcaaacaaatcgccatgatgcctcaagtggcttcaaaacttagtcaaaccttcaagtttcaaagatacttaaacttcctatgtccattcttcccatcttagttctcccaaaatacgggtagttttcaccggtaagtactggctgtttatacacaacagagttccaaactgtaagtcatgtgatacgttttggtcaatgcagtgctgcttccaactcgaagcgacaatggcttctgtgtctcgtttacagcaagctaacacaaccaaacactacgtctaatgcacagcgcaatcattcaagctactggacatgctgcttttacttaacaactttacctgtttctgaatgatttcactttgattagaagcttggagggtgtgttcccgcttaatttctatctgttgctgcttcttcttttgctgctgatccctgagttgctgaaccctctgcaactgctcttgcacactggctgcctgcactgcgaccacattctgaatgtggtgagtctgcacagggctgctctgctgaatctgaacgggtaactggagtttgatctgctggggcacaccaccttgctgagcctgtatctgagccacaacctgcggctggatctgggagagaacctggacttgtggtggcagctgcggcacagccaggacttggggctgaggctgcggtacttggagcggaggacggggcggggatgaaacagcaacttgacttaacgtttgtcctggtgaaagagtttgagttgaagactgtacctggggttgtgactgtggctggccctgggaaggtgtcggaagagatgtatgtggctggattggaatcggttgggaggctggagtctgaccctgggcctgctgtccgggagacacttgggatggcgtcgatggacgtactcgagtctgtggtgggctctggacgcgagcaggagactgtccttggacattgctctgaggcggacactgtcctgcaacctggggtttggaggactgtgcttgggtgggctgtgcttcaggagggacatgggaggccacagttgtttgggtctgaacttcaggctgagtctgagtttcaggctgagctggggatgggggctgggtttggggctggggctgagctgaaggctgagctgaaggttgagcgggctgcgcaggctgaggctgggcttctggaggactcacgctcgacggcggagctggaggcaggcttttggctggctgcacctgtgtcggggatgataatttactctgtctttgttcacttgtacctgtgaaaaggcaagagcaaatacttatgactctagaacgtaagactgtagtttaagaagaatttgaaggggattttctaaaggtgagaattctacatttcaggacggaggactgaggcttagaaatgctccatccagaaatactttggtcaggactcgcctaaatcggggaaccctccccatgttcacggctgc

SEQ ID NO: 56919 - DNA, 2191 bp, Bovine  19866880542312
gaaaggaagccctggtgtcagtcagtatgggggctgtaaggacctggaggtcagggctgttggactgtgattactggaacaatatcctttccctacaggtcccactggactttgctcgtagctcagacggtaaagaatctgcttgcagtgcaggagacccaggttcaatccctgggtcaggcagctattcaccccagtattcttgcatggagaattccatggacagaggagcctggcagggttacagtccatggggccccaaagagtcggacatgacagagacttcagtaagcacaggtcccaatggtacaaatgcccaatctctcctgcactcctgggggatattttcccactttaatatcatagttctgggggtgagaaacagtttggaccagagtaaaccagccttgcaaatagccaagcagaattaccagtcagcagcatgaagcctgagttacttttaggagccaactcctccccacttcaacccatcccatggagcccctcctggtccataaggtaatggatgtggaggaataaagactttactctttattcacaagtttctcctgaccgcctaagaaacactgtaggagctggggatacagtgcctgttctaggagctaggatacagtaatgaataaaataaatacccttccatcagtctacagggttggagggtgggattgtgtgtgcatacagacataaagtggggcttctctcgtggctcatggtaaagaatctgcctgccaatgcaggagacctgggttcgattcctgggtcgggaagattccctggagaaggaaatggctacccactccagtattcttgcctgggaaatgccatggacagaggagcctggcaggctgtagtccctggggtcccaaagagtcagacatgacttagggactaaacaacaacaacaacaatagacatgaacagataaagactgacaggaggggagttccccggtggtctagtggttaggattcaatacttccactgctgtgcccagggttcagtccctggtcaggcaactgagatcccacaagagttcccacaagccaagcagcaaaaaaaaaaaaaaaagagagagagagagagagactgagagctattttgatttggtcctaacattaagcagggacccaacagaagtgagagagggaactctgtgcatagctggggagtgggcagagagtgttctaggaagagggaccagcaagtccctgaggcaggtgtgtgctcagcgtatctgaggtgttaacactcctgtcacgtggtggctcacctcctcactcatggggaacctagatccctcagagttttttctggggacaggggagtggggccaggtagtgcatgaaactggtcctgcatcttcctccttccccacacatgcccagagcagacatgggggcgtgggggcccgtggtcagcctgccccagatccctgcggatggagggaagaggagagaggaacagcatgaaacactcccacctgcttctgaaaactcctgctgagtcagagtcctaggggaactgctctaatgaataaataagaaccctttgaaggcggcctatttaaaattgtgcgcaactgggcactgggttcttcccctagatggatcatatagttccctttccattgtgttcaggagccaaatgtgctcagcagacctttttccatggtagataacttctgaaggaagactggaaccctggttcctgtctctagttatgtcgagtctcccactgggggcttctgaatgagccggttaggtgggcgcttggcaggagccctgtagctgggaagcccagccccctgtttggtttaagcccaggagaggagctcagccaaggccgcccagaggggtcagcaggtggcccaagggcaatctctgaaacacacgtgcttgccctttctgggaagctgctgctaggatgaacgggcaagggctctgcctgggtcacctgggagggagaagccgggcctagagtctttggtctttgctcagccatcttgtcattgggctgtgacctcctcgactgggcagaatagaaagatgcctttgtatggcgtgtgattcctcaggacatgtgtgtgggagcctcctaccctgtgggctcttcatttttgcatttctggcacccagtacagtgtcaggaacatagcagggcctaaggaaga

SEQ ID NO: 56920 - DNA, 823 bp, Bovine  19866880557128
ttaagaacagattatgcaaactgatagctgtgaaaacctacatatcaaactataagtttatacgatggtctttagttaataaaaaacatttaagttcctacctggatcttgactatgtttgagttttccaagagcacctgctaatgacgacacttcacacttgaatggaactacagttagaaattttccatgtagcatgaacagattttccccgtaataccagagctacaaaaacagaagttatcaaaaatataagaaaccctttttctaagatctgattcaacagagccatttttgtggggtaaggaatcttaatatgacagaaaaggataaggcaaaggtaagcaactttctagaataatctcacacgttcaattcattaattaaggtaggtttacaaagctcttatttttgcccatgtgtgaatagagcataatttagggaatattttctttcaactcataaacatctgatcaatatatatatttaaaacaagtgaattgtcactactacacatctgttaacatgaaactcacgaaggctcctataaaataagcaaactgttttgatgtactaaaaagaaaaaagtagaatttaatattatttctatctcatgatcccaattataaaattgtaaaaatgagaaaggtataagaataaaaagctcacatgaaatcaaaagtgaagtctggaaaaaaaaagtgaagtctgttaaaatagcagaagtgtgaagtgttaattctgtttaaatataaattagcattctttgctgagaaatctagtctccttatcctctaattacaagatcaacaatgtcctatat

SEQ ID NO: 56921 - DNA, 1777 bp, Bovine  19866880619418
acctagtaagaggctctcgtgaaacctgaagccccgcctaagagcatcagccagtgatggtctaggtgctttcacatgcatctgtcttgtcatcgaagagagagtcaaaaaaacacatctcttgcctggctgaggaggaagaatccacaaaaaagagcttcataaaacgtccatgaagggaaactagtaacatcagaagagttccagcacttcaattgagtataattctctattattcttttcttgatttaatttctgtagctcacgaaaacttacttcaatcttgttgagctcggaacaaatgcttatctaaagaaaaaaattccaaaataaatttttaccataacttgtacaaataaaccctccacaattacttagagctattccaagaaaaactaataataatgcttcttggttacaaacagaattcagtatatataaaataacaacatacctgggatttcacaaatttgtaaagacttaacagtagcctttttgcttctggtatcattaccacaacagtaaaattagcatccagaagtagacatatccaatccataatctgaagataaacagtgaaaagggaagttaagattttacaaagtctatgattatatcaagcagttataagaaaaataagctttctttacagaagtctgaacattttagtttagagatgaaggaatttctaagcaatctaaaaaggctcttttctgctttcatatttaccattttataagcataattgtgtcttttccatcagataagtcagtaaaaagaaaaccacagtaatatttaatcctagggaaagtgagcatattttatttaaaaattttttttgatttaactactggcagctataaaaaaagaacccattcatctcctattctgaaatatactacatacattatgacgcaaaaatagggtgtcatgtattatagatgaatggccaagaactaaaataaaattactttatacttacttaagtatcctacatcttcaaatgggtggggttaacatgaaaatatcattcatgaaaaagcattaaggaaatcaattatccatttgcgggaggggggaaagcagattcctatataccctctacatcaaaataaattttatatgtatcaaagagttaaacacagaaaaagaaaataaatgtattacagaaaaatacacggtggctatttttatactcagagtgggtagggccttaaacatgacacggccaaaaagaagccaaaaaggaaaagcttaacaactttaacggcatgaaaattaaaaactcacctacggtagaaatgacattaaagaaagtaaaaagacagtgataggaaacgagtatttgtaatactttgacagaaacagatgagtacctcaatggacaataaataacttacaagttaaaatgaaaaagacagaaaatgcaatggaaaaatggacaaagaatctgattaggcagtgcagaaaaagaagtataaatgggcaagaactgatggtctatctttctcattaccaaagaaatgcaaattaaaacacccatctgttacctactgattggccaagagtaaggtctcggacctttgtggccatagtacctcttgtcacaacacttcggaaaggcagcctggcatgctcaaaactaaaaatacacgtaccctttatccagtaatttcactaatgagaatcaacccaataggtgttctctcataatacataatacaatacaagaatatctgtataaagatgctcacgaaggttcatttacaatagcaaa

SEQ ID NO: 56922 - DNA, 2256 bp, Bovine  19866880654432
ttattcagtcagatgtagatatacgaaaagtcaaagtgttagtcgctcagtggtgtcagactctttgcaacccccatggactgtagcccaccaggctcttctgtccatgaaattctccaggcgagaatactggagtaggtagtcttattcctttctccaggggatctttccaacccagggattgaatccaggtcttctgcattgcaggcagattctttaccgtctgagccaccagggaagcccgtgtagatatataggaagatacaaagcacttggcagttgcctggcactcagtcagctctcagtaaatactgctgctttccctactgcctccttgattgtcccaccccccagattggcacgcaatgtggttataatagagtactcgatttagagtccaaagcacctggtgaagaggcttggttctttcattcattggcttatggccttgggcaagtcacttaacttccctgggcctcagttttcccatctgtaaaaagggaataacaaatttgtaagtttttagggggaataatggcattgcagggtggatgaggagcaaacaaaatacacgaagaagggctttgaaaaaacagcacggtccataatgttatccctccctccccacagccacacacctgcggcttctccccttctccgggctcagctctatccgcgggacccaaggcagattaaaatctcaacctgctttcctcactcccctacccccagcacctctctgtggtgccattcatggaggcgccatggtggcacagcgccagggtttgacccaactctaccgcctggctagtcgtcgtctccttgtgtcaagccccaattccaatttctttctctttcagttaaaacacttggcctcgaggcctctgtcccttgagcctggacttgcccgcacaccctatgaatagctttgattagaaagaaaaaccagcatttggtacaagggtcactcagcacttgtgttgcgttcagcagggaagggacgccagtctacccagtgctgtttcctgagagcctggctacaggcttggctggggaggggatggcaggcagacccctgtagggcttggcagctgctgatgccctgcactgatgatgctgcccttcattggttcacggctctccccggattgtctgtacattctagggccagtcttgagttattaacccactcccatcgtgatggacacactgggcctccataggactggtgtgacagccttgagaggagaggggcctggaaaggggagaaagaaggggcagcatcgggagaggggccaggactgtcctcagcccagcccccacctgttagagaccaaaagccccttgccctccagaagtgttactgtgacttcaactctgctccactgtgcctgtgcacacacacacacgactccaaaagctcttaatttccaattaagggcaaacatttggaaggggattttgacatcctctttctagtccagttgtttatacccttttttgagtcacagactccctctgagaatctaatgaaagccatggtccctttcccagttgaaatgcatgtatagaacaaatttttcattaaatttcaaagtctgtaagaacctgtaaaatttccagtggactgagattaagaatttctgatcagatccaactacatcattattgataaagacactaaggcccagaggcggcaagtgatttgcctatgctcacacagcaaatgagtagcagagcccagtctgaagcctgggttccaaattactagttcagtaattccccacatagtgtctctcccttttttctccatgatccctctcagccagtcctttcctagcatagattagaacacaaatgttcagtgattgtggttatcaggtgagctggaaggtgggccaacttcttttaactggttcctacaggttcagagcagatggggtttggttctagaggtgtgtgaggggactgagtcggggattggctgggtttcttccaagctgttccaggctgtgaattctgagcgctccagtctacaccaagtgcagggccaagagaagtgtcctcagactacagagcaggggacctggagcatgtccagccttcctctaaatgccagccaggacctcagctttaacaccaccccagtgtccctgttcctcctctgctctggaacccacattggctccctagtgccataggatcaaattcagattccttccctaggtatctcctctgcagaaaaagagctcatct

SEQ ID NO: 56923 - DNA, 1604 bp, Bovine  19866880762496
agcctcttacagatggtggcctgaaaggaagcactgtctggggagaataccagtgcactgacactctgggaacacacagctaagcctggcactcagcctgtggtcttggtgttcatgggaggaacaggtccatcttcatcaccaaagacaaacgcttttctttgctggggatgccaggccagtgaggtagtattgtagctaacctactatttccctctaccagagcagtttctattgttctcaacacctctgagacaatccttatgggaaaaagcagcaagaaaggtgagctatgaaggggttcacttctgcgtggttgggcagaaatcctggctactgctggcagcctggtggccccaggaatcaaacccctggaggctggtagtctgagcctccacaggctgctccacactggggggcacactgggcacaggggcttcctccatacgtccgcggttcacagagaccccgggccaccaagtgcggaatgagcctcactctattccccatgtccatggggctttgctgcgtctgtcttcctatttcttagtaaacatgtttcccactggtaggatggctgagtccaaagagtattgtatttaaaatgctgacagtgcccaattgctctgcagaattacacacttcacgtcgccatcaactctagtcaccctgctttcccataccttcactcaagtcagtaccaaatttctaattagcccaacggagagagaagaaatactgtcccattgttttttatttacatttaattatgagagaagtaacccccttttttttttaaatgtctactagcctttcacatttattttgctgccaaatgcctgttcaaatcctatgtcttgtcggttatggatatttcatttataaaaaaggtctttttcattttaaaggaaagtttccatttgtggtgcaaatatttttcctcaatgtctcagctgtcttttgagtttgattatattatttttccactgagaattttaaatacatatatccactttactcatctatggcatctgggttttatatctgtttgaaaagaaagtatcacaacaaaaatataaattaatccatgctctctttttaagctttctgttactgtttttaacagtatgttgtttttctttttaatcctcatttgtctgatgaatgtttttgctgaagcaggaatttggatgatattttccccacacacaccctccttccttgtctgacaggaaaagttatcacagtagatttccatgtgtgtttcggtttgtttttggattctctgtttgattccattgctctactttttctctaggacaaagtattttgactattgtagcttcaaaacacattctaaatatctaatcctttttctgtaacacctgttttccttttcttacacattaagttttctagaggaaatactagcatcattttggtcaagtctcccttaccctccaaacggaaaactattcacattgcaaatgaaaattaattttgatagattaaattagcataattagtatactgcatggaagcatatgatgtttctttccatttactcaaattatatcctttatatcttttctttctggtggggg

SEQ ID NO: 56924 - DNA, 819 bp, Bovine  19866880794955
gttaattagctggtgagaaactacttcagttcaaaccagggatacactgtgtggagagtgatatatggattgttaatctaaaaacaaaagggtctacaagatggggccatatgagtgtgtcaccgtgggtaaccacagtcagtcaacctcgaggcctttgtcgtttaagatcccaaacagcatagtggagactatctctatgacaaacacagtgtatcttcagtgctgacgggtgctctggaggaatgcctggtcagagtcacagcaaggaatgagtgtgaactgcagggaatgagactggccttgctgacacccctggttctacccaatgtatttcttggcagattcacctagaggaatcgaaatagtcctcaagcttccaactaacctgcttttgaacatcagggagtaacagacagttgtgtggtgggtcctattaccactacctttttccttctgaattacaaccctcgcatgcttttcactgccgcaggtggaggccctggggtgtttctgtatgctgccttcaccaggcggtgtgctgcgtgttctggaagtaagctcaggacttgaatttcaggttttagtctttctcactagattcccaaaccagcctagtttggtataagagctcacagaatactccttaaaactctccccagctagaacagggaatgaatgaacctggtatactgaaatgttaataatgaaagaaagtaaaaaatatgaaatatccacaaaataacgatctcaatacaatgaacatatgtacgtgtgccgcattttatgcaatttaaaagttgtgtgtgaaatgaattt

SEQ ID NO: 56925 - DNA, 2585 bp, Bovine  19866880796313
aaatgctgtttctactgcagataccctagtatacaatattatggtgttgtttctgacacataacaacacatgttatggtgttgtttctgacagtgtattgctaatctaatgagggagaaaaattgtacttaaaatattcagcattattttaactaatagaatttattgctaggatgatttcctttgaagaacagctttcaaatttatgtgtactagtatattttaaaaattatttttaagctgttattcttattgtgaagatatgcagttggtcctttatatctacctgtatatatatcatttatgattgccttccttgaaacaaatagacatcatttttaagaacagctttaaatttacatagaaactatacagaaagcagacacttctcatatgttaatgctgtcataggaatgttcttgaaggggtggtcaaagtgaataccctttatactgtcttgacaatcttaattttcctaaaattatgtttataaacgttatgttataaacacgtcatattatttaggaaaatgaaactcttttaatcatcatttctaagaagttgtagcgcttagtaccacaggtgtgtctataaaatatttcacatgggaaaaagtgaagattgtaatttatgcaaaatttcttttgagaaaatagctctccttcaagtcttaaattctagacatagaagcacagtacataaggcgtatctgtctcatactctgctggtcaggccacgtctggagggtcacatcccgttcatgtccagtatgtccagtctcactctaaggggacggaaggagaccagcccgagaaagcagccagcgtgtatggacacttgaaaccgcgtcctgagcgacgaccgcagtgaccagggcaggaccctggcatgtcagaaggactgttcttttatacacatgctcatctttctgtccaacctcctttgaagataactcgcagctttctaactgttgtgtaattatcattttctgtttctagctgtcttttgggtttaaggtaaagtaagaaccctcttgtctggagttagcaagactccctcgccttagactgaactagggaactcctcggacaagggaggggaagtaaggtcctctggccagggtgttatgtaagtcggttgatggtctggtattttctttaattgatgacaggaagagctcaagagggacctgaaaattaagaaggaaaaagacatggtgcaggccacagcagtagctgccacctgccccgcagcaccgcccgcacctccagcccctccgccttcgcctccacctccgcctcccccacagcacccgggccctctggccacggccacgaccacgctgcctgtggcttcccagaaaaggaagcgggaagaggagagagactccaactccaagtccaagaagaagaaaatgatctctactacctcaaaggaaactaagaaggacacaaagctttactgtatctgtaaaacgccttacgatgaatctaagtgagtagatctttctgagctctagtttattctcttaaaagtgtagctaagtgtccagttttgaagaaaatgaggatatcagtagcagtgtaaatgaaaatagttaaacataagggtaatgatacttcattttgtggtcttgcatctgatattcttaaccttgacactagaataaaaatttatgttttttttttcccccacgtgttcatgattcatgtttgtccttcatcatattcttttctgtcaaaaataagctttctgttgctcctttgctttctccttttctctctggatcaattccagatcagtcagtaatgctctctgaagaaagagtgtgttactatcaccgcccaaagttgacatcatcctttctggaatcttcacaagcccatgattacatccaaccctagagacaacctagattcaaatggtggaaaagggctttgagttggaatggttcggaatttttatcatttaattgcaagtaattctatctttctgcaatagaatactgtaacctaatatttttgtccaagttcccactttcttattggggacagaagtcagaaaaatacaaaaaggagttctttcactcattcctcgagaatgacactcaaaaatttgataagcacggcaactggaagctgtttttgatagttgtgacttgtatttggttatatatacaagattttagagacattaattcataaatgtggttacacttttttttctatcatttttatcactcagctaggtatttagcttccattttcaacattcgtatgcaggccaacgttttaaaaccaaaattaacagcagtattaattttacaatacccaaaagtttgattatgctaaaaagtgcgatcatttagaattagggatgcttaatgtctactgtaagtagatgcctaatccgtttataaaataaaattgtctcttcagtgatgtttaagttgtaacattggagctattttagtgatgctgtttaaattataatccgtttggaagtgctaaatcaaaactttttgttggtaacttcagctgtgtattgaattaaacgcagatcagtataggcatcttcacttttca

SEQ ID NO: 56926 - DNA, 920 bp, Bovine  19866880813600
attacctgatgtttaactggaaatgtgtattttacccatgtagcttgttgcattgtttcttcctcttcttgtttttttctccttttttttgactttctccttttcttctctttcaattgatgtcattctatgtaacctaagaatgtatgaatagaaagacagagttacatttaaaaagtaaaaagataaaaacacagtactgaagattaagaaggtaaaagcaaagaatgactaactgtaattccacaacccggaaaactggaaagtcacaaaaataagcagatatacaattatgtaacagtagaaaatcaaacagtacaaaaaggcaaaaataaaacttgctgtccttcccatatgcctctccataagaaataactcatttataatttatttcatgcatataccaacattataatcacacaaaggatgttatattataaatacaattacacagtttttaatcaatggaaaactgcatagatctttccaaaccctaagatacattatcttcttgcctccccccaaaaagatcaacaagccccaaaacttttatcaaccaatatttctatttagcatttggggctgtagcgccttcacagggtccactaacatagaatttaggcttcctactagcagagagacagggaccctgcttttgggtgactggaagggttgggcaggaaggaccacattaatcaggcaataatcattaggcgtacagcatagaccatgctctttttttcaggcaggaaatcagataccactgcacctatctgtaaggagatgggtgagtctgtggtgaggttttaagttgattacactagatttctgtgaatgggagtattttccataaaaaagaacattaaccaaaatctacaaaggagctcctgtctctaaaagccctagtggtagaagaactg

SEQ ID NO: 56927 - DNA, 1343 bp, Bovine  19866880961092
ctttttgaaacccgtcctctcttccctgtactcacctgcacaccttcaggcacaggatttacaatgctcctgctctgggacccaggtcgccatcctgggaatcactgccaggcccctagttctgtcagctgccctcaacgcccagcccaggcccccaccccaccagttacgcaaatacagagagagccacagccaggctgggccggagtcaggaaggatcaccttgataaatgtgtatataattttccaggctccttgtcagggttggacgggaacagccacggtgatggaggcagcctggaacccagacagtgggttcctgaggacactttgacaaagaagattctggcacatcccctggccttctcaaagtccactttttctgcctctctcttacagtggttcttaagtttagcttcatattagaatcacctgggcaggtttaaaaactcctggtgcccagatgacacttcagaccaatgacatccaactctctggagggcaagactggccatcagtactttttaaagcttcccaggtgattctaatgtgaaccaaggctgaaaaccacagcaacagaagtgaagttttcaggggcaactggaaacacctgcttctatttaaatacagctcaagacttgaaagatggaaggaatctctgagattggatcagtttctattaaatccacataaccttttgctaaaacatgtctttattaatagaaaacatttatacgcatttcctatgtgtcagactctattctaaatgcttgatatatatatatatatattaattcatgtcattcccctaacaactctttgagggaaggcactattatgaggatgcccattttgcagatgagaaaactgaggcacattataggaactgccccaaggtcataaagctacctagtgatggagtcacaattcataacctgggtggtttggctccagggacttccagtaacctttagtctgttctgcttgtcatgaaagccgagacaggtaaagagcctgtcctgttgacagcctcaacccacctgtccagccccacctcaggcagagcattgctagggatccacagattgagtctgacctccaggagcctccccacatggataaagaaattgtggccctgatggggaagctgacacggctgaaggtccttggggagggtcaggcatagctgggctgggaacctgggccttggggctcagggggccctgagggcagtgaagaggaggtgacttacttctcattgtcgtagtacagcttcccaatggcccaggccacaatgatggggaaaggcacacctggggggagaccggtgtcagaggacctgt

SEQ ID NO: 56928 - DNA, 915 bp, Bovine  19866880988409
tggttacaatggagctgataccgttataatggcagttgtcacctagacccttgaaacttctagctagctacgtgtgctgcctgttggctccagtctttttgtttaccctgcggtaacatgaccctgaattttacacatttttttttttaatcccctgtatggtgttttgggcttgcaggtcagttttttacatcgtgcatgtatttatgtatggcatcggtctttttctaacaccagaatcacttataactctgcattaatgatttggtttgtacttctcttcgcctccaattttgagagacccagcttgtggcctaacctccagtatttataatggaaagataagccaaaaatgaatacaagtgattacttatggcgggagcaggggagagaatgggagcaaaagttagacttctaaatgtactatatgttgtagatttgactttggaaccataaacaaaagtgaatcaaaatgagaataaatcagtaccttaaagataagccttctctaactgtccttactcttttaggtggcaattgcattgtaataaaaatttaaatgtttttatgttcttctagttgtccgctgaggtgtatagaatacattcaatacagggaacagaacccttggtgctgttcaaggaaggtgcagtttcgtggtttagaagctttgcttgcagagccccagcagaaaattgaaactgttatctctgatgaagaagtgattaagtacgttccaatacttacaatttttactaaaagaaaatgcactctgggggattccagactcatagcttccaatgcaggaggcaagagttcgatcactggttggagaactaggatcccacaaaccttggggcacagccaaaattttttttaaataaaaaacaaaccaacaacaaaaaaaacttgcta

SEQ ID NO: 56929 - DNA, 3661 bp, Bovine  19866881233714
ggacatggaacacagactggttccaatagggaaaggagtacatcaaggctgtatattgtcactgtgcttatttatcttatattcagagtacataatgagaaacactgggctggatgaagcacaaactggaatcaagattgcagggaggaatatcagtaacctcagatgtgcagtgacaccatccttatggtggaaagcgaagaactaaagagcctcttaatgaaagtgaaagaggagagtgaaaaagttggcttaaaattcaacattcagaaaactaagatcatggcatctggtcctaccacttcatggcaaatagatggggaaacagtggaaactgacagactttaggggctccagaatcaccgcaggtggtgactgcggccatgaaattaaaagacgcttgctccttggaagaaaagctacaaccaacctagacagcatattaaaaagcagagacatgactttgcagacaaaggtccgtctagtctaagctatggttttttcagtagtcatgtatggatgtgagagttgaactataaagaaagctgagtgcaaagaattgatgcttttgaactgtggtgttggagaagacttgagagtcccttggactgcagggagatccagccagtccatcctaaaggaaatcagtcctgagtattcactggaaggactgatgttgaagctgaaacaataaactttcgccacctgatgcaaagagctgactcatttgtaaaaaccctgatgctgggaaagattgaaggcaggaggagaaggggatgacagaggatgagatggttggatggcatcaccgactcaaggcacatgagtttgagtaaactctgggggttcatgattgacagggaggcctggcatgccacagtccatggagttgcaaacagttggacacaactgagcaactgaactgaactgaggaaataaacatttgttttctcaagagtgtttgttttcttctcctcatcctctacctttctgtgactgccttatccctgaaaagaaattctggataattcttgttacagtacatccttgttaaataggatttttgcttcggcattaggcgtcttaaattgctcttatttattttgcactttccagaaccaagtcaattaaaaccaaaattgtgctcatcaaagtggcatgttcctttccattataaatagcagtttttgtttgtatgggcagttgggaaccttgtgagccacaggaccccaagttcagaaggccattaagggaagtgtagctggctgctccttccctccctccaccctagctgaagcttgccaagacccagctggctgattttgcaaagcccttgaaatatgtcattaatggtgcttgcttttgagattgggctgttgacctaatttgtgatgaacaaaacctggccaaatcatgccgtgctcccctccctgcagggaaagtgttcgtgaaaagtgtttagcaacatcaccgatttaaataacctcagctaataaagatgatagaaaacactccagctatcaagtaggattttttgaggacagaagagcaatttaattttgagcatttgtatgttaaatggcatgttgttggcatcgtttgaaagcagaattctggtgtctataaacgcccagttcctcctaaatatttgggacagtttcataacactgtgtaggagttgtacacagcaaaccctcttaaattgatcagtttgtgcattcctctcaggcttacaataaaaaatgtctccctatcctagttcctagagtggtgcaatggaatggactattaattaggagccagatcagcctaagttaaaatctgtctctactgtattttagtgagcgtcctttgggttatctgtgtagcccacaatccctcgtgggctgtaccctgcaataggttaccatataatgtctgattaccatataatagcagtatgctaggtaaatattgtagtcatagaacagctattccccacttttttttttttatgtaattattttctgttttggctgcaccacacagcgtatgggttcttggttccttcaccagggatggaacccacaccgcctgcatgagaagcatggagtcttaaccactggattaccagcgaagtccctattcccaacctttaacaacaaaggtttctttgctgttcttccacagacctctattttgatatttacctcctcagttcagttcagttcagttcagtctctcattcgtgtccgactctttgcgaccccatgaatcgcagcacgccaggcctccctgtccttcaccaactaccggagttcactcagactcctgtccatcgagttggtgatgccatccagccatctcatcctgtgtcatccccttctcctgccttcagtctttccaagcatcaggggtctttactagtgagttggctcttcatatcaagtggccaaccagtggagcttcagcttcagcatcaatccttctaatgaattttaagggttgatttcctttaggatttactggtttgatcttgccgtccagagtcttcatcagcacaatagatggaaagcatcagttcttcggcgctcaggctttgtggtccaactctcacatctgtacatgactactggaaaatccatgactttaactatatggacctttgctgacaaagtgatatctcagctttttaatatgctgtgtaggtttgtcatagcaagtgtcttttaatttctggcttcagtcaccatctgcagtgattttggagcccaagaaaataaaatctgacaacatataggcctttacttgtgatacgaagctgcttaggtgagcaaacattttaccaagaaacaatcaaacaaagctgtgttttctactctgaatgaggttgaatgtttagaacttgaacagattcaggtagggatgtgtgtttgttagtttcccagtcatgtctgacttttgcaacccggtggactgtagcccatcgggctcctctgtccatggaattctccaggcaagagtactggagtaggttgccattcccttctgcaggggatcttcccaacccaggaattgaacccaggtctcttgccttgcaggcagattctttaccatctgagtcaccagggaagccctcagggagagatattggaagcttagtcataaaaacaaaggaatttgagaaagaattggatgactcagaaaactttgaattcattcaaaatgaatgaaaaaggataatataaatacataaatattagtaggctgttccaactgtagttatgaaagacatgattttttagcaaaactgttggattacaagagaaatgtggaaaaatacatagaaatgagaagacctttaaaaactggcttaaaccacatttttagatgaccagtgactatccccactcttaatttttgtacatcttttcaaacaatttcttttttttttttcaaacaatttctctgtcacatcaaggaaacattaacttagtgaatgtgaaacttgtttcttcttggtaactttgtaaaataaccttttcttatgttacagaggtaatcctaattttggaaaattttaaaaacccaccaccacaaagattaaaatagcctaaaatctcaccattagattgtatattttttcatagataggaattctttttccagttagttttaattt

SEQ ID NO: 56930 - DNA, 898 bp, Bovine  19866881271930
aacaaagaaatgaagcctcctttgtttttgtttttaaaatcactagcatgccagtgaggggggaaataaagtgtctaatgaacgtatgtataaagaaatttctttaattttaaactcttaatttaaaatgatctcagtattcattccaggtatatttgggtttaagaacttttgataaccgggcattgaaattaaagtggttgtattgaaaggatgttactattgttaacaaagatgttttgttctattcacaaagcagcatctctttactgctttgcagttaccttgattttctaaaagaaaagcatgctcttcgcttggccagactgttgcttagcattcttgatacctacattgcttatggatggcatttttaattaacggtttcagggtgtgggggtgtcaccatctaaataatatcacccaggtctggatttagagctgccctccgtcttggccccagaccacactgaattaattcataaacttctcgcaagtctgccctttggaattgaagagactctcacgtgacacacaagggctgatataaaaagacagcagaccacatgatgcagaaaatactaagggaaaaattccagctgtaaatactcgctctaaatccccaccaagctaattagtgatcaagatggtagcttgattaacctattgttgagcgtgtaccattcattgtaaagaggcatgaagttaaattctgccaggagagtggcagaggaatccccatctggggaaactgctaatgaattgttgtaaaatttccaaggagtggagtggggagtgcaggataaagcaacagaaacatttaaagtgacactaattattatttttatgcattgcacataccgaagataacaggttctttgttgaagtttttttatcc

SEQ ID NO: 56931 - DNA, 1764 bp, Bovine  19866881317023
ggtctaccttatctcccccttactgctgggtgcggactcaaatccagctctcccaaatcccactctgagaccttgtccacttcatccactacagtagataattcattgctggacatataacttctcataacagcactcagaattgtcttcattaattcaactgatttatttatttttaaaaaaattatttctttctttattttttggctgtgctgggtcttcatcgctgctcgggcttttctctagttggagagagcagggctactctctagctgtggcgcttgggcttctcattgcagtggcttctcgttgctgagcacaggctctagggtttgaaggctccagtagttgtggcacttcttggcctttcatataatatttattgaacacctactatgtgcatggctgcctaccaaagaatgttcacattcttggccttggaaaaaatatgacaataaacaaagaagcgcaccctagtagcagtggggtgaggtaggaggaacagcagtgggcctggagagagccgacctgtgtgagtaccagatccggtccactaagagcctgcagaaccacaactgtgagatacattaaagataatatattatttacaggataaagaggctcaggaggaaaataattttgaaaagcgctatataacaggagatatatttagacagttggggttacatgtacctatacacagttgattgacagtaaaaagactgtatcaagctatgatatcggggctgtcacagtttaggagagaaaagaaattgactgaaatgctgttatatggggcttactatgctgggtactttcacctgcgttcggcgatgtgttatttaggcagtgtatcaattaggatggaacttggtgggttcctgcaagaaaccgcaaataatagtggcctaaacaggatagaagggctttccaggtaactctatcagtaaagaatcctcctgccaatgcaggagatataagagatgcaggttcaatccctgggttgggacgatcccctggaggattgtagaaatccactccagtattcttgcctggagaatcccatggacagaggagcttggcgggctacagagttgggcatgaccgaagtgacttagcatgcacacatgcaaagagagaagacaagatacacagaaaagcagcaaagaatgcagctgggacaagatcaggaagacaatgccatatgcccgggcgacccagagagagctgaggatgccagatcatcaggacaacacccaacacaacatcagtggtaccagctatccccactccaagatccctagtttccatatttccttgggcaggtaaggaggtgcaaaccccttgccttcacccacattgtattcccttcactgagtcatagtttctttgtcatctgctcccactcagagtgactcacccacgtcaacgaattcaacacactttccccacccttcctgccattcccaagactggttctcagtgcacttggggtcgatgggggcagagagtggggaggacctagctttggctccagtgctgacgttgctggggagggaggaagaaggatacctagcaacaaagcttctggagctcccgaaagggaagactcttggatttctgctgaaggcagtgtaacatctggaaagcagtgtagaaattggactggaggcaagaaatgaaggagggttggatctgcatggttggctttcctctgtgagggcttccctagtagctcaactggtaaagaatctgcctgcaatg

SEQ ID NO: 56932 - DNA, 756 bp, Bovine  19866881382107
gggctgtgaattcttgaatgggatgcctgtggtggggaagggcagaggcaactctggataactgtcctgacaagctaagaaaaatgacattgggtgtggttgaaggttggtagctagctgcttcgaggataaatgtttccagtgacttccgaggactcaggaataaaggaataaaaatcaccctgaatatctgaacgcataaaagctattttcaggaaatgcaatgctaccttgaaacatatgtctcttcccagtttgttttattcttaccgttttgggttgttgttgttttttaatcctctctttctcttccttcagaatgaggtaggtaattgatttctttatcaacatgccgggtgatacatttttcacggctttcagggagcacagaaaatctaaaaccattgtctggcagatgcagctttcagctgcaatcatctttatcatcaggtaagcctgctggcatatgtttttcaaattttattcagaagcgttgtcttttactggtcaagtaacattctttgtgattgcgttatccaaaaataaaaaagaatttttagcaatgatcgaaataaagcttgttagatcattttaatggtaatgaattggttcctgaagatttgattaaagagaaaactaggtcaatttaagcagagtccaaatgaggcagaaggaaagtccatagaggggagggaaaaaaggaagttgtggaaccacagatacactaaaagaaaaaatttagagtataaaaataac

SEQ ID NO: 56933 - DNA, 857 bp, Bovine  19866881946554
gcagtttgcctggctctccccacgccaggattcacttacattccttgactccattatggggaggataagttggccaagttctggcccctctggacccatagttggacctcacaacctaggaccttgcccgtgagatgagctgggactgaaggcttggtgttgatgtctggggctctgagctcaagacttttgagtttttcggatagataatgttcacagagattcaaaggaggaaagctccaaacagattataaaaagctctagccaaaacctgctcctggcagggtgcattttgacatgttgaatagtgatgggctaaagagctctgggtgaataaagagagattctgacaagtctgtgcagaagataaagctggagggcaccgatgggggtagtggttgttcacgggctacattaaggagctgcagttagaaaaccagagggaggagcaggggagagtcaaccaggagcattgaagacaacctgccaaaatgtccccttaggacatgcaaagctaaccattgcgatctagcagtcaagcgtgccttcagtgtggacagaacgagccagagactagaagcaagaccagagataaaaaggaaaagagcaaaggagaagggattgcttaaaaaaagggtgaaagatgcagcatttgagtctgctagaaagtgaaagtgttatttgctcagttgtgtctgactctttgcgagtccatgggctgtagcccaccaggctcctctgtccaggcaagcatactggagtgggttgccattccctcctccagggggtcttctcaacccaggaatcgaacccgagtctcctgcatggcaggcagattctttaccatttgatccacc

SEQ ID NO: 56934 - DNA, 1104 bp, Bovine  19866880440071
tcaatcaaggtttctctgtacaagccagaaaggacctaggagcattacagcttttgttttccttcttaagccacaggaattattggagaaagtccacagactactgactttaagtgattttaggtctggtagaaaaaacaaaacaaaacaaaacagttccttaggtagagaacagagtgttcatcagagaaatctctgtctctctctcccttctcaagttcaggacatctgttatctgctgcaagctgtggaccctaagcattgacattatttgagtttgcattaatcattttaatccttatttattatggagcacattgccaaagcaaaacgaaactctctaaatttcagctctaccacagaggaatgaaaggtcagtttacccaggtccacatctagttgaaaaaaatctaaagcataaatcttacctaaatataccagttaggtacatctcccctgcattcctgaaaaaatgttacattagtgtaaccattgcagacaaagggctttagagaaataagaggtatgccccaaattaaagcgtctcattggagggtttgttgaattggagggaaatttctccatggacaggattattagagcaagagttacaccaggcttatggttccatgcaccccaacagaaataggaacagccataatatgattcttttggagatttgtatttcaccaatggccttcaaacacatcatgacattgaaacttcatgagcaattcgtatgaagaaagcaaggcattttccttctctaggtaagaacttgaagccctaggagattaaatgatgtgcctgtaatcagttacagcagtcagatggggtaccaactttctttgcacagtttcaatgtgccagccactgtggtgaccacttcacatgagagcctctctatcccttgcaacaatcctttctcactaaacaatgaagttcagagaggttcgataacttgcccaagctcataaagcacagagagtctgatttagtctatgtttttctttgcagtttatggtgcttcccagttagatgtacagagcaaggttttgaaaaccaggacttctaaccccaaatgttacctcctccataagtatg

SEQ ID NO: 56935 - DNA, 4694 bp, Bovine  19866880473747
acccagcaagccaaaaataaacaaacaaattatgttaaaaaaattaaaggtcacaagaaagcatgtgtaaggaaacccagctaactttctttagcccaatgtttgctaaactcctttgaccaggaaaactctgtcttccccacccccctcccccataactattaatgtttttccattgaattaaactcagaaagcactgctactagcaaatgccctgttttcataatcttcacattttcagaatctcattatttacatacatatatggaatcattaaatgactttcaggaaaagattcccataatgcttctaaacccaaggtgggatatcaaggctgtcacattacctgtctgtagctctttgtctgtttctagaaatccaggcccaaaatggtatttcctctcccccatgggaagttatgtgagttggactttgcaaagtactttacaaaatattttcaaagtaaaggtagataatttctgttaaagaaaaagctttctagcagtggcagatgagttggaataactctttccctccagtcactctgggccaactttgatcacaggtgggagctttcgtattaaataaatgcaaagagaagaataaagactattagaatcaagcctccctgatggttcagtggtaaagaatccacctgccaagcaggaacacaggttcaatcccggggttggaaagatcccccagagagggaaataccaactcactcaagtattcttgcctagaaaatcccacggacagaggagcctggcaggctatggtccctggggtagcaaaagagttggccatgacttagcaggaaacaacgacaacgctgaggccactgaggtaacagaactccccaagagcagttggttaagagcagtgactgcatttctgacttcgaccggagtatttccttccaccatgttccctgcatcctttaattctagcagtctgaagacatggaaagccttcaaaaaagttgtgagcagtaaagcagtgtaaagcccctctagttactctcaagtatatacttactaacaaccagggagaagccacagtcaactgggacaggctttacccaacccggcaaacagaacgtgatatttggcaaacctgtgagcagagcttgattgatggattgcccaacaaagactctcccacttctctctaaatcacaaagaacaagctctttccccaccaccagctccgcctcttcctgcaagtctaccctggccagggataggggataccaggccactttcctttcccatgctaatgcagttcaaacaaccatcctttgatttcccagcaaaattgcctacctggggtcactcagcaataaaaaggcataacaaaactgcaactaaaaaaaaattaacctttatatactgcaaacaacagaatataactaaatccagaaagagtgcctgtgagtctccatgtccatgtttggagggagtggatggaagcatttttaaagttcatgtttctggttttctcatccttcatttctccttcaaccccctgcgccacatccctctttctttccttacttccttttcttctttcatcacttcctccttcctcagcatcagcagtcctgacgtcccacttcctcctcggccacctccttagtgacacagccaatatgctccatgtgtcctagggttggcagtctggttaatcccttctttgctcaaatcaagccacaggtttcccgtttcccaaggcacctgcctccagagtggagaaagggtaggatgcgggaaatcactgctcgagaaccacagtgaggcactactgaacagggcatcagctcaccacaccgcagcatgggctccctcgggctttccttaaccgagactgatggtcaaaaagagagttgatctaaaacccagtgagtccaaagtgtgatctaatcatttttttcttcaacacacagagaaggtgggcaccatgcaattctagctgtcagcttaattttgcagtgatgctaggaacagatcaataatttggttgtgtcgtttgccaagactaactgaagcagttaaattgtgaagtagtgaagaggtgcacactcagtcacttcagttgtgtccaactcttcgtgagcccatggactgtagccggtcaggttcctctgttcatgaagttttccatgcaagaagactggagtgtgctgccacgccctcctccaggggatcttcccaacccagggatcaaacccgcacctcttatgtctcctgcattgcgggcaggttcctagccacttatgtcacctgggaagcccatgtcaagagataaatgaattcaatttattaagcaataaattttaaagcatattaagatgctttaatatgggtaattttggtaattttaatatgggtcattttaaagcatattaaaaggaccattgtaaatagaaaaacagacatttacattatttttataaatcaaagcaactaataaatacacatttttatatacttcttcaatgaccaacagttgtagtactgcccacagcaatgttatcctaggttgcagcctatgtctgagaactgaaacctctctttttcatctcaaagaaaccctctacacttgtggacctccaagaggagggtcttctttatgcttcttaaggtatcccttcttccgatccttctttatattcctaattctgctctgttccaggcgtatcagagagctacagactctacagaggcctttggggacctctcagcctagcactgtccattcgtttttccttaggaacacaattcactataatgtatcatcactggaaaccccttaggaaatcttttattcatttcatcctttttacagagtacattaagaaagatttaaaataaagcatttcacttgagatcaatatattattaaagatattatcataaagttcatttaatacaattttaattacatttgttacgtgtgaaaacaaatttcacattttcctccagttaataagaagtgctatttcatttaccttgagtgtaagaaaaataatcatttgtatacaatttaaatttaaaggattacagacatgttaacatgcacattgaggcttaactgcaccatattgtgtcaaaatttttttaaaaattaactttgtgatctgatagttgaaatgttttcatcatatgcttaacccacttttttgggtaatttttatgagcacacacatctcaataaataaccatagagtggatataaataatttttaatctaagtaaatgaagagccatagtggatggagcaggcgctgggtcttatatttttagcacctaatatgctatataagcagagaaggcaatggcaccccactccagtactcttgcctggaaaatccatggacggaggagcctggtaggctgcagtccatggggtcgctaagagtcagacatgactgagtgacttcactttcactttttactttcatgcattgggagaaggaaatgacaacccactccagtgttcttgcctggagaatcccagggatggcggagcctggtgggctgccgtctatgcggtcacacagagttggacacgactgtagctacttagcaaatgctatataagaaccccgatcaactcagcttgaagatatgcttagaacaatcttaaggttattagcaggattatcatttttacgcttctggtcagcttatttgtatttcaacatcatttcctctcttcaaccagaagttcatgaaggttaaaaattaaactatatatgtgtattagttagctatggctgtaataataaaatatcacaggatgagtgtcttaaaccacagaagtttatttctcactgttctggaggctgacaagaccaagatcaaagtgaaggcgttttcaatgccgtgtgagaactcttcctagcttgcagacagctaccatcctctctccgagtccttacacggagaaagctctggtgtcatttcttgaaaggcaccagaacctatgggactagggtctcactcttacaacctcatttaacctttctcacctcttcatacagcctatctccagaaacggccacactggcgttacgacttcaacatataaggtgggcacacaaatgttcagtccctaacaggatgttgaagagtaaaagcaagtcaggtatatataatggtcaaagcatcagtcaagtgagtaagttctgagcaccatcatctgaccgaggatgcacatctgcccaggaaacatgtgcccaagtggctgcagctggaagggaaaggcctcgttaaggagtcggggaagatgagccagctgcccgggtcaggacaggagctggctgtgtggtctgacaggcaccgccgctggaaaccagcagaggaactgacaacgcacgggccccacgtgtggctccaaactctggagtcatcactttcgactccctggagaagttctgcacattctgcaggacaagattagtgggcccgggtggtggtggtgtcgtcactaagtcatgtctgactcttgagactccatggactgtagcccaaacaggctcctctgtccatggggtttcccaggcaaaactactggagtgggttgccattcccttctccagagaatcttcctgacccagggatcgaatccatgtctcctgcattgcaggtggattctttaccgctgagccacctgggaagcccttcaatggg

SEQ ID NO: 56936 - DNA, 2069 bp, Bovine  19866880481379
caagaagatccaaccagtccatcctaaaggagatcagtcctgaatattcattggaaagactgatgttgaagctgaaactccaatactttggccacctgatgtgaagagctgactcatttgaaaagaccctgatgctgggaaagattgaaggcaggagaagcagacaacagaggatgagatggctggatggcatcactgactcaatggatatgagtttgagtaaactctgggaattggtgatggacagggaggcctggtgtgctgcagtccatggggtcacaaagagtcatgacggagcacctgaacggaactgaactgaagccacattatgtaagataatctgctttgtgcatgcatgctaagtttctttggtcatgtctgactctttgcgaccctatagactgcagcccgccaaggcttccctctgtcccatgggattgtccaggcaggagtactggagtgggctgctatgccttcctccaggggatcttcccgacccagggattgaacccacgtctcattatgtttcctgcattggcaggtggttctttaccactagtgccatgtgggaagcccaatctgttctacttaaagccaactcattgtaaatattaatcacatccacagataccttcaaagcaacatctagactagtgtttgaccagtaactgggcactagagcttagtcaactggacataggaagtctgccttcacagagaccaaacctcagaaacagataaaagtgacttggaagatactatacagggagagtgcttcattaacatattattaatatctttagagaaataagagaagatagtataacctcaaaacaggagccggatgttatgtgttttaagaaaataaaagctcagtgaacaaagtaagagcctttggaaaaactcagcatatatgaaaatgtcaataaaagtttcaaaagatgataaactcagaaagtaagacaaaaccccacataggtgtaatttaagagagaaaaataaaattaaagaaaatccaaaagatctgacatccaaaccataaaacttccataaagatagaacagagaaaataaaggaaaggaaatcatcaatgaaataaagaaaatttcccaaagttcttacaatttacagcttgtgagagatcccactgagtacccaggactggttgaagtaaacccacatgaaagtgtacatcattgtgaaagctcagaaaactgggagcaagagaaggccttccaaactgttaagagaggaaaagaaaccaggtcacacacaggaaccaaaatgactttggatttctcaaaagtaacacagaaggaattgcttagaattccatacataacttaattatcaaaaaaaaaaaaagtgtaatgatggagtaaaaatacgttcagctgtgtgaggtctcacttgacctcatgcacacccttctcaggaagctgctgtggaagagatgtactgccatgagcacagtacctagataaagtcctaagtagagacatcctgtctttacagtagcagtgtggtggggaaagcatcttccttcgcatcctgatctctgttcttgggatctgttccctgggtgtcttttcacccttcttactatcattcatgtatgtggttaattagatgaatttttgtggactagcacgagctacaaaccattacgtggcatttgtgtggcaagatgtgttccaagttcaaaataaccaatttgctaatcatctttggaatttggaccctcttcagaggaattaggaggccacattactgaagagtctgtgcacgctgagcatcagcagcagcatccgtggctcacaagctcctctgtttctccaggttatcagtgtacttgtctctcccaattcactgggagaaactgtgaatctgagatcacagcctgcttcccaaacccctgccggaacggaggctcctgcgaccccataggaaacactttcatctgcagttgcaaagctgggctcactggagtcacgtaagtgcgactgtgcagttagtctttttctacactgcctcttcttggtaagaaaacaaaattaactggggcaaaa

SEQ ID NO: 56937 - DNA, 1560 bp, Bovine  19866880504678
tgctgctgctgctgctgctaaagtcgcttcagtcctgtccgactctgtgcggccccatagacggcagcccaccaggccccgccatccctgggattctccaggaagaacactggagtgggttgccatttccttctccaatgcatgaaagtgaaaactgaacgtgaagtctctcagtcatatctgactcttagtgaccccatggactgcagcctaccaggctcctctgtccatgggattttccatgcaagagtactggagaggggtgccattgccttcggtgctatgtgacttctttatgtattggtctgttatcttatttcgttatcttattgtctttgctagagtgtgatcattaggtattacttttcaactggactagtctagactctagtcctgcaattgaaaaaaaaaagtctttggagtatagaatggaaatggtcccacatctgaagactggtgtaaactcaggtgagggaggagcccttcttaacttttcctggcctcttcctcatttaccaagagggacacttactgcgatctggagaaggtgctggatgtgatgtgggaggtgatgaggaattggagatgtagagggtgaagtactgtgatgttggcacttccaaggactgagagctcctgaggtccagggcaaggagagaaaggaaggggtttctgggcgtgtgccctggcatgcagagaggtgtggacctgagtgcagaagcactgggaacctggtgtcagtatgttcctccgcaacctgcctcttattctgaattgtgtcctttcgtcatgcttctgaaaggcaaaaatgatccaggaaaatatatatataattaaggggttggaaggagcaggataaataagttatgttcattaagatgttttcataattagtaccccctcagagaatgagatctgctagattttattccttgttcctcctttataactgatcttcctctgactcaatttccttatcattttaatgctttaattttaatgcttgctgccctcacagtttgaagaggtgtcctgagaattcacttcctacggcttgagtggttgagaaatctaattctctagccgaaaacatgagtgttactctctttgtgatccttgagaaacatttatcatccagttgctctactgagaagccaaatgagcagcaagaaaaactcatctttttagattcaaggagaatctcactccctccactgcaggaagaaaacagttcctaagagcacagctaaggtcatttgagaatctgcactttacctttgatagctgtgaacttctcaggttggaaataggacctaagtccatcacaacagcatttaaacttagaactcaatggatagcaattaggaaaaatttaaagcacaccctggaggctccaaaagtaaacatttctctgggcagatgtgttatagctgaattaactgggtgtttgtgcaactgcaatgaatcggagagataacagtctttattgcctgtagatgtagcctgtgatttcaaaatacaagtggtgttaaatgttcccagtagaggttcaggcagttt

SEQ ID NO: 56938 - DNA, 2768 bp, Bovine  19866880593852
tgaaatggacatggccccagtaaatagcagacagaaacataaaagcagcaccaaaaattgcccatctgaaacaagcactgccatctgcctaggttgggaagtataatttagtgaagaaacaggcagaacacgtacttccgagaatgttaatccacagtcaataaagtaactaaccaatccgtagtaacaaccccccaaaggacaattctggagtgttttattctgagagcaaattaaagcaagacaaagatgagtctaccaaaaacacagcagactctcctctatttctcatatgagtcctgagagagagtcatggaaattatctatatctttccgtatctcctacctgcagtgtacagagtcaacccaaaatctttgttcaagtgcagctacactggattaactctgagctcagggctctacactattgctttgatgcagaatatgttcagatttaactatttacaagccgtattgatctaggaacagagtcagagttttgattaggttgcaatgagccagttacccaatcagaagtcctttcatcaaatcattaatgattattttaaaacagtagaactcctagggtgcataaaagctggtactttattctttgcacgtgagaacggatcctcggcttttctggtgcctcagtggctgggaagcattcccacgggacctgtggttgtgtagcacatgtgaccttgtgtgcttgtgttggggtcagggcaggatgggcacaagtgttttcattcatcatatatacatgaccatagaattagcttttcagacactaatttggggtttggggcccttcatttctgtgcaatctattggatttggtgctctcattaagatgattaaaataaaccagtctatcaatatgtggtccaattatttcaattgtctaaacacaggtttagtctggtccttttctgttgtgagagaagcatgacataagagattgcttttctggacttttccaggacacctgggtcactccaagctcccttaagttttccaaaatgaaatcagagtggaaaagagatgaacaacatatatttcagtcttcaatagatgtttacgacaagtgatacatccactagagtttccagagaacgtacatacgatctaccggtaggattccaagcagttaaaatggcatattttcattacattattggcttccatgatgccagggagcttctctttaatttgatgtattgttctattttcactcaattgaaattaaatatgacttgtttttcccttagaggaacctatctacaggcttacttctgtattacttctgtattttttaacccgtgaatcttgttttccaaaaattgtacactgagtgaacggtacactgaggctgtataaatatacacatgaacactcccctcattcaatttcatcacacacattttcagagacacttctcaaaaattactcgtctaattaacttctttatgaacaaataaattctcttcacctatggatgagctacagttacaatctagcatctgggtgtcggatttcagaatcttattaatgggtggttattagctgaagatacaaagggagaggtgaacatatagagtgaatttacagttactgtctgaagagagatggtgagaatcacccagtccctctaatctaatttacatacaataaacagggttttagattaaatgattttttcctgtagttccataatttacgtatgataaaactgatgcatcgtcattatcaacttcagcattttaaatctttcttttcctttccctgaagaggcctaaggaaagcaatatttcattgttctaaagtaattttcatcttctccctttcccaggtagatttcatcttgagtgtcacactatacctgtatctatccacacagtacaaagaggcactcttatcaacaacagtctttaagtactgtcttcccaaggtttctttctttctcataatagtcaacactggtgaaaattctaaaatgggtacaatttgcccaacctcagagtctaccttatggtgagggattgggggcaggaggaaaaggggacgacagaggatgaaatggctggatggcatcaccgactcgatggacgtgagtttgagtgaactccggaagttggtgatggacagggaggcctggcatgctgcgattcatgggtcgcagagtccgacacaactgagcaactgaactgaactgaacagttgttatataagaaagtaacaaaatgtgttataaaagagtaacaaaactgggccactggacaagggaatggcacaccacttcagtactcttcgcttgagaaccccatgaactgtatgaaaaggcaaaaagataggacactgaaagatgaactccccaggtcagtatgtgcccagtatgctacaggagatcagtggagaaataactccagaaagaatgaagagatggagccaaagcaaaatcaacgcccagttgtggatgtgactggtgatggaagtaaaactccaatgctgtaaagagcgatattgcataggaacctggaatgtaaggtgcatgaatcaaggtgaattggaaggggtcaaacaggagatgacaacagtgaacattggcattttaggaatcagtgaactaagatggactggatgggtgaattgaactcagatgaccattatatttaatactgtgggcaagaatccctagaagaaatggagtagccatcacagtcatcaaaagaatccaaaatgcagtacttgggtaagtctcaaaa

SEQ ID NO: 56939 - DNA, 4588 bp, Bovine  19866880596824
catcaccaactcccggagttcactcagactcacttccatcgagtcagtgatgccatcatgccatcatggatgatccagccatctcatcctctgtcgtccccttctcctcctgcccccaatccctcctaaattggtgctaaatagtagggaggtgtagggggagcaagaaaaggcagaagcaacagtttggcctttaactcatatctgtgaactgtttagctaattataaggttatttaaaataagggagaaatcatctcagttgtgagtgatgatttaaaaagaacaagaaagaaaaagagaaaaaataaaaagaacaaagagactgtcattaatgaaagaatattcatgcctggaagaattccctctggctaccagggtatctaatcacagggaaagagtcttacttccccagatcaaaggctagaatgcaaggagcagtcaaagaggaaatttgagctggagaaagtagagcaaggtgcttaaatgactccttgcacatgagaatgttgataacacagttatctgagcatcttgctgttgttgcagccctgagttatgtgtcactctaaacttccatgacacatatgtttctacaatcattctcttgggccttagaggatgctggaggatattggtcattggctgtcctgataaacctctgctctcaaatcatgacaatcttagcaccagactcttgttcagatcattcagagttttaaaagtgggcaacccagagcatgaagcatatttctttcagagaagcaggattctgctcgaaccacttccaagcccactcaaacccttgacaaggctgccgagtctgctagctcggaacagcgtggtcagcagatttgaccagtgttatacctctgtctgtcccacgagccggccacaagaacccaggggagtcagggcccagaacactgacttgtaataagagggtaattatgactctgaaaatcaaccacagagggaaggctctctcttggcaaagccttaaaattatatgtatttcataaacatgagctggaaatagcaaccaccgtggaaaagaactagcctagtcccactgtgacccctgtgcttccagacccagtgggtcggcagcagcccagggagcacccatggtctgaatatgcgggtctcagtcctcagagtctcgtcctgctcagctaaagcccgtgaccagaaaacacagtgcagataaactataatttggcaaagcagtgtggcaactgagactgccaggcagaaacactcattgaggctgctttcataagactgaaaacttaactcttttttttttttaatatttatctttttaattgattgatgattgctttacaatattggtttgatttctgtcatacatcaacatgaattaaccataggtgtacatatgtcccctcatttttgaatctctctcccagcttctaccttttcccacccctctaggttattacagctcaatcttaaaatgagaagtttataactttcagtgatagagtcctatttgttaacatgtctgtttgttactatgtccttgacactgtggtaagcacttgtaagtgcttctgcactgagatacagttctcacccaaatacccttgttgttgttcagtcgctaagtgtgtctgactctttgcgacgccatagactgcagcacgccaggcttccctgtccttcactgtctcccagagtttgctcaaactcatgcccattaagtaggtgatgccatccaaccatctcatcctctgttgtccccttctcctcccgccttcaatctttcccagcatcagggtctttcccaatgagtcagctctttgcatcaggtggccaaagtattggagcttcagcttcaacatcagtccttccaatgaatatccagggttgatttcctttaggatgggctgattttatctccttgctgtccaggggacactcaaaagtcttctccagcaccacagcttgaaagcatcaattcttctgtgctcagccttctttatggtccagctctcacacctgtacctggatcagtggtattctttgctcccctcaactcccatttttctgatgaaaaagtaaccagcccactggcacaccgctagtaaggtcgggaagccaggacttgatgcctgtttgtggaactcctgccccctgcccccagcctacactcttaacctttgttactcaaaatgtgttccaagcaacagtagcagcagcatcactggaaatgttaaaaatgcagcatctgagaataaatcagaatctgtgtttttaacaagatccctcagtgacatgctgctttatctctctgtctccgaattgccctgaaccacccccccaaaaaagaaacaagttctattctgcttttgcgtgttgaatatagtatttctcaaactccacagtgcctctgcaccacctgagaacctgattaaaatgagatcttgttctagaagactctcttgcttgttaaggagaaaggaaaatctgttgacttgccccggtcattctttttccacgtcagaggaactttctgctaggtcactgagttgtattttgcaaattcctgaacttaccaccaaaaaaaaaaaaaaattatcagtgaaaagtttggagaaagaaaaagatccaaacctacaaatcagaatctcagaatctgcaagagtagaattcaggcatctctgtttataacaagcctccaaagtctatgcagttctgaacttgagaaccactgacatttgagaatcccaataaattccttatttgccagaatgtgaatcagtgaattccaggagacataggacattcagaaattgaatgtcaggtgcatagcctgcattttgtaataactgctttactgtaaagattgaactttgttcctcagaagtttggggtcaccctgagctccctttcaaaggtaaaagtaatagtgtgtaccttccccctctaagcaacgtgcacaaggcagcaagttcccagatgttgtaaatagctgggcacagaagcatcttcagttacagggtgacctgtgctactttgggtgatgttttgagcccctaacttgtaaatgtctagattaattcagtctatcaagctctaatcaattgcctgacttgtgcaaagccctgtgttaagttctaggatcctgttgatgtctctgtgaccaacggatccacttatgcggcctccctcccttcatggcgggcttaaaagaattggacaggtttcctgggtgtgctccgtccactggcccacttagcatgggggacaaaaaacccaggctccaagataatatactgtggacaaatttgactaagatttgaagcttatgagggggaaaagtttttttttttttttttttcccctgggtctttcttctaaatactgaattaactttctggggattactttagaaaaacctcatagtaatagcattaataatattttattgatcctaatagaaaaactcaaaaaccctaaagcactcaaattttgtgcacacacaaaagaacatgctagaaagtgaaatgttacagtgtgtttaatgttgttaacacagtaagtgtttctggatcctcaaggaaaatattagaggctcagcccaatgtatagtgtgggaattgtgacccagctttccttgggaaagttagagagctccctttcaaaagttttcatctcatgaggtctgaaggtattgcatgggccctgcttggggaaagaggaaagtctgagtgacttcaggttgagggggtgaagtagtgacagaggctgtaagccacagctaagctcactccacttttgggtggcaccccacataataatttggtcagcagttttctcaagctcactgagactcacatggacataagtttcaatatttccccataaatagcccacatgcatgttaagtcacttcagtcatttctgactctttgtaaccccatggactgtagcccgccaggctcctgtgtccacgggattctccaggcaagaatactggagtgggtagccattcccttctctagatactgcctacaagtcagagttaaaaaaaaaaaaaactcatggctttccattgtttgattatgagcaagagaaacgaagctgatttctgaatccattctaattacagtaattacaacaataaagcacctaatgtttgtgggcttcattgtggttgatgaatccagaaacctcattatcctctgagtgggtatgagtgatgcttaattatcagataaaaacggaggttcctagaggtcaggcagctcagctgatgggaaacagccagaacttagatgtgtacccaccacatcaccgccctctccccaaatcataaagttcctggagtgtctaaatgcagtccataactgagcaagcatagtggttgatgctgacttcagatcccaagtgctagttgcacatttgccattatttccctctttgtgcaaaaggcagatgtttccttatcaaggagccaaaaccgaatcaggataatgttcacctccaccaagcgagtggggcagaaggtggaagtcatcacttggagaatcagatcagaaaacaactactaagtcaaagga

SEQ ID NO: 56940 - DNA, 1129 bp, Bovine  19866880669380
cattgagtctggtgatgccatccaaccatctcatcctctgttgtccccttctcttcctgccttcatcttttccagcatcagggtcttctctaatgagttagctcacatcaggtggccaaagtattggagcttcagcttcagcatcagtccttccaatgagtattcaggattgatttcctttcggattgactggtttgatctctttgcaattcagcttcattatcagtccttcttgacatctgagtcaagggtatgcaaaaaatatccataagataaacttgatatgtggtcacattgaggggacagaaaagtgtgtggtcttttgaaccctggctgtggtccatgatgtatctgaaactgccctgcagctctgaatgggagatgctgttaccattgggcaaagtcttaaagtgaattcaattgcaaggtccacatcctgcctccaaggaccccctagagtcatgcagacagtttcatatgtggttctgaggcataatggatgggcattagagtgtggttggcagtgcttctcagaagcaagggtgtcttttcttctctctacttttacagcatgttgacacatgtccactctcatcaataaatgttcccatctccactgatctgtttggaagaggcaagaaattcatgttggggggacaactcatttgtctttagaaattgaaaaagcgagtgcttcagaaagaactggggagggaatagaggcgttttggaaatgatcgataaatctgcatctaattttttactaaaataagcaccggctatttatagagtccaggcagagattgtgaggaaggaattataagatagagagacacaaagaatctttgtattttgtttgatagacagaagctcttcgggcagatgtaagacgcatgccttacatatccgtgaatgtgggtggttattataccaaaaaaagtggcttcctcggtagccaagcagatgatctgtgtttcttctacctctacatcaatattattattactgttactataattattgggatactattaatatcaactaacattgactggtctaaacatagaaggagctatattttatgagcaggatctaaggacataatctttcctctggcaccgagaatctc

SEQ ID NO: 56941 - DNA, 1219 bp, Bovine  19866880679109
tattggtatgagctattcatgtgaaatggaggaaataatgtaatttcaatttaattccccttttaaatcactttagaatagtagcctgaccttctgatctcaaggcctgaagtaaagtagcctaaaaccaaagcaaatcaaactaatgaacagtttttaataataaccccaagcacaataagaattactaactccctgagttggaaaagctttagagtttatttcagaatcagtacatgaacatgttttgcaatattcctaccggatggtcaaccaacctccacctggattctcctcacagcttcacgtcagtcctcctcacaggtcaccctccacttctgaatccaaaaaggggtcacaggctcctacttgtagtgataaaaatgaatccctataatgctcatgtcagccctccggcgaaacacaggcaaatcttctcctgttctgtatgcatcctcatttgctcagtcatgcccaactattttgtgaccccatggactacagtccgccaggctcttctgcccatgagattctccaggcaagagtactagagtagattgctatttcctcctccagaggatcttcccaacccagagacagaacccacatctcctgagtctcctgcattggcaaatgggttctttaccactgagccacctgggaagtcctctcctattctgcatggtacttatttgaatacttcatgataaacattgcatttctcctttttttttttttttcaagcataatcattatgtcccagttcctccctctgattcaagaatttcagatcgtgttccatcatggttaccctcctcaaaacaagctacccaatctgtatctctggtttgacctcaaagacgccatggctgccagagatgttccaccataaatcaggaccatttgaaacagagggcagtcttcagcagtaggtacttgaaggtttccagtgttaggaaacattgcaaaacccatttctgctcgaaagatgcttctgttagattttcctgcccatccagcaatgggcagcctgcagaccacatggatggacagcctgactttgaaagggtgtttcacagtgggatactgctgccagggagccaagtcacgtgagcatgactagatgggtgaagagtccaaggaggagagggtgcttgctgcatattttgttcttcttgcttagcatgtagccctgccaaaggcctcattcattattcat

SEQ ID NO: 56942 - DNA, 3264 bp, Bovine  19866880745728
aatgtggctctcttatagggctccttacatatgagacctgcactgtggctacagccagtgcagaaaccagctgtgggaggcacaggggtccattaagaaccatagctattctggcagttactgcagagatgaaggatattaaaatattaaacttcagccttagaggatatgaggtcaccaaagccatatttcaaagccagaaggccatccttagtactttaagtgggttttattgtttttttcctagggcaggtaaatttacatttggcttggtaatagaattctttcaaaggggcctgaatttgaaaacatacaggcccttagctttccttcttttgtatttgatttaaaggcacacagaggtcagtctccttgggtttatggttgaaagataattccagcagtagaaatgggttgtgctggactgagtaagggatagaaattgggaaggagccagtcttgtaaccaagactgcttacaagtcaagactggttaccagtcttgtaaacagactgctttaggcacagtttagcctctgtgtcaaaatcctagctcctctgaccatactaaattatagagggattgttagtgatgaaagaaaagaagggatataagataaaggcaacaaacatctcctttgtttttcacctgtacatcagcatgctagcggagaaggaaatggcaacccactccagtgttcttgcctggagaatcccagggacagaggagcctggtgggctgccatctatggggtcacacagagtcggaatcgactgaagcaacttagcagcagcagcagctagaccagcacatacagtgaatgctgataatctattacagtggttgcttgataagcaagtgcttctgaagcttttgtgcccaatcaaatgagacaactactgtaaaacagagtgttcttacgaatgaataaatgttagttttcgagcactcttttttcaacctttttatataaagtcggctatttttagaggataacagaagtagtgataactagttaaaatctgagtttggttttatgataagaaattgcatcctgtgagcctggccacctttttaacacagcttgtcagctgcttatccatctacaatttgatttctctactctgcttatccatctacaatttgatttctctaagaaggtttttcttccttaccactccaccttccttctgaatactctagtgccctctgtgactgaacttttccatgtcctagctcagctcctactcctgccggaaaagccttcctaccatacgcccctatctaaggcttaaaggccaagtttaagtgtcccttctccaaagaagcctctgccgcactctctcattttgtattaatctgtcactccccgacctcctacagtatattgttgaaactttgattatgtcactcatgagtaagttccctggactaaaaaaatctctatgtgtcagcatccgtgttcgaggcagttgaatcatatacttgaatatgagtatcttgaatcctaagcacttgaatctgagcatctgcttaagaatatttactgagatcataccaaaagaaaataatgaaggaaaagatgagtttctaaagggagagaaatttgttccaatttagaattccagtgaaatttaactggggacaaacatgaagattaggcacctatttgtattggtctgaagtagcaggctggtactccatgggcttactgacggtacaagattgatttcctgtatttaagcatacttttatgacaaacggggcttgatatggaaggagacagcagcttcacaatatgaatagcctcaattagggctcagttagacgtgtcacatctttgttactgagatcagaggggaagaaatgtcgtctacgtggccagagagagagaacatcagaagtcatgctaaaagatatgctcactcaaataaagcaagcatgatatatccacttggctgaacacataagcaagtttaagcttaagcaagaaacacaacttaataaggaggagaaaattgtgccgagatggtgcgaggagagagagaattgggatctgttgattagaacctactatacttcatacctgaattcataactgaatcaactcattcaatgaaaatatactgagtacccgtaagtgtaagaatccacctgcaatgcaggagacctcggttgggaagattccccagagaagggaaaggctacccactccaatattctggcctggagaatttcatggactctatagtccatggggccacaaagaatcagacacgactgtcacccgtaagtgctagttacatgctgtttgacaaaacttttactagtaaaagggggagtgctacagcaaataaatccgaggtggaaactgcctctcgcccaccactgtctgttctctccttttgcagtaatagaaaagcctgtccactcagctagaaaccacatacattcctcgtcctccttcacggctgggtatggagagttctggccaatggaatgtaactcctaggtcatttccaactaagaggtcaagccgttcacccttccttcctttcctttccctatgagctgcaaaatggaagtgcctaggactcagcatcaaccacagacagaaagataaaacccaaggagatagtggggttgtatgatggacaactcctagtccttgactggtcacatgaaacagaaccaccgcacctgcctcaactgtcacctcagtgctgttacattaaaggcaagcaaactgtcttcattattctactgcactttagaagcttcttctttatgacagcttaattcttatcctacctagccgaaggcaatggcaacccactccagtactcttgcctagaaaatcccatgggcggaggagcctggtgggctgcagtccatggggtcactgagggttggacacgactgagcgacttcactttcacttttcactttcatgcattggagaaggaaatggcaacccactccagggttcttgcctggagaatcccagggactggggagcccgatgggttgccatctatggggtcacacagagtcggacatgactgaagcgacttggcagcagcagcagcagcagagtcaaaatggggcttcccaagtggtgctagtggtaaagaacccgcccgccaatgcaggagacaaaacagacttgggttcgatccttgggtcaggaagatcccctgagaaggacatggcaacccactccagtattcttgcctggagagtccccatggacggaggagcctg

SEQ ID NO: 56943 - DNA, 1063 bp, Bovine  19866880750695
agtactcttgcctggaaaatccctgggcggaggagcctggtaggctgcagtccatggggtcgctaagagtcggacacgactgagcgacttcactttcacttttcactttcctgcattggagaaagaaatggcaccccactccagtgttcttgcctggagaatcccagggatggtggagcctggtgggctgccgtctatggggtcgcacagattcggacaggactgaagcaacttagcagcagcagtagcaaacacaaaaaggcaacatgttggaaagatgaagtatttgggcaaatcaccaaaccatcttgtgcttcatttgtaaaatggagagagggtcctaacacacaggatactgcaacaataaatgagctgccacatgcagcaacacctttaaaagcctttatcattacagtgttacatgttctcattcaacttgcaatattcaaccacagatggtggtcagaaacatgtttttctatgcatgaactcttcttgggttttattcatttctttttatccatatgtttacagaatacacaggtttgaaaatttgtacttcaatattcttaagcttttaaagctgcttgcaattgaaagtcatatttttactgtctgctgaagggaatttacactgtatttatggcctggacataatcattaccttccaataaaaatgactcattaaataaaaagcaattttcaaccatgagcttctaggatacatttgcttactaaaggaaatccagtaacttcctgctcagtattttctgcatttcttactacagttatttggggttcatatgtctattcaagatctaacaaatctgagggactcacagacactaaaagacagaaaacaataacaagaaacacacaagcaaagaaaaccacactcgttatcggaagtgagaaatgctaggatccatttgagagggacagagaacttctgatcttcattcagcttctggttagaagctgaaacacagcagcactgctctttccaacatcttcattaagaatcccacaggccaactaggaaagcctccctgcaagcagagaa

SEQ ID NO: 56944 - DNA, 992 bp, Bovine  19866880773633
tttcactcttccctccccaaccaggccttggcaaccaccattctactttctctctgtaagtttgcttctttctgacattttgtacaaatggaatcttacactatgctgtttttcatgactgactctttcatgtagcataatgttttcatgattcattcatgttgcaatgtggattagtacttcattctttttaagaggtgaataatattcccttaaatgaattaccaccttttgtttgttcattcatcagttgaatggtacttggtttgtttttgctttggggttattacaatggtgctgtgaatatttatgtgtaagttttctgtggatgcatgtttgatttcttgggttgtaagagttctttatgtatagtggatacaaattcctcatgacatacatggtttgcgagatttttttattctgtgggttgtcttctcaatttcttgacagtattattttcaaaacagaagtttcaaatttgatagagtcttaacagttttgtagttttagcagctacatttagatttatgacccattttttagtttatttttgtgtataatttaatgtttacaatagctctgtaagatgagtactgttctattcattttatatgaaaaatacctgtgactcacagtctaaattagctcccaaagatgaaacaaacatgcacggaaactgggactcaaactcaaatttcaaattaaacccagatacaaagttgacaataccacaaaacctgactggcacttctcgaatatgaaacctcaattatttttaaagttggcattttattcaaaggtatacttatctcgtgaaatgctgtttcattaggtgtttaaattggaaacaaaataaaacaatttggtaaacatcttccaaggctgaagttcattaaaaggacatgtactataagttaaaaatacatataagaagaccaactagactctccagagcatggttaatgagtctcataagtcacatcccattacat

SEQ ID NO: 56945 - DNA, 720 bp, Bovine  19866880779419
tggagtctctctgggtacaaagatgacttattcttggcatgcacaccagcctttccacagtcccttttacttcccagtgccaagttggagctgctatgacatgtgtaagggagtcagggctgcccttgttcctactagttctccttgtgtcctgcgatgggattttgttttgaagcacaggaaggcatatgccccctctaaatgacatgtcagacacggtttggtttggatcctttcccccttctgacaccacaatttgtcaccagtagagaatgcagatagccatgccaaatgtgaatgtctcctgcatgcgcacatttggcaaatgtttacccagatctttactttgagagttaaacaactaatcatctagttgtttagttgttaagtcatgtccaactctattgcgaccccatggactgtagcccacctgtcctccgtcaatgggatttcccaggaaagatttgggttgtcatttccttctccaggggatcctccccactcagtgactgaacctgcatctcttgcattggcaggaaggttcattaccactgagccaactaggaagccctcatcatctaacagacgatatctaaggtactacttagcattgaaattttgtaattctatgggggtttattggcacttttgtgaaaagctgccgatgatatgccattttgctttcactgagaaaatgttacaaaggagaacattaatcta

SEQ ID NO: 56946 - DNA, 1684 bp, Bovine  19866880804737
aaaaaagtcaacacgactgatagtttcaattttttctttttacttgaaaatttgtttaaccatcaaattttggcagttacaaacctgtacactgtttgttttttctgtggggtttttttttgttatcttttttgtttttctttcatttttttagaaaaagaacacaagactgaatactgccaacagcattatatgcagaaacaattcatttccataagggacaggatccactttaagtgttagctttccctttgcataaggtttggtgtgtgatgtgtgtgcaagttgaggtgagtgtatgtgagtgtgaagaaatgatgtacttcattctgaatctgaaatggcatacaaatcaggtacttagtaactgggcaaaacacactcaatttttaaaatgtcaataaaaacattttcttggaaacagagaaagttaaatgaaaacagtggaaccaaagaaaggctagagaacatttggaaatgactcaaaaacaccattttcaaatctaaaatgctttatgtgtgtgtgtgtgtagttacctcaatagtttgcagaccaacagcgtgggtgacttaacattatattcaaccccccaaattaaagtatcctgataggcatcaaatacagtatatctacaaaagcctggaaaattgaaaccattatatacaattttataaacattttaacaccgaaacatacatcttttacaaaccagcctgtttgtaacaggtaaatttacatgacaatctctctgatacagtgcttaaaaagaactgcttccatttctgaacacatctgaacacatttgtcatttcccaaaatgcagtagtatgggctcataaaattgttcaatagtagcaattcaggtatttgtttgccagaagggtactacagtacatactgatgggtccaaacacactccaaacgactctacgattctcgagtgcattctaaacactggaagagactaattatggcctttgtgtaatattacatacttgtaattattgcttttcattattacataaggaaagaaaatcttattcttttcctatctcttagccagctggctaaatattaactgatgccaaatccacatatggcaactttaaaccctagaattatacaaccagaagcttaaagacattgtggatttccaccagactaatgtgcagttgaacgctgcaggacaaaccccagcaaaaacacagaacccgccttgtcacagaccacacaaaatgataacgctgaagaaatgcctcttcacatctccatttctcatgattggaagctaaaaacaaaaaacataaaacctaaccactttagcaatatccgtgcactgggagggcagcagagaggagagaccagacgattatctggacagtgcatgccaaaggaacagcagagctcccaaaattctcccatggaggtgtccctgggtcctcaatgatctagtttgcttacctcttgtctccctgatgctgatcatgtagactcaggcatcggcggggcagcgggtgggtgggggtggggaagtaaacaggaattggccaacaatgtttcccttgcttcctttccccaggctctgctaatgattcccaagagtggttccaggtaagttccaggaacgcatcaatcccctctctaggttttcaccccaattgtctgataggataaatcttaaat

SEQ ID NO: 56947 - DNA, 2164 bp, Bovine  19866880814344
tgatctatacgcctacactagcccaacagcccacagccaattcctaacagacaccagatataaaagcccaacctccttgcctccaggtggatccaactcagtagtacagtgaatgattcagagctccctttgggatcaggctgaggttagacttcaactgagaccacatccttgcttcgcatcctcctctgtctatcttgttttcttcattccctttctcatgggaacacttgctcttgaaatcatttgtactcacatccctgtctcagactctgcttctgggaagcccgacctaagacaactatcttcaagggcccttcctctcacagaaactggggcaaagtgatcacgcatgaacacagcactagggagctatgagttgtcactgtttttaaaggctacaactattagcaatgcatctggaaatggtattgttaatgtaatagtttacaaaacttttttattttggtttttgtattttctgtcactgatggtttgcttgttagacttaactgcaaactacccccaccgctccaacacacacacacacacacacacacatttacatccaggacagcatagcagttaaccctacatatctgggcaaggaaacatgcttttctcagcccttatatcagaccatagagaagagccattaacacccccttccttactccactgcctcgaggaacccacgcttccaccgagagagatctccttcacttcttcagggttggcttaaccagaggcctctgagatgagttttgcaaggttgatgcctttcccctgcctcctcccatctccctcttggaatcccatgtgacaattctacgtgacaatgacaatgcatttgttcccttttcaacactaccaccacagctataagaaatcaaattagctcttcttacttttgtagctgtcattcgtgtccatacaacactaaaatttgcaagtgcaccatttgcttttcaagtttcccacatctgcaaggttggcagtgattcaaaacagcttctggcaaatgtgcttggggccccatgtgcccgagttgcttcccgcagcccctgagcctgttgtcctcagatcgctccccgcgtcttccccttgccaaccccgtcgtgaggatggactctgagccccacaatatacgagtgacagatgcaggcttccaccaggacccaggctctgaaacagctctctgtcctctccgcgtgtgagtagatcaaggccgtggacaacgggcgccctcagaagtcctccacggcccgcctccacatcgaatggattaagaagccgcctccttcccctgtgccgctgaccttcgatgagccattttacaacttcacagtcatggagaatgacagagtcaccgagattgtcggggtggtgtctgtgcagccagctaacacccttctgtggtttgacatcgttggtaagtctgagtcccccagggcagtattgggcagcgtaatcactgactgttcagagcaactagcaaaaaagaaaagacaataacaacaacagcagcaacaaaaacgcttaaagactatgctaagattaaaagatgtatagtgctggaatgcaaaagagccagtaaaatgaatagtcgacctgtgctttcgttctgagttctgtagctaagctgaaccgaaagtgctctctggctggagtttccatagtatgttatttactgcaatcttaatgtctttctgtgtgtcatttaaattctattgtcacacttggctaatctcatttctaaatgtattgatggtactagacttgctgtccttcatttctctctttttcttcaccttttttctgcattctgttccttttttttttttttttttctgctcccgactgccctgcttcaaggtggcaagcatgctcgagagatgttctatattctacagacagcttgtgggcagaactgttcaacagaaggtacccttagtgcaaacacatttgctaaaatacagctatccaatctgccttttacggggttttttttttttctttttaagcaaattaaattacatctttcataactgcctgtgacaggctgaaatgcagcccacagatttcgtacatgcctctaacagcgattgcattactcatatccagggactcctttgtttgaggttcgatggggtttggatttggg

SEQ ID NO: 56948 - DNA, 1062 bp, Bovine  19866880852367
ttgtatgtgatatactcctgagaatgagttaattttatgaaagacagaattaagaatggaaatgacctctctaggctgaaaatctgggccaaaagcaaggcaaggaaatattacagggatgaaaataaaactttcattgaggttcagaagtgtggttgtagaaatgaagggtggaagcatggcctagaaattcatttgaattgactctttaggtgaccaaaacctggagatgaaattgtgacgtagtttgtttctatttagcttaacatggcctccaagtacagtgatgcccaagtgtggttttaaatgaaccagttttgcagtactctgggcaggcttcgtgcattgggcatagtgcatcacagggtattttcagattgagtactaggggagtagatgaacagcatgtgaagaatgggtaaaagccatcttataagagtgaaatccaaagacaactaggaatgttgactccagagaagagaagacagagaggagatagattcgttcattgtattcagttatgtgaaatagaagaggctgaatatgtattctgtagtgttccagtgggtggaaagtgtaggcaggcaaatatgcgggtccgatatgagaaggagctttctatcagttacatctgcctatcgatggagcagaagggctcggaaagagggagctcatgaatgtagtgatccttcacctgctacaggggatgtgtgaatttgatgactgtgatgttcttcctgtgctgagagtctcaagatgcgccagacatgaaagcaaagcatgattctctcacttacaatgatatgaccttgcaaacatcattgcaaaactttcaaacctgttttctcatctctaaaatgggtttaatatggtacctgtgagtaagtgctacagtacagtcagcactccatcaaaggcagctggcaccgctctaatcttatatacctactctgcttctttgctttagtctgaccagtgagtttaacttcagctgataaaatgctaacgtaatgttcagttctcagtttcttgctattgttagccagggttaaataatgagtt

SEQ ID NO: 56949 - DNA, 2250 bp, Bovine  19866880859588
tttgtactttctcctgacttaaagagttgacatttcaagagtctggctggatgcagggatggaaataaaatcaagttctgtttgggcatctggcccagtaaatttaatttgcaggagaagcttgactggatgttaccagatacacagtgaaatctgtgatagaagcatctagactagagggacaacctggtaggtctatattaagagaagtgcacgcatgcatgctcagtcatgtctgactctttgcgaccccatggactgtagcctgccaggctcctctgtctacggaattcttcagacaacaaaactggagtgggttgccatttcctactccagggattttcctgacccagggatcaaacctgtgtctcccaagtctcctgcattggcaaccagattcttaaccaccgagctacctgggaggcccattaagagaagcatctgagcactaaaactgggaagattctataaaaggagcacagatttaggaataaagatggagaaacatgaaaatggatgccatgtttctgatcatgattcctaggtatgatttggagcagcctaaagggactcctccctgggaggactctggtctgtcaactgcttgtctcttcttggaccagttctcatttagccaaaggtgctgtggtggctgaggctcagaacacagtggaaagtcacagtgactctggacgggtctcaggagggatcagtgggcttaacgcatgggctgcccggggcatctccatcggctggcttcattaccccactcaccctgggtggagatcaaccaaagcaatggcaggaggaagggggaggacacaaagaccttgaccttcagggttaagattgaagccaggatagacaccatgaacacatacgccagcactaatactgctgaatggagtgcatgcaagtcaggtcacacgcagcatcattaggcatgctttcctatacacagtcatacacacatgcaggcatgctaaggatttgcacaaacgacttggataactggggtcaggtggccggtcagacggagcatcagaggaaggtgtgcttgtaagattactgaaggcatcctggggtgggtgggatgtgccgcatgtcaagaggttgtatgaatgcatcatgcaagggagagaaacagtgctttcaggccatagaggcgcttgcaaactggagtgtcggagaaggaaggagatgaagtgatcattgatggcagagggcgagtcctcccacggctcagggcagcgcagcaggagcctcggcctttggctttccactgcactctccctcggattaccgaaaagaagtcatgattgcacgggagacacgcggaaactgagatgcatcttctgtgaccctgatggggcggtggtgaaggaattaccaaaggtgatgcagcaccgacagccaggcgatgcctgtggtgtgagaacacgactgagaagatggaggagcagagagatctttcatggatcagaagaggtgccatttcaaaggcgttaagtggaaatgaagatggagtggaaagctgggaatgatgatggtcatgcacagggatggtgtgatagatgcccattaagtgaaagatagccgttctaccagcattctagaaaatgaaataggtagaaaacaagccttttctttgggggaagttcaggggacactctactgatgttccatttgggggccatggggcattcattcttttctatgcttcattaaaacagatgtggaacattctaaatgctttccccagacccagtcattcctgggaagagaggcaggttcctgcccatcctaggcactgacacgtgaaggaaatgattcccccagagcagctctccggagtcaccgcctcccacggacgaccgtgggaagtcagcttcagctgaacccagcgtcagacccagggctggcgtgcactcttccctatgcttggattcctggtccttagcacttatttcctctccgccgcctctccctgccgggtggtgaaggggcagttttgccctctctttttgcagcctggtgtgctttcttgctttctttcaaggaatttaaaggttggcttttaaggtctgtcctgcctgcgtccatctgctttttgtatttggctctcacaggaagctctcgctggctatatatccgggctctgtttcctgtccttcctattctggaccacagcccggcctctcctgggggcggggggtttgggtctatgtatgacactcctacaaaactgag

SEQ ID NO: 56950 - DNA, 876 bp, Bovine  19866880898207
cccttagatattttcaacttaaattttctagtcttattttcaaaagcaaacagtgaattagaaagcacagaagaggatcaaaagatatttgaaacagtttgtgacagtttggtcatcaaaaacagcaatgtttttgattcattcctgagttgagaaaataagtactatttattgacatcggtgccatttgttccctaggaaaaaaacacataaaaaccttgaaaatcagctctgtcgggagcaatccaaccatctaatttcatcatttctgggagaagtttgcagtgctgtttcctggatgaaaaacatgaaagaaccgatggcataaaagaaaagttccacagaataataaggggaatttctattattttaaatcagtccttcaaaaaagactgcagtcaccttgaattattgtataatcttaaccaaattatgtgtgtatgaaaatctgtatttatactgcacctatttctacccccaattttaaagtatcttaaagaactttcaaaagaatgacacaattagaacagaaaaaaagataatgatggaggaaaaagattattactaatgatcaggaaataatatggttaatgtaattagcaatgttttgttctaaactgtgaaaaagggggatgtctccttatcagaaaaaaaagacatatggcaagacttaaaattgtgctttctacagcatcttctcatcctgtggaaggtcacataaagcctcctggtactggctgccaagcaaccctgttcagcatggccaacgattgaaatcaaaatatgtttgtagctgctcaatgcaattgctcacacaacaaatttattttgttcccagctggcaatagtgggtaaagaatctgcccaccaatgcag

SEQ ID NO: 56951 - DNA, 1207 bp, Bovine  19866880930626
aataccctttgaccaaaatatttgaccaaatatttgggcaccatagcccagccaagttgacacataggttaacctcctccagggcagaaatccatgctctcttagtcatctctgattatccagtgctcagagctgggaagataatccacattcttcatgtgcttttattttaactaaaaagtaatctacacagattttaaatcagaaaacacatgaagaagaaaggtaaaatctttcctactttcaacttactccctagaggcacctccgtgtaataatttgattcatatccttctggtctttttaaataatgaaatgtaaatgtgtgaaatttgttttacaaattcgggacccaactgtacacactgttctgaaacatgcccttttcacttcaagggagtccctggacatcttcctataatcagtacattcttttagcagctgcataatatcctgctacatggatgcaccataatttatttaacagttcccttattgatggatatttttcattgtttccagtttggaactgtcacaaacaacacggcaatgtgtatcattgaatatattttagcactctttcgtaagaatattatatgataaagatctaatagtgaaattatgagatcaaaagataaattcattttaaacattgctagatcttatcaaattaacagatgcttaaggagtgtttgttgaattggtttgaatagactcagagttctgcagcaaattcagcctagaaggaaaggacagagaaaatgaagggaaagcaaagaaaggaggtcaggaaagaggtggagagtgtttgacaaccaacctacatttggttctgcctgagaaggcaatggcactccactccagtactcttgcctggaaaatcccatggacggaggagcctggtaggctgcagtccatggggtcactaagagtcggacacaatggagcaacttcactttcacttttcactttcatgcactggagaaggaaatggcaacccactccagtgttcttgcctggagaatcccagggatggtggtgcctggtgggctgctgtctatggggtcgcacagagttggacacgactgaagtgacttagcagctgtagcagtgcttcagacagtacattgtgtccccaaggctgtgcaaaacacctcccatgaggtaagctccaagaaggcagggctctgttctgtcattggtgcaa

SEQ ID NO: 56952 - DNA, 1306 bp, Bovine  19866880962263
tgagctagaagaaagttcagaatatgtattctaggtttatccttggagaaacatactatgagcaaattatactaactgcctcgttgaaactcaaagcctgcatttcagtcatttctaaaggaaaggaagtctggttttatttacaaatgcagtaagtgttcctgcctctgggaaccatgagtccattattaaaatgatcaatccccagcctagtaaagtgaaatgacactccaggtcatgagagggaatgtcttttctgaataatacataacacaaatttgtttacttctgactttggtaccacgattgctttttttcttcctaggtttatgtactatttgttctctggggaaatcttggccctccactcttgaagatactttctttttttttggatcctggagttcccttgaggaatctgcctttgcaccaagaaataaataaatcttttaaaaataataataaaataaaaaaacattgaagaccagtttaaaaaataagcaaaaaacacaaacgacaaataaacaaataaaaataaagctatttccacaatgttttttggtggttatgttcatcatctttgccataagcatgaagcattagtttcccagctggggtgttgttgtcaggtagaaaataaaatgtgttgaggatggttgttttagaaagtttttacttcagaatcctgaacaggcaggaagaaggaaaatctgagttcagtctctaactttgctccagacttgccttaaactggtctctgctcccttgctgggcctgctttctctgctgaagaacggcattgataatactcaatctgcctacctggcaggcagttgatcggggggaaaggggacgtatcaacttcaatgcacgtttaagacggtccagtattcctacagcacaagcacactgccagggtgatctcaatgcctgggagctgctctgcatgcaacaaagacactgatgttctcagctccttctctgttttctataaaggcctccagccactctcctgctgccatcgagcccaattaaacccccacgaggatgatcctggtaaaagccccaccatgtgatagatactttgggaatacatggttctagtcttcaaggagctcttagtttagctgaggaaagaagaaatacctatgtgaaaagttgatggaacacagaatataggtaatatctttgcctggtatattagtttactgttgttgttcagtcgctcagtcgtgtccaactctttgcaaccccatggactgcagcataccaggcctccctgtccttcactatctcctggagtttg

SEQ ID NO: 56953 - DNA, 814 bp, Bovine  19866880988182
cctcatccgtaaaaacttgacttacttttggtggtcaaagttttccttcctaatacttacagagacaccaattctcacctagccgagtcttttcatcctatggtgtatccgaggaggatgatctcagacactggttctgagtccccacagatctagcagttctctggggcttataaatgaacactgcgtagttaggagagccctaatctagatataggactgaagaatctctggctgagggccaacggatttgggttcttctttttcacccacttttattccagggaagaaacaatccacacacttatccgttagaaagctgacattaagcagaaacgggatatggagctgcttaaatatttcaagggaataaaccctgggaccctcaaaataatctcttgatgctgtttcctgaagaatgctgcacaaaactgactttgatgaggattttgtcaccagccaaatcctttccaaatactgagagttaagaaaacgatagtttcatccactttcattctgctagaagttattgttttgttctttttttgccaataaatttgatttcaaatactcataaaatctttaaaacacaaggaacctggagtcagaggaaaattaggggtacctttggatttcctcctttttcattttatttcacttgattattattaatatatatgcaactgtatctatatattgatatatgcacacatgcactttttgaaaatgttaacaacaccgtcacacttccctaataagtcactcatctggcacagggtttttttgttaagggcatatgaaacagagtctcaga

SEQ ID NO: 56954 - DNA, 1947 bp, Bovine  19866881063224
ttttcaccccgtccatggatgtttttacagtgtaacagtttacaggaattccatgcttttcatgagtatcctaattacttttagagcttttataagctgagccccagagttttcccatcacagtggtaagtacttaagagttcttgcagtaagtttctgcagctttggtgctttgggtgagggctgtaatgatattcaagaacactgtgttttcctttgacttttctggcacatgtttgatttcctgtttggcgcttgtttcaaccctgaaatgagaaaggtgggaaggagcaggctgggcatttttctgctcctaattaaaaatgcttgtccacgaatatccctcaaagtggctcagagtttatttagggccctctgtagagttcttgagggacctagagctcatgcagaaagtatgtttgtatggattacggtgtcttctctgattcctttggaataactgtgacatttgatttgtaggggaattgcatcaaggaggcttatatttttgcatgcaaagcagtttccatcccaataggctaaagaacacttgaaaggtctttttcacttttgtgaatgaacagataaaatattgtgtcctgggaaagcttttggttgcataagaaatcaatgcaacctcagggtaaatgggaatattgctgtgattgtgcactgatttcccaggcatcatgggaagtgttttgacctctgctcactctcttcccattgctcccagctgtctcgtgtgtgtgtatgtgttttgtccacgctggaaattcaaataaagtatttgtgaatgtgattatacatctcaaatggtagacgaactagttagtatagttttgcggaaaataatgttctgatgtaaagagaaacatcttgattttgtatttttttttttttcatttgccattattacttagcacagcccttctctattggagatgattggcttagtctcttcccggtttgctctctcagtcactctttccctactctctcgtaggagtcatctctacagcagacattcttgatcgagagacaacggggtcgtactggctgaccgtgtacgccacagataggggtgttgttccactctattccactattgaggtctacattgaaattgaagacgtgaatgacaacgccccgctgacctcggaacctatttattatcctgttgtcatggaaaactctccaaaggatgtatcggtcattcagatccaggctgaggaccctgactctagttccagtgaaaaactgacctacagggattacaagcgggaatcctcagaacttttttgccatcaacgtcaaaaacagggtaagggggtgcttgtatgacttttttttcagttgttagtccaccttttaaattcacaactctggtatttgctgtgcctttttatttatttcattgtgtggagaagagcatccttctttctgggaacagtttctgaaaaggtgaatgttcttccagtctgtttcggtatgttttaacctcagctgaatggaagtgaagtgatctaacagaaattaagaggctttctcagaaagccttaggtttgctttagtcataattataaaaaatggctcctagaccattcagagagctggctgcttgctctcgctttcttaggagaacatagcctaggctatgctgagttctctcgctatctggctttgtgatgcctctccttcgagactgcctccctccacttggccttaatccagctcattataaataatctccttaaagccttaactttaaggcccagattgttgtgatttctgtattacccatcaatgaagtgttatgtttagaagagcttccagtatctaaatctttacataaaacacacttttttaattttctgggtttttgcttaaaagtttctagagattgcagaaaactatacttgttggctaaggatcagaaagggcagg

SEQ ID NO: 56955 - DNA, 1337 bp, Bovine  19866881121252
cttcccttgtatttccaagaaatgctactgatcacaaaatgtaacagtgtgtgatacatgtaagccctttgaaaagtctacagtgataggcaaacacaaatcaatagttgtctcttgatggactggccaaaagttgatccttcctcgtgtctgtcttgattctattgtacttgtaaacataactatattaaaagttttgtcaaggaatagtttcatgtcttgtttgtattttcaaagctggaaatataattctgaaatctaaatcagggagagaaaaatcaattcagctgatcagtcttttgagagtagagaggttcttcctagtttattgtttctaaaaataagctctccaaatttggcactgctgttggggagcagggatgtgatgtcagcagctgaaagtcctccaagtgcacgccacacacggaactgtcagatgcttacggagctactgagaaaattcctgacatatgtgttttgttctaagaacttaacacagcacgcttttttttaaaaacattgcttttatagaaatgttctgattctcctggattcttttgaattgttgccagcatgtgatttggatccttgacttggccctgcgaagagaagttgaaaaccagagatgaatagccacgcagtctcttacacttgaggactgtccagttaatatttcaagtcgccaaggccagcctcgcagaaagcatgtattttattttcgttctaaaacattatgttctgagctatttcctgaagggcttttgcaagaaaccaattcattctgtgtgggaagatgactgtttctcagtgagttctctttcaggtccttgttccagactgctattggtgataggcttataataatattaataagaaaaagggataatgagaaggtgaataagaaattaggaagaagggaaggatgaggaagaagagaaaaagatcataatgatgtccttccagtaatttgaaagtgtgttagtcattcagtcgtgtctgactctctgcgaccccatggactgtagcccaccaggcccctctgtccacagaattcttcaggcaagagtactggagcaggttgtcatgccctcctccaggggatcttcctgacctagggatcaaacccaggtctcctgcattgcaggtaggttctttacagtctaagccaccggggaagccctcaagtagtttattcttttataatttacaaagtgagttagtgagatagttgatgtcacaagtgaggaaactgactctttggtgtgacattgctttcttaagtaatagagctagagcttaaataacagagctagagattaagtcggagaaggcaatgg

SEQ ID NO: 56956 - DNA, 2004 bp, Bovine  19866881127887
attgaaatcaatccccataatattgtagctttgaatgatctcttaaatatccctagctcatggtaggtgctcaatcatgttgaacgtaagaatgaacttagtattaatctggacttcaactaagtggatattcttctctgggaagagattttgtaaaaagagtatctcacatattgaaaaaattatgaactggattttttttcaaaactgtaaaattcactctaattcagagagagacattcagtgtctcatttgaaaccacctttttactgttgccagctgattaaaatcacccttagttcataaaataaagaagctacaaggatgtattatacagcccagggaatatagccaatattttataataactataaatggagtataactttcaaaaagtattaatcactatgttgtacatctgaaacatatataatacggtacaattatacttgaaaaaacataaacataaacatcatcccttttttgaagtaacaaggaagcagtatttcctaaaaaggtagttgcccaaagaaatgctacggaagaaaacagtaaataccttcattctctatagtgtcaactacattgttgacaagctgaatgacagtcactatggatgcttgtggccaggaaagacgacaggagggaggagaaggacagtctcaggttagttacgtcttctgaatatacactcttaacaacagcacaacaacaacaaaggaactgcccgccaatgcccagagcttcccacagtccaccgactggactacagcggacactcttatcccctgggttctcggaggaagggaaacagcagcaaatctaaaggcatggtcggcaggaattgccacgccataaattcacacctcgtggcccagggaaatcaatctaggaaggcagaggctcataagctcgtgctaatttctcattagtaactcccaaaggctccgaggaagatcgcactattcccagggataattacttgctggtcagctgtgctactccgagccaaatgccagtcatggacgatgacctttgcaggactgatggtttcaccctcagatggcaccaacggcaacctgggacgacccgaggcccagctcccacccgccaagcgtagatgggagcttggcctctgaaatagtcagaaaatggggaggagatttctgtgcccacctgggtcgccttagcatctgataccagaagtttttggcgaggtgatcaggcttaaaccaatgggtagaaggctaagtcaaagatctcttttcgtaaacatcatattactcttgaaaacatatggcttatgttttcaatcaatatcttttgatattgatttctaacataattccacagtgattaagagaacagactctgtatgatttcaatacctttagaccatcaaatttttgtaccttgttttatgtccctggatatattccagtctctcctagtttatagtccatgggaacttgaatagaatttgtatcctactattatgcaggtcaggaagcaacagttagaactggacatggaacaacagactggttccaaataggaaaaggagtacgtcaaggctgtatactgtcatcctgcttatttaacttctatggcagagtacattatgagaaacgctgggctggaagaagcacaagctggaatcaagattgccgggagaaatatcaataacctcagatatccagaagacaccaccccttatggcagaaagtgaagaggaactaaaaagcctcttgatgaaagtgaaagtggagagtgaaaaagttggcttaaagctcaacattcagaaaacgaagatcatggcttctggtcccatcacttcatggaaaatagatggggaaacagtggaaacagtgtcagactttatctttttgggggttccaaaatctttgaggatggtgactgcagccatgaaattaaaagacgcttactccttggaagggaaagttatgaccaacctggatagcatgttgaaaagcagagacatta

SEQ ID NO: 56957 - DNA, 944 bp, Bovine  19866881129496
actgagtatatatatgtaaataaatcacatttattatattaacttcataacacaaaccaaatgaggcatgtaaagctgttagtattattgctgctgttgtttttatgaaggcatcagaggttctgatgtgaatacaaatgccagacttgctctaaaggaaatctagtgcctttggagagtttctgaggctgggaatgatttaaaaattaggttacttgggccagaagagggcatatggaatcttctataccccagatctcccgtatccttccagggcaagaatagaagtgaccttcaggggtcactggggatagacccatgtgatataagaggatacagtcagccttttgaaaagaccacccctgccgtggaattgattaggaaacactctaatgaactgttgagtgattacagctcaaaggaggccggcccttgaacccactctagagagaggtaccccagtctccaaagaggccattctgaagctgaatgtacaaaaggaaatggggtattggcacacttcccagttttgctgctgctcccctggccctaaactcagcttctggtttctgaacttaaaagacaaaacgatttcagactccaaaccaagaggcaaaatactaacatgagaactgactgcgggaaaagataacccattttaattaccttcagtatgatgcaggggtttgctctggtgtacattataatcccattgctttgcagggtccgcagacgcagggccagtttaaagtcttcttctttgctgttttcagaaagccggtatttgatgtaactgtttccggcaaagctgagagaagtgtgtcctgaaaagaccatgatgaggagacatagatactttgaacatccagacaccagaagggacccatggaatcacagaacaactaccaatcaagttattaggtggcaaaagcatagaggacaaa

SEQ ID NO: 56958 - DNA, 1577 bp, Bovine  19866881145989
tgtaaagaatctgcctaccaatgctggagtctccggttctatccctgggttgggaagatccccgaaaagaaatggcaacctgctccagtattcttgcctgggaaatgccatggacagaggaacctggtgggctacagtccatagggttacaaaagagtcctagacaactgagcaactacacaacagaaatgacagcaactaatgctgcgccatggtcccctggactgagggatgctctcttttgggtatatcttttgtttcctttaacatcatctccttcttagccgatgaaaagggcaggggcccaaagcttccttgtacatttaggttaggacaatgctggaacaagtgcaattaaagagatgaaataaggcagcaagccaactctaccatgagactctatgttaaaaaaataatgataaaaatctcactgtatgtaatagatccatgcctgacaacttatgagcaaatcaattcttgaaaatggattccgactttaaaggcaacaggacactttctgttcagaataatctcaagattaatgttccttaaatgagaatggtcatatcagttagctgttttgtaaattaggatgtttgtataacggaacatcatgtttgcacatttataattaatgcatatataatttaagtgtgggcttccctggtggctcagcggtagaatccgcctgttaatgcaggaaacgcgtttgatccctgggtcaggaagatcccctggtgggtggaatggcaacccattccagtatccttgcctgcaaaatcccatggagagagaagcctggcgggctacagtccatggggtgtcgtaaaagagtcagacatgactaagcaactaaacaagaatttaagcgcacatggacatgatataatgggatgctacagaatttggctccctgagacctaggtatgagtgtggccttgccgttatgacttgggcaaattgcttaacatctctgattctcatttgtcacgttgataagctaaagatagtaaagttgaagaaatgaatatgaatgtaagttgataaactggaaaacaagcacgtgctgatgtgatttttcttcttaatgcattcaaaaacaggtcttgcaagcttggaggggataccagaggcatcatccttgaaactacaactgtggagtgttttaaatattgttctgaatgcaaacagaggcagaattttcagtaattcaggatttaatttgttctaataaaagacagaggccttacccttcagctcaccccatggacacttcatgccatgagtctttgtaaagcgaggctcggcatctacccagacttggctcagacaagcctgcaaaacccggagtgtttgtggtgggcagcactgaaaccagaagagacttcccacactcagggtccctcctgctcggagtccattgtgcttctctaggcctttcaattaccattttgaacacaacatctttgaaagttactttgctttgtttggttgttcaggagctcacaaatggccccaactgtgggaaataaaaagcaaatgaggaaaaggaagtcttttacagagaaacactgttc

SEQ ID NO: 56959 - DNA, 767 bp, Bovine  19866881159306
cgaggcgaggatttggaagcatggaccaaagtgagcatacaggttttagatatgaatgacctgagacctttattttcacccacaacctactcagttacaatcgcagaaaacacagccctaaggactagtgtcgcccaggtgacggcaacagatgcagacattggctccaacggcgaattctactactacttcaagaacaaagttgagctgttttcagtccaccccacgagcggggtcatctccttaagcggacgattaaattatgatgaaaagagcagatacgacctggagatcttagccgtggaccgggggatgaagctgtatgggaataatggagtgagcagcactgccaagctttatgttcacgttgaacgggtaaacgagcacgcccccgctctccacgtggtcactcacattcctttctcattggacacagagcctgtatatgcagtggtgacagccgatgatctcgatgaaggggccaatggagagattgagtctgtttccatcgtggctggggaccctttagaccaattcttcctggccaaggaaggaaagtgggtgaatgagtacagggttaaggagaagaagccggttgactgggagagctttccctatggctacaacctcactcttcaagccaaagacaaggggtcacctcagaaattttcagcagtcaagatagtccacatcgccaaccccaaaagagacactgtcccaattagatttgagaaagacgcgtacgaaggagcattagtaattttccc

SEQ ID NO: 56960 - DNA, 1600 bp, Bovine  19866881222554
ttccctactaatgtaaaacaaacgcaaatgtaatttactttatcaggacccttaatttagtgaaggtcatgagtacactcagcagaggtgaggattacctacacttatcaaaagataacctggtgacagcgtagctgaataggaaagaaaccagggactcccactgaaaaccatcagctctcatgtataaagaggtcttcttacaagtcggtgaattctaaggaaaagctttgacttggtcacctctgcaccaatgcaacctcatttgtcattccgcttgagttcaagaatagcccttcactttcccagtgttgacaactgaagagacatgaaacaacacttctggcacaaaacatgaaacttaccactctcgtcatcaatattgaaccttccaagaccactgccatccctgatggagtactggatctccccatccctccccgagtcctcatcgtgggcagtcacctgcagcacactggttccaatccgtgagttttcttttacagagccaacaacagcaaagtccgggaaatagggagtatggaggttttcattgacatccaccacttccacctccacaaaggacacggatgacagagagacaggccgccctttgtccttggcccgaactgtgaggttatagaactgctgcttttcatagtcaagctccctgctcaggcggatggcgccacttgctttatctatttcaaatctcccgttgtaatcattgaccaaagaatagcgcacttgaccccccagtcccagatctgggtcatgggtctccagccaagcaatgacggtgccaacggggaggtcttcaaggactttcacactgtagctactgggaatgaaagctggggagcagtcattgacatcatccaagaaaaccttcagggtgacaacggaaaagagctgctggccactttctgccttgtctctggcttctatttttaaagaatagttcgctttggattcccggtccaactggtctgctatatacacgattccagtggagctattgatggcaaactgctgcgtatctgtcaagactgagtaagtcacttcaccattagaacccaaatctttgtctctggcttccacttgaataatctcagtgccaatacttgaactctcaagaatgttaactgaataactgtcttggagaaaaatcgggctattgtcattggcatcctccacgttgatggtaagcaacctccatgaggacttttgtggattccctaaatcatagatggtgatgttaagtagatagaggtctctgtgttctcgatccatgggcataaggacttgaagttgcccggtctccatatcgatattaaaacagctatccatattcccatcagatattgtaaatagcaccttcccattgaagccagagtcggcatcataggctttaatcttcaggatattagcaccaactggcagattctccttcacagccacatcagacggaaatgacttgtcaaaatgcggtccctgccggttaactgaataaaagtcaagaaatccatcttctagattcagtttcccatttgctttggccttaatgaggagcttctctgccagcttttgagccacgcga

SEQ ID NO: 56961 - DNA, 966 bp, Bovine  19866881312159
atttctgcagcaccaaggctcttctcccctgattgtttggttggcactttgggaagtagcattaacactttcagggtcactagggggctaatcatagccattttcgtgattgtagaactgaattgccgttcagaaagaataatcatagcagttcacacaggggtctttcctagaagatttcactatcttaggacaaagtcatttgcattaagaccattccatgaggctagtgtcatgaaagtcattatttatacagcttttgctctcaaattttcaggcaccttaccagaagtccactgaatcctctgctcattgcatatgtgtgtgtgtgtgttaaactgatgcacacaggcagtatatgaaggtgattgggaggactaatagacagatgtgctgctgctgctgctaagtcgcttcagtcgtgtccgactctgtgcgaccccataggcggcagcttaccaggctcctctgtccatgggattctctaggcaagaatgctggagtgggttgccattgccgtctccagtgcataaaagtgaaaagtgaaagtgaaagtgaagtcgtgtccgactcttagtgacctcatggattgcagcctaccaggctcctccgtccatgggattttccaggcaagagtactggagtggggtgccattgccttctccgaatagacagatgtagatagagataaatattaatagacacatagacaaatagacatgaatgatggcagttactgccttgtttacatgagcatgctattttaaaagaaaattataaaaataataaaaattttttaaaaatttaaataacttttaaaaaatttaaaagaaaattatttcataaaaggcaaacttaaatttattaaccatcagctccgtgcacgacactattttggatacttacatacactactagactcaaagctgtttgttgtaagtttacattcccaataagggtgcacaa

SEQ ID NO: 56962 - DNA, 1472 bp, Bovine  19866881321353
atagtgccagcagagcattaaaccacacttgtgatctttctgaacataagccccaggtgggaccatgacaccagagctgctggtatcatcgtgttcaatttaagtatactatgcttgcaagttgaaagaataaatttaacacactttggcaagtggacccgaaagccggagatgttttcttaaagtttttttttttctttttttaactgaagtatagttaatttacaatattgtgttagtttcagctatatagcaaagtgattcaaattcttttccattacaggttactataagatactgagtatagttctctgtgctatatagtacatccttgttatttacctattttatacatagtagagtgtgtatatgttcatttcaaattcctaatttatctccaccatcctcccacccacctatccctttgggtaaccatatgtttgctttctatgtctgtgagtctacttctgttttgcagataagttaaagggttaaaattcagttatacagaaaaccacttctgtgtaatttcactgtcctggaagttactggatatgactaaacttccaacacacagcttcagtaacaagctcaggattcaaccccaaacataagccttccttttgttaaaagtggttttcaatattgtaaaaacacacagttcactctcttagggctgagaagtttcctatttctttgtgttcctctcacacctatgtacagagtccccagaccacaaagccttattaaatcagacaggaatgaaaacacaaaataacttaagccatttactaattatgataacccagcaaagcactgatagtgatcaactgaaaccatctctgatatttctaaacatatgcacataaatataaatccaccaagtgtatttgattaactgtaaaagttagactttgggaatggactgtcaaagcccactttacactaaaagccatttcattgggcactaaaaacacttaaatacaaaatgagagaaatatgtctaaatctagtttcaaaataaaccattttaataaataaccccatttcccgtgcatgaacatcatttcttcagagaaaagcattgctcactgtgacagaaaacaatttaactaactaaaaaatgaacaatttagtatgtacatagccaagatgaagtatgtctttataaaataggaaattttatagacaaattaactaaagtggtaggaggtaaaattggatttgtcttccttaactgaagtatctgtaatggcaacatatttaaaaatggttcattggcaaaagctcagcattttcttgtaatattctgtttctaatgtgatgtatttattttacatttcctcactcatgttctcagacgttttccttctgaaaataacctataaatattgtaaccatctattattgccggaaaaaaaaagtcccataaaagcctttaatattatttacttaatctcttcattttcaag

SEQ ID NO: 56963 - DNA, 1788 bp, Bovine  19866881324567
aaaaatcctgccagcaaggccaaccttccgatttctctgatcttgatgatattagagaaacaccaaaaatgccatatttttttccgattcagttaactttattttggtattgccgtttatattaacttgaagcaaaactgagcttttttaaggaagaagacaaaacagtattttgttataatttttcagaactaaactcttatttgaaaaaagtataaagtttcattaccccctgccctttggttctcctctcttccgacatgcgggctttgaccttgagtttccagaattgccaggagaatcatctgactgggaatacagtaactcgaagcttaaaggtgatgagctgagtaacttttctcttttgcatcagtcggctcatgggcacgtgcacagaggccacggttaaataaatgcgtatttgcactctctgcatatgagcgaatctctgtgtccacagtttctggtgacatacggtgttggtgtgtctcatccactcagatgtatttttcagttgtttcactcatgttcagtccacttctttataggagtcaatgtttccacaagtttgtggttaaaacaaacaaacaaaaattcctattcattctcaagcttcctgagtaaactgtacactcatacacttcacagatttttcagcttttctcctcttcctatctcttagtcagacctactcatggaaacattatctgcactgtggtcttgaaataaatgaatttcactaaggctgcttgggagaatgaaatctttggtatgttccttatgtaagaaacccatttgcaagaatcacagagaaaatgacagactaatggtctagaatagaatcgctgctacactttctatgatgcagtggcataaaaaacaatcaaagtaaaaccaacaattcatttcttgccccaggaaatattagaaggagattaatgccgatgagtcactcctgcttgcacagcataccctccaggcagagtgccctcggaacccagtaatgaagtaataaatagatcctaatgctgttgtgaagtcacccaagaaaattgtgcccactcttggctctgaactgtataaaatacctctttcttcaggatatcttcccctggttttctgcagagtagctctgcagctaaatgtatcccagacaagtgtgttatgttttgatcaattacctttaaacacatggtatcttttcactttctggataattagcttttcctgtagattctgaaatggtttgcagccaggccaagatggaactaggtggggtgaccaatgattcaagagctggaagggtccttaagatctgcttatccaatccccttattttatcaaagaggaagcatacccagagaggggaagggactcacccaagctcacacagaaagttaagtagctgaacaagaactagaactcatccatttgaccagtattctttctattactattattcaccactaatctgcatggggcatggtatctgcctgcttctgctggagctttgatttcaccccattcctgctttgggatatactagaagatagaactcatggagagtatttctctggaagcctcatgatcttagggtttttttgcagcccccataggaaaggtgtattgacaaaattcatacatttctttggacatctatcaaaactgctttcaccaaatgaatgttttctaaaatgaggatggaatgatagttataaaatggaactcaaactgatcagtaagtacagtaaagctctgattatattacctaccgggtccatttgtttt

SEQ ID NO: 56964 - DNA, 818 bp, Bovine  19866881331138
tgtgcccttacaagaggaatctcaggaagaagccctctccccttctgcaaaatgaggatgcatccagaagacacagtctgccaaccaggaagtgtgacttcaccagatactgagtctgctgcatctggatcttggacttccagcatccagattgtgagaaataaatctctgttgtttatgaaacaccaagctgatgatattttgttagagctatcccaatggactgagagagaggctgtgagcatgaggcagctgagggacagacagacaggctctgataggcttgatcctgaaggctttccactggttggtccagaggttagtgacacgcagctgtactctttgcccttagattctctaagggaccctacagtaataatacatactttttccatcagagtttggagtgtctcttttgtaaatgaaaggaccataatagactattgctgtggaaaccaggtcaggaggaaggctcaggacagaagaaacattctccaatgtcaacagtgcacacaggttaaagactagaagaagcctttagatttggtaatctggggagaaaccagtgaaaggcatttgtcttttttaagtcacattattgctaggattgttcatctgcattagcttgaatgtcgaccaccactttgcatcttttatttgtggaattctgtgagtcatgacctaaaatatttgtggtctccagcatgtgcttgaattaaaccctgtctctcttcattaatagttctcagagggatattagctggcttgaattttatctgtaggaaaatttgccaacaatttggttaaaagcacattat

SEQ ID NO: 56965 - DNA, 1580 bp, Bovine  19866881349895
ttaggaaaagaaaatacacatcaacaattactggggtctcaaagtttttgttgcaaaatttaatgtagcctccaactaattttttttctcccctataaagaagtttttttttttttaagttctcacccctgttcattaatttggttgccaatcattcacatccctctacttcacatgatggatactaccaagaaaaataaaaggaaaatgcattattaaatttcagagaagtagcgatatgcgtgtgataagaacatccaaataccaccaggctcacataactaatgctcacttcccctcattcaaaaagggctgcttcttgcctcctttaatgtctttcataaatttgttctccagggactgctggctgctgttaattacacatatcaactcccgctatgccagaggaaacttaattattctaattttcaaggtcatagaaatatccaaaggtgccagtttgacagtccaaagaatatccgagctcaagggaatcagaagcagaacttgccgtggaaggctgcttacacgcttatccacagagcagtgcagggttgctagcttcccaaccggaattaaattgttcaggacaagctaccctcgagtgaccggccaatgaccctggccataaataggaaacatttctttgcaacatgtgggagggcagttttctttctagggtccttcaaagctgcaacttctttcctataggcaagagcttacctttgcaaaaccacttaaaccttcttgcttaaccactgaggttttggccatgaagacagaaaagagagaaagaaaggaaatgctctgcagaatttcaaataaaagttgttctacagtttctcggaaaaagtaactccagagtagatttccagaaactgaccagcaagaatcagaatcctgttttaaatcgtcctgatttcttgaggaatccttaactggaagcccaagattacttggattttcattattgtaattaaaagatgagtttctaacaatgcacatctatctggataataatatgtcaagggaacataacataaaaagtgaacacactttcagtttagcaaaagatattttaagctccagagtaattttaagtggtaaattttaagtggtatctaagtggtaaagaacctgcctgccaatgcaagagacagaagagacttggggtaaatttctgggtcaggtgatcccctggaggaggacatggcaacccgctccagtgttcttgcctggagaatcccatggacagtggagcctggtgggctgcagtccttggggttgcaaagagttggacacgtctgaagcaacttagctcacatgcatgtaagtacaattctgggatttcatggcttctggaatataacttcttattcactggaagtagattctaaattcccatgtcgagttctgcttataagatttacctttttcctcctattttccaagtcttgctgctgctaattgcttccagccctgtgtggttcataaagcctttcagtacccagaggctgtgacactatgtttcctctagggcctttatatagctcattcataaagatcttccaggaagcctc

SEQ ID NO: 56966 - DNA, 1090 bp, Bovine  19866881351509
ccccaggaagtcatcgtcgtgcggcggcgggtactcgctgtccacgtcgtatccccccaggtagtagtcgctctccagcccccgtgcactgcccggtggcgccgcgccctcctggctctcataggtgggcacctcttctatgtcggacaggcgggccccaggcatccagtcggacgtgtcccagtggtaggctgtgagagggaagccagggcagttagtttcctccagggcagcgctgggcacagggcgcagaaagccgtgggcaggggacctggcatgcaactttcaatgcccaggagacagctaagaagccaggcacagccccatgctttttatagggcccttctcaggcccagccgtgctcttgccctgggggtacaggcagcggcagctctgaggacacctgattgttgccgcgtctccctctcagccttggtgagcaagggcacgctgtggaaacacagttctagaaggctctcccctccacgccctctttctagctgtaggctaagtgcagagccaggctggcaacatgctctaagaggcaagatgcaccagccttcctgtggacagcaggagggcgggagatacccgtgcaaatgaatgaatgactggggaagggagaggcttggggagggagatgtgagcagggctttcacccctagtgctgagcacacaagacacctggaacatgcaaaagtcagggcacacgagacacctggaacatgcaaaaatcaggtcaaagacactcagaaacgatggagggagacggacaggttaagagcaaactcagaaatttctaatgcataaggaacatctggtgctgggggcgtggcagtgtcacctcggttgaagttctgtccttgatccatgacagacactgtttaaatacaaagggagaagtgaaactgacagtccaaggcatgtgaagagggtataacaggacattttaaatgacttttaacaatgctcctattcctccctgttgttatttacaaaacaaacaaacaaaaaaacccatctatagcaggccctagtagttttaaatcactaatgaaagttactgattaaatcaatccccataatattg

SEQ ID NO: 56967 - DNA, 1617 bp, Bovine  19866881383591
ttgacaggcagatgctttccctagtgctgccttggaagccgacccaaacctggctctctcttctccctgcctggtccttaatgagtttctgtggactttggagcagatgtgggtgggaagtacctatccccccctccactttcttatcatttggttcactgtaggtcccccttcccaacaaagacagggacgtggggaaatgggggctgtcgcaggaaccctaacgcattgttggattacagagcagctgggcagctttctacatcttcatcctctgttctaagccacccgccatcagcaaataagacttgtcgtccaaccacaccatcccacttgtgaccttagttttcacttgagtagtctattttagcgtctgtatttcttgattgggagcccacttggtgtttttggtagatgtgaattttctgtgatgcttagaaaattttcttggtgatcagtgtaagtactggctgggatatactcgatgaaaattttccccatggagacccatcatttctcatagaatctctcacctctttctgtaccgccttggaagcagagtatggtggatgctgacagatgagactaagagagagggaaaatggccagctccagcagctagctgtcatccatttgatcaaagaaacatggtagcaattacacggatttttaaaattaacttctagagacatttttatacaatagttggttagtaacagggtaccgcgtctccttggggaattttatctgtttttcccacttttcaaaccagcttagaagcaaatgtttaggaatttcttgcatatatgaagggataattattgttttgctgttcagtctctaaacaaattaaccaggcaggactatattttaaacatgtatttaacaattacaatgttgttaattacaatttaacaattcagtgttgatcatcctcttgaataccatgggattaaaatcacccccatatttcatatattatcataaacttttcttggcatgtaagtcacattagtaaaaaatgattactgatttctcgtttacattttctcacttctcaattttccattttaaagataatttacttttcttgctgattgatttgtgagtcaagttctatatatacctgtgagtaaatacaagtatgtgtttggtcacccttaatcttactgatttccagtctccatagccctgtccaatttcctttaccccgataagactctgaaccagcatctctcatatctacctaaatttccttagatctgtagtccagtaaacaaagagtacctttcacttcggaacatttatctttttcaccttaaaatgaaataccatgacatctaactttgtggttgaggttttaagtgtgttcaggaaattaaaagctgggatgcctgcaggagccataagataatgatacatggatgataagtgtaacaaatttcacatatatctgaaggagctgagtcatcactgcctttttgctgtgaacaaataccaattccctgaccttaaaaatcttcaaacgttaagttaatgcattttatttccatttccagtgagttgtttgaggcagtattacacacatgacttctgagggttttatattaccgggat

SEQ ID NO: 56968 - DNA, 1261 bp, Bovine  19866881547300
ttgtaatttttttatattctacatataagcatgtcataccatatttgtctttctctgttttacttcatttagtatgctaatccatgttgctgcaaatggctttatttaatccttttatatggctgaataacattccattcatccatcgatgggcacctagatagctttcatatcttggctattgtaaatagtggtgctacagataaacagcaatgacctactccgtaacagagaaaactatattctgtatcttatagtaacctataatgaaaaagaatatgaaaaagaacatatttgtatgtgtgtgtgtatgtatttatatacatatataagtgaatcactttgttgcgtaactgagctgcacatattataaatcagctttgcatcagtataaataaataaaagatgtgagaagcatgttactcattgtgtgtactcagtacatgataactgcctttataatgaaaggcaacgtgttaatcactcagtcacatctgactttggcccatggagtgtagcctaccaggctcccctgtccgtggaattttttggcaagaatactggagtgagacttctagtcccagggactgaacctgggtctcctgcattgcagccaaattcttaaccgtctgagccaactaaactgtgctgtcaataagaattaggacagggagtaaaccccagtttgctgcctgaaaagcaagtgactccccactgccgcacatgaggagtccttggctgcgaaacgtcatctagaaggagcagaacccaggttctgtacttgggttgaagttcaaggacgaggtagaggagttgggcgctgcacgtcttggagtgggcaaggcggggcacctgaaagactccagggtggcctctggttccttttctcacccaggctctggttgccagctctacaggggcacaaaaggagggaatacaaatgtttccttctggagaatttcctcttacaataaacaaaccagtcttcatcatggtattaaaagaaagtggcatgaacgctgtgtaggttctgccactcaccctgtagctgtggcaattacaccatttgggataattgtcttgtaattgccgctgtgatttaaaatctaatgttatcctccaattgttctgatgtcttttcatgaataatgcaatcatcccatgagccctctgccagtttctcattcagattggccctgtgttgaattatgcaccattgtcttacccaccagtgtctcacaaaaggaatgcgccagagaca

SEQ ID NO: 56969 - DNA, 1615 bp, Bovine  19866881566673
atacgtaccagctgtgagaacttgggtgagttacttagtcactgtgcgcttcagttgcttcatctgtaagacaggcaggttacaggaagacaaggatgtaatgcatacaaagagtgacaaatatgaagtactcaaatcgtagccacagatgatttttcctaattttcatccaggtccttttgtgtagaagcagctttcttcatttccaagagctccaactagtggcagctggaggaacagtttagttcataatgattaaagctattaataacaaaagaaaaatccttttgagtttaaagcgcaggtgttctctggagtctagctttgtgggaaaactcttcggagtgttatccatcatcttatttaaataaatgtgttttgcacagataggaggtacagggctttgatgtggttgcccatctgtgtggaggctcgtcctctatcttggccagtcactttctgatgaagctgagtccctggccaatttcaggagctccttctccaggcagagattttaaagctgtatcattcctgtgacccagaaaaaaaatgtcatttaactaggtcacaaagggattcagtgacaggcgacgaggtcttggtgtgtaggaggggctaaaggtctggatgcttgttctaaatggtaagaaattgactctgagaggaatgatattaaaatgaccaaaagggcagcaacttcaggcacaaaactgaaatgcagtgataagatttactgtgtaaataattcacctagcttgggaaaaggctcaggatgggctctgagcacaatgggactttttcttgtctcagaatataattaattaagaattcaggatacaaggtaattagagaaaccatatcctggaggcattctgctgaattattctgatcatttttaacaatgagaaaatttaattttcttgtcttgtggcagagattttgaatttagataatgtaaagagcaatgttcatacagtacagccagtaaattaaattatttcttttgattttgatttttgcagcaaaaattaggatcgagtgattcaatctaaatcatggaaatgattgtcagagctgaaaaatgcttgagagaaaaatgtacaaattacaattgactctcatcttctctaacattaagttgcccatgttgctttctttgtaattactgtgtgtgtgtaaatctatttcatgatttgccctgggacaaaagggatgaataaattattcttatatataatgggggttatgtttacttaccaccaaattaaacttgctttccttaacaggaagaggttgtcaacagcttttagtcatcagtttagtaccagttaaaaattaaattcagttttttaaaaattcactttttatgaacctagcattcgcagaagatgtgctacaacctactgtgtttaaattgtccattttttacattactttggtattgcctatttaaatatttcctggggtatctgtgatgctttttattaatataccatttatccagcatgtgttttcaaaacgattataatgatattctgttattggtgcctcattttgtaccaacaaaaatctctaattgtaccatcaagatttcctgatgtcccaccccaaaacg

SEQ ID NO: 56970 - DNA, 1499 bp, Bovine  19866881675860
aatgcaaattttgcattttagaaatgacatacactacgtgtctttctattatgtaaaatacccaccctatcccacaaactggcataggacctatcaccaaatataccagtgtttctacagtgaagcatatggatagtcacactaaatgagggaaataaagactagaatagcctcggaatggtttgcttggttttgccagcaaatgtttgccacaattatattctcaatctttttacttcttagagctttggggattgtagaattgcagataaagagctgtgaacctagacaccccatacagagtttcccaggaggagaaagtttttgattctgacatttccctctaatgaacacagtaatttttggtctctttgggaagctagagtaatggggcatatgtaggcactgggtggagggatactagcaatgtttatcttccagattctatgcttaggtttttaaattttatttttatttacttaatgtgggatctagttaactcaccagagatggaaccttgggcccctattggggagcgtggtctctcagtcactggactaccagggaaatccctgtgtttctgttaaaggctaatgctaactcagattaccagggggaaaatgattaaagcattctaatgaaaaataaatcaactttattctctttaaagcaatccatgacttgttttgagtatagttaaaataggcaaacatgtaagttcttcctctgagtttaacgttatttaagaatatagtctttcctcttccttgtcctctacttctgcagttgttccgacatgttcattttaaaaggtccgatcacgtatatctttggtaatccaccttttaaaatgtagtcaaatgtccctaatgtgaacagattgaggccaggtcagctggaaattagtcagaatcatggagtagttaaaaataaatgcagctttattactttaaattacatccaacgattcaaagtcagctaagtatttcctggtaaagtcctcaggagatttgctttaatgaatacataagactgatctgtaattagaatatcactttgcttgagattttatatatgtatatatatatatatttctaaaaccatcaaggatggttaaaatggtgttttactcagaactgaaaacattccctttccatttggctaacactttaatttccctcattcttgggggaataaaagattttcaaagtaaaggtaagtctttagtttctcaggatgatcataaaaccctaggcagtagaatccagtcgatgagttctggggaaatgcatagcatatctatctcagaattatcctggaaacattaggtcatagatgactttctttaaaagaattttttccagattatataacacatagtacttatataactttttgaaaatatagagaagaataaagtaaaaatgtaatttacccataatcccactcctcagagataatccctgataacattctagtcattggtaagcactcttcat

SEQ ID NO: 56971 - DNA, 1586 bp, Bovine  19866881704180
tattcttgagctcactggtaataagaactgagatccgggatgcgggaggaaaagatgaaaccaagacatccatagtgctttaacagagagataacacacaactcgggtaattctaactggaggtgaggaaataggagggttcagtgaacatttcaggaaagagattctcaaacataacaaccacacaatgaccaggctattactggtttgtttttttggcagcactgtgcaaggcatgcggcatgcaggatcttactgctctgaccagggatcgaacccatgccccattgcagtggaagaatggagtcttaaccactggacagccagggaaaccccagatccttactgttttgcagatagagagagcacagagaggccaatggcttgctgagggtcagttgcataagctgggtcaggacaaggccagaatctactttcaggcttcccaagtccaggcccgtgtgacctacctaccaaagaaagctatgtgagatcaaaggaaaagacatctatctgtgtggtagggtgggagggcaagcagaggggaaacacgaggtgactgtctcaaggagcaggtgagattcagtcacaggacaaccaagggcttgtggtgcagaacaaggtgccttctgaatgaccatttgagaaggcagccaatttctggtccagaagtaactctcctctgagaactgggtgggctttatttcaggaatactgatgccaaagcctgggttttgttacctgctttgaaatcactgggactatcccaagtttgcagtctggtttatctccatcactgatttgggacacagccatagaagcctgggaagggggagcattgtcctttcatttagccatgttccaaccatttttgttttgcttagcaaatgtgttaaacttataccgtatgttggcaactattacttcatttcaataaatcgtggttactagtgaatggcagttgggttgagcagaaaagtgtttgtttcattttattctaataaggaccctgtgaaatacaggtttgtaagtttggaaaggaagatcaggatgagaatggaggaggaaaagagaattgatattcattgagcaccagttacagagttcgaaaggtgttttcattttttgctgttatgaataatgctgcagagaataatactaaaataaaaatatttttgtcatgcagaaatattttttaattgttgattaatattgacactacctgaacccttcctacagcagagggtttctgaatgtctcctgagatagagcatatagcaatttgatactgagcatgaccttagtaatggtatccctttcaccccgcccacacacaacagagaccatgagcatcttttgaaaatacgtagctggggagttaataccacactctgcatccacctccaggctttcctcccttctgtcccccatcctatttctcccactccatccctgacggttagactgccccctgggggtccctggagctacgaccagtgagcctactgcctgagaacaggaaaggacttctctgctttcactttgggacttgggtttttccattctaacaataaagctctactcag

SEQ ID NO: 56972 - DNA, 1445 bp, Bovine  19866881977585
ctgtggagcgcggtcagcactcaccgctgaataaattagatcgatgaaaacatgtttcagagctgggaaatgacagggttattctaggcttataattttacaaagagcacaagttaaacaggcaccacggttcttcatgctgaaactggccaaaggatccatttttcccctcacacatcaggaaaagcaagtttcgtatttttttttcaactgggaatgttcagaatcaaagatgtcactgcaaaaatattaaaacacaagccacatttatccaagtaagcgtattctttagatttttttaaagcccagttacaagagggtagtatgtggtgctctcctgctgagaaaattatgctgttgctatatgcagccttgtcaaatatgtttccaagaaagagcatcatctaagcccgtgtgttgtatttcttgtaggtgaagagatagtgaagaaatacaaaactgatgcaatgctttaaaaaggcaaaataagaaaaaacaggctaaaattaaaatttgatgaatgcaactacattttattttgcaatggaaaactgcatatgccagagaaatcacccagggggtctaactttctaatcaacatcaagtattttgtattggccagaacaccaacccaggacgcatttttctgctttgctcaaaaaaacagcagactctcacttgttcactagatctggggggaggtcttgatttcattgtagctcctagtgccctgcgtaagacttaggggcctggggatgatgatctctgccatcttgtttttagatgtgcatgctaagtcacttcagtcgtgtccaactctttgcgacctcatggactgcagcccatcaggccgctctgtccacgagattctccaggcaagaatactggagtgagttgccgtgccctcctccaagggatcttccccacccaaggatcgaacctgcatctcttatgtctcctatattggcaggcagattctgtaccatcagcaccacctgggaagctgtgtttctaaataagtgattttcatataagcaaaataattcaagacaaaggctaagtatagaagacgaatagaaaggagaaagataggagatgatatcccagcatgaagcacaagaataaattatgagaactgagcattactcactgagtagtgacgtctcaaagaagcacgtgtccaagagccctctcagacctccttgcataacacgcaaagcagacagagacggcaggtatggcgtcccctgttcctacagcaaaaaatgaaaggataccctatgccaacatcaccaagataatacacataggtctcagagttccagtgagcctgggccgtgaaaacgccctctcctccgtgaaaggctccattgagactggccacaccttcatctcagctctgctaagaacatttatttagtcttcaacgctttacagactcatgg

SEQ ID NO: 56973 - DNA, 708 bp, Bovine  19866882134319
ttctgcctaatgttaaaactgtagttacagtcaagaatatttactggaaaacacaaagactgataatcacattctttccaatgtttgcacaatattaactttcccctcaacttacaaaatgggacccagatatctcaagtattcctcttcattgatatctttctcaatgatcataaaatataactatattattttggatgcttaacacaaacaaacaaacaaaaataactgagcatactaaacatgttacccaaacctaactttatagctgaaaattgggtagcttatttaaaaaaaataaaaagttgatttgaaaggcttcagcccattttcttatttaataatggtcgttcctcttttcttttgcctaagagactaactttcccaacagtcataactactattttcactttcccccattggctcaaaattacatgcaacaaagcctcttggcttgctgccagttattaatactgcaaggaccagaccgacgctgtaacacttcccagggcacaagactgcacaaagcagacagacgggccgtctaacgtcacggctgagcttgattcccccttgaaaacctcggtgcacctctgggtcatgtaggcaggcacgtgctgcccggatgatggttcacctctcagaaacaatttctgagcctttccttttcacccaagcggagtcgagcttgctcgtgacagtacgggg

SEQ ID NO: 56974 - DNA, 1547 bp, Bovine  19866880346202
ctttcctttgtggctttgatgtgaaacaatctgcctgcaatgcaggagacctgggtttgatccctgggtggggaagatcccctggagaagggaatggcaacccactccagtattcctggctgggaaattccatgaacagaggaacctaacgggctacagaccatggagtttcaaaggactgaacacgattaagcgactaacgctttcactttctttcatatttgttaactttatcaagtgcaaactttttatagttgatagtatttattttattattattattttttactttacatcatcaaaatctttttcttttatatcaggtattaatattattctttagttcagtttggatattcttttaaaatccggtggaattcaatgtagagttttttatgacaaaattcaatttgtaacattcagaaaacaaagatcatggcatctggtcccatcacttcatggcaaatagatggagaaacagtgggaatggtggcagactttatttttgggctccaaaatcactgcagatggtgactgcagccatgaaataaaaagatgctactccttggaagaaaagttatgaccaacatagacagcatattaaaaagcagagacattactttgccaacaaggtccatctagtcaaggctttggtttttccagtagtcatgtatggatgtgagagttggactgtgaagaaagctgagtgccaaagaattgatgcttttgaactgtggtgttggagaagactcttgagagtcccttggactgtaaggagatccaaccagtccatcctaaaggagatcagtcctaggtgttcattggaaggactgatgttgaggctgaaactccagtagcttggcctcctgattcgaggaactgattcatttgaaaagaccctgatgctgggaatgattgaaggcaggaggaaaaggggacgacggaggatgagatggttggatggcgtcaccgactcaatggacatgagtttgagtaaactcagggagttggtgatggacagggaggcctggcatgctgcagtccttggggttgcagagtcagatatgactttgcaactgaattgaactgatcttagttgtaagttaatgagtaactagcatccaacttaatcattttatttttggtaatttttaatttttattctctttcagcatagtggagagtttacagtctctctcagtgatatcatattgacctggaaatactttctacatgagaaattaaacttaccagttgaaaatataaaagtgattgaccattatgaggacatcaggaagatttatgatgatttcttaaagaatagtaacatgttagatctgattgatgtttataaaaaatgtagtgatttgacttcgaattgtgaaaattatgcgaacatatctcctgtaagtattttttaaataattctgtcttagttgaattaaaatttggctagatttatttttattttaagtgatggtattagcatttatagtaacttgataatgcttttgctttttggatcatgttaagaatggaaaatttag

SEQ ID NO: 56975 - DNA, 1024 bp, Bovine  19866880493741
ctttgtttgtagtgatgctttctaaggcccacttgacttcacattccaggatgcctggctttaggtgagcgatcacaccatcgtgattatcttggtcgtgaagatctttttttgtatagctattctgtgtattcttgccacctcttcttaattatacaatattaaaaatggagttcttcagtagcagtagcacatttcaagtgttcacgagacatgtggctaacacctacaatactggacagcaaaaactacacaacattcccacagagagttctgttgaacactactatgtaacaaagctttacagtctatttcccatggtacatacatgaagggcagatggattttcaaaagactcagggacattttttagttttctgggtccataatattggaaccaagatgtagctttacattgttaaaggatacatctgttcctcccatctttaactactacctgatgtgaaagggccagttaagcttcagtaaacactacaatcgttatatcttcaaatactatttcaatcctattttctcctctcattctggggatccaattaggcatatgttaggcacactctgtgttcttatcttctcttttgtttttgcattccttattctctccttgctttagttcgtatattattctaatgacctatcttcatgtccacctgtactacctaacgctatgtctggtttactattaaatttacctaattattaattttagataatgtttttacagttctggaaattctatttggttttgatttaaaatgtttggttctcaggagttccaggtggtctaggaattaggatttggcgttttaactgctatggcctgagttcaaaccctggtcagggaactgagatcccacaagttgcatggcatggtccaaaaaaaaaaaaaattcactgttagaatttcccaattttatccaatttgcccatatattcctttaattacttttaagtgttgaaggactctgtctttcaaaggtttttacattggttcttggtctcc

SEQ ID NO: 56976 - DNA, 1320 bp, Bovine  19866880569237
aaataaatgccttactctgaagaatccaattaaaaactgactgtgattgcatttgatctctggaggaaggtgactcaggtctgggaagaaggagcactgtactgaatctaatccccatgccatgttagagtgtttacaccagcttgagtggttgtgatggggtcgtctgcatcatttggttcttgtcctctgactcactgtttctgctgtggggttaactccctgcagtggaaaagggggaagttacttgccagaccatatggagcagagaatagcagattgacttaggtttcggtggaagctgaaagcatataaacttaagcctcccagaggataaccttggaaaattcgtttaaatagcatcctagtagaggtgtctaattttcaaaatctatcttcaagccttaagaaagtttccaaagttactttatggaaaaaggttgaatgaggacaaattgtagaaggtatgcagtttcactgcctttgcttacgttttcggtttagagaagctggaaaaaaagaatgcctccctgtgatttgctgtaattctgcctgggctcggaggtatgaccatgtccatgtgtgtataggagattcagggatttcaactctgttaaacctgggttcctataggcataactagaccagctaatgttaaagaatttgaatgagccaatgaaattggaaaactggaaatgcatgtatttccaagttggattagacaagactcctcctggtacataaccctgacaacccatggatttgttaatcgtggccttaaattcacagtgtaccttgaatatatgtagaactgttatcagttcagttcagtttggtcactcagttgtgtccagctcttggcaaccccatggcaaagggaggcactccaggcctccctctccatcaccaactcccggagttcactcaaactcatgtccatcgagtcggtgatgccatccagccatctcatcctctgtcgtccccttctcctactgcccccaatccctcccagcatcagagtcttttccaatgagtcaactcttcgcatgaggtggccaaagtactggagtttcagcttcagcatcattccttccaaagaacaccctggactgatctcctttagaatggactggttggatctccttgcagtccaagggactctcaagagtcttctccaacaccacatttcaaaagcatcaattcttcggcgctcagctttcttcacagtctaattctcacatccatacatgaccactggaaaaaccatagcctcgactagacagatctttgttggcaaagtaatgtctctgctttgaatat

SEQ ID NO: 56977 - DNA, 1489 bp, Bovine  19866880659906
gatcaaaccctgcatctcctgtctcctgcactgctggcagattcagctgagccatcagggattcccccactgaaaagggtatttaattttaagtggtcactgaacttttgtaaagtagaatttgcaagcttatggagaaatactgttgtatctgtgtgggaattttctctagcctctgaactgagcacaatgattttaatatattaaagtgtatataagtgtatcctgttcttaacacagaataatggccccaaggacatctatattcccatactttttaggcaggaaccacccctctatgaaaagtctcattcaaggactggattgtgtaagtaagtgttagtcactcagtcgtgcccgactctttgcgaccccatggactgccgcccaccaggctcctgtgtccatgagattttccaagcaagaatactggagtgggttgccatttccttctccagggaatcttccctgacccagggattgaacccaggtctcctgcactgcaggcagattcttaaccaactgagctacaaaagtctcattcaaggactggattgtgggggatactcaaatgatgaatagtaatttcagcactcaggtagttcatgaccccaaagtggagccctaaggtttaacacgatcctcaagtagtaaaggaaactgatcaagaaccttttggttttagatgactgtcccacttccttgtcctctttttctcctttcttcaaaccaatttcaagtcatgcttcccatcttccttcccactctcttttttagttttttgttaagacaggtgtccctggatctggtgcctaacctgtcactgggttgtgtgtgcacactcagttgtttccagccctttgcgatcccatgaactgtagcctgccaggctcctctatccacgggacttcccaggcaagaatactggagtgggttgccatttcctaatccaggggatcttccctacccaggcatcaagcccatgtctcctgcattggcagacagactcttttaccactgtgccacctgggtcattgggttacttgatccttaattcacaactcatttgcagaaagtatttttacttctatcatgatatttgatgcccaagttatgtttctaggctacctcccaaatcatctttttcatcaagcaatgtaacataattttaatagaaactgaaacagtatatatttaaaatgcaatccttagggaaaacataaccaacttcaaaatttaaaaagaaaaaatgtttttgtgaaatcttggaactgcttttgttgtttaatcacaataaaccttactgaactatttcacaaaacctccagaaagttcattcagcagagatgggctgtaagaactgactgtaatagaatcaaagaggatttaagctatgtcaacagagtaactgggggacaagcggtcatagtacatgattgcatacaccgtaattcttactttactcatttgttaccttcttaagtgcaag

SEQ ID NO: 56978 - DNA, 2831 bp, Bovine  19866880745487
ctggactattacagtctcttaatttgtggtcctgtgtcccaggtcgctcagtggtaaagaaactgcctgccaagcaggagatgtgggtttgatcgctgggtcaggaagatctcctggagaaggaaatggcaacccactccagtattcttgcctggaaaatcccatggacagaggagcttggcaggctacagtctccagggtctcaaagagtcagatacaaacttagggactgagcacacatgtatgctccatgtttaataacagtcttagcctggaatatattttatacattgccatcattgctatcttttttctaaaatgtaagaagtatcattttatttcctttttttaataaagtaagaggttttaactttgtaacagactgacttgtaacttctttgtcccatatacaaagctttcccagcctcatcccacatgactccctctatgttacccttctttgctacctggtcactgaaaataccatattcttccttacccctgtgtgtctcctttgtgaaaccatccctgataccagggtaaattggtgtgcttcctttgatgtgctcctactgcataaggtatacatggtcttcagaatagcacttagcactctgtaatgcctttattgattacttgtttattttgtcaaagagactacgggtcccttgaggtattggtttttacctttcaaacacagttcttgggacttaggatgtacttatggctgattactgaaagaatgaaggtcaactagtctttttatttttgcatttgagtagatctttacagccatctgtggggttggtattcaggtcaccagaatcccacttctggtataagagagaaaaaataaacagattaagtcatgtggctgaagtcacatttgttgttgttgttctgtgctcagtcatgtccgactctttgagaccccatggactgcagcccgccaggcttccctgtcttttactatctcccacagtttgctcaaacttacgtccattgagtcagtgatgccatccaaccatctcatcctctgcagctcccttctcctcctgccctcaatctttcccagcatcagggtcttttcaagtgagttgactgttcacatcaggtggtcaaaatattggagcttcagcttctacatcagtccttccaacgactattcagggttgatttcctttagaattgactgctttgatctccatgctgtccaagggcctcacaagagtcttcttcaggaccacaattcgaaaaagtcaattcttcagtgctcagccttctttctggtccagctctcatatccacacaagactactggaaaaaccatagctttgactatatggacctttgtcagcaaagtgatgtctctgctttttaatacgctgcctagtttcatcatagcttttcttccaaagagtaagcttcttttaatttcatggctgcagtcaatgtccatgactttctttgaagcccaagaaaataaaatctgtcgctatttccattttttccctgtttgctatgaagtgatgggaccagatgctgtgatcttagttttctgaatgttgagttttaagccggctttttcactctcctccttcacctttatcaaaagactctttagttccttttcactttctgtcattagggtggtatcatctgcatatctgaggttattgatacttctcctgacagtcttgagtccagattttgattcatccagtgcagcatttcgaatggtgtactctgaatatgttaaataagcagggtgacaatatatatagccttgacatagtcctttcccaattttccaaccagtctgttgttccgtgtcccgttctaaatgtcctgttcttgacctgcataaggtttctcaggaggcaggtaaagtggtctggtattcccacctctttaagaattttctgctgtttgttgtgatccacacagtcaaaggctttagtgtagtcagtgaagcagaagtagatgtttttctgggattcttttgctttttctatgatccagcagatgttggcaatttgatctctggttactctgccttttcctaaatccagcttgtgcatctgaaagttctcggttcacatattgtgaagcatagcttgaaagattttgggcgttacctttctcggtcacataaattgtagttaaacttcttgacgtaaatcttagtgttattttgtccaaaatctaatgtcttcatttgataatattattttctgtattttttggtgcttctggaagctcataaggtagattttaatatggctcgagggagaaatattcacaagccttaaagccacttcttgtggctgattttttatagcttaatagaagaggagggataacaatagcacatgaaatggaaaagaatggttgattgacccagctggagtgattcttacatttacttgaaattatttcttgttctagccaaaatctcataccataaaccatggcactgcatactgtggcagagatactgtgaaagctttactagttcttttggatgaagaagcagccagtgctcctaccaaaaacaaagcagagcttttgtatgacaatgaaaacacaattcatcctaatggaacttctgttcttacactttttcggtaagtaatgtggaagttatatatatgtgaatgttaggtctataaaggaaatttttgaaaaagcccctcattggttataaaagaattacatgttatggtaggaaacttgggaactacagaaaaagtgtgaagagaaaaaacaaaagttagttaaagggagatttaacatttgaatgtgaggaagtcatatataaaatgctattt

SEQ ID NO: 56979 - DNA, 3457 bp, Bovine  19866880783822
tcttgtgaagctcacaaacttctttaatcccaactctaattcacttcacttcactgagaggacagaaattattcaacataagtgttctcaatgaatcctgttatcatctaagcccctaaaatgggactctcccatttccctaccacagatgaggacatggccccatttttttaaagccagcatagctgtattcataattctctgcaaagaggacatttttgctcttttttctctttacattcatgtaaaatgtctgttcttttctgaatttaaattaatgccttggttctgtgccttgcatctccccatcctctgctccttcagactaagaaagctttctcaagatcttaaagtatttccaaatatagaaaatttcttcttggttctggctgttagattaaaactattaaaagtccacatgaactaccgttacatattgcatataggaaagggaacagaaacactagatcttagttaaaatcattcttcaactgaagccaaagctggaaatgcttctgaaggttctttatctttcacccactctatttgcaaacattcttgttcacattcactttctcagtatgcacctttattaagacagatctaatcacaccccagttcagctcaagccatgagagtactccacaaaataatgttttctataatgtcctcatgctaactctcgtatattcacccagatgccaccctgatcatatccatcccataggtatctaggtgcagtgagtttaagcctgcaattctagcctgagttctccccaagatttcttcaaatcaccaagagttcttatggtctcttctgctcagttctccattatgtcaattcagaagtgaaattcagtctcttcattaattcccatagaaaagcctccattcacataaactacagcttagctgaatacagaaggaccacaaggaaggatcatagcctgcacccagagcaaacagcttcacatcaaccactcctcttcaccggggtcctttctagtaatcccaccaccagggatttcccagttggctctttacataatcagcactttacttcatgtctttttgtaaattcccctctattcttactcttttccctctccagaaaactcagaccctggaggtttcatttttcccctccaaggtattttttccagacagatactgcttcttccttaagaggaattccaatgtaagctgttaaatttagattagaatctaagttaatttttgaagataatttaataattctagtcttgtttcttttgttctttgaatgaggaaacagaggcctagaaatcttaagtgccttgcttactttagctcttacaacactatttacagagaccatctgattcagaaacatgtgggtggtttttataaaaaaacactaaatttgaggctgcaccttccatctgctaaaccaggatctactgaagagctccccaaataacttttaggcacacaaagtcactgccttagaatttaaggactgggcgggggaggggggtacaaaaaaatactaaagctgttaaaatttaattaaatctgagctgtaagaatgacagtttggtttcacgcagcacctgaaaagaccttagacaattttgacacaggacaaagtaaatactagtgtcacttgagcggaagtaacagcggactaggagtcaaagctaatgtgtaaccttgagcaagttacttaacatctctggacctcgggttcctaggggaaaatactgctttccctacttaacgccaaggactatttgaagggtaaaatgagatcatgtatgtgaaaacacttgtagaaggaggagaaaataaatagctctctacaactgctaggtattgtttcaaagtcctacttgggcctggaaaacatcaatcttctgcctgttaccagtgtgctagtaatacaggctatggagtttctcaagaagcccgcaggatccaagttaggcagctcattgctcaggctgagtagccagagaggggaattcttgattcaaagcagcatctgttagtgattaaggtttcagaggcatgtgcctgaactgaaggcaatgctacagaattggtcatagcagcagtcccagttgtaaaacagattccatccttaaagtggatatgaaaggtaaacatgaaagcactattccacagtcacatgaaacaaaaatgatgcttgtttaacatcccccacagcacacgtgcaagcacacacaacaggaagcaacagccagaggcttatgggaaagaacgaggttctcccaagcgacagccaccaccatcaaactcagaagagctcacttgcattctaacaactgcacataatgtttgcaaagtggatatctctgccattcactctctgatgctctcttccttgaaaactcaagtttgatcaaattggcaaaaaaaaaaaaagaatccccatatccaaaaattactatgaattctgtctgtgtcagagatctgactatagttaacatgaccatgttcactgtgacttagaagacaggatggaccttgaacaaagtccgaagatctgggcctggtgtgaagagtgatcttaggacttctaggtaggctgggtgagaaattctgagagtgtttgggatagcggtagaatgagaccccaagatttttattaatgttgttttgggaaagtgtgcactatctataaaagtggatgtagtgtgtgcttgagttgaacttagaaagcttagagagaggactgttaaaaaatttaaagaaaaagtcaagatgagcagtttaaggtgagtcagaatttactgttcaggctataaatttcagttgaaggtacatgaataagaaacatgatgtcccacaccaggggagagtcctggtttttatggggaacaccttgaacatacccagaaagtcagcaacttggatgacctggctggtttaagttcagcctttctggaagcacttgcgaaaaagcagggagagctgtacccaaggccaaagcaagtgaccaataagaaaacagaataagaagcaaaaaactgggactttcctggtggtctagcagttaagacctcgccttccaatgcaagtggtgtgggttcgatatctggtcaggaagctaagatcccacaggcctctcacccaaaaaagccaaaacataaaacagaagcaatattgtaacaaatttgataaagacttgaaaaacttgtctacattagaaaaatcttaaagaaaaataaagtgaaagtgaagtcgatcccacaggcctctcacccaaaaaagccaaaacataaaacagaagcaatattgtaacaaatttgataaagacttgaaaaacttgtctacattagaaaaatcttaaagaaaaataaagtgaaagtgaagttgctcagtcgtgtccaactctttgtgaccccatggactgtagcctattaggctcctccgtccagggattttccaggca

SEQ ID NO: 56980 - DNA, 2563 bp, Bovine  19866880787800
catttaagattacaagatacataaaaaatttttttgtattgtttataaattcagctagtcgttaagtcataataacatacctatttatttttttggctgcaccatgcggcatgtggaatcttagttcccctagatcaaacccagtccccctgcagtggaagcatggagtcctaaccacttggaccaaatgttagggaatttcctaacatgttcttttaaaaaaggtaatgtgagaatatcctgcatgctacaactaagatctagcgcagctaaataaataaatggcaagagtcacttagtatcaagtacaagttgaaccatggtcttgtttgattttgttatgattggacccaaattccgttaaattcaaagttctattttatgatattaaggtataagaactcaattttaaaaaaactactcactgtcaaaatctctccttcctataggaaatttagctgagttttcttcatccccaatttctcttttttcttgtgttgattcagtattttgaactcattctcagctggaaaagctacagatccttttagtgcaagataaggttttatagccagattcagtggcaggccatgatttaagaaattatgtttggaacctgcattctgtaaagaaaaggttgatttgtgttttaactgttctattgggaatggaactataatacaattgtgtaatattcttattgatcaatttaaatatgccctgcactgtttttaccctttaagaaatactttagatacaagattttcagggaataaaaactttttgaatgagagagatttcccagaatggaagaacaacctggtatgtatgaaatttgtttaactgttctaatgcatactgtaactttttttcacgtgcttctgcttataaaagtatcaactttactttcaaaggattcataaagatcattcaaatttccattgaaataaaggacaagtcgcattatcacttaaaaaaataaataaataaataaataaataaatgaaataaaaaaaaatctaatgctagaggcactgtaatagttataaattagaggcaaagataacttagatcttttgcaggcaactacttctaatgcaatatgaaggacactaaccacaagacttttatcactggaagtgatttgacaacatttatcaaagtttaaaaaatgtgcactgtcttgacccacccaccactgtatccaagtatacaatgtatcctaaggaatttgcaggaactttgtattgtcatagcattgcttaatagttggaaattggaaacaatgttagataataggaaatgggcacatggatataaaataatatttattaagatggaaatatgtgtactaaatgtcaagttaaaaaaatcaggttattgaacaatgtgtatcatacaatcctttttaaaaaaataaaacatgtttacataccaactgatatggcacaagatgttaaataagaatggtttttctccaggtagtggaattataggcaattattatttgatgtgtgaatgtgtatttttctgtttagaaaaaaataagggaatcatgggaaaaagtaatttagtaatctattcttaaccaaaactctacatcctacaattatacaaaggtgcctagtatttcaaaatattgcagataaactgtacttaaaattgcatgttaaacaagatatgttaaaaataaagcactgtattgtaaacgaaccaggctgacccaggttatactcttaatgtatactcttaatgtcatttaacctggacttaaccccttaaatcccaattaagcaaaaagcaaagcatggggttactaacggaaccagcaaacaatatttaaactctgggtacacaccagaaaatggcaatttaatacttagcaaaatatatgtcccttcaatttacattttacccattctgatattccagaagtttttccttgattaatctagataatcaaaatggtttccttccttatttgaggaaaaattgttcttcttagactacaatgtggcattaagccaggaaattcatggttctatataccataaatgttgacaataaagctcattattttagattaggaatagtcaaacttctctcaagaaattgaagtcctcttaaacaataaattagtaattaacggattggttcctgcttgctgttagttgcaaggatgttcacagacaaacttgtgatatgctcctctcccccactcattctctaggaagtatagaacggtatgtacttttccctttttccaatcatgattcatcctaccatctttacttctgaaaacagagataacatcatcctacacttaaggagatttggggattaaatatcgaagtactggtaccaacacagtactgggaccatgtttaggggctcaaaaatactaatttccaatgacagtctctggacttgcaaataacagtttgatgtactcttgcttgcacaactgtctgataatattcaacacattccaaactccctcgatatatagaaataaccaaaaataaacaatcagatattttgaaacggaataataagtatccca

SEQ ID NO: 56981 - DNA, 644 bp, Bovine  19866880846598
tgataaataactttattgtaaggaattgaagacaacattgaatgatagagaatcatgaagttagtctttcagagaaaagacagtgaagcacaggagaaagagcataaagcaatcatggatggatctgaacaattttggatgaaagtcagatttctaaaaggtagttcaagcagaaaatagaaaagatcaaacaggtcaattttgtaaaaatcctttacaatgtactaaatacaattttaaatggttgttctaaaattttaaatgtttctataaatgaatattcattaattaaaatatcaccaacttactcagtgttttgactaaattgttaaaactggagagtaccataatgtcttgtacagaataccaaaggtaatttagtattttcttcctaatgtgaggaagaacaagtaactgtcaattccagtgcaagtctggagtatagcaactctcctattctcaggcaaaatagcacaatccttggagcagagacctcaggttctggagaaggacacctctgccacttgctaacttggacaaattgcttactatctttctcaagtctaattctttacttataaagtggggatactactaaaagagactcttgtggaggttgatacaagtgaagcattcagcaacat

SEQ ID NO: 56982 - DNA, 1286 bp, Bovine  19866880876076
gccgtgtctacttctctattgtgtcttccctgaccctcctatttctaaactatgttcttctcttttgaatttccctgctatggcatctgtccttttttactttgaattttagttatgtgtatatcttatttcgcttaggtcaagattcctgaattcagagtcagtgaatgagtgaactttctgttcttcacaacatcttatacaatgccttacatataatagaagctcaagtgtttagttactgaactaattaattaagcaaattattagaattaagcaaatttagaactctcagaataggaatatgaacactttttatatagtactataaaccactaggttcagaataaacttttattctctaactgtagggttgaggagaggtgaaaacaaatttaaaagctactttggtttgtaaatgtttactttttttggatgtagatctcccacacaagtggataattcaccaatgaaacccttaagagaacgcatctataagtcaatggaagagaaaaaaatcaaggtacaatttaatgtactatcatgaaaatgataaaaatttgttttgcttttagaagaaataaatatataaagctgagctggatattataaatatacattatacatggaactatagggattaaatggaaaataaattatgacagttgatatacagaaactttccttttaatacaatcttggctaatctgtatctgacgtattcaataccctggacctaaaagaaggaaaggaataagcacctgctgtggtaagtggtcaataaatatctgttcagtgaatgaaggggaaaataaagagaacatggttttctcatttacatttctcatatcttaaactgagtcttgagagtctgtgtagtttcaattttgttcctgtctgaagacataatggcagaatgtaattgattgtagattgagacaaggagaacatttcacattgttcattcactaaagctattctttatattttcatttagcatccctgttcacatatgaaacattgtgcctatatgtagttaataacatgtttttaggcatttaaatttttcttaatctttgtctcaaaaagaagcttatttttaactcatttattcatttaatatatatatatttattgagtatctgctatatgtcagacactgttctatggttgggaatttgttcatttaacaaaattttcatgtaaaatttacagttatccttaaattatcaaataattattcatctcttaataaaacttgagaactctaatttgttcttcgtatt

SEQ ID NO: 56983 - DNA, 765 bp, Bovine  19866880977378
aatcttttgggggtcacagaaatgctatgtattactagcatctaggttataaaagtacatgtatttgtcaacactgatcaaactgttcctttaagaattgagtttactgtatgtaaattattccttaatttaaaaaaattaggttagctcagtaagagctaaattatgattgttaaatactgtttactaaaagaagacatacattttagatttgacatttatggaaataaggttagtgttttgtaacagaccttaaataacctgacatatcattgcctttgtgaagaaggcctcagcaagtgtgttaatttttttctcaaaaagcagtcattcttttcaaatgctttccacaaaactgaagcccaaggattagaactacagttggtggctcagatggtaaagcatctgcctacaatgcgggagacccgggttcaatccctgggttgtgaagatctcctggagaaggaaatggcaacccactccaggattcttgcctggacaatcctatgaacagaggagcctggtaagttacagtccacggggtcacaaagagttggacatgactgagcgccttcacttttctttcctcattttatgtatggggcagtaagggtgattaatgactcaatcaaatttagttattttaacaaagctgcactttcaataagtggtaaatcagtgaagaatttatgattcataggaatctcacataaacagctttgtagtcaggctcaaacacatgcttcaaggcatcactgttacgtc

SEQ ID NO: 56984 - DNA, 1141 bp, Bovine  19866881106397
gaactgataatcttcttccttcaccacttcttcaattcttcccatctgaagacttccctcttttaagtatattatataaagtccaagaagactttccttaccactccaacctagattcatccttctttcatctgaacatctctcaacccttaggtagaacttattccaaacactcttacccaagccaactgtgcaaaaatcacttccggttataaagattaaaaatttgcttaaaaaataagacaatttccagggtctcagtcaagatcaggaaaatcagtgtccaagattagggcacagaagccagtactttttaaaagccctcccaagtgattctgcttcacagcctggcttaggaataattaatctataccacagagtctgaaattagtcataaaatacttgattacatttaaataaacattatttatgtgtgtcttctagaactttttgcagaagtcttataaaaataatttttaaccataataatcataatagttgtatgtttaccttaaaattggcatcaccgactcgatggacgtgagtttgagtgaactcagggagttggtgatagacagggaggcctggcatgctgcgattcatggggtcacaaagagtcggacacgactcagcgactgaactgaactgaactaccttaaaattataaattaaacatcaaatgtgcacgtcacacattaaattatacatataaaagcttcacttttgacaaattaacaaatcatttcaaatccaatggcaatattttgacacagacacacagaggcatttgtgaatatagtataatgacattatcatagaagggcacatattgctcagaaattaatgcaattaagcttattcaaatgggcagcaaccaaaattcacttttaaaaaaaagttaacctaaatacagtctactaacctgtttgttgttctctgccatggaaagctgcaatgccaagagcatggagtctgcaccacacacagtagttctctcagagttacaaagagtgtgccagttccttctgaactctttaatcatatccaagatagacttctgattaagcccagccatgctcttaatgtaggacagaatgcaatgttaaaaagccatattttaattggaaattaacatttaaca

SEQ ID NO: 56985 - DNA, 1097 bp, Bovine  19866881274979
tgggagggtcttacacatttttttaaaaataaatgctttattattattatttttttaacatagaggaagcttggtggcagatctgtagccacttgatgtttttataactaagaattatagttcaggctctctctgctgtagaatgtaaaggtgcactaacacacatatatgtaattgttaggaaaattaagcttagtcactaaaagaagactcgccatctgaactttcttctgtgtttttttcaccttcaccatcaggcactggatcatctggcctctcaggaaaatctgggtctagtccttccgataccattttgtttcttatcgccgtcactggaacacccacttgaagcattttgagatatctggcatatcctggatccttggctacagttaagagattttctggtgttacttcactttgctgtggtccagagtcctgcaaactgttctgctgtgattgctctcaagtggcttcagaatgtgttccatttgtgatcctagtgacatttacaggagatgcttcaagtgtgacatcatccaggcctgggatagatgataactttgcatctaaaatattgagagttgtttcagtctgctggatacgaagagaaaggtctgctagtttcttctcacaaactagaaaagcggttgaggaactgtacagtgtgcatcgcaaactcgcttagaaatgccaccgttcttttctgttgaatagctggcaccttagtcaggcctatgcctgagcccatgagaggaagcccatcctcatccgtctcctcagcgggtgggggacccaggactcaccctcaaacccctccccagcccagcccgcccaacccggtaatagcgtccgaacgcctctcctagtcccctcttacacacatttaaacaataaggaaaatacatgtttgataacaagcagaaagagaaggtacttttaaaagaatgaaaattagaaagattattgtcttttctagtaacaaaaaaagagcttggtggatgtggaactctaacatcaagaatgagagagagacagagacagttcgttcttgaccttgccaaactgcccttcatgtgggatgcaacagactcata

SEQ ID NO: 56986 - DNA, 940 bp, Bovine  19866881765208
atatgaaagaactgatgaacatatcaagttctcccaaatattatttttatattgtgcttcaacagtctatagttctgtgttttagggtagttaatgccaacaacagctacttgctattatttgctaacatttggttgaatctcttttaatactcagttggtttcttggtattatgaaagtcagtatcttgtaattcttaaaaaattgagcaagttaacttcagcccttatatcttgccctgtaaagaggcatgggtataggaccaaatagtgcccataggcccgtcccttatgcttcaggggacttcattattggttactatttagtggcaaatgtatgtaggggaatgagatcaggtctcatcagaaatgcagctgtaccttttatatcatttctaagaagacattttccagcaattatgatagttgttatttatagattttcattgatggcaagttagtttcattagcaaggatatgttctttgttcaaaccaaatttttggtttatatggcaattctcatttcccaaagagctgagtaagcatttgtcattgaatgatcataagtattttactgcatattaaaaagattatttgtgaatttagaaatcttcaataaaggaaatattttattgtacaggtacagttactagcaaagaaaattatctactcatatttaaacctgctagtgaattcgaagaatgacttggctctggctcatattctcaatattcctgatagaggacttggaagagaagccttcactgatttgaaacatgctgctcgagagaaacagatgtctatctttttggtatggacatgttatattttcaagattttttagagattctgaactgtggatccatgtaccttaatgtagagttcttgtaactatgatataacaacttttaaattgtgaatatgtgttctacctcatgta

SEQ ID NO: 56987 - DNA, 875 bp, Bovine  19866881078777
cattaaactatactttgttttcttaagaaatccagggaaaatacatattacaggtttggtggtgggagctggtgggagaaacaactaataaaaatatgaacacagtgccccttagggttgtttatgtagatcacttaattacatatatttgagtgactttcatattaaaaacattaaccaaataatatttttaaaataagatgattctttcaagaacatcagatatgtttttcatacctgatttgtctttatcctatatatataatcaatatacagcttctcttttcattctatatcaccaaacccttattgaaaagctcattgtattcaaaataactccttttaaattgcttgttatgaggcaatttaaaatcatttcttgtcagtcaactgcataatgcaagctccctctctttgagagaatggtgttatatatccaaaataatctccaaaaacataatcaaggagaagaatcactttgaaaatgctgcatgctgtattcatcaaagtataggccagagatatcctcagttgattttaagaccattgaattaatggcagtttcactggactgggatatttgaaagttgaaaaatcttatcaacaagacaagcttagatagcagcagcaagctgcaccaggcttaggtatttaggagaaaactctaactggcaatgtatcatgaggaacattactcagtgtcttagggtccccatttcttcttgggctatatgaaggatactatacctgactaaccatttcctagttttctttgaactgcaagtttccctgatatatgagagagttaagagtatgtggctacagtcattatttataaaaattacagaggaaagaacaacctatttttgatgcaa

SEQ ID NO: 56988 - DNA, 1458 bp, Bovine  19866881094137
atggcatggtcatacatctttttttatatatattgatattgataactggtggctcagatggtaaagcatctgcctgcaatgcaggggacctgggtttgatccctgggttgggtagatcccctggaggaggaaatggcaacccactcccccactccagtactcttgtctagaaaattacatggatggaggaacctggtaggctacagtccatggggtggcaaagagtcggacatgattgagtgacttcactttctttctttctatggctgtattgtggcaaatggtataagatgcataaatggagagagagcaaagaagagctgtattagcagttgagctaatggcaaattagagcttttgcttatttttggaaaagggatggatacatgtagaggtattaaagaaaatcatagaatagaacgaacttagtaacttactgaagtttaaagagtgaggagggagaaagcagttctgagttctggtctgtgcagctggatcattgctgtcaccattctgtgaggtcaggaaacactgcagataaagtatttttaggaaagtcatatcagtgtagtatgtgtgcttatgtgctaagttgcttcagacgagtccaactcttcgtgacagtagcccaccaggctcctctgttcattggattctccaggcaagaatactggagtaggttgccatgccctcctccaggggatcttcctgacccagggatcaaacccacgtctcttctgtctcttgcattgacaagcaggttctttactactagcatcacctaggaagcccatcagtgtagtatagactgagtttgaaaactgcaagcaagtggagacatttagtaggaagctggggttcagaagagagggctcaactgaagatgtaaatgtaatatgtccaattgtcactccaaaattctgtgatcattaagtgttttggagaagtgatatctagagatatgctctaatattttcttccttcatgcaaatgaagccattgtttttctctttctcctccttcttccataaccacaccagtctcctgcagagactctagcccaaatctgaataagcacatatctgtacccattgctaaagctcagaaggattatggggctatggaatgctggttctttcagtgttctggtggttggaggctccaagtcattcaaattaggtttatcaggtgaccaaagaaagaaagaaactgtaatgagaagggaatccagcaaagactgcaaaggctatatgatactgatttggttcttctccatgatcctttcaaacatctataaagtataattatcatgatgtgcaaggtctgaaagaatttgtggtataaattgggtagcaaacttaattctgtgccaggtttgttgtggaagaacatgattaatacaaaatatggagctcagaagagccataggaaagttaatatgagaactgttaagaaatg

SEQ ID NO: 56989 - DNA, 1289 bp, Bovine  19866880186416
aagtcactcagtcgtgtccaacttccagcgagcccatggactgcagcctaccagcttcctccatccatgggattttccaggcaagagtactggagtggggtgccattgccttctctggggaagaagcacaggtgaagggaaaagattgcctcgtatacagtcccagcatttgaaatttatgggggaaatgttgatcaggtagtgaagttggctagactttgttaactatctaggaaacatgaaaaaggagaagttcatgtcactcaaatattaacttagggattgttgtgacaggcacatgccctctgtcgaatatttaaagagaccttcatcttctgcagctagagggtgggatgtactgaaaatcaggattaatattagattgcacagatggcaagagttaggaaggagctgaataaataggcatgacaaatctctatgctaaaagtagtgttctgatgaaagaggagatggaaccatgaattcttgggtggagatcctgagctcctagatagctctaaaccctatgggccagcaaaagaaccccctagctctttgtgagagtaggtcagacataaattgcttagaaaccatgaaaaggtgatgattcacaagataagcttgttctccttaatacaaaacaattcaatgtctcacttcattgattgtatttagacttggagcctgtcctgatacactgctggaatgataccttgcagcctggaaatgatgcttccactgtagcagtgctcaaagggtagtctataactctgtagggatcctagagagcctttcagggagtttataaggttaaattattttcataataattctaagattaattttgaatattctgtttgttgacatttccactgttagtgccaaagcaatagtgtatcaaagtcaggtgttttagcaaaaatcaaggcattgacaccatactgtactagaattctccactgccaattttaaaagtcagttttctaacagatgctctcgatgaaagcagtcaaaagtattatattattaatcttaaaaatcttgatactggagtaagtgtatttttaatactctatgtgacaaaacagtaagtatgaataaagcttttgctgcataccaaagtatgatcattatatcaagaaaaagcacttctgcaattattttacttgaaagctgaacaagcctctttaagggaataggatttttccttgaaataacaactgacaggcaaaagatggttattcaaacttggtattttggcagtcatttcctcaaattaacaaagtaac

SEQ ID NO: 56990 - DNA, 1109 bp, Bovine  19866880386175
caagagtactggagtggggtgccattgccttctccatcacaggtggcatagatactgacaaatgacatatatctgtttacagatactgaaattgaggcttaggagttaaaaatacctgccttagcattgatgtgagcattggtttaataaatcacttagctctgtgcatggcatataagtacttaatatttggtatcatttaatctaaattttgcattccttattttttttttttaattattgggatattggggaggaggtcacattaatattttatttaaaatagtttttaaagaatcattttgatgttcaaaccaagataagagttagtaatggggaaagggtgctttgtttctagcttgaacttaaatcaagctttgctttaagacttgtatccaagttggacacaaaggatgatacttcgtggtcagaaagacttgtgtttaaaaaaaaattcaagagagatagatcaaaattatactttaagcattagaaaggaggcaatagtaatattcttaatatattagacacagagtcattgaataaagtctcagtgatgcaatagatgttccttctttcaattttatcagtttgcaaaattcatgaggttaataagtattaaaaatctcattactgtaccatatcaaatagggatgtagctcgagggtgtaataaactagttctattgttgaaactccatcaaaaagcaggactgcacttaccagcattataaaaacctctatatctctctgcatacaactttaacaaaaaatattacatatggggtttctgaaaactcacaattcaaatcttgaaactcattgacttcacatataaagttatagcaggtggctattaagagtttgaaagagattcactgtcagcaaagtgctattggtctagttgtagatatactgggaatttacatcaatagccatattttgcttttttttttttttttaaatcttgtataactttgctgaagcaataacggttccaagtattttgcacagtgcaactgttaccccctacttcccatagagattatatatcaatattgatagggtttaatagctgcctactccttctcaggaagaactaggaagcct

SEQ ID NO: 56991 - DNA, 1166 bp, Bovine  19866880540317
agtctgacatgacttagggactagacagagataggtatacaagttcatgctacactttctattagtaaaaaatgcgttattagggattaataccatatatcgatatatagctactcaatcttacatagatattttgacattaacaatgtttatttagtattttataggagtatctcttccattactttattttcaaattgtgaccctaatcagtgaatagtcaattttttaaagaaccagattatttacctattatttaaagacatgtttaatcattgcatttgataatgccattatctcatggtttagaacaagtttttttccccccctttttcctcctctgtttacttgaattcttggtttgattgaattctctactctccttttcctcttttggtttggaacttattgattctatatctggtttttagtgctcatctttatgagttaacatgaatattgacttagaggaagattgagcttagactttgtattggtcaggaggaagataaagatggaaagaattctaatgcatcgccttccatgttagtgccaatattttagttctatattatttagcctcttggtcagatgtatcctgtcaccacttcacatcctctcagcctcgtttgtcttttgccagctgctggtggagaaccagccctgtgtgcactgtgagccactttacacaggagtcccacagcctcccctgtgcctctggcctcccactctattcctcttggagccctcacatatttatcatgggagtatagacagttaataccctgaagagcaaaactttgtccattcccattggtcagatatttacttactggctctgctttctcccttcacccacagacgatctctagatacactgtatgtggcttttgggggaagtctcatgggcttgaacaatcagtcatatgtttattttgggtcttcctcctttcctacttcatttcctctagcacctactcctgctttctagggttatcttaaaaaaaaaaaaaaaaaaatagtatgtaagttccctgccttgggccctggttgttaaagattaagatcctgagacctgagatggagactttgggacatatgagcctgaaaagcctaaaaccctggaatggtaggtactctgtaagccctaccccataaactcaagg

SEQ ID NO: 56992 - DNA, 881 bp, Bovine  19866880666717
aatatgacttgaagtacaataatatttgaaatatataaaaagaatctgatcagttctcctgacaaggtggattatacctcaaagataatgagaggaacatgcttaaatgtcacaggagaagaagctacaccacagatttaaaagctttttaatgctcagaatctgatcaaagtaattatagcttggtaattcagagaatgagagatatttacctctcagagtaaaatgagatatttgaaaaatacaaattccatatgagaaacatttgataatatcaaaatatcttgacatttactaagaaaggaagcttagcacagaacaaatttcctttcagtcagaaatacttgattttatactcattttattgttatgttgtcaaagaatttaaattatactatgaacacatacagggactcactttggattgcagaactttatctcttcattgcaataatagaggcaggaatgagatagagaaggactaagagcataagctgtcaggaacgttgtttcattgagataggctaagggggacagtttatataagtatgttaaaaaaaatccaaaaaaattaattgaaggaagctctttgttcttgtgatagtaaaaaaggaaagatctttttggaggtgaagcctaagactataaaagtacctctatacatcaatattttctatatataattgtttaaaaataaatgatttatttagtgatgagcagagcaaagactaatagagttttggcaagaaaatgcactggtcatagcaaacaccatcttccaacaacacaagagaagactctacacatggacatcaccagatggtcaacagcgaaatcagattgattatattctttgcagccaaagatggagaagctctata

SEQ ID NO: 56993 - DNA, 1333 bp, Bovine  19866880689164
actcagtctatggtgttctcttacagcagctgaactaagagagtacgttttatgaagagggaatttattcttagctataatacttaggacattatcatacatacattcagcatataaaatgtttatatgtacatattttcatgtgtaaatttaatactggattactaaaggaatgtttcccattgattgagtcctctgaattttgagaagcactcttattccttatatttccataaatgctttaacttctcatattttccctccagattcagagtagataagaaccttaaagattcactaacatctttgtctcattctaattcttttaggcatgagtttcctcactgatcaaatgagagcatatagattcacatcagaagagatagggccaagggtgcgagagaaccatgttctcagaggttatttgtattggttattgagaaaaggacagaaatatcccagtacagtgtccactgcagcactcacgcatgactgggcagtgcatatggttttcggcacttggagaatatcagggcatagaagaaatatgcctgctttttattcctacttaagtaagaacaaagtctgagtaagaatttggctcctatacaaaaaagttaatacaaagattgcttctcttcaatagatttacttgacttaatttcttatggatcttcgtatttgtagatttaagagctgaggcaaaaacttacctggttgccagagaactcccagagcataatcagctctcaacatattgcttctgtcaaaggaaaagagacacaaaaagtgacaaacgcagatacaaatgcagtctggatgaaacatagcatgcttttcataaaatggaaaggacatctgctagttgcctacttgtatatgcttccctttacttcagtgtttcgagtacaagacagattggggacctgtaggaaatggggttcagggtataagaacccctcctggctgtcctaaatacagttactggctaatgtggatagaggcagggaccaccctctatttcatctttccattgtctgccagggtggcatgtaatctattccaggcatctgcaactggaagcaaaacatgccaattatttttattgatctaaagccttcataggtgggacaccttgccagggcagcatatggaaatttagataaggaaatgattgcagaggcatggaaagggcttcgctatttggaaaagaatgtgtaggccttaaaaaaatgaacaagcacttggtattccagagcttaagatgagccaaagatgaattatgcagttgctgcaatcgaaattgattactaagccttcgatgagtcacatg

SEQ ID NO: 56994 - DNA, 854 bp, Bovine  19866880719492
gggttgcttgaggaaactgggtatggtggacagaagcaaactatttagaatgtacttttacagtggcttctttctactactttctttcttctgggtacttgaagctggctattcttttcaggaattataacaaaatacttttattttctgtgtgtatttttgctgattcactaacagttttcatgaaaactgcatattcccaaagactttctttcttccctgtacacttaacaatattttcatcattcaaaaatagatctcaatatcacctcctctatgaagatcttctggaatcttctccaatattccattaagtcactgtcctactaggcttccataatatttcatatccatctccaccaatgctaactcactattttttgcatataaaactgtctcctttcatggactggaagaccctagaggggaagaaccactagagcagttacctcctttatactggctagacaaacagaagtgaatagaccatacaattcattagttcattgcaaaaatattagttatttttttttgcatttatgttattattttgtatttatgttcttacttctcccttaaattgggctttctctccataggccctgttgcctctgttgcacgtggtttatcacatgtatcaagagattagaacattaagcatgtgacaaatatcaacagtgacctgggggatttattataatctaccaatatgctcaaccttgtaattgctcagggctttttgctccataattatttggttgcctcagtgtagccattcaatgatgttataattagtgggtaattaactaaagcatttaccgaggtgctgtagagcataaacatgtgtgcaagct

SEQ ID NO: 56995 - DNA, 1466 bp, Bovine  19866880785313
tttgaaaaatgtggtaccagattctaagtctttctctttcacagttcacttcttatctttggtggtatctagaatcttccagcaaatgaaaatatcagggttcttttttttttggtgacattggcatttaaaatacccatcttctgccccgatatttgattgatattttgtctcaatgtagatttgagatcatatgatctcaaataataataatcatagatcatattataggtgctttttggagctcaatgtaagcttagggagggcagttttctgtattatttccaaatacttggcagataatagtgagagaatcaataaagatatccccatatagggctaagacaggttcaccaatgacatcccaacatgaataagggattttatttttttaatgacttgaaaatatgacgaattgtttggaaaagtatatcaaattatctgaaactacagtgcaaaatagattaaaatgcttacatgttagcaagtagaaatgaaaaattggtgaaaaatttatagttttgaactaaattataccatttaattataacagtgtctctcatcttttaaattaataagatattgcttctgtttttaatgatgtcaatactgtagtcagcttggactcagttggtaagctagtttatcataacttgaaagtcatcctatatttatagtatattaaatgcatgaaccaataattctgaggctggaataatgcatcaatccataatgagaactgcttttaatttagccattgataagtaaaagataattcaatattcatcttctaggaaagttattttaataatgatcccagttgtcctttctcaataataaagtcaaccactcaagcaaacttgccatgttctaatctcagtgaaaatgagcgtgtctaagtccttttagatcagcactaatgaggctggcctctgagacttgagtccttcatgagtcccatggactcatgctatattccattccaagacaaatttcatgcagctgcaagtatgagaattaaatgggaggtctataaatgcaaacttaccattattacaataagtaattcaaatcagcagcagtagcagtttttatagcaagggcaagaatattatatgctcattccattaacttttattccgtatcttgaattcatacattctcaagttgggagtatcctaaatttatggatcttagcctcccttaacctctgacttatgcataaagttcctcagttttgaaaacagctattatcttcagtctccattatacataggaacagtcttcacccctctttttttaatatcctcttttcttcattcttcatatgatactggttttcagtctttctcagagtatgttaagtaaagctgtatacaaccctttagaaatggtctgactagctgaacaaacaagggtattaacatgctcaccctatataattagtctaccaacacatccaaaag

SEQ ID NO: 56996 - DNA, 1030 bp, Bovine  19866880803598
ttaaaaatagagacttttcacatgaaaaatctaggcaagaatactggagtgggttgccatgccctttgccaggggatcttccccacccaggtattgaacctgagtctcctgcattgcaggcaaattctttaccatcttaagtaccagggaagccatggtgaaggcaaaaccagaactctccacactggagccaccctccccaggagtgcttagtagcgtctgttactccctcagagggagcgagtcacctcctgcccccagctcagctgctaacgctgaacacttctacctggtcctacaggcactgtatttgtgacctgtagtgtagaagaatggacttaatcagtcagcatctgagtacccactatgtgtcacatactccaggataaaggcttttctttttcttacacaaaatctgtgaactatacattgtcttctttatagggaactcagaggttggccaagactggggcttgacttggctgaggcactagatccgaattccatccaactctatgttctcgaagcttccccagtttctcattcttgtaggaactgcagtaattctggcttagtttcatacttcttagatttgagagaaggaactttctggggcacctgtgtgaagtattttgcattccattaaggcttcatcatctgcattaagagaatttaaaaatcagtaaatttggggagggctttagtctaattaggttcaagtgtcaaagcagaagtttttggggcaattgaaggcagatttgcaatcctgtcaagtagatgcagtcagatatgtaacctgaacatttcaaggacagttaataatggcttctcagggaactgaatgggaagaacatttgtttgatgtagttaattttctgagcagtttttttttgtaacacaaattgctaagtgcacctctggtgaagtgaggcctcatgctcacaactcagtagtggtcacttcagctcctgaatgtctagagtccggccttttggtagggttttcaactggtgttataaaatttatcaga

SEQ ID NO: 56997 - DNA, 1534 bp, Bovine  19866880862744
ttttcctgtcctttttttagtagttaccccaggtattttaacatgcatgctttaaaaaattaaatgttgatcagtatctttctatttgttccccaaaacaaagactctagtgcttcagatctaatcaaacttctcgaattatatgttattattgtccagtatttggcttgtattttttaacttgacaaaataaatgctattgttttatacagtcgatatttgtttagatttacctacatttttatggaaatctttctgggtaattcctttctgcatgtgagactttccactttggattacttttacctgaatctgttggtggtaaattctgttatcttggttttttgtagcatgcatttgttattctttccctcttcccttgaaagatcatttcaccatgtatttcattgttggttgacaattattttcactcagcactttaaagataccgttcattgtcttctagttttcattgttgtacaaaaattactccattagcttatttgagatgtcttatagaaagtcttggctctctacttgtcttgcaagtctttcccttgcctttgatgctttgtagtttcactaagatttacatctataagagaatttcttttaatttttgcctaggatctttttggcggagaaggcaatggcaccccactccagtacttttgcctagaaaatcccatggacggaggaacctggtaggctgcagtccatggggttgctaagggtaggacacgactgagtgacttcactttcacttttcactttcatgcattggagaaggaaatggcaacccactccagtgttcttgcctggagaatccaagagatggaggagcctggtgggctgccgtctctggggtcgcacagagtcagacacgactgaagcgacttagcagcagcagcagcagcaggatctttttggatttccaaatctgaaaatcagttgtgtttttttttaattttaagttctggaaacttttaaccattatctcctaaacgattgcttcttccacattctctttattctatcctcctgaaactccagttagagaagttagaacttctctctcctccacgtctcttaatccctttctacctttatttctatactaaagagtaaatcctttacaacctgcagtagcgttacaaaaaaatccacttctggttaaatataattggaattataaagctccagaaagggaattggaagtaaccaaatcttgttctatcacaatgcgaaagctcgatcttcagtcagacttgagcaaggtcattagctatcttgctctcaggcccaccctggaacctcactggaaaaggcacactcatgctaaagttgggtttcccaggtggtgctagtggtaaagaacccgcctgccggtgcaagagacacgagagatgcgggttccatccctgggttgggaagatctcctggaggaggaaatggcaacccattccggtattcttccctgggaaatctcatggaccaagaagcctggcaggctacagtccacgggggtcacaag

SEQ ID NO: 56998 - DNA, 1924 bp, Bovine  19866881011987
atgatagtgtgcctgataaaaggggccggatactcccaagtcaatcagctcttcacttaaatctctggagtgtgaaaactggacaagaaagatgtcgacttgagggcgttctcctgagatacatgacttaacatccttgcagaggcttccacacccaacaaatggtgtgaccttgcgactatgatgagtcctagaaatataaaacaaataatgatccatgctggagagattgaaatgatagaatttctatggaagatagaggagaaatagaataaaaggctgagtcaagtgagcatcctagaatggttatactatattcatttataagattttccagatgattactttccacaggacagcccatcacaaataccatttactaaggccagaaagaatgtgctattgggaagggggctacttagctaaattgctaagtagcagcattactctatagaggagagatgatatttggaaaattatggtatatggacagaagtcaagccaaagtgtcacaattatcatagtgagtgccaagattggagtggcagtcaagggaagctaactcacaaaaatgtatgaagatagttaatggaacatggcaatcctagagcaaaataggtgggcagccaacaaggatactattcaacttgtaccaacaaaggaatgcaatgatgaatgacaaggagtctgagggaaggcatcccatcaaagggtcacaatccatttacagtttctagtcctgagccagttttcagactcaaaccccatttattgaagagatgaccaggtctccaggatcctgcaaagccatagcaagtatccatggtgatgattcctttgtccaaaaggatttgggaccatttactcagggaaactacatactgaggaaaaaagaattcccagtcttttgacgagtgttaaagaaagggaatcaattgatgaattgatgatgaaattgatgaattgatgatgaaattgattgttaaagaaagggagtcaattgatgaattgatgaattgatgatgaaacttggaaactcaaaatatgataatggccccctgttcacattgagccatatgaaaaccaaataataaatgaaatcctgacttgagtccaggtttcaatgggtcagctggatctgcagacctatatattggtcctttctccatttccataaagtatgattgggattagcatgtttgaaaatggtgcaactccaattttggggtcatggctcttcccactataaactgaatcctataggctaggtggaagcttctaaaactgcccttaccaatgtccaaagcagtaaataaaaaacaatatcacgtcttggggagggagatagtggctattagtgtacctttaaagatttcaaggatgcaaggatggtaattcccatttatcccatctagtccctaccaaaaccagacagactttgggataactataggactaccaaaacctcaaccaagtaatagctccagtcacagccatgtacactctcagtgactcactgggagctcttaatttatgcttctttttttctgcagttcctggcaaagtcacagcatagaagggtactggggcccaaagagctaacattttcacagaggacacaccaagaatcctaaattgtaaactgactcatgggcacttgagcctcttgcatcaagggtctagcaagcaaagaagagtcagaatcctgacagagagaactgaccttgatcatcaggaggaggtaagactactcttacacaagcaactctcttaggcactttttgggatttagttgcccaactgactctatgaatggacaaatatacaagcctagcctgaaaagtggagaaggcaatggcaccccactccagtactcttgcctggaaaatcccatgggcagaggagcccagtgggctgcagtcca

SEQ ID NO: 56999 - DNA, 2581 bp, Bovine  19866881041249
tttattattaatggtttctgaggagcgtctcctgagagggtaataagtacactctgtctaaagtatctgtcttcactaagtacatactgggcttccctggtggctcagatggtaaagagtctgcttgcaatgcgggacacctgggttcgatccctgggttgggaagatcccctggaggagggcatgacaacacaactcagtattcttgcctggagaatctcatggacagaggagccttgtgagcctgcagtccatggggttgcaaagagtcggacacaactgagcgactaagcatgcacgcaattatatattaatataaaagacgcacgctccttggaagaaaagctatgataaacctagacagtgtattacaaaacagagacatcagtatagtaatcatgtacagatgtgagagtcggaccataaagaagcctgagcaccgaagaattgatgcttttgagttgtggtgcctgagaagactcttgagagtccctttgatagagagcagatctaaccaatcaatcttaaaggaaatcaaacatgaatactcaatgaaggactgatgctaaagctgaagctctaataatttggccacctgatgcaaagaaccaactcattggaaaagaccctgacgctgggaaagaatgaaggcaggaggaaaagtgggtgacagaggataagatggttggatggaatcaccaattcaacgacatgagtttgagcacactctgggagattgtgaaggacaaggaagcctggtgtgctgtagtacatggggttgcaaagaattagacacaactcggcaactgaatagcaacaacaaattacatattttatcattaatgtttcttaggtcaaagataccctttaacaatggcccaacattttgacctcataaaatttgcaattgcaaaaaatacgtaccaaccccccaactgattcccatgtatctctaatactatgagttgatatgcaagatttttttttaaagaaaacatattatttccccacaaaaagagattatgtaactatactcaaacacctaccagtatcctggcccttaggatattgtacttctgatggaggcaatttgtcctggaaaaacacctacataaatgtgtgggtatatgtactttctcacagatacagtactagagtcacaaaagttactcttctagctcttctgcagtgttttgtagtgaaaatagcatgagttttggagtcacacttgatcaagttacatatcttctcagagtccctgttcatcgtgtgtactatttaatacaggggaattgccaggtatttaattatgaagatatatgtgagataagaagcacagaactattcagtatttaatctcctccaagttccccctcccatttcaaaaagacagtaaacttctgagcagggataaagtggtgcccttcccttgcctgttcccttccactcaacacacaacccacatgcacctggtactcagaaaatattactgactgaattcattagcattcagtggaaagccagaccctaaggaaccatatcaaataaatatttgcaatactatcacctctattgtaatcatctctagatgaacttcccagtcccaggtcttatctccaagaagaagatgccttgtctgaacacacaggggtttgaacagaaccaccacttgagtgtttgcctctttaattctaacatgagtagggcaaccctgtgtacttttaaaccttccatttaccctgcccctgaagcaaatgatttgagtgtgtaaccaactgctagtccctttattgagtttctctgtggcttatcttaattatagtaccacagaactgaatttgccaggcacagtgcaatcttttacatctgtttagattatgattaaagtataataatattttcttcatgaacaggttttgattgttggagtctgaaaatatcttttgcatcactaattcagattagcattctgatgctggccacataaaatctaaagttctgaatttgtgagctctgggctactgatgattccttgctatgtacaaaaccctgagacttcaacattatttgtttataggtgtatgaagacaaagttaagtcaggattcttggcaagagtctgttactttaacatgagaacaagccccctagcctggcagagaaccatgcaatattaaaaactcagccaacggggaggagttatgaacttaagtgctctttaatagactacatttgccaaacacatacatctcaacttaatattttatttatgaattaattttaattagcataacaataaaagagtgcttgaaagtcttttggaataaatttgacttttgaatgttattactgtcctctctttaggcacatcaaaatctttttttcaagaatgaaagtacttagtattaaattttacacttggactttttcatcttgtttttgtatcaggtataatactataaagataatcttttaaaattaagtggaaacgttatcttactaacttgtttctcattttgtatcagcttgttcactatgataattttaccataagaatctgggccagactcattaggactttt

SEQ ID NO: 57000 - DNA, 863 bp, Bovine  19866881043778
gcatcctctattcagcaaaggtaatttaattaaatactgttcctaaaatataatattgattactgaatattgtcttttaaattttagaaaactcccatgaagtcatgatgatattgtgagccacgtaatacagttgactgtaatcaggtcaatgcaatattgccaataagtatgacaaatggagccatcaacctagtgaacaaacttacatccttcatacataaagctgtagccaccatgtctacattatcagaagtatatctttgttttgttttccagcaggggagatggctttgtgctctttcattgtgactagaaccagtttttgtcaaaaggattgctggtattgcaatgcagtcttgctaaatagcaaattcccactgtgttgcagtcatcttcactgcttatcaaggcatgagacatcctttcctttaaattagacatcttacatatgaaagacatctgtatgcatccattctgttaaaagtatcttcttccatccctatatttgcaaagcaactcattatttattttattccatctctcatcacagtttgcctcatatttgggttaacatatgtatctccttaattatgtgcttttgaaaatctactcctatgtcttactcaactttgtaacacccacagaatgaatcagtgcttatacattgtaaataatataaaattagtcatttaattaaaaaaataaaataattaactgataatattgatatccctttaaaagaagggattaaagcacttggaactttgaggaccttaagtcaagagattctatttatttacataaaaagcccagtacaacttgctaaatatatctagattcataaaaatatagttattttt

SEQ ID NO: 57001 - DNA, 1540 bp, Bovine  19866881169149
gataaagaaactttctattatagactggcaggctacagtccatgggctcttaaagagttggacacgactgagactaagcatgcacttgtgagaagaatcaccttgttccgtggatgtgggtagctgggatgttactcactgctatggggcctgtccctatactggggagaatattactattatgtaattgctactttttaccaaagaacatgaaaagggattaaagattaataatgttgaagatttatagttgaggagtgcttataaataaatgaaatggatttaaaacaaatcaaaacatattattttgtatatgaggagcagcttcttaaatcatacttttgctgatctcccaaagggacatgcatactgtcaactttattacagtaaacagtaccattatttactgtttgcagaatttctatactgcacctttccagtaataagtgtaagtggacaagctacccccctttctgggattcagtcattgccttgtaaagagaaggcttatatatgaagataactgaggccccagccaactctgaccttttaagattagtacaccagctagtcactctggtctagaaacttgtgcaagctctgcaacctgagcagccagcagtcagagcagatttttacagtcagatctacccattcatgcaccttacaatcggcactctaaattactgacacacttgataagctgtgtcaataaattttttgtacgtgtgtgtgagaatgaagtgtggcccatagatatctctttttcccgtcacctctggcaccttcttggtctgataaaccaagatcttggtctgacaaactgtgaattcctctgtgaaaccttcctagctttctcagaattagttgtccctttatgtcccttcataatattttgttggtgtttctaatattgtatctttcaatgattcattgtattgatttttttttttttttagtatatctgtcttcctgctagactttaagcatcttaaaaagagagtgatcttttcttaatacttgtattcaacacattgccttggtttatagccaatacacaaatactggttggataatgaatgagtattctttttatattcaatttaacttatgccttttaggaagatgcataggtcagaaatggtcagagacactttaggaagtctagaagtcggttctcctgcttagatactaaaatttgcttatattcttttggaagtaacatcaaggaaaggttattagacataatatagaagttttcattctttactcttacaataagactcactgaattgtgcctagatttactttttcccaattattttattttttacagtttgcaaattgtctatatataattactttcaattaacttccctcagccaatcaacagaccataaactcagcttaagcatttatgaacagagctttgtgatgagaatctatccttacattaattgttggttcagtaaaagttagggctcaggaaatgatagtagctatatttgagttcctcatttatggttgcattaatatgttt

SEQ ID NO: 57002 - DNA, 1108 bp, Bovine  19866881265520
tggttcacatattgctgaagcctggcttggagaattttgagcattactttactagcatgtgagatgagtgcaattgtgcagtagtttgagcattctttggcattgcctttctttgggattggaatgaaaactgaccttttccagtcctgtggccactgttgagttttccaaatttgctggcatattgagtgtagcactttcacagtgtcatctttcaggatttgaaatagctcaactggaattctatcacctccactagctttgttcgtagtgatgctttctaaggccgacttgacttcacattccaggatacgtggctctaggtgagtgagctgacttttacagattagcaaaattttcaaacttcctatattttaacccaaagagcttgtgatgtatcatagggtctgttgcagcctagccaaagatttctcagagctgcaattcagtctgaggttcttccttctgaagtctctttctttccctctctcctttcatagatgtcagacttggatcatagtctgaaggctcccctttcccacttctgctttctctcctctttattcttcacaagtgttttccctaataaatttcttctacatacaaggacccaaactaacataagactcaacagctaaatgcattctcttggatttctttccttctaatatatgagtgatttgataaagtgtgtactgtcccaattgtaatttaatgcactgaaataacagttcttatttcaacatttttatttaataatcacagtttcaaaaattgtaatgatgttacagtgatcactcataatgtacgttctaacctgagttatttgtatgttaaagatgagtatcctatcaccccgtgacttgtcactgcagcagagaatgtacattctttacgttaatgatccattttgagaaacactgctgtaaaactgaatgttcatttgatctgggagtgttcaaaacaatatttaagattatcctctgtatatcaaactaacagtgcttatatttaaaaagcagaattatgggtaagggtagacatttttcagattgaaagccttgagagaatacacaaagagttttcttagatctacaaggaccctaga

SEQ ID NO: 57003 - DNA, 1457 bp, Bovine  19866881344256
tattctaaacagacttctggaaagtcccatggatcctataagaatttatgattatctgtttcaggaaatgaatattccatcccttaatttctaaccttgtgcagttaggctgatgctacaaaggaatgtaaaacaaaagtaacctgtctcctcctttaaaatgaaccagtactagttgtcagaaagtttttaggagctcagtattacaggtggcaaaacaggtaggaaaagtagtcacttttgcagttaaaatttgctgagatagtgaaggaggaggcattggaaataagaggttttctcagaggctggggaaagagaaggcaggtctccattagccactggaaaaactttttgtgtacaagtgaaagtgaaagtcactcagtcgtgtctgactctttgcgaccccatggacttagtctatggaattcgccaggccaaaatactagagtgggtagcctttcccttctccagaagatctttccaacccagggatcagacccaggtctcccacattgcaggctgattctttaccagctgagctacaagggaaggcaggtacaccaaagcttggagaatcatggctcttgtctttcaacttttaaaaaattgtatttatttttaactgaaggataattgctttatagtattgtgttggtttctaccaaacagcaacatgatctttcaactttttatgaaaataaaattttcactactcatagcttttcatttagtactatatgacaagtcctctaatgatacgacagtgagcaagctggaagttcctgaggcaggggtgtggtgctgcaggaagataaaccccaagaaaaccagcaggggactgagagactggagcttcaaggcagccagaacagcagaggtgctccttcggttgagttcctgtaggagaaatcatgaaagtacattttctaccctacttctgggccaagttcatcatggtctgatcaactcctttcctgctgtgtgagaactccaattccttttcctttcttttgaaaagaagtcacacctcaattttgcaagtcagaagcaaaccaatctattgtaaccagaaaggaataaaggattgtggttaaagaaagtagtggggagggcaagcaccttggcagaagatgagaattctggtcctcaggattaagtaatgatggccatcccttcacaacagcacatatagaccactcttctgttttacttgatgatccctttctcagggctgtttcttcttatgtaaatattaagcctactgcttcttctggggaaagctaagaagagtgaatactaggaatttcaggttacatcatgtgtttctctaagcatgaatactgtagtgagttgccattcccttctccaggggaccttcccgacccatggatcgaacccaagtcttatgcattacagacagattctttgcctctttagctagattcacattacttagg

SEQ ID NO: 57004 - DNA, 1441 bp, Bovine  19866881386378
caggaaacatcagaatagaagctataatgcacaagatgctattttactattaactcagacctttcttttgccagatggtgttggaagaaagcttttgttttcttgttgatgggcatctcctttgaattttgctagccagatatgtttcctctcttctcagcattcacagacactgtagctttcttttaagtacctcttacatgcagtaaccggtgtggcatttccaggcattgtatgcccttccgattggtttctgggagaggaatttatgcttcttgatgtattgattttaatcttcaaaaatttggataaccatgcatcctaccagcataccctgttatagcactcgccacattaaaatgtcatttgcctaatttcctgtctctctgaaatccatactactgcactttcagttactcaagaactctttctgatttatctttctattctagtctggcatatggtagattctcactaaacactttcttgagtacatgaacaaatgaagaccagaaattcaaatctactttgatatttaaaggaagtctttatacttcctggaatcacatgggacagaaggaacatttactataaatagatgcctatgctgtgtctggagcatagcacatgttacctcatttaatctgttcaagcaattcatgagatattcccttatttgctgccatttgttggatatttgtctgtttgatatatataatgttctgtcttttaaaacactttattatttaatatttttaatgatattttgaagaagttattactattcccatttttaaaagaaggaagttgagacttaaagagaatatgaaatatttgaatccaaatctacctaactctaaaacccaaatatttcctacttgaccatcatgacttggaagacaaaatgtttgggacaaataggttatttattttatttttccactttattttctctctaatattggtatataccacccctaatggtatatcttatgttaactcccttctagacaaaagatcttactattaactaaaaaatatagagaaacctcactggccatcttataggttgctaggcaaatgttaagtcaataaatatattcctttgactaacaatccttggtttgatcagttgtaaccagattcttaaagtcacattccaaaaaacttggctacttttgcatagcaatctgccttggcagcttttcccagaagggacctgtaggtctggcaattgctcagaatttcatgagtagtccagtcacaaatagaagatgctcccaaaggtaattatgagactttcatcagtacagtaattttaagcacggctttactaaagtagcatcaaattctaattggatccactaggcttaatttaaggagccatagaggactaattctaatgtactgttacatccagtatatcagcacaatattatat

SEQ ID NO: 57005 - DNA, 1402 bp, Bovine  19866881593848
accacctggacctagcagtgcgtgtgatggttaaagacgtctagtttaggtcctggctaactgtgtgatcttaggcaactcccttaacaactctgacaaatagtttaactagaaataaagatattaaaccagatgacctttcagttctcttctaaatctaaatgttctgagccatgtaacagtatatgttaggttcccctagaaccgccacttcccataaatctctctggtgatggaaatattctgtatctgtgctatgcaatgtggtgaccactagtcacttgtggctatcaagcagttagaatgggatactgttattgaggaactaaatttttttactttaaataacctcatgtggtcaatggctactatactggaaagcacagctctagagataagcatgggtagagaataattatttccttactaatgtgtaatcaagcagttacaccattttgtttttcacagagttgttccaaggactaaataagagccaccagggaagcctaagaatacatgtggagaacttcaaatattagtccatagtaagcacaaaataaatgttacctcttctggtaacactcattttatgcagctgagttttgtcaaattttattaagtaaccatatttttgtagtttgataaacaataggtttatgaaactaagcaattatctccttttgtacatgggaaaaggaaaaatgcagagacagtagtagaaaaggttaagcagtacctgggaattcaatatatatggcagcataatcccaaaaatcagacctagattctctccccttttacagaatactttccattcacaataggtttctttttttttttttttctttcagctccatttcctctgagccctgaaagggtctcaacctccgtttctgtagctgaggagttttacaaccactgcataccactcattttacctcttgttaggtgcccttccgagcaagataagatggctaattacatataccattaaccgaatgcaattccaactaattgacaaaaagcattatacagtagcagtttttgaagaacaaagttgtatgaaataacaaggtcataattccaaagtctgaccccaggaacaaaaaaattctaaacatttattgtcttactgtgaattctaagacctgtgcctttcacatggtgtcccatagctatgagaacttcattcatcttttaaccaaaatgcactgagtgtgggttacctattagttctgctaggcatcataaataaatgtgtgcaagatatagtccctgaccctcaggaagcttgcactgtcccttccacatatagtgctccagtcattctcctttgcccgaggataattatctgtcctgtacagcccatcatgcactcctacacagcctgctgtctccagct

SEQ ID NO: 57006 - DNA, 1007 bp, Bovine  19866881612328
aaattcatttttaagggatgcattttaaaataaaggaacatttgaaataccacaaatctgtatcatgttcctattaagccaataggcttaaaaatgttacttgactacaccaagatttaattcccaaatatgaatattctattaagaaaatgctcatattatgttagacacataacatgcattgcaattacaaaataaacaattctgcaatactgtcagctgtctaaaattcaaaccagcaagtcaaggaaacaatctgttcacacatcgtaatgtatttaatcacattaaaatgaatattgatgattttgatagttaagctgatggtgatatttattttttccatttcttcattaatgccatacttgtgcagtattagacaataatttgtcaaggtgctagaacacattttattgaaaagagtgtaaatgtctttgtcaattataagaaccatctgtattataaaactgttcttcacataactcagagaaacttttcaaagctgttgttcagtaacttcttaagtgtaaatttcataagttttaggtaatggtcatgttctactttgcattatttgaaagaaaaagtctataaattgatcatgaaacaaaaaggtattttacaaaatgaaatgtaattagcaggctgttcagtccatatttgtctttacatttgaagaacaggacaagtgatcaaaagaaaacttcagtcatcacttaaaattgccagtgtcaacccagaatgacattttatgggactaaataatactttgtgatgctctatgtgtgctttcatgtctccagcttatctataccagacacagagatcaataaatcaaacttcaaagtaaaaattttatatcatctcccttcctgagtccccatctatctctgcttcccctccagttcttctcaaaaagaccagaaaagtggagaaggggactgaaggtcttggcagagtgtaagaggtttcagctagaaaaatgtttaaaattcttgagtgtgtta

SEQ ID NO: 57007 - DNA, 727 bp, Bovine  19866881825684
cgattctttaccactgagctccgggaagtacttagggttagggtaagcaaaattgctcaagatgatagaggatagagaggagaaagactaaagtcaaccaggagccatcatcttttccccctgtttcctcacaaagcacttgccctctttaaaaaacacacaaaccacacacacacacattttatattgaggtatagcaaattaacaaacaatgttgtgacagtttcaggggaacagtaaagggacccagccataaatatacatgtatccattctcccccagatttccttcccatccaggttgccacacaacattaagcagagttccttgtgctatatagtacatccttgtatctcaataaatgctgttcaaaatagcaaagaatatttgtttgataaaattccaaattattacactttccaggatgctcctatgtttgaacctggccctgaccatatactttcctgaggctggctgtcaccttgtcctgttacctaaatcccctgctacttctgtgcttgtttatcctttatgaactcaatattctagagggagggaaggtaggaatggagacacaggaaattttaaaaaaaagaaatacttaaaatgtttctctcaacaaatttagtgagagtggagaaggaaataaatcaagtctttggaagctctatgtcttgatttggcatgtccaggctttattttcctagcagtagaattctattatata

SEQ ID NO: 57008 - DNA, 1208 bp, Bovine  19866881886497
ctgatctgatcaaggttcttaagcaagagcatttgcaaaaaaaaaaaaaataatttaaaaaattaagcaagtaaagaataacatgtgatgttcatttattcattaaaatgtcaggatgacccctgataagagcttgacatattttaattttggctagtattcatataggtaccaatgattttaaagacagaattacagagaagggacttgtatcagtgatttggggagaatgtgttgctgccaatctatattaagaatggatgatttttattgactatttaaatatgagctatcactacagccacattatgaaacaattattaggataaacatagcaggtagacacatccttattatgttttatagactaagataccataatttaaaccgttaaaagcaacttgcctcaggccaaaagtttaatatgcagacagacagggcttagagacaggtctgtctgatactgacacgtatgctttttattattctgaaatattacttctgtatttaagattacaaaacattttccacatgcgatctcatgtcatagcattaaaacattaataaattcacatacaaagaaagtctaaatgatgtgcaaattcatgaacagcctatcagaattttttaaaccacattttgttaattatcaggtatttgttcatatgtgtgtagtagggatcaaagcactaatgttgggaaagatatcagcggaataagtgaggggcaacaaagtaaaaatgggcaatgcaggaggtcaccttagagttgttaaaataaaaagcaaaaattcagttccacaaaaattagcctccaaagatcctattatcacatcgggccattctttactttgtgtactgaaatcattggtgactatatcctttaagaagttacatcaagatcttaaaagcttgttattatttcgaaaatcttctttggtgagaatagaatataaatatatttgttaaaaaatattttcttaaaatagcataaattcacatatcactaatttagactatcattccctcaaaaactgtgagctaaatgaacctttatcttattcctgagtagagtgtgactctaaacttctttggcatagcaagccactattgaaccacactaaaagtaaaaataaaaccacttaggcttttagaaaatagactgtaagagcctcaaaggacacagtactggcgctgctgtcaataatg

SEQ ID NO: 57009 - DNA, 946 bp, Bovine  19866882147588
aaaagagagtaagaatgataagacagaaataaggatggagggggaagagaagaaatcagttcatcctgctttaaagatttcttttaacatttaatttccttcttacctgcaggcagttttctaaaggtgcacatttaacttctaggttaaatatgaaacttgaaaccataggcgctgtggcataaattaaataaggggagaatagagagtgatttgtttttctcctggaataaaaccccagtactcctccagggttgtgtgaaaggctgaggaatctgtggtataaatactttaattagctgacagcttgtgggatgaattacatctgatctctgttcatgatgcttgtataataaaggacttaattgtttcattttttacagtataatggatggatggaagaggatgataatttgagaatttattcatttaaagcagtgattgcaatattgttctgaaaagtagaatataacatgtagaaggttatagagaaagtaagtaggcgtcttcagcttctggagactgcacctttgccctctggctggttgggtagctgaccatcaaatagctctataacttttgtcttttgccatcaagaatcggagaaggcaatggcaccccactccagtactcttgcctggaaaatcccatggacggaggagcctggtagattgcagtccatggggtcgctaagagtcagacatgattcagtgacttcactttcacttttcactttcatgcattggagaaggaaatggcaacccactccagtgttcttgcctggagaaacccagggatggtggagcctggtgagctgccgtctttggggtcgcacggagtcagacatgactgaagcgacttagcagcagcagcagccatcaagaatgtaacagccccttaaaaaaaaagttgtttattgtaatggaggataactgtgttacaatat

SEQ ID NO: 57010 - DNA, 2879 bp, Bovine  19866880111532
ttgggggcttcaaatcactgcagatggtgactgaggccatgatattaaaagacgcttactccttggaaggaaagttatgaccaacctagatagcatattcaaaagcagagacatacttgccaacaaaggtctgtctagtcaaggctatggtttttcctgtggtcatgtatggatgtgagagttggactgtgaagaaagctgagtgccgaagaattgatgcttttgaactgtggtgttggagaagactcttgagagtcccttggactgcaaggagatccaagcagtccattctgaaggagatcagccctgggatttctttggaaggaatgatgctaaagctgaaactccagtactttggccacctcatgtgaagagttgactcattggaaaagactctgatgctgggagggattgggggcaggaggagaaggggatgacagagaatgagatggctggatggcatcactgactcgatggacgtgagtctgagggaactccaggagttggtgattacagggaggcctggcgtgctgcgattcatggggtcgcaaagagtcggacacgactgagcgactgaactgaactgatcctaagtactaatgctgtcaataagcaggaaaacctttgtctcaatttggacaaatactattgctcttaagttacttaggttcctctggtgcaattttaaatgctgttcaataaataggtttcttctcacctaaaggtcataatttgcatttgaaatatagtaatgaatttctcaataatggactaggcaccagaaattttacattcttaagattgaaatctatgtttaaagtccatgtgtaatcaagagacacttaaaatgggcatgatttaaagaatatcaatcagtatatgtaagaaagacaaataccaaatacgtttgagactaagatcagagggctattatttacattagttactgggcacattgaaagtattcagaacttacgttaacatgtagagcattactttcttagagacacctaattagtgaattttggtgctactgtaagaaaattatctgcttctattttctatacctataaaacagatgctatctaaatttataagatagatttgttcctagtctatttatctttgcagagaataacagtttactaattatttaggaaaggcctgctgaacaagattttaatgaaagttattagaaagacatgagggtaaaagacattcttaccattgaaaagttatttagaaattttcaagttcaagactagttttattttgaaaattcatacaacattatttattcatacaacacacaacaatgtatcaggcactgcaacaaagtgagaatcgaaggatttaaataaatcttagtggatgaaccagaatggaccctgggtctctgagctgtttattcagtgttattttcactttaccaagatgacatttcagaaaatctttttttctggaatcaccaatgtttcaacactctggaaaccataatattgcatattttaaaataatattttgtgtaagtggttgaaagtaactatttcataaaagggaaaaaagtatttgaggattgaaacattttagggaaatgctttaggattccaaagaagaaattaaacagagaaaagtccctttcatattcaccgatgaggagctgaaagtaaaagttcgaaaatatgagaaaagccttgggactcatttgggtacatttgcctgtatttccaaaaggtaaaccacataactcaaaagaatgtttttggccagtttaatagccttaggagaataatttgtggtgacaccatacaacttccttttatattcatgctcctaatattgatttacctattggtctctctcctgaccgacttttccaatatctctgagaatgtcagcagtcaactttatctgtagagtaacaatatattttaggtctagatttgtattcccaactactcctagtgactttacctagatgtttattgggaaatgtagaaacattattaaaaaattaactttttcctcaaaaaatgtgccctccctttctgtcttctgttctggtaaatgctatcattactcattctgctgtgtggctaccacccaagcatcaacaataacatcttttttttctcactctacacggcaaagtttttcaaatcctcttgatttcatccccaaaataaatctagcatttgtcctttgttttcctgtgcttagttgctcagttgtgtccaactctttgcaacctcatggactatatagcctgccaggctcctctatccacggaattatccaagcaagaatactggagagagttgccatgccctcctgtaggggatcttcccaacccagggatcaaaccctggtctcccacattgcaggtggattctttaccatttgagccaccagggaagcctttgttttccagtccctctctttctcagattaggtttttatggccatatgtggactgttgcaattactcgcctagccagctacctgcctccgacatactacgatctgattataccacctccctactcaaaacctttggaagctcccttcatccttggtataatgccaaagttccttcttagcatagcatccggggaccttcacaatctgaatcagcacatacttccgtctcttctatactacccgctccatgcactctccactccagtcacatgggaccctttattctttgcatacaagtttgcatttgtccatataactttgctgtctcttaatttgttctttctgccttccttacccatctttatttttttaatttgttttttaattgaaggataattgctttacagaattttgttgttttctgtcaaacttcaacagaatcagccatagctatacat

SEQ ID NO: 57011 - DNA, 4590 bp, Bovine  19866880200959
gttcatctagtcagggctatggtttttcctgtggtcatgtatggatgtgagagttggactgtgaagaaggctgagcgccgaagaattaatgcttttgaactgtggtgttggacaagactcttgagagtcctttggactgcaaggaactctccagtccaagggactctcaaaccaggccattctgaaggagatcagccctgggatttctttggaaggaaggatgctaaagttgaaactccagtactttggccacctcatgcgaagagttgactcattggaaaagactctgatgctgggagggattgggggcaggaggagaaggggacaacagaggatgagatggctggatggcatcactgactcgatggacgtgagtctcagtgatctccgggagttggtgatggacagggaagcctggcgtgctgcgactcatggggtcgcaaagagtcggacatgactgagcgactgatctgatctgatctgatctgaaaggctgttttcagagtgtgctgaaagaaagcaaacacacactaaactttgagagccactaatatttaaagagtgtacagagaactaaatgaggaatgctcagagaagtgagagataaactaaaaaataagaggattcaagaaagcgaaactaagaaaggatttcaaagatgaagtagtatcaagtgataagaaggtgttaaccttggtgagaacagtttcccgtgttgaggtggaaactgaacagtaacaggctgaagaaagagtgtgaagtgaggaactggagactgttggcagataattctgttaagaagtgtggctgtgaaaaaaaggagaaggaaatggaacagcagctggagaggatgaatggaattttctccctccctcctcgctccttccctctctcccttccttttcttctctctctcttttttaatggaacaaaagagttaaaatagtgctttgtactcagagtttaatattcttgggtgctaagtcgcttcagtcgtgtctgactctgcaaccctatggattgtagtccgccaggctcctctgtctatgagattctctaggcaagaatactagagtgggttgccatcccctcctccagggcatctttccaaaccagagatctaacccccatctcttaggtctcctgcattggtaggcaggctctttaccactagcgccacctgggaaacccttgagatgagttaattttagaggttgactagacccatgctatgacttgtggaagttgaaagatggtaaagatctttgggatacaggaggtcagttgtgtagctcagatgtggaataggatgttttataggtaaggatgaagaatgtaggtcacataacaatattatcattagatggcagggaactgtccaagggttagaagatgagagctgtaggctcaggtaaatggatataaaatcacacagcatgagcttaaaacaagaggggcttcttgaatgaaaataaatgtgtgacaaatagtaagtggcagtagggagccaagaggatgccagcactgccacaagggctgagatgtttatgttgacatatgggagaatgcagagttcctgctagagaagtcagcatgagaagaattgacctccctttgaggctaggttactatttaaacaaaacaaaacagccattcaggacatgtcctgggagaggttaaagacgtaaagatatagaggatttggatttcttgcttctttttcagaatgaagagttccaaagacccatggaaggatctggaatgaaggcagaactggagggaaaggagcagaaggaagatgggccgctagggctagtggtcttatctgtgatatctaagatggagagggggctaaagagttgtaggttagccagaaatgacataggtgggattccatttattaatggaaatttgatttctagtaattttggtagtgccttgaacccaagtttccagttatctgattttatagatagccggctatgtataggctatgtatagatactaagatgatctagcctgccaggaagccatgggatattaaggcctcttgttgcttcttagcctctagcatgtgtcagatgagtccaaactttaggaggaatgaatagttgttacagtcagtggcagtcattatagtaagcatgactaaatgtagtgatcccattattctcacttagccctcagcaggacatattggaatctgagagatgcttatgggaaacctgtggttcatcagtgggattgttgaggaacacttgtttccatctctttcctcataggagttagctgaaattccccagtagcctcataacacagagttagtccctttcagttctaagagggaagaagtagggattttccaggagaaaggagaatccccagtctcagtcccactattcttgataatcacaaacaaagggacaaaattcctgaggtcaccgtatgtattttcatgccttccactagaacttccggagaaggcaatggcaacccactccagtactctttcctggaaaattccgtggacggggtggggagcctggtgggctgccgtctgtggggtcgcacagagtcggacacgactgaagtgagttagcagaagcagcagcagcagcagcatgagtgtatttttataatccatatcctatcatctcagaaactacatctgggtatttgtatcctattgcagttttgtgcattcatttcattcttacctaacagattacgtgtctcttaaaaacagttttgtggacatattttttaaaaaatatgattcagagtatatttaattcttgatttttacttcttattttcccccaatatctaagttgtgactatgagagtaagtattttggattctaaaggcatattgccaagttaggataattattcttgtcagtaggcatttttggaacccacaggggaggtatactattgtatttgagataaagaatgactaagtaaagaataatccataagaaagaatactggaaatgaaaattattgaaaattctgtaatatcaattattcaacatatctattagaatatattttggaaccattgaaaaaataatcaaaattgtacaaatgtattgagaaaacagtaggacgatatgttccagcatcatatttcatcttcagtttagaaattcttttaggaaaattatatttgcattttaatgagaccttttattcattgcaagttcagtgctattgatgaccactaaggcaggtttacccgggcataatagcatcctggggagatggtgaagtaggaggcaccaagggttcatcccacccaggcagtagttacacagacagaatttggctgatgtaactgttttgaaactctggaatctaatgaaggcttgctacttttaggggaagggttggacattaaatcatgctcagttgcaatttcagcatttaagaactacccatcccactctccttagcccaatggcagatagctgtgcatgtgtttctgaagcagcttgtgcatggcttgcaggagccaccgtggcaataagaactctgtccttcaaatatcagggatttatgttctgattgctgattgctgtttctgatcatggatttgcagacacagaggtgggcagctgtatttcttgcaccacatcttaccgttggaagcccctcctgcttccagatgtagtgaattccaggagaattaaagggccagcattcccctgctctacactttatttttctttttttcacattttgggagccaaagattaaagataagaatattcaaaagcaaccatgtgtatagggaaaattagaaagccgccatgcatgcccagagttccaaagaagagcaaggagagattaagtcttcttaagtgaacaatgcaaagaaatagaggaaaacagtagaatgggaaagactagagatctcttcaagaaaaatgaagataccaagggaacatttcatgcaaagatgggcacaataaaagacagaaatggcaaggacctaacagaagcggaagagattaagaagaagtggcaagaatacacagaagaactgtacaaaaaaggtcttaatgattgggataaccacaatagggtggtgactcatctagagccagacaccccagagtgtgaaggcaagtaggtgtcaggaagcattactacgagcaaagcttgtggagggataaaatttcagctgaactatttcaaatcctaaaagatgatggtgttaaagtgctgagctcaatagccagcaaatttggaaaattgagcagtgaccacaagaatggaaaaggtcagttttcactccaatcccaaagaaaggcaatgccaaagaatgttcagagtattgtatgattgcagtcatttcacatggtagcaagttaatgctaaaaatacttcaagctagccttcaatagtacatgaactgaaaatttccagctgtacaagctgggttgagaaaatgccagaggaacaaaagattaaattgtcaacattcattctgcttcattgactatattaaagcctttggctgtgtggattacaacaaattgtggaagattcttaaaaagctgggaatacaaaaccaccttacct

SEQ ID NO: 57012 - DNA, 1933 bp, Bovine  19866880398631
cttttacacctctctaagcacccatgataacctttcctcctcatcactgatgttgtcaaccatctctctatataaacttgctgtcagtttgcttatcttctcaggcctcaactctttctgacttctacttccattaaattccccttatgatcactttcctaaattcaatggaattttttcaactctttaattttcttgatctttcagaagattttaacactcatgtcatttagaagggtctatatgatactaaagtaaaaaacaactccaatcccttaggctcaccataacacaggtctctttcttgctctctctgtaggtccattgagggttagctggaggcctttgttcaactcaatcactcaggaacttggacctccagagcagcctctaatttggacactgcttgttatcctggtagagggagacctctggtgaacttcatacaggcaattatagactatgcccagaatcaacacacattctgtttgcttataactctttagccagaactaacgcatggccacacccacccaccacaagccaggaaggagagccatctacgatgtgcctgtagacagagctggaaaattctgatgagttggacacaattcctactgtgaggttcactgatcccttcctggtacttactctcccttggcatctgtgagactcttttgatgcttttcctgtctctagctgctctttttcaaagcaaatgagtctttgctgactcattcccctctactgtttgtcctagcagttcatctctttccccatgcaatctcatctttgccactctttacactatctgctatacattaatggtataaaatttatatcaggactctcctctgagcgctaaacccagataactagctctcaagctcttccctcttcttcatttctactcctgctgctgctgctgctcctgctactgctttgtcgcttcagtcatgtctgaccctgtacgactctatgaactacaccctgccaggctcctctgtccatgggattcttcaagtaagaaaactggagtggttttctgccctcctccagagtatcttccccaaccagggatcaaagccgagtcttctgcattgctggcagattctttacttgctgatccaccagagaagtccttctacccatgcaattcaatcaaaaaacaaaaaaacatgaacttgtccctaaatggtttccttgcctgtatttcccacctcaggaagtggcaccatgagcagtccaattttgaaggccaacctccccaaatcacctacttcatgcattccatatctaattcatcactagcccttgccaggcatatctcctaaatataattcatcccatatccctctttcccacttcactgtcatgactctcctccgaacaacccacttcccttgcctcaaatacaacagcagcttaagtggcctctttttttttttttttatctatgtttgatgctcttcagtcaattcttttttattaaaaatgaaagaaaacacaatggtttttccagaatgtaaatacaatgttccagccttcaaattaaatagctttcccttcctctcagtgtaaagctgaaatccccatttggccaggaaggccctccatgctctcttgtgtcccttcttatctgcccactttaataatattactcttaatgattagtcctgttctggaggagatttcttctaatttctagattttccaagatttcttccatcagagtcttccacatttcttccaactggaatactctcctctctctttccgtttagatctgggctactcaaaggaaagccttcatttgagtatctatagaaaattttacattccatgataatttttgtaaataattcctgttcattgttcagataagctccatgaggccaaggcctatgttttgtttcttcactttatttcccag

SEQ ID NO: 57013 - DNA, 2864 bp, Bovine  19866880571433
gagtgagcaagcttttcttcagtgatggaaggtatagaatgaactttaaatagtagcattaccctgggacagtcacagccctgtggctacctctgtctgtaaaatgacagatctgaactaaatcattggcgctaaaatattttcttagaagaaatgttctaaaaaataatccctttgggcactatgctagataaaactgataaaaccagaaccagtgcatgaaatgggtgtatgtttctacatgtgtatgggagtgggcctttgtgcccccaggagaggtagaaagtacagtctattaagcatcctttaagtcacacttcccacctcctactcccacccaccttgaacacacacacaaacctattagcctctgagataactccaggaaaatgctagaaattcactgaccaaactttggaaatggataggctaaacaccagcttctactcctgccttattgttccgtaatactgtgattctgaagttcagaagaccctgcattcttatcttcacccatcactttttgaaactgagacaaataaaagaaaagaatagcgttgcagaatccccctcagcttcagggcattgtggtagaggtaaatcaggaaacattgaaacaggacaatgaatggagcctggaactgggctcattggtgtctaacaggtctgtgctcctaactggctcaagcctgggctaacagtctgtgctcctaaatggctcaagctcagactgagtcagactgtttatatctatttccgtgttaccacttttacaacttcatcttatgtaaccaatcaatagatttagaacagacatcttttaaactcatggtgtgactgaattgaccagatgttcagctgaattgacagagctgtttctagtataatgtggacgcagcctgagagtcagtgaaaggtgacagaactttgacttttccttgtccagagatagaaaaggcaaaaggaggaggaggcagggaaaatgcaagagaaggataggtagatgaagaatcagcaagggagcaatcagcagcctacacaggagtcccagatacaatacttgatttcaagggaacctctctctagtttaacctttctctattttaaaacttattttaaaatgaagaattgttgaacagagattatatgaggcagatggaaggagaggctaatttaagactaaaacatgaaaactacagcaattaatatgttgttcatcactaagaataagataatcttccttgtcactatgtataattaattttgattctctgatgtttcatgtatatatcaatactaacttttaacataaagcaaaaagaaagccaaattgttgggaaatgtgctaatatcacacatgcatgcatatatatatacatgtgtaaacatgtagtctattccaaagccaaggaaaattgcttcatggcattttttcagcgtgctatctgaccaatatagttcatgcatcagtgggtcctggtaactctggaaggagttgtttctacttggttttaaattccactttgtttcactgtaaatgaacaaaaccaccttatttgtttttctaaaaaggctgacttttttttagcacagtaaaaaaaatgtagattcaagcatggggattttcttgaagaaaaactgatgaatattcatgcaaagactgaagaatataaaatatgaaatgtcaactttcctaaaagtcatgggataatttttgtggaaggatattatattacttaaaaaaaaaaaaaaacctccagaaaaaccccaacaacaccacagaagcgagtgatatatttaatgccactgataaattatgattcttctagataaacatgaggagggaactggtatgctactttgaattattatcagttatggtatatttataaagtgatagtgatagtaagaaagaaatttaaaaaaaacaacaacactaaaacatagtctaaaatatccttctccactttgttttccctcatagcacttataacccttgtgccttattatttctaagatcatttaaacatttttgttttgttttctctcttttaactataaaataggtctattataatattaataaaaatttattgttttgttcactgctgtatccctgacaatctttttaagagctggcactaataggttataaatattggcagaatgaatgaactggtatgtggcaatatgtgccaagagataccgagtcagtttacttgagtataaagagaaaatctttttgaaatcacagcaaaaagacgaagctaaccatgatagtgaacaaaaattcatctggattcaaatccaaaggaactttcaatgctggaaggctatggagagatgccattggagaaaaaatgagttcggaatgtgataaagatatatagcttatataaggctaactctcctacaaataattataaaataatatataaaccaagttgaaggcactttagaatgtccaaaggcagggagcgtcatggaatatttcaacttttgaaagaataaatggccactgggtcagatccatatttatttgcctttgccccaaaggcacttcccacttcatatggcacaggggaagaattattcaagcagaaacctgctatttcattaggttgagttatcagagaatacatgagctatacattgaagggggaaatcctaagaagaaaggcaccagaggcaatgagtttccaacccaggatatacactttcctcaaatcctcgcttgacctttgaatcacaaggaaaactccaagaagtctagtggaaaacaacagctggaaaaggtgaaaaacctgagtagttctcttagctcctgagtagatctcttagctcctgttatcttggtatttgta

SEQ ID NO: 57014 - DNA, 1320 bp, Bovine  19866880652082
tacaattaaaagttgatatttttttctcaaataacttgcaatatggtatatcagggactcagaataaactcttatttcccctgaaagtgagtgaggtaatctgtatgcttgtacacacacatacacataaagacatctgttaatggagtgcaaaaaaatcactattttaatcaagggacacaaaattcaacacttttctaggacttaatgataaatatatactttggaaaatttctggaaaatcaaaagttccagggaaattgatgtaaagacagctgaaggtttttccagagtgatcttggtatgacaatggcagttataccaataaaaatacagaggagtcaacaaatggactattatttaggttactgttacgaggcaagtaatccatagacgttccagcaaaaacttcacaggggattctctgttgttgattagtagaaaaaggacagcatggaaacatcttttgatcatgtgaagagttggcatatattccattatgtgctatcctgcaagcaacaagtgaaagaaaacagcagtgaatttctaaactacagcttggcaggggtcaatttatgaatgattcatcttatgcttgagtaaagagccagaaagatgtaatgaaggaaactatgaaattgtaagcacaacttggctcactttcttaatctagagaaattaggattgatgtgacctaaattaactttggccctaacatttaagggcttccctggtggctcaatcggtagagtctgcctgcaatgcaggagaactgtgtttgatccctgagttgggaagatcccctggagaaggaaatggcaacccaatccagtattcttgcctggagaactccaggacagaggagtctggtgggctacagtcaatggggtcacaaagagtcagacatgactggctgactgacctacttaacatttttctatgatttgagatactcactgaaattaactggtaaatggcacagtattaactgttttgggaaagtcgtagtatgatcatgactcagggacaaagtgatccagaaaacagatgtcataggcagcccagtggtgtaagagtcaatggcataccgaaacaggacagagaaaaaactccagggggatctttcttataagcttgcaaaagtggcctttccctttccaagacagcctcatatggggaagaatctgatcatgttgggtggggggagtggggaggcatatggcttttgcctatcgctctttctagtatatttgttccaaacatagggatgaaacatgagtgatatttaatataggtcattaaaggataccaagaaaatcc

SEQ ID NO: 57015 - DNA, 989 bp, Bovine  19866880751810
aaaatgtaaaattaaaagtatatacacaagaataaaacatgcaaacaaaagaggagaaaaaaccagataatgagaatgaaaaagatacaatatacataaggaagaaactgcaaccactggatataaaaagagtacaaagagatttcttctaatttttgaatctgggtctctttgggaacaaaagaagcttaccaccatagtagtatacattctaaccaacagtttcagcaacagccttcttttcctattcagaatattatttgtgttcttagtctcagttattgcacctcagagagccataaggaacaagtctgcatccttaatttcttgtttcttcctgtcttttaaattcagatgtgtattctttccaactgtttgtcttttttctcccttccctgcagtttatcaggatgtttcctttctcacatcattcacgtaagcacagtgcatattctgtctattacatggtactttacctacagaactcagaaggttaccttgtcattggtgttggcccaaccacccaaatcttactgcctcatcagaaacacattgcctgcattcatcctctgctctcatcagcctctgaaggccaataaacaaatcaacactatccactaactaaagacaaatgagacctctcagactgcaaattccttctgttgtctatatagacattctaatatatcttgctttttcattatgagactactgctgctaatttttcacctttatctggctagtgagacaggcatgacactttatttcacaggtgtattaacattttcagatgctcagttatcttttcatgcttggaaaggtttattaactaagacacaatggacagagcatcaacttttacagtaatgtctctcaaaatggttatctgtggagcacctacattaggatcaccaaataataaaaatgtaaaaataattctttatcaagagaagaatttttaaataaattgtaacacattcacacaatag

SEQ ID NO: 57016 - DNA, 1093 bp, Bovine  19866880970236
attgggggcaccactgtaaactattattaatgaggctagcattttaggatggaagaaacattattagaaatccattattctgagtcctggctctctcaggattctgattcagtaattctagaataggatccaggaatctacatttttatattggcttggccaaaaagtttgttcgggtttttttctgtacaacgttacggaaaaacccaaaggaacttttctgccaatccaatacattgtatactgatcacattcaaagaaatcttaacctgaagatttaaatgctgataatctagagtagatactacagataaaagaaatacctgatggtttgacaaataaacaggagaaagtttgacagatatcctttgaataataggttttgaaagaagtacctaactagagagactatagggaataaagtgaaggacttgaaagaaggcagctcacaatagaaaagaagagaaggggaataaagcaaaccttagtcttcatctaacaaggctcctcaccactgactttgcttttgggcgggagtgcatggagatggagttttggaaaacagtctctcccaactacagattagtctctttcctacacagagatggaccaggagagaaggaaagatgtcataatattctcatggaatgatacaaagaactctggccaatatgtgaagaactaagagataaagcagaactcaaacaagattttcaatacaaaagaccaaagctagaaacttccacgtgtgtccttgctatctctaggtactgagagaattacgaacgctttctctgccccactgttattattcacaataattcccagaagtactctcatgtaccaaacggatcatattcagaagtagaaaatgattcagtaatttcattttaagtcttttccaaaagtctattcaattcctggactctttgtacttgcaaaaactgaatttgcctaccagataaaatgttttttcttagttctctagagtattagttacttcccaatcagaagacagaaactacacagtatttgaaagatggaaaatttagtataaagaaatagcaacagaagactgaagtaatagggaatt

SEQ ID NO: 57017 - DNA, 990 bp, Bovine  19866881386559
gtggtttaaggaagtaaatatctgtccagtgggaggaagatttggtttgagttctacccattgagtgggtagtgttttccttaacatctgcaaaggaacttccagtctcaatgtattacacacaaatctgattaaaagacttccacaaaatttctagcctcgggaactttcagtctttggtaaaggacaagagataacggtaatgtgactcctatataaagatctatttttaagttttcaaatgcttcaaaagatgatctgtctctggggaatagggatgtgctacagactctgcaactgttggtgccgctctcattacagagtctaaccaaatgggatttcaagagcagcttcccaaagaatcattataaggacatttaggtctaaccagatgcatcaagatgtcagattctcatggcctttgcattaattcaaataaagtaagcccttctctgaggttttgaaatgttcagtttcttttttactaaaatactgactcttggagtggaaagcgattgaagtaaagttatgtcttatttacgttattgtgcaaaaggaataagtaaaatgaaaaatctcatttgaaagtattttgtggtttgctaaataaaagcaatatattggtaaaaaacagcaagaaaaagaatattgtgtcttaggaattaagaaatttatcaaactattcagttacaaataccttttgtatgttttgttatatgtcagactctgtgctaggctccaggcaagcccaagaagtaaataccctttctgttgttaaggcacttctagtctaatggtatttcccctgagaactagaagaactgctgtacaatagggtctcagccatttctcctcacccacagtcaagaatccatacttcaatgatgtcctaagtctggtaataccaggtacatgcattaagatgactttttagtgatctcctgtgaaaatggccttatctaaattatatttaatagaagcaatcaaata

SEQ ID NO: 57018 - DNA, 1945 bp, Bovine  19866880369270
ttctgctacattgttacaaggattaaatacctgaactggactgtcagtaaataaattctatcagtgttattgttatatttttgttaattacctgtgatgggtagaattacaaccaactcttgaataatgtgggtttggtctgtgcaggtccacttatatgcagagtttttaaaaacagagaatatggttgaatccacagatgctgaaccatggatacagaggaaccatgggtatggagggccaaccataagctatacctggagttttggactgggtggaggatcagcgcccttgaccccctccttgtttaagggtcagctgtctttcctccctcccctgccccgctccccccagtcagtcttcttccttcctggaggaatttccttgtgtgtgtgctttaatcttatgcagtgtgtatatatttaagaatactttgtgtacaaatactagctctgtctttgtaagtttacttccaaacattttaatatttagagtattgactattttttgctccctggatggtttatttttgtttatttgtgatgagctcattcattcttattagagagtgatatgcatctattctgctgtgccatttatttcttgtttatggaagattatttgcaagatcttgagctgtttgaatcaatctcgtctgggcaggttttagtgtattcaattctggtttgggtttaataggtgttctgttaggtttggattgcttaaataaaataattcctttgtgaaaacatctgtcatgttggaggttaaaagatatctttttagaccaacagccacagtaacattttagtaatctgtcagatagaatttgcattggctttgaacactatatatattttaagatcattttaaatcctccagctaggttcttatattactttgaaatagatttctaaatgttgagcatgtaggtattatcattctgtttatatggacttcttgtttccttatagatcaggctaacccctgtcctttaataagttggtacagagttaaggtcctcgggcaagggggccgggggcagggtttgactgtattactgtttaccctagaactgttgtgcaggctaacatattatttactcttttctgaacctttgatgaatgtttattaaataacttttaaacagctaatgacataggctttcaagttaactaaactttagtgtgaatccctctaaagagattatgaactgtccagcccttggcaagcttcttacccattggaatcctcagggtcttattctgtaaagcgaaggtttattctgtaaacctatcatagataggttcattagaataaagagagacttcatgtcaattgcacagcccttaactcggtgaatccttgcaaacaaagtcataacaattattatttacctagtactgtcataataagtgatctctgaaatgagctttcctgatagctcagttggtaaagaatctgcctgcaatgcaggagaccctggttcgattcctgggttgggaagatcccctgaagaaggaataggctatccactccggtattcttgggctttccttgtggctcaactggtaaagaatctgcctgcaatgcaggagacctgggttgggaaggtcccctggagaaaggaaaggcaacccacttcagtattctggcctggagaattccatggactctatagtccgtaggatagccaagagtcagacatgactgagtgactttcactttcaaaatggttttcattacttttcagtactttgctgtgtaatgttttatgtgatcagcacaaatgggaacttctgtatgtacaggaggcatcagatgctctgtttaaagcttccttcagtttagccaagatggggactggattgctgcctcttgtcctttgctctgtgcctgggggctgaggggatgcgtcagcagacactcttacctctggcttctg

SEQ ID NO: 57019 - DNA, 2897 bp, Bovine  19866880444798
ctcatctttccctcataccatgctgttttttgcaaaagcctctctggcctccggcttcacagaatcaaacaaaacaggacaatgacagctttgggacctgggtagagctctggccctgactccactcagaggccatgggtcagtttgatgggtcgccatcaaagagagcctttatgaagacggtgctttgagacacccaatcagtgcgtttttgttagtttctccaaacttaagctgagtcaagctgtattgattaaaaccggttgggaaatgaattcctgaggctgatctataaagaaattcaatctggagatggagcgaactgtcgtcaggattccttattaggcacttcgcaccaggggctaaataaagcaaacaaacagatacgtaacacaaagggcacactttttcaggggatgaaaatgacactgtggttggggaacatcacatctaataccataggaactgaccatttcttaataaccaacaaatcgatccctccctaacaatgcttccaagaagcgagaataagaagggactatattaacaaagagggatggaaatgaaattaagtccctaacccagccttttcagtatctctaagataggggggtgatcctgtcagaaactgcattctacaaagaatccagaatggttgcctcatttaattaggaggagaaaagcgtgtggggagagagggagtcttctgggtaggggagtagagcaaagagatcgaaccttctgtttcaaaagttgcttagcaaaagcaattttaattgctgcctttgttataacagattaaaggtagttatgtcctggtgtacctcactttaagcaatcaatgtgttcctgaatagttatgtgcaaatcaaattttgtaaatcaaatccaattttaaatgccctcagagagcttgttctttccaggaaatttttggtgaattctttggtaagacctaagacaatcctcttaatttattgggttggtagctttaatttcttttagatgatgataaatgttattccctctcccatattccgaagaggggactgaaaatagaatggaaataaaatgacttaatgatgcgatatagtaactgatggtatctcctatggtaggttaatttagtaaatggtgagcttacctcttgtattttctatgaataatgactagtatttaacatcgggacaatgagactgtaagaaaaaatcaaaaaggattacttggaaggagttttaagaaatatctaatccaaccttcaaaaccgatttctctttgcagtattccagaataatgactgtttaggctccacttgaatactgttagaatgagctgtgatattcattgataaatttattcattaaatatttattgagcattaactatatgggggacaggaagaaaactagatattggcacccaccttctttagaacttaattcacctgggaaggcagatattcactaaatggtaacacagtaattgatacattatttgatagacattatgaagattaaatataggatgctatgaaagtagtcagggaaaactgacccaaggaaattgcatttcatctaagacccagaagatgaataggtgctgagacgaaggagagccggcagaggacgccatgtgtgggattgacactgtatgtgggactgtggtttgagatagttattctggctgctgtgtgaaaagtggactggatcagggcaaagataggaacaaatagacccacagtcagggtaaaagatgctggtgacttaggccaagatgctaaatgtggggctggagacaaacagattgtcctgaaaaattattgggaatatgctcagtaggacagagtgattgtctgtatatggaggtgcatgcatgcttagtcgctaagtcatgtctgactttgtgaccccatggactgtagcccaccaggctcctctgtccatgggatttcccaggcaagaaaactggagtgggttgctatttccttttccatggtatatgggaagtatgtgaaagcaaagagtgaaggatgatcttggcatatctgagttggacaaatggaaagacagttatcccgtctactgatattgagagcattagcaggagaagagattagggacaagagatttggtgcaaataattctgggcatgttaagttagaggtgccatcaatgggaaatgtccagcaggcagtttagtaactgagtctgggacttgactttcatgactgtggcaccctgtaagcaccttgcagcaaggccagcacacagcagccccccacgactggcttggggttcaggacacggttccaatctctggagaaacaaagtcctagactgataaaccaggccagcagccaaaactataactggaacataagacctagatctagacaggaattaaatggggagtgtggggacccaggacataggaatgcaggcgggttcaagtattagtgttcctactcaatatttatgatttgggtcattgaggtaataaaagcagtagccaggagacttttttttaaaaatgtggaccatttttaaagtctttattgaatttattacaacattgcttctattctgtgctttggtttatgaccccaaggaatgtagaatcccaactccctgacaagggatcaaacccacattccctacactgggaagcagactactagaccactaattgtcaaactgctggtcccaacttctggaccgctagggaagtccccaggagactcttttgacctctgatgccaaccagcattgtgataagaggcaatatgctctctgctgctgctgctaagttgcttcagtcgtgtccgactctgtgcgaccccatagccagcagcccaccaggctccaccgtccctgggattctccaggcaagaacactag

SEQ ID NO: 57020 - DNA, 2066 bp, Bovine  19866880493486
tgaaaagtgaaagtgaagtcgctcagtcgtgtccaactcttcgagaccccatggactgcagcctactaggctcctctgtccatgggattttgcaggcgagagtactggagtggggtgccattgccttctctgtatcagtaagagagcaaatcaaaagaaaaggagagagagaaaactcagccagggggcatgataggaaaggagcccacttaggaagcaagttcaaattttgatatgaatttagaaataaggggagaggtgggccatcagaggcacatgccaggaccacagggaaatgtacaactgaggagcgtattttgctatgtaagccatgccagttatgcctgatagctcagatggtaaagaatttgcctgcaatgcaggagacccaggttcaatccttgggtcaggaagatcccctggagaaggggatgggtacccactccagtattctcacctggagaaatccatggacagaggagcctagcgggctacagtccatgagatcacaccgagttggacagggctaagcgactaacactatcactttcaagccatgcctattacacaggtctgagtaactgtgaggccgggaaaggcaaagccctggggacaagactgtggtggaggtgtcagaactcacaaaaccccggcgttcaaacttcagaagcctcacctgcattttcagctcaggaagctgctaaggatgctttttcagctacaacaaaaaccaacttcacagtctaaagtgatgccatagctggaggtgctggcagcagccaccaaagctcagacccatggcaatggataaaccactcttatcatggtggggggagccaggatcacccccagaactgacagaaggcacggacttcaagagggtcttttcaaccagcattgaacgggtgcttatggtagaaattgaaaccagtggctgttgttcagttgttaagtcttgtccgactttgtgaccccatggactgcagcacaccagggttccctgtccttcactgtctcctggagtttgctcagaatcatgtccattgagtcagtgatgccatctacccatcttatcctctgccaccctcttctcttgccctcaatctttcccagcattaggggtcttttccaatgagttggctcttcacatcaggtggccaaagtattagagcttcagcgttatcacatgaacacaatgaaaaccagtggagaaattcccgtattgtcaatggcctggataaataggagctcatatatgctattgtaaaaatttaaatactgcctttgtggaattcagtctattgatgtgtaggaatttgttctaggaaaataattataccagagcagaaagataaatgtgcaaagcagttcttgaaaacattatatgtaatggtacaaaaaaaattatttaagcaacctaaaatatccatcctcaggaggactggttagatgcattgaagtaaatccatctggcgtagtgggccatggccgtttacaatggtaatatagatctgtatgtattgacttggaaatatgttaactgaaaatggcaagttacacaagagtatgcataatagagtcccattttgttttttctgggaaaaaaaaagaaaaagcatgagtgagtctacataaggaaaagctaaaagggtcgaatctcagcagtgaggtctagcctcgtagttagaagtgggccctctgcagccaggggaccaggctcttattctcttattcttcttcttaggctcttattctcagctcttgcttgagacctgggacaagttcctgaaccttctttgatcagtttcctcatctgaaaagcagaggttgtagcttgatatctgaagtagagtagcctgaggtcagctctccgtgaccaaaggtctgaacgtggcgctgcattttgcctctaggtcttagatgatgcgatggtgtggactgatgctcttcttgctctttacccttgcttgctccctcccttcttcccacttttgtgacattatctgtgaaattaaaaactggtggcaatctaaatacccaacaggagaggagttagataaatcaag

SEQ ID NO: 57021 - DNA, 1497 bp, Bovine  19866880499341
tctttaaaataagcctattgacatgttccttgccattttactaaaaatgtgtgattgataaattatttgtaaagcacattctaaataaaatgtgctatgtaaatgctaagtattggccctattgagaagtgttagaaagcaggacacaaaattttatgtgcttaaaaacagattcagggaaaaagaacataactgaggccccattagaaacacattaaaaattaaaaaaaaaaataagcaaaagctttgctctaagtaaagttaggtaatttacaatggtgccacaaaaagttgaattaaaagcttattttaaacatcatctgtgtgaaagtaaattttaaagtacataatgtagttaggagggaaaacaaacaaaaaaatggaatctaagtcaatcacatctgaggtttagcctgaatttaaccaactgcagagcagctatgtaattttcgacaacttctttagacacgatgtaattgtttcttctgatgtcacataagacactagttacaattttattggtctttgaaataatgtttttaaatcagtagagaaaccaagtcataggtggcaccttacagactaaattatttttacaattttacattttaaactagtcattactaaattatcactttaactccccatctgaaaagtgaaactatcgtaacactaacaccaacactgtcatcaattgtgaagagtagaaaatggattagaattctaattaaatatgtgtaaatgggatttctctagccaataaatttagaatctatttaaatgtgttaccctggagaatcagaaaacgtttttcaataaaatcattaaaagtaatttattaaaaattcagtgggttctttgccagaaatgtactcttcagatatgtttgccaaaatatgctaatatttatgttcaaggttaatcctgggatcggtgtttgaataataatctgtaagaaataaatgttcattatttgaagactaattaaatagactctaaaacatgcatataaaatattatgcagacattaaaaagaatgaagcaaaaccgcatatgcttatatggacaaaggtacaaaacaacccattaaaaacaaaggttacaagcgagcacgggacttgcagggtaactgaggagtttatcaaagctcttccataaaaagcaacaataaaagctgactgaatagttaaaaacaattttaggactctggaaacttattgaagggatacaataaatggaaaataaaataaatctgtttgtgaaaaactgctaagtctcaggtaagaacggggggagcctgtggtgattttgtctgaggatgcttccatccctcctcccagcccagatgacgcgtgagttccactaggatggtaaaccacaaaaaccagaaggaggcggttcactcagctgcaaagcacgaacgaaaacgcttcacatccagcagcactgccaatatcagcagcaactgggagtgaatgaccagagaagaccagtcag

SEQ ID NO: 57022 - DNA, 1729 bp, Bovine  19866880544171
catccaaaaacacccacccagaatagtatttgaacaaatatttgagtatcttattgcccagtgaaattgatacaaaatcaagcatcatacttggcatggtccagttacttagcagtgagaccagatggggaggagccaatggctggctctaaagcccacactctagaaggagagatgctgagaagaggcagttgtagccacagaggggagtggcaggtgatgtgatcaggcactactagaaccagaaggagagcctgccaatgaagagattcgggtgttagctggtgcgagtggaagcacacccaggaagccaatgtgcaagaaacagttgaagggatatgggcatacggcttcccagctgattcagtggtaaagaacttgcctgtcaatgcaggaaatgcaggagacacaggtttgatctctgagtcgggaagatatcctagagtaggaaatggcaacccactccaatattcttgcctgggaaatcacatggacagagaagtctattgggctacagcccatggggtcgcagagagttggccataactgagcacacacacacaagtgatgatgtgagcataagagcactgagtgtgtctgctgcagatgcctggaccagggaggctcctcagagaaggtgacatttaaagatgagaagaagcagacatgagcctaacagggaggagaagccagacgttaagtggagaggacagggttctgcagaaactgaaagagccatggacagtggtaaactggaaaagggtgctggtaaaatctgctttatccttcctgttttataacagggacaggggaggaagcgggaggcccagagaaactgaataacttgcccagttcacagagccagcaaagccagagacctcagttctgactgcatgagcaagggggtgagggaggcaggtaagaccatgctgtcagaggggtgaggggactagagacacaactcagggagcctagcagaagagaacaggcaggaacaccttgacccctcctcctcccactcctgacccggggagcctcctgggttgctatggttctttcttcgggcaggaaaagcttctcaagtacaaggatgtaactgaacagacacggttataaataaagtgacagataccatagcaacagggaaagcaaaatgaaatgcgccatcttattgtaaagggcaaaacctacactatatatacaacaagcaagcatctccttcctcttcccagtgctttcctacacagacatctcagacttcacacgcaacaggcctgtctcctccactgaagcaattctgatacagaatttatacatatctttgtgcccgtctctttgtgtgttcaagtgtttagctacataaagtgcccccagctctgtacatcaagatatactttaccttatgatccagcaatcccactgctaggcatacacactgaggaaaccagaagggaaagagacacgtgtaccccaatgttcatcgcagcactgtttataatagccaggacatggaagcaacctagatgtccatcagcagatgaatggataagacagctgtggtacatatacacaatggagtattactcagccattaaaaagaatacatttggaatcagttctaatgaggggggatgaaactggagcctattatacagagtgaagtaagccagaaggaaaaacatcaatacagtatactaacgcatatatatgggaatttagaaagatagta

SEQ ID NO: 57023 - DNA, 1270 bp, Bovine  19866880692882
atgaggattttaataggaaggatggaaggaaataaatatagaagcctagaaagaagcaagagagggagagtggaaggaaggggcttcagtccataacctgacctcctcctcctcgtattttcagcagtcaggacccagtactagtaactgtgacttccaaggccagtcctggtgcctacaccttaatccagtgctcctgtttgttcttcatgattccgcccaggtggcatctctccaaggggccattcttaaccgtcatgggtaggttagatggtccccagatgctcccacagtactgtctttccacatactcccttttttatatagcaatgatcttattacatgcctcacttccttacatgggcttccccggtggctcacccagtggtaaagaacctgcctgcagtgcaggagcaacaggagacacgattcaaagatcgtgtctttggaagatcccctggaggagggcatggcaacccattccagaattcttgcctggagaatcccatggacagaggagcctgacgggctgtggtccatagagtcacagagtcagacacgactgaagtgactgagcacgcatgcacaccgtcttcacaagactatgaaatccatgttattaccaccaccatccttcataaacacacaagttggttggagctcagagaaattaagtaactaccctaaggtcacagagctaggatgtgcagatccaagatttaaacctgccttaccctggtctcattccaaatctcttcattttccccatttcaaactgttttctacaacaaatagattgctaaagtgcccccattggaaacatgtttctctaaagtgaacctcaagctggacactcaagagtggtcccaagggtcctggggcaatggaacattctgcctttcaaagagaatgatcttataattcacaagtttgcctttcaattaaccgaggactgtgactctttatttaatgttatttctacataatctaatttcggctgcaggttaatggacccgtggggagttattgctacttcagtttcaaaagcattcagcagcattcccagattattggtcattaatggaatcacccagctgttttgactttctcccaatcctttttgaggtgaccttagaggaaaggacaaaaacagagaccaagggactcactcttaggatagtgggactcgctgaactcttatctacttctgccagccctgtgacctgtggattccaggtcctagaaaaccaaggctcatctccagacccta

SEQ ID NO: 57024 - DNA, 786 bp, Bovine  19866880755998
ccagaggcaggacttgaggcttcctcccatgcagcaggaagcctgtggagtctccataaaggccctaggaatgccagaatcatgtatatgttttaaatgtacttcctcgggtggtatatgctgctgagtgaatctttaggaccaccatgtgtgaaataaacttcgtagtttttattttcttttcttacaatgacacccttttaaacatgagttttctttcttcaggaagaagagttgaggaaaagtggagaagcaaagtacttccatctcaatgatgatctccacgttctcattgaagtttttgcacccccagcagaagcctatgcccggatgggacatgctctggaagaaatcaaaaagttcctcattccagttagtacagtgtttcttgataattaattggtacttgaaagtcctccctttgtttaaaatcctggataattcttatcagtaattgttatttgcatagtgcttgatctgctaaagtgtccctgtgaactacttggcatcattccttctttttctgtgaggctagggatcttgaaagagatgaggcaatacagctcgggtgacccagcaagaatggtgaagagcagtcagtggtgtgtgttttgggtcgcaggtcctaagcctttttgtgacactgaagtcacctcacaggttcattgctatgcagcatgagctcgttggtgccggccacgagctgggcgctgtgcttggagctggtgcgagatgagtgcagccccggcctcgaggctgtgtggtttagggaagggatggatgcag

SEQ ID NO: 57025 - DNA, 1501 bp, Bovine  19866880760980
cctctctttcccatgtgaatctaacgtctcaggtgccagtattcattcttacagtttctcttcaatcatagaatctgaggttacacagcctcagatatgcatatgacaccaccctaatggcagaaagtgatgaggaactaaagagcctcttgatgaaggtgaaagaggagagtaaaaaagctagcttaaaactcaacattcaaaaaacaaaaatcatggcatccggtaccatcacttcacggcaaatagatgagaaacaatggagacactgacagactttattttcttgggctccaaaatcactgcagacggtgactacagccaggaaattaaaagatgcttgggaaaaaagctatgaccaacctagacagcatattaaaaagcagagacattactttgccgaccatcatccctatagtcaaagctatggtttttcccgtagtcatgtatggatgtgagagctaggcagtaaaaaaggttgacatcaaaaaagaattgatgccttcgaactgtggtgctagagaagactcttgagagtcctttggacagcaagaagatcaaagcagtcaatcctaaaggaaaccaaccctgaatattcattggaaagactgatgctgaagctgaggctccaacacttatggacacctgatgtgaaaagttgactcattagcaaagaccctgatgctgggaaagactgaaggcaggagaaggggatgatagacaacgagatggttggatggcatcactaactcaacggacatgagtttgggcaaaacggcatgctgtgacccccacgctggggacactactgagcaactgaacaacaacattaggccttcaaaagtcaatggcaaagttataatataggaaaaggaagataaaaatgatcagctttttcatttatgagttaaactataatgtaagtgactatcctttttaacctcaaagttagaacttatgggtggacaaattctagtgtatttatggccacaggatattgaaaactggtacagttttggaaaatataggatatatgattgtaattggtataatgtaattttttaaagattggtacacttgttttcttagtagtgactttgtatctgaaaatgcttccccatccatcacttgagaatctgttctcccaccttttaaaatgtggagctccaagtgagatctctgaaaatgatcttcagtgaaactgcttatctttctcatggccatctaaaatgtccccagcaataacatgtaaaactgactaatgatatgcatatgcctctcctagcaattcactactcctgattcttcacagtgagatatgctcattaaaaaagcaagattaccatcctacagaaaaggtagtgattaatttaacatgttttatatcaaaataattatattcgctttacacaatttaatcaaatccctacaatcctctctaccctctccttccctgctgtggggaacataaccacttaaacagtctcgagaatttttaaag

SEQ ID NO: 57026 - DNA, 1925 bp, Bovine  19866880959916
cctttcaagtagcttttcacccctatcctcttttaccatcccttctaggactctgatgacactgaatttagatttttgttgtattcacacaggttgctgaagtgctattcattttgggtttttttagcccattttctctctgttgtttggattgaataactcccattctgttttctaattcacagattccttcctgttcccactacatccatccattgagctttttatttcatttacttcatttttttttttttctaaaagtactgtttggttttctttatatcttctatttctttgctgagactctttttgcatttatttcaagtgtgtttgtaattacttattgaagcattttatgatgggtgctttaaaatatttgctagaattctcatatctcagtcattttggtgttgacatcttttgactgtctttttgatttagtgtgagatcatcctggttcttgcatgctgagtgattttgtattaaaacatgaacatcttaccttttatgttatgggactctgcatctcatttaaaccttctgttttagctgacttttttgggcattgctccagcaaggaatgagaaactgtggctctattagtgtcagatcgtggtagatgtccaatttcccacctggcctccattaatcccagagacataggggaggtgcttctccttactgagggacggggatgagagttctcactcccaaacaagttgtcactgatatttcaccgactgggaaagtgtaggaatgcatcgttactgctcattgtatgacctatactgatgccacagagtgcagtgtgaaatccctgaatctctacagcgtctcctttgaaaatacatcagtgggaatatggagtgttactgctggggaggggtagaaatataggcatccttcctccaccgttatcccgtgatggattggtactgtttcttattcaggatgttgcctttactggcataagcctattgggatgcctcactgcagatgggatggtatctacattgcctgcttggcctttgctggcatgagtgagaataaggacttttttttcccctgtggtgtttgttgggggtagagcagttattatctaaaagtttctttcttgctatgctgttccttcactggccctttggctaaagggatcaagcttttgttactttttttcccacttttgggatttctaagttgctggctcctccattttaaaccgtgggatatatgtggtataaagaacgtgcagaaaaccaattgtgtcccaactagctgggctgccatcttctctccaattttctgtcttcttttaatccagccttttagatctacatgcatgtgtgctccgttgctcagtcacgtccagctctttgtgactccattgattgtatcccaccaggctcctctgtccatggaattttccaggcaagaatactggagtgggttgccattcccttatccaggggatcttcctgacccagggatggaacctacgtctcttgcattgacaggtggattctttaccactgagccacctgaaggccttttagatctacataggacatgaagttgcttagtcatgtccgactcactgcaaccccatggactgtagcctaccaggatcctccatccatgggattttctaggcaagagtactggagtgggttgccatttccttctccaggggatctttctgacctagggatcgaacccaggtctcccacattgcaggcagatgctttaccgtctgagccaccagggagccccagatctacatagtgctacacataagaaaagctacatctaatccaatttcctagaatcaggagtcactaataatattttaatgcagacttgagatgtactctactctcagtatttgctagttcggaaatactgaactataaaattagaagaaaaaa

SEQ ID NO: 57027 - DNA, 700 bp, Bovine  19866881009952
cagggaaggagcccgctgagaggacggcccagggtgggaggagaggacgcggagcgcctgttgatgccggtttccctggtccagctccctcccccacagtctctgcttctccaaacagatgctgagttacactgctctctctgttcccagggcctgttacgtgcctgccagcaacaaggcactaataaatgtttgttgaacaaacaaattaatggagatgtttttgcatataaaacacgatatgttgcttaaaaattcaatttgtgctcagctttgcagatgcgcatcaatagttggttattttaattacatccagctttttctgtgcagcgtttatgaagtggactgtggcagtaatataattaaactaatcagagtagcaagctaaataggattatccaagggtgatgttgaccctcaattatatgatatggtgaccactatttaggacagtttaagaggtggggggtggtccgctggagtgatcaactccctgggacacaccttctaggttcaaatccttgctctgtccctaaacttctgtgttaacttgaaagtgaaagaaagtgaaagtggctcagttgtgtccaactcttggccaccccgtggactctacattccatggaattctccagactagaatactagagtgggtagctgttcccttccccaggggatcttccctacccagggatcaaat

SEQ ID NO: 57028 - DNA, 1444 bp, Bovine  19866881019045
ttttgcacctcacacctataaggggagtaaagcgtgtatctcctgctcaattttctgacccacccagaggagaccagggtctgtctgtgtggcccgactctgcagatctcttctgagtgcactttttgttttcagctccaaaactgaaagttttcacaagagagaaggaagctctggaggctgagggggtgtacagagatgcttctccaaatctggaggagagaaatcagagaacgctttctgaaagatatattatctgggttgaggctgaaagaatccatgggccttatccgcagagaagggaagaaaaaatattttccagatcagtggtcagcaaaagctggtcttatcgcaagactgccagttgtccagcgtgactggtgctgagaactgggtgacctgaccacagagggcaccaggtgggggccggtcaccctccccaccccctcctcacatccatgctatctcttgtccggcaggcaggcaacatgaagctctgccggcagcaaaagtcggccctgtgtcctgttgcagactgacccacatgcaaggacccccagggccatcacgtccctcctccatcaggccctccaaggtgactccctgcccccggcactgacccagcctggtgccaattacagggtaaaagcgactcctcaccacggagctttcagatcggtgctattatccttacgtaacatttatatttccttttgtcctctgcagcctcaggacttccggctcctgattagtcatggaatgtgacttctgctgcaaggaaaaagggtctggatggctttattctgctccctctcaggtccttttgttaagctgtcccctgttccccaccccacacccccgagatggctgacgccccatgacaaattgagaagaagagagcagccaactatatgtgctaatgtataagcctgtgcccatttattacggggcaagagaaaatcaacacaggctgtcaggaagaaatggacttgatgtttagaggagggagggaagaggaaaggaaagaaggagggaaggaaaggaaggagaggaagaagagaaggaaggaaaaacaccagagggggcaaatatactcagagaagtcaagtacagtatgagatgaggtcaaaggtaggattaggggattggagggagatttccctggcagtccagtggctaagacacttagctcccgatgcatgggggccaggttcaatccctggtcaaggaactagatcccacatgccacaactaagtgtctgaatgccacaaccaaagatccagcattcttcagctgcaaaaaagatcctgcaagctgcagataagacctggtacagccaaaaaaataaatattaaaaaataaaatgaactcctttgcctacaaaaaaagaaaaaaaaaactagatggggccagctcacataacaacttgctaggcaggcaaag

SEQ ID NO: 57029 - DNA, 1115 bp, Bovine  19866881027034
ctgaatagattagtgatggggggcggggtgggggagcgtaatcaggggtgcagctttgctcatctccaaaggaaggaaagaagaggtagagagaggcaatcaacagtttagggcactcctttcgctccctataataggtttcccaggtggtgcagtggtaaagactctgcctgccagtgcaggagacacaagagacttgggttccatccctgggttgggaagatcccctggaggagggcactccaggattcttgcctggagaatcccatggacagaagagcctgaggggctacagtcatggggtcgcaaagaatcagacacgactgagtgacttagcatgcatgcacgggcctggtccagttctattcatgccacaggcacagggagagaaaactgcctaagcggtacttctttttggggtggtagtgaagatttcctgagacacctcatgaaaaagttaagagcattttggatattgtagatgctcaataaatgcaagttccattctttctttccaagaagggaattgctgcatttatgaatttaattttgttaaccttttatcaagggttcattaatggaattccatacggaaagggaaaacttaaggagaaaatctctccaggactttttgctctgtgataattagctgggggaagtaatgtgccaattaggctaagaggacagtgaagcttaaatatcatctgagtaattttgaaaactgttttgaacacagcttccagtttgtttcacagtctctcttcatccttgagcactcgaatgtaaaacattcttcctttcatggatatggtttgctgtttaagaggaaaaaaaaaaaaaaggcaagcaaaatgatgtgtcactggccttctttctgccagcttcaaattacccccatttaaccccagaagaacaatccaaagagcagcatccttcagctgaaatttcagcttaaatgttttgatagcttcccagctgaattgtcattcgtaagccttttaaaaattaattattaaaaccatttccattagtcttttgcttggccttcatgcaatcatttttcttggtgctgtttaacaagtgacaaaccaccagcattagctataaatacacgg

SEQ ID NO: 57030 - DNA, 4023 bp, Bovine  19866881031358
cctgggaatagggtcattctttggattggagtatttgctaagttgctgtagcaatagcaataacaaaagtccaaagccactgtgtatatgagataaaagtttttttctctctcacttaaagactaagaaggtcacggcccagggttggtagggtagatctgccattttcaactcagttggtccagccagagcatttcacagagaaggaaatccaggctcagagagcaaaagggcttgtccaaggtgccactgcccacaggggacagagccagctggggcattcttccttccgggatggcactcctcccacactgccgtgctgacctcgtctttccctcctttcagatgttctagagcacgttccagtttagtgggtaagcaggcatctctctgccatggagctcctgggaccacctggcagagaggcccagaaaggctcgagcagaccatgtggatgctctcccagagggagggctggactaatggctcttccggcctgggcgagtctctgcatcctcccgaatgcctacggttcacataaggaccatgcagcccagggggtagcaaacacagggagggcacggctggtgtgagagctgcaggaaacaagcaggtgacctgagaatgcctcttactcacccagcatccattcacattagtcttgtcttacagtacaaagtcccaaaagaaagtttgggagagaggctcttttgcccctttgcccaacaggtctccccctcttttcatgcttcttccaaaccctaacaacctccacactcaagaaggaagagcccaagatcttcactgcactctgaacagcaggagggtgtgtgtgtatgtgtgagtgtgtgcgtctgtgtgcttacacatgtgtgggaaagcctatgtgtttatgtggtttagcaaagtgtatccgtaccctgggcatgcagagctctgagaagaagagtcagttttcacagtgtattttcacattgaatttcacaatgttcacatgcctcctgagacattaaacaagactcctgggacttcccagggcggtgcagtggttgacttcaccttccaatgcaggggtatggtttcaatccctggttggagagttaggatcccacatgacttgtggccaaaaaaccagaacacaaacaacaggagcaatattgtaaaacaatttttaaatggtccacataaaaaaaatatttttaaaaaggcccctattctttctttccaaaattcaaaactaaggacatgagttgaatgaactcaattaattcagacccagagccatggaaggaaaaatcagtccttggaagaaaaactgctccgaagtcaaaagagttctggaccaatacaccgatgctgaccctaaattaacagaaagcatgaggatgtgagctaaggacagggatcgaactgtttatcttttattggagctgatttgaattggacttctgtggctcccatcaggaagaattttgactacatcatctctttacaaaacatcagcaagtgaacagtactgttaattatatttcacaggtgcggaaacaaaagtgcagaaaagtaattaactgtccctaacatataccacgacctgacttcatggtctgcacttcaagggtccctatgctctgctgtttggaccgtgctttttctctccatctccaaggtcatgtattttttccagaatatagtggaggactcaccccctttcttctcccatcatggatatatccaggtcccacctggtcagagcccaatgagtgaagaaaatgtagcttaaaataccgtgtctgaaagctgtcttgttagggattaattccacagaacattaataggagttactcaaaagcagattctggaatcaattagtttgggaaattctgagttaaacactattaaagtgtttggaggggcttccctggtggctcaggtggttaagaatctgtctgcaatgtgggagacctgggtttgatccctgggtcaggaagatcccctggagaaggaaatggcaacccattccagtattcttgcctggagaattccacggatagcagagcctaggaggctacagtccatggggtttcgaagagtcagacacggctgagtgactaacacttccacttttttcaaacagttcagagacggattttagcatcagactgaaataggtgtgagtcctagcttgattgtctattagctttgtgactctgtgcaaactatttaagctttttgtgactcagtttcttcatccacataatagaaatgatactagtccctgccattgtcagccaggattcagtgcgagaaacagagaacattgcaagtattttaagtggaaaaggattcaatacaggaaattaagagcttacagaaatccctgtaaagactggaggagaaaatcacacctccatgagtgatgcccagaaaaaaaaaaaaaggaagtagaactgactgtacctctaccatgattagaaatatgaagaaacttaaggcctttcaaataccatagtaggcactattcagggttcaggaagccaccaacaccattactggactggcccgaccattaaaaagtcagtctagtcactgtctccaccacaaccgcctctctgtacccaagatagcatctggtccccatgaccacacgcactggaccctaaaaatagccaacccaccaaaactcactccatcacttcttctttcccagtcttaccgtaggacatcttgctagtggaactgttttctcagctggaatcccacgtataagagagtgtgaagcatgccatttcagggctccaacctctgcatttcagaaagatacacaagctgaatgggacagcaatgcggttagcacaagttcctgtccctgaagcacaggaaggccaaacaaactgaatgtcagagtttggagcagagaaaggcttattgcagggccatgcacggagacaggtggcccatgccctagaaaaccccaagctccccaaagggttttggcagagcacttttaaaagccaggttggcagggaggggagtgtgcagggtctgtgagcagcccatgcccagttctctgattggtgagtggagagggaacagggtggtgtcacatgggttagcattatcagttcttaggctccaggaggcctggggctgtgagcctatggtcatcaagtaaatatcttctgtttggtggtgggttttcacatctgcaaaacaactcaggaaatgtgcatgaaaggctagtatctgggtacttcagagagcagctaaagaagaggatgtggaggaaggctgaccccccagccagccaaggcctcatggggtcttgctcagttggagtcccaggtgccaactgactacatccagctctccatgctttgtgtcattatgagattgaatgagatactgtgcaatatgcacccaatagtgcctgaaacagaaccccaaaacgtctgctgttccgtttctatcgttgtcatctgcagcaagatttctcagaggctttattatgttgacgtacaagtttttcctccccgatggtaaaaatagtaggaagactatatcttctattttcttttttcagcccagagaaaaattttagattcaattatagcacttgtatataccttatgcctatcacctttgtgttatttttacctctctttgaaactttctatctttatttttatttggtcccttttaattcttctttatgtcttggcttacagtaaataggttctggaaaggtagttaaaattctttatggtgtgcagcctggtataaataaacacatctattaagtgagttgataaatcactcgggcatcaagggcatgacttttaatgatggaaatcgagaatgaaggtgatattttggatggggttccttccctacatcgtccagaaaacaccacgtggtttcccatgggcttgccctcacctcacacctcagtgctgaattgtcctctaaatatgagaggagaagccactggggaactaaggtggttcccaactctgcccccggcat

SEQ ID NO: 57031 - DNA, 1425 bp, Bovine  19866881081268
tcctactgggaatgcagaatttacaagttagaaagacaagcagcaaaaactggtagtgcagattaagcatttaaaagctgctacaccactggcctcctgacctaaggactcacatgttagggtaggttggttatggaattggttgtattgactccagattgctcatcaaacccaagaaaactgagcagcgaggtacaccacgaatcacgcacaatctgcattgcagcagcaagtccttttgaggtatttgtttgtctcagacagaacccacagattagatataagaaaggagctcgccacctgccggccaactgtttactttatatctaagaactgtctcagaagctgtatatatcacaaaaatggcaaagtcctactaaaaccacctagaacagaatggccatttatgagggatattccaagtaggtaatataacataaaaggtggacctggaagcaaattccctgaatcaaagaagttgaaggaaacatgtgcttcacgctgtaacaagcccactctggctgctgtagagggaatgcagagcggctgcgctaatccaggggaagggctcttgacttggcctcagtggcgctgagattctgcccattctggaattgggaccaagtagattcggtgtgaggggcaggggatgggtggagctggatgggtgagggatgtataattaaagcccaatagattaaaattcctttaagaaatgagtaatacaaagattaaggcacatctgatacagcttcttgaagggctgctcaaagatttataggcagaggataaattggctctgacgagagaaagaagacgatgtgtctcagtgctcacctcttccagtggcaggtaaagtgtgaagaagaggaccatcatgcaaggtggccagtggccacctcctgtgccaggggcggggactgggcagagggcacagtggagtgaatgcttgtgttcccccaaattcctactgaaatgctaaagtgatggtattaggaggttagaaggtcatgagggtggatccctccctcagctccttccaccagtgaggagcagaggaaagtaggctgtctgcaataagggcccatccacgctggcacccttatcttggaccttcaagccttaagaaaagtgagagatgcatttctattatttatgagtcactggtctgggcactagctgtagcagtcccaactcagacagaaggtttgggagcctgaggtctctcttagaggagcaggctggagagcccaggagccctcctccacggagggggcacttggttacatcaatctcagtcagttcagtcactcagtcgtgtccgactctatgaccccatggactgcagcaccccaggcttccctgtccatcatcaactcctggagcttgctcaaacttatgtccatcgagtcggtatgtcatcca

SEQ ID NO: 57032 - DNA, 1225 bp, Bovine  19866881133797
gttcgatccctgggtcggaagatcccctggagaaggaaatggcaacctgttgcagtactcctgcctggagaatcccatggacagaagagcctggcaggctacagaccattggctcacaagaattgggcatgacttagtgactaaactaccaccaccaccatttcatgtgagtctccataatggaaaaatacctcaatagggggtcttgttggttcctggggattaccactcttgtatgtactttccctgcaacccactcaccccccaaatttgtataatattatgttgtaaactatttctagataagcagtgatatccactgggaggagatgatatttaggatatgaatgacaaggcgggtaaggcatgtgcgctctagggaagagccatgtccaggcctcgccttcccccaggcacaggtttgagagaccaaggggagactttggcagagaattgcaaacgggaccttgaagccgtggtgggtggagcggagggagataccagctggcccgagctgataggaaagagtggaagcagcaaggagtgggcggatgctgtttctgtgacattttcttcaagtggttttcttcctgctctaagattttgctctcctttaatccaacttagaatttgttttcccattactgaggatgttatataccatgtatttgtttattccctttcagcttacaccagaaggactcctacctacttcaaacacagggaatgtttgtgtatccatacatgtgttctttatgaatttgtgatcatgctcaaggtcaaggtaggaggtcatttgcatgtcagttgtggagcatttcaggagaccaaggctgcccctggctcttctctgtgtgatgaagcaatgcagaagggtcacggcagctttgccaagtttggtcaaaagatgcctcctgttgctaatgagcatgggcttgagagtcaggagacagggttcaaatccaagctcacccactacgtgaccttgggcaacttcctttaccactcctggtctccatctcctcatctatataacaaagattctttaaatgagcccaatgcatgtgcactaagtcactttagtggtgtctgactctgtgagaccccatggactgcagacttccaggctcctctatccatgggattctccaggcaagaatactggagtgggttgccatgccctccttcagaggatcttcctgatccagggattgaatgcatgtct

SEQ ID NO: 57033 - DNA, 1472 bp, Bovine  19866881157904
atgtgcacgtaaaaaagttaccaagggctttaccttttggtttaattatgcactgagccctatacagtaatatgttcagcagtttaatattaatacatgataaaaatactaaagctttcctgaagagaaaggtttcaataaaacagaaatgttttccagtgtctacaagacaaatagaggtaagaaagcaaattttcaaaacgcgaagaaagagctgttgtaaaattatacattatcaacagtctgcattgaatgtcggctgtgagaaaagccctgtattcttcagctctgtggggaaacccaaaaaaatagactcagtgcatctgctcacaaggcatcaacatgcaaataaggaagagaaaagccaagtgatgacctgagaatacgcaggaaaacactcaatgaactgagacaaatataaccaacggtgaatgctgtaaaaaggctcagaagtttgaggtcctgcaaaagtttttagaggacagttctgactaggagctgtgacgtcactcagggtggagaacaggaagctggggtgggggggtgttgagaggagagagacagagtttatacacacatttcttcactacagagaaaactgaaaatttctaggttatatactgctgggcggtagggtggggcggtggtgataaatttactctcaagaacgtctacagaatttctaaaggaggaaatcagtcttctgaactgctgggaagtcaaactctagcctacttggaaaggcaataaagaatgtgagttcactgacagggtaaaaaccagaaataagaatccatagtggaaaaaaaaaatttctttttaacagaattctctaaggcccagcagcagcagcagcatcttaaagtctggaagctcggctggcatctgctccaggatatcctgttttgaagagagcatcccacactactcggcatgaaacacgcattcgcacagagcgcagtgaaggcagaaccccaaagattcctggtgttcatccacacactttacaggcacgccccccaccccccccaattctacctcttaagatgtaattacactgaaatgacgtctgcgaatagccggtagcagcaaacatctgactgaaagcttagctgtgtggtacagcttccagtcggggatgtttacaacaacagaccttctgcacaagttaacagagggcatcgacacaagtattgctggtcaccatctctaaatgcttgttaggccttttagtcctgaacactatctgtgacattttgggacaaaaaaatgaaatgattaatgaaattcattagcaagagataagtggtttatcaacagcaatttttcctgaataaattattacaaaagacaatatgcattgtaaagttatcttggcaaattagtaacattaaagatatgacccagttattctatacgaagatacactttctatttgatatgtgcaaaaaatgaagttttctctcccgtac

SEQ ID NO: 57034 - DNA, 881 bp, Bovine  19866881176737
cagaaagccccaatttatactcaaatggttggaaacacatccattactcattttcttcctttttggaaaaaaactaactatgttgaattgcactgcatcctttaagttattcttagaagaccagtgttcacggagatggttaacctctgctattcacatggccactgtgagttctacatgctttagtgataatactgttctcaccatcagatttatttgctaacagaggctcttctcaatgacacacgctcagggaatatttgtgacggtgactctgatgaagaacagttggctcagatgacattataatcaaatatcttcaccaacacactttgagaaaaatcagtcgaatttcaataggcacatttcaacaaaaaaatacttttgcattaccaggctttcttgcttgggctaagaggaaacacttttatagtgcacatactattatgcccacttttataatgggtcattatttaataaaaataatttcaacatatatcataaattgagtttttcttgggcctaatactgcactggaataccttcattttagtacacataatctgaagaacattgagtattctaaggactgaaatatatagtttctcaaaaaaagcaccagttgtggcagaaataaaagaacaggtttcatctcttctttgtttaaataggcaactgataggacttctttgcatcttttattctggaaataatggccttagatactaaatgttaaatgaaaattaaaataaataaaccaaatgggtcagatataaccagcaagttctatacaaaaagatttgttaccacaaacatatttcaagtaaatcattaaaaattacgtttttgagttctaaaggaatgacaagccttttttagag

SEQ ID NO: 57035 - DNA, 726 bp, Bovine  19866881198708
cggtgggtggtgcccactcccttggtctggatctggattgatgagttaaaacaccatcagatcgggactttactggtggtcctgtgggtaagacgctgagctttcagcatgggggactcaagttccatacctggctggggacagatcttgaatgcagcaactaaagatcctacatggagcaatgaagatcccacacagccaaataaatttatatataaaaaagactgtcagaacttcacaggccccaaacaaccctctccaatattgtcctttatgatgctgaaagttcttctgtctccttttgttctaagaaactttgtgcctgccaaacaacaggaaacgtggagagatagggagaacaaaaaataattaatatttaatctccttatctcctgaattttgtatatattattatgagatttttaattaaaagctcatctcagattcagtttctctattaaacagggtaaagggagacgggtagggtgaacaacatgacttaagtttagaaaggtacgggtttcattgactgttccctgatcctctgaaagacggtaatggcacacatcagataactgggaaggatcttcagctttctgtatttcaatttctgaggagagatcagtctggtgatgcactgagttggactattaattaactattgaaagcaaagaagaaaatccaaatcattgctgctcttgtggccccactcgagtgatggtagga

SEQ ID NO: 57036 - DNA, 1430 bp, Bovine  19866881235899
ctgtagacacctgctctactataacctcaggactctagttatacggctaacttgagaaatcatatgaaagcacgttcaagcctctgttcccagtggcaattggcaataatgagtaagtcataaataagcctcatagaacaagaagcatattgttttgtactaatgccaggagtaagaacggtcgctctcaaatatgaaatagatttgtgtcaagtatgtaagtcgttacgcacaccaaaacgtgttcatctttagcctcagctataccttcattagattcaacctgcttactctgtttttaatgatgaatacaagagcaaaaagaacatttgtgaaatacagggtacatattgtaattacaatttgtgtctagatactttatagaatattcataattgattttattagaacatacttaattattcaacttctatacgtttagttttcaactgtcttcaagaacacatcataaacaaattacagcatttgacaaaattccctaacaaccctgaagaaaagattttatatattatatgtgagaattaaatatagtagctctgataaagatgtcagtctttttgtcaacctttaaaaaagaaaaacagggaaattgtttgaaggagagacttgcaattgctggttcattgcaactcagtatgcagcatcctaattagtcaagtattgtgtgcctacctgggcatgaaataacttttttttcctaatttaaatctggaaattttcaattgcagaacagcttgaataccctttgttggaaatagccactgggttcttttttttaagtatttgtcttcagaaacaatgaaggtcatcttgtatccatagagaccacatgcactttcctcattatttctagcattgtttctgtaatgggtagttatttatgacatttaaagcaaaaaaaaaatgcagaaagcaacattaaatattaccacagtaaatatcagtgaccgaaatcacttactccatagtttctcaaagaaattaattaatattagaaaattagtagcctttcaaaattgtgtgtattgatgtgttcagtagttatcctgtagggtgtctgtctgtgtgtgtgtgttcatttcttggaaatcactgaaacttaattgtatactctaattgttttaactggggtttttttttttttttttaagaaacagtaacttcacatactttagatgaaagcaactcttggttttggtggcgtgccgattttttttgtcacctaatcttccttctgtctttcaggaaagtggtgtggtagcaaaacgattttagcctatcactgcttataaacaaagccgaggtcaggagttcgtttgcttattacctgccttgctttgttatctccatggcctgtatgtgcatctctaacctaactcagctgggcacaggcgaagaaggcatagagt

SEQ ID NO: 57037 - DNA, 1339 bp, Bovine  19866881252189
cctcctgaatgttgacctcttgccttgcaatctggcagcacctcctactacagggaacagagtggtgctggcagtttagtcactaagttgtgtctgactctctgcaaccccatggactgcagctgccagtctcctctgtccatgggatttcccaggcaagaatactggagtgggttgccacttccttctctgagggaatagagtgtattttcccaatccttggcatggttcaacaatatgaccccctttggccaacagaatgaggctcaaataactgtgtgccagctccaagtccaggctctgaagtctcctcccatcagcatgggaacaacacaccccggacagcccctgtcccagaggaagaacaagggcctcaagggcacggaatcaaacctccccagccaaacccggtccaaatcaatggactcacaagtagtgcacagatcagtgagttcaatgcatgttccttgtggtacgctgagcttcagggtggatgttcgattcatcacaattgtagcaattagataaaggacgcagtgaacctgcaccgtttacagctgcctatcgaagcatcagctttctgctctgctaaatggagattgtaataattaccgtcctagacgcttcatgacaacaggtgtgaaagccgcttcacagatgatgacgcaccagacacacgtgagctcttcttgcctgttattaattagagagcgatgcacgtcgatctgttgcaaagagctaaattgagcctaatcaagtggtgggctggggagcgctggcaggaaggcagtagctagggccctttggggacagctaacagacatgtggctttgttctcagccacagcttgtcttggaccactcatccagagaaggcaggacaggctggattcttaggcgccagccttgggcgatttgcccagaagaacagggaggggaaagatgcccccagagtgggctcggggtgtgggagaagcatcctgaaagggagtggccagggctttcccaagggcacagtggataaagaattggcctgccaatgcaggagacacaagagacatgggttcaatccctgggtggggaagatccattggagtaggaaagggcgacccagtattcttgcctgggaaatcccatggacagaggagcctggtgggctatagtctgtggggtcacagagagccagacacgactgagaacacatcatgagcacgaattcatgagggatttctcagagacactgccttgctcgtcacatccaacacttaactaattggactgagagacaaacaagaaaggcttcagcatttgataaattaatcagtgagggctgcagcaaa

SEQ ID NO: 57038 - DNA, 804 bp, Bovine  19866881260086
tctgtactgttttaattaaatttttcgctatggaaaacaagataattgaagcagtttagagattagttaactgtcaaaaaattataccagcagtcactgcaacgggaagatttgcgtcagtacaactctcattgtactcaaactcccagactagtcacataattaaaacttcaggtgagctctcagaagaatgaggaatgttccttcactgagtctttaaacaaaagctatattaaagaatgacatgtacattttaaagacatatttggtttttccctaaaggctttcactgatgttcctcgttgactaaacttcagaagggtttattcttcgggcagatggagaaacagtgttccctgtggtgccattttacagacaaagacactgtctatgtagtgttttctggagacaagtttcttcctctatagctttaatgagcccgatcgagggacaggcagaaagggtggcctgcatgcacaacacagtgaggtttctcccattcaaactgtctctatgacacttcaaaccctgggttaggttgaccaatgtcagaagccccatgaggaaatactagttgcagaagaactagtgacaccagtaacttagtcatagactgcttgctctagtaagtctcatgtaacaacctttatatctgaagtgatgaaataatttcccattcatttgataatttctctgtttgcaaatacagagttttaaattagatggaactggcttgtccaggaagcactgggtcttggctaagagtgtggctctcaagccagactgcccagctttacattccag

SEQ ID NO: 57039 - DNA, 871 bp, Bovine  19866881261074
acagcaggggaaaaaaagtgaatacagcctgtctctctaggtagtaaatacacattctccagtgttgggtgctacatgtggtgggtttgtttcaacttaggagatgaggcttaccttatcaactcaagaccttttatcaaatgggggaaatttcagctacggtttcttcacatattttgcctgctccttctctcttcttttcttggatggcagtctcaggttagatcctcagactgcacttgccagcctttgtgcctagtgcaggactctgcagcacactcgcaggctgccatgaggggtttaaactgtcatggggccacctcagagatctgcagcttccagacgctgtgtgaactgtcagcgtatggtgatcatttgtcatcttagcattagatcatgccccactgatattaatgatactgtgtttttatacggctggcacatcagcagctgctgataaattctagccacagtcgcgttgactagtgggcaccacgtaacttctcaaccatgggatcagacgggacatggtcaccctcattttcgcatcaacactaaccttcacgtggtacctattctctttttaaaatggattatgaataatatcatagatactgaagattgttttagtgagagaaaatgatatgtttttctccacagtaggtgaagttatgagaaatgttattgggaaaactgaatagttaatatatgggccataaatatttcaccagcatatgatatgatttacattaatctaccaatctatattaaaatgtccttttttattattaaggaaaggctggaaataggaaaaatgatctatttctttttctactaaattataagtttccaactggaaaaaaacctgtta

SEQ ID NO: 57040 - DNA, 987 bp, Bovine  19866881386569
acggcagcccaccagggctcccccatccctgggattctccaggcaagaacaccgggaaatctagtcgtctgtaaaatcggggtaatcgtgccaatcctgcttccctcgtagggtcgctgccaagccccaatgagatgagtgtgtgacaatgctttgtggattgtgtggttgcagacctgtaagctattattatttccccagctaccgtcgttaagggctcagcggtgccctgcaaccaaatcttctaaggaaatctaagttctcactgagaagcaaacaaaacaagttcattccatcttggcaacaatcagaaaatcagacggaataaaatccttgggagagaaaaatgtcttttgccagaactgcagcccactcaggaactttaagttccaagcttccaactcagctgaaacctcttccatttctagctcttcttgtcattggaaaaggcaacacagtgagtgagggaaatgtcccttactaggagactttctggaccttttttgcacttgcaaaatagtatcttgaatgacccccaagtgattcagaaatgaggagacttcactggcttattaacaccatcaatgcttcatgcaacatgtagcatggatttttcctcctctttaaggagacatcttcctgtctttcctgccttggaataaaatgcattttatggatttcagggtgtcttcttctttcacagattacagcagttctgaggatgttcaagggtgcacagattaccactagatggcaagcctcaaatttccagctagatttatcagctgcacagaaaaatccctaagtctccaatgcaccttgtgggtcctcttgcgcctgatgcttctaagaatcaagtccatactttgtagcatcacattagtgagccacccagctccgactctgactttcccttccgccagctgctgtttctcatcactctccacggttatagatgcactgtcctctgaccctacagaaatactc

SEQ ID NO: 57041 - DNA, 1861 bp, Bovine  19866881491288
gtctcttaactgtcattgtgttattgatgattttatcttgcttaaagattgattcctactttttaatttgatggaaatcaagattttttgcttcaaaaaatagaggtatagttgtgcaagactttggaatcaagactttggtccaactggtagctatcgaccctcaatgagttattttaagctctctttgcctcagtctccttgtctacaaagtggaagcaatgcttactttatacagaagttgtaaaaaattagataatgtgattatcgcaaagaagcaaagggagcaaatataggtgctgcctgtaaaaaatcccccatgagatcctctctcttgctctttcctttcttcttctcgaaatgctccaggaaaccatgaaattctttcacgtgaccttctgactacatggaacaggagttctaccgtctgttccacaggcgcaagaaattaagtgttcacttgcatcaaaccacggagagttctattgtatatatcagctagctattgtgtgaaacaaacccctcctacacatttagttcccactatgaactgattcatgtccctcagaattcttatgttgaaaccctattgcctaataggatggtgttaggtcatgaaggtggaaccctaataatggcattaacgcccttctaagagacaccagaaagctctctctctgccatgtgaagagatagcaaaaagacggcggtccacaaaccaggaagggaattgtggcaaatgagttcctgctgtttaaaccagcctgtctatggtactttgtcatagaagcccaaattgactgagacagtggcttgaaacaacaccatttgtgatatctcacaaatgaatgagtcatttgtgacgtttagcttactctgaatggactggacttggtctcagttgggctcactcactcatctgaagtcaagagccatgccagctgtgggctgggtggtctggagtggattacgccgggataatcccacttccttccgtgtggtcactctcactccagcagggtagcccaggctggttctcatggcagtgacagggcccaccagacagcggggaagcacacgtggcctgctgatacctaggcatggaccactatctcctctgcggtattccactgaccaaagcaagccccaaggccagccatattcatagattgaggactagagccatctcttaatgggaggagaagcaaatcacattgtgagaggtcatgagttggggccagttttacgatgaacctacagcatagcaactagggtcaccttaactagtactgtcacaaacagatggtgatgacagagccagaattcaatttcagacctgactaacatcaaaatcagagccctttttagaataccataatactactttaaggaatacaaaaacaactttgatgaaaccaataataacatccaaatctacaaacggatagaagactgtctcttcttcctccccattatccagagcatcttcaaggatgctgaagaggtggaagcagctctattttgttactttccaggattaattcttcagatgtggagtcacctccctaattagttctaattagatgcatagttcatgtcaggtcacaacaaacccaaatgtgaataatttaagaaggattcaaagtcagtgacaacaaaaccagcttcatggctccctgggcgatggctagccttcctccacatggattgccaggtacctagctgactttgaataccaaacatgggctgatcttaatagaaagagggcaaccatcatgcattcaatggcctcagggagggacgggaggaaggagttgtaatttccttcacttctgggagtgcttggcctacactgacatta

SEQ ID NO: 57042 - DNA, 1496 bp, Bovine  19866881534301
ttgagtgcctgctaagttccggaactcttgtttttccctgctttattatggtatcattggcaaataaaagttgtacatatttaaggtatattatgtggttttgatatatgtatacattgtgaaataattatcacatgaagctcattaacatatccatcaactcacataattaccattttgtttatttgcggtaagagcacaagatctgccctcaaatttcaagtatacaatacaatattattaagcatcatcaccatactgaatcttaggtctccagaagttatttatcctgcataactgaaacttctaccctttgaccagcatctcccgactcccctcaccctcctgcccctggaagtcaccatattctactctctgcttttgtaaattctacttttggagattctacatgtaacagagatcatgaaggaattgtctttctgggtctggcttatttcacttagcataacactctctagtttcattcctgtccttgcaaataagatttccttctttttttaaggttgaatattttactatattttatgtatgcataagcatgactgagcgacttcactttcacttctcactttcatgcattggagaaggaaatggcaacccactccagtgttcttgcctggagaatcccagggatgggggagcctgctgggctgctgtctatggggtctcacagagtcggacactactgaagcgacttagcagcagcagcagcagcagcaagcatatatagctattgtcaaaaagacaaaagataaatcttggtgaggatgtggagaagaggaaacacttgtatactgttcggtgggaatgtaaattggtgcagtctttacagaaaacagtttgggacgttcttcaaaaaattaaaaatagaatgactgtatgattccacaatctcacttccaggcatatatccaaaggaaatgaaatccaggtactgttttagactttgtggatacagaattgaatagaatagttaaaattctaccctactgaaatttacattttaatgagaatacagacagtaaatatatcagccagcaagtagagagcatggaaagccattgtatcaaatgagttaatttaatgggacaatgtacaagaaggagaggaacaagaacagtcctagacccttgactttacaggttaggaaaaggaacagaagagtgtgagtttcctagaaaaccaatgtaaaaagaatttcagaaaggaggaagtcatgtttgagattctggccttacctccccctctagtgagacagatcactagacttccaagaatcgaagtttagtattgttcagaggctcagtgttttttttttttttcctccttaaatggggcccctgaatgttatcataagaataaagtcagtgaatgaatatggagtctctttataaattgccttatggataacacagaccatcatcatgcccaccagaaaatctgtgtgcccagatttggtttcatacatttttttt

SEQ ID NO: 57043 - DNA, 1334 bp, Bovine  19866881546844
caggggtctcattcgaggtcctccaaatctgacttccacctacttttctgccatcattccttgctgcctctttcatgacagtctcctgacagaggagacttgagtatttgactggttggaaaattcttcctagcttcctttgagggtctttgtgtgggcctctctccccatgtgaagcctgctcacaagcccatttagcacctggatatttttctgctatgatttgtttgggatctgtgttgtgtcttgttcttctggctttcaactcaaatgtaaactttttgaggacggtcttttcctcctatagggtccagataaaaatgcctgcagcaaatgacaccacaccaccctttaaaagaaatgcccaagattgcaataaggccggatcgacctgacctttaattatgtgtttgacttggaaattctttaccagtcatgaagcctcggtttcctcatctgaagcatgatcattatagcttctggctgcatccttgccagaatcagacaagaaatccaaagtatttagtgtgtgtggagcaattctcactggaaagtacttagcaccatgctaatgggtgcccgtggtctgccgccttcttccacacgtcctcacatataaacagggacctagtagtactcttactctgggaactagtactttacctgtaatacaatctccaggataaaactttacattaatgcacttattaatgtattaatttatacattattacttacaaagatgaaatatgctacttattatttataaagaggaaaaaattggtgtacaaaaaatagaggaggggtgtatgtgggctgcaaagttttcaaagaagatggagccccagagctgaaagatcaagaaagtgcatggaggaatccgatgaccgaaggatcagaaatgaaaccctgcatcggaggagccggcatgggctccttctttcctcttccagctcagtctgcggaaatgtcacctcgcgggaaaacccagggagcgctgatgctttgaagggttttcagaacattctcacctgctgtgagggtggggctgtcagaggcagcgaagagcacatcaaaaccctcggctgtctggagcatcagcctggcaggggtttcggtctcgctggatcagtttggataatctcaaagcaagaactcggccattttgttagctcaggaaaagaccctaaggtttttcccaaagtcaaagcagaaataaagaccttctctgcctgacaaggaaaagagtggcccagaaaactgtggacaggggctctctaagagatgccgggggccagagttgggaaacacccttagttcccccagtggcttct

SEQ ID NO: 57044 - DNA, 3082 bp, Bovine  19866881716867
aatagaaatctaatagcaagggacttgcaatgaagtagataataggcaaactacttatgctggatgactaagcaggctctgcggagttggagccgatgccacaacaaaacatcacaaactgagcgatttaaacaatagaaatctagtgtctcacagttctggaggctacaagtgtaagattaacgtgttggcaagttggcaacctttctcctaggctgacttcttaatggttttctcacagtctttcctctgcttgtgtctgagtcctgatctcctcatctaatgacactggtcataaacagggccacttcagtgatctaaccttaaaaacctctttgaagactttatctccaagtatgatcacatgctaggtcttggggttaaaacttcactatattcatttgctggttcagtccacagacttcgctggtggctcagtggtaaagaatctgcccaccaatgcaggagacttaggttcaatccctgggtcgggaaaatcccctggagaagcacatggcaacccactccagtattcttgcctgggggatcccatggacagaggagcctggagggttacagttcacagggtcgcagagtcagatatgactgagtgactaagcaacaacaaccaaaagctgagtccacaaaaaagccatactgtgtgacactaagatggggaaatgtgaaagcaggaatactgctctaagtggaatagaatcaggatgtctgtgaaaagaggaaccaaagtgccataaatctaagtggaaaggggcagctcgcaggtcttgattgacagtcgtctggacagtgggcttgttcaacactatgctgtcctgcatcctgactcccacagcctgggacccagggcactggctgggcggggaggttcagaagcataaggagccccacgttaatctcggacaacctcttccagtcgacactctcagtcagtgttgtactcgtaagatatctgtgatttccacgaggttgatgacattgtcaccacctgacaacagaaaggaactctctcaggcagcctgagatcgcatggatgcctctgccaccagatttgtcttcacgattgattgaatactttggccacctgatgcaaagagccaactcattggaaaagaccctggtgctgggaaagactgagggcaggagaaggggacgacagaggatgagatagttggatggcatcactgactcaatggacatgagtttgagcaaggtccgggagttggtgaaggacagggaagcctggcgtgctgcagaatcaaacaacttagtgactgaacaacaagttcccacctagacagtggtctgttaatgacctgttatgtgttgctcttccattttaaaaggcacagtgatgcatcataaaaatagtgagtgaaaaaataattacatgttcctgaaactgcttagtagtttatccttgaactatcaaatcattgcaattaattacttggtaatataacttttctttttttaatttcatgttaatgttccaatttactagtcacaaaagatcctgacatcactgctacaccagcagggtggatattttaagcagttttgacaatataattatggtgattagctagatatttgctttctatcagctaaatgataacaccttgtcctgagaacctgtttcttggaggaatctcaaagatgtttatcagcaagcattatttatggggagggtggggtgggtcaaaggcccccaggttgaggggctcacatttcaggttgacacgaggccagtggtagttaaaggagaccctagcccaagaatggcactcaggagaagcagatggtaagatcataaaagcttcatgtcaccagggagcctggtagcgggggtgtggtccctggatcaggggcccttgggactgagattcttatttctttaggctgtgctgggtctccattgcttgcaggctttctctagctgcggcgagccagcgctgctctgcagcagtggtgcgtgggtttctcattgtggtgccttgtcttgttgcagagcatgggctctagggctcctgggtttcagcagctgtgccatgtggcctcaatagcggtggctctcgggttgagctacaccgcagcacgtggggtcttcccgggtcggggattgaacccatgtctcctgcactgggaggcggagtctttactatcaagctatcaagaaagcccaaggctgagattctgcaccacaatgtcaggaatttgggcctctaccatttctgagaggccagtattagagcccaatataacagacaggtaagttcctgaaagtctgctatgtcccaagaagtctaagccagatatattgtgtgctcttgtgctaagtcgcttcagttgtgtccagctctttgccacgctacggcttgtggcctgccagactcctccgtccatgagattctccaggcaaggatagtgaagcagggaacccacctgccaatgcctgatatatttaccttggcagtaaaacaagcaaacaaaataactcttactttaaatgcatagccttattagcaattaaggtaacattaagtaaaagcaacttctaatttaccatagaacacctattgaataaacagtaccaaacagatgctgtcagggatggaaagacacacgagtacactctgcctcttttttctggagaaaggcaactcaactggatctataaaactattttctttgacttttaaattatttcaaatggaatcacatggatgaagttctgagtactttgcccagcacttagcaggtcagcaaggaaaccatgtctcctttcctttgggtactgccttagctcagtctcctggaaaatcaacctgaggcacagcctaagtgacagtgtttataaggggataaaaagcctgggtagcaagaggtgggagtttttgtttttttagtttttttttttttttttaataagagaaataattttaaggtgggagctttaggatgaaagtttcttttcttactcagggtatgatgaggccaacagatttggaaatgatggccacagtttgttatttccagttcccagaaggaaggacacacacgg

SEQ ID NO: 57045 - DNA, 1697 bp, Bovine  19866880398421
tgctggatttataagttgaaacacatttttcctttggttttcctaaaaccagggtagtgctaagttgaagactaagtgccccaattatgaaaaaagtagaactttcaagcaaatcttggtacagttttctgatatattgaagttttgaatacattatatctgaaacccaagcattatttcttcctataatttaccttgaatgtacagagtcagaattcagcaaattgtctcttaaaatgcctcatcattttcttgtcttaatgaagcttacaaagacaaagctcttaaaaactgtgtcaaagaaaatacccaaatgcaatctctgcaggatgaactcagacaatattttcctgatgttgttcctgaaaatgctatttagaaggttataaggaatccttttcttactaatattgagtcattgccagattttaagaggggttttagaattcaaatttgatgtaactgtcaacaaaatatatggaacatcatttcagagattttgggggacaaactatctctgtttgtaacaagagaagaggatttgagtgccatctattttcatcagcatacatttgcaaagttctttttttcccttgtacttctgcctctgaaagcaaagtagtacagtgggcgcaggaacggcctttagtgtcattgccaaatacttctctggttctttgtttttcagtacctgttaagattacatttcctgacttcctctagcttgcatgaggctgtgtgaatagttctagccagtgagttacgagtgggaaggagacacaccccttgcagctgaacctttaatgccaaagtgagacactctagaacactctttcccatggcttcagttacttgccacataagtttcctagaagtgtcattaaaaattaccacagaattgggtggcctaaaacaacagaaatttattatctcatagtttaggaggccagaagaacaaagtcaaggagttagcaggcttcattctttctgaagattttaaggaagaaaccattccatctatgcctgtgggtgagatcctggtgactgctggcaacccttggcatttgcctgtagatacatcacttcaacctctgcctccgtcttcacattacttttctgtgactctgtgccctttcctcttcttataagggaatcagggattgaatttagggtgcagcctaaatccaggatcattttatctcaatattcttaactagttatgtctgcaaagcccctgtttccaaatatggtcacattctgaggttccaggtgggcgtggaatttttggagaagacaactcaacctactataccagccatggctcagacacatgatgctccatcaacccaggacctggagtgaagactgggtgggacagagcctccgccagcttacgggctgagaggataagtgagaaaagcatctgtgccacaggaagtactgagattttagagatgttcgttatcaagcatccctggacagacacaagactgatgttcaaaatgacccttttaagtgtccaatcgtccatctgtcctggtgtgaaaaagtctattttaagcaaatagactcagtggtcacattaacatcaaatgatttagatatataaacatatttttggaatttttatatatttacatattttttcttataaaattcatctgcttcaatattttgtcaaaatattagtcattcaa

SEQ ID NO: 57046 - DNA, 1064 bp, Bovine  19866880678190
tttcccaggagatggactcttggtgatcttttttattcccacttatacctagaagaatggagaaggcaatggcaacccactccagtactcctgcctggaaaatcccatggatggaggagcctggtaggctgcagtccatggggtcgctaagggtcggacacaactgagcaattcactttcacttttcactttcatgcattggaggacgaaatggcaacccactccagtgttcttgcctggagaatcccagggacgggggagcctggtgggctgccgtctatggggtcgcacagagtcggacacgactgaagcgacttagcagcagcatacctagaagaaggccctgaacacatagtaagttcctgataaatactcataggaataaaatgtctaacttactagaaataatgggatagtgtagcctcaaaaatcagcatgtgtgttttcaccagcttttatctagctgttgtgaaacttttaactgaaaggggaatataaaaaatttagaaagagaatgagacagaaagagacagaggaaacaaatatatttacttgatgaactgaattgcaaatgggtttctgttgtcaatattaaaatactatgttatttcatttggagaacacagtaactctttgattgcattcagagatataaatccctgtgcatatcatcatgaaatagtattctctgaaatatgggtgatgataaagattctttgatttgagatgtctattcagcctcattccacttctctctgcagagcagcagttattcttgttagcagagatgtcagaggattcatttgaattttactgatacctttttaacactctactcatccaactgtgaacagatccttgtctatcaattatgcaaaaagagatgtcacttgaggtaaaaccaatatctcaaaacaaactgcttccagttcctgacactgtctctcctttagtgagacttaagaatagttctctgagtagctttattacttatatttatagttgaaacccactggtacgccagaatgtccatgccttccgggaagtacataggaccgtccaca

SEQ ID NO: 57047 - DNA, 2332 bp, Bovine  19866880788543
aatgtatgctactatatttaggggcttccctttatagctcagttggtaaagaatctgtctgcaatgcaggagacctgggttagattcctgggttgggaagaccccctggagaaggaaatggcaacccactccagtactcttgcctagagaatcccatggacagagagcctggcaggctactcttcatggggtctcaagagctggacatgacttagcagctaaaccaccacccacccaccatgctactatgacatagaactgctgtaacttaatagaaaatatgattttggaaagaggtgttcttcaggttcaaaaaacaaaaattattataaattaagaaaatgaaaagagactagggaaaggccattggattcatcattagcaaacctacaagtttagtgacattaagtgtagatgggaatgtgaaatctatccactgaaagtacaaggcgtatttggaaatattgatgattttagccagtcaaatctaggttaagagaaatggatgctcctccccagttgaccaattaaattcaataaatatgtattgagcataaaacacaatgcttaatgctatggaaaacattgaattttgaaagcatcattcacgatgccataaagcacttgtattttggaatgcagtatttcagttgcttcaatgtatattttggtggctttgtaggtcactagtcactttgaataaatgtcagtgagaaagtgctggcatgtgccaaaagcctgtaatcaaaattctgcctcatctgttgcatcctaaaactacctcaagatatgcaatatttattttctttgatataacaactttttgaccatagtttaaaaatgcattttaagtatttctgaagatgttttctgcaggcatatcaaacaaatttgcactcttggcagataaaattagggctagaaagattagatgacttggctgggcaatcaaacagcatttgtgaagggatagatcagatttgcagaccttttacctggcctaaaaggattcttatattttggtaaaatatatagaaatacataacattcagagacacccacctcccccaatttataatgcttcaaacccagtaaaagtttatttttttctgataagaaagccaaaggtagatatgcttggttggtaagagtctgactttcttgctgttaatgactcagggacacaagctccttcaaaattgtgacacccgcccccacccaattctgcagttcatgacattttttgcattcagttgatggaaggggaagcagagtgagcaggaacactcatttccaaaaggccttgtctggaaagtaaaataaatcgcttcttaatattcctttgatgataattactcacaaaaccacaacttcatgaaaggggggctgtgtgggagaaaggattttatggatagagagcagtctctcccttacattgcaagtgagattttaaaaatcaataatttaattcaacattttaatagtaattctaagctgacacagctagaaactagttgctaagggagatcacggcatgatccttaagcccctttgattgtttggtttcattttacaaatattatgaaacctcatggttttctctttagtggcacttctagcctagtatctaatttattgatacgcacaatttctcactgtctgtctgaatacattatacaaacatggtaacataaattctgcaggtgtcccatcactactgtaattatttgtcatgttctcacctcttccttggcttgttgatgctttatcgtgcaagagagatatttttggtgaagaacttttatgcaaggagtttcattaacaagaatgaagcacatctcttatcagatttgttttggctggggggaggattaccatggatttcccgtagctggtaaagcgcaggtctgcaggacgagcagcagagaccagcatggaggttaccgagcaagcgtctgcatctctgctgtcgtcggccctgggtgcttgtgtctgcagttctgcactgtgagatggtagatgccaattttaataagggaaagaaagacaagttgtgctaatatgcaaatatctgaagcattctagtggagctgagctgattaaattgcttattatgctgaagactcaaacagaagaaagagagaagcaaggatttttttccccaaagcagatctgatcatagacttatagcctccaggtggaatatatatcctgagtactttctctgagcaggagtagacactgctggattttatccttgcatgtcagcaactgcagtgagagggaatgctcatgggtgcttctcctgggtcaaaaattcattaagatttcc

SEQ ID NO: 57048 - DNA, 1246 bp, Bovine  19866880964861
tctgggtcctaaatttgtggcaaataaaagcatcaaaaactgaagcttcacaaatctaaatgtaatttttatgtgcaaagaaagtttgctatttaaagcaaatctatttttctaactacatccacatttaacactaattttaaacaactctgtgttttctcatgcatatttagaagcaagcagctgcacatatgtatacaacacttggaaatgcagcttgaatattccttaaaatgccgggtttccatgtcagcaacacataaagccaaactcactgactttgacctcacgtactcactgttctctccagccatcaggacaatagttttcctttcttggattattttttagaagagggaattctagcaatttttagtttgatcttgctgccttttttcccctgggaatccgtaagcacttccacaaggccagatcaggactggttccttcatcacagtggttgcaaacacaaaggctaatttggtagcatattacacaactcagagatcaaaatgatgcctgtttttgtaaacagggaacacagccactctcattcatctatgcattgtcttttgctatttttcctatgtttttaaggaagtgagacggtgaccatatgatccttgaagccaaaagcatttactattttacccctgaagtaaatgagttggacagcagtaaataaaagtgaatggcagggactgtgatgaactaataaaggtgttttacatttgaagggcctagcaattactactatgcagaaaaaagcaggcacagcttaccaaattcaatatttgaaaaaaacatagaaattcagatttcatatgaaatcttcaaattgttaagtgtcagctactaatccaactttttaaatgaacgaaaccaaacaaaataatctactgccttgatctatccttttacaacctctgaagtaacccttaatagctacgtggtatctctgtgtgtctcagtttctcatcagcaagctgccaactctccaaaaataccaacaaagtaaaccctgataattaagcagaactggaatttttgcttgccttcactaaagaaagcaagaatagagtccaggtcctgtcttggagaggggagagaaaaggcaataagattgggtggtggtggggatcaggggggagcttggggaggtcctgttttaaggtgtgtctttcagggttgggggtgataggaataaagcaaatctggacatagtgcaggaccaggggcacaaagg

SEQ ID NO: 57049 - DNA, 1301 bp, Bovine  19866881387618
aaacatgaggtacagtcattctaattataatgtgaagtactgtcccccactgtaagaaaaacaatctctcaacttattagggaagttgggaaaacatgtctcttgccttaaggatttaggtggaatgcagtagttttgcttataggacaaatttggcctgaagacattttgttagcttacacagagttgtttttttatttgaattacttacaaaaaattaaattggagatctcacacatagaattgcgttttctcaggaagaaagaaggaaagttctaaggctgaatttccacatactaaaaatcaaacataatgtcatattgtctcacaaattcaaagagcaccacttagcttgtatctgatttagaaccattattctaaataatatttaaacaaataattaaaacattggcataagtcctccatgtaggtagggaatagtgtggatagccagaagcatagcaagtagaagaaagcagtggtcccagaaagagatgcatatgagcacagtgatacagagtaaggagcaaaacacattccaaagatacccccacactcaaagtcaaccattatccctccaaaggtgaaattctaggatgctttccagtgtgggaataattgtatttctcacgaactgttcttcctctgttatactgtaatttcctttagtgactccaaccttttaataaaattggttatacctatgaaggcttgcatagcggtgctttggacaacaaggaaaaagagaagtaaaggttggtgtgatttttctgatgtgcaagcatactctggaaggggttgtatgtgggagatccaagtggtgttcatcagagtgagatatagagcacacaaccttaagaagctgcaattccatgaataatccatgactcaaaaagaatacgaaactaaccctcactaactgaatacaagaggaggtgcagaaatagaatgaacagcagaaatatatatatacacacacatacgtacacaatatctgtaaatatacacacattcataaacacaggtataaataaaagacaatagatgaagagataggaagatggtttgttttgcaagtaattctttatgaaagaaaaaattgattaaaagattccggaggtccttagttttccttgcaaaattcctggaaactaaaaagttgcttcttgtatcttcccaacacctgtatagtcactgagtgacattgcatgctccagttttgacactgtaagcattatgctagtctttctcattgccagtttaaaactacgcccttatttaaatggctagaatgcatcttg

SEQ ID NO: 57050 - DNA, 1298 bp, Bovine  19866881419869
cggctttcgaaaatttttaagtttaaactgattttgagtctaaggggaaggaaacagataaatacatttttcatgcttatgttttcaactttagtggaagtgtaaaaaaagtacttgtatttaaaagcccaacttgtacaaagctaccaatgaaaaatgacagatattatattatatctatattaaagctagaactatttacagtcaataaagcaaggaaacccaatttacaatgcaaacctgcttctaatccctttgcaataaggaatcttggaataaaagggtccaattcatctttttctaataagattagaaaaaactaaaaagctaagcagctgctatattaattaattagatttggggaattactattaagtacaagttttgtgaaagcacatgtctgatataattttaaagtaccaagtgatctaaattcaggtttttcttaaaagaatgggggtttactttctgaataatgtctttttattgtgacctacagtcctctcttcaaccctactcactcttctccatacatactgaaacccaactctattggtttcttgcccagataaactaaaatcacatggagatatttgctgctctagaaatgtctccatgcctttgcaaatgaagtggggtttttgtttgcttttgctttgcttgaaaacccatcccctgctcctgccctagtgcctccaaccacaattccaacttttctgagtagattaaggcactccgctttctgctcgcctggacttttatatatgtactttcagcacagcacttaacggcagttatgggacactgtctgcattgccttgctcagtgcctatcacatagaagcactgaataaaatttttgcataatgattagaaagacagaatatattattcctaggatgcatttcaaattcttttagggtagcaatttaaataaaaaataaaaataaaaataaacaaaggcacaaagcaacacttgaaaaaaaaaaagaaagaaaagaaaagcctgtgatgtcagcaagctgttttttctcctaattctctctcagtgctcttcagaacggctatttttttcttcctatttaccaactttaaaaaatgggatctgtgcagaagcctttgcttgtcttagttaagcatggtgagattctcagtaattagtgcttgtaaaacactacaaggttttcagatgaattaaagtgtgaaatcttattacaagcagtatattgctgaagtaacaaacaggcaggaaaattacaccatttcctagtttctacgcttttaaggaacaacgcaatc

SEQ ID NO: 57051 - DNA, 901 bp, Bovine  19866882106131
aggcttgaattttaccttagccctgcttgtctcattgccctacttttaggtttcattctatgtggacttgatctgcctttggctattaggttcatcaaaaatgttcagttttcaataataacttctagttctttgagccaggttccccagggcctttagatccacagccaaattacaaaaatgaacaaacagcttttccactctcactaataggaaagcaaacctctcatcacattctcagcaaagttggcctttcatcaaagtctcttatttggggtgattgggtgaaagatgtaatcaaaggacatttagttcaaacagaaaagtgtggaattgttagcacttcagttcaaccttgctttgagtattcaggcaataataattatagctacaaaagctacttgccttgtgttaggcaatatgttctattctttacttttaactctactgatagattttgtaaaaaatatggactatttttatctcttttctatataagaagatatgaagttttgaagagttgagtgacttgccaaaagtcacaggagaggcaaattacaaaatgcagattcacgaaagtactcctaatgccaaagactattattttaaaaacttcccactgctgtcccccttagaacaagggcagtgatgatgaggcaagggcgtgttgctttctctttctgtaagagaaagagcccaatgcttgagtcctctcctggtcattttcatttctgtcctgaaagtgtaaggtagcagagtcatttagatgcccctttcgtacccaggatgaaacaaatgatttcttaatgttccctacttggtaggagcttaaggaagctacttattcctttatgtcattgaacaaaccatgaggtcaggattttttttctcctggcagatt

SEQ ID NO: 57052 - DNA, 1026 bp, Bovine  19866880350352
tgaaaaaatttctttgccctgtgtagaataaatctgacaagaaaccctatgagtttttattagtaccattattgttttctttggcttcatgtactatatcggtaaaatgacaaaaataaaaagaaaaaaattgtaaaaaggcaaatattttgtacaaaaatacaaagttttaaaagctctttaagtatatttcatattgttactaagagttggcctatatatctgtatgtctgcatatttttcctacatttgggattttatcaatagaaatgtaaggtactgtttacacggtgtatgttttcagttcttcctaaagctcaacaaccaatgataatcttttttctgattggagcattccatactctggaagatatgatttgcataactgtatggttattggctgagaagaatctatgtgattcagtccatttgcttactgacaatccatatatcacactaggggaacacttttgttccaaactttgtccttgagcaaggcagatggtagagaacatgggctttcaatgttttcagtaattggtcttcagtgctttccccttcaatttaatgagaaggtgatgcaatcagaaagaagtatctttgccttcgagaactgtcgacagtttgttcctattatgatatcacggtccattataatgtaattgctaattctaaaagagaggaaaaagaatggggtgttagttcctcttaaagaacaatgttaacggacaattcagaaaaaggagtgtgtgtttttaaagaaaacattccaaatacatcattcagtaattattttttcaaataaatgcctccaagttcttattcagattcaataaaaggtaaaattcacttcaaaggagcctattctggggtgtcctagtctcaactcaaatcccaaacgtagtagtgctgttgtgctcagtcgtgtctgactctttgcagccctatgggctgtagcccaccagactcctctgtccaagggattctccaggcaagaatactggactgggttgccatttccttctc

SEQ ID NO: 57053 - DNA, 974 bp, Bovine  19866880352289
gtttaaagttaaaaagggggggaagggtgtctctctgcctgactctgacttgttagagacaagatatcagaatgtacaaagattccctctgggttctcataagtgtgtgggtgtatcatcctcagaatgtatatattcacactcaagcccagaagtcagcattccagtacacattagaaagctgtcattcattgagctgtgttgaagacagatttacttcctcagcaatgtgatggaggcagctccgtgagctgcctctactgtggccgagataacaagcctgcagggagaggctgcgtcacacgctcctctgtgaaacagctgctccttattcagaatcagtgtgtgcagctttttaaacagcgcgttttcattctgggacgcatgacaggccttggttttgttttttacatttctctgctgctcttgggtcaagcaaacgtctgcgtgactttgcaaataacacttgatttctgttttcttaaaagaaattggaaagctggacagccagataactggggtcatggccacgggcctggagaagattgcgctggactgattaattttgggcagtggaacgatttcccatgtgaagacatgaatcacttcatctgcgagaaagacagggagagaggtaagcagtggaagggatttaagagagcacagcagagcttatatcttattaaagggcaagaggtgaggagtataagggctctgaaagtaggttctgcaactggattccagtcctgattctgccacttagtatcttggcaagctattaacctcagggaaataataatagtaatcctcttaatggggtttttgtgaggacttaagtaagttaatacatgtgcctaatgtagaggaagtactcagtaaattttagactaatgggtgggcctaggtcattaccttataatattggcagtcagtgttctttatcatatggcaccaatgtcatatatctttttata

SEQ ID NO: 57054 - DNA, 800 bp, Bovine  19866880560022
tggaaggctgtctgcttttgcaggaaaaatttgccttttttttttttttttttttaaagaattctctgtatttctttccttggctacttaaaggtcattttgtcctttttgttgtaatcagaatctaaagttaataggtatagcttttaaaagtagaatagtatgtattctgtgttactttttaaagttttatatgcaataaagtttttattttatatgcagtacttttttttttcccctataactgtccaaattgagattaaatagtaagtgagaagtcacttggaattgtccctcggctggatagagtttgacatcatgtttttatttggtcgctgtctttagcacaaaagaggcttgagagttcccactgctgattagacagctaactttactgacaaatctctttattctctcaaaactttaccttctctgttttctccttacacatactacttaagaaatcacatatcttcagaagtagagagcgtattctagttttagaataaccataaaatctcacacagaatagttttatcctattttgctgtcataatttttcttccttaatgtgccttcagtagtgcatatatggttaactagaaataaattacagattattttgatatagagaagcactaagcaagtgattgtgcaacagtgccaaattaatttgtatttttattttgcagtattctggaagaagtcctagctgtttttaagagttataaattagatgatactcaggcctcaaggaaaaagatggaagaattgaaaacaggaggagagcatgtatattt

SEQ ID NO: 57055 - DNA, 911 bp, Bovine  19866881161428
caatgaagaggtcttcgacaacaaaaacagggcatgaaaagctgccaggtgagtgaggcagtaactgtggatgctttcacaacacctggagaaagtgctaaaccctagctgtgactttaaggtcatttattgcttacttgtttactgtccttctgagtattacggtctcttcaaacatgccaccaaaattctagcaaacgagaatgggagagagatataagagttgagaatcagtgagctaggttgtcaaaatgtcaaaactaagagaaagaagctgggagtagagtgaaagacgaataagatttctgacagtagctgcaaagcctctgctttgggcattggacttcccaggatggcactagtggtaaataacctgcctgccaatgcagaaaacctaagagacgtgggtttgatccctgggtcaggaagaccctccagaggagggcatggcaaaccactccagtattctagcttggagaatcccactgacagaagagcctggtgggctataatctacagggtcgcaaagagtcagacacgactgaagccacgtagcacgcacgcaccaggcaaaaacatctccaagtccttccaggcctaagattatgtcttaagaagacagcgcatttgctggaaaatttatgccccaccaccagatcccaggagagagaaaggaaggggtgaagggaaagtaatttttcatggagctgagcctgagaccactgtcaatgtttaattatatcacgcttgctgtttatttgggtcattttttaggataaggtacatgggatcatataaaaactaaatttatttggtccctttcaaaaacactcaactggcttacatgtggagcaataaagtgcgaaagtgacatagcatccaaattgcagccatgtggactggctttttta

SEQ ID NO: 57056 - DNA, 1345 bp, Bovine  19866881280239
ggcccgtgaccttcgaggcagaggcgcgaatccggagtgggaccactcgttcgggaagaaggactttgaaccgacggccactgccgtcacctccccagcccggagctcccggataagccgcctgacttggattctcagacggctaccaccttcccttgcggcccatcgagccgtaaccagccgccattcacccgacttcccaaaccaggagaacgccggccaacagcccgagcgtcccggcttgtaacccgcagcgtgtacagggcgaggccgcgcatctgcagtcacccatgggttgttacccacgaacccggatcgggcgttgagtggctaaccctggctcccaaacgccctcccgacctccgtcacagggaagctccctaacaccaccggacccgcccctgcgcccacaagccactctagccgcgcacggagccggcactctcgttgctcccgccctgacgtcatcagcgggcgccgcgacgaagtggcgggcacgctcagccaagaaagatgtctccgacgccgccgctcttcagtttgcccgaagcgcggacgcggtttactgtgagttgcggaacggtgggcgcggccccggcccaacgctatttgttgctctcctctccctgaaattacttgaattttgcactggggtaaagcagggacagaggcgttacgccgcggcgacgggttcccggccccgtcgtgggctggggaggcggcaaaggcgctttacctgcctcttccaagagtcctctgcggtccgcctcctcctttccgccggcgggtcccggagccctgcgcccttcgtggagggctcacccgcagactacctccgtttgggtcctgctcctctgcggtgctcgcttagccaggcgggtgtttccagaattggcagggggctgctctagagggaaggcgggactggttttagtccagagaaccggcttccgccccgcctcctaactgccaggtggctcttctcgccgcttattcatcaccctttaactctttgtatctcactccttagagatcgatgaggacggtcctaagtggggcgaggcaaattgatcagcttgggaagggttgtcatctgtcattttattcttccgccttggggaacagtaatttaagcatttgggggaaacactttacagggctttttgatgttagcttatttaactcagaatagccctgtgaagtagggtgtttaattatccgcagtagacgagatagaaactgagacagcccgccccccagcccccgcctttgttgttgttcagtcgctaagtcgtgtccgaccctttgcaacctcatggactgcagcgtgccagtctttcctgtc

SEQ ID NO: 57057 - DNA, 993 bp, Bovine  19866880366258
tgatgctgaagctgaagctccaatactttggccacctgatgtgatcagctgactcattggaaaagatcctcatcctgggaaaaattgaaggcagaataagagggtgacagaggatgagatggttggatggcatcaccaaggcaaactccaggagatgatgagggacagggaagcctggtgggctgtagtccctggggttgcaaagagtcagacacaacttggtgactgaataacaagaacaaagaatcaaaatgctaattgcaagaataattggaaaggggccaaaaggaggatccgtggatagttcgggaagagacctttagagagggcttctcttattagatcagagctggaaggagtccgaaggcagctttagaagaatatagactgtaattctttttattgcagtcttgcagaaaagctcttcctgctaaaatactaacacaaactctgcaatattttctagacttgctcacctctatttatttcagtcttctgctgggaaatagaggtgaaggaggaaaaagggcatttgagcccaaagaaatttaaaatggaaagcaaactgaaaggctctgaggccaggtgatggaacaacagagcaggagttaacagtttgttgaagacagcctgtacctcctgaatcctacataacttggtccccatcctattttttctcctacagtttctccctttggtccccatccccttcagtttctcccttgagatgctgctcctggacattctgtaaagcttctcttgacttttaaaaacctctactgactttaagaagtgtcttttcctagtgcaaagacattctgtggttagaaactgcagcttcatacctgagttgaaaagacattcctgctaatgggcctaactggatgcaaccgaaccacaagaatgtggtctgtaatccccgtagcctaacaggagagaaacaggaagggtgtttgagtgggtgtgttacgtggcatccgttataatttcaag

SEQ ID NO: 57058 - DNA, 1532 bp, Bovine  19866880522877
ctttcatgcattggagaaggaaatggcaacccactctagtgttcttgcctggagaatcccagggacaggggagcctggtgggctgcggtctgtggggtcgtacagagtcggacaggactgaagtgacttagcagcagcagcagcctgaaatagaattttcagtccccaaaatgggtgggataaaaacaagcagctcagccccaccaccaatgccaggacgtgatcctctggcagtgtaatgagttcttggaactttcagtgttttgtctgcctctcaaggagacttatctgtgtttcagcttacagaaagattttcacaactcagcattactcctgggacaaaattaacaatgctgttaatttctttaagcatgagatgaaagcgttagcaaaaatggcaagagattgagtgaactgaagatctatctgaacagtttgagtttcagcggcaaacagtacttgccttttgaatgtgaggaaaaattaggcttgacatcttaagagacagaaaatactgaactttttgacattctggatagttgagtggagtatgctatattctgagatacctttaggaatagtaatttacacatctacactctaaaatagaatattcaagtttcctatgtagtcactttgctgcttatacaaatggagctaactaaacaaaccaaatactcaagtttcactaacttacattattcaggttctgggacagactagtgtatcaaatcatcatcactgacaaaattcaaatgaaatggatccaatactatcacaccaattactgcatccatcctttatcttctaaaacaaatgctccttcacaaaataaaaatttagttaaaatatatttttagaatgttttgtcaaaacatatagttattttaaaacacaacatatctttatattctaatattttcttcctgcttatccatataatatttattgaactcacctatgaaaaagttatgtttcctggaagaaagattagttttcttttttgctatgttatataagctaaaatgtaatttttaccactttcaaaaaaattgtagtaacttaatcaccccaggagagccaccttcatttgtttgtcaaaggataatttgcttggtatctacttctccaataaaacctccaagaaggcaaaagttcagagtatacctatgatgttatttagtgttcataacatccgagaaaaatctatactttaaattcatgcaaagtctaagtagcaagtgcatgaaggtacaacatgcattgtatgatcaagattctttcctcccaccaacatataaagaaaaattccaattgcttttttgtaggcaacaaaagggagccctggtgagctaggcttcctaaagaagtctgtgatatgattgaacacattgattccttttatattaatcactttttttttcaaagcacgataactgctctgtgatcattttcttctttacttacttcacacgtattagtaacctaacagatcatcaacatcagttgactcatcaagctgtatatacatt

SEQ ID NO: 57059 - DNA, 1497 bp, Bovine  19866880532712
ttagggttattgagttcaaattcctgtcccctcaaaaataaaacaagagcacataaggctgagaaacttatgtatagtttattgaaggaaaaaaaaagataagtaatcaatagaaatggtgttcttcaacaacttagaaggaaatattcacttgatagcatttctgtgactttatgtcagtttgatgctttcatcctggcataagattattcagatttatatagacacagcccaattagattaagagatgcatgaactggtaaatactgttaaatgagggaaggtttaatgcaggaaattagcttcaatcttggatttaaagctctaagtgatgtaacttggatgacagaatgtgagacaaattaactgttgataaaaccagtgatgtgggaatgatattccttcaagtgaagttgctagctctcattgacccaaactggtttcattaaaaagttgaaattctcatatatgtatatatacacacatacatacatatatataacactatataatatagtgtaatttatatcatggatctgaatgatgagggcagggtacaaaaagtgctgtcatgaatgtacaaagctcaccaagtaggttaatcccagatgcctttattgtggataagctcctgcatatgattgaacttcctaagtaagggcaggcacaaacaacagcgtacataactgctcaaagggtaggctttggaaccactctctctgacttcaagacatggttggccattattagttccatgaacttgcaaaaacgattaaacctattcgttttcctcacgtggaacaaggagaaataacagtatccggcaagggcatgtttagatgagaacagacatgtgaagcactcattgagcaccgtccacaatgtttgggctcctaataggtttcagatgtattttaggcacttgaaatatatatatatgtgtctagtaggtcttgtaagtctcgtatttagtcgcatttaagctaacattattgtggtttccagtggtatctttgtttttatgaaacccagcagagtgacttgactagtaagccctcaaaagaagttgctgaatgaacgttcaactaaagcttggttgatggcaaataaacagcacccatgagtgaacagaataaaggaaagtgctttacaaagttaggaaattctaggaaagagatttgacaccatgcagaatggagttcttgactgtaaaatgtaccagaagaatctctttgtttgaatggaaattctagttgtaccaacaggcaaatcttaccttcaaatctttctttttctactggcaaaagaatatccaaaggaaatttttattatctatgaataagtataaaagtaagttattctttgagctttactggtctttgaaattaatccagactattagagaattagaggtaataattcaagtgtctgatagagtaatggatgagacactgctttacttttcacccagtcatggctgctagaaatagctaaata

SEQ ID NO: 57060 - DNA, 2825 bp, Bovine  19866880558698
agcttaaagtgctgccatctggaagatttgcttcaggacctgttcacggctggttcactgttctcttgggcagcatcatgtgccaaaaaagaggcaggtgggaaggttatgtaaaaaactgtctacatgactgaagtgactgcaggtgcaaaaggcagatgcagagaataacccccctgaaataaaaataaacatgttgataatcccctcaactaagagacagctctgacctatggactgtagcctaccaggctcctctgtccatgggattctctaggcaggaatactgcagtgggttgccatgccctcctccagaggaccttcctgacttagggatcgaatccgcatctcttacgcaggttctttaccactagtgccacttgggaagaccaaggaattagtcactctgtcatgtctggctctctgcaaccccataactgtagcaggctcttctgttcatggaattctccaagcaagaatactggagtgggtcacatttccttccccaggggatcttcctgacccagggtttgaactcaggtctcccacattgcaggcagattctttaccatctgagccaccaagtaaattatatacatgtaatacatatcatatttcataacatacacatgtaattgtctttatgtgtctataaacatatcacatacatatgtgatatatatatgatacatatatataattatacatgtatatcatacaatatactcagtgtgtatatagtaatatagtatttatttagatacaaataaacacttttaaatcactttagaaagatatatgatggaaattctaagttttaaaataaaacaatgttcttttcactgccccttgtatactgtcacactttacaaatataaatttcttgtatgatatagtctgacttactgagttgattacattttaaatttctataggaaagttcttgaattagcatatttttagttttccattattgcctttccttttccagaaagtaatgagcacctgtcaattacttctgcaaatctaattttttttacaactatctgtatggatattgagctcattaataattactgttttgtctatgtataattctgcttttactgtagctcatctgagtctcacaggcagctcccgcatctcttcagcctcatacagacaagcttacacattttagattcagtcaaacgtgatttcctatggccgtgccttgcgttttcctccccggctgtcattctacttggatataatttcttaacataacctgtcgaaggaaagtccttgtgccccagatcccacttcatcttcagggcagtttggggcttaacttgagctgccaaaggtgcaaaggttaatctaatttagggaagtagttcttttgtttctccgtaactaaaattccagttgtgcaatgtaataaaaggagtcatagcagcaagaaatggctttgccatgcctctaggagcagtgtccaaacaggcaaattctaataaattatcaacttaaccaaaggacaaaaaaaaaaagaaaaattctgttcggaaattctttcttaacttgaacatgccaagtataaaattgtcactcacatattgaaaaatccaaatctagactctaaaaactcaggataatgtgttgagttctgtgtatcttcttaccaaagattacaggactattgcattaaagtgaaaattatagttaatgtgtttcccataatgttacattcaacatcattttatcctaactctccaacaactgactgcctggactttgaggtcagatcgtgttctcagtcctgccgcatgaacgttgagcaaagttatttaatctctctgactcttagctttctcttcaggaaaattggtggtggttgtgtcaggggcgggtgggtgggtgcagagggcaggtaacacgtacctataggattgaatgtgagttttatcaaggagtatatgtaaagtgcctagcaaaatcatggctttaaaacaaaacttagttcttttcttcccttcttttgctttctttgccttctttttggggcatatgttttcttctttattgtcagttactatttgtgaaaaaaggacactttcctcaattaataatcagcacattaactttaaaaacaggaataaattcctttaaacattagaaaggaaacacttggaaaaaattactcattctctttcaagagattcattctcagaataactggaatagagcttcattaactatttacatgttggatgtaattattaggaagggaactttgtttcctttttagctacagaggtgacatgaagtattttaagaagtcaaatgtaatttttttgtgtaataaaaaaacacacaaagaaatgtccactatcttacacactgtatgtatcaatatattatataaaaataaaaactgggaaagttaagaaaagttgttggtaggggcaggaaccatgcaaactgaaagacttattttaggagtttcatatttttaacattttcataaattatttctgcttgtaatcacagtgccttggtctctctactgcatgatgagttctctataaaattgacctcttagcagaaactgaaattgaatacactgtagggtaggctattctatgatgtcagtcttctgtgaaatttgacccctcaagtacgttcttccaagctttgttcccatttatatatgcataaccgtaaaaatctcattcacattgctcaagtgggaataacccatttttttcaatcactctccgttgttacacaagtcataacagcaaaagcttccatctttttaagtatgggatataaaataaaacaca

SEQ ID NO: 57061 - DNA, 857 bp, Bovine  19866880567012
gtactggtgttatataaaagtagtcctgataattctaatgtgtgcaggaagagatctgcatgtttagaggatgaaggaataacttttatgaatggtgacaccttgaaggtttctttcggtgctttattcatgtttgctaggtgaacataaatcttacattccagaactgtctttccatattggtttggagataacaattcctgtgtatatgtgtttatgtgggacctcatcagaattagaatattccatttatcatgagagtattaatctaagaattttacatttgatttctagaattagaattttgcagtattggattataaattggcagcattatttgactataaaccttttgggccatcttagaacaaaagaaagttttgatcgatgtctgcttaacatctcttttaccagaaccatatcaaagaaaatatacaagaatttattattttcattgacaaaagcagtgatgtatagaaatctcatccctttatcttccatattctatggtacccaataaaaccagctttgctaaatgattaattcctaaatttaaaatggaatgtctgctacaaaactaaatcatgaccagaagactgcatggcataaatccttcacagggtgctataacctttatcgtttttgaaatgtgcccccatgcaggaggcctcaggcaaatgtacaaggaacccagatgacatttacatagccattgtgtcagattagactctgtgatcctcccacatcatcaggcaaggcctgaacagagcagatgcacgacagactgcccaagcctgatgcagagcaaatcactaatcctagagaaacaacagaggttttcgtttacacttaggccc

SEQ ID NO: 57062 - DNA, 2479 bp, Bovine  19866880574035
gatcgtccatccctggatctgtgactctcactgtgtcttgcgatgttcatgtttatctaggggaaaatagaatttcttaggatcataggcagagattcccgtctcagttaccaatcctgagcattacctccttcagtccctgatatctctcctatatgcttttgaggggaataaaaagctagaaccaagaaaatggggaaggtaaaaggtagtgctttcatagtacatcacatacacattgagaaattcaataagagagtgagcactaccgggcaagctgttccgaataccacttgtacctgtagagggagatcatttaattattttttcaattttggagaacaaaaaagtaaaggttggcagagggaaaaactttccccttttaatctttcttgctattgtatagctatgaatttctgggaagcattaaagtttatttttaccatccattcaagctgtggttccatttggtgtaaacacactcagtacattatatgactagtgtgtaaagagatgtattaatcacttgactacaactacaggtggtttggaactgaaataacactaacactatttccgtaagatacagacacaggacaaatatcttaaggaaaattagcgttgtgcttttcaagcctttagcaggatttttttaatggaattttattgtactattcagtttattacagaaaagcactttccctaaataaagtatctctcattatattaataatactcaatatagtaatgccaatgttgctgctgctgctgctgctaagtcacttcagtcgtgtctgactctgtgcgacctcagagatggcagcccaccaggctcccctgtccctgggattctctaggcaagaacactggagtgggttgccatttccttctccaatgcatgaaagtgaaaagtgaaagggaagtcgctcagtcgtgtccgactcctattgaccccatggactgcagcctaccaggctcctccgtccatgggattttccaggcaagagtactggagtagggtgccattgccttctccgaatgccaatgttagagagggtctattttattatttctaaacaatgaagaaagtgttgaattttaatataagtgataattagaattttctctatactcagcatcacttggatgcccagtattgagctatctagtttaattctacaagaatttattgagtactatctaacaattgtctcatgttgtgaatataaagttaattaaacccgaaagatgtggccaagatgatagagtagaaggactctgaactcacttcctccatagatatacaaaattatagctgcttatggagcaactctctgtacacatgtcctgaagactagcagaaaaaggtttttcacagctaaagacataagaaagaatcacaatgagatgtgttgcaaggggggagatgaagtataatttggatccactcccttgggtaagttttatgatagaacaatcctgctcctaagccagagaagagatgtttatgtgttgtttatttgtttttgtcaagcatttatgtgtaaaacttttaaaagctttgagttggacaggtttggaagacagaatgagttttaggcagtggaagctggagggagaagacagttcaaagataaacattatctcattaattctcacagcattcctaactgtttggcgttattcaccagttcacagaagacatatgtaaattttgatactgctttttggtactagatctgttgtacataatagcttgttcactcttccattctataacactgaaatctaaaatcggtctaaagattacttattttaaaaccaccatttttcctctacttcacagtttcaaagcatcttcacattagttacctttttttttctttttaaaattcatagtaatatcctaaagcagagggtagacatttttattcttattttcctgtgagggaatagaggctgagagtgatacaaaaactggctcaatatatcacttcagattgacgagagtacaatctaagtcatcctgactccctatttgtattatttttgtattcagtttctcagtctggtaaagaaagaaggtgaagttgctcagttgtgtctaactctttgtgaccccatggactgtagcctaccaggttcctccattcatgaaattttctaggcaagagtactggagtgagttgccatttacttctccaggcgatcttccagacccagtgttcgaacctgggtctcctgcattgcaagaagacgctttaccatttgagccaccagggaagcccctctcagtctggtagttattgtgataaaatggaacaccactgtggcatatttcttcttacatgaagtttatgatctctttaaattaagagtttaagttcagttcagttgctcagtcgtgtccgactctttgcgaccccatgaaccgcagcacgccaggccttcctgtcaatcaccaactcccggagtcctc

SEQ ID NO: 57063 - DNA, 1174 bp, Bovine  19866880757816
aaaaaaaaaaaaatgtatccctgtcattgtattgtgagcttaaaataggaatatagtttcagtttggtaaactctgattgacttatctttcattatacatggtctttctctttaccttgtttgatagcattcttacgaattatagcactcctttgtactaaggcattgtttccagcaggcccctgttaaaatgcaaatatgccatctggcaagcctttacctcattagctcacaccatctcagcagcacatattatgtatcatattagatatggaagagacactgagctgatgaactctaagagaagacggatggaaaaatcccaagaagggggtgctttgggatatgggctagaggcagtagagctgaaagagaagagtaagatgcagagtagggggaaaggaaaacagtttttccaagtttggcgtttcatccagatcctggctgtgatggattcaaagagacacagaaagctggtgctggaagagaaattcacaaacatgtgatcgaacacttttactttacacgcgagtaattggaggttgcaaagagctaagtgaccactttaagtaccctcagctggattctcatcattcgctcttaaagcccagagggcctgcacttacctaatgccttaacattgcacagtgtgtaaaggtgcacaattattcacgtccaattttatgtgcatacttggtagcttttactgtcttcaagtgcattgaaatcccctaaatatttctgttgtgttctctcatagcagttgatagaattagggtgatgcctgctccagtcactgatgaccaaggtcaatctctcaggagaagtagaatttggttaaaaattcagggaaattaaactccagggtagccctgtctagaagactgtgtgctaaaatatttaacaacatttctcctgggttcataatcctatacccaagtcctgacatacatggagaaaagtcttatgccctgtgctaaaaaccacgtaacaacccctaccttccttgtccagtttctgactgccacatgtatgactacattgtcaagttggggattttaggtgagtaggagaggctctatttctacagatacatagcaaatatgagcagaaacagtttatttgtaactgaagaaatggtgtattttgggttttgaaacagcaatggatgaga

SEQ ID NO: 57064 - DNA, 1341 bp, Bovine  19866880769730
tgctataaaaatcaaatttgaatttcaaactccaaaaatactggagtaggagggaggaaagggaagagaatgcattaacagttctctgtgaacagtgggttaaaaaacaaaacaaaacaggaaaccaaaaaaggcaaacgatatcttatgaacccgtatttggaaaaccctattctagattgagtgtaacagattctaaattcaattaaatgccatcttagggttgcgccattattttagtcatttgatcccattagtgaagtgtgctgacgcttcctttccggagctatgattcatgcagggcatcagaagatgagttaagtgatatttcgggaatactctgttgattaattatcaacaagggaaatccagcttgaaagactggcttgactttccatatgaaccacacagggtaaaagcctatttctgcagagaaaagccacagctcctttagaaactttgaaactgatagaaatgttgaattattatgaaattgtatatttatattatgaaatttaaaaataattcttactttaaagtttaattggttaaaaaagcatggtaatatttttattatttggggcattgccattggacaatggcagttgaacagttgaaaaaattaaaagtagcatttataaatgaatctgtaatagtaatatctctaaggactacttattctacatttcaaagaaaggagaatgaattatataacttacagggaaagtatcaaatttatataacataaatcttcagaaaaatgttagaatgtttacaaaatgttttccatatacagtagatttcagtaaatcacagaagcagcttcatgaattttgcaataaagaaagtgtctcataaatccttttcaagtaggacattctgtacagagaagagtacccaatggtttgattattagcattataattagcttggtcagttggatgaagagttcagaccagttccatttaattctgttctatgacaataacataaactccccactgtcaaactatctcaaatgtaatagtacttgacacctgtgtttattagtacagatgatcttgaattctcatttttccaactataagagtgttattttaagacttaaaaacatcaataatcttattattaccttgcttagaagcatccaaagatactacattgtctagacatcaagccacttaagactgcctaactcaccccttgagaaaaagggggtgaagacttcaaatctaactctgcttcatagaagatgtgctatatatttaaggatggaaataagttggacaaaactaacgggaaaaaagcattctaagcaatggaactacatacacagaactt

SEQ ID NO: 57065 - DNA, 2274 bp, Bovine  19866880795688
tgtttgtggttaaactgacagatagtaattaacaaattaataagattacattgaatttctaggttacttgttagaagttagatgcatatttttaggggcatatgttttaatatgggggcatcagtagttataggaaaactaatgatgtttcaattccttgattttttcttaagcaccaaatgaaataaagtgatttgacacacatttaacgaaaaaagagaccagaagattattggaagattaaaaaagtgaaattttctcactttacaaattgatttaaagttttacaccaattaacaatttcagcttattattataagaaacttaaaaaacatggtaccatgagaaatatggtttatcctatatttgtttgaccaaaagccaatgtaataggagcaaaagccaataaacaaccttaaattcccttgaaactcagtgaattcagctgaatttttgatcaacttggtcagcattaccttttaagatgaggctgacttttccccctcagttattgaggggttattaaataattgatgctgctgacctgaatttggaacattggtacacaatgaagaaccatttctcaattgaaaagttacccaatagcttattttcataattctgtcctcatttcagggatttctcctcctcctttccatatgagaacttccagaaccatagatttatgacaaattgctcagatagtatgtaaccatcttctctagtctgggaacacttactggtaggtcttacaactccatgaagaggtgatggtatgactcctttgtgagatcttcagagaaagttaataccttttcattgtagaagtcccagtgacaagaatattaccttacacatttcagtattcaacaaatgaacctgtttggccacactggacatgtaactgtgtcttggtaaagagaatttgatattctttagccataatattcctgaaatgggtaactataagggcattgtatacacttaaaatcactcaaaatacaaaaagaaggggaagggggacttggtagtgtcatgatgcaacttcaaattcacattattttaggagcatttgacaaattctgtattacttcaaagaaatggatggtgtctctaatgaatgtatattctctagagttatatataaaagagccataacaaaactcacactcaataaagtctttagtacttagctgccctcttctccagcaatgttacaccatctctcataaatatcttgtttgaacctacacacttaaaaaggcattaattactattgacagtgctctacaaataagctagccataaaaaatgtgaataaaaggagtgacatgatcttggttttgtgaatatttggaggaacaatgagtttgagaagaggacaatcctatttcattcccactgacgttcgtgtccatgtaaactcccttttaatagcattcacattacactggaaaataggtatgttaccttttgaaagtgagtgcattaaaagaatccagctctttgctaaaaaggtcagctcttgaaagccttcaagagctttggtagctgagaaagctggagggctgtaaatccttcatttcgttgctaagaagcttggctcctgagaatcacatcagtgttctctaacacagagagtggaatgcgaatcctttgttcccagcctatgatgctgcacttctgagtacttgtttccttggctaagagaacatgcgggagaggtctatgaggtgaacttagagattaattatgaatagagacaaactgagaaagataggcaaaaaatgtacagtgtgttaagaaagaagacttacttgcaagaatgccagatggcaaatgccattacacagaaatacatgcactgaaatgatagtcacatggtaacatttgaaaatattttgtaatctcagcatattttttttactatgaaaaatatctgtcgaggaaaatgccttccccattggcttattttaacacactgattgaaaataaagaaaaaatacaaaaagtcattgtacctttaaatcaaactgtgacataccagaaccagtcttcacttattatatagtaagaggaacactttaaacaactggataataaataattattggttgttcagcaaaaaaataagtacagcacattttggatacatgttgaagggcattgtatcaactttttttctatttgcataattaaaaacagcacaaatattatgtgatgaagtggtacatttaaggagatcattatacctatctttaaatatttcaatac

SEQ ID NO: 57066 - DNA, 1192 bp, Bovine  19866880894398
ttactttgtgacagtttggtggttatcgttttagtctgttattttctgtttcagtgtacagatagcgctactgcccaagaaagtgacaggcacgttgttcatggctctagcagggccgagggtccttgtggcagccattcggggcttcctggccagggctgggagccacccagcagtctgtcctcttcctggtcagaaggcattgagctctgctcaagtggactctaacactgttagcaaatagaactctaattttttgttcccaatattgctttgcatttcagggaaacagacagtaggtttgctgcctgaaagactgtaaactactatcctcaattcttctcgccaaaggaaacttcagccccattaacctattgacagttttctttaaaattaaaggacagggaagtgaattgtgtgtgtgtgtgtggtgttagtagctcagatgtgtctgactctgtgcatggactgtagccctgcaggttcttctgtccatggaattctccaggcaggaatactgaagtgggtagtcattcccttctccatgagatcttcctgacccaggggctgaatgtgggtctcctgcatgcaagctgattctttactgtctgagcaacctgggaagcccagggaagtgagttaagtgagatgatatgagttctggcagataaagacatgattagacaatggcaccccactccagtactcttgcctggaaaatcccatggacggaggagcctggtgagctgcagtccatggggtccctaagagttggacacgactgagtgacttcactttcacttttcactttcatgcactgaagaaggaaacggaaacccactccaatgttcttgcctggagaatcccagggacgggggagcctggtgggctgccgtctatggggtcgcacagagtcagacacgactgaagtgacttagcatagcatagcatagcatagagaaattacagggatattaagatttcttgctcttatttcccacttagatgcttcatctcatatctcagaggagttgtcatggttttcctatttttttttttttaacataatgaaaggtttaataggatctttagaatcataatccttattatggtttcataatattcttcatgtgggacctaatggcaaatgaaaaatgtcaaataaatatttaataattcccaatcaattcta

SEQ ID NO: 57067 - DNA, 2297 bp, Bovine  19866880988505
tcacgtgaaatcaaacacagagaaaatactagaaatatgcagagtggtctcttgcattttttttcccagtatcactttcgccatggctttctgaagactgagaccaataattagagtaagaagtgaggtatactaattgtcccagtgcagtccaatagacctctctgtgataatggaaatggtctattacctgctcaatccatcatgacagacactaagccacacgggactgcagagaacctgaaatggagctagtgtaatgtaggaaccaatttttaaattttaactttacattcatttaaactgaaattcaaatagctgcttatagctggtgcacaggccagtctctttaaggaacaatactaatctgcaagcatgtaggatggaaacactagtttaaaactaacaaaaacatttcccaccttaaaaagtcttggacttgttttggttaaggatcctgtgggcacaccttttgctcttactatgttattttctgcttaatctgtattgcccttggtctcttgtattagtctggctagggcttttataatgtttaaaggaaggagagtctctctctctcatgtagaaagtatcctaattaagacaaataagtcatgctgcttttgtttatgtcacaattttccctgtagctagaattaagtgatgctgtcaaagggcagtgctaatgtttgatggtttttaatatttttgtccatatcaaaagactaaataaatgtaatcaatattctcaattcctaactttctagtaattattccaataaagagatattcatgctaccaagcatcgatacatgctcttcatagccctaataaatctgctcccagaaaataaaccgtgttcatctaggattttagagagaatattagcaaacaccaagctcagaatgtgattaaacaagtttttcagcacatggacctcacaaaatatggattttcaaatccaaacatttaatgaaaactatcaaaaaataagaatcatatctgcaaaggagctgcatattatatttgggtcagctccttaagcaaataactcacatggagagtttaaatagcactggctcttcataagaactttctctaaatcccatcttataaaaagaacaaaataataataatatcaagagttaatatgtaatacttgctggctgactctgttttaagatttttaagagttcctcacaagaaccccataaagtaaacactactttattcccattgtacaaattaagaaagtggtttaagaaagaaggctgcccaaggctatataactggggtagaagggttgtggtgttgatgataagatctgggtatgtcttagtacagaacttttacctcttatttatttcatagtcaaaaacatactttcaagataaaccttttatatattaatatgctaagataagcctttaacaaggcttgtgattgacaaggcagtgccaacctccttcccaattcagtctgaaatttttcagcatgctaaaaccctttttttgtgagttgcagttaggtcagctactgggtatataggttgactttggtggttgagtccctaagtcatgtctaactcttgcaaacccatgggctgtggcctgctaggctcctttgtccatgggattctccaggcaagaatactggagtgggttgccatttccttcttcaaaaggttgactttattgaatattaaataattacagttttacttggtaaagtcttcaagattatataagagaatgaggaataaatgcttttaatatcctagtcattctagaaatatttgtatcacacacacacttacacaatataagcagatccaggaactcacatcttatttgcagatctacttgtacagaaatactgacacagggaaaggaccccagcatcaaattattggaacaggtattacattatgttatcaatgtcaaaaagagagaacagcaccttgagttcagggggtctaagacaaatgtatgatatggtagggtataaactttgcctttgattctttacaatccagataagtgaggcaaaaaaatgaaaggtgctgtacaaacaacaggaatatatttttcacagttcagaggttgggacgtccaagatcaaggtgctggttgactcagctccccagcgagggcactcttcctggcttgcagatggccaactttcggctgtctactcacaaggtggacagagagcgggggcgggaagctttctgatgtcttttcttaatgggcactaattacatcaggagggaccctcaccctcatgacctcctctaa

SEQ ID NO: 57068 - DNA, 990 bp, Bovine  19866881155666
atgctcagtcctacggtactttctttgctgatcattatttcaggcagccttgctgacaaagaaaaatctttacctgttttattttacagcctccaaattttctctctgccagatgggtgcttacctaattgcaaagcagattgtgtctgtgtctacaaaagcaaattgaattggagacttgaacattaatctggaggccatatgcgtgtgtgttgtcctaagtaaatatgacaatagcatccagtcatcattaagctctactcatcaaatggtagagctctatttgcattgattcatccatacatcagtatttttctaggaattaagttagatgacctacatcagagtcacccatgctctttctaaaatgcatatatgtgagtcctactcaagatctacactatcagaatctcagattgaaattctagagaaactgaatttttaacaaacactccgagaggttctcttgaacagtgttaaagaaaatattcacgtcttattaaaggactagaaggcagacttcattcagggggttactgggatgaggttttttaatagaggggagaacttaactttgaaaacaatatggactgctggagatttagagccaagcagcagggcggggctcagtggatggaaaattactaagaggaaatatcaagagtaaagaagattctggatcagccaacttgacaggacttttgcttaagccctgccaaggtgataagatactaactaagggtgggggataagaaacttaaacacatacaaagggtaatcagatactaagaatgggggatgaggagtcttctaagatatggaggctgggggattttccctatactgacctactagttgctaaaactgaactaaaggggccaacagcagagctcccagtgaggtctagtctaaaagaggactcaagggagctccactgaagtttgtttaaggcaagggtctttgtcaacagtaaagtccaagataaagagc

SEQ ID NO: 57069 - DNA, 1473 bp, Bovine  19866881327113
atattgcctatatagacggtataattatttgatatatattttatttgtcatcttaaatgttttttcagttaaggcagtatgctaatatatcatgaattaatttgaattttttcaactcaagaaatcatataaataaaaatatttttttgtgtttaaacaaataattaacaatttaaaaatgaaatggaaccttgattactttccaatttattcctatgtctttctaggtacctgtaggtaagaagttttccatttttttcctttaattcaataaaataaaattgactggttattctatattaattgaacttatagtattgtgtataaattcacatttggaagcattctatatacttccatttacttgagagtttccaatgcatatctcaatgttcatggcctacattgaaactaaagaaattctcatggatctcaagtttctgaaatgataggatgtagcaactgagctctgcaaagaagatataatctttgcaatatataatatatagctatatactctccattacacagtattcaaaagtggcacggaaccacatttactaaatagaagccacaaactatatatctgtgttatgttctgtggtgcctacccctaccctctgtttcttataactggtttggaatattgagaactttcagaaaaataaggagaaggaggaggagaaggagaaagacataaagcttgagaaccatgtcatttcccatctttgaacgtatcactctccattgccactgagcaccagctgatcactttcaacatcaatgcatttgtttcctctccataaggacagtctatgtggtgtcatttgtattcacctcgggcagacacagagcctctgctcatttcatcaaagaactatttatgaggctgtaaaaaagatgagtttctccgaatagtctccaaattaaactttttaaagtttaatgttggcacacaagaataattacagttataaaccattaaacatttagaagaaattcataggattggagggagaaaatttacagctgtggcctaatacaataaatttcctctgtaaaagcagaaccacagaaacatttctattctggactccagagaaagaaaatgctttattaacattacccaaacatggaggcactatttttggacattatttatacagaaagatgaataccttttaaagatatagttaattaacaaaactcccttatactggaaaacaatccagtgccttagagtattttttattttttctactagttattatacagcaactattacattcctggctgggttggcgatggtggtagggcatctctatggagttcaatcatgatgtttaaaaacagaattacccagccccacaactgcagctcagtttctaggagacgtcctcctctgaaattctaataggccttcataatgcagacacgcttgttttttactgtttgcttaaataaggactgtgt

SEQ ID NO: 57070 - DNA, 1663 bp, Bovine  19866881367320
caatatcctattgctatatatttatacctggaaagtggacatcactttttcatcagaatcaaaaatctgctgccccgactgggcaaaacctataaacagagtgcctatcaagtttgatcttgagaaacttgtctttgaatatgctacacatgacaataactagggatctcaagtcagataaatagttttcatttctacccggcctattttaagatctggggtatctgaatatgacagcctgtaaggaaatctgtatgattatctctagatttattcctttaaaaataaatatttgtgttttttaatgctctcaactagtatataaagtatatatagagaatttcatgaattttgacattatagataattttgattaatttggttaaacaagtaatttagtgaagaatgaatacatttagtgaaattactaacttgacatgttcttcacttttttcttccatcaaattggcctatagttttatttaactgactaaacccataaaattgtttgaatatcagattgacagcccaatgtacataccattcagttgcaattctctttttgtgtatattctacctgtctgccttatctgtcagttaccatatttaaactcagctatgaaaacccatgcatatacagcacagcagtaaaattaattgatacctttttgtcctaaagaaataaaatattagccaagtacaccatattacaggccttagaatagctgcacattccataatatatacaaaagttatatgaatacacagaagtagtaattgaagtgtcacataatggatccaagtcatcttgtaagcccaccttcatttacaaataagaaaaatcagagatttctctctattttcagtgtattaaacgttagaactgaggccctgtcaaattccaggcactgtacacaaaacagaagacacagagatgaggcacatgcaatgcctgagttacagtctagcatgggagaccataacctgagggtcatcgttaaaaatcagggtaagtaccaaaactaggggatgtctaaatgttacagaagtaggaagaagaagtagaaggaatgtgtgtgatgtcatcgttgggacattagaaaataattcagagaaggggtgacactggagttgcctcttgaaagcagcgaggggaatgtgtgaggacaagtaagccttccagtaagaggaagccttattcccatcaccagaatacgcgagagcagcacacctttaaagacttgccaatacgctgtgtggctgatgcggaggatgactgtgtcttcttaggagagtgggaggagaagctcccagttgtgtgattctgaatgttacccatgcctctgggtctttattttctcatctgaagcttgaaataatgcttaccttgcagcatcatctccacagcaggaaaaaaagctaaaaggcagacagggtacagaaataagctggtccaactgattgtggggatcaaaatttaccccaaattgactaatttacaatttaaaattacaatttataatctcaatttacaattgagacaactggtgaattttaagcacaataatggtatttaaaaaaatcattccaatggaagagtgaagatagatttaggggaagaagtgtataaaggctgctgtcattgagttatcatctcccaaaa

SEQ ID NO: 57071 - DNA, 1772 bp, Bovine  19866881388466
aataaatgcattctatttcttttgtttccattttttcctaacacatcatatgcataaaacttcctctaagatttagacataacctgtatataaccagacattatttacagagggcatctctttatctactattatttttatgggaaaaggaaataccttgcagaagaagtgagacagaagttaggaaatcatagcaatagtaaattacttttatcaatttttttaattgttatgttctgaaatttatagaaactatataagatctagttttcaaaaccatgccaagcatacaaactaaagtgagacctgctctacgcccttagagttactctggctcgaatgtcctgtgacaattatgataagaatccatttactggacacagataggaaggatgacaactttatcaatccaccaggaatcaatggaacaacagcagtttctggggtattttgtcaaataaataacactgaggttaaagctgaactactggaagggaaaagctgtcatgctgagatgtgtttgttgaagaaaaggatttcaaaaatgataaatatgaagtaaaaatggaatgtctgggaaaactgaagatgaactaggatatgaagaactttattggatttaggaccttgttcctgataatatttatttagaaacattttccaggatatctttgaatgattatatatatataatatatatatgtatatttataaatagatatatatatatatatatggagagagagactgaattgtgaatgaaagggagagatttcaaatactgtaaaatatacctttctccaagttaagaataaagaccgaagtaagacttgtctttctaaaacactgtgttcacatcagctaatatgcaagttaatgcatttattccttctttctttattccctcccttcctcccttctctccctttctttctttcctttttaggctagacgacaatttcaaacattattataccattatttggcatggaaactgtcacagatctgaaattccaagtcttctgaattagtattttatttttcatatatcagagctatttttcccacagcataaaatgattcattgctctcctttgcttagaacttttctgtgtcttctctatgccaacaggatggactccaagctacttagtatagtcaggaaaactctttagatcttggctggagtccaacattgaggaataaattttagttattttcagtcataattgaatatactatagaccagaggttgattacttcttttgatatgtggcacattcaaaatcaagggctctgggtagcacattcaaaggtataaaacactcacatcaacatcaaacagcaccagtgattctagttcaatctctaatgcagtataatatctcaaatactttacacaaactttgagaacacaagtcactcttgtcatcttttagcagtgagatgccccattgagccatacaaatctctagaggcaaagtttttccttgttatgtgtgcatgtgtgtgtatggtgatgtcatgcagatttacaaatcttattctgataagcttcattctacttttcagtggggaaaaaaatggagacacaacagcctaccaaaacatacttagtgagaacaaccattttagacatttggaatttcttgcatttgcttaaaaatatactgtatcctttcttcaccttgagttaatgcttgaatcaatgtccagtcctttatagtgggggaccatgtgtatttgcacaggtgtcacacccagaagccaga

SEQ ID NO: 57072 - DNA, 1173 bp, Bovine  19866881411980
ctcattttgggtaccttaattaactttccaaggacttataatctgacttaatcagtttatgtgattctttaaaattgcacagtcagtgtcatctcatttcattaatttggcttaattattacacttgctacttagaaattttagattaatgttaactgaaccgagggacttagattcttttcactatcatttcagtttgttcatataatcttaaataaaacttaaatttgcccaatgttaataaaatgttcaaacttccaatgtcattagcatctagagtagttattaaaaacaagttgatttcagaaaatgccttctactcatttataaattgtcttgagtaactgatttttgataataaccatgaattaaaacattgcacagtgaaatgcgtaagaacatacttttaagaacaggccgttcacactttggagtatcagggcaaaggctttgctggcttatagtaatacacatgtccagattgcagttcaagacatgacctttattatgcataaatatttttttctttgtgagaagtaactttgcacataaaattttatgcgattttcaggctttttttgactacaataaatcttttactgaataccctttatactaggatggtgaacacaagtgagtaagtcagaaaatagtttgacttagcaaatctgtaaagttattacatgataaggaggaatttatgtattctgtaatctagcctggataagagagtgtgatttgttccatctaaatgatttgtttaatctccattctcaagatgtattctgatttaaaaatattcccacttttttcctaatctttgggatgtaacctagggaaagaacatggacttgtgttttagatggttatttaaatgctgcctccaatttccagaccttgataagtaattaagtctttctgagctacaattacttcatttgtaagaagaatatagaatataaactccacagcattatcatcagaagagtgatggcatatgtaatatgcccaacacagtaccatgtatatatatatatatagtcaatacccaataaatgtcacttcctttagctgtggtttcttggcctatgtccttttgttggtcatagctcagtcatgtccacctctttgcaacctcacggacagcagtacaccaggctctcctgttcttca

SEQ ID NO: 57073 - DNA, 1098 bp, Bovine  19866881482271
tattttcaatatatattgaaatataggcaatataggcaatatagaaaataaaaatctacctttgttcagtgaatttgagattcgcatgagaagaattacagtatgtgggaaacatgacaaagttttgaagtcaaatattcctgagttcaaatccttacttcttcatattctagttctgtgaatgtggcattgtcatttaagatctctgttcctcatctatgaaatgagagtaatttctacctcaagttagatataagaattaaatgtcatgtatttaaaatgattaatgaaaaataaatttccgtcttttccccagtgacgaccttccaaccctgattttttaggttaaaagggatttgctctgaaacctaataaaaacaatagcagcagcagcaacaatgcaataataataataatttgcagcattagtagtaatagtggcagcatagcgttctcagtgaggtaatctaatgagatcaacaattggtctcattatttctcagatttgttaacgcccttctagtctttaaccattttgatttggatcacatttttttatttttcagagtttctttcttgggatatttcatgttctcaggattaggtctctttgggaaagatggaaactgggaaggccaacaagcatgtgcagacagctatttatatgattctagcttctatttataagggtgataccataatccctctaaaactaattgacatttatgctttaagcatatctgttgacaggactggcagaaatgctattatacaactgtttgtttttccttttgtattgatttcagaaagatgcttctttcttggggtgtcttcctgaatggataattaccaggaaagtgtgaaagtagagagttcaaacttcaaggcattttattaacactgttcctctctaaaataaaataaaacttgttagagcgaatggtaacctatgcttgtgtgccagcaaatggcagaaagatcaagaataaaataacagggagctcttaagtaaatagaaatgtattttctagaacaatttccagggctgaaggacaaatgagttcagatactcaaattgtactattatatttcaaagag

SEQ ID NO: 57074 - DNA, 2103 bp, Bovine  19866880353532
ctattataaggtgagttacaagatattccctttccagggaattggtttgatcattcatttaaaaatggacctttccagttaactctggtttttgtgggtaatgggatcggtcaagtaaatgattataataagcaaaatcaccgtgcactaaagctctcaggatcttgtatcagaagagagagatttataacattttggggatgttcacgatttcttaagagaaaaacatagataaagatgaggttggttaaaatattattggctaaaatcttaaattattccattctttttccttatctatttttatctggtgtatttctgcaaatcttatttttgaaaatatgttgcatacaaattaaataatggtaggcatacggtttgatctccatgtgtggtcagttatctccttttgtcatgtgctcttttttctttttgttaaaccgagagctttatttgaaaggtagaacaacatgtacgttttttggctgcacagtgtggcttgcagggatcttagtctcccagatcagatcagatcagttcagtcgctcagtcgtgtctgattctttgcaaccccgtgaatcgcagcacgccaggcctccctgtccatcaccaactcccggagttcactcagactcacgtccatcgagtcagtgatgccatccagccatctcattctctgtcgtttccttctcctcctgcacccaatccctcccagcatcagagtcttttccaatgagtcaacttttcgcatgaggtggccaaagtactggagtttcagctttagcatcattccttccaaagaaatcccagggctgatctccttcagaatggttggatctccttgcagtccaagggactctcaaacccacgtcctcagcagtgaatgcttggagtcctaaccactggactgccgggaattccctgtcctacactcttctattctgcaagtggcagcacaagttttacagctgggtactcatgagcaaagccactgccatggaaggaggacggtgctcatgggacaggcccaaggcacgggggctggtgtgacactcagaagaaaaattcaaaacctgattttttcggattttctatatccacattcagtgatttctcagcaaactcaaaaatctgctgtcattttaaggcataaaattctccttggcagcattaaccaggtgagatgttggtcaagttcattatcttgctgggcctccccctctcagagaggttctctctcccatgccacctcctgcccctcacactcctcacctgctggatcatctctggatgctgctgcatgatatgcaggaagcggtcgctctcctgggtcaggggcgtcgtcctcttcttggtgctgcgtgaaagctgcttgaagaggtatgtcacgatgtggtccaggcaggagcagcaacctgtgcataccatggtgtctggaagagagcagggcagggatggaacagagcaggggtactgagctgccactggcaatgcagctcaatgtgaggtgccaagctcagacccctcagaggcatctagctggactggggacgtggctggtgtagccaagactaccaatggggatgctgtctgttaacctctcaccctcatcttacagccgggtttaatgccaaatctgaaaatgagctcttcataatagctaataatagaaatactactgaaattattgacttcatatgatgtggatttatgtcttctgcttcataaaaagtaacaaatagcttatagtagagcaagtgcttttatcgtgtcagatactgtgctaaggactttatctctattttatcctttagagaacgccaggaggtaggtgttccattttaccaatgagtaaacagaagtgtgtagaggttctgtgacttgccttaaggtctagtaactgcaagtaattggaagagcaatgattagaatccaagcacgcgacgtgagcccgtgctccgagttacctgggtgatgtcactgaacccagcttagtacagcctatcgacactacggtttgttaagagtgggatgctgaaacattcttttctctctggcatttctgggggaagtgtgtggtgtaaagctgcaggtgtctgtgca

SEQ ID NO: 57075 - DNA, 3078 bp, Bovine  19866880558260
cccgctgggggctcaagggtgagttgagcctgagctggcctgggtggtgcagtgttgtcccccggctctgatgtctctaactatgtgccccgggttggacgcagtcagcatgcgtgcttgcgtgctcagtcacctcagtcgtgtccaactctttgtgaccatatggactgtagcccacccaacacctcggtccgtaaaattctccaggctggagagggttactggagaggttgccatttcctcctccaggggatcttccccccgacccagggatggaacccatgtctcttatgtctcctgtgttgagaggtgggctgtttaccacttgtgccacctgggaagccctggaagcaatcagaaagaatgtcaaaactggaagggatcttaagagattcttcatctggtcccacctcctcattcacccgcgaggtccagagagggtctcccagctagttagcagcgcagtaccttagacaaggtgccagtagtccccctggttatttccattttccacattggcaccatcactgggggccccatttaaactctgtctctcccacggcaacatcccgattctaactctccactgtgattggtgccggctccctctatggaagccatgccctcatcctcacctgctcttactccctggaagagtattaagagctactttcttctgacctcaatccctaggactcacaggtaagagcggagaggctttaaacttggggtctgaggtggtggggtaagctcggggaatggaaggcagtgaggagagcccgggtgtgaggagttccatccaggtccaaggtctctgagccagagagcctggttcctgtcagtgggggaagggcctgctctaactggccagcccccagcccagcctgggtctccatggtaacagatgcccgctgtcaagcttggccttggggctcagccagggggctggtgccagggactctggggcactgctgggtagcctgtttgtgctcttcgtcccttcctattctgcacctgcaggcctggtttctgactctgtttgcttctttaccccatgggaaccctagtgatgggccccaagtgaggaatctttcaggcctagcctctgaattttgtccctcttccctggcccaggtcgttccaggctgtgtgacctgtggcaagttccttcacctctctggtctcagcttcctaatttttcaaaaggaaatggccacaagtgatgatgtcaaaactaccatccatcacatcagctaagaggaaggacacttcctgcaaagggtcaagagctacaggaatgagggagagagaggcagagaccctcttatgtagtccagcctgagtctacctaaactttgactttctcccctgatgcgagggagctgggaggggccagaagggtagagttcattaacatttatggggggtggcaggaggtgctaaggggagtgagaagtagcctgggccctggtggttaatcccatcccctagtgccaagttcaacaccccccagcggggggacgtctcacgcctgccactagcagcccagcttgtgcagacaggcggccacctgcaggcctgcccctcgtcaccacctgctcgacctcagccaacccctttcctgttgacaaacagaagagcttgggctgaggaagggtgaagggcaaaggcctctgcagcaatgcggatccccccatctttgctatttgatccccaccaccagccagcacgtggaaatcaaatatcagcagtctagctgttgactgcctgtggctgagtcagaggaaaggagaacaggggcacttgcctgaggctggagcaggggagaaggccctgaggggaacatgggctttgctataactgagctctgaagctgcccgtcctgggctccagttacgcacggactcaactctaacccctgttctcagtttgagacttcctaatgccctccaagtttcatgtctccctctcacccacagggtggttaaaaacagggccagactatctgagcctgaatcctggctgtgtgactttggggcaagttaacctctctgtacctcactttccacatctgagaaatggggctaataataccctcctctgggcagagtagtgaggattaaaggcatgaatccactgaaggcactcagagcagtgcccagctaacagtgtcatcactgcaatcacatcagccttctttctgcccatatctctgtgcttgttctgcctctggccctttgcaccctctgctcctgggaatgtccttctgccagctccacatgtacccatcatccctttcctgtccatggtctcctttgaggcaccttctcagatctaactaaacagcctacccccaccatagaaattagcctgttctacttcctccacagtgcttgttggtcattgaaattacattgttggctcttcatttccactagactctaggccacttgaaggaagttgtcttgcccaccccatatcttggtggcatgaggccacagtcagtgccagctgcctacctgaagccagacctgatgtcccctgtcactctgggtgactgaggtcagtgccctgttctcccttgttagaaggcaggacaaaattcgcatctgcctcatggggtgtagaaagcagaagcaagaatgccagccctggacttccctggtggtatagtgaagaagaatctgcccgccaatgcaggggacatgggtttgattcctggtccggaaagatcccacatgctgcagagcaactaagcccatgtgtctcaactgctgagcctgtgctctagggcctgtgaccagcaactactgaagcatacatgccttagagcccacgctctgcaacaagagaaaccactgcagggagaagcccgagcagggcaacgagaggagcctccactggctgcaaccagagaaaagtccgtacagcactgaacacccacccagcacagccaaaaaaaacaacgccagccctgcccacctctacctctttctggcatcaagagaagctgaatagggagattgaagcctgtccttctgatgccaggtgttcagagacctctagcctcctgggacc

SEQ ID NO: 57076 - DNA, 923 bp, Bovine  19866880924382
cgggagctacgtcaattttggagtcttccgtctctatggggatgatgccctggacaatgctctacagaccttcatcaagctgctcctctctatcccccacagcgacctcctggtaagccctgagcttcatcattgaccgaatctgagcccctcatcatgtcagtcttttttttttttttggctgaggccatgattgaatgtttctctgaagaactagaagctagctccactgggcccttctgtcttcccatctgaagggcactaagctgtttatttctgatcgtgctcacacgtgctgaggtacacatgacctcctctgactctaaccctgcttctcccacaggattaccccaagctcagccagtcttactattcactactggaagtcctcacccaggaccacatgaactttattgcaagcctggaacctcatgtcatcatgtatattctctcttccatttctgaaggacttactgcacttggtaagcacctgggtgggtgggtgggctggtcaattggcttttaccacctcactaagcaaaagggagaatcttgcctcaataggattactgctttgggatcacaccagagtatataactcttgagaacattctcctccagcacatacttactgatgccctcctacagactaggcactaaggacctagtaattagtccctgtcccttgggagcttttcatctggtagatgaaatagacttgtagacagatgactgcctgttcccgcccttacctgtgtaagcacagcagtggggtgagtacagagtgtgtaggagcaccccggaagaatacctgaattcctggccttgaggaagggtgtcctgcaaggcgctgaacgggcatcatcagatgaattggggaagaagcctcctggcagcaggaacagcaagtactagcccccaaa

SEQ ID NO: 57077 - DNA, 1346 bp, Bovine  19866881126074
tatacagcctttcatataaattattttacacattcatttgtcttttatctcagatgtgatttgctaatttctcttcctacaatatgtatagtgtaaaacttgtggatatttttaacatacaaaaggtttcaattttgatgcagtcagatttagcagtcctcttatatatcagttagattttgtgtcctgaaaagcagcagttttaaaataccaatttctcataccttgtctaggcagtttaagtatgactgcattccagatgctgaaatcaagctgcacaggccaactctttctgccttaccttttttttttaaaccaggatagtgttgaatactgcatcattggtgtcacgattttatcgcagctaaccaatgaaattaatcaagtaagtgctacagccttcctcattgaagtaagtgccatatttttacttagtattggtgttttctgcctgtgtgtgggatgatcttttttggcagttgtgtgcttttgcggtaagtgattaatgcccttttgaaacaaaatagttccatggggttttcctctgtgagtgaggtccggatgcccttccatctccagaatattttttctctcatctcagctttcctcagtggtattaatgtttaatgttagagaagagcgcaatgatcctaagtcagaacttaggaaacccacatcactggtgtgctctttctgctgtataagttaatgtatttataatcattcaaaaatcaattctcatttgccttcattaaagattttgctgataatcttttcagaatgcacaaaacattctgctaaatatcaaataatttgttaaaatagtcatcgatgtcacagattactacagaggaaacaccagtggctttcttttgctctggctataatattttttagtcatttacttttgtatccagccaaaatgttgtaattattgaacaggcctgaattaattgtcccagctcacccttcagctgtcagctattaattacattgcatcactgttgctattgctcgtacttatgcagacttttaattaaccctgagaaatttaactgtgagttggtattttaaatacactcactagcttagagcctattaaaatctggagtccatattgtattctctgtcacatgcaatccacactacgattggtaattattaaaataataatttatacttttgagtgatttctgtgtggcaggcactgttctaagcacttatattaattttattctcacagtagtcccgtgagatagagactctggttatgctgttttctggataaggaaaccaaggcacataaagattaactaatttgcctatgatatcacagttaccaggtg

SEQ ID NO: 57078 - DNA, 1327 bp, Bovine  19866881142002
ttctgcttgtcagtacatctctggcccgtggtaggtgactccatacaatttgctgacagaaaaaatgactttttaaaaaggaaagaattgagtaatgtttttttttttctttttcttttcttttttttggccacgccacatggcatgagggatcttagttccccgaccccagatcgaacttacgccctccgcagtgaaggcatgcagtcttaaccactggactgccacgggagtcccagaactgagtatatttaaaagtgaatgggtcttatttatgatatttcctagtgtggggaagtgatacttaaaaaaaggaggtgttagctgaatctttcggactgaaaaagacaagaaggacaactgagttatggaatgaataatatttgaatgagaaatctcccttcctagctaaaagtagctctgttcacttaggcaaataatttacattcaaaatcacggaaacaaaaacaaaaaacacacaaaatgactagttctctccttattttccttcgaagtgaccctttcaataatttcaacattcctgaatctagggacaagctccttttctgggtaaatgttaaaaatctatgtacagacattcacttaaatcttctgaaggataacagattgaactgttttctagggtttttgctatgtgtgacctctagattgagctttttgcatgataacagagaggtatatactaatcatacatgcttatacacacatacacataaaataaaagtaaattctcaaaagtcatacctgtgggttttccagtattcgtttaacaccatcaacaaggtgagagagaaacttggccctctctgcattgttgaatagggatcttctaactgaggcaatctgtactaagcaggataacacctagagcagggcacaaccaaaacacaaatgagcagaaaagatggtatagctcttttcattactctttcccttgctataaatattcttctctgttttgtcaccctctgctatcattataatgatataaaaaaaaagatcaaggaaggtgtagttgaggatatctgaaacagctttatttaaagaaaaataaagggcattagactcacagtgagcataacaactggttaaatccacagtttggaacttcatacaggtattatttttcaaccacccctatggcttctttgtgtttaagatacatatttaaacttgaaaataccaagaaactgacagtaaacaatgctttagacataggtttttttttttttttttttttcctgttttattaaggccttttggctatcaggttttgctatgtagggctatcatgaaataaccaagt

SEQ ID NO: 57079 - DNA, 1635 bp, Bovine  19866880472583
taacagttaggaacattgtcatttctttgttcattcattcattcaataactcgctcattcatccatcctttcatccattcaacaaagacgaaaattcctggcctcttgaagctttcattctagtgagaaacagacaataaaattaaaaatatagtatgtcaggtggtgacaagtgctaaggaggggaaaagggcagaaaaaggagataggaaaagcgtgtcagagaaaagaatacaagcgtaaacatttaaaatagaaaggtcagagaaggtgacatttcaacaaagacctggaggagatgaggaaatgaatcatgcagatattagattgaggacaaatgcaaaggtcctggagcagaagtgggcttagcatatttgtggaacaacagagaccagagtagctgatgtagagggacctggaggaaaggctagatggggtagggccttgtggcccactgaggtgactatggcttctagtgacagaggaagacaccagaggatgctgagcagaggcgtgaggtgacctggttttgttcttccagaacaagagagcagcagagtcttagaggaccccatggggatggctctagcaggatgggaggggccttgggggtcccaggtgggatgaagaggccagcaaggccgggtaggcgccaggtcacacggagaggcagcccccgatttcctcctcctggaaggcggaccagcagctgacgggcagatggccagacaaaggccgggtgagcagacagggtggcctctgaccgccaagttggacgttcacaggggctggctggtccctcacaggcctgcgcccctaagagaagagacagacggagggaggagggcaggctggggccacgtgactgtctcttatcctctggaggaagacagagagtgtgtatggtgtgaggatactttgtaatcccaactgggtgatgcgggcctgctgcagaatcagcacagcagagaggtgcaagaatctggactccagacacactgtccaggctcgaattcagctctgttccttgccagcgtggtgaccttgggcaggtcacaacctctctgttcctcattccatggtatgctgataaatgtttagcaactgtctctccaaaaggcggggggaggcgggccctgatgagtagtgttgccagtttgcatggtgcaaatactcccaatgtggcctgatttcaaactcccaacatgatgtcactgatcagaattgagaagagatacgcagttccacagagctgtatatgaatctaccatccagattcaacagacataaataacctaaagaacgcagataatagatacaaggcagtaaaataattaggaagtgatgaatcttgagtgtttattacctttgtttttaatatgttgtttaattgtaagttgatgtaatttagtttttaacaacggtctgtgcttaacaacaagctcacacaattcctgaaaatttaacaatcaactctcaggagtataagccacctccggcgtgccaacttcctcatctgtgaaacgaagataaaaatagcaactcccggctagctctgggcactactgagataatgcttgtaaagtgcttaatgccacgccctgcccagagtgggtcaacctggtcaacaaaggg

SEQ ID NO: 57080 - DNA, 1056 bp, Bovine  19866880499547
tccatccttcaccttctcagattgaaggaagcacagttcttcctgtactttctctgccagtcctggggaaattgataggctccaggggaaattaatggggcttcctgggaaggcccacaggaatgtgggcatgtgtgctagtgtgtgcgtgcatctaagtgtgactatatgcaggtctgtgaatatgaatgcagatatatgtactttcgtatgtgtccatttctgtgtacccagtcatgctctatgtatattgcaggtacatgtatattcattgtatatatgaacagtgtgtatgagtgtgtcatgggtgctgttttgaatacatgtctgtgtgtgagtgtgcacattcatgtgtatccaggcaagcagataattgtgtgggatgtgtgtacacatgtgtctgcagctgcatatagcttttctcccactgcttttgtggctgcattgcattggaaggaagggtttggggaagcatcgtgggcatgctcgtccccagtttgctgaaatagggccaagtcatgctgtatgtttcacggtgatgaggtttcccgagcatctgaagtctggtctgggggcttctgtgggggagcctgtgccctggggcccacctgcaggagcagagggttccttctcttccctccttccagtccccttggcagggaaacttgacttctcggctgttaattgggatccagacgcgcacagcaggtcttggctcacaccctcttccttggccttcttcccagagtcgctgcccttcagaggagaaggggtttgtattcagtggagggactgagctcagggtaggaactccatcatcgctggcttggtagctggaggcgatggttgaacattggcagtacccccttaggtgggctttgtggtccagagggaggagctggtattgggggatggcaacaaacatgcattgaggcatctgaaggacctgaacctgttcctgcttcttcactacctagctgtgtgagttagggcaagatcttgaccatgctgagcctcaattttctcggctataaaatgggagtgctggtactttcc

SEQ ID NO: 57081 - DNA, 1723 bp, Bovine  19866880536778
tgcccacgagtaggtaggggacggccccaacacacctctcattgcgctgtgcatgtagatgctgcgctcagtcttctgctcagctatcgggttgcttggcgccatctactgcctctcggtctcgggaaccgggctccgaattggaccacagtgcttaatgaacggctcctgggattaccacttccaagacaccgcgtaaggcttagcctgtattcgtggccctgccccattctctgtctctgcccacctgcctttcccacgcggaccggggaacctaggccggactcggctttgagactgcttcctccacgtgggccaaacgagctctgtgtatatccccctcggcgcctgcgcggggcgggaagccccaggttgggggggggggggcggggagggcgcggctccgcgtgacctcctgctctcgcgtgaccctgccccacccgcagaggctcttacctgctcaaccgcacgcaatggaacttgtgcgtggagccgcccgatgtggtcctctggaacgtgacgctcttctcgctgctggtggccgcatcgtgcctggagatcttgctctgtggggtgcagctggtgaacgcatccattggtgtcctctgtggcgattgcaggaagaagcaggtgggacggtgtgggatggagctggcaaggaaacctatctgctccctggctgtgtcctgtcctcactttatcttttccgcagggttcctctcagtgaggctccatctacgtgatccgtcgctcctggatacccacctggcccgccccaaccctggaataaactagagtatttagagttctcttccgcgtctcagattgtgcccttatacaaggagtgttggaaggcctccaggtacaccgttgcttggggcttttataccttgcttgctattttcttaataaatactgagctgttggtgcactgaaagtactgtataaacaagacaggcaagttctgtgctcttaaagaatttaacattccaggggttagaagatggacagtttttaagaggcaatagattatttcagttggtgataagcacttttttaagaacatggaggtaatggggatagatattcactgacgcatgacctttttcataagacaaagttcaagaaagaaaaattggacctgaaatctggtggatgggctaatcatctggactgttgggagagtccaggcagagagggcagcaaggacaaggacacttaataggactcaatgtacagaaaagccactgtttgagttttgtagggggaagaaaaggaaacatatggaaaagacaagcttcccaggtggctcagtggtaaagaatccacctgccaaagcaggagatgagggtctatccctggattgggaagatctcctggaggaggaaatagcaacccactccagtattcttgcctgggaaatcccctggacagaggagcctggtgggctacagcccatggggtcatagagtcggactccactgagtaactgagcaggcactcatggaaaagacatgttagtctcctaaattctagaaagtgaagccttaagacaatatagcattgtcacctaatttggtagaagtttcttaatctggggtcactggtggttcagaaaggaaacaacctgggctcttaatggggatgacacgtttgcagaggctgtcggaaaagcaaggacttcctcaacctgaaagcaaaatctgtttcagtgcatttgttt

SEQ ID NO: 57082 - DNA, 935 bp, Bovine  19866880538364
agtcggacacgactgagcgactacactttcacttttcacttagagccctgatctcctccctgtcacaaaatgccctcggtcccgcggacagatctttaagtcccctttgccctgagggtgatttctggaactgactgtggtcttgtgcccattttcccagtactcctggctcttcttcttgtcccgggggctggtggggactggcacagccagttactccaccatcgcacccactgtcctgggagacctcttcgtgagggaccagcggacccgtgtgctggccatattctacatctttattcctgttggaaggttggtattaccctggatctacttctctgtgtggtaaactgaggaccaaaggggtcagaacaggggctgggctggatgtaggagacattgagcagaaggggttgcatttgaaacccaactctaccttcctctctgtgtcactttatctctctgagcctcggttttctcatctgtaaatggggccaagagcacctacctgtaggctatggtgggggttagagatgtgtaatggagatgctccctgcatactaacgcactcctggaggagggagaaagagcagctcagcagtgtgggctacacagggaggggctgactctgggaggtgaggcagggaactgtgttagggttgggccacacaccccgcaatgggataggacagagtgggctttgcagtcggacccctgaactctgacttaggtttcctgaaatcacctgacttgggcagggctgagacttggagaggcgggatgagtggtccttatatagggagacagtggatggttgggatgggcctggagccagagatcactggtgacttaccaagggcagtggacatctgggcctcatgtggctcactttccccagttgggagctgctgagagctggctccctggggtagggg

SEQ ID NO: 57083 - DNA, 783 bp, Bovine  19866880624827
agggaggccagacaaatcagatacaggacagaacatgtagcgtgtttagtgacaggtgttaaggagaaaatgcaaggccgacatgggagatataactaggggagggtggtaggagggatggggaggcctgatccaggtggattctgggtgaagataccaagggagtaggtaatgtggatgtgcagggcaggagcgctccaggcagagggtaccacaggcacaaagaccctgaggtggaccacccgggtgtctgaggcaggccctctaagggaaacagcttcataaagtaggggctggatttcacccctccccacccctccacacaaccacacacagcaagccttggaggccagcctggaagccggaagtggggtcagagggctgatggagagcaagacagtgcagggtggctgggttgcaaggacttgagcttttactgagagagggatgagaaggaccacagcagggtactttacgtgacatgaccatgctcgtgtctgcagtcctgcctcatgggggccctggggtgggcagtgggcagagcagtgggctctggtccaaccccttcccccaattgcagtgtgaaggagggtgccaacaaggaggtgctggggatcctggtgtcctacagggtcaaggtgaagctggtggtgtctcgaggcgggtgagtgctgggctgggggagcctgggggtggggtgtggcgcaggggtctcctctggctctgcactatcatctcttcttgccacctctcccccaaccccagggacgtctcagggagctg

SEQ ID NO: 57084 - DNA, 2048 bp, Bovine  19866880637790
cctccctgactgccccagcagcattcacagccctctgcttcctttgagttctctgtcaccagctgagatgttgctcccctactcagaggcctccctctgcctgccatgagacagaatttgggctgggagggagggagctccagccttggctctgccactgccttatccctgagtgacctgagacttggagcctcactcccctcgtttattcagcagacatggttctgtagctttgccggcttctcaggttgttgggaagatgcccaagtgtataatgctcacctctccgagcctcatgggagagcatccctcctctgttccaggcatggctggggaggtaggttggggtcacctacccaggtctcataatttaccataatatggggcatggaccagactccacttctttgttacagagccatgagccgagtggagggcagggaagagggacagattgctggagaatgtgatgttggatttgggtcgctctggtgggggagacttgatcctcagagaggagggaggaaggcagagcgggagcgaaggtgtggaggtgggaagggcaggcagcctgcttagggggtgtcggtggaggatcagggaccacctgagtgcccaggagatggaggatgggagcagacaggctccgacagccccagccctctcccagctccatccagagcacttttcctcgttgttcagtcactcaatcatgtccgactctgcgactgcatggcctgcagcacatcaggctgccctgtccttcactgtctccccggagcttgctcagacttgtgtccattgagttggtgatgccatccaaccatcttgtcctctgtctcattcactttctctttcagctggagttttgtgtggtcgacgcttggagtgacagccatggcctttgtgactggagctctgggcttctgggcccccaagtttctgttcgaggcccgtgtggtgcacgggctactccttccctgctttcgggagccatgcaacagccaggacaggtgagggacgtctcggctcttttttggccacacaacacggtatgcaggacctgagttccctgaccagggatcgaactggtgccccctgcaatggaagcgtggagtctcgaccatgggactgccagggacgtccccaacgtctgggctcttgatgggaaagttcttggggtcctgagtcccaagactcagtctctgggtggacaccaggacttggggctcactggcctggttctagctcaggcagagctcttgctgctgagtggccacaggccgctcccttgtcctctccaggccccagtccctgtcttctcgctcttgggccactgtgagggtccggaaggcacttgggggtgagtgaggcttctgtggaacctagggaatggtgggatttctaggcagccttccttcagagggacctgtagcatgaggttgtcccattttacagatggcaaactgaggcaccaaaggagattgtgattttttttttttttggctgcactgtatggcatgtgggaatttagttccccagccagggaactgaacccgtgcccctgcagtggaagtgcagaatcttaaccactggaccgcctgggaagtcccaggatattatgatgtttatcctggctctacagctagattcttatctccccagaggcaaagactgagtcctaaaagtcccccagcagcttgaaaaagtggaaaaataaaccaggcctccatcccacttcagacattcactggctgtgcattcctgggccagtgatttccactttctctgcttcagcctcttcgtctaacttggctccttcccagaacctgggtgagaaactgacctgggagttagtgttcgggtcctagggctgatggaccgaatgaccgcacactcagtagcttcgagcaacagaaatgtttcccatagtcctggaggccagaagtccagaatggtttcactgggtcaaaagcaagttcatcggggccgcgctcccgatagaggctctcggaaagcctcctcctgtgccgcttccggtgcctgtg

SEQ ID NO: 57085 - DNA, 1583 bp, Bovine  19866880666025
attaaccgtttcttcccaagactttagtcatccttgtcaagctgctgattatacgtctctgtttcctggcaggggcccagagcaagggaggaaaggaacctacaatagtggggggaagtagaaaactctggctattctgataaaaaaaaaaacaaacaacactttgtaatcaatgcaatgctgtaaagccaatggatccagttcagtagaaggaacactgtgattcaggcttccggaatctacagacaagcattttttttttttaaggaagagaattacttagcaccaatttctctctctccagtaatacttccttttcctcggagcccttggctgtaatgagtcggagcacagttcagtggtacttttcatcagtaatgcagccgggcaggtggggggcgcagtcactcggcacaaacagcgctctcacaccactatgcagctctgctcaagggggcctcctgactcggggacaccagcggcctcaccgtcttctctgggggatggctctccagccccaaggggcttcactcaaagcggcgcaggtggttgtacagagactggacgtaggtgaagacgcacatggggtccggcttgcggcccatcaccatcatgtcctccacctcaatgaggcgctcgcagttggccaggttcctgaaacacagacgccccatcagaatgtcagccccagccagcagccagcatcactgctggggaacacagctcagcccagagctggaggctcctgagtgcccccagtagggaattcacattaccccacaagagtttgtggagttactctctctaatgcagtgtttcccgaactcccacatggaggaagcacccttccaactcgtgttttgacttgactgttgtatttcagtctctcagttatgtccaactctgtgaccccgtggactgtagcctgccaggctcctgagtccatggtattctccaggcaagaatactggagtggcttgccatttccttccccagggcatcttcccaaaccagggattgaacctgcacctcctgcattggcaggtggattcgttaccactgaggtaccagaaaagccgctttagctaactagtgagtgagtgaaagtcactcagctgtgtccgattcttttcgaccccatggactgtagcccaccaggctcctctgtccgtgggattctcctggcaagaatattggagtgggttgccattcccttctccaggggatcttcacaacccagggattaaactgggatctcctgcatgcaggcagattctttactatctgagccaccggggagacccaactaaacttactttaaattttcagtgaaattcaatttccctttcaagtttcactaaatattaagttctgctaaaaaaaatttcagtttttattaatttagtcaaatttatatgaatcaaaatggttagttttattgataaacatccagctctgaacttaaatttcactaaaaaaatccaatgtctatcagcagtgtatggagaatcagcatagactataaaataaatgtaaaataatcaggtaaaaaataaatctacccatatgcctcctaaaacagt

SEQ ID NO: 57086 - DNA, 679 bp, Bovine  19866880690025
ggaggggttgagggctagtggccggattccggacttgggctcacctcagcctctccccgggaccctggggctgagtctgcttctagtcaggcagagaactaacattcctgagtggctacagcatagtccacagaagccatatgacaattccatgggttttaacatttgctaatctgcctgtttaaccggtgaggaaaaactctaaaaagtaaagtgatttgtttcaggttgccagcttgtgaaactgggaagcaagtatttgtatctctactcctgaatcctctaagttctctcagggacctgggcactcagtcctcagctccaaagaggctatcttcagccccaggggtctagctcccagccccaaatacccagcgctcagctgttactccagggatcaagactctgaaataacaggcacttaaccttcaagcccaggaccctgttccaaagacctggttccacttcccccatccatcctgacctccttatggtacctgcggtgtaggtaaaaggcagggttgccagttctccagcccgctccatgaaggctgcaagccttgggcaccaaaatcggtggcttacgtcatctgggcatcgcttccagtctgcacggagacaagcctctccacagtacaagacagcactgcactgggggctggggttataggaggtggtg

SEQ ID NO: 57087 - DNA, 938 bp, Bovine  19866880715208
cagttttgcatccccagggcctataaccgtgttttgcacgtgggggggtctcaactgttgaataaatgcgtgtcctaacaagtgaaaactcttagctctaagctctgcttaaagaaagcattcaataaacatcatgctggttaggctttctcttgccttttgtatacacacaattaagaatatatcttttctgagttttttggaatgagacctcgtctggtggtaaacagagctctggaagcctccatctgagacttgaagttaggatcttccaagagaaaaaaaatgggcctcttatttcagaccttttctgtgtccaagtttggttatattccagaagaatcttctgactggtaactcctggcttctcacagagcagaaatatcagtggaagtggatgggacaaggagggagcaggccctgggctgacctctttccttttgtcttgctcctcgtggttgacccgcttcacagacccagcagcttctctttactgtccggccagctggaagttttagactgcagtgtccttggaaccgggggggctgcgctcagtgtgtatggaaataacaccacggcgcacaggcaggagggacttgttgccgggcagtcgtgctgacggagacgttcttgctctaacagtcttgtggtgttgtgtctcttctctggaggagtctcttccctttccttttctctactccaggctgtggaactagcaccacttggagggctggcagttctgggcgtgtgtttctaggccgatgagcaaccactgcactctgatgtgctggctgtccaaatgttgatgatagatgcctcaggccagggctggacaggctgatctgcagcagaagcaggggctttgagtggggactttttccctagggaactgcaggtgagggtggggctcttgggggaactagtggcacttggagtga

SEQ ID NO: 57088 - DNA, 1480 bp, Bovine  19866880716364
ctccccccccaataaaggacccacagtgtggcaccttccaatgactaaaacccgcacgcagcagagtacagaaattggtaagtcctagagtagttagtgaaagtcattcagtcgtgtctacttgcaaccccatggactatacagtccatggaattctccaggccagaatactggagtgggtaacctttcccttcttcaggggatcttcccaacccagggattgaacccaggtctccccacattgcaggcggattctttaccagctgagccacaagggaagtccaatactggtgtgagtagcctatcccttctccagcggatcctcttgacccaggaatcaaaccggggtttcctgcattgcaggcagattctttaccaaatgagctatcagggaagcccacagtgtaattaactgtgtaattacacagtgtaatcagtgtagttaagctaatggcattaaccacatgtcacgtggcagaatcacagagttggtccactgagcctccagggacagaggcggagctgtgtgctcatccgtttccaccaccatcctggcctcggacagagtttggacatagtaggtgctcggtgggccctgttgacctggctgggacacatcacctgcacacctgctgacaccgctccactgtcgtggtaaacatcgcattgcacgttggcaagtttggggcacacccagccactttgtgcctctgataaaggctttgaggtaactagagcaggttcagtgcataactaagcacagatcaggggttagtgagcccttctggtggtccatggtctgcgatggagcagccgatttacaagggtttgttctcccactggtgactttccttctgccccccagggcagggctgggctctggcacaccagacccaccctccgagagggaccgattccccaaaggaaaacccaaggttctgccccgaactgtgccgctgccaccccccaaagtcttcctctgggcctaggaatttcatcccaaaggagctctgtttctttctgttactttatccagcaagcttacgctgacccgaggagggtgactaaggggaaatggagtattttcagccaggggccatcacagtcactgtatcaagtatcttttgggggcagtgaatttcacgacaggtgtgtttttattcaggagaaataatgcacttaatttagagggatgaactttccttccaagaactgttcactctctctctcccctaccctcacccatgctgccaggagaacccacagcgatggcaaccatgacatttaagcctggataaaccattgcagcataagccacaacatctgacttcaagtcttgtcttttaatgacttttaatgaggtgaattcaccaagccatacttctctcttctttcaaatgggcatcagcctgtctctacaggcttggaaggggtgaaagtgaatgtgtgaatcactcagtcgtgtccgactctttgcaac

SEQ ID NO: 57089 - DNA, 702 bp, Bovine  19866880755624
gtagagaagattctggggaagttctagggaagagtacatgttggagtcttggggctcatcctacctcggtcctgggcacccagcagcccaatctcagtgatatctcgacaccaggcctgcagctcaatgtcgtctctcacagactcgtccgtcttatagtggagactcacaatcccctccacgtagctgccagtggaggggtcagggcaggagagtggaggctgatgacatggagcccacaggccctttacggtccttacctatgtggacaggccagggcccgcagcccccttgctggggcacagacctcctcttctcccagcctccccccaccaccagccctgccttcctcccacctcaccgagagagaatttcccagagcctcagggcatcttgggcatagaaagaagacttgactcccaggagcccccggtcagccaggtcatcagggggacagaaggagctataggttagaaaggctcctgctcgctggagcagctccacatggccgcccccacctgtgctcaccacctgagaagcaaagacagcgtggtcaggcaaatccacctgccctcaggccagagggagcgtgaatcccacttctctccttgtacctggtcgaagactcccgagtcagagaccagcccagtcctggccccggatgttaatttccatggtgtatcgcaggtgcggaatgagaag

SEQ ID NO: 57090 - DNA, 987 bp, Bovine  19866880933603
ccatcctttggccccagtacccggtgtaaatgcccataagcccttctgccctcaggatgctgatgagggcatggaagctggttttgtactctcgtgtcttggctccttccccactcagctgcatccggttcttcaccaggtccaagggctgcacaaaaactgtagctcccatcctgggggaagacaggggtagcatcaacggctaggtgtctcagatctaccaaagtcccttggagcccagcgacaagaggtcacaaagggcagggccgccatgccattgattaagagttcaggaactggtgggcatgtgtacaagagtctctacctgtatcaagagcaatgggtcttaaaagtccagcagtccagaagggaccatgcaatgaaagcgtttcacacagcaacaagggtgtcaagcagtgaccccgggattgcgtgcagtccaacccaaggagaggtgggcattcatgatctaggaccccatacagtccagcaagagccatgcaatgacctgaaaccccatacagtcccgcagtcaagcaatgggttgggaaactcaggtggtcttgtgggggtcgtgcatgcagcccaaaggcgccctgcgatgggtgaaaagatcctggcagtccatcaaggatcttgcaatacgatggggacggcactgaccccgtgtcagctcggttcactgcaacacacccaaagaagaaccgggcccggtaccttgcacccgtcccttcctcctcctgtcccatccctggggcctgagcttacccggccaggcccccaaacaggaacttgacggacttaggggaggtacggggcttcccgtccatcccagaagccccgggactcgccgtcgccgccatcgccactcaatggccctcggctcgcggtcccgtgcgcgcgcggccccgctcgcgcccaaggtgacaccgcgcgcgcaacaggggcgagggcgcgcgcgcacgcccctccggctctcaggtccag

SEQ ID NO: 57091 - DNA, 620 bp, Bovine  19866880959949
tggaggaggggccccgtggtctgtggggcacagcccccagagcagggaggctgaggacaggggctgacgttcattttctacaagtgtgcgtctgcccctgggcacagcacccctgagggtgtgctgcttcctcgtctgcaggaaagagaagggcctgagatcctgggcctggaccctgctgccgggatggccggggctctgtctctggccctagaagctgactccccagcctcctcctctctctccccatgatccagggcaagctggcctcgtttttcctctcgcgggtggatgccttgagccctcaactccagcaggtaaggggaaggagggagacagtggggagcctggggtctgagctggtgcttccccccacctcttggtttcttgtttttctatttttctattcttgttttctattgccgcttttctctgcattttcattcccctccctgtcaacgcgcagtacacaccagtaggggcttctgcctcccggtctctatctgtgtctttctgcctcttccattccatctcccctcctagtgctctgacctccatcttcctgggcgctggtggggttgggatccacggctgggctgattcccaccgatcgggacccc

SEQ ID NO: 57092 - DNA, 1076 bp, Bovine  19866881034081
cgcccgccctgcaccccccagggcggagcggacagtgaggatgacaacgacgatgaggagctgggggacgaggccatgatggccctggacaagagcctggccagcctctttgctgagcagaagctgcgcatccaggcccggaaggacgagaagaacaagctgcagaaggagaaggcgctgaggcgggacttccagatccgggtgagcccagggccctgccctccccctcaccacgcccctccccctgccctcgcccccacacctggctgagctcaccttctcactacaggtcctagacctgatcgaggtgctggtgaccaagcagcccgagaaccccctggttctggagctgctcgagccgctgctgctcgtcatccggcggagcatgcgcagcaacagcagcgccaagcaggagcaggacctgctgcacaagacggcccgcatcttcacgtgagggcggcagggtgggcccggacagccgggccggggggctcccggagggaaggggtgggagccaggggcccgcatcactcaggagcctacatcactcaggagccttcacccatgtgttcctgcagtgcttagcacagggcccccagtcccatcgatgccctcagggtcactgtagttgggaaagcagacttggtgcccagttgtgacaggctggggctgtggcagcgagtggacgggagatgggacacctaacccagtcttgagggactggggaaggcatcctgagagaggtgtcagcagtgctgggggccgtggagctcgctcatccacccagagaccacaggcagaacaggaaggcgtgtctgacacagtcagaacataagcagcttgtggcctggccgacctcagtgttgaggggccacagaggcctttgcagcaagagcagaggtggggtgaggcagggtgggcgcagctggagcagggagcccagccacggagacatagatagcaggtagagtcctgcttcctggggaagggtgggggaggacagtgtggagacaaaggcctgacaagaacttgagacgggggtgtgcccccagtgtcctcacctcaccggcccaggt

SEQ ID NO: 57093 - DNA, 786 bp, Bovine  19866881035341
ccctgcccgccccccacacccacaggaacacgctgaaatacaccttttccttcctccagctggggcagggtggatcctgtcccaaaatagagccgatcagagggaagctgcagccacaatggagcctttgagctgaacaaaccgccagaggaggccaggtttcctcagacacacctggaaacccaccccaagccaccaaacccttgtctccacgcggcagctctgaagggcaaagagaggcccggctagggagaggccacctcctcaccccataattacagagcctcctgaggcgccgcctgggctcagggagggtcactccttcagagaggtgtgaccccctaagagtagacagctcggcccaccctgccacacggggctgctccgaggagatcaccacccactgggtcttgatttccccagccccacaccccaccaggtgcctccatgtgccaagagcttgtgcttctaaatctgggagagggacatccctggtggtccagtggctgagactccatactcctgggttcaattcctggtcagggaaccagacccacatgctgcaactaaaaccggtacagccaaataaattttaaaaaacaagaataaaaaataacctaggagataacctcagtgggtgctgtttgtgttccccacaggctgtgtgcaaatcaggctaatcaccagcaaactgcccagggggctttgctcctggatggcccctgtccccccatcacctggtgagacacagacagggggaggtggggtggggtgtctcctccacac

SEQ ID NO: 57094 - DNA, 826 bp, Bovine  19866881083677
taaaataggcttgcaagaacagggggagtttgtgattggtttgtaaatttgtgataacagctttgagcagaaacaaaactcaagtaccactttcaccagagcgggtgacacgaaaactactcaagtggctgttttttctttttaagtcggaatgacacgaaaagaaaaggcaagttgactgacgaacaaaactgaactttctttagttgctatgttgttctgttgctatgtggtctaatagaacctacaaacataatcaaggcgatcacatttcctctgcctcagccattggaaaagcttcatacccctaagagtcttcatccgcagttgtgcccgaagcaacaaagtttgcccgagggtttaaattgggaacgatagtaagagttatagctagctttttttgaacgctgagtgctaggctgggcgatttgtgtggatcatctctttaatccccaccgaagcgttatgagttaggttctattattatcagctccatcagacagatgaggagactaagcccatggaagactgagtgctggcccacgggacaccgcaagccagtggcagagctgcgatttaaatccaggcaggttgaatctagatccctcatccgagctaattctatttcctagtctattaggggcaaagccagaactagaatgcaggtctctttgttacaaattaaaaagtgactttagtgttgaaaaagacatgtatgggcacgaataggtagaaaactttagaagagggctgactcacatgtcagcaggatgattctgcctgctgcgttgagaataaactgtagcgggaagacaggcagaagatg

SEQ ID NO: 57095 - DNA, 728 bp, Bovine  19866881096134
cgggtttctgatttttagtgattgccgagccctgacccataaaggtagcacctgtgctgaaattgcccttgtctccctttccccaaagagcagtgctgggaccaaaggctggctctgaaatattgacacccttactccctgcctgccaatttttcaattttctcatctaataaaagaggaatacaacctcacaagattactgtgaagactatatgagaaaatgtaggtaaaagcttagcatggtgcttggcatgctgtggatgctcaaaaattccattctagctttgtccttcaaggcctaacgctaatgttgcctctgtatgaactttctataatacctcagccccagctggacagagtccaccctcctctggaatctcagggccttttgcttattgataaaagtggctctctctctctctcacacacacatacacactcactcacacacaaaggaaacagtttgatgactaggaagagcctgtgagttgtttctcagttgttcaaagtctgaactgtgactgctgaagttaacatttccagtcaacagggtctatttttaaaaaattgtttatttcagggggatcaaaggagactgatggataatgacactgttatactcctggcacagttaaaaatgcacttattcactcgcttagtcaccccacttgtttttcacacatccatttgactggtgtgtgcacatgagaaaagtctggagctgaaag

SEQ ID NO: 57096 - DNA, 1165 bp, Bovine  19866881124078
gccccggaggctggggagtgtccgctttcagcccagcaaaaggccttgtcactcagagcgagcggtgggggtggggaggcccgccgaggcaaggggctggactagggtctaggcaaggagctctctggagcctcttccggtctgtagacaagccaggctccctcagaagcattcttgaggctccttggggctggggtaggcatgggaggtctccgagggcacgagaccttccttaggaaggcctggagagccgaagccagcatccggacccaccaggcggccactttccttgcaagcccccagagtctcctttctctaacaaaactgtccccctgacccttggatctgctccagcaacaggtgaataactgaggctgccgaggcgcaaactcgcatatttctgccattgtggctgctctggtcgccctgcccaaagcatcctttccacttgccatcctgtctgacactctcctgctcctttttcagatcttcagagcccagtttttggggaaggttgttttattttttttggccatgcagcctggcatgtggaatcttagttccctgaccagggatcaaacccatgccccctacatgggaagtgtggagtcttaaccactggaccaccaaggaagtccagagcctggtttaaatgccaccttctctgagaagtcatccttggtgaagactgtcagcctgcctggcttccactctctgccccactgtgtccactgcgtgctccactcctgccctggttccctgctctaatgcgggatttgtgcttctctggagcagtgatctcagtttggagctcccgagagggcagagcccagagtcgctcagccctcaactccatccatcgcccagccccaggcactggatgaatgagtgcaggaactagtgattgaacagtgaatggagatggagagaaccaggggggaaggaaagcaggaaagaccccgtctgtgtctcctgagccctggagggactgcccggtgtgccagtgggcaggaaggtggcaggggcagcccaggctaggtttcagggatgctgtgccgccctgggctgcagccagctcggtcactctcattctttccagatcaaagttcccccagggagcagcctggaacctgacactggcccagcgtggaggggaccggctggt

SEQ ID NO: 57097 - DNA, 920 bp, Bovine  19866881127069
cccactcccatgtgcaaactggagtcacaggtcacacacacacacacgcacatacacacataggggagtggctcagagcttaggactttgcgtctcaataatgtcatggctcactaatctttggacctcagtttccttatctgtaactgaggattttaataataataatacggtatctgtatcctagaattgttgtgcatgtgtgcgaagtcacttgggtcatgtccggctcattgtgaccctatggactgtagcccgccaggctcccgtaagggatttcccatggaacatctgactcaggatcaaacctgcatctcctgcattgcaggtagatttgttaccactgagccaccagggcaacccccctagaattgttatgctcagtcactcagtcctatccaactctttgcgaccctatggactgtagtccatcaggcttctctgtctatgggcttttccaggtaagaatactggagtgggttgccatttcctactccaggcggaattgttaatatgcattaaatttattcatatttgcaaggtccttaaaaacaaagaccttatatctggctcatagtaagcactctatttatctatctattagttaaataaaattaataaatatgcatgattgcatgcttcacacttgactctcaataaaaattacaagttgctttcacctttatcctgttcccctgggttgagccagaccctggtcaccagcaggtccaaacaagcctgatgtgagaagttgtgattcaagtctaggaagaacatacagctctgggcgtgtgcatttcgccagatctgctagtggaaccacatgtcattaacaggatcacacgtggagaaatcatttcgcttctggttaaagacagttgaaaccatctccctctgctccaaacaagtagacatgagga

SEQ ID NO: 57098 - DNA, 903 bp, Bovine  19866881160808
cagggcagtcccagctgtggactttctgtaactacctgggcttccctggtggctcagacagtaaagaatctggttcgatccctgggttgggaatagcccctggaaaaggaagtggcaacccatccgagtattcttgcctggagaattccttggacagagaagcctggtaggctgaagtccatggggtcgcaaggagtaggacacgactgagcgaccaacactttcattttcacttgtaactccctagcgtgtggcttaacaaggtcttcctggctgctgggatgataacaaaatgaaatagataaagataagagataggaaagcccattagcagactttccaataatgcaggcaagagatgcctgtggcttggattgggctggttgtagaggaagtgtaaagaagtggtcagattctgggtgtgttttggaagtagaatcaacaggatttcctgatgggttcagtgtggggtgtgagagaaaaggatgagagaaaggatgactccagggtttttggcctgagccattggaaacacagagttgccatttactgagatggaggtgctgagttgtttttttgttttttttttgcttttgaaaagagtaggattaggagttcaattttagacattttgaatttgaggtgccttttgggacattcacctgcagatgttaaggggcagttggaaatatatgagtctggagttcaggagagaggtctaggctggtatttaaagccatgaggctgaatgaaatcagcacgggcctgaccttgaatagagaagaggagaggacagaggatgatactctggggcccttgacacatcaggggatgtggcagccacatgctaccacagtgaactcaaacgttgagaccagcagttcaatccagcacactctatca

SEQ ID NO: 57099 - DNA, 636 bp, Bovine  19866881241898
tgaccctcacctgcgcctttcgctatggccgcgaagacctggacgtgctgggcttgtccttccgcaaagacctgttcatcgccaactaccaggccttccccccaacacccaacccaccccggccccccacccgcctgcaggagcggctgctgaggaagctgggccagcatgcccaccccttttttttcacagtgaggatgcccccaccctctgtagagcaaggggtcccggactgtgttggggggcaggggtgaggcacctgttacaagaaggtctgggaataacactgtgggaccctagacccccagatcccttcagggccaccctgcactcttagcctctctgcctcttccctgggtccccctctgttttcctttctcatccccaggagtccttctccagcctcttaagttgagattgggaggaagatttggggactttctggaagaactgaactcttttcctctgccacagataccccagaacctgccctgctccgtcaccctgcagccaggcccagaggatacggggaaggtacgggaggaaaagtgtccagcaggagccaggggcacacctgaggcaggctggggtgctgaggagacattagggtgggactcagggcagggaaatatgccc

SEQ ID NO: 57100 - DNA, 653 bp, Bovine  19866881256620
cctcattaccctggggactctgcctccccctcccagtccaagtcacaggcacagggtcctacctacccccacccacaggtgctggtcctcccaacccatcccctggaggtccaattgcctagcaatgcccccttccccaggacctaaagcccctgtccctcattgcttagctcttcccccagcccagcaacctcaccgaagtgtgtgaccagtaggagtaatcgaaagtgaagcttttgggggcatccttgctctgtttgggattgatgatggctgagagcaaaggaagtaaggccaaagtcaggtactcccaacctctgcccactccccacaaacctctagaatccaggtatcccattctccacctctatcctaattcatctctcccctttaacactccccaccccctccaggcaccaaagctaattttggcttcccaggacccgccccccctcccggctgcctccctggattgggcaatggagggcttcaggccaacattccccctcccagggactgggagcatggaaaggccagcccctgtccttacaactagcacctgctctgtgcccagcacagccctcctcccggttcggcccagcaggcctggccggtatagtgggcctagcctgccctgcctgtgcccagccggg

SEQ ID NO: 57101 - DNA, 834 bp, Bovine  19866881279847
tagccctgtggatgcccagcccaggcccagaggaggcctgccgtgccctcaagagttccccagtttgtggagggccaaggccttgtgagactgggagaagacccctgctgcgtcccctccccagtgggtcctgccctctctctgcagccctggccacactcctgccctcccagcctggcaggtaccttctggcctcctcgcctctgctcaccggcttctctgcctggcgtggccttggggctcttctggtcacatcccgatcctgcccatccttcagggctctgctcagtgccacttctacgtggaagccctccctatcctgagctttcctctgacttcccttgtaccagcctcgccctgcgctgcaacttctgggacctttcagagtctccccccggccccctgacagcttcctgtccctcatcttgtcactggggtgaggggatcaccagaaagtgatttgtgacctgggcctgatccttctcatctgtaaagtgggagtcatggtatgtgtcttacgaggtggctgagagttggttgacaaacggagacaggcccggcatgttgtcagtgggcaggtagtaacccttcagtgcctctgtcctgggtgcttgtaggcctttgggtcccagagcctgggctgccctgggcagagccccgtgactccaggaatgactaattccactccagcaataagctctcaggagctctgagaaatgagactttcccctccttcctgcctcattaaactcttcttgagtgagtggaatgaagattgtcctaatcctttggcatgaggtggggggggttcaagggagctgggggagacaggcc

SEQ ID NO: 57102 - DNA, 1458 bp, Bovine  19866881365775
gccgttatgattgcccctttttataggcaggaaactgaggcccaaggccgttcagcaggtctgtggctgagcctgggctggagcccaagtctcctgtctggagggaggaaaagagaagagccgacagccttgcagctgatacactcacccgggagtcacagacaggacagcgctgtctataccccgtagcctgggtcaaagggagggccagagtatctagacagagagtgagcctcctgtccacagcagtattcaagcaggttttgttggctagttacatgactacacttccccacaaccctttcaaactcagattccaggatgccaggatttctttaggagatggaagatgagaaagtaggaaccgctgatttattaccagaaccccagccagcattccctgccccaggcacagggcacaagctttacagggatcatcttgtttcaccctcaccataatccaggaggtcttttcatccccattttccacacagggaaactgaggctcagagacacaaagtgacttgcctaggtcgcatagagttagtaagtggcagtaacagggctgacacctaggttcgtgagcccggctgcatgcccctgcatggaccaccctcaggacagctctggttccctaatgcccagtgcttgaccatgctgagctgccaggaggtaggaagagggctctcagggtgtcgctaggttggggacctggtgtaatccacaagggcacagcccttcagtgtttaacaacttccctgcaatctccaagaaggaggcagggaggctggatggagagtgtgaggctcagggagggtcgtgctagactctggacctagcatcatgtggtcaggacagcatcaggactcactgtagcctgagccttgcagcccatgatatgggaagctggggcggcccgaacccacctgggctcggtgcccccgaagtccagcatccctgactgcatgcccagtgtagaggccaaggagaccacttgcttagaaggatagcagtcaagaaataggggcaaagaaagaggcctggagtcaaaaagcctaggtcccagccctggctcagtgcctctgcgggctgtgtgaccttggtccaggcccctgccctctctgagcctccatgtgcttacctacaacacaggagtgatggccagaggatatatttgagagtgtcagggaggcccctggtccaaggtaactgcttgctgacctcagtccctgaccccatggtctctgaagccccacctgacctctgggccactcaacagcagaagtccggccctggagcaggacagaaccccagctgcccccgttcaacgccccaggaccagccctctgccctgacccccacacctaccagcaggatgtcggcaaccaccgcccagttgcaggacaggagcagctccccaagggccaggaacacctgtggacacgggggtcaggatga

SEQ ID NO: 57103 - DNA, 1540 bp, Bovine  19866881390010
cgaccccatggactatacagtccatggaattctccaggtcagaatactggagtgggtagccattcccttctccaaggattgaacccaggtctcccgcattgcaggtgggttctttaccagctgagccaccagggaagcccaagaacactggagtggatagcttagcccttttcaagtacccgaagggctcacctaccgctgagcattgaagaggatgtagttgtgtggtctcctaacccaacggggctgtcctggctcccctgggcccggggcctggccgaggctgcccctcttgggtgagggctgcttcctcaaaaggcacttggtctcttgctgggtgatctgagcaggtgggctccgccatgggaccctttccccaaccctcaccccacccctgaaactctcctttcccatgcagttttcatctgcagcttcatggtggccgcccccatcttcggctacctgggtgaccgcttcaacaggaaagtgatcctcagctgtgggattttcttctggtcggcggtcacgttctccagctccttcatcccccagcaggtgaggcctgcccgggcttcccacccggcattcctgtgcatcccgtccacgtgtcctggttcctccagggggtggcctgtcctagtctagactggggttccagcctgttgggttcaagtgtactgcgatgaggggggtctttgggtacttcgatacactggccttgctgatgggctttccctgtgctgggcttgagctgaaggactcgtagcccagtgggacatcttaactctccctgagctggttctgatttgcagagaatgtgagaaagagggggaagcaagtcaggccaaggagtcaggaccttgggttctagtctcggctctgctgtcgtcttgctgcgtgactctagatacatcgcccacctttctctgggcctcacacagtttgctctttgtccaatggccagccagttccctggatcaaagtcctctggaaataaacatcggtttaacctaaggaagatgtttctgacttggctcccacagttcagggtttgaagatcccagttctgtggcccattcaactttgtgatctggagaaacttgctttacttctctgagcctcagtttcctcatcttcaatagggggataacacttctctgtttgaaggactattgtgagaaaaaactgaacgggtggatgtccacaccctgacacatacatggaaggtgttcagcacatttttatttctgttctttcttccaaagaggagatatgttgctctgataggtagtgagtgtcccatcactaggggtgttcaagcagagaaaggacaatcacatgatggctattgtagatggagatagaggaagaagggggaaaatcagatcttatcctcagggagttttcagcctaggggacaaaagaggagaccctggccttgggagcatccaggctaggggtgggaagatgtgacaggagctcccacattcagactttcaagatatgcaaagtgctgaaagtcctcactaagtagagacaa

SEQ ID NO: 57104 - DNA, 1071 bp, Bovine  19866881525497
tgtgctggtctccgttccctttccagttttattactattccagaaaaggattatttttagtctctccctcccagctccaatagactagttgggtacctcactccccgagtcggaggtccttccccgagcccccatgtagctgggaagtgggacctgggggtggttggacccctgggatcctgaaggagggccagagagggcgcagaactccgtttctgttcctgttatccggacgcggccccctccgcctctcctcccgctgccatgcaccctgcggccttcccgcttcctgtggttgtggtcactgtgctgtggggagcggcccccagccgagggctcattcgagcggtgagtcggaggggccaatgggggaaggacgctgaagggagaggttgcagactaaagtgccaacacggactcttgtccgcagatctcggaccacaatgccagcatggactttgcagacctcccagctctctttggggctgctttgagccaggagggacttcaggtgattttttccccctttttcctgtgtccttaaattatctctcctgggtagaggttcaggagcctttcttggatgaagctgttagtgggaaaagtgtcaagttaggaactaagtgcaagagcacgtttagtgtggtggaatccagaatccggaggtaaaagacaaaagtctactcctagaactctgggccttggaagggaaactgaaagtggactaagataacaggtagggctagtggtgcttatcagtagggtctctagagccaattactgcccttatgatcgtgacaagtaattatctctctgagccttagtttgttttactgtaaaatgggaaaataatagaagttatcacaggattattgggaggattaaattagaaaagcagttttgtaggactttttcacagactaccatatagcaagaactcagttgggccatatataccggtattgtttgtaaggtgggtaattggaagattaaagggaggtgttaagagagaaaattcagcaggactgaattttaaagctcttactggcttttaatgacccaggaatcggg

SEQ ID NO: 57105 - DNA, 693 bp, Bovine  19866881669178
ccgccccacccctgcccccgtgcctggcaccatgctgaggcgcagagctgagtcagacctcccacccttctagccacgggctggtcaggggttagtcaggagagacaaccctgggtgaagcagatttgcagggaagctcaggtgaggcaaggaaggcttcctggaggaggagagatggcaggggcccgacacccaggccgaatctgacctcctaggctgacccgtactctgacagcaaaccccaggtgccctgaaggtggcccctgaggagtccttactcctccctgccccccagggtcccacccccagcacctcccagacactctccccaccaccagtcaatcccccacattaccctcctctcaaccctctcctggccccaacttggaggatccctgagatcaggaccacctgtcaccccatctcaaaccaccacccccagactgctgccacagtcaaggccacaagcccctccaggtccctcctagactgctcctgtccctgctcaaggacacaaacccctgccaccactcagacagccctttgtccctggctggctggtctggagcccattgttggccctgtgaagacagcctctgtccacccagcccagccacaggcatcgggcaggcacgcctgggacccatgctgagccagagagggcagagtccacaggagctcagaccctggggg

SEQ ID NO: 57106 - DNA, 777 bp, Bovine  19866881806224
cacacacacacacacacacacacaccccacatacatatcctagatcgaacagtgacacacactgtgcctgagtgacagctgttagaaggtggggctccaggatgggttctagtagcagcagcctcgtccctccctgccccctgccgtgccccgggagctggggtgcctaggaggtagatggcaactcttccccgctctgccgcagacgcttcttggcccggatctcgttcatggcctcttcaatggagcgtgtgtccctcttgttggccacgggcactaggggcagatgggaggatgggaggacctaggagccctgtgccttggtctcccctctccttccccccaacctgtgctcctcttccctgccccctcccagcccccactgtggcctcaccacagccgtaggtcttgttggcctgtagcatgtgagctgcatccttggctgcccccttgccaataaggtggctgtatttgtctttgtaatcgctggccgggctcaccaccacgggtccctgctgggccgcttcctcctcctgtcgctgggccagctcctgagggtgcagagggggtcaccggagctcaaggcctgacctcagcccctcccagatggtggtggcagggtcccagggactgccaggcataactcaccttcagcctccgcttctcctcagccttctgggggtcccactcctcgccacgccggtaggagtccagctcttcatctgagggtgcaaactcctgggagagaagtgggtgatggggtcaaggttccacata

SEQ ID NO: 57107 - DNA, 3525 bp, Bovine  19866880193656
tctagtcaaggctatggtttttcctgtggtcatgtatggatgtgagagttgggctgtgaagaaagctgaagggcgaagaattgatgcttttgaactgtggtgttggagaagactcttgagagtcccttggactgcatggagatccaacaagtccatcctaaaggagatcagtcctgggtgttcattggaaggactgattctgaggctgaaactccaatactttggccacctgatgtgaagagttgactcattggaaaagaccctgatgctgggagggattgagggcaggaggagaagtggatgaaagaggatgagatggctggatggcatcaccgactcgaagcacatgagtttgggtgaactccgggagttggtgatagacagggaggcctggcgtgctgtgattcatggagtcgcagagtcggacaggactgagcaactgaactgaactgaacatgttacaaagaatcattaacagaagaaacacagtgaataattaaaataaataacaatataaaagatgaaaattacagaaaaaaattgaaaacatatttagtttcctttagaaaattgtaggaatcattgaattatcattcattaaatttggaaaaccatgcatattataaaagagtgatcaaacagtaaatgcaaagtggtatgactaaaaaagagcgtactagggaagcataaatatattgctaatgtacactatccttcagtgcaccttaaacccatcactggaaaatatttctttgaccttaacctaatttaagtagttcaactcttgaaggtaccccttgtggtgggccaaaagcctggtctcaatgtagacagggaacccactataaatttgcatgtttctcccaggacccttttgtttcttttgtcttcctaatagttcaactagtattttaattcgtgctaatttttaaatgtattttctttatgaattcaaataaaattatgttaaattatattttaccttcaatgaaaaccatttttagaattgtaagcaagaaatgctgtggtattgaaaggttaatgctttcttcccaatccagtttattcttgtaaatagcataagttatatgtcacaataataaactgtctataattataaatagaaaaagacactagagaattgaaaaactgccactaacgtgctatataacatgcaaaatccactaatatttctggtcattaattaccctagttataaattaatgatataaactagattatctcagtgttacatgttatgtgtatgatttcaggtaaatttgcctcccacgattatcttcagtacctaaaaattatctttcctgtttgagcttcattaaatatattcaaatactacaaaatcagtagatatagatttttagtaaatagggctcatagaaataccagtgactaagtatcataaatattcctgcttctagtaaatacatattacagagcagatgtacaaatttatctttgtataatcttttaaaatatagaaatttaagtacataataatcactattcagtaagctttaaattgcaaagttaagggcagtcattctttttctccaatactattgaaagcccacatctggattttaaatactctttttccctaaaagcccaaagttataattcattacaataatattgcacctgtgaatgatgcatatgaattataaaagcatatcattcataactctttatcacttcatagttttcattggcagcctgatcttatgtgataaatagagaatgatattgaaatggatataagagttggggaaaaaaacacagtgttcttaaaacaagtattaataactacttaaccatttcagtcttctatttggtgggcatataaaagtaaaccaaagtccctaacttcaagttcattttatagttggttagagaaacaagcaaaccaactcgggtttcttttatctactttttgattataggttttgtgcttttggatttccaaatgtgtgaaaataactgctttatttaactgttactaagatttaaaaaataaaatttacagaggcattcaaagatgtcaatgttaatgcaaatgatagtatctgccacttatttagtatttatgatagcacagaaagcttatgggttttttttatacattgtattatttaattcttacaacaactgtataagttctatagtaacagtggggaaacagaggataagaaaaaatattcaacttgtctaagaatacaataaaaataagctgcagttacaatttgaattttgatcttttttgcctgccaagttgttgaccatgtgtccatatagtctttatgtttaattaatggaaaattacatataatacattggaaaagaccctaattctgagaaacattgaaagaagaaggtgaaggggactacagaggatgagctggttgaatggcatcagcaactcaatggacatgagtttgagcacgctccagaagatggtgacagggacaggaagcctggtgtgctgcagtccatggggacacaaagagtcaaacatggctgagagactaatgacaacggaccaatatataattcgtaatcttagtataattcttctgcatgttatccattctttcatcttgaagcatacatgaaatgaagagcagaggtagaaaaattgtcagtatactgtgaaagaaattgtcttaaagttaagttccacaactaaatatttaaaatattttatgattaacttaataaaataatcctttgattcaggttgcttattcattatagcatttcatactgagtcaaaagggacatgcctttttttgtttaacataaacttgaattgggggcttatataaggaaagcagaaataaagtattttagaaaatttggataatagccaattaccagatattgtttttttattgaagtacagttgattcacaatgttgtgaaatatttgctgtacagcagtgactcagttatatacatatatacattctttttaaaatattattttccagtatgggttatcataaggtagtgaatatagttccctatgctatacagttcagttcagtcactcagtcgtgtccgactctttggaccccatgaatcgcagcacaccaggcccccctgtccatcaccatctccgggagttcactcaaactcaaggtccatcgagccggtgatgccatccagccatttcatgctatacagcagaactttattgcttatgcactctagatagaatattaatagcatctggcaacccccaattcccagtccatccttctccctcccccttcccagatagtcttaaagaaatagactgacctgagaattctcagaaaaataaactctgttctatgttttctaagtaatctcaatttcagtgataattgactttttgagaacagatttataaataaccagcagaaaaaaaaaaatgaaataggtataaattccctggtggctcagacggtaaagcatctgcctacaatccgggagacccgggttcaatccctgggtcgggaagat

SEQ ID NO: 57108 - DNA, 1976 bp, Bovine  19866880510710
gtcttgatccctgtctcctgtacaatgtcatgaacctctgtccatagttcatcaggtactctgtctatcagatgtagtcccttaaatctatttctcacttcaactgcataatcataagggatttgatttaggtcatacctgaatggtctagtggttttccccactttcttcaatttgtctgaatttggcaataaggagttcatgatctgagccacagtcagctccctgtcttgtttttgctgacggtatagagcttctccatctttggctgcaaagaatataatcaatctgattttggtattggccatctggtgatgttcatgtttaaccttcacttaataacgagatgtcaacttcagcattccttataacaataagatagagagttgcctaaatacaatatatttccaccatattcttcaatagtaataaataataaaagagtaactttgaggactgattaaaaaagaattctgtgataaactgcttaattaaactgcaaggagcagaatgatgcaaacattataatgccatgaatgtagttaaactatggggataaactgattcaatttgtaaaataccctaatagtttacacaactttataatattcattaaacatatttgtacattttatatttttatattacataattttatgataatatgttatccatacaaaactactagaaagtaagtccgtattaattaatttcaatttgctaatgaggaatcatattcattggagttgagaggaccaaaaccacatatagatggggtgaaggttttggctttaccacttaacagcatataatactgtaggtaatataatactgaaaagatttcaaattctatctgataaagggcctccagagaacaccaaatctaatgtatagaatgccacattttgaaatacacttggatttttactgtgtaacctaagaatatcaaccaccactacttctttagaacattagaattctagacataattatttgctaattcaagcaaaagtgaaggtgtccattttcttttggtggtagaaaatacacctccagaataatatggatacaacttacttccattgatattctctattaccttgactccagatagtaccatctttctcaaaacagggggtagaggacacacttttcctgagccatttgtgtgattctattcttaatgttgcaaaaggaatgctgttttgaaaataaagaggaaaagatagtggtgaaatttcatctacacagatcttagaaaaaatgtcatattgtttgaatatttataggttaaaaaaaaaccacaagtatataatcttggtaaaaagtatctcttaaacaacagaaggtcaagatttaagatttagacttcttcttgatggcctcatattgttaccacaggctgacagaatagctggaaggcatttctacagcttttgaacagatgattacttactctgatatcccaatattattattttacaccttaatggcagatcttattcttaaaagccaattccatttaaaaaaaaaaaagtgaatgtctgaacttttgacaaagacattttaaaaactcggtaaaataattattgctataaaatctagaagtcctctttcttacaatttttacaagcttgcttactttctttgtatagaaaatcctttcatattatctagcttcttttaattttcattaatattagttgtaccagggcaatacagtaatatcttttctgataaaatatcaccagttgtgacaagtggggagtgaccacaataacctaaacttgtttcccaaattgattttgcttcttgtgtcttccgattgttatgactatggttggcacattttatacattgacagtaatcattaaaataagaagaaaataatattttaacacatgcattaattatactttatggttacttgttagtcttgtatgtaaaaagaggtaaaatttattatgatttatttg

SEQ ID NO: 57109 - DNA, 1508 bp, Bovine  19866880812629
aaaaatgatcctccaagaaattggtccctggtgccagaaagtttggagactgctgccctatgacactcaaaaaagaaaaaaaaaaaactgtatagtacttttattctgtttgtgaagaaagataaattgccttctggtactattttcatctgtttatgtttgtttcccattctgcctcatcacatcttctctcagggcttctaattttatttccttcaattaggccaaatagtatatcaaatataccttatgtttaagtctctaaatatcccaacaaatctgatttacttatcatgctgcaatgacagttgttcatattgtgtgatgcaattttaaattgaataaattacatataatgccactcattagaaagtagatcatagcagaacaaaagacctactgcacattacttttaaatataatttgtgcttttgttcttgcttatgttttacattagttgaaatatactcaacttcaaataatatgtaatctgactcaaactgctccaaaaaatgtattgggtcatgttgtagtacgatggctgcagtaattttgctctttattttcacatataatgtggtttgttgaaccttaatgagaacaaagttttgccaatagttcttagcaaaccactgctttggacccattgttctgggtcagatgatcattgtaagccaaccactggcaagatgggtggaattacctgtacaccaatcagagccaccttagtagctgaattgcagtcgcctttaactgaatacatgagttaagtaacacagaggcataaagttgagaaatattaggtttctatagagaatgaataaggcacagcaatgaatattggcacagcaaccaataatatacactttaacatgttttaaaatattctccattactcacctcgttgagttcgaattatgtcttaaatgctcctattgtaagggagagttgtgttatatgaaatatatccattcagatattctgtagtgtaaaaggcagttaggtacatttaacaggcccagattttgtcattgggagtatctgatttctgctgaaaataacttgaaaggagcagcccatcagccttttattctgtaccagaagaatgaacacctttcaagcagtgtcagaaagcacaatacaaacacataacactgagattagacaggtagtaatttttgcaatggtaattacacagactctgtagaactattttctcttgtgtttcacacacacacacacacacacacaaatccactaacacctgtctagttcagctatattacttacttctcataagacatgaattgtgtcaagtaaaaataatcaaaatagtatattcttttttttttttttccaatactagacatgttcagggccattttcattaattgggaatacatactacatactgtatatatgaacactctacatatttcaaagatatattaatcacaaagttatttgctaaacattatgtggaaactataaatataataataatttaa

SEQ ID NO: 57110 - DNA, 1171 bp, Bovine  19866880955952
agtcactctcccaaagaatattgccttctggataagtgtggctgtctttatagtacaggactttgatgaaaggaagaagaatatgtaaaggatggagatattatcatatcacagttatatgctatagaaatttacagtaccatgaattacttcatcctgtctttctcagagctctaaaatgtattttgcttacaaaagagaagttgagatctggagagatataactttccccagataataaaggcacaaatttattgaccaggatgggaaactttatccaaaatcaaagcttgcattctttccaccaaaccatgaggtgttaatctagagaccccaaataatctaaaagtatgttaaaataattccaatttcctcaaatattataatgatagaaaattatttataagctaattctaggtaaaattgaaaaatttagtttttcttctgctttttttagttatttttttctaaaatcatttaccacttaaatacccttgggaagaaattttttattctatgccaaaccaaaactagcaaacagacaatgctacatttttttggattcaagttgcattcaaatgtttataggataaactaatattaacatattttaagttgtgtcagcaaaagagtcaaaaattaataaagataaaactttgtatctactcattgataatttaagagtgcttcagggatgagaggactaatatcataccacagtcaaaataattcaaactggaaaataatcaaggatcaagcttgctgagcctcaaattgaaaaagacctgccaagactgatcttttttattttggaagttttaaaatgttggatctaattacaaatgaaagcaggatgcaaagactaaagatgaaagcagtttaaaaaaggtatctttttctgtaaacttcaaatttcaggaaattataagaaacaatatgaagtcaggtctttgctaagacattaaatcaaacctatgcccccaaattgtgtgccagttgaaacagactgaggtggtaaattttcatgtttattatattaaaataagcagagactgggatatgtgtgtatgtgtatgtgtgtatattaaatagagaaaacaatttgagtcctctaaacccttaccattcaaactacaacctcaaaccttaaattaaatgtttttgttttgtt

SEQ ID NO: 57111 - DNA, 728 bp, Bovine  19866881390711
taagtgctggattcttatttatgagttgacatatgatatttttctaatgagtttaagtgtccttatcatagaatgccagatagttttaatcttcattctagatacacaaaaagaagtatagtgtttttagtaagtaatttcccatattctcactaatctctgtcagcaatattcacacatgcaagaaaatgaaattatatttcatatctaatctaatgttctggtccagagtaactaactaggattattgatatattccccagaattataaatcttctgaatgttataaatactttaactgaaattactttaaattataattactttctccttcaatctaaaaatgagaattttgaatatatgtagatgggtctaaatgtatttacttctcaattcaagctaaatttataaatgttaagtttatataatttgctgaaaaatattaaccattttagatttctttagagggataccagagacttttcttgcatataacagtgatgactggctagtcagcagcctgttactagtagcttttaatttcaaagtagactaataagagttgactggtgggtgtctgtgcacgttcttgagtgataatcagtatagaattaatcgtcagtagaggcttatgtcataagctgactgtctaaatgatgaatatataatgaaattaaacagaattgagacagatggttctaacttttgataaatgtgcatatcttcat

SEQ ID NO: 57112 - DNA, 2444 bp, Bovine  19866880153225
ctggaagcaacctagacggcatattcaaaagcagagacatttgtcaacaaaagtccatctagtcaaggctatggtttttccagtagtcacgtatggatgtgagagttggactgtgaagaaagctgagcgccgaagaattgatacttttgaactgtggtgttggagaagactcttgagagtcccttggactgcaaggagatccaaccagtccattctaaaggagatcagccctgggtgttctttggaaggaatgatgctaaagctgaaactccagtactttggccacctcatgcgaagagttgactcattggaaaggaccctgatgctgggagggattgggggcaggaggagaaggggatgacagaggatgagatggctggatggcatcactgactcggtggacgtgagtttgagtgaactccgggagttggtgatggacagggaggcctggcatgctgcgattcatggggtcgcagagtcggacacaactgagcaactgaactgaactgaactgggaggtgctgactccatcattacagaccagacttagtcctgtgggtctatagtcactcgagaacagtcctaggagaacacacacctaggagaacagaactttctttctaacgcacctgcctctgccttcttcctcttggagcagcagctccggtgctggcctggttgacggaggaagtgctctgtcccacctacaacttgtatctgaaagattcgcccacaccatcattccacagagtcatcttctaaagcctgtactagaaatgtctgtctttcagcaggtgtctcctctatattcagaaataatgaactagtgaaaaaggctggatttctttaaagtattaaatttaaaaattcaagctacacctgtgtataaagtatgatcctaattttagaaaatgtatatcttcagacacatagattcaaagaaaaaagacaagaaggaaataaggagaaatgtataattattacctgaaagtggttgaatgatgtaggcttgtttgtttgtttgtttttcctttatgtgttttggaaatacttacaatgaaaaataagacctgagtattatttatccctcggagaaggcaatggcaacccactccagtgttcttgcctggagaatcccagggacgggggagcctggtgggctgccgtctatggggtcacacagagtcagacacgactgaagcgacttagcagcatcagcagcattatttatccttttgcttctctatgcatccctgaaggagaaggcagggtggaggatgtttcttttctttttctcttttatatacattctttttcatcaatcttcttttccactatggcttaccccaggaggttggaaggttggaatacagttccctgtgctatacggtaggaccctgtccggccgtcctgaatgcgacactttgcatctgctaattacaaacccccagtccagccctcttcctgctcccctcccgcttgacagccaggagtctgttctctctgtctgcgaatctgtttctgtttcatagataggtttgtttgtgtcatattttagattccacctataagtgttatcatatggtatttgtctctccctttctgacttactgcagtgggttaccatttcctcctcctggggatcttccctacccagggatcgaacctgcatctcctgcattggcaggcgggttctttgccactgagccactggggaagccttgtaaaaggacttttaatacactgttttcttttattccagctgtggcttcagagctgatttgcattcctagtctagaagtcatttttgatcacaaatatcaggagtgatgacagagttgaaagtcttacttatcagaataagagtcccagagaacccctgattgactccaaagcttcccccttttaaacttgggatgtttgtctctcttcgtgccgctatgtcaggggaaagcactgccaaatggagtttttccatatttgactcaaagcgggtgtagggttgaagttgatccttgttataacgttggtgccaacagttggccaggaataagcattcacagccagatttttgaattcctgtaaccaggagcccataataaaaagactcctacaaacccccacctctctctctctctctctctctctctctctctctctctctctctctctgaggcctctggccaagaaaagcaggaacctctggagccaaaaggatccaaggatggagtggagagagatgagagtcctggcaaagaactcgacggggtgcacttattccaagcatgtctgagacaaagtctctccattgctggaccggccaggccactcccacctcaggcccgggcaagctggacttcagaacggttgctgtttcgaccacatcgcactcagttggtgaccagccagcggtcattgcccaaagaggcccaacccaaccacag

SEQ ID NO: 57113 - DNA, 1509 bp, Bovine  19866880413497
tattggagtttcagctttagcatcattccttccaaagaaatcccagggctgatctccttcagaatggactggttggatctccttgcagtccaagggactctcaagagttttctccaacaccacagttcaaaatcatcaattcttcagcactcagctttcttcacagtccaactctcacatccatacatgaccactggaaaaaccatagccttgactagacagacctttgttggcaaactaatgtctctgcttttgaatatgttatctaggttgttcataacttttcttccaaggagtaagcatcttttaatttcatggctgcagtcaccatctgcagtgattttggagcccacaaaaataaagtctgatactgtttccactgtttccccatctatttcccatgaagcgatgtcttctagaggtgcttagtatggtttgctcatgaacgaacctgaacatattctgtgtcctagcttgaccaccctttcacatcttggattttcagtatatgctcgaagctcaacttgatcaaaatagaattaactgacttttccctctctgttcttgccccaccaacttttctaagtaatgcaggctttgtcgtaactgatttctagaggactaacttacttatattagcaataagtgtaggatggcttccttaacaataatccctcttccagttagtcaaaagtcctggggaattctcagcctccatggttccaccaaacttctgaatggcaagagaaaggagatgtcttatgcaccatccaaagggccttggaggtagtgatgtcctggctgatgttggttttttcataaccctcccaactctttgctctatttcttaatttctgtcatggcaccaccatctacctggtcttccagaaagctgatctttattttacatgtattcttccatcccaagccttcctctagctactgtttctcttttttcttatttgtagtcatttttcttgaaataattgcttatgcgttactgcttttactacttcatctcaccagtgagcaccaactcctaatccatggaggattagactgtgggcttagtctcatcgactttctgcaacactgcatcttatctgatagttcttggaaatgtgactaattatcatacttgcccaccgataacctacaagtatgaaaagcttctctttgccctcttttgtcaagtcagaattccattatcaggcttcctcacctaagtttccctttttttttgctataagtgttgcttaggcctatatttctcgataaacaaggaggaatgagatggccaattttttctcctcggtgcccccaaaacatctttgtgaatagatacacatatttatatcttgtttttaacaaatacattggcttaaaattctgtcaaaataaagtccaaaagcgcttgaaataaatggaacattatttgtgattgaatgtctggttaattggaaatatttgttttaaaggactttaggttttatttgtggagggtagaca

SEQ ID NO: 57114 - DNA, 2418 bp, Bovine  19866880461474
gtcctaagagcagagatgggattcaaaccaaggaaacttctagattctgtgctcttcatccatcatctataccaggggattcctcgtggggcaggagtggacaaggattcactgtcttaagagaaaacgaacatggcggtggggtgaggaatggtggtagaaggccgtgtaattctactggacacacgtgaacaaggaaagcctccttggctaaggtcgcatggtagtccctgaggctgatgtgaatgctgtctctgtccctgagctgcggctctgggttcaagcatccttccactttgattccccacagataccacttctaggacatctcctttaacctcccagtcttgcggccagcatgctccttttgggagcctttcctggccatcatgagaaccattttgtgcctgattgatgtgcatatcatctcaaacaggagcagtctgcatcagcttgctactgatgagacataaacctggatacgcaagccttgaaagtgcctctgagaccagcagaaattcctaggggtcaagcttcttccaatttccctggaaaactatacatgagaaaggttatcttacagggaatcaggaaaatacttgcttccctcctgcactgtttccctgatgccttagtggtaaagaacttgccggccaatgcaggagacacaggttcgattcctgggtcaggaagattccctggaggaggaaatggcaacccactccagtattcttgcctgggaaatcctatagacagaggagcctggcgggctacagtccatggggttgcacagagtcagacacatctgagcacacccacatggtggagtccagggtgttacagagtgcaaccatgttccatgttttctttgcagaactctggaatcgattttggagacatttcttccagaatggcactccggaagaaactgaaatgcaaaacttttgactggtatctgaaaaatgtttatcctctcctgaaaccagtccgcagcgttgtggcctatggaagagtacgttttatgaaactgcattgcaggttttaaacatttgcctgtaaaagatgaagagatctgagtctcatgactttccgaacaagggttttcaaaacccattccccccattctcttcctacccccaactctctcctccaaccctcttggttttctttcctctctcactctccagtctccttttccttccttctgtctctggttccttagcttgtaaacatcagcccttgctctgaccctcacagttcctcgatccaccagggtgtgtggcctcacccctctcaatgcgggtataagagcccttcctttacctgtgctataacggtctgaggagtggatgttcctgttgtagctacgagttctgggaaacaaactcactcagaaggacaatgcagatagtggagtgcagtttattacactgtgggcccaaggcagagtctcctcttagccaaggaccctgaccagtttttgtgaaaaccttacataccctaagtgtacgtgcccaaacccccctccccaaattccctgaaactagtctgaacaaaggaaaagaaagatacaatcaaagttaatccgtgatccgtatgccttaagcctaggtagctaacagtggacaattatcaataagcctgtggtcatactccaataagcataatagagtttatgattctatttggttacacagataattagggtattttttttaggcaatggggagtctaggtacaagccgtgggtctcttccatccggggggtctggttttccagttggtatgttgtttccatagacactgggcatatagctcatgtaagtccacagtctggcccaagatggagtcctgctttcaagatggagcctattctgtctctttcctgcttcattcccaggaagcgcatcacagcagagtttcgctttggcatttgtctagtgcttagaaagtggctgccaggatctcaaacccttgccccttttgggtactcttggagtgctggcaaaggtgcagggccctgggagggtcggggaacctccttctctggctctttccaaccgtgttgctgtgtgctttgctccctcagatgaaaaacacgttggatgaacgcgtctgcctggaccagggagctgttccaggcaacacccccatcatgcattactgccatcaatacaattcccaggtatcgtcctgctccggccccctggtcagtccgttgtagctcggcccctggcaggtttggacttggtgttaggtgatggggagacaggagctgagtggcctgggtagtgggtcaaggagaagcccaaacttgtgcttgtaactcagcccttccgagctcacctgagaggtcattccatctcaggtacaggaagggcgcttagaaagactgcactctctatggtaataccttca

SEQ ID NO: 57115 - DNA, 1220 bp, Bovine  19866880461669
tgggtcatcatctcggggcttctggtctcatgtcctcttctaagacacatcttttttttttttttttcttctcacttgaggggctgtgaggctcctgtgaatcagagagtggaccaagctgagctgggcgtgcagtttttcttggtggtcctcctgcttgctatctctaaaggccaaggaggtgccttcattcctcctgagactctaaaagcccagccccatctgcgggtcttggtggcgtggctggggagtggaggagatcacattcaggtgcggtgagtcgcaggtgcacaaccgtgagagctgtgcgcatcatggtcacagggtgaaggaggcccttctcgtgggttatctccatcaccaccaccgccttctgaagaggaacaattatgtgtgtgctaagtcacttcagtcatgtccgactctctgtgaccccatcaactgtagcctgccaggctcctctgtccacgggattcttcaggcaagaatacggaagtgggttcccattcccttatccaggggatcttcctaacccagggactgaaccggcatctctttcgtctcctgtattggcaggcaggctttttaccactacaccacctgagaaggtgggacaagcatcatcatccccattttacagataaggagactgaggccccaggacgcctcggtttcacagtctcattgggccttaagtgaagtcagatgtcaggccacgagggacaggcatgtcccatcggagaccgcacgacccactgaggggggcccaacagagcagaggtgaattattccccaaagggaaagccttgctttaaacctcagagaagctctcctggggtcagctttgaacacctacgatgggaggaccctccagcaggactcaccttcctccaccttaagccagaggggctgctagagggctgttgcatgatctgaggaaaatgttttcattttttcacaagcatgatgctgaatgttctgtgtgtgtggggggggtgggggggtggggagagagaaaggtttacatggaggaagagagtatacctttgtaggaatctctccctcctccctctgttcatttctcccccctttctttctttccttctgtctttcttttgcaaaccacagaccagctacacattctttggcagtttcctgaagatgaacttcagatttttgggagagagggaaaaaaaaaacaagaaagacaaaagcaaagg

SEQ ID NO: 57116 - DNA, 1372 bp, Bovine  19866880509021
atcgcttctgcttacagctcattgggtagaactactggcctggtccaaccataagtgaggtagagtgtacaattccccaccttcctgaaacggagagagttggagacatttggaaaatatcactgatgatgccacagtagggaaatgggatgaaaaagcaggctgcaaacttgcagaactaacaagtgctcttgggatcctccctgcatgataaaatgctctttatagatttatttcttggcagggttagtcatctcctagggctgttgatttgcacgactcagatgtctaatgcatttcttttccaatatatagcttcactcagctgaaaactgttagatttttctctggtggattctggagcatcactatctccatcaccagtctgtagctgatatcatcaccatcatcgtcaaaaactttacctaagcagctaattataaatgatccttatctataagatgtatttgcgtttgtccttcctcttgtcactttggtcccagggaaagcccagagggagggaaatggtcatgggccacggtgttagacttattattcctgtcctcaacaatctacggtgaaaagctacagagagaggtgattcttcttagggagagtgtgtgtatacacacctatagacaggtaggaactgagggagttgaccccttaccactctcctttcactgaggtctgtggctgaaagggcagtggagaggcccattcatagagattactcagagaagcaaggctaagtctccccagaggaaaaccatgaagatcccactgctggggtaacgacaagcgcacatgttcctacacacacgcacacacacacacacccatgacctgtctagctcacagctttggaacttgtctgcccagaatgatcttccctgcttgtagcaagtctggttctttctcttctttgaaatctcagttaaatcactacctcttcagaaggaactttcccaaccacctgatgcttcaaagcagaattcccaggttcgtgcctaactcagcatccagtttattttcttcagagccttcagtacaatatataaatatcttctttattgtttactgtgaaaattttctatctagaatgtcatatatttattgcaagaaataaaagcagacggtctgtccaggctgctcctaaaaccccagcacctggcacatgatgagcacccaataacttctcaatgcaagattaaataaatgaatgatagcgaccatcagtgaaaacgtctggctttagacagagttaggaaagcctatgctgtcgtgaaattggggctccgtgaattctggagaaatgttcacttgtgcagtctgaggatggggttattcctcttgtcttccttcacgtggg

SEQ ID NO: 57117 - DNA, 837 bp, Bovine  19866880592066
gactccctgtttccttctcgctcctagagatgcttaaaagagggtggttacaatccccttatgtaatgttgaacttaacgttatcgaggtgaaaaattcatcaggaagaccttgatgggccacgtgaagaagtctgtttcctgcccacaggaacaacagatggagaactatttgccctgttttccaaagtcaaatggtaaatctggaaggataaaatagagctaaagactttggaacattaagctccttgaagaaagctgttgcataaataatatattatatgcacttaaaaatcttacctgcttgcaaaattgtctcgcgttctctcagacacatccaacatagcaaagtactatttcctgtctcattcattcagtatttattgaacactgactgtgtaccatacatgaatccttccccttgaggaattcagtgtactaggagcaataggggaaaatcagaattaaaatgtgtttttcaaagtagtatggggatacagcagtgctgatgtcaagtgggagggcaaagcaatatcaagcatggggcagccatgcaaaggtgtaatgacttaaaaataaatatagcaggctgtccagtggttgagaatccaccttccaatccaagggacatgggttcaatctctggtcaggaaactaagatcccacgcacctcatggccaaaaaaacaaaatataaaatagaaacaatactgtaacaaattcaataaagactttaaatcagtccacatcaaaaaaattttttttaaatatatcattaatacaatttttagaaatggtgagcagtcctatgaggttacaaggaaggatgcaaaagtgaa

SEQ ID NO: 57118 - DNA, 1028 bp, Bovine  19866880666551
gctgtatggcacacatgaaaggtaagagaacaatcctcagcacaggaggaaacattttactttctatttctttaactctgtgtctgtatgagatgacggatgttcagtaaatttgttgtgataaccattccctgatgtatgtatgtcaaatcatcatgctgtacaccttaaactcatgcagtgtcatatgccaactacattcccaacatctcaataaaactgtaagaaaaaaacccaaacaaacacatcagagtccagaacatccctgaaatttagggtcttatctattttcgtacctctgcataggctttggcccatgtgcttgccagctgatggaggtcaacttcacctgacttcacagcttccagggcagcttcggcctctctgtcataatctctgagggattcttcttcgataaactggctcagagcttcttttaagtctgtaatatcgataacaaataccaccattggcagacataatttgggaacattttacctggctaagcattccagtgtgacactcctgtcaagcttatacccttaagagcatgtctaactaagataaattcagcttagaggatcattcaactaatctcacacttatttttctttataaccacaggttactgaatggtcaaaattcttaactcttatgtaatataaccctgatactaattaaaaacattaatttctgaagtcctcatctgaaaccgactagagaaaagcacataaagaccttctacagagggagggtatgaagctttctgtatttaaatgagtttcctatataactttcaaggatattattgttgtgtgtgtgtgtgctcagttgcttcagttgtgttgaactcttggtgaccccatggaatttagcccgccaggctcctctgtccatgggattctctaggcaagaatgctggggtgggttgccatgcccttctccagggaatcttcctgacccagggattgaacctgagtctcttgtgtttcctgccttgcaggcagattctgaccccactaagctat

SEQ ID NO: 57119 - DNA, 1836 bp, Bovine  19866880717600
aaacgtttttgttttttttttatttacatctcaagaatgcaccaaaaaacatgcagtattgcacctttgtttgttggttttgcttgtgtttgtctctagctataaagaatacttgtccttaggtgttgctatatgtaccttgatctcttggtttttcaactgagcttcccgtgaagggatgggcatattggtcccctctctgtctaactctgcacagaaacctgacatttccctgagcaaaggcaggaaaattgactaagtgctccccacccccacccccacccactatttcttttgggtccttcatcccacaaacataatttttattatttttttaacgtttttacattaaatgaatcatgcactaattaattcaaggtacaccttaatcaaatcagccataatgctgaataagagaacatgcttggagctccgaaaagtactgttcctggctcactaacataggtacttaaatacagtactttattgactaataaaaagagttaataaatgaaggagtgcacttttggtgaatgcaaatgaagaagaatctatttgcagaagaatcgattcctaactaagcttatcccctattgtctgagttaacgttctcagcatgcggttataaaataaatcaggatcagattcagacatgcttacacttcgctccatttgtgctctcttgcaacaaggaggctaaggctttacgttcagttctggaggcgggggtcagggtgcgggacttgtgagcaaagaccctctgggcgtatctgcagttgagaatcttagcagcactgcagacggatcaacgaattgcactcagtgatcactgtttcttagagaagagtttgaatcagaaaagaatgggggcagagggaaaaatccctacagaaccaggaccaatatcagatttctaaggtgcttggtgaaccagtcttaagtaattttttttttttcaccttggaatatgcagttcggtggatcaaaataaaaacatctgtccgttgcccattttggctggtgtatcatgttacatacaatacatctgatgctctgtcttaaatatgttgtgcagtttgccaagatttcatgttagagtcccatgcaaattttcatttgatatttctaagcgatcctctaattctcattcagtcacatgaaagaaaaaaattaaagaagccagcaagaattaaaaatgggaagcacgtgattcttattttacctagactagttcgtggactgagtgattttaaaccagttttagaaaatacactttcttttcccattcttttaataaaatgaaaatattttttttttcatggttcctgaagtcttcgggttttccacccccaacacgggcaatgcccagtactggcaatgcgacaatgcattgacagttcaatggaacgtccaaagcttacttagcaaagtatctacacagagagtgactttggtcactcggggtttggtttgatttgggttttgttttttttttttaagtctttcaagctgctaagtgggggctttttaaagtttctttgcttggctttttaaacatcagtcagtagcttgctcttattaacacagttttggttagctgtggtacaattgccagttctgatattggcctgtctaaagtggcctatgctattattcatatcctcttcgatctccatgtattcagatttgctgagagtggacgagctgcgccgactgaggtcactgtcagaggctaagttaggggcgctaacgtggagcaactgagcctgctcttccccctcagtttctcggtggtagaaatagttgaaattggacacaatgacaggtacgggcagg

SEQ ID NO: 57120 - DNA, 1972 bp, Bovine  19866880769077
aaaaaaaattttttaattaaaaaaaaatagtttacttacaatattacattagtttcaagtgtaagacaatgatttgatattgattccttctgtattgtttacattttttcatctctaaaattgagatgaatcaatgcaatggcaggtcataattgtcgatgttccctcttgcttgcaaatattaatatatcaaacatctttaaatcaatggtgtattggattcaattagttgaatacaatttttcaatcatctggtttttttttttttcaattatctgtttttaagttggttcaaaagactgcttttcagttctgcatcatgaccatgctgtcttatctgctttgttgttgttcagtggctaagttgtgtctgactcttgcaactccatagactgtagcacgccaggcttccctgtccttcaccatctcctggagtttgctcaaactcatgtccattgactcggtgatgccatccaaccatctcaccctgttgccccttctcttcctatcctcaatcttttccagcttcagggtcttttccggtgagttggctcttcccatcaggtggacaaagtattagagcttcagcttcagtaccagtcttctgcttaggattttgcaatgggacacactctgcccagccccaggggggctcaccttacctccacactcaggcctggagaggctccacagtctagactgagggcagaaagcatcagccagcttccctccccagtgtcacggtggttgggctcacattgcatcagccctctgctgcttggcctcccttaaaactgacctgatgtcattttgaagctctgtaaacaataaatttgcaaggagatccaaccagtccattctgaaggagatcagccctgggatttctttggagggaatgatgctgaagctaaaactccagtactttggccacctcatgtgaagagttgactcattggaaaagactctgatgctgggaggaaaaggggaccccagaggatgagatggctggatggcatcactgactcaatcgacgtgagagtctgagtgaactctgggatttggtgatggacagggaggcctggtgtgctgcaattcatggggttgcaaagagtcggacacgactgagcgactgaactgaactgaatgtagtttctaagttccaaaacactgtgatgccgctgtgacccctgctctcttccgcactgacctagccactctctttgtttgttaaagatccctagtttggtgccttcattcaaagccctgctttcttagttccttcttggtttcagtgatctttttctcttccctactgcagccactgtaacttattctttgtcaacaaatttctgaaacttcaatttaagtccaccatattctagcctttctgatctagtcggggggcatttttgtccccactggttaaagctttcctcaagaaatgtctatggagtccttgaaaccatttaattgtcttcaccactccactgaactgtgatagagcttaatgtcaaattcagagatcaatttttgatcctcctctaacttgaattttcagcatggtttaccattcccttctgggaatattgtctttcctcagccccccacctccctggcttcccttcctcatcctgacttctaaatgttggcatgttccatgtcttcatctttgaccttctatctacctcctttccctggatgagctcattcagcacatggcttcagataaacccactgtactctagaattcattcctctgttgatgaccacaactctatacaaacctaaactcttcatgttgcccatccccgttgacgtctatttattctctagtcacccccatctttgcagtctgttttaactgttttgctcagattaaaacccactctaccctgaagtcctaagcagagttgtttctattttcctaccttcatatacccccggtccattgttcatgcttctagctgctcct

SEQ ID NO: 57121 - DNA, 782 bp, Bovine  19866880808451
aaagccaaaagcaaagggtgggaagaagtgaggcggaaagcgacagagcgtgtgcattcacacgcacaccacgcctggcaataaggaagtgagaccagacctttttcatgaatgggctcagctcagcccggtcggacttccggctctcccattcaccagctttcagatttcacctctgaccgtccaagggagctggctgcgggcccaggaacgaggagcagttggagatcgtcccctgaccacagacaactgtgtgctcacaagaatcttcctttgtgagctggtaaatgcagttgaccagcgtgttggtaggacaccgggtttggaggggcactgacctttgggtcccccacaacagtggctccctccctggggggctgctattactgcccaggaaactcagaaaggagagcaggcactacccgcagtcatgctccagcggggggctgcacgctgggagggttcgcctgccttaaatgatgctggcggatgagcctcatggtccagaggggatgcgtcgagttcttcctgccagggctgaggggcagtaggctgtggcttgtggcctgagagggtgttgttctttcacttcggatgggagatgcttgaggagccgggcaccactgaagctgctgtcagtggttgaaaattggttccagagggttcgcctcggtcctaggaagtctggctgcagatcttgaagaagtcattgaaatttgctagtacttgggaaagatgggatgagaacacctcccgcaggggtgctggcatgactcagagag

SEQ ID NO: 57122 - DNA, 666 bp, Bovine  19866880879785
gtgtgttgccatttcctcctctaagggatcttccaaatccagggttcaaatccacacctcttgcattggcagatggtttcttacacactgagcctccaaggaagcctatacattgtaataaccaagatttattgagtatatatttaagtaccaaacattggaataaacactacctaatttaattcttacccaaatcttataagagatgtattaccatttgctcaactttatctgtgaagtaactaaagcacaaagaagtcaaacaacatcccccaggtcacacagcgtatccaggattcaaacacagaatcatatccattgtttttgcctcactgcttgggaagtttgattcttaaagggagaaaaatactgagtgttggttgaaaaagatggtagagttaggagctttttttcccttctcgaatattagaacatttggatatatttaaagtcagtaggaaaggaatctgccaagagggagaaataagagaaggatgttagacaggaagggtgtttcttcagcattagggatggctgggctctgagcacagggaggctgacagcagagacagagacggggcagtcctctgagaccacccctgagattgctcatggcacttggggtggggctagattggctggaagcaaggtcttttgacaaaggaa

SEQ ID NO: 57123 - DNA, 1174 bp, Bovine  19866880933640
caagctagaaatgcctgcaggaagaaaatgcctctgtcctgtttaatgctcttcattcattcatgcttttcaaaaatatctgtagagcaggtgccaggggctacgttgggcacttcagtcatgaacaaaaccaaaagtggactctgctctcatggggtttatagccagatgggaaggcagatactaacacaagacacaaactaatgagggtgtagctttgaacttggggaagtgttacagcagaaaggggacaattctgtggaagtgtatgtagctgaggctactgattggcccctcagcagccagcctcccatcttgactcacagaatccctgatttgttggagggactaatgggcccagctagaacatgacttttcctaacctctcctgaagatggctcagtgggtaaagaaccagcctgtaaagcaggagacccaggagatgcaggttcgattcctgggttccctggagaagggaatggctaacccagttttcctgcccggggaattccatggacagaggaacctggcaggttccagtccatggggtctcaacaactgagcgactaaccctttctttaccactgagccacctaggaagccccagagagatgtggggaggctacctaagggaagggacccctctccaagcttcactcctctggtcctaccagatgcttgacattccagcctctggcccttggggagcctttgtttaaatgcagattgtatctggtactgtttaattggccttcattccagttattagcaccttagctctaatcagatggccctcagctgaaaaagaagtcttgggccagagcaggggagtgaaggaaaacctaggaaaaggagagaggtccttacccttgggtggtcttggcggactgagaggggaagtctgttaggaggcccatgaggcgggagcacggcgtcactgcacgtggactggagggcgggcagctcccgcacgcggaggcacaatgctctttcacgcagtacacagttatgcaaaaacaatgacagctccatatcttggaatattacacagcagtttcaaatgaataagacagatctgtatgtattgatacacaaggtgatggttaaaaaaaccccgcccatgcttgaacatgggaaaatctgcacgaatccgtattacaagagtacatttcaa

SEQ ID NO: 57124 - DNA, 1064 bp, Bovine  19866880967548
aaaaaaaaatatatccctgatgaaatatattaaccagagatgtcggcagggccaaggaggcaaggagtctcgcagtctgctatggacgagcaggaagttccattacccctgatctgggtttgctgagccctagaattaagatgtcagctggagatgtaggctttgttcacatggaaaagctgctgattttcagcaagttttatacacatacacacccaagcatgcacggctgacacttgcctgctcttgacaagacaactgggccatatggtgacaatattaattagacaattgctgctgaagaaggcatctgtacagctctccacctgcttccccaccatactcagttcatctacaacaaacagccaaccggggctgacagccccaaacggtacagctgtagttttctccagggtagtagctccagaagaaacgcaagatgcaggagacctgacagagtcttgggatggaatttgccctctagaccttctttgcaaggctgccagatcattgtccagaggttgaacaccaaacccttagctcaacgctgagggctctctggcagttttattagggaagtcaatcagcaacatggccttaggctcagcaaccatgtagagctgggttcaaattccaggcatgccttgtgctagctgtgcgatcttcaactatttaatttactatttgaacttcttcccttacttcgagaacattatcaccttcccagtagactgtcccttacggccttcataagagttaaataaaataatatacatgtaacttctctatatcggctgttttcccctctccttaccctctgaagtgctacccacgccagtcgatgaaccatggttagaacagttagtttctcacacagaggcttcactccatcacacaccatcacctggagcatgcttccagttcccacctccaagttagacacatgccagaagcctcagctcagagcctccatttctgctgagtcttccaagactccccagctgaaggaggccactcctgtttctgaaacgccagaacagtattgctagtgagctttccaatgt

SEQ ID NO: 57125 - DNA, 1517 bp, Bovine  19866880985929
caatctcccttgatctttttaaaattaaaaaagaaaaaaatcaaagatctcccacgtaccagtggtactgttataatcctttagctgagaaaagtacatagtgatgaaaatctactagggattcagttatgcttctcagtgattttggttttattcagaataactgtgtctccatccttttcatcaatggcatcatgacaaaagggaaacacagcatttatttcatccacagaggcctttggttattacctggggcgttaacatgcagggaggggaggatcaggtctttctcttgctcttaactgcttctctcccctagcgggagatggagtctgagcggatggggcaaagggtcactggtgctgacaatatgtggaagggtcagagatgggaccctagagctgggggcggcttgcactgcagccaggggcctgaggagccctgcagacggtctcccaaatggctttgtctgcagcctgcctgctacccagggcgatgcaggaacgaggagtgagaagcacgacaggcccggtggaggcatcttcaaacgcttccaagttgcctatgcaattgtgtgttaggaacggggattagaaaggacaggcgtcttcagagccaggaggtgctgtttctccatttcagctagggactgagaaagcagcagttgggctccaggaggagagggtcttgggacaaagagttctctgggtttcttcttacctccccactccttatccatgcaaccccctccccaactcccatgcccatagacaaccaagagtaaagggggaaaacggcctaggcagccctagaagaaagaactttaaagacaaggagaaacttccatcagtccggtgacctagtgaacaaagaccagagtctgggatggctgtctggtccacctcagactctgaggggcatttccaccagcagtaactcatgccaagacccctgtatgtcccacccacccatgcaaaatgccccctctccactgccagagctaaatgctttagagctcgggtcctcagaagtccgattagacctacgtggaatttaagacattgtcatgctggagcttggggcctggcaggccccggcaatgtgatccaggggaattattttcatttgttcaagtaataatatacggtagctgcttttcttaacacggcgtttgcttggcttttctcaccagagctgaggagccaacattcctgagccatgagactcggctcagggacacgaatgatgagatgaagcgaggggctggtcccgatgccagcctgagcatccgtggggctgtggagcatcagctggagggaagagttcagggccatggtcttggcctcctgcccccagccacagaggggctcagagaggaaggggccagggagaggcagagaggctttcaaagcaacttcatccatgtccgcacagaattctggggaaggcttcagagagtaaagaatctgcctgcaatgtgggtcaccccggatttgatccctgggtcaggaagctcc

SEQ ID NO: 57126 - DNA, 2765 bp, Bovine  19866880998606
accggcccatcacctgcaggcaacaatgttgctggagagttttaacatcccccgaggcaaccttggatgtgcgatcacatgacctagctgtccaggttgctcctgaaacatgcatcaccactttgggtagggttctattcccaagtcacgcacgctgtgcaggtcagccctaccctgttgtttttagcctattattttagtgcacacttttgcagaatgcaagggttttcaggaatgctcaggctatgttacagcgtagaaccttgtggtaatttaatactactgatctttaactatatgtgaaactgcagaacgatcatacccacaggatactaagctgcggttaaaattttttaaatgtagagctatgcggggaaaatccccgtagcagagtaagtgaaaaaaaaaaaaaaaagcaagttgtagaacaatatatgcggtgtgatctattcatgggatggggggataaccttcaaaacaacaccttttacccctatgggtacatgtattacatatgtctgtaagttagagggaaacctctttctctctgttttggcagcttcagggtttagttgcagtgtgcaggggctttttataaaattaattaatgtatttatttatggctgtgctggctctccactgttgcttgggctcttctctggttgcgacgagcaggggttactctctagttgcggcgcacaagtttatcattgcggtggcttctcttgcagtggtgcacgggctctagagcatttgggcttcaggagtggcagctcccgagttctagggcacaagttcagtagttgtggcacacaggcttagttgctctgccacacacgcgatcctcccagactagggacggaacccacgtctcttacattgacaggcggattctttacagctggaccaccagggaagcccattgattatgtatttaacagctaattaaaacataataaaaagaattcaaatactccctcttcatccagagattggaattaacaaagtctttaatgataaaccttgatgatggctcctggggcctaggtggggaggagaagggggaaaaaaatgaagacgtgaggggagcagaaggggcttccctggtgactcagacgataaagaatctgtctgccatgcaggataccagggttcaatccctaggtcgggaaggtcccctgcagaaaggaatggcaacccactcctgtattcttgccgggacaattccatggacagaggagcctggtgagctatagtccatggggtcacaaaaaggaggacacgactgagcgactaacacaactcaaaggggaacagagctctgattactctgagtgacaggtgacaatgacttcctaattttacagaaaccaagcatattttgatggctgtaaagggccatgggggcgagggtggaattccccagaagaaaaggccacagccattagtggactttccaccccgaagccacctaccgcccaacatccaactcggggatgagcgagagaaggatacaggaagttgctgtgagtggccctggatctcggtgcaggggcagatggtcagagcgccttcggaggggccacagaccaggggatttcctgggggtggagtcttgggtgaggcccccaggctattctgagtgtcccccctcctcgctgccccagctcccccacactggttccaggaagcctgcctgggattatcagaagttgccatcttcagctgtgttcagcgggtgcggagggggtggagggcacaggccacctggttgtgaactgaaagagcccagaaccaggaagcaggaggacagccacccgagggggtggtgtgtgtgtgtgtgtgtgtgtgtgtgtgactctggacagtgcactcaaccccctgggcactgctggcccccccttccatgtgtaacatgtaaaagtgggataatatttcatctcagggcaacctccaaaggctgtggagaaaactatgcaagataaggcatgtgaaagtgatctgtaaactgcaaggtgccatgaaaatataagtgactcatttctgtcccagatgcaactcatacgtcacctcctccagaaagccctccctggttccctagcctagctttcctgttgttgttcggtcgctaagtcatgttcgactctttgcaatctcattgatggcagcataccaggcttccctgtccttcactctctcctggagtttgctcaaattcacgtctgttgagtgggtgatgctatcccaccatctcatcctctgctgcccactcctccttttgccttcaatctgtcccagcatcaaggtcttttccagtgagtcagctctttgcatcagatggccaaagtattggagcttaggggtttctattcttggagctctatggctcaccatgtgaactttggttttaacccttcatttgtcctgttatattgatggacttggaggacaaaatcatgtttgttttccagtcccagcttccatcaccacgctggacacacagtaggaactcgagaattggcttgaaagagatgtgtatgtggatgagggatggttgtcttctccaaatgatgtggagtacccaccgactcatccttgccacaagccctgggatgctgacaattgtcatgtagtctctagatcgcatggactgcagcccgccaggctcctctgtccatgggattctccaggcaggaatactggagtgggttgccatttccttctccaggggatcttcctacttaatctgtgcttctttctgtccc

SEQ ID NO: 57127 - DNA, 1080 bp, Bovine  19866881060302
ccctctgccggcagcatattcctgcacatcctccagtcctcagcaaattctggccactgccttttcaagagcaactgatggagaaaaagtaagacctgcccttcccctccgggagagcttcacgtctcctcataaaagtagagctgataaggagcatatgaaagagaagagctaaacccacgggcttcgcagctgagtagagatgggctcaattcccagctctgccatttgttcggcgtgcaagctgggaaggatttcttgatctctctaaggctcttcatcagtgtctgtaaaaaaggcacagtgatagggctgggcacaggcggctgcgaggattacgggagatagagcggctttcatgatcagagccctcagaccagcgggcatttcctcacatcactgccgtcatagcgcacactcctcagatcctctgcactgcatgtgttggctgggtgagtgcgtgggggagcggcaagcagaggagggagagggcaccaggagaatgggtcaagaaggatgctccagttatcccaggagaggtgccccggagccccacttgatcacaggagaatcccagcagcccctcctggggtccgttggcatcagtccacactccactgtgagcagcatcctttctgtgctccagggaggacctagtgacagggacactccagctgcaggggagttcctagaaagtccaatggaatggctgtcattcctccgccgtgagtcatcagccccaacaaagcccactggtatttccgagtctgttcccagtgcccggagctgggcccagcggctcggcagctgcagggagtggaatgcggctccccccagcactgtgccctgggttttcgttttcgggaaagcctcatggccccggaagtggggaggcaccctgaaggtcatctcgtccaggctcctgcctctgggcccaaagatcttaagaccttgggggtgtctggggaccccctctgacccatccgagtgtgaggaccagggctaccagggtggggacaggagaatgatgtccctttctcccgttgtctccttgatcttccactacaagggctgcaggtg

SEQ ID NO: 57128 - DNA, 1095 bp, Bovine  19866881140365
ctagagaggcataaacttattaacacaggtgatgaggtacatgctctgatggtgtgaggcattgtttggaggggctgagaagaaagaacagtccatgcagatgagggagattagaaaagtctccataaaatggtgacatatgagcctggccttggagcatgagtgacctggatacacagaaaggagaggagaagattcacacagaaagggtgctgactgccgcctcgccggctccacacagctgtctcggtggaggatcaggctccacgtacaatctggattcctgaaagacatctgggcatagatttcaaaatcacaaaagcttgggagaatgtgaccaccatggcaaacattaagcagtatgagccaaggacttccctggtggtccaacggttaagattctgcacttccaatgtgtgggggaaggggggacacaggttcgatccctggacagggaactaagatccatactgtcaaacaataaaagtatgagccaaacaaaggggacaacagagtccagggagagagaaacgtgttggcacgggtagaagaatgctgggagcttggggtgctccctacaggcaggggagaaacaggaggcaaggcggaggggaggggcgtggggaagtgggagtcagaagaggctgaacagggacaactgtgaggagagttctgtgaagtcctcaccctgccccttcagatcaatcaaggcaggcttcttggaggtggggaccacatgtgaagccaggtttggacctgaatggttttctccacaggcgccctgatgatcaggtcggaggatgccggcttcgtggtgataacaggtgtgatgagcaggcggtacctctgcatggacttcacaggcaacatttttggatccgtgagtttctttctgtgctgggttattagttgcaaatacttatcccacagctctggcaaaacatagaaccttatagcttaaagatttccacctgcagtgtatcttggtgatcttttcactgaggacttttacccatctaagtatcagatgctctggtttatacaactggggtctgaacccagtaagtccagctcatggttcctgggtctcagctt

SEQ ID NO: 57129 - DNA, 787 bp, Bovine  19866881181522
caacctctccaggtttcaccaccaggccctggtggagctgaagatcctggaagctctcagacggaaggacaaagacaacacctacaacgtggtgcacatgaaggactttttctatttccggaatcacctctgcatcacctttgaactcctggggtcagctgcttcctctctttagttcactttgtgttgataagttacgtaagtgacgaaagggagccttggaggtcagagcactagatttgtctttatgtgactatttaatggggggggcttccccggggcttaggggtaaagaatcattttgcagtgcagaagatgcaggagatgcaagttcgatccctgggtggggaaaatcccctgcagaagggcatggcaacccactccagtattcttgcctggagaatcccatggacagaggaacctggcgggctacttacagtccatggggttgcaaagagtcagacatgacttagtgactaagcacccatgaactggcaacccacacataagcttttctggttaacatgctttatattagctttcaatatttataagtcagcgtatttcacttaatatagcaggattctataggattcaatatatattctctctctctctctctctctctatatatatatatataggattcaatatatattctatatatataggattctatatatatatagagagttataagattcctgtatgtatatgtatatatacacacactcaggattacttatatataaggattctatatttatcggcaagagccagccctcag

SEQ ID NO: 57130 - DNA, 1759 bp, Bovine  19866881202769
cattgcaggcagattgtttaccagctgagctaccaggaaatcccctgtagggctagagatgcggtcatcgataaacacgggtctcttccagcctgggccatttcctgctatgttaaattcaaaaagtctgtattttctgtcaaatggtgagctgaggaagtgacattcctaagtggaacactaggctgaaagcattaggtcacggccttggatttgaagaatttgggtttgtgggcccagggcatgtgtctttaccactcttccgtgtttgtgagtggatttataaatacaggtgacaacaagatggtctatctcagtgatgctatttagctgactcgaaaatgccaaagtattttgacactttttggagaggggtgttttacccaccaccaagcctggcaacacttctaaaatttggaagatggaagacttgtcataaatgaatgaaaatttaagtgatatagtaacacatgaaaggtgtcaatattatttcaactcaagccttagtgagcttgaaccttctagctttatgtaaactctaaatgtgcactgttatttattccaggtacaaataccacataattctatggtgtcttagttaaagggcaagtataataagtgttattttatgtcctttgcaatttataaggaactttatcatacattattctatttgactcttacgacagcttcttggggtggcaggtgaggtatagatatttcttgccagttgtgggttgagtctgctgagatgtctgagatggagaagatgtgcaggaaggtgttggggagtgtgattgctgttatacctgaagggagaagagaacagggatgaatggggagaagtcgggctgcacctcagtcatggcagaagccaagccgtcctgcaggatgctctgaggctgggctggcccttcagcgctgtcctggattggagcctgggaaccagggcttgacacgttcttgttggcccatctgtggacgaggctgccctgggaaggaatgtgaccttggctgaggtgactctcgtcatcagagaggcaattcccagagggttgatggctgagtgctctcctgggagctgggaaagagtgctctaggcatgaagagctagggggacttccccaatggctcagcaggtaaagaatccacctgccaaatgcaggagacacaggagacatgggttctatttctgagttgggaagatcccctggagaaggacgtggcaacacactccagtatccttgcctggagaatcccatggacacaggagcctggtgggctacagtccaatgggttgcaaagagtaggacatgagtgagcgactaagcacagcagcacaggcacaaagtgggcttagttgttacatcactacaagaggtgggggtgatcagctcgcctgtggccagaggggaggcactcagagggagaaagactaacagtagagcagaggaacgttttaaggaggatcgtcagtttctaatgatcacgatttgacggcagttgatagattcacttgttaaatggacagactgctcggaggcccctggagatgctccttcctaatgcacgctagcaggcatcttccagactggcctgaactctcctgtatggatcgagttcaattattaatcaggagggctgggggatgctgcctaatggcatagactgggtaattgagcgcctttgtaatgtgtgttcagagcgcaggttcggatggtatcgacatggactgctcctgcttggctgcacacccggg

SEQ ID NO: 57131 - DNA, 1249 bp, Bovine  19866881316952
tttctcgagaggtttgtacaaattcttgaagcaactggttatagctaatttggggagtgggaaagaaaagtgggtggctagaataggtttactattaatccacttccctaaccaaagcttggcttgtagcagccacagggaaaatcaggagagtggaaaggtcagaggagtatattttgaaggagtcaggagtaacagcactcattggcaaaatctgcagtgggattcacttccaagacagatatccgactctgtaagaatcccaagccttatgacaagaagccaagtctgatgactggccatttataggccctcaaatatgcaccgttcgtttgggggattatcacgctgttcttcactttaaaagacattttattttgttagttctggtttatgctcgacagcgcttctctagaaaccatgtaagagagcttaatttcctaatcacatccttttaaataattcaaattcagcagacaagtacttgggtttgccacaggagagacaaatcatgggacattagggtacaactggggcgagttgtcaaagtagatgttctggtatacacgagaatggagtgtactctcccgctattcaaccatgaatatacagccttacagtgattcctccacaattaattcatttgaaaatagcgaagtttccaagggctaggaatgtgaggattttcactggatggttgggtgggagttagggaatgtgaaatacccaattcatgatacatttgtatctacattagattagtcctagctgcacaggctcttccaattaatcaatcctattcccagaaaacacacatcacaggaacatagcaattacatgtatctttataagagtttacagatgatccaatattcaacttgcctgctctattagaacaatgattagcattcagtgaaaactaagtaactgccaaaagaggcagaattaaaaaaataaaatcagtgttgctgtcaatacctatattaattaatcatctttcaggaattaaaagtaaattagtttgtaaaaatgtttaaagaactagctaaaaatgggaagtgaaatggagtagtttggcaggcaactaactgcaaacacctacaagaacgtttcgagggaaccagaggcttttctgcattattgggggttttcaacaatgctgttctaagaccatgagaaactacagctcaatcagattagtaactttgaagtctgaatctggggtatttctgttccacaatgatacaca

SEQ ID NO: 57132 - DNA, 782 bp, Bovine  19866881390985
agcccagataaacggggcagggcggaagtccatggggttgcaaagaattggacacgacttagtgagtaaacaacattcagagcagaataaaaggtgctgcagaagcgacattaacccaggattcctcatacacaggtcacctgttagattattatcttgaagtcctcaagttcaagaaaccataccctggccatccagcttgttttccatctggcccacccagacctggctctgccccttcccctccccctgtcaccagatatgctaagggcacaacagtcccactgggtcctgagtccccaaaacttcacaacaaaacctgtcttctcccaaatgaaatgcaagggtccttaccttcacagaggcgagattttgtttctttgttgctttcaacatcgggaaggatgtcaaactgcctttccttggctttttagcatccatttcagtcctgcagaaggagatgaaaaggtaaactggcattagaagtaaaacacagcaagtcccctacacaggaaccttcaagttgcgaattttcaaagatgcaagcgtgtgttcacacgtccagtcacggaagtgagttcacgtgtctggcgtccatcgtcacgtgcatgcgtcctctagagctgggtgtgcttctgtggactttaccttataggactattgctgtacaacatgagaaccttactaatgaagacctgatggaattggaggcccagagaaaggacaaatgtagacaagaggaagatgaacaaactgaagaagagacacacgacgcagaagag

SEQ ID NO: 57133 - DNA, 1188 bp, Bovine  19866881409841
caggctgagcaccaaagaattgatgcttttgaactgtgatgctggggaagactcttgagtcacttgcacatcaaaccagtcaattctaaaggaaatcaacactgaatattgattggaaggactggtgctgaagctgaagctccaatactttggccacctgatgtgaagagctgactcactggaaaagactctgatgctgagaaagattgagggttggaggagaaggaggcaacagaggatgagatggttgtatggcatcatcgacacaatgggcaggagtttgagcaagctctgggagatagtgaaggacaaggaagcctggcgtgctgcagtccacggggttgcaaagagtcagacacgatttagtgactgaacaacagcaacaatcttctctctgggggcttcccaggtgacacagtggtgaagactctgcctgccaaaggagacgcagatttgatctctgggttgggaaggtcccctggagaaggaaatggcaacccattccagtattcttgcccggaaaattccatgtacagaggagcctgttggtctacagtccatggggccacatgacttcagacatgactttgtgagtaaagaagcaacagcaatcttctttatatgttgtggctgtttctgttaacccatctcttcaagggtctaatgaaggaggacaccatggcacttgtatgtcacagaacgcacctgtctccatgataccaaggactggtttccaaagccaagaccacagacagttttggagcctgttcctcacgtgatgtttgatagcctgcagacagtgaccgaggaaccaacgggaccatctcagcatcgtaatgccgagtaacagcacagacggttgcacacttcccacgcccaccgcccgctgcccttccggcagcaccttccccatcccaggctcacaccagctggttcaccattaggtgagtaataaaccagcccttcgggccaatccccgagaaaaagcaacatgttcaaacaccttgttattattgctaccaatgataataagaggaataatgagcaagaattgcttttattaaataaatcaggaaaatgcactttacaacatgttcctggggcgcgtcaagaggctctaaatgctgggctgctgttacagctcgcgctgggctccgacaggaagggaggtcctctccaattacttgt

SEQ ID NO: 57134 - DNA, 865 bp, Bovine  19866881419118
agttccttgtgctctacaataggtccttgtcggttatgagatctgcttctttttttctctatatcctgtccttcaccccaactcctctgctcctctcaccccactcctaagactaccacgaaggacaaacaaagcccagaccatccatccctgacttcccccagactaatcaagtttcctgagctcatgcagactgacctcacaggagcagtgacatcgtggaaatcaacccaggctttcggcagtgcatcatagcggcaccagagttcccagttaaacccgtcaaccgccagtgcatatttaatcagttcaaaggtgtcaaaaagaatgttgtcaaacacaggagatacgatcacggtgcggtcttcctgaatccgagccaagatgggctcagccctgcaagaagggtgtgtaacagacccaggtgggatttgaggataatagtcaaagtgagcagacaaagctgctccatcccatccccttgtcctgaccctgaccaccttcttcactcaggccacactggctagtaggcagaactctccagagttctgagaatctgcaggtttgagaaatagctggggctgctggcagctgaccccagtcaagagcacatttgaaactggggtacccaagtaccaaccccaagccactgtggagaagtgctatcagtatctgcctgaatttgtcttacttcttgagtctccctgcttccaaaataacatctctattactatctgattccccacattctttgagtaacacagcttcttcgtatcatgtaacttcatgggaaaaccttaagattaccaaaaggtagtctcttcatgcatggatgtgagagttggaccataaagaaagccgagtg

SEQ ID NO: 57135 - DNA, 2350 bp, Bovine  19866881546910
ctgaacgcctgcctggagattctgatgggctggcccagcagaagtccacctgcctgagcgttgaggggcctcccgagacagaatccatcctggaggtgaagagaactcagtgtctgggcttgacccatatcaaatgaagagtctggaaataaaaccccaaagaggaatccccagggtgcagggatcaatagttctagtcgggcacttctctaacaagcatcactatatggaggggacccagatactcgtcctggtgttgaaacagaacattggctccttgagggctttgggtcttcagcgttggaggaaaaagaaatacccattggctgtaagcaggaggtggaaggctgatggatgggactcccgacaggtgccctgcagtggtcccaggcaggagcagccacgtgctcacccacacatataaggcacactctggacttccagaaataactaggggccacttacagtgtgctgaagctccacttgagctttctgcatgtggaatcttagctccccgaccagggatcaaactcgcaccctctgcattggaaggcaaagtcttaaccactgaaccatcaagggatgtccctggaaatgttttctctctcttgaatcttcctatttgtagctagtgtcacaggccctaaatgttggctttgggcagggttcctgctagtccctcccctcagcccaagcccacctctgacccgccaagccccctgagctaacactacctctgcagagcaggtgtgagcgcacaggtgtctgagcaagagggagggagaaggtaaaggaggcggcagtcccacagcccaggtaactcagaaagaccaccagaaatgctcaacatagctgtgtcattttatacctgataactttctgtgttttccaaattataaaaaaaaaggcaagtgttaacttttttcaaaatcaaatgtcaaaagttcaggtaaacagcacttttgacagtctaggtgagctttctgggctttcccttatggtcactcctagggtgtttgaaattcatgaagtgataactaggaggcatagaaggcaacagggcttccctgatggctcagcagataaaaaatctgcctgcaatgaaggagacactggagacactagcccgatccctgtgttgggaagaccacctggagaaggaaatggcaacccactccagtattcttgcctgggaaatcccatgcacagagaagcctggcaggctacagtccatggggttgcaaagagctggacacgactcagtgactgagcacacagcacacagaaggcaacccacctggttgtgatagaaggggttccaccaggcaggtcaaacttgatcaatgtctactgcgtggtacctgccccccaaccccacccagggacaaggactgtcatggaaggagatggacattagcattttttcctctgctcacctctaccaactcttggctcatccagagagagtgattgacagccccagaggctgctgggcaactatttgaaagaggggtccacggagaggcctcctccacctgttactctttttctctatcacttcacatccataggggtccctaagccccaggagaagggtcaggtgcaaatctggtaaaccaagaagccctagcagttgtcaacttaattagccttcaggaaaaatctatggctatatgagcacagcagggttgctatggagacaggcccaggagggcgcatttagaacagggcctcatcacatcacgcgataaaaataagacccaggctttttaatagaatgaattacttaagttttatatttaacaggggacgataccaaagctattactggttttcagaatattttaggaatccgagctgcctgcttctgcatatgttagcagccatcacaatatatactcgggtggccggcagttaggaagtagaagtccacgtgtctctcccatccttgagctgagagatggtccttctcactttgggtctgtcctccttgaattggttgagcaattttcaatgtgtttctgagaaaagactgtactgtgttctgcacccagccctttgcatatatcgtcactaatatataataaccctgcatggtaatggtctcattttgcagacgaggctcagagatgttcagaaattttccaaggtcacacagctaacaagtggtggagtcaggatttaaatccaggcatcccgcattccaaacccctttgctttgtaagatgccaaccaccatctctgaacaaagaatctgcaatgaggcgaacctaaagagattcactacttttgttgatacctggcaaacaccttgtgaggtgaatctctcctccaaaggggtcccaaagcg

SEQ ID NO: 57136 - DNA, 2843 bp, Bovine  19866880458669
agagataggacttggtttctggttggaatcccatgcataccaagcttggagaaggtcaagtctgacagcacacacacttgccataatgtctgtttcctttggaacgggcagttaggttctcccaatgcagctcccaaaccagactacatgggagccatcctaggtctgtcagagatgacctggtgtttaaaaggcaacgtgagtggttagtgggaaatgggttctattctgagtgatacttgtgattcttctgggctactctggcacaggtcctggaaggttgtgggcatgctaagtcacttcattcgtgtctgactctttgcggccatagggactgtagtttgccaggctcttctgtccatgggatcccctaggcaagaatactggagtgggttgccatttgctactccaggggatcttcccaattcagggattgaactcacgtccctttcatctcctatgttggcaggccagttctttaccattgagctacctgggaagccttcaaagttttaccaaggcaattatgtgctaggagggaacttttaaacaaacatggaaattgacactctaaccattcttagaaaaagtaaaatggcagataactctcaatctctcagtcttttttattaattttattggaatatcgctgatttacaagttgtgtttccaggtggacagcgagtggttcagttatacatatacatgcatccctcctttttcagattctttcctatgcaggttattatagtctgtagactagtgttccccgtgctatactgtaggtctgcactggttatctattttatctatagtggtgtatgtatgttaatcacaaactactaatttatccctacgcccaccccatgttttccctttggtaaccatatgtttgtttctgaaatctgtaagtctgtttctattttgtaaataatttcatttagatcccttttaattagattccacatataagcgacaccatgtgatatctgtctttctctgtctgacttacttcacttagttactatcatctccaggtcaatgcgccactctttctctctcctcatttggatccatacttgaatggactgtagccatagctatgagcactgcagttaactcctcattaaatgccagggactgtgaaagcaggtttggggacatagctcattcactcctcctagcaacctgtgagctgccgcttttcgagagggcaggcagaggctcagggactatcaagcagaagtgcacagtcttgctagtgatcaagcctctgagctcaatgtcatgtccgttagaacccagcgtctcagttcttgaagtttcaagacagtagagctcagtcgtgaaactatatggcagttctatgtgaggactatatgagggacctgagtcggggatggaagcagaatgatgggggtggcacccagagatctgcaggtgtaataggcttccctagaatctcagaaggaggtggttaatagactacactttaaagaacacatgtctccatctctgctttgcaaatgggttcatctgtaccatttttctattaatggagtccacatatatgcattgatatatgatgtttgtttttctctaatgggattgatgtatgtacagtactacatatataataggtaacttgagaacctaccatatagttcaggaaaccctactcaatgctctgtagtgacctaaaatgaaagaaaaccctaaaaaggggggatatatgtaaacatatagctgattcatgttgctgtacagtaggaactgagatgacattgtaatcaactacactccagtaaacactgaaacacaaaagtgaacaagaaacagccctcataccctcctgcttgtaggggtatttgaaggagattttaggttcctgaggatgagttatgaagaactggctagggccagctctttaggccaatcaacaaggaggtcaaagcagtcaatcaatcctaaaggaaatcaatcctggaaggactgatgctaaagctgaagcttcaatactttggccacctgatgcgaagagccaacttgttggaaaagaccctgatgctgggaaagactgaaggcagaggacaagagggtggcagagggtgagatggttggatatggacataaatttgagcaaactccgagagatagtgcgggacagaggggcttggcttgctgtagctcatgggcttgcaaagagtcagacagggctcagcaactgaaccacagcatcataaatatctaattgccttcttcaaattcacctgtctcaaagatcatttccttgtgtcttaaagatccattgacatagaccttaaagtagtcaggttggaaaatggcacaatgtttaacattttctttccaaaacgattgcaaatattaggatgaaagaaggatccttaaaacagacttgcaaacaccaagctgagcagtgcaggcatcagcagcttagtaggtttgggagtgggtcggggagggaaggcggccctgagggagaggaatcgcttcaaatgcctgttgaacttgaactccgctgtatgtagtcctcatctgtggccagctgcttgcatggtttctccagcagccaaatctgacccaactctctcttcccccacttccttgttttaaatgagatctggttttacttagatgaattaaatgtcactgtatttgtttctgtgaattgttccagcagaacttacagcatcagtgtctgactttgaacgtctgcaagactgtcagcctctctgggctatttttagttgccttttaaaagttctaataaatgcttttagagagcgattggtttcctttccctttaagaagcctcagaatcg

SEQ ID NO: 57137 - DNA, 3929 bp, Bovine  19866880506973
gaattctaagatctcccaggtttgcaagaacacgtccacatcgggagggtgacgcaccccacctcctcggggagacaggagctcctgcactcaagaccctcccgaactggtcctgagtgtcttcatccgactgtccatctgcaccttccatcatatcctttcatcaactgtaaaagtaagcgtttccctgagttctgttggccgaaagtaagcaagcgtttccctgagttctgtgggctgctgtagcaaattaattgaacccaaggaggggtagggctttccctggtgactcagtggtaaggaactcacctgtcagagatgtaggttccatccctgggtcaggaagatccctgggagggagggaaatggcaacccactccagtattcttgcctggaaaatcccatggacagaggagcctggcagcctacagtctatggagttgcaaatggtcagatgcaactaagcgactaaacaaggacaaaggagggctgaggggaccttccatccccaccagtgggacagaagcacaggtgacaacctgggtctgcgtcctaagtggggggaggggaggcagtcttgtgggaccatctgtggggtctgtggggtctgaagctgtctccaggtagactgtgttagaacccagttagacggtaggacccccagctggggccgcagagacccgcatgatgtcgggggaacctgaacacgtggtgagcagaagtgtcagaagcacagcgttttgtgtgaggaataaaaacacacagaaaacagactgaagtgtgagatgtctccctgtgacggggggaaagactgaggctttttttcacataggattttcacagctgtgacaaacgtgttaacatttgtaaagcatttagaacagtgcgaagcactccgaaggtactcagtaagtgggcttatacacggttcatacagagatacgaaaggtaacattcagctttgcacgcgtgacctgagtgctcagtcgcgtccgactctgaccccagggactggaacccgccaggctcctctgaccaagggattctccaggcaagaacactggagtgggttgccatttccttctccaggggatccagggatcaaacccaggtcttcctggtccagggatcaaacacaggtcttctgcattggcaggtggattctttaccatctaagccaccaaggaagcccaatggctgagtagcattccattgtatgtatgtactgggttggccaaacattcatttgggtttttctatacacgttatggaaaaagctgaatgaactttcaggccaacccaatactacatttctttacccactcatctggtaatggacatggaggttgcttccatgtcttggctattgtgaatggcacggctccattcccgtctcatatttctcctgggcaagcctaggcatgttcttctcgtgatggtagatgacacacaagggagaaagcccagttgttcaagagctttttaaacctttgcttaattcatgtcctctaatatttcactggtccaaggagtcatgtagataaactgagagccaagtttataggaagttataccctgcctacttaagtaggagaaacttcaaagtaatatggcaaagtacagggattcaaagaaaagagaactgaggtcgtaaatgcaatttatcataaggagaacatgactggtcagatctttggaaaccctctcctgagttttgccatttgtatattttattggtttgtacctattggtaagatttaaggtggcaatacagtttttgtgatgggttgttgttcagtcactaagttgtgtccaactctttgtgaccccatgaactgtagcacactaggcttgcctgtcctccactatctcccagagttcactcaaactcacatccactgagtcagtgatgccttccaactatctcatcctctgtcatccccttctcctcctcctctcaatctttcccaacatcagggtcttttccaatgagtcggctcctcacatccggtggccaaagtattggaggttcaccttcagcatcagtctttccaatgaatattcagggttgatttcctttaggatggactggttttatctccatgtggtccaaggatctcaagagtctaaaaggtaccccagctaaaaaaagatttggacttagttcagagcaatttatgtaactaacaagtactttttggacagtgtagaactggcactggagaaggataagctttgatactgtggcctgtggggaaagtggaaaagcccagagccctggacatcaggtagacaagggcagcagaggaggaagccatgctgaaacttagaggtgaatcggcaataaagaaaaagttctcctacatctaaacttggctcaaagacagcctacaggcagtcagtcttctgtcaaacctgtctattgccattaaaatggaagcagcagtgatagtctcagagggaaaaaatgtccttctgagataactacatagctaactctgcaacagccgaactttattaaggaagtgtctatgaaaactgatgcttacagagctatggttttctccgggaatgtgcccaatagtgggatcgctgggtcacataatagctctgtttagctttttaaggcacatctacactgttctccacaggggctgcctcagttacattcttactaacagtgtaggatggttcctttttctccacactctctccagcattccttgtttgtagattttttgatgatggccattatgactggtaagagggaggggtatatgcatacatatgcctgattcacgctgtttcacaataaaaactaatacaacattgtaacgtaattatactccaactcaaaaaaaaaaaaaaaaaaaaagatgcttacctttaaagttgacttgctcatatttacctattttctctttgtggcatgtgaacacacaaaagctaaagtaagtcaaaataaatgataaaatgaagactggaccaaggaacttctgttcattcagagtcttgaaaatgccttgagctggattctaaatatttgattcagaaaaacctaaaccctgtttgtcaactgcattctttttcccattaaaaaaataaaataaaaaggcctcccatgagtataatggtggaaattcaatcccgtatgttttctgattcatttacacttagctcatcaaaatattttgtaagagctgagctttttggtggccagagacactttgtggtccttttcccctttgaaacagaaaaactgcagtttatcatcagcttgcataaatgaaggctgaagcacactccttaaatctgttatcgcataaggttggactgaacttatgagcccagaaattctgtcttcccgagctggcttcctcacccttgtaatttatcctcatactccagtgctacctgcctggtgctgagcctcttttcaccactcacatctagcatcactgctctcactgataaggacaaactaaagaaaaaaaaggatcagcctcaggagtgatccaggaaaggcaagagtaggcttcaggcaaaatgttccgagaaatgttagaggaaaatgaatgtttgggagtgtggtgtgattctgtagccagatttcaaaggtaaagagcacagtcttctatttatcaaaagtcgaaaggaacagctgtgcccagacagaatgccaaaaccaaatccacatttatcagaagaacagaggaagctttccttttatgtaacagatctgcagtcctgatcgctgaggtgagcagcttttgctcacagcacatcaaggacagatctggggaaaatacaaagtcagaacagaaatcactgtatcgatagaaatactaaaatcagtaacagaacaagggagcaaccagtcagcaaactcaggtcatgagatgctaaattatctgaccttcctggataca

SEQ ID NO: 57138 - DNA, 766 bp, Bovine  19866880558239
taaaacgtcccccgaaatcctcaagggatgtcctgtaacattttccatggaaatgccataaaatattccatgcaattagcttcgcttaaagaaacatttgtcaacgtgcttcaccttcgtataggtgacttttttttttccctcaaaatacatgtcatttacaaaagtagtatgttgtttaacaaaatacttagatgttattatcactgtgggattctgatggacagaaagctaatcagagcaaaattacattctaaagctgaagtcgaatttatcagtgaggagcgagttggaatagagtagagaatgcagggggagggggaattatgaagagatttttgtttaggtaaatcaaactcctaccctttcaggggcccattttccagcctcagaaaatatgaaatttccttcgaaagactcactgtaaaccatgtgacccccgagaattcacaggaattgaagtgaactcccagggtccccatctgacgccaagaacctaggctgcaaatcaaccgctattttccaaagcatggaggagtgttaccacgaatcaccacgtgctgacgatggaaaacaggtgtgtgggtgaggcttcctgactgcagcaaggccacgctcagtccccagggggctcatctacaccccgccagacggctacaccatctaagccactcccgactggtgtgcagggattttccacggggaccccaggcctttcacggggctgctcaagtgcaggagtatcccatcacactttccctccctg

SEQ ID NO: 57139 - DNA, 1917 bp, Bovine  19866880579086
acgggggagcctggtgggctgtcgtctatggcgttgcacagagttggacacgactgaagtgacttagcagcaacaatctggaaggcttgctttgtatttagaatatcgtggactttctggcattcttcactggcacatggaagcttggggagagccagccccgtccctggcatgttcctccttctcttctcacctgtggccccctccccaatccccaggagcccccacgctcacctgtggaccctgaggccatgcatctaagctctgtctacacccccaccgtctgccatcatctgatcactccttgggccaggagagtacacttcaatattttcaaccaacctgactttactgagagtctcccttacaactagaagttctggctataatgctcgtgagctatgactgtgattgggatgtgtcagaaaaaagcagaaagttcagggtgggcagtgaacattcccccactgtagtggaaaggtattgagcatgatctgctgttcacatctgtttgtctcgtgtgggcatttccgtgtgttacaaagatgcttgaggacttcaaggcatagtttccaatcattcatccctgctccaccctcctggaaagaaagacccccgactccaacagcaggtccctggagaaaggagaacccgctgtggtttatgggtaagcgaatgaagctcagtgttcagtgggtggcagagtagaaaagggttaggagcacggagactgattcgggtcctgagtgtcctgtatgctggttgtgtggctttagataagttcatatctttacctttagttccatctaagaaatcctctagtccatggtgataacgacagtactcatcactcagcgtcatggacggaagttaaatgagctgacatacgcagtgcatttaacagaaggccttgcccgtcatttatggtcaagaaacttggatttgttttcattattacttcaactataggacaactacttctgctatgattatttactcagggctgtgtgggtcgcgtgtgctaagtcactcagtcctgtccaactctttgtgaccccatggactgcagccctccaggctcccctgtccatgggattctccaggcaagaatgctggagcgggttgccatgccctcctccgggggctcttcccgacccagggatcgaacccgcatctcttatgtctcctgccttggcaggcgggttgtttaccactagcaccaccagggaagcccattactaagggttacattaagcaaattgagagaacttaaatgtaggttttctgattcaaagatttgtaccctggaaagccttcagctatgctcatttcataaaaaaataaacataaagcataaaacaagataatccaacagcaccattacttgcagacacccaccatcgtccacaatcacagaatgaaaggggctgaggtcagggcagcgacatctcgtcgtcttgtaaaggcagagctatttcctttcctgtacgatcacactcactgcggtgctggccccagaccagcagctggaggaagctcttgactgttcacacaaatggagtgtgacagctcggaaaatgcagaacaatgggccgctcaacctaattacagcttggcttttggctttagggctggaggttctaagtctctctgtctgcccttctctgcccgcctccctctcttttctcctctgtctctttctctgtctgcctctccgtcacgtgcacacagaagcacagacacacacaagcacacattagacatgcgtgcagcttcccctgtgttcacctctttgctctttgactccccttgttgcccttcgactatcgtagataatccttcctaaccaaaagctgtacgcaaaatgctgacgtcaccttaaacatcctgccgtgttacgcatggcatgcaatcagg

SEQ ID NO: 57140 - DNA, 1761 bp, Bovine  19866880631800
cttggcaggagccgttcaggcttcgctgaagattctctggatccagatctctgtggtatgaaaacaaacagtaaacattttccttgcagtttacatcccagatctaaatatttccaagcatgtcaaactcacttttctccaccactcccctgcggggtccgtgtacacttcggctgccaaggaacccagttgaacttgccttgggaggggctccttcccggaggacgggtggagctgggagcagcggccaggagctgagagcctgcagccggcccgccgggcctggcagaggccccgaggcaggagcaggtgtgcaatctgcctgtctctccgcgcaggccgggggaagacgctctggccctgctgtttgctccttgagctcgaagtcctcccgtttccctggtacctgttcgcagagaagcactcaccagggacacgtgctcttctttcactaactttttctgtccaagccattctgtgtgtgtgtacgtgcgcacgcgcgcgtgtgtgtgtgtgtgcgtgtgtgcgcacgcgtcggggtgtgtgtgtgcgttaaggcgcttcattcatgtctaactcttttgcgatcccatggactatagcccgccaggctcctctgttccgtgggattctccaggcgagaatactggagtgggctgccctgcctcctccaggggatcgtcccgacccagggatggaacccgcgtctcccgcgtctcctgcactggcaggccggctctttacgcccagcgccgcctgggatccggctcacttcccagcttggcgctctcacttcagcgcatctgtaagggaaggggattcctctgaagaagcgatcaaagggtgccaccagactgtgtctctccgtctccccgctctttctttaaacgcttttaaaattggagtatacttgctttacagtgctgttagttaccgcagcatctttttttcaaccttttattttgcattagagcatagctgagctgattaaggatggtgtgttagtttccggtgtcagcaaagtacttcagcgatacacataggtgtgtctcttcctttttcacactctgttcccatttaggttgttacagtatatgaagcagagttccctgtgctataagtaggtccttgttccctatccacgttaaatacggcagtgtgcacttgtccgttccaaacttgggttttcaattcagaatgtactgatagttgaagttatcttagaaaaagggaacaattgcaactgagtttaagtcccatctcagtccgagttgccttagaccacatagcatcttgaggacttagtctggaagtgtcctgagtcgcttagtcactcagttgtgtccaaatcttttgtggctccgtggactgcagcccaccaggctcctctgtccgtgggattctccaggcaagaatactggagtgggtttccatctccttctccaggggagcttctcgatccagggatcgaacccatgtcttctgcgttggcaggtggattctttaccactgaggcaccaaggaagcccaaaacagtcctgacatagtggcaaaggcagtgtttgagttttcaaaaacgtgtttcttttctaggtgctgacagcaaattctaaaactgccataacaaatgtaatttaacttagctaaaccaggaaatgatgaacatatcagcagacactgaaacccttgtctgtggcctcagagatgtactgcatagcagaggaaataaataacccctacctttaaagggagcacttccgt

SEQ ID NO: 57141 - DNA, 1363 bp, Bovine  19866880731802
actattaattattactgcaaagactaatgagtgattcttgctaccaggaagatgcaaataacaggagctgctcttctcttctcattataaattggactgcagtgacggttaatggacccttgaaaataaaactaattgctggtggtctttacttaagcacaaaagagagatttgtgttcctggcagaacaatgtccttctgcgtcacacgaccattcataatctgactgcagatctagactgtgactaatatttggctctaatattataagtggttactctggagggaatcagtagggacatacttgtcacttccttggaaaaatgtaatctacagatggatcccaacaccccaactgtactggtgtccaactgcattggagatttttttttgttttttgctaaataaggactgattcagccaaaaagatatactctcagagaaatctatatcacatactcgctccaaaaaagtacacttatccaagcactgaatggtttggaacactagaattttcctaatagggacatagtgaaaggtctcattcattaaaatgcacatttatatttttcttataagatgaagcaatagagttaatcaatgctctcctgcatttataaagtttcagttataaacaaaatgtaattcttcatgtttccttatttagctaaataactaagggaaacagtctattcagattgggaagcttcctgttaaaagtcaacctgtctctaatttttggtttcaataaataaggcttgatgcatatcattccatgggaggtgaaagtgaggttggtaagaaggactaggatacacgtatttatttgcaatttatttctcatcagtaaatttatacaaacaaccatcatctgagaactttgcattcatttttttaaaaaagatttttcctatcctatgcaaccatcctgacctgtggtgtattcaatttacttagagtagcatattaaaataaaaccatttcaatcgtaatttcagagaaatggtatccctttctgggtgactggttttcaaaaagagctcattacctggaaataagagtgttggatttttgtggcttggaaaatcctcagccatctacagatgcatagattgaatcacagtaacagaagagatcatctataaacgatgaatttcctctttccatttaggtttaatatgctttgaaggattcatcaggcctctccggtccaattaagaaatccacgaggaaacccgtctgagaggcagctcattgcagcgcagtgagccgcaccgcatcctttgtccactggtcacgcagacttagcttgtctgtctccaggctctttcagctttaggctacggcctggcttcctatacat

SEQ ID NO: 57142 - DNA, 2660 bp, Bovine  19866880790703
aggggatcttcctggaccgggatcggaagacccatgtctcgtgcattggcaggtggattctttgccagtgcgacacctgagaaaggcaggctgctctgcacccttgtccactcctttgtccgtcagcaatcactatttccttctttcaaaagaactttatttagagaaatgccagatgttctttacaccaccctactgtttgtggaattttatgacatgtttcctcaggctcattgttactgacatttggggccagatctttccatcttagggaggacattcctgtgcatcgcaggatgtttagccacatccatggcctgtgcctctagatgtccatggtaccaaccctgccccagctgttacaaaatgtccaaaatgcccctagacactgacacatgttgccccccacacaacagatcaagtcctttccttgttcatggccccttacatagatccagtagattttggaagggacatccatggacattcttcaagctgaggatgcatctgactctatgagtcagtacatccccgtcatttatgcatttatcaatagagtttgaactgcagtccatggagttgtaaagagtcagacacaacttagcaactgaacaacaataaagtccagcccagtaactgtcaaactgtaaatactaagtactggttaaaattttaatataggaattatattaagtatacatcagcatgaaagtgtggataagttgacattaaaatggaaagagcatatttatctaccataaccagcttcctgatcaaaggtcagttaaaacacagattcctatgtgcaggagaggcagacctctaaagtagctttggttacctgtcagaattacccatcccagagctgccggaagcatacacacaattttattcctaaaccatcataccagtttccatgattcagagaagagcagctgtccatctgaacagctgtcagtgtttctggacagaatcgctgaagggaagggagagaagctggtttaactatttgccacatgtgtgcatttctatcctggagacttgagtttaaagcaggaactggggtaaactaaatcacagtttagatgggctttacacccatctaactggttgtttagcaattagttgatgggagatgaccagaatacaccttgaaatatcattacacagtgattgtactacctccccgcccccaattcttggattgattggctgaattatcatgaaaattgagccaaacattccttccctcctgctcaagaattttgtacaatttctctctagtcagaaagtgactgggtatttgatcaatgttcaagggacagggagaggaggaagaaagccatcagatttgttatcatgagtcacacttgatgtgagctctgctctttttcagcagttaagaaattagaacagattccttttttctaaagaagacaggctgaaacatttgcagcttttgaaaggtaatctaacactgtcaagcttatgacgtgtcaggattcaatttaagcattttgtttttataatacaaagatcagagagtcaggcaggttttggcaaaagaacaacaggaagagtccctgtctctagagagagctgccaaacttcaaagtaatttacatcaacagtgtaatcatcccctacaaaaagcgcccccctctgcaaagctagttaataaagcacttgctcagtcataaaaatgttttgaggaaagcggaactgaataccttaggtaagtgatgatctgagatataaaaacccacctgatagtcttgagatttggttctctttgaaaacaaaagaaaaaacatactttcaatttctcaggatcgagtgtgctgaaatgttaacacatgatctcagtaaaatgtgattcatctagtgttgaaactcaaagaattacagaatgacttgtaaagaagtgtatactgaacaaggaaacaccaaaatccatagaacttgcattttgaatttggttagaaacgacactctaatgtagactcaaactccattcaaactctatttaaataacctcccattacctaactattgaaagtcacttgcatgcccaagttctagtaggcatgtagggaaagtaaatacttatagattttgttgttttaagataacattactctatagattcagaatttcaaacatatttgaacccaaggtggctcatcatactgtcactgtgcttcagggctatggaaagaaacggaaaccgtgttggaaaagaggagccaggatgaaaatcatttctaggcagagtgctttttccttctgtgcactgaataaattccacacctacatcacgagacattcactgtctcttacaatttttccctcctggctccaagaaacctgttcagtgtggttcctattcaagctccatcttcaaacttgttcaagctcccttttccagagatgtttatattctagatccatcctgccctcttttctttcctccccatccaaattaaatcctattttaccatctcccagcctcccaaggcaacagtagataatttgataattctactggctgactttattttggggggctccaaaattgctgcagatgggtgattgcagccatgaaattaaaatatgcttactctttggaaggaaagttatgaccaacctacatagcatat

SEQ ID NO: 57143 - DNA, 1120 bp, Bovine  19866880805809
tgcaacttttaagtacatattgttgactgtccgtagtccacgcagagttacaactcccacacttcaacaacaacatgctgacagttcctaaagaaaactactcaaaaaaaaaaaaaaaggcataacccagatgttccctcatttgaccaactccatctaagtttagatgtgcagaagggcttagatatatccagagtaagccacatgcaacatgttacttgatcaattttctaaaataaggtttcaggacaatgacagtaagataagggaagaaaacatggaggaatgaagtcctaattactatacatgcatatttttttttgacagtagggggaaaccttttacagataagttacaaacaaagaaaaggcaaataaacaattttgtacaagaaatttaacacattctgtacaatgtcttcactttgctgtcatcatttgtacaaactctgaaaaagaagaagtatacaaagatgttgagtcaatgccaaaagtctgacaaaaccaatcacatttactcaactactgagcagttcccactcccctgtcttttgtcaaaactataaagtacagaggaaagctaatttactgctaaagctagattcttcacaaatcaaaaattatttatgattattaacaaataaaccaaatcattgctttagtttatcatatataatacttctgaacagaagcatgaataatttcagacttaaagctaattgaagggaaggataatccaatgaaagacattaaagtcaccttaattttgaggatcctgaaataagtttaaagaagcttttcaaactgttccacaatggtaccaaaaatggtaaccaaaaatggttttatcctagtttggagtgcagtgcttcttttaaaagggtaggatctgatagtaaagcacaggatacagctgtgacagtgcaaagacttaccttcatagtttacttgaccatcaccatcaatatctgcttccctgatcatttcatcaacctcttcatctgttaacttctctccaaggtttgtcatcacatggcgaagctctgctgcactaatatagccattaccatcctgcaaaaaatttagtaaaatgtctgagcaatattattcgatgtaatgag

SEQ ID NO: 57144 - DNA, 2279 bp, Bovine  19866880808150
tatttgtctatgtatagggtacaagactgaatggtccagatgaaaaagatggacatatattattagttatactttatggaggaaatattttccagggcagcaattcagactctgcagtaaacaccataaatcaaagactctataatgctgttgacaaactctccttaagccctgttgataggttggatattgtagggtggattaatttcttgggccggtgctatatttcagtcatcccttctctatgtttaaacagacagggctcacgtagttcaatcaggagtgcggtggggagggggcaggagtatattgtattctgtggactcggcccatgaaaagataggaaatagcagacctttcttttcgatggaatggctttccttgaacctatgtatgcatccaattaaatgaattttcatttgattaaatacaaaattctgggaaatggtgcttcagttaatataattttaagcgaactgatttacagacagggagtatacctagtccatggaaaaacagagactcatgctaccagattaatagcatttactatgtagcattatcaagataatttttatatgaaaggtaactcattttttaaaggaaagattagttttcccatttgatatgggtgtgtgttttctgatttactcatatatcctgatgttaggttagttttgtcaagtttttgaatcattcctgtgccttttccatgactcaagttgatattgccacagaaagtggggtctactttctcgtccctcaaaagccagtaaataggaaaggttggtggacaggaaagtctgctttcttctggatgctgtcagctggggttggggggagagggtagatgcctgctcaaagaccagctccatccctcccccagcgatcagtgggcaagaggttttacacgcaaagggaggggcccacatgcagaagcagcagggtcagctctgaccatcacagtgaaattggtcatctggtggtcttgattcttttaagcagagttagtcttcagctccaggggcagtttgttcccagtttctttgaggccagttctcaggactgtggcacctgatggggggctgcagtcggtcgtcattctcaggactgtggcagctgatggggggctgcagtcggttgtcattctcaggactgtggcagctgatggggggctgcagtcgatcatcattctcaggactgtggcacctgatggggggctgcagtcggtcgtcattctcagaactgtggcagctgatgggagctgcagtcggtcgtcattctcaggactgtggcagctgatggggggctgcagtcggtcatcatgtccttaacttccccgcccaatgggggtttcacagtagacagttcacaggacgtggctcagagtattatctccagcccttgtttaatgactgcattattgttgtttggtatcctttgactgttttcctttgtttctgctgttctcacttctttgattaaaattactctttgactaaaggtttttaacagacaaaaggtaggcagaggacgtggagggtggggggtggtcaggcaccacagggtccgggcccatttcagcaccgcatgtgcccctgctcagaagatgctgaacacagttaacacgtcaggctgagttcacacgagaaggaaaaaagaacaccttactattcttttccaactcacttcctatggtggaatattaaggtctccaatagaagacatgattgagaaaaacacgttttttaaaaaaaaattgtagtggtccttggtcctgaaagcacatgtcgagcaattttatgccattttggacagacatttacaaaaggctgggctcttaataaaaatccaactgctgccctgtatgtctgagaagagaacggtacctggcatttcttttcatactttaaaaaattgaatctatatcactatttgtgccctacccagttgtttgaaggaagatgtttctctgtgtttttttccaaattgaagtttttccactggtgaaacatgctcatgcatacacccttctgaaatttttttttttttttttgcttatactcaatctgtatttgccatgacaactatccttggcttttgaagaatggcattgagcctgttactgttgaagttcattgtagatgttatattattttgtgtacgaatatttttgtttttcttccattttttcctactatatagacatatgtctgtcctcaaaagaaaatgtcaagaacaatgtcatcttccaggtgattattattacagagtactat

SEQ ID NO: 57145 - DNA, 1195 bp, Bovine  19866880830299
tggagctactaagtgctggactcaggtttagaatcccagtcctgactgcccagctctgcttcgccctcccgaactggagctgtgacagggggcttctctgtgggacaaccaacagggtctaagtccttcaaagatgcacccagggagcctgtggttttaggtgaggggggaaatagaaccattctcattttcccctgacaataaatccttcagtcatacaaactccaaatataaatgcttgggaactcagtggaactgtgtttttttgtttttttttttaagggcggtgggggatggaatttcaaaccaagcagcttctggaaagagtctcgcctccgaagcactgctcgtagctctggaggtcccgccatattggaacaggtcctaattggcggaaagaaagagcaagactcgcagtgaacataataacagggcgagatggaaggaaaaggactcctttctcttttccttctaatcaagggccctggtaaaagacacgcagacacatagcaagagccttccaaggttgaatcacatttgttttcaaacctgctgtcctttaaaatggaggttcagaaaaataagcacccgacaatcaagaaaaaccctctcatcctgggccaggttctgagccgaacaaaggcaggatattttctagaagcttattaaatgtttgacccacgtgaaacagtcctgtatttgttataaaatgcttctcaggctcccacagctccaatgatatggatgggtttaagcagagtgacatgggagagaatgttcatgactgctgctcacgttgactaatgggagatacagggtgggactgcctgaaccatcatttttcttattacaggcacccacatctatggctttgatctccactgcagacagcgttctgctccatctcagaagaggttgccggtgtgtgccccattagctggcctttggaataaactcacaacagaccttccggctagaattccaccactgaccattcgcaaagaggtaagttgtaagtgctttgcatcacttccaaatatttctttcaacagagaacagttgttttttgcttttaatctattagctaatattaccatctgctttggtcctaataaggtttagagtttgccccttaatcatgaagtgttttgccaaagtccccttttttcttccagtcattgaaggaattgcaatt

SEQ ID NO: 57146 - DNA, 1688 bp, Bovine  19866880840262
aaagggaaaaagtggaagaaatggcagattttattttttgggggctccaaaaacaccagggacagtgacggcagccatgaagttaaaagaaacttgcttcttggaaggagagctatgacaaactagagagtgtattaaaaagcagagacatgactatgacatttacacagtcaaagctatggttttcccagtggtcatatatggatgccagagttggactataaagaaagctgagtgtctaagaattgatgcttttgaactgtggtgctggaggagactcttgagagtcccttggatggcaagatcaaacctgtcaatcctaaagaaattaacctgaatattcactggaaggactgatgccgaagctgaagctccaatagtttggtctcctgaggcaaagaactgactcactggaaaaggccctgatgctgggaaagactgagggcaggaggagaagggggtggtagaggaagagatgattagatagcatcactgatacaatggaggtgaatttaagcagactccgggagatagtggctaacagaggaggctggcgtgctgcagtccacggggttacaaagacttggacatgacttagtgactgagcagcaactacaactgtttgaggtgcccatgaaccaactgtcaccaatgcaaacttttaaccatagaccttctattacagtgcttcttaaatatggcagtttaagaaagttggttacattatgataatcctgttgagtatagtaactctaccacaaaaacgtttcagaacaacataactgcccgtcattcaaagaattgtagaatttcattcctcatgaatataaaggcctgggaaaaagttcatttactgtcatttcagtattttgagttttcattaacattttgttcctaaagatgagtggtaatctagcaaatgtagttagatgagatgctaacacttgtcacataaaatctcctaaaaaaagttcaagttctaacaccttgtgtcctgaattctccattctgtttttaaaagtagcagtgattgtttcttgagcataggctcagatgtgtttaatatatcttaagacaatatatttctaaacgcaagatatataataacaaaaatttaaaatgcccacaaagaggatattaccacacaacagcttatttttcgatttggcaattttctgctaaactcatagcagctggagagagtagcaagtaacaaaataagacagatgtatggagcccacacatggcaatatttttgtataaaattagtcaaaatcattatacttgtagatgaagaaatggagtccaacaagtttgcattctttaaagagcagtcatatttggtcttagtgaactggaagatctgagcaatgtattggattagttgatcaccagccttgtaactcacaataaaacctgcagaagcatgccaagcatcggcgcttggaaaattaggataataatacatcgattttcaataaggagaattcaacccacattgaggtctatcttcctatccaaggaactgagggggaaataagccattaggagaattttccactggaatttctttgtcttgctcttatttatgcctaaaattttctgatagcgaagggcgaggcaggcatacatgggcatcattttcagaaaatcgaatgcacaatatttcactttttataatgtaatta

SEQ ID NO: 57147 - DNA, 1169 bp, Bovine  19866880906378
cctgtgataaaccttaatggggaaaatatattaaaaaaaaaaatatatatatatatacacatataggaatcactttgctgtatagcagaaattaatataacattgcaaatcaactatacttaataaaaagttgtttttttttttttaatgtaggaagtaaaaatgaagagcacagcatacccttaaactgtgaagtctcaaaattgtcaccaatgatgctaggtgaaacagttccaagagtgaaggagaaaatgaggatttgatcagaaagagaagcaaaatgaagatgctgcaatcgaggcatgatgggagaaaaatacgcccccagagaggcaggacatatctgtgggccgccgagaaggataaagggaggatgttggcacgaattaagtttttaaaaaagctcacaaaagacatagctgatatttttatttccataatggaaaattatggcagatattaaaagcccaatggaaaactaaaaatcttacaagttaataaacagaacttactctaggttttgagctgccattagacaatggaaatagaattaaaaagaaataaatctgggggaaaagaatcccaatcatagcggagatagtcctataacacttagctggagtccaaatggcgcaaaatctcaatattggaaacatcagggcatggaaagaacgttgtcggaaactatgtatagcacaagctgaaatgaaggactatttgttaggactgtggtacgtttaagtgaccatatcatcaaatggtaaattgataactgtgagtttagacagagcttgtggaaaaataaatgagggaacaaggagatcactgagactttccaaacctttttgtcattttttttctttaaaaaaaaaaaaaaaaaaaaggcagtacctttgtgtagtataccttccataagcaaaaacatctactaagattaccagggattaggctggtgtataattatgagctagtttgtatataattaagagaactggtttaccagctgtgtagtcccaataagcacaggtttcaggatactgaaagtcttatgtaaattctcttccttgaggctattttctgcttatttactcttaaaccaaaaatcttccatcaaatgttagaggggagaggctacatgtagacggtggtcaactctcttcagaagaaga

SEQ ID NO: 57148 - DNA, 1838 bp, Bovine  19866880922177
ccaaggtctcctgggagggaaaacgtgttctagtgaatttgtgggatccaaaggcaatgagatcacagcgtgcataatgctgatataaaacgaccatctgtaaagtcagaataaactaatcaacacccacgctcatctctttgactcattttcctttcgttttgtgtatgaattttcctttgttcttgttctgctgcatgttcattttcctgtttgcttgtttttcctttgaacccaaaatttgtttcaaaaaattccaaggcactggagtcagcaccttctgatcatatcttatctgccactaaccatgtgtcagggccaatctggatgccttcaacaagcctgatgccttactcatcaggaacactttttcctgctgtggctctgataagccatcaacaccaccgtttatcatagactgcttgaggtcacttgcatacagatttctctacattcagtaactgaaaagggggccatttgactcagagacactgagaccagaccaaggcctagaattaagtgcaaacctgtggagtcatgcggtcacagctaaagacctgctccccatcactccaaacctgccacatctattttcggatttcttggttttcttttctgccaaaggactaagacaacaaaggcagaatagaacgggggtcaggtggagccttttctctgaacaatcctcaagcgaaaattataaacaaagttattaaagcttttctatctactaaagaagcagcaatgtgacattccatttcagtccacctctaatcttcagtccctttatcccaaatactgaaatttcattagagatgaccaattccaaaatcccagattcttcaattagtgtgcactttaaattattaaataggaaacttgaatatagactcttttctcattcaattttctcagcttatgtactccctttcatggtgcataatttaaatttataaattctatggaaaagctaatattctactgagataaagactcatctaatttttgcagccaaggacatcacagcaagcacctacattctgtagaagagaagtgaaactttcacaacagtctctagaagcagcacaggggaaaaccagcctcatggaacgaactccacctgctccagaaagagtacaaaccactggagtttggtagcagggatcaagaggaaatgaggtcaagtccaaggtactacagtggaaaatgatagaggaattctgaaaattccctggttgtatcagaagaggacttatatggccctctttctagggtggaaaccaagtgcccaggttcccagggtctccatctgaatacaacactctgacctgttcccatccccactgcacgcccttccctacccatttctaggcttctaacccagccaggtttcttcgaagaatgaaagtcattcaggaaaagtgagaaaacctaaatctctattctctcctgttgttgttgcttagtcactcagtcgtgtccgactctttgcgacaccatggactgtagcccaccaggctcccctgtccatgggattctccaggcaggaatactggagtgggtgccattgccttctccaggggatcttcccgacccagggatcgaacccatgtctcctgcattggcaggaggattctataccactgagccaccagggaagcccattctctgacatccccaaactaaatcctggcttccttctctcccccagaacactgtcaccacaggcaatgctcagacttcacctggtctcactcctggctcctgagtggccacttgctactgtccaaatcgcccccaggtcaggcagtgaggtccagacccaggatccccagcgg

SEQ ID NO: 57149 - DNA, 770 bp, Bovine  19866880933438
taacctctcctagcttcctctccttcacagtgactcaggccattctcctattgcccaactcttgttgcgacttgggaggttgttgggattggtttgtttttaatatcttgcccaatctttccatttttagttccagactgttgcttttaaccactttcaactatcccattctttaccgaatgacacagtcctggatacaatctcctcagagacttctgtcactctggttctggggtggctgcatcatacccatggattgtacaaaaatggccagtgggaggttgttaggcagtttctacttattctcttaggggtccagcacgaggggaaccgcccccaccccccgccagtgattgctgcattgctctcacaatggtctggcatgtgcactggcatctgaggaatgggggtcagtcaagagagccaagatcatccagttagtactcgatggtgtagtagcttgcacccaagcctgactgattccaaacccattttctaaaaaaaaaaatttctttctctttcttttttatttttttaaattatgagggtatgataacacatttacaggaaacatggaaaacacagagcaaaattacatatagtttttattatatattacaattatttttaagtattttggattttagaattatttttaagatttttagttggagtttcaatatcaaactctcaaaaattaatagaatgaatatacagaaaagtggaagtatgatataatagacctgaaaactccatgaaccaattcagta

SEQ ID NO: 57150 - DNA, 1684 bp, Bovine  19866880999546
tagctgttgcagtgttttgtttgtgaggggccaatttgaacacctgggaaattgaattggaaagactctcaaggaaaacagaagcaaatcgttaaccctttccatcttataggaacaaatagtaacctgagattggtgacctagaactattttaaggaacagggactgttttttgaggacacagctgatgccatctttccagagtagaatactggccttgcagaagtgatgggcaaattgctaaaaatggattttcaccacttgctgccatttcaaacgagatgatacgtttccaaagagtcttccatggaaagaaaaaggacgttagtgaaaataagaatttccatgtgtttatgaacaaaaaacatgtttttttgcaaggaggactggtaaacccccccctcctcaccaaaacaataaaatcaaaaaacaacaatttttcaaaagatgaaaggtaaaatggggggaaagaaaaagaagaagaaagaaaacagcagaagtgtgagccccattgaaagtcaggcttagccctgcctggaagatctaaataaagtcaggcttttttcagatgcatttagggttttgtgtttgtctgtttttttgtgtgttctttctgttttatatctgttgcttacaacaaaatgaacgtcaagaaactttaaaaacagttgatagtttttaacccaagtagagtatgctactgaggcattttaaaatctaaaggtgttttgtaagaacccgaggttttgacttcggtgtgccttggaatatggattcaaatctctccacctctgtcttcctttttgttcacttatcacagtgaccagtgggaagagcatttaattacatatcagtagaaagtcatggggcttccctggtggcttagacagtaaagaatctgcctgcagttcgggaaacctgggtttgatccctgggttgagaagatcccctggaggagggcatggcagcccactccagcattcttgcctggagaatcccacagacagaggagcctggcgggatacagtccacagggttgcaaagagtcagacgtgacagagtgactgggcacaggaagttgtgagttataattccactgtatattacttggtcacagtttaatgacccagctgcatctgttaagtgtctgcatcccttcaggagaggaagtcttcctgtggattccttatcttgcctcatctgaaacctgctgggtgggattagctggtgtccagggtccctccagttttaatttctgacctaagacttcatcttggagagaggaacaaactcacaaacaggactttatcttcacttctttacactgcatcgattcagttctaattcccaaactgtgtgcctgtcttgagatttcaggtgccccagagataggccttggagaggggacacagctaaataggtcaagggaatacggaaggaatcggatgaccaaggtttgaattcttatctgtgctactctgagctctgtgaccttggtcagttaccacatgtctctgagtctctgttttctcatcataagatcctgccggggaccagccccggctgatccagggtattcgaagcggggacggcgtcggcgacctatttatttaaatattttatcaaagatataaagagtaataggatgaggaagctcagtaggaaaattcagggagaaaagagg

SEQ ID NO: 57151 - DNA, 1343 bp, Bovine  19866881008081
tagccatggttgcctggattgtagtcaccccttggtcaagaccaggccaatcagatactctccttgaaaaatctggatatgtatatattatattgggcttacctgagaggtcagacagtaaagaatccacctgcagtgcaagagacacaggttggatccctgggttggaaagatcccttgaagaaggaaatggcaacctattccagtattcttgactggagaattccatggacagaggagattggtgggctatcaaattgataataacctgcctagaaaagagtccttgctttttaaacttggccacaagtattttttcccagaatggaaattataataattagctttgtttcatatgtctattaagtaaaaagtggtgtacccatttcaatttttaaaatctaccttatagtcacttggtagcttatgttagcccgtattaattacttccatggttaaccttatctatgccaaaagtaatggctaaaatgagtttttggacagcatctatcccttttaaaacaattttaaagtaaagatactgaatgatcagtgaattaaaatagtttgagcctgtagctgagaaaagaatgatgaaaaagcaaatcgtgcataggaagggatggtaacagtaataaattagtgtaaacagatatagaaaaatgtagttgatgccaaaaatacagatgggagtgaaaccattattttcaatggtctagagccaaaataccatataaaacagacttcccagattggcagatttatgagagaatcataaaaactagtgatcataaagttgttagagggaaaaaaaatctaaacaccgtctactttgattagattcagggttgaactgaactaaatctcagaggaaaagaggcatttcgcggtctagtaaatgtctccgtattattcacaggctgtaccagcctttctgagaaagacagccagaggagatgtcaatgtatcagctacttccttaacatgggagtaactaagagctgatacttaccgagtgtgaatttcaggccaggctctcttgtgtcagttctcggtgtgtatccccaccttgcactggacccctatcatccctggcttaaatcacttagctttcaacatgttccctgcttctggtctattatcaacaaaacaaccagaggaattattgaaaaccataaatcgtgcctttctagaacctcgtgattgttttgtgcttcgcttggagtgaaatgaaagtcctctcccaggaaaggggagcagaatacatgagtccaaaatgccccacttgggcaggtggattgttctgacctgaaggcaagctagacccagcagacttagaagaa

SEQ ID NO: 57152 - DNA, 1968 bp, Bovine  19866881011548
aattgtgccttttgcagagatgtggatggacctagaggctatcatacagagtagagtaagtcaaaaagaaaaaatatatattgtgtatattaacacatatgtggactctagaaaaatggtatggatgaacccatttgcaaagtacaaatagagacacagatatagagaacaaatgtatggacagcaagtggggaaggggagtgtggaatgaactgggaggttgggaatgacatatatacactagtttgtgtaagatagatagctgagaacctactgcatagcagagagaacttgactcagtgctctgtggtgacctaaatgggaaggaaatccaaagaagaggggatatatctatatgttatagataattcattttgctatacagcagaaactaacacaatattgtaaagcaaatgtactccaataaaaatttacttaaagaaaattcccttagtatgctaaagggcaagtttgaaaattttcaaaaagtatcagaagttatattctgaaaggtgattagaaaatgttctacattttacatttctctagtgagtgtatgtgtgtgtgtgtgtgtacatgaacaaagaaaatgatgtatttgggtagagtgagtgagtgatagtcactcggccatgtccaactgcttgtaaccccatacagtgtggcctgccaggctcctctgtccatgggattctccaggcaagaatactggagggggttgccatttctttctccaggggatcttcctgactcagggatcgaacccacctctcctgagggtcctgcacgcgcaggcgggctcttgatcactgagccgcctgggtctcccgcttgttcggtctagatgcgcgcgggtagtgacagggctcacaacttttcatcctgtgcaggcgctttccacacgtcgccttgtttaaccttggtgacagcctcgggaggaggttctgcaaagtgaccccactccacagaagacgtggaggcacagcacgtgcttcacgtcccgtgtctcctgagtgggagagcacgcctggagactcagtctgccctctcctgataaaggctgaggctggggccttatttttcgcatttctgattgaggcaccacttttcttgccaaagcccgtggctccccgtcccacagtctcctgtgagctgcttacacctgggatccagtttattcacatctccattcgcagggtgctcagttctgcaccttactcatggaaggcattcactaaaagcttattgaagtggatttcttatatttaaaaaaaaaaaaaaaatcctgtcctctaagcttgaacccagcagactctgaaagtgagttggaaaggagaagagctaaaaatcccttctcgttgaagtgctgacccaaactaccagtggacagtctccagggtctctggctgccccgggctccagggctgaggcctgactgaggaaacacggccccgtccagggaccatcctttgcccacactgggaaaatgataagatggggtggaatgcactttgccctgcgactcaacagacctggcatccagcctgccagacacttactccgtgacctccttggagtttctgaacccctcggggctccagcttcctcacctgtaaaatgcgggggaaggaccctggccaaactcggaggaccccaccagctctcacatcctgtgattttaggtgtagttatgcggttcctggaagctgggctcatccacacagccttttggaaaaaaggaaaggaaaaaggaaaagaaaaacacttccataaaagtatttatagcacagccagtgactatgaatcatggcataattaattctctcttatgcagttgcctggctctctgtcttggtggggtcattcccaagcctgccccagcagcagcttcattgacagacatggcattttccttgtcatctctcaggaataagttcagagcacccagactagtttctgccagttcca

SEQ ID NO: 57153 - DNA, 1370 bp, Bovine  19866881023001
tccagcctcatggcaaggagagcctgccacgggcactcttggcatacaggatgattcaagaaattgcggccgaatgcatcaaagactttcaaagaaatgcaagaaattctgtgttgctgaagtttaaaatatcaggagagacaggcggggagactggagttgtttacagtggcttccttgtaaaaaagctagcatatacagttccttaaaggggatgtgagttcaaaacaagctggagatgtatagggaacacagagcggtgcctccatttctgagcttccttgtggagcttgtatagatctgaggtcagccaagtggttgtcactctggaattttttaggtaaccgagaggaactcattggtgaacttcaggtacaattattgtcgtctcttttatcactcaatcaaactccccatttggcagaaagtttcaacttgcccctttatagctgtcctattgcaaagattagatcagaggtccccagcctgcaggaactatgcctgatgagctggcgtggagctgaggaaataattacatgaagccagtccctggggccaaggaggctggggactgctgggttagagggcggtgtttatagatagatgtctgcatacgtgtttctttctctctcatcctttcctcggggtgtttttgaaaccccaaattgtctaaggaccctgaagctttctcttaaagagatcattcccaattccgaataccgaatcaaggccaaaaaagagatctctttccaaagtgatctctgtaaagtcacccctctctgctgttcgacacagggtggccccttgcaagaccagcagggatactcacacagtgctgaaaaatgggggatctttaagttcccacattcatctcatccttgttattcctgagcactgtgccagccaaagtggaggggctcagagaagcttcgagtctcagctctaagctgtgcccagaccagtgctttcaaacccagccacgtgctgaactgagactagccatcatcagaagtaaacaagacccttcaacagattcaagggtagtcattttccttgctaggcttatataagaaactgtataaacactgcactttcttatgtgaaatgaattgtgaactgactgcgaagttgtgtctttgaaacttgaataagcagccgtgatgtaaattcacattatctcccccagacacctgacaataattacctcagtgataaatttgaccagagaaaattgttctcttatctagaatgtaagcaacggataaagaatgcatttaaatagaagatttattcttaggcattctggtgctttgaccacggaagtgcccatgtcacatgacaaatccgtgtcttcaaaacagagaagccag

SEQ ID NO: 57154 - DNA, 1709 bp, Bovine  19866881070651
ttcctctcattcattcctgtttctcctcggactccctgaatccagatgatttctccccgagaggaagcacgtcaggacgacgttcaggctcatgcttaatgactaaggccttctgagacacctcgctggaaagctgccctatggtttgctaactgaacgagcagggtggcagagaaaaggcctttactgttctttttagatggcctcacacatttaccctcagctcttggtaaagaagaatcgattcatctcacaacctccgctgttgccatggcacccacctggctgtagctggagagaagcacccactgttcttgttcagtctctaagtcacgtcatactttgcaaccccatggaccacaatacaccaggctcccctgtccccgactatctcccagactttgctcaaattcacatccactgaggcggtgatgccatccaatcatctcaccctccgccaccccttctctttctgccttcaataattataaaagcttacacatatcaaccatacaggaactatttgttaataaatgatctgtcctaatacttacaaatgcaaagcataactccatcctggtaaatcaagtctgggaagacatagccgttggcttgaatttttgaggaaggttttgcggagcttgcacaggtcttaaaggaccatacagattgcgaacagtgcagcaaaggtaataggaagtcttggaaagtggcaggcaagaagagattaaaatagggaaattcataggaattctaggaaagctctgttctgtttaagaagatattaagctagaattggcttatgtcataacctgttcatgataagaggaaatctttttaaaattcaatcctctaagcataggccttgcagatgtggaaaaaatgtcacaggaagctatgttcaattccctcttggctaaactttcatacttgtggccaatattaaaaaaagaaaaagaataaagaaatcttgtttccttatgacttagggtaaaagatttatcccagtgttttctcttccaataaatggtgacccaggagtataaacaggtacctcctggtataatatattctgcaggactttgaagcctgcatagagtgaaaaaggaagtgtgtggcatagtgattaatgtttgtaccaatctaaattttatgacaccacctgagttactgttaaaatgacaacagaactctacgtatataaacatctttccctcagtcttctggaagagaaatttgtcccagttaaatcaacttaactttgtggtctattaagacatagcatctttgaattagatgttatcattaataactaagcaactgaattcaaagtcttatcacttttgaagtagaataaagaaacaaggagctatattagttttcaccatgtagtatcatctacaaacagtggaaaataggttatggacttgaatttaaattaactctttttatttgcaagttactagtcaagagagaccaatatcagagaagccaggacttaaaacaagggaaatcactcttctggaaaatttaacacctggaaaatagattccactaaataaaagatgttttacagtagaaataaaagcctacccaacattatggtgattgcagttagagacaaggattatatgttgtctttctataaactctgagagcaggaaatttcagggtgtatggattgagaagaaaaagatagctttaatgtg

SEQ ID NO: 57155 - DNA, 720 bp, Bovine  19866881239644
tgcttctgctttaggctttggcttttagccgcaaggcatgtggaacctcagttccctgaccgagatggaacctgcaccccctgccttggaaggcgaagttgtaaccactggactgccagggaagtccccaggccccaccaccttgcttgtgagccctgctaggagcctgggggcatggaaaacaacgaggaacttgtccgaagggatacaaacctcaggttcaatcatttacaagagcaactataccttctttgagcagagcaaaaagtatccaattaagagacgtttagtaggacattttaccgggtttcctgaaaccatccagtctcctttttgcctgtgaatcagtacatgtttaaacagtaattagtacaagtggcttcacagtttacctttgggtagccttctttatgtaacaaaagcccaactgaacaaactgacggcggttacacagatcattcttcttctcagaaggaaatgtctaaaattcttcttctaaccccagagaaagagatcttaaatttgatacgatttaaatagcagattttgtgaagtgattcatgcttttctagtgaagaaaagtaaacttctcctcgataacttcagcatgtcttctttagagaaaggcgcttgtttcttgttttcttctcctgtgtctttctgtacaaaagccagtgcgttcctttttaaccatcaagagctgactttcggaatgtaagt

SEQ ID NO: 57156 - DNA, 2593 bp, Bovine  19866881281833
gacgtggtttgctagaatgtttgcacatttttggatgttgaccttagccttgctatttggaatattttacacgtcagtttaatcatactttgtcctactctttttcctgcaagtctatcatttctaatatgtggcaaatatttacttgtatcaagagtgaattcattttccctctgtatctaccttaaggtctgttgagtcgatgatgtattcgtttataagcactgtgtgcaaagtcttgcactgcttccagttgcctcattcaggcaaggtatctcattgaaagaaatttcacatccaatttttggagaaaaatatctcctggttccttggaatcttcttaatcaacccttcagcgccatgaagaatctagctttacctttttttaaagttggtttgcaatgatttatgataactcaaagagagaccattttacaagtgaaatattaaatattattcagcatttgcccaaaatcgatgctaccatgagaccctaacataaaagaccatgcagccaaagtggatgaaaaatacttgtaaaatatccagcatgatacaaataggaaatatcccaaatatcccacaacagcaaaagtctcaaatttactttgaaatgtcattctcagtttgaaatcgaataagcaaaattgagagctttacttgaaaggtgatatttatttttcttttctttttttgaccgtgtggcttgcagaatcttagctccctgattagggatcaagcctgtgcccttagcagtgaaagtgtggagttctaacccctggtctgccagggaattctcaacactcttgagattgcagtgtgatttctttcagttaccttgattcaaacaatgataattggatacatgtccaagaagtaagttggatttctgtagatcatctggttttaactttgatataaacttccaaatttgataattaaattaatacagcagaaacttcacttgttaggaactgtatctaaatcagctgtgctctgtttgacagaaaattgagcattttactgttcaaaagcaaagcctaagggcttaaaggttaagctcccaggcagcctgagatatcagttctacaagatagctaagtcaacgttccaagctccaatccacaaagccccaaggtcccacaaagccactttaaaggtcctttattgaacaagtgttcaatcctgctttcagaatatggcaagaactgcagcttgtgagagagtggaaactctggtgtgcttatccatcagcactgttctctgctcttccagattcattcttggccttgttttccacccaaggagcttaactataggaactgcaaagcccagggtctctccttttggctccaggctctgctgacttagtcagagtcgccagccgaagacggtcctgcagccgtctgccactttcttgctgggccgtcactccttaaccgtggcttttgcagggcaaccctcttcaacatccaaatctctctgagttctacatcagagccttctcctccaccctctccaggcttagagggtttatggtgagctccctactgttatgagcccctgggcactgggccattgctttatgattctgttaatcctgcccttacatcagcaaaacccccttctgtttgaactctcttcaactaaccccttgaattaattcaacattttacctactccctgccagaactctgcctgacaccattggtttggtcttccccattgccaccaccatataaactgttcactctactcaggaccattccagagttttcagggacttccctggtggtctgtgcataccctgaagagggtgtaggttcgacccctggtctgcaaattaagatcctgcatgccacatggtgcggccaaatttttttttttttaatttaaaaaaaagagttttcaacctgagcattttaaaagatctaacaagaatgatccatttgttgggtgaaaacaggatattttaaggggtgccctacgatactctaggggtttccctaatgacttcgatggtaaagaattgcctgcaatgtgggaaacccagttttgatccctaggtcaggaagatatcctggagaagggaatggctacccactccaataagcttgccttgagaattatgtggatggaggagcctggaaggctacagtccatgggatcacaagagtgggacatgactcagcgactaaccctttacaatactctaacgtaacttttaaaattcattttttcctttcaatttttagttattgtctattttttcctcccactaattcatttattctctcccttttcggattttcctcctgtgaactccgtcagatggtggtttccggaatcaggaccgcgttgcccttgaactgttcacccgtgacaactctcctggggcagaagcacctggaagatgcctcccagccccggggagtaacactgtcccccactgtgctccctgcctttcatgctcccttctcttctcgggaaacaatgtttctcattcaattttataagtcaacagattagaaaggagtcggacaaaagcagaactgtatgatcgtgcggttctaactaagcttctacgataagc

SEQ ID NO: 57157 - DNA, 1400 bp, Bovine  19866881310245
acatagagaacaaacgtgtggatacaaagggaaaagggggctgggatgaactggaagatgggggtgatatatatacactattgacactatgaagaaaataacaagaaccaactgtatagcacagggaactctactccgtactctgtggtgacctaaatgggaaggaaatccacaggaggggatatatacatatagctgatttactgccctcaatctttcccagcatcagggtcttttcaaatgagttagctcttcacatcaggtggccaaagtattggagtttcagcttccgcatcagtctttccaatgaatattcaggactgatatttaggatggactggttggacctccttgcaatccaagggactctcaagagtcttctacaacaccacaattcaaaagcaacaattcttcagcactcagctttctttagagtccaactctcacatccatacatgactactggaaaaaccatagttttgactagactgacctttttggcaaaccaatgtctctgcttttcaatatgctgtctaggttggtcatagcttttcttccaaggagtaagcattttttaatttcatggatgcagtcaccatctgcagtaattttggagcccaagaaaataaagtctgtcactgtttccattttttccccatctatttcccatgaagtgttgggactggatgccatgaccttagttttctgaatgttgagttttaagccaactttttcactctcttctttcactttcatcaagaggctctttagttcttcttcactttcttctaagtactggtactcagtagctggtacttagctccataaatgtgaaccatgttcatgaatattgagaagagtccatcatataatattccctttcttataattgcaataaatctagggaaaactaaatgtaggagtgggtacacgcttttaattctcactcctttgtaaggacctggagttacatgtttcaaaagagaggcttatcaagtgattttcttgggtacttcctccccaggacacagcagaagcagaaccaggtccttgttttaattaaggcttagtcatgcaacgagtcggactttccaagaaaataatgtctctatatccttaatgtctaattaaatacaaaaagaaatgcaagacgttagccaagcgtttgattgtagacatgaagagtttccaactcactcaagggactggcatttcactcctgcacatttatcaacaggaaaaggtagtgggattaggaatatttttaaaaaaagaaattgctgaaaaaggaaaacagtccaagtagtgagctttttaagatatgtttctactttgctacatttattttgctttgctaaaccacttagctagtcttcagttgaaggatatagtcttataag

SEQ ID NO: 57158 - DNA, 1263 bp, Bovine  19866881392044
gtggcccattgtgaggacggagactctgcctacagccaagatgtcctgggaggcacgtccaagctctccccgtctatccgtctgcttctggccgcttcatccatcagccttcagagctgccttgattagccacatgtctttggtcagcatttctgtctttggtcagctcttcaactgcattttggggagacagccacatactttcaggatatggcccatggctgagcaaacacatcctgaaatgttgaaggtaaaataccccatggcttgtgacaacctagagggtgagatggggctggaggtgggaggcgggctccggaaggagggtcatgtgcgcacctacggccgattcacgctgagatatggctgaaaccaacacaatactgcaaagcaattatcctccaattaaaaatacatttaaattaaaaaaaaaaaaaacaactatttccacaaatgttgcccacaggatacggggttctttgtaggtttgtctgatgtgtcttggatggacatcttacaaacaggaagctattcaaggttgtcagtttctactccctcatctgatccttggaggcatgagaatgcaacagtctcatcagaggcccacaggactgcaaattaagaagccgattcagagatagggctattctcttcatccatgcttccttctaacccagttccttcaagggaactgcacccgttgtgggagtcataaatcaagagctgctgtgagacactctgctctttcctgctgccaaaagggaaaagagaggtttttctttgaaatggcatttacttggcatcgctcggagtttcggtagtgccaacgactgttataaacaagcccttttaaaaaataccttccacagtatactaattggtgaatgaagtttcaattaatacaagctacaagtgagcaaatgtgaatctgtggaaaaattatttctgcataatgtaacaatgtcagggatacaagttaaaagctgtgagaattctattccagaaaccatcaggtcttctactgtggtttattatcctgatcattcatttcaacttgtccagagaaaagtgttcagattctgcttaaatgtgtacagtttattcatctatccttcaatttccccaccacgtaaatgatgcatttcctaaaaggcagtttcttttaagctaaatgttagatcatagccaaactgattaatttagtgtttaccatttctcagcctacccatgtgctaagatgtttacaaaggtcctgttgtcaaa

SEQ ID NO: 57159 - DNA, 791 bp, Bovine  19866881410267
gtgatccattttaaatatagccgtgtgcacacgtccgtcccaaagtcccccactgtgccttcctccaaccttcgcacccccacatgaggccttctcttgaagggacatcatagtgggtggtatcaatgacactgcttttcactaatttagaaaatacacattcctaccctaggctttcttatgttgcaaataaataggacagaaatcattatcctagttgttgcagaagaaaggagtgttggagcgttgaaaatacatgtttcagttcgcaggtctgtttgttgaatggatgggtagtagaacccaggggtccacactcctgagtctcagataccgtcccctgaccagaacagagggatcctctggggaagcttttgaaggccgccagcgtccccagacgaggctcgccgtgagcatcccctggatgaggcttgccctgagctctggggcctggtctcctggaggcagcgagtcccccccacagcccggggtcccccgagcctgtgtgccatcttctttgttcacatggtggcacgtctccacgatgccacagtaactaatcagttcaagatattctctgaagaagtaaaaccagtagtttttagtgtcatggaaacaaaacagctggttgataggacttttatccattttcagttagtgcttttagagctatgaagaacttgcctgtcttgtttcattttatgaggtcttttccttccctctcctgttccctctcctcacccacgtctccctctgcccctctcttctccttcctttttattaagagacat

SEQ ID NO: 57160 - DNA, 695 bp, Bovine  19866881669390
tttctgatcagtgggcagcatgaacaaacacagactgaatgactttgaataaggacaaaaacagagccaggcttacctgtgtcctttctcccgaggatctaggagctaggaactcacagctgggcaagagtgaaaatgttctttagttaataatacaggcaagaaaagctccagaccccaagaacctgggttaaccattgacactggcttgttcctacagttgcaccctgggaacacgcataggtagcccgtggcatcttaggaagccggcgccaaccggtcagctgagaccacggctggggccccgcccctgcacccctggaggaggtccggggagaaggtcacccaggcgtcccctgactcactgttcacttgcttgggaacacaaaggaggaagatttcctgggccagaaatatgttcagcagtgcccgtaagtgactcaaatatttacagacagggctattggaggctcagttttcagactttgagcaatgcaaagaagctctttttgtcagagttctttgcatacatctgagcaggtcagagttgaaaggggatgccgatgaaaatggagacgagacaacctgcaatggctaagcagccactcgtccctttactcagcgtgccttcggtggtcatctaccctgtgcagcacaattccaagtgggcttcccgggggctcaggggaaagaat

SEQ ID NO: 57161 - DNA, 821 bp, Bovine  19866881892452
aaatccttgacaaacacacgggtaggttttggggtagttcatcaacattgcagtgcattggatcttagcaaggaattacggctgtgacataaatttgacctctgtctgaagtttgttttgagctgggaaatcattccatgacaaatgggttcacaaagatgacaccgcagggaagtataaattactggcaattgggacagaatttgagcttccaaataaagtttcaaattagccaaaacaaaaaaaaaaattaaaagtggggaagaggacccatggcctctgtcccagatatgacatttatgatttcaaggtgacgttctgtgtttggggtgctgggttcggaagtcatggtctgttggtaaaatattgtcagaagtcccaaggagaggctcatcctaaagatgagttctttgggaagggaaagttttaatttgttttgtagattctgaatccgtgaaaccaaggtggggaatctgggctgttgttccccacatcggaattcccctccccgatctgagttcagtgtttctctaggattggttccacagtggggtaaacatcgggacagaggggctgcttcaaagcaaatgaggcccttaatttatcataaaaaagaagactggttgttaaggttttattggattacaataaaggctcctagcactaggagcctgtggttttattcccggcatcactcagggaggttgaaatcataaccacagattatagcagtgaacttccaaatttccataccctaagcagagacgctgccttcctggagctaacgtggaattacatgctctgcgattttaggggatgta

SEQ ID NO: 57162 - DNA, 1215 bp, Bovine  19866880590953
ttctttagcataacaggccttatataattctataaattttatattaaatatatttaaatttatataatattttatatttaattctatatttataaagataaatttccctgtgaagaacaataagcagatgggggagaaagtaaaggggtagaatttaccaatttgaatattttcagcacggaaactgcctaagtttttctatgaaactgcatggaacatgaccacagtactaaatctgtacaaatctaataatcactgagctctcgggctcctggtttattttttcttcaaagtaagatttgagttactttatgcagagtcagcgaagtgtgtgtttcataacgtctcttcctttttgaacttttcaaagtctaaagtcgggggaaacaagcctgctggtggtgatttcggagaagtcttgaattcgactgcaagcgccagtgccaccaccacggagcctcttccagagcagacgcaggagggcctgtgagcctcccacctttgttctgctgctcactgccagatgctgcaagcgagatccaagcacatcttgtcaacattcattgccatgaacttccaccagatgtgcttttgttgagctttacatattcctttgaccaaatagcttgtgggttgaacaatgtaaaagtatcttcacttctattcctgggaaacaccctttagtgtgcatttcagcccctttatttagcaaatgtcacgatgaaaacacatctagtacctggggatcctcactagaatgaaatgagaagctgtgggttatcataattgcttacacaattgctctgggtgtgggctaccagtttgatctttttcttctatacaggtttctgtttttcctctttgaatctctgtatatttgattcctagattagactcttctttaaaatgctctgcatcctgcttattaaaaaagttttggcgaaatgttctttacctccgagggaagaactaaacagctacacaaaatatttttgagtatcgtttggggataaagtatcttatatcttgggtgtctgaagacaccagactaagtaaatcttctctatattcagtttcttatagttttgtaagtgacattatgtacagtaatttcaaatcctaggtgacctgagagtggagccctttgtttatcaccatctgtgacagtaaccatttcagtgtcatggttattatgctacttatagctacttattt

SEQ ID NO: 57163 - DNA, 1718 bp, Bovine  19866880591737
cttgtctaataggaaccctcagatgatttattagtggagactgaggacaggctatttttctttcttgtgttagaagcagtagctcttggataattactttcacatctgcatctaatggtttactttagaagcctcatgcgtctttggcattttccctggggaggaagcaagagagaagataagtgagggaaagagagattctctttagtcatccatcattttaattttgctacatttgtggaggaagggcactcaccctactatgtatcttgggctttaggacagagtctatgaaatggcttaaaattcttcctttctcttttctttctctcccttccttccttttacttctttctttccttcttgaatatgagaactgggcttaaaatacaccatgagtgaagcttgaaaagcttttactggtaacattgtagtacatcattatgatatcattaggagtagatttttggccctttgaaaatagaaaaaattctgagtcaagggcctaccatgtggtcaatgggacatttttcttaaattcaaattttattagaaggcaggttttaattcttacttctttgcttggcacttgctaagttctgactttattactaatttattcagtgggtagcaatgcccaagaagtccgtagaatatgatggagaggatgcggagcggtcccacccaggtgctccctttagaactgggagtgttagtagctgctgctttcagcttagtttctctaggagaatggccctcatcaggagaacgccaccttgctcaaaatcatttcctgagggcagcccactttctaggatgggtcaacatagggatagtaaggcagggctctttgcttcaatttgggacattctgaagaagcatccccgctgcagagctcccagaggtggggaatgaggtgtctattatgacaatctcaaggtttgctcttagcctcatcttgcttacttctctaccccaacaagttcactccccggaggactcaccaataagcttccttcctggggaatctgtaacaacgaccaaaacattttgtatgaggaaatcatattactctcttttccttgttccctcttcagaatcaattacctcttaatttccctaatctaaggaactgaaaatatattttattgagataaaattgaaatatattttattgagataaaattaaaatgtattttattgagataaaattaaaatatattttattatcttccccagaaggtaaagaatctatcttcagtgcaagatacccaggttcaatccctgggttgggaagatcccctggagatgggaatggcagcccattccagtattcttgcctggagaatccccatggacagaggagcctggtgggctgcagtccgtggggtctcaaagagtcgggagtgactgaacgacaaaccctttcacttttttcccctaaaggaagaacaactaaaatttatttcatgatagaaactttggagttgcatcacatcaaggactgccttcagaaaacatggattggtaaacagattttatagcacttggtatctttctcaaacttattcaacattttctctgtccctccataatagtcaactattatttataatgatcagttagaagtgaaaaaagtacaagtgtgggataagtctttttttttaattgtcaaaaatatacaggacatgaaatttgcaattttaaccatttttaag

SEQ ID NO: 57164 - DNA, 1972 bp, Bovine  19866880750174
ccttttatttccctcacaatctacccttcctgagttatttaggacagggacatatacaactgttttattcaaaagtaggtccacatattaaaaattccttttatctatagacctcaaaaaaatgaggttttatcttaggttagccatagttataatgacttgttagaaactttaaaaatactaatttttaagtattttaaaaacaattttaagaccagcttaattaactttagatgataaaagcatacaaatagtggtctggtattgcacagagatgagttttgatgaagtcagcgaatacgctggtattcttgagaacggttggataaattcacattgacccataacaactctgactccaggcctagaagtactggtcctctcggctttgttcacagaaattttatgaaagaaactagtgtcacaggaccagatggatacaaacattgcctggaattggtcatttagccagaaatttggggataattctggcattttgagactcatcttcaaaatcccagaaatgtcacgccttcactttgagtagaatcagttcttgaacccaagccatcctgaggtagctgcaaagcacagtttatgctgttgaaaatgtatggctctcttgaaattgtgaccttacctttacccatcttccaagtgtattgcttccttaggtgcagcctggcctggccaggggagtcagtgtaatttctgtcatcatctccttacccacttctctatgggattagaaaatcaaatgttctcatttttacccagataaaaatttttaaaatacttgtttatttatttgactgtgtctcaggtcttagttggagaaggcaatggcaccccactccagtactcttgcctggaaaatcccatggacggaggagcctggtaggctgcagtccatggcgtcgctaagagccggacacgactgagagacttcactttcacttttcactttcatgcattggagaaggaaatggcaacccactccagtgttcttgcctggagaatcccagggacggcagagcctggtgggctgctgtctgtggggtcgcacagagtgggacacgactgaagcaacttagcagcagcagcagcagcaggtcttagttacagcacgcaggatcttctcaggcttctctgggtgtgcagacttagttgtacccggcatgtgttacccccaggttttaaggtcaccattctcagacatcttgtcccctcagtaagaaattctgtgtgcactagagagtcttaggttgagtctcagacctccaggtgctttatctgatgtagcttacttactaacctctttaacaaattttcttgccatctgaccacattaatccaagttaaatgcacatactacacttttcctttttccatagcagtggtcaaagtaattagcatgagcgtgaacgtgaaatacatttttcaccttaatcccttttgccctgctgtccaatactcattataaattcttgtggtggatagtataatggaagatatatctatcttctctttagatctgaataaattgttgacagttttctccttcttttgcaagtaacactgaacttaacttttcaacatttaaaaccaaacttctcaaattcattttcagctcattagttaatgccagctaattttgacttttaaagaaaaaaatagaacctaaaatcttggaggagctgtatttcaggctcctgttgatttagaatggctgtatacatccttttgatttaggaagaccaagggcaggaggtttgacttggtgacttctcagagcctcaagaaggtaaattttatactatatttagtttgttctgttctgcagatgcctttcttaatcagtaatggcttagtgtggggaacttagtgtgagcttagtgtgagtattgaacatctctgggtttgagattgtacaaacacaacaacaagggcctactgtatagcacagggaact

SEQ ID NO: 57165 - DNA, 1272 bp, Bovine  19866880785652
attagaaggagttgtgcaaaaagcaggtagaatcatcatccattccccactgctaataaactgataataccaaaagtgatatactcagtatataccaaaaatggaaagctggtcatcaatttgctaaaatgctccagccagcagaaatgtttgcattttccctctttatataattttcattctgttaactagtagcaaaccctttccgccactgtcaacatctccactgcccttctcaatttaactgaaagaaaactaaaatgtatcaacaccatctgtgcctcttaaattcaggatacattagaagcaaataactacttttgatgaaatagcatagaaaacatttaagaaagttacttagtgagcactacatccaacttcctttggagaataaacatttaatcagcactgtctcctcctctacttgtaaatgtatacataaatactcttatgtgtacactggagaagtaaagtaccaatttggcttctatttacagatcagactttcagtgattatgtataaaactaaaagcacatttggaacaggtattcttgtctccctgccaaactattatctttccctgttaactgtttctatctaatcccatgtgactctatatacgctagaaatctttctaatgaatatttgtacaataggataaacatttatggagtaccaaccatgtacacacttgaatgagagtctggaatacaaacagaacagtctcctactgacacttcatttctaaccaagtacaaatcttaatgggttggataaactgctatctttattcctacagccctattcattacaccataagctcctttaccacaccacaatgcctccaaaaagctcagaatacaaggggtgaagtttaatcctattaagtaaattctcaatccaaaactttatatggtgatgttttatatcatttttaagctgacatttacatttgcatagctgtaacatgaagtacagtcaccatgcctataagccaaagcatggaaactaatagtcctacctagaaccactactttcagtattgattacaaaagcatctaaagagaagacataaacacagagaaaaaagtattgaaggcaactgagagccatgacagttactctaaaaactgtcaccaagaaaacatctgctcttcataatgtcttctgttagaaaaataacatgaaacataaccaaaaccaaaatagaaaaaataaatattttcctcaaaacacaaaggtttactatgaacaggggagaagggtggcag

SEQ ID NO: 57166 - DNA, 837 bp, Bovine  19866880896937
catggtttccaaaattgcaggcatgctgatttcataggactaatcccgctgccctcctctcccttatcatggcttctaaaggaaagtccattgtttgtttatattaaaggcagcattttcccaaagttgctatacagtgcagttcacctcatttcttagcccaaacaatacatgtggtgccacagagtctaccgtcaaatggctctagttagtcctttataaaacaagctcagagaggtccttgtcactgccgtgttagtcagaggatcccagcaaataacctcagactttatttatagcactgtatgttttggatttataacattctatctgttatagacgtagtatattatttgcttggttactttataattgtgatagtttcatgccacccaccgtaggtttttctgcagtggttattctaaccacaaattaaggagttatttttctgtgggttcagttatacacaagaattatattgcaagagttgctggagcccaagttctgtaaacagtttttttgggaagaagtctttgtctaacagacttgactagattgctggtactcagaacgttagaagtcagaacttagatgcgtaaaatgtaacttgtcaataaaatcgtagaatattgtgctataaaatgtcagatgagaatctaccagctgctgtccacgttggtatatgggcagcagtcttttcagtagaatagaattattggaattttcctgtgcctaaagcagtgatggtttatacttcggggggtcataggccaacttgaaaatatagtgaaagcacattgtgtgtctaggaaagtttacacttgtatatactacaca

SEQ ID NO: 57167 - DNA, 1644 bp, Bovine  19866881157992
ctgctgagatgcttaacacattatggcacatagtacatactccaataaataataggtattatgaaattcattacactgattcttatatataatataaagtgtaacagataactaaaaggataataatttcagatataaactagaacattgctcaaatggacaagtctgacagcagccttcaatatatacaaaagaaacaaaaggaagacaaaactgactgaagacattctttgagtctgagtttggggctgagggaagaggataataaaatccagaagttactttataatttacagggacagacttgataactctgcagggagtcagagctgagaggcaaaacacaatcaattggctgtggaagctttttacagtttttttctttcctttttttataaaaatactgatgcctggggtctaacccagacctacaccatccaaatcagtagggtggagctggagattcatgcacatttaggaaaaacttctcaaatgagtctggtttgaaaagcattggctacagtattcgtaagttctctgagtatttatgagtattcatgagttctcagacattctctgagtctctgtctctgtcaaactccagataaatggttcatggcagtcaagggaccgagctgaatcttggtcagttcaagctttagttgccctaacaagtgcatgcagtgcagacattacatagaaagtcaaagttagacctgcacattttacatatcaaatatgagataagcaaagttgctttcctattatgaaactgaagagattaataatatgtatttctctctaaacaaggggcttccctgagggctcagatggtaaagaacctatctgcaatgcaggagacctgggttcaatacctgtgtcagcaagatcctctggagaatggaatagctttttactcactccactattcttgtctggagaatttcatggacagaggagcctgaagggctacagcccacagggttgcaaaagagctggacatgacttagcgactaaacaacagcaaagcacaggttccacattatatttcccacataaaaagtccagtctcctttcacttttctgaccacatctagggaattgtcatctgtttggaaacaagacagtcaaagaatcttgtagtatgtaaatgaaaaattaagggaaggagcagtttgaacaaaagtagaaaaggatcttatacctgtctaaagaatttggaagtctttaatactaaagaggtcacaatatttattttgtgcatctattttgtatgcctccaagaaagcagaaataagaaaaatagttagaagttataggggatggcagatttatggaagattcagctttaatatgaggaagaacttctaacagggttggctggaaggggaactggttattttgtgcattactagaggaaatcacagggaattttcatgacagatgagcactgtggtcagatgagcatggtcatctcacgatggagtttgaattagtaagggctgaattagatgacttccaaaattcctttcatttataaaattttatgagtctatgactcaaaatacttattaggtctcccaccatcaggaagcacaaaagctgggaagcaagttaaagaaagagcagccaaacagaaggtag

SEQ ID NO: 57168 - DNA, 781 bp, Bovine  19866881194139
tttttttcctaagtatactacagttagatttcctctaaaattttatttcagaaccttaattttggacctaaaatagaatactttgtgttccttttaaaaatgcaaattagctatgaaataggtataattagacccttaattagtactgattgagcatattataattttcatgtggattttatgctgttgcctgtgtcattttttaatttattaagcaaatgattctttccttgatgtattttccttgaaggcatttaaaatatacagtccttctttgaaaatgtggttatcgagtatttgttatgataagtagtggagagagctgtccgtcttccaaagtggaatatatgattgaaagttatctggcttccaaaatacgttgctgtgaaggtatgtattttgagacttaacatttttacttgagttaacatcacctcaaaacttctattttactcaccatcatttagtttcagccttcacctttattttttatttactggaaagacatatgccaaactatttttgaatgttaacagctaaacataaactcttaaagtctcaatctgttccagaaactaaatatcttttcctaattgcaactggaaatattttagcttgcctatttcttgaatgtaatttatttagaaactttaattttgaattttgcttgttttccaaatactataccttcagcatgaattttttttgaagttggtatcatttatttcaccaaagaaaactttcggagttgaaggaaaatgttcccaaagtggtacctaaa

SEQ ID NO: 57169 - DNA, 1407 bp, Bovine  19866881299309
tgtatgttgtatgtgtctaagtggatagttatcatcccactggagccttgaggagagaacacccctggatgcccgagcgcttggatggtgctgccttttgagccagagttctgtggacccggcttagcccgtgccctcttgctgcgcactgctcccgagggtgctagggctgggtgcgctgccttctttgagactgtgaggttattcagggagactgtttttattcagggatgacagatcatcacaacctcctgtatcctaggtgctggagctataatgatgaataatataaaactcttaccatcagggaactcagattaaatgcctttttttttttaaactatcctcaatataagcacgattttggggggaaaaatggcataatgattaaatttaatagaataaataataaaaaatcaagtgttgaatatattctgcctttgaaaacattgtccaaaaaagaagaaataatcttttcactttaaaaattatatttcctgttgggacttacctggcgattcagtggtgaaggctccccacgcaggtttgatccctgatctgggagctaagatcccacattctgcatggcatggccaaaaaaaattttttttaataaataaaaatttaaaagttatatttcctgttaatgttcctaagaaatgttggtatattctacatggaacaaccactatgtgaaattaaaatatttgctaaaatgcatactggtcactgtcttaactcttagaaatgaaaactatttccaaattcttataatgacatttttttttgcaaataatatttaaaaatttttgtacagtttcatgtatagaattattttgacagatacaagtataatcacttcaaaaggctttacatatttgtaagaaataaaccatatgccatcttgcagaagccttgatttggaaagaatgtggctctcagccagcaattaattaagccactcttttgttttgaccatattgtggtgtgtataggtgtgaaattttctgtctttagcaaataggaatattcctgtgtatccatgatagttaatagggaaagcagttaacttctggtgttattctcctacaaagtaatggaaattttaagtacagatatttgaagcacaagaagaatgggggaaatttgggggataaagtgaaaatatgaatttggccctggatagctgacaagtgactcctgtcactttggtcccttaaagatttcctcattgttatcaggaagatggaagctgagcatctatcaagtctgttgctagagaatacagaatgagagaagatcacttaattatttggtgtgtgtagtgggataccctgttgtcaaaaagagagaataattagcctgaccaatcaatttcctgcatttctccgaatccaattcagatat

SEQ ID NO: 57170 - DNA, 1824 bp, Bovine  19866881382709
ggcaataacttggagttctgttttcaagtataaaagtgtgttcttgaagagttgttataactgaaaaagcatacaagttgaattagtataagtgaaaggtttttgaatgaatgaggagtatttattacattaaaagactagagggaattctgtcactcaaaaaatctctttgagggaataccctggtgggcctatggttaagatgctatactttcacagttaaggacacaggttcaatccctgggtggggaactaagatcccataagccacgtggtatggcaaaaaaaaaaagagaatttctttgtaaaaggatcattaatgtccttattttccttctgtgcaaataaacacatgcacttcatatagtcctgggaccaacatagttcacacagttttctcatctgtaaaagaagaaaaatactactacctttacctagaaagttgtgagggtgaattttttaatttcatgtgaagaattcagctccttgtctggcacagagcaagaagtcggtaaatgttactctttttatcagctattgccaacgctgttctttatggagaagtgatgtattatattaagtaaagtgttaaataacagtagtaacaaaacactcttggacctcatgactttttattaccctacggatttttttgtaattgaaaacagagaatgaatatatttaatgtgcccaagtgggcagtgttggggcaaaaattgtatcaaaaagatattaatagttaaacaaattttgcagcctcccattaattcatgcagccagccagccagtcaggaagtatttattggatgccagtgcgtgcaagccaggacctgcaccactggacgtggcagagctcgtgacatgtgggtaggtgattctggagcaccagtaacggtcacgatattataatctttgctttggtggaattaagaaatcccggttcaattataattcttctcagtaatcaggactatacctttccaccctggataagtgattttccacaggctttagcaaggagcaaagatgtttctgatgtgcttttcacttgtacattttctatgcctggaggcttaatacagcctatgaaaaatcgctctttcgttcttttcattctctctcaaagcttcaagcctcggggcccttgaaataaatcaatactgaattcattgacttgggcattccaacagaacaaaaggaacttcagagaccagacaaaccattaaaaacatttggaatttctttttccccaaagtgcctccttttttccttattggaatagcaacagttaacagtattctcgaagcaggatggccattgttttgcctgcaaacaaactaaaaaccttgtcaatcatcaccttcccaaattcattttataagtaacaaattaccatttaaacaataaccatgaattttaaaaagagtgtaacaataaaatgcatgactttatataacctgctttcaccctactttataaatagttttcaaacaacatatgtattcaagtgtatttctgggtcatcaatatatttaataagctttcctgaatatgcaaaataaacactttgacctatttctggaaagcttagagcattgcagaaaggaggatcaggagacaataagccaacacctgtgatattatagatccaatagctttgggggtgctaaatattctcttttggtttctagatcaataaacagcaggaagctctggcttctgtctattagcatgcttttagttgtaagaaagctcaattctattaataatcagttaacaataactagaactacttaacaataaaataactaatttagagatagg

SEQ ID NO: 57171 - DNA, 1754 bp, Bovine  19866881111554
tatacccaatcttgttttaaagtcagtcctggacatactgttcctaagaaggaacatatattcctgaagacattcaaaaggggggactcttcgctctgaaaccctaacaatatcactttaatcatcgcttctgtccctgcacgtcacaaggccatacctctaattaattccatacctctaattctgcttctcttccccagggcccagtcatatatgcgcagctagaccactctggcggacaccacagcgacaggattaacaagtcagagtctgtggtgtacgcagacattcggaaaaattgagaagaccgccatcatatcctaagcaataaacaaatccaaactggactcttgtgcagaaaatgtagcccataagtatgtgtggccttggaaaccagaacgtggagaagcacatgtttagtcatagagggagaaaaagatgtgtataaaggatgtgtataaatgttctatttaatcttcctggtgcaaggagccagttgcatgatgaagagacggtatgattctatgtgtatataaattgccttgctgtttttgtactgcccttcagggtcatttatagtcgagaaaattcagacacattcctatcaccatcgtttagatgtggtttgccttaatgaggaaagtggcagatcttttagtattctaatagacatggccttttaatataagggcttaccccgcctttgtgtgtatcgtagttggagagtggagatgctgtgatggaagcatgttcaggatggcctttagcccagggtatatcgcctgtttggcagttatttttagaaagcatccatttgctatgccacttgaagaccatgtgatttctgttgctatttttctctctaaaataccgggcagttttctgctttcagtgttacgtagactataaaattacaccctgtagcatatcatctcgatttgtggattcatcatagcaagattagcaaaggatcaatgccagaagtcatttctttccaggtacttttggatccgtaccataatcgatacataattgaaatagagaacccagactggcttgaagagtactgtactatttggagagcaaaaggtatggtatattctttgctgaagtccttcatgcttgtaacaagtccccatatagctgaaggagcagaatttcatttccttctaagtaggcagaaatggaataattagattgccagtctctagtatggcagagctctctctagagaatctttataaagcttcagtcatgcttccagcagcctggctcctataataatatcttcaaggactttgaggttaaaaacagttagatttgtaaagaatttttttcatttaaaattgaaaatactgatgatatagtcccagaacacactggggggtaaatggggtgtgacaggtaatgttagttttcatctcatttagtttgaggtcccctaagagctgcttcctttttttcttcccgtcttgttctctttgtgagagactttgaaggccaagttctaaggaaataaagagtaatttagatttaaagatgtttaggaggtggttacacaaagaaaaagtatatgagctacaaacaaactctgccccatttgtgcggtcttttattttctgagagactgctgtgaatcccatggtactccagctcacattctgttgacatgtatgtcagcaggactgggtttttgttgtcacgcgtgcctgccgtctctgagcctggcgtgtctggtctgtgttgcacgcggg

SEQ ID NO: 57172 - DNA, 1039 bp, Bovine  19866881392487
agcatcttgctttttaagtttaagtgttaatttaattgtattcaacataattttagcatgatttgagggtctactgtgcctgatattatctaagtctccttgtatacactatgttatttaatgtcatttttaccacataattatactctacattgtgtttattattcccatttagcaaagttaagaaccctaagcgacttaatgactgaacagcaacaaagaaagctattccttcttaatttaggtttgttttatttgtttaatgttaatccatgctatatttcagtatgatacagattctgtacctgtgactccagtcagatatccagcagtacaaattagcttcacattacacatattgaacaaaagacagacgttgaacgagcaaggagtggaggggcagggcccagggggagaggtaaagaaaagaaacaaagaattgaacatgcatgcaggcttttccataccaccttcaatgctaacctgcgtcagagggagagtaaaagtaggcaagaatgagcagccatggactgttgaactgttaccagcaccatgcttttcagcaacatttcagcagagtttgaaacacagcaaaactattacaacaaactccgcaaacaaccttttaccacctcaagttaacatccaattaattttaaacactggtataaaattcaacttaaacaattagaaaaaggggaaatgataccacataacctctatagtgcaattaacctttctcttagatacgtgcatcaggtaaaattctaatggctttcgaatgaatgtaatttccattctaatggtgatcttgccacgtctggcaggagacaacacagtaatgctgaaaaagcctctatgcagtcctgttagtgttcttaacctaaaagctggaactagtaaaatccacagaaattcactcttgcttttaagaacttttgtacccgggggtccagccccagttggatccagggattccctcgggaggacggtgttggtgattaaagggatatcacagcagagagatcagaggcctata

SEQ ID NO: 57173 - DNA, 2957 bp, Bovine  19866880097189
atagcatattgaaaagcagagacattactttgccaacaaaggttcgtctagtcaaggctatggtttttcctgtggtcatgtatggatgtgagagttggactgtgaagaaggctgagtgccgaagaattgatgcttttgaactgtggtgttggagaagactcttgagagtctcttggactgcaaggagatccaaccagtccattctgaaggagatcagccctgggatttctttagaaggactgatgctaaagctgaaactccagtactttggccacctcatgcaaagagttgattcattggaaaagaccctgatgctggaaggaattgggggcagaaggagaaggggacgacagaggatgagttggctggatggcatcactgactcgatggacgtgagtctgagtgaactccgggagttggtgatggacagggaggcctggcatgctgcaattcatggggtcgcaaagagtcggacatgactgagcgactgaactgatctgatctgatctgatcctggatgatgactggagaggcagcccccggtgtggggcctggggagagtcatctccaaggcgagtgaaggaggtgaattcaggttgagaacaagatgtgccctgaaccaactgagatgcccgggcttggctccagggactttttcagcaccacgaatgccagacagctccctggcctctcacttcccacctcctcatggtctcctcttcagagagccaatccctgctgagaaaggaggaaccatggctgtcttttccttagagctctggtcagagtcaggcagacctgagcttgcgtctctgttccccacttggctgctgtgtcccctgggacaaaggacagcccctcttaggttctgcggcctccactgtagggaggggatgatggcccccacctccccgggctgatgtgggctttaagttacttattcactcagtgactatttattagccacacactttgtactgagcccttttctacactctgttagattgaagaatgtttctgaagtggcttaacaccgtgcttggcacatagtaggtgctcattaagggttaatttcctgcctgagttattcatctgtaacaaaaagccgggatcaatgactctaagagcaaccaaccagttacaggcgtcacaaagcgtacccccaaagttcccgtgctgcaggcaaacttcttttttcatcctgtccttttgatgaacttttccagtaaggtgttatgatcttgatatacaaccactctcgggactctttggagttttaaagtggccctaaagtcagagtgtgagaggtgggtccaaactcttcttaaataaggtagaattcattggaatcctttgcctaaactcaggccacttcttctgaccctcagttctgtggccaaccccttgactttcagctccctctgggaagaaaacgatgcttaacacaagaacactggtggggtgaagatacagattcactcagttccttcactgaagccccgctgggtgcttggtgctgcccaggacacagaggacagacctggcccttgccgcccgggattcaataaagggtgggcagggcagccaggaccatctcctccaaccctaactcggagtcgccacttggccggcagccaggctcctggagggagtggatagcccagcagtgccctcgctgctggagacagtcggctgggggaagggagttggctgtaatccgtgtttaatttctctggggcctccattataaattccataactccaccagtcacaacatgactaattcctgggactgcagcctccaccggggagtggaaagccctgtgctgttttgccgccttttatcaccactaataaaggcttggcagccagtaatttagcggctgtgggtggttttcttatgcatgtgagttcctccgcctcccctccccacagtatcgctctagaataaatgcttgcttgctttctgggctggttttctaccagctttgtaatattctcagcctgaaaatctgtgggtctaggggaagtttacaaagaaggggccacagtgctcagggttaattgggtctttgatgattctgacaagggcagttcactgtgtgatttaggagaaaagaatgggtttgttggaagtaaacagaacagaattgcaggtgtgatgttttccctgctggcgcaccccctcacccaaccagcttaacgcccctgtgagaatgggctgtgcaggcagtgctgcctcgtgccccctgactgtgctgccctgggcaggcggcttcaccttcctgagcttcaagctccttatctgtaaaatgctgcagacaagccatcaaccctggctgtcctctaaggcttatgtgagtatggacttagtcaagtgcctggcccatcggaagaaagccagctaagcaaggttggaggaaaaaagatcccccacggtcgtgccattttatctaacaccttagtaattatatattcattaaaaacgttccccgacggccttagtaaggtattagtttgttgtctttgcaataagcaaccaacttggctttcatctccaaatacagagcctgtttccaacctgctcgcccccctacctggagttaaggtggtctcactgtaggtaggaaatggttgatgggtggagtttgctggggggagtcaggggggcacatggatggagtgttgagagctggccccgcctcagaggagaagggtgagatggtggtggtggttcagtcgctcagtcgtgtccgactctgtggccccatggaccgcagcacaccaggcctccctgtccatccaccaagtcctggagtttgctcaaacccatgtccatcgagttggtgatgccatccaaccatctcatcctctgtcgtccccttctcctcccaccttcaatctttcccagtattagggtcttttccaatgagtcagctctttgcatcaggggccaa

SEQ ID NO: 57174 - DNA, 1909 bp, Bovine  19866880486148
gaacatcagacctggaggtgcccactggctccaggaagacgaggtgcgcgtgtggggcaagtctgcaccccgtccgtggctggtggcaggccccaccaagcccaggctagacgaggctgcccccagacaccccgcaggtgagtgagtgaggatacacggttgctgtgctaaggcactgggtggtttgctatgcagtgttattggcaatagctgactattacagcttcctgttgaaatcgggagaatcctgaactacttactctgactcatgaggctctacatgacctggccactgcctaactctcttgggtgttgggcaggggtggagtaagctcaccagggtgaaggaaaagcaagaaaaaagaccctgacattgagtggtacaagctgtttgtattatatatttggggacctagagattatctttactgaatgaagtaagtcagatggagagaggcaaatatatatcgctgatatgtgaagtctaataaacagaaatgaacttgtttccaaaacagtaacagactcacagacatagaaaacaaacttatggttaccaaaagggaaagggagggaggggtgagttaggagaagggattaacatataaaataaacagcaaagtgttcagtatcttgcaatcgtctgtggtggagtcttaaaagacacatgtatgtttgtataaccgaatcgtgttttgctatccacctgaagctattaataacacaatattataaatcagttgcaaaaagaaggtcctggagcaggaccgagatggggccttcaagggacagaaacgtgcccagtgttaggcagcgaacagacctccttttggagacctggcgggctacggtccacagggtcgcaaagactcagacatgactgaaacaatttagcatgtatggagacccgtcttaagcaggttttccatggacagaggagtgtggtgggctgcaatccatggggtctgtccctgggattctccaggcaagcattctgcagtgggtggccttgccctcctccaggggctcttcccagcgcaggaatcaagcctgcatcccttacatctcctgcattggcagctgggtctagtcagagttaaaatccaggccattatgatgatagattccgggcgtgtccttgtcgcccccaccacagatgacgatattattgagtaagcacttcttctggaccagacgctaggctaagtacttagcatccagaatcaatcttcccatgctaatgagggtagttcgattatgcccattttgcagatggggaaatcaagttcttacttgcctgagctcacactaatagtggtaatagagagagaattcaaactcaggtccgcctgaccccagagctccagctctccagccactgcctggtcttcccctgactagcactacacacccagccattttccaggacaaattttcccttcagggagcaggagagacgtgctgcctttcaagtgcatgacaccttccggagacaagtgtcactgcgctgccatcagagtcttcggtgactctcaaaggcctgctacgcgctctccaggttcacagcgccagcaccctctccttcagcagggtggggtgagttgctggcttatctgaggacaggtctccgggtgcacattatggacagactccaggggggatgttcagactctgtagtctggtcccacggttaacgggcaacaccagtagagtgaggcaacagatagggcaaggtaagagactggttttgcgggagactggccggggcaaaagggtctccgggagggcctttggggcttaggggagctttaaaggatacataagtctggactccaccccaacctgggatttggagcttagggctgtatttcttttaagggttcttccatgcccagctggttccgatttg

SEQ ID NO: 57175 - DNA, 2615 bp, Bovine  19866880528344
tgtggctgccttgtggtttccgcactggtgggaaaggaggagccctggggccagccacagtgggccgggccccacctcaccatgtccatctgtcctccccatctgtctcctccacagctctgcccccaagggctacacgtccttcagcatcaccgcctccccaggagtggttgtgaaggtcgcccacaggcccccagccaagaagagtcccacaggcgcgtcccagtggcgcctggagcccggactggacgtgagcctgaagctgagagcggccagcgagagcacaggggaccagcaggtgagggcagcacagggctgggaggcggggcggccaccaggtcccgacaggcctgcccctcggcccatccggggtcagcaggtccgacaggcccgcccctcggcccgtccggggtcagcaggtcccgacaggtcctaacaagacagagcctccttgtctttggcagagctcatgacagcttgttccagccatagcatactcacactgagatgatgttgggggcttacggaggtcaagggttttgactaaatttattcacccagcaaatgtttaataatcgccttctctgtgccgggcactgtcagaccctgaagattctaatgaacaagaaggtgagatcgcagcccgcgtggcgcttgcggcctgtgggcgagcatcagacaagacaaacgactggaaacggtggtgcggctgggaagcgctcagcccggcagccccgggacactggtccttgccctgtatttagcttcttcggctgctgtaacacaggaccacaattttaaagcaacagaaacatattctctcacgtttctggaggacggaagtctgaaaccagggtgtcagcaggaccgtgttgtgtggcatcagttcgttgaggagaatcagttctttgcctcttccagcggctgctggctgtcggcagccctggactgatggccacgtggctccaggctctgccccggggcccgtaccccctcctcagtctctctcggcctccttcttagcaggaaacttgtcactgcacttaaggcctgtctggataacccaggatgatcacaaggtccttaattacatccgcaaacatttttttcccccaaatggggtcacattcacaggatccaaggattaggatgtggacatatcttttgcggaatcaccgtttaacccgctgtactcacattgactatagatagataatcagggccctccagagggtctcacacacagatctgggccaataacctcttgttcccagcaggggaggccaagcagtctctccgcgggggcagagagttatttcctgttgtaggaacagaccttgggcatcaaagctggtcagcgagtgagtactcagggaaagcttcctggaagaagcggcaagctgaagggtgctctgcacgacctatttgagaggggtaaagaggagctagagctcagcacagagggtgtggcccgagtgcgcactctggataagagagggtgagatgtgtgtcggggaagctgaaaaaggcttgtatggaaagaaaggagcagggagagagggagccggtgtcagagggttggcatccgggacctctttctcttggggaaacaggaagccaacgggaacctttcatgcaggagcagcgagaccgtaaatgtacattagaaagagccactggctgcagtgagtgcgtcgattagatctaggcagggcgaccggtcaggaggtggacgccatggtctagacgcaaggtgacggaagctgcgtttctctgggtgcccgccatctacagggcaggtccagatgcctcagtgtggcccgtgggagctccgcttcctctgggggcatcgcttgggttttgccctggggaactcccctccgccctcttgcttggaagcgtggttcctgatgctcagccaggcggggcccatcggatgggttctccctggacttggagccttgggagacaggggttggtgtctcttgatctcaacagcacctgccctgaagaggccaggcccactcaaagcccctgctccccgatccctgagggctggggcccagcctttcccagtctgcttcctcaggcctcctccctgcccctgctggccagcgttccctgcggctgtcaccccagcatccatctcatgcctctcccatcacacccccaactgctggactcctgcggtccctcccggaccccccgacaccaggcaggcagactaggccctggccaggctcctgaaggacccccttctacgcatcacggtcacctgagtgtgttgctgcccctccagcccacgcgctggggcgttccccatgggctgggggccctgtccctgtctccttggcaccccgctctgagccagcacgcagcaggccgcgtggagcgtgttgaatggctaaggacgccattcacggctcgctcctgttccgcaggttcagatttcataccatggacccgcgcccaccccggctgaagccctgctctacctcactggggtcggtaagtgatgcctagcagctcggagctcagccccctgccctccacacaccccacgcaggagagactacaccccgacgctacttagaccaagggagaaaagaaaaatt

SEQ ID NO: 57176 - DNA, 1008 bp, Bovine  19866880547603
tatccgattttacaggtgaagaaactgaggtacaagagctaaagagacttggctaagatcacacagctggttagccagggagccaggacgttctggccaccgagtgccgtgcgctctggcccagcactgacacacggctgtgtgtgtgtttacaaggtcatccaggccagtctcattctgtgacctcataaggtcaccgcacggttatcactggaatggtcgtgttgccgagtgctctgatgaggggagcatgtgctttctcccccgtgctgtgtggacagagcagctatgcctgaggctgtgctttgtcccagggtgcacagaacggaaagtcaggtgggacacaagcagccactgcgccccctctgcaagctcacggggcctgaagttgcggccagaggctcctgtgaggggcaggtgtccttgcaggagctttgcctcacactcccgttggggtggctgggaactcgttctgaagccctggggtggggggcgcacgggtctggttggcatccaggttgtggcatggcctcccacccaaggaggatgcctgtggtcaggagcccctgcacttctgtctgaattgcagccagacttcttcttgggggacatggggagtcttacaccctgtgtctcctctgaaggggaggcaaaaaagccttcacgcaggtaagtctcctggggaaaggactgtccgtctggggccagactaagtgccccacccttgggctggtatcctcaccaaccctctcctcttattttctgggatttcagaaatctccctgagtgcagacatcagccgcactggcaaaatgaagcccacgggaagcctgaaggacaaggtatgcacagcttgaccttggcggggccctgaatggcctccggactctgctgggctcgcgtcacacgccccctggtggtgatggatgaacagcagtgtgcttcatgtaccgtgttaataggccaagaaacacaagttcagaaagaaaaagaaaatttaaacctcca

SEQ ID NO: 57177 - DNA, 2743 bp, Bovine  19866880557504
atgaccttggccgccaacctgggacgatgtttgcctcagagtctgcccaagttgggggtgagatgctaggtctctatgccagtgggccactctggggagggggccatatgtgggagaggtgactcagccgaggacatccctgagggcctgggagtcaaggactgtgagtgagtagccttcccaggagctggagccagccctccatttcttcctgaaggacgttctgggtgttgccttacacagtctgccaccgaatgtctcctgtaacctagggctgccctgaccttcctctaacctagtcctgcttctcctggctctggacttccaggccccactccctgtgtgcggcatcttttgtcttcagggtcctggttgctctccctcagacccaacccagcaatcagaggtggcttctaggtgcctgaagatttcttatccttatctctgggctttactctgactccagggcacccttttctagaggaagaacataagtccctttcttcatcagccagtccctggatttttgcacttatggaagggagccatgtcaccaatcatgcaaagcagccgataatgcaaaatcgtttacacctgtccttcagctgcattgcgtgattacaaggggatgggaaaagtgtgatggaattaagtgtgtgctctggattcagcctgcctgactgtgtatcttggctctaccacttactacacaaccttgggaaagattctcaaccctgctgtgcctcagtttcctaagctgtagcaaagaggtttgaggatggtacctatctcataaaactgttgtccatgctacataaaccattagatgccatgccttcagagcaatgcctgatacacagtaacagctcaagaaataagctttgatgtttgccctgatgtaaagtttgatacagagttttgctaaaatgtacttgttacttggtgtcatcctcacttaattgaggttggtctggaaaagtttctgtggcagaagaaattgtcctgaccttaaagaattgccatggatgtcctgccaggtagatcagctccagacaggactcccagtaggcagggcagctaagaagagaattcagcaccacggacagaccccatacctttccctcaatgctgttttcttcctccggaggacaagaaaacgtaccaactcagtcagctgccatttcccaggcttcttggctagctaagggcccaagatgcttttagtccagcgaatctgaggttgcctgtcttgattcccgcaggagcagtagacagagaactgaaagggcccgcgaggtgggggggttctgtggccacatgtgcttggcggtggggacactgagggtgggccttcttccctgctctgggatgccctttcttcatctgtaaagcagagtgtgactcctcagaatccggcaggccttggggcatggtgggcctctggggatggaggtcatggatccctggggccagcagagggcagcctctggcctgtgtccaccctcagggcaaggttttctaactggcacctcccgggacaccacagaggatctctgagagcaatggagtgagtggagtctttgcatcctgaacatccctgctccagacctcgttcctcccttactcacttctccaagccctgggccctctggctctcatcagagcaggtggggctgatgctacgccttggagatggaggtttgtcctgctgttctctctgaccttgagctactgcctgtttccgtggcacctcccttcttcccctagaggactatgctgcagggcttggggagcaaacacaaggcctttcctccttccaccacccctctagtctccgcttcagaatactctgagctggcacccagaataagcatggcagtggggtaggatggaaggtgatgctgtggcttggttctcatcctgtggttctagttctgtcctggaggagcttgtgcttgctgggagcaggagatacaattcttcgagtcacaggagatgaagaagagtggaagagagtcccaagacatgaggcgcctgggcagctgcatgattcctgttgagcacctgccctggaccaggcacacgttgaatgtacagcctgtgatgccagtactgacactgttactgtgagaaagccagtggagaggctgaagcttctactgaaggtcacgtagctaagaagtggcaaaaccaagcttcagtgtctggttgaccccgtaggtgacttagagtgatgtctaagtggggaggagccttgggcaggagtcagccaaacggggctccgatttcagttctgcccctgaactgcagttgtgtgaccttggacaagaaattctgtctccctggacctcagtctccccatttgagaatggaaggatgggactaggatgctctctaaggatcctccagctttaagtgtctatgaatagactctccctgggcctaatgctttttaaaaactactggcaagaactcacatatgcacaagcccagccttatgtataaatggagtaggcggcagcctgtatggtgtgaatgatggctgctgggaagggtccctgcttaaaatatctcagtcgctcatcccgctgccaaagagcctggagtctcatcactctgcagtcgtgccttccgcgagtccctatttcagaatgccaatatgtcgggaggcctaacagaattatgttctttctttctaggaggaagggaacttttgatgggtattgaaatttgtttgcatttc

SEQ ID NO: 57178 - DNA, 1579 bp, Bovine  19866880699143
ttcccctcgggggacgggttaccctccggggatgggttccccttgggggatgggttaccctccggggatgggttcccctctggaaatgggttaccctgagggtatgggttaccctccagggacaggttaccctctggggacaggttaccctcgggggatgggttaccctcgggagatgggttacttcgggggatgggttaccctcgggggatgggttacccctcagagatgggctagggtgctgaagattctccgtcacttctctcgtggagacgcttcctcacctttctctgaaatctgagtctgtctttctgtccgacagtggagcacgatggatgcgacactatgccggttctgggcctgatagtttcttctttcatgcttttgggagccctgagctcccgtgtggaaagtccagctcccctgatggagacacagctgggaagacccagagtcagagaggccctgagagagtcctgctgaccaactctacacacacaggtgagctgtcttgcaccctgttgccggatcaggtccccagatgacgacagatccagatgtgtcatgtcgagcagaagactcacggaactgagcccagtcagcccacagaatcatggcagatcatcacagaggatcttgttctaagacgctaaacgctggggcagttcgctttatgtgaccacatgcctcctccccttctggtaatagagcatccttgggagatgccctttcacctgctcaccgggggggtggtaccaaccctattaacaccttgttccttcagtcccaggaagggttgggacccaggcccagtcaagataatattaaaccacatggcagtagtgattggcttggcgatggtatgtgaccctagaagaaccagtcagggcccttcctggggttgatatgttgttgatgggcgagagaagctatgtctcctgcgtttgctgagctggggtgatgtgaacccagaagctgtctgtggtcctgttccccacctgcctccgcatgccagctggaagtaggtcgattccagctgtggtctgagaggactcgaaggtggtgcagtgactgctgggccagctctctccctggactttatcgtttcatgagttacatgttctttctcctttaaactggtttgaggaggtttccgtcactggaaccgatgggacgcatcacactgactctatttcttggctttaaatggcttacgcagcgttgttctatctcagaggctccatcctcacgggaaaggaaagaaaaggtgagcctgttgtgtccagggccctggtgctgggcgctcggctctattctggcgctgagcgctcaccgctgcctgcaggggaggtggcccctggccatttggcagggtgggggcgggtcacaggccgagtggcagacccccaaccatggcgtcgcgtggcagctctgctcaggggcagagcaaggcagagaccaggcggggaggaggcgggaggtgagggagtcccattaatttttccagccttaaatcaatttaatgggagcctccgatgactctgatttcatttttcattttcaccattacaattatcag

SEQ ID NO: 57179 - DNA, 1600 bp, Bovine  19866880817625
ttaaccggaggacctgagacagggccaggaaggcagcggggtacctcctggccccactcctgctcgcctttgctcagcccctgcccgggctctgcttcagtgtcctgcctttcccgccactccagcgcttggcctcttgcacgcctccacgcctgtttctgagtctgccctgtctttctctgactttgccaactcttctctctctctctctctctctctctctcacacacacacacacacacacacacacacacactgacccagatcccggcactgatcacccggaaggctctgtcctgggcttctaacctcggggaagagagccgggcgtgggggtgggggcgagtgtcaggtggccggggctgtgacgtgccctgaatggccaggctagtacctccacgtatgaattgtgttctctcagtttcttgtctgacagaatgtcctttattttctgctgttttttttctgtcatggagaaaaagaaaaagaagcaggtgaattcagagatccactttgctcttcccagaaggtccagtagggactcagttttcccatctataaaatgggggcagtgatgattcagaacacacaggtttgttatgagtatctgggaggtaaatgactttaataaagtagtttacacggggtaagttcttaagagcattactttcagtcccgtaaattctctcgtctccagagggatcctgtttcctgaggggcaacacaggcctgaccattgcctgacactccaggacttgtacagacactacgtgaaaaccctcagctgtagtgacttcaacctctgactccagcctcagtctgtgcacatcattgaaaaaaatatttcattctctgctccatctggattaaactttttttcaggtcctcttgctttctcgtgcctctgagccttggctgttccttctgcctggattatctggactatctttagtccccatgccactgccccgtttatctggccaactcctgctcacctctcatactcaggcctgatctttgcctcctccaggaagccttcctggggctcctcccagacacccctcaaagcccctgtgttgctgcctcctgaactcactctccccggactgtgagtcccgagggcagggacctccccctccctgttcacgaggcacccccagtgcccggcacagcgccgggtgcccggtggctgggcggaagatgccagcggcctgagtgattccatctggggatgggagaccacgtgcaggcagaggaagcttcccggggaaggaccaggcgcggccgacttactcttgacccctggaaacagcagggcctccccgtggccctccttcagctgctcctggaacagttggtagcaggccctggggctggccaggagaagccggaagccctgggggcagaaagcctgcggtcagaggttagtttggtccctggggctcccgggaggaaggctctgccaagggtgtggggagtggggggctttggacctaggctggctgcttcttccatgcccccttctgggtgagggagaaagatttgggaagataagggcagtgtcccccaccctccccggcagaggcagagctgagtctgg

SEQ ID NO: 57180 - DNA, 1546 bp, Bovine  19866880835789
tatctacagcacaggataagaagttaatccacgtgcgacattttcccgtgaacagctcagcagactggtggcacggagtgagcgtctgacgggtgactgctgctgctatcaccggtgtcgttactatcaccaccgttgagctgcgtgctgggctcagtcgtgtctgacactttgtgaccccgattcgaggtgtccatatctattcagtgaattgagttgcagtccatgccaggaccccagagggccatttggagcatgtcctcagccacagagattaccctgagggtcagcagcactgacctctcttaaatccccctctgaaccctcattttgggctgaggagatgctctgactcatgattagagaatggagggtctcatgccttgagtcagatccaaggatgagactgggtttgcaggctgggctcctctcatagggctgccaagccctccccctgtccacgcgtggctggtgtgggttaatgagtctctctccctgtaataatctgatcaatggctcctccctacgctgctcctcgatggaacctctaggtcctttctttggctggttccagcctagtggagacctctgcatagaccattattgcttaattactggctaaatggtctcatttgttctccatttgtcagcggtgagtcccgccagggcagccaagagaattttgaaatttctcatcaagctctggctttaggaagtgaagacacctgggtctccttcctttctgctggtgtctggcaacactgggcacagacttgggggagcagctcctggagctggtgttggtgcctcttcccacactgtctccacagctttctttgctctccttgctttttgcttatccccccccaccccatttttgccttggcctctccactctttcagcccagcatggtagaatgaacttgaaccctgcaaccatgaaacctgagtttgaagtccactggccacctgtgtggctgaaagtccatatttccatatgcagaatgcacacttcacagaggcacaccgagcgtggctcgagagtgactttccaccgtcggctgccgttgtgtatgtcgcacacttacgagttttaattatgcttttgtagcatacatggtacatctcatacttctgtggccctttcatagggcctctcacaaagctgaggagtctggctcaggtccccctttcaagccggcattatcttttgctccttccccaccactcatcttctttctcctgcagtgttccacatggacgctacgggtccagagcgggaggcttttggatttcaataatgttgttaaaaaatcttctctgtgctcttttttctatgtgaaaaaatcaacttgctaataaatagttaatctgaagtgcaagtgagtacatggcctgggaaggggctggctggtcacccccattatgtaaagctgggcattaaagcctgtttacagttggtttccataggaggccgactccacgattaggcttggcatgcagaatgtgtgttaaggaagtgctcttgggaacagtgcccatggag

SEQ ID NO: 57181 - DNA, 1372 bp, Bovine  19866880856810
ccctgtgacgccgcctcctctctccctccagcgcggcccctgcgggggcccagaccttcggcctgaagcactcggagcgcgtgcgggtggaggtggtgcgcgacgggcaggccgaggaggtggccaccaacggcaagcagcgctggcccctgtcgcccagcaccacgctgcggctcaccatgagccaggcaagccccgaggccagcagcgacaaggtaccgtgggcggggcggtgctcctgcgcgggcctgggggccgggggccaggccggtatctggacgggccggatccgcgcgggcaggaaaagccgagcatggaccacacatgtcggtttcagttttctcacaaccacattaaaagagcaaaaagagagacctccccggtagtccagtggttgggactctacacggtctctgcagggctcatgggcgcgatccctggtcagggaactgttaataaggttcccctatactgggcgggatggctgataagtaagtaagtaaaagagcaaaaagaaatagatggacttaattttgatgattttttttacttaactccatatatccagatactgtcatttcaacgtgatatcaatataaaaaacaagaccaaggttttctccacgccgagtctaaatcttctgtgcatttcacacctgtagcccatctcagttcaaaccaaccactttttaagagctcagtaaatcagctcatggctacagccacagaaggatgaattcatggcaggttaatgtcacgggactcttagcacagactcttagactactggaagcgaccgccacgaacgtccttggtttcattgtgtatcagatgggatgctgggcgcccatgcccaagagatagagccgagaccagaccctttgttccctgggttctctaattattaacatgaacgtctcatgtgtcccgtgtcagagatggcactgggcgtcgtccagtgagaacagcctaagctccattgttgctgagtgggagctatatacacaccccagtagaagtgggggccggcagcaggacgcacaggggggcaagtagcagacaacaccctggatgccctctgagagaggggagccccctgtcttcttagatattctgagagaaacagcccaccaagccaggagcacttcctggaggagagggtccagctggttagagcggattggcttgacagactgtgaggtggtccctgcgggtctgcctgcctgtgacctgtcacctctgttctctccctccctgtgcccctcccccacccccatcaaggtcaccgtcagctactatgaggaggaggggatcacgcccgtcgaccaggctgggctcttcctcacggccatcggtgagtctgcgggctccag

SEQ ID NO: 57182 - DNA, 1374 bp, Bovine  19866880884653
aatttttcccccatctctttaaaaagaaaggaacaaaaggattattgtgcttttacaggcactgggactgagtggaagaggctgagggtcctatggagagtggggggcagcgctccgtgctgtctgtgtccagccctctggacatgggtgtccatcacccctggtggttgttttgggagaactttgagactacatccttaagaaaaagagctgctcaaactgtcctctcccttacaccaagggccataaattagtagctcaggaaagttatttccttctctacttgagcccctggaaccacctccagctgtggctacgcctttgacttcagcatgtgtgcatgctaagtcgcttcagtcgtgtctgactctatgcgaccccatgactgtcgcccaccaggctcctctgtgcttgggattttccaggcaagaatactggagtgggttgccatgccctcctccagggggtcttccccacccagggcacaaactggcatctcttgcatctcccgcaatggcactgcctgggaagtccaaacgcaggtgttgccttgaaggaacctagaaggcagcggggggacggctcagggcatcccagatcccttcgaaatgcctgtcctactgaacagggacagcagtgtcatgggaagaggtttcattctggtaagacagaccccatcgtcctcattcataatcaaaatgtgatccagcgtctcttagagaagagtctgtttgtgattgctttgatgacacgggaaataagagctagttcctttacgcacactttgcatttacactgcctgtgccagggtggtatctaggcttgggaagtccactctgccgtctacccacttctcttctgacctgctccaaggccaggctgctggcagtgggctgggctgggaggcagcggcgggagccctgggctctcaccctcgcagttccatcagcttgctagcagccgtggccaggtcgctgagcttcgctggccaacagaaggcagcactgtgcctggtcctgccccgtcccccctgggcagtggagcctagggagaagagtcccagtcccacccagatgtagcatttgtgattatgcttacacaatagatcctgcaccaccagaatgctcggccagtgtgaaattttggttaattgaatgttctgggacatggaaacagtcccagaaatcctttttgttccttttgtggctattgaaagccattcgctcatctatttagcaaatatttgtctcacgcttccactccatcgggctctgtcccaggtgctggggactccagcgtgagtgaggcagcagagtctctgctcccgaggactcacgtgccagggaggacatggggcaaatcccacacaaaaca

SEQ ID NO: 57183 - DNA, 1460 bp, Bovine  19866880901907
tctacccgggccccctctgggtccagagagactccccctggcttcctgcaaactcctgctccaccctcaaaaccctgctcaggcattcccctgccttgggggctttccctgaccagtcgccctgatgagtcatccaagattcttcctcctctcgtctccctagtccatgaacagacctcgctggctttatttccaaaatctgttcccagcggactcctctctgggactgttcaggtgaagccacctggggttgacggcctcttgcctgtatgactgcaagaccctccaatcagcgtctcttctgttcttgtcccttcctaaggttggctctatttctcaaccagagggtctcttcaaaacctaagtcaaggacttccctgctggcccagtggttaaaagactccacgcttcccctgcaggggcacaatcagggaactaagaccccacgtgctgtgcagcacagccaaaaagaaagttttaaaaccctaagtcagagtattcaactcccctgattcatatctttccgtgtcaccttgcttgggattggtttctccccttccttaacttggcttaatatttccccaataaataaaactcggctcttagctctgacgactgttgggtctggtctggccacaccagctcttctgttccacacggggtggatgtcagctgtttctgtgcccgagggcctcctacttccagcccacccccaccgcaacctttgcacagccagcccctgcctcctcagcttgaggatcgtcgtgagcacccacagccccgaggctgatctaggaactcatccgatcctctcgctttcccgctctcacagcacttagagttctgctgaggtgagatcggggcagaggtcggtattctttcatctctgccacatagagcggggctcgtttgtgagcagagaaccgggcctcaaaaggctgggctcgacacttcgtgctcagccagggctgagctggaccctgtagctggagatgtcaggtcctcggaaacctggggcttagggctgtgtgtcctctggtcccgaacatgaacattccggaaggggaggaggctggaccctaagctttacccttagtggctagggcttgggcaggtcgtttcatctcggcccccgctgagcacagggccgtccctggcttagctccgccagggggctgagtgaagctggcggggcctgctgtgtgtcgctcctgggcccgcccccgcccctcgccacagggctgttacctggagccaccggcccaggcggttggggtcctcgtagacggacgccacctggctgttgctcctctcgctcagctccgtcaccgtgctcacgaagccctggacctgcagctctctgccacgggagacgcgccggtctggggaggccgccaaactctcccacctgccgtgacctctcagttccagaggaaaggggtgcccctgccctcgagggg

SEQ ID NO: 57184 - DNA, 1027 bp, Bovine  19866880992650
gacgagagcgagaggctggactgatgcgaggaagggtcccgaggaaaggagagcaagtggcccctcgaagcgaaaggaggcaggaagcgtctccccagcttctccagaaagagccagccccgctgactccttgacttcagcccgatgaaactgatttcgggcttcagatctccagaactgtgggagaataaatacgtgttgtttttagttaacacgtttgtggacgttcattaccgcaacagacggaaagtgaggcagggaacaatgatacaacgcgtctgaaaatcataaccaccaggactcattcaacaccgcactcgtggccccagggttctgggactggaccatgagaatgaaaaaaaaaaaaaacaaaaacaggctaacaagatcttagaagattttatgggcttgtgccgaatcataggagttaggtaacgcccaaaccaagcctgagtcagaaagagagactttcacagagattgtgtgggcttcaaaattgcagacactttccaagttccttcataccgtctccatctcccccagtacaccactgataccacccacggccatagcacagactcagggagctggaaagggaagacacttcaacctctcttctgaggcatcttccctcacagataacattccaaatagttcaaaccagactcctctggctctttgtcaaaccagaaagatcctagttctagattaaatatgccaaaagccacagagggaatgccaggtctcaccaatttagatcatttcttctagaaggctatgaccaagcactttatttgactaacagaggaaatgaaatgtcactagctatatgatagctgtctcccagggtgtgctcaaactcacgtccatggagtcagtgatgccatccaaccatctcatcctctgtcgtccccttctctttctgccctcaacctttcccagtatcaggatctttttaatgagtcagctcttcacaacaggtggccaaagtattggagcttcagcatcagtccttccagtgaatatt

SEQ ID NO: 57185 - DNA, 1453 bp, Bovine  19866881049708
cagcgctggtgacctgctctcgactcctcatatacactttcctggggaaatggcaaatagcaagaatgcgtaaattgagaaagattaatataattacctgagctatttcttgtcatcttttcatatcagcaataatcacaaacctttcctggggagaagcctggccatgatggactgtctccccgaggcaggcagctggcttcttctctgcaggaagcagagccttgcagacgccccgttctggaagccagccctgacagatggcttggctgtgtggtggagagggcatggggccttgagtcaccagatgtggattcgagtttgggctgtcaccactctgtgtgtgacttggaggtccccacctctctgagctcgagtcctgcccagtacgaatctagaggcactgatcacaagtccagacaccgtggtaagtgcattataaccttgatggcaaggaatctgggaaacccctcccctctcaacgatgttctgttattatccccactttacagatgagaaaactgaggctcagagaggtgacgtcactggcccagggtcgaacagcacagaagaagatcctagggctgtggccttagtaggtgctttgtcattcagtcgctcagctgtgtccgactctttgcgaccatgcagactgcagcatgccaggcttccctgtcttcactatctgccagagtttgctcaaactcacgtccattgagtcggtggtgccatccaaccatctcaccctctgtcgtccccttctcctgccttcaatctttcccagcatcagggtattttccaaggagttggatcttcgcatcaggtggccaaagtatgggagtttcagcttcagcatcagtccttccaatgaacacccaaggactgatttcctttaggatgggctggttggacctccttgcagtccaaggggctctcaagagtcttcccccgccaccacagttggaaagccttgatacccacaccctgccgcctggccccgccctgtccctgtgcccccagaggacagaggggtgagggcaggggcccagctggcagtgtggccgcaggacgtgtgcgggactttcgcttcagtttccgcttctagaacgtggggctaggaagggcaccgcctgcggcagctgatttgaggatgccaagttaactggtgcaaagcgctctgagcagcccctggcccgtggtgagcccgttagctgggctgtcatcctttcgcacaggggccctgcccagcacctgtatctgagacgctcctctttagagcgtttagcgcccaggcacgtcatgggccctttgcacccctcttagagacgcggagctcagagaacccagcagtgtgcgcagaaagtgctgtcggttctggtgtctcagttcacacagaccctggtacccgcaccaggcgttttgggaaaacactgtaagagcaaagtgtggtgaa

SEQ ID NO: 57186 - DNA, 1611 bp, Bovine  19866881073664
ccgctgccctgtgtctggcttcccagacctagaagacatgtctgtgatgattctgcggacacaaggccccaatgccctgtttgacgaccacaaactcgtcctccacacttccagcgctgacgccgagcgggcgcgggtgttccacgcctgcggtgagttgatgccctccttccctgcccggggggtgggggatgctcagtttccctacccaggctggggtgcaggctctgctctggatccagggccgccttgagggcccagaggaagaagcatcagatgctcgagtttcacgactggttgcctggtgtccctggcacagccgtgcccaagatggttttagcagatgaatgcatttttaaacatattttaagcacgtttaaaaattttgattatcaaaactttcgagcatacccagaagcataacactgtgaagaacccttatatgccaaccactcagattcaacaaggatcgctattttgcttctcttacttgatctgtcctttcttgtttgctgaagtgtttcaaagccagtcccagacaccctggctcctatgttcagtctgcatctcccgcccaccccgataaaccccaaaccattgctttacatagctacagtgtcattatcacgaatgcaagcaaggatatataatacttcaaaaaatacaaatatgtatttgggtttttctgtaagatgtaacttttggggcaacacaatacgagtagtaatatgctcattttagaaatacggaagtatgtaaagttaaaaatgagagttctctacccaactccaaaacctgagtcttaacacgtgtcctctgttggccatttcgtgtgtgttcttccggacatttttttatgtgcactgatcgtgcttggtgcgtgcgtccacattctgcggtccacattctgctgtccacatggtttctctcaccgagttatgcatccttcacgtctctctgtgtgtttgtttagctctgctttgccttcctccacagccgcgtcctatttcaaagcgtggaggtgctgtaactgatctggtcccgtgaacgtacggtttttgtggtgttttgattttgcagaaatcttggttcctggagggcagggaccgtgctcacagcggtgtcctgagccctgaaccacacctcctaggggcatcgtaggtgctcagtaaataatctgtgaacaccttccacttgtattttataggaaagacacttacctagacagggacttgctgcttaggggtaaacattgctttgctagatgccaccgaattgccctctgaaagatctgagcgccaccttagaaaggaacgccctccctgccccacccagacctgcccgcactcgggtgtgagcctctctgtcctctgcgagtgggaggtgggaagcgggggtggttgtgttggtttccatcgtgttggggaggctgcgtgatgcctcctgctcccgggcccctcgcgaggcccctctgcccccgccaggccccagggactcctgcgaggcgtaccggcacgtgctcggccagaacaaggtgtcctacgaggtgcaccgcttccacggcgatgaggagcgcttcttcgtggagggcctgtccttccccgacgccgg

SEQ ID NO: 57187 - DNA, 879 bp, Bovine  19866881120705
tcagtcactgttgtgcaggagtgtggtctctttattcctagacaaaacagaatcaccaagactgctcccgccttgttcttctcaaaagaacagccaccaagttccagggaccccgggcggggcctctgctgccatctggcatggagacagaaacaccatttccacatccacaagctcgcgtcctcaaagagcggaacaaatcccacaggggtgttgattgaaaccatcatggatccgtggagacagcacgccggctggagatgggagtcagctgccgctgtctgtttccataaggtaataataacgcgtgcctctgccttatgaagtagaatttgttacagccgatgagccgtaaaaattgccgagtgggggagaaaaaagaaaggaaaaaaactataaataaatttgtaattttaacagggattaccatgtaattgagaggggaagactgctaatggcagaggcaaaggccaactcaggccccacagccttagccccacggcaaagcacggtgctgaagcagtttaggggcgatgctgggagggaaagtcaagagacacaaagccagggagcagacacaaggaaaagggccgagaatccgtttggtagctgcttactgagtgcctgccacacgtgcctggcacgaggcaggaggacacagagggggacgcccagtgcccgttagtgggcaccatggcgggtctcagacaaaagagccatgtggttggttttttgctcgaggactctcaccctggctctcatatgcaaaatggactggaattggcaagagtggggactgagagatgagttaggcaaccgctgccgtgacttaggtcagaatgagtggcggcctgaattaaagcggaacaagaggagaca

SEQ ID NO: 57188 - DNA, 999 bp, Bovine  19866881156656
ccacagttcgaaagcatcaattcgtcagtcctcaaccttctttatggtccaactctcacatccatacatgactactggcaaaaacatagctttgactatacggacctttgtcagcgaagtgatgtttctgctttttaatatgctgtctaggttaccacatatcaaacaaaacaaaattaaaaagcaacccgcaacccaagtactgacgttattcttgccttttattccagcatctcccagagctccaatatgtacaaccttcatttatacacatataatatacaccatatatacgtatttatatatattcacacaccagcccacacgctctcatacactcacacgcacacacccctccaggagggtcgtgtggccgcccttgagccccgcttgggcccagacaagaggcgctgggcttgccaggcagtcgtgaggttttgtgtttttttttttttttttttgcttttaaaaagaaggtcatctcctccggaggtgtcctccatctccccaaacccaaaccactcccctaaacactgaaattgtttttttcttaaaaaggaagaggtttccctctgctccgctcaggtacatggaggagttccaggcccgttctcgtggccccgtgcaagccccttgagggcgaggccacccagtgctcctggggaccctggacccccgaaagggcccactgcaggccgagagtcgggcgggctgcagacaggcccgccgccacgtggcacgggcggggctacggcgaggcctgggcggggctacggcgaggcctgggcggggctacggcgaggcctgggcggggctacggcgaggcctgggcggggctacggcgaggcctgggcggggctacagcgtcaagggcgcctgccagatgaggagggtgctgtccgtctccccgcacggggccggcttcccggggctgccagcggcgctgccgaagttgcggtagccgcgccctccagagatgatggccacggagcagatctc

SEQ ID NO: 57189 - DNA, 1531 bp, Bovine  19866881177631
tggacgctgtaggaagtaaagaggccagtggttcctgcctcgatgtccccgtctctggtctgggaaggcggcttctgacagagaggtggagaggatcccgtggggcgcccctgccctcctctgtgggaaagcaggactggggagagccgcacacctgggagcaaggtctggggctggcaccacgcagccagctgtctgtgggcaaacagctgtgctctctgagcctcagtttcttcatctctagaatgggcacagcagtggcatcgccaactattgtaagtgctactagagcacttacgcaaaagtgctctgcacacagtaggtgctcgtgaccgttagtgcacctcgctcccctgctctgcacacagtaggtgctcgtgaccattagtgggcctcgctccccttcttggagtccaggaagccctgtgagcagagccccagcttgcacgccaagagaaggcaggcaacggggagtggcaggctctgccccttgccctagcagagctctcgatcccagggccaccccaaaccctgtgcacagcgagctgcacgcgttggccctcaaggtcattcccttgtgtccattcctgagaggcacctggggcctcacttctcagagagtgcctgtggaccaggagccccagcaccccctgggatcctgtaagaaatgcgcatcagtgtctgccctttaacaaggtcccagggggttcacgtcccccagccatgtttgagaagtgctggatggatcctcgtccccatggtcccagctcacctttgctgctgtctcctgggcccagaggtcaatgacaggaaggaacggatgtggtcatttcagacccgcagaggagggaggagatgctctggaagggcgcatcacttgggatgcaggtacttcttctgggatggcagcctgcctgtgcccccacccccacttgcccggtccagggggccgcaggtataggggactgtgtcatcacccagcgagcagccctgggaggtcagactgcaggacagagcctttgccttcccaccagcctcctcccactcccctggccccgtgtctgagggggcgagcggcggaaactgacgcagctggggccagccagccggtaatgaggcagatccaccaagcagctgctgcagaaggcgcattaaagatgcttgatcccactttaataacctgccagcctgagcagccaaacgtggctcagaagttgtggaacaagagggtcatttcttattatttttaataaagagcttttcataactgacttcataggtgctattaacatgccgcatgtttaataagatgacatggtaacaagggggcttcctcgttcctcatgtgccgaagaggcaggagcatctgtgggcacgtccacagtcacatgccagcatgcaccacgcagctgggagtggtccacaggcctatacacagggctgcctgggcacctgtggacacacgcgtgagcgcatgcgtgctctcacaggtgtatgcatgccacacacgtgcaagtgcacgagcctgcag

SEQ ID NO: 57190 - DNA, 810 bp, Bovine  19866881220533
tctatttttgaacacattaataaatctcagcacaagtacaactttatatcactgctgtaaatagaaactcaggatcatatgccatcaatataaataaataccatggaactaaatcactgttaattaaattctgcctgcagctttggcaaaggccatgagtatgaggctctcggtgaaaaagggaaaagttaaaaataaaaaggagaggtgcggaagagcagcatcaagagaccttctcctcggtgtcatcacaaggactggaacagaactggaaatggttaggttgctcctcccgtgacttgacgttattgagggcactgtcatctcgctttccacctgtggtcatgctgaaatcacactaaatctctcaaccagagagacacatcccacaccttggggagcccaacgtaagagcttacttttccccataccctctgttaatctctcctctaaagttttattatccatcccccggcatgtttatcagagtccttctgtataactcctccatttttgacactttaagctttggaatctccgatgaggtcaatggatgttcaaagacactccgcattcctttattaattaaccaacatccagaaaccagtgaaattcctatataaatactttattcaccaaataagggcagagacagctcacgtttactctcccatcttgtgaaaattcaagtttgttttttaaaaacatcattttaatgattaagttatgaacagttacttataaatagttacaacttgcctgtcatctgtgtcaacatttatgacttaatgacacggtttttatgctatt

SEQ ID NO: 57191 - DNA, 830 bp, Bovine  19866881390837
ctagcaccttcattcccggactctgctgagctgcctccttggtctgcctcccacagcttctctggtcctggatctgactcttggtcggggcccagggcagctcccagaaccccccaagacatcctttaccgctggtccgagggtaagcggcgagggtgccatcctgcaggccggccaacaggtggaaggggctgtgtcgcaggcagagcacgggctgcaggcctgggctccggcaggccgccaggcactgggtgcctgtatccacgctgctgtagagcaggatgctgcagggagaggcggtgactcactcagccccccgcccttctggcgagagggtccagcccccacctccaccagctcagcctgcctccccctgtgtgaccaggccatcgctcagacttctccatgggcagcctttagggggcagagccacggaaaacagggggctctggacacagcacagccagggggctgggagaacggttttcagggtcacatctgagggcaaatcctgctgactgtccccctccagctggctggcctggaccactgagcctcagtcctctctgaaaaatggggccgtgatgcttacctcacggccataccaaggaacaaatccccagcgtgtggactgcctggatgaagcttgaaaacgttagggggaacgagagaggccaggcacaaaaggccacacactgggtgggcctgtttggatcatgtgagcagaagagacaaatccagaccaatggatggggaatgtgaggtgatgcagaggttctgggggatgtgacgagaatgttataggaacaagtagtggtgaggatacgcat

SEQ ID NO: 57192 - DNA, 1188 bp, Bovine  19866881392698
tcagggtgccctggccaggagcgcatctgatccttgtcagttatcacagtgaatatgtttgacctttaatgctcttgtaaagcagcaggtcggctttgcaatgccttctaaaggtgaggacgccaaaggggggaaggggcttgtccgtggctgacccagccgtggcctccccagcccttctgactcccagccttgggggtgagtggccctgtcacctggtgaggagctgcccgaggcttcgaggagccagctgtctcgccctcctggctcacggccccgtttctcggcctgcaggaggccggccgccgtgagcaatggggacgctgtggacgcagctttctccgaggtccagcgctccggctggaggcggaagagttcccgtcgcagtaagtccccctccctaccctgccccccaggtctcagccccaggaggctggtgccaggagagccccccttctctaggccaagggagctgattcgggctcatgctccctgaggggctgtcctcgctacatgggcttagtggcagctctgaggcagacgggccactgcccacccatgagacttgccccctttgccaccctggagccatggtcccggagtagatcacacatccagctgttcatctgtccccttccccctcaagctcctacaggtcgatctgggtggtgggtgttccccagtgcccaagatgagggggtccctctgacagcagtaccagacacatgggtgggctcttacggtgcagagagcaggtgccaggaggagggtgggagctgagagagcccacgaggaccgaggcagagtgcagagaagcaggcgtcagggccagagtgttcagattgagggcgaggggacccctggcaccggggaagcagtgagccttggtgtggtggaggggagggtctaggggtgagcagggcccggtgaggctgccatctccccaggtcctcccagggtgtgtgggggaggccttggaggccctgctttcccgaaggtgccagggagacagccatgcggccatgtctgcatttcagtcacatcactgatactctgggagaaggtagtgggctggaggctgtccaggggaggcaggtgacatctggagctagggacctggagagaggtgggcgggtctgagggccactttgggggcagaatctgtgttgatggggaggggcagtgagg

SEQ ID NO: 57193 - DNA, 1193 bp, Bovine  19866881493943
cctagcggtcaagagcggggaccgtggaggcggcccctctggctctacacctcagtgccgctgctacctagctctgtggtctcgagtgcttagcctctctgagcctcagtaaggagggaataatcatagtactcgctcacaggagtccatgtggattaaatgagcaactgtgagaagctgcggggagggcctggaactcagggcgtggtcgctggagcggctcttgccgccctcctgtgcccagcaggcagcgtggggtctggcacatagtaggtgttcagaaaacatcaattactgaggagaggccccggcacccaagcagaagctgtgcgggtcctgaggatgcgcgccctccagagggcggtttgctctcccaggagctgactcgtctgttcacagcccctggggggagaccagggcccctcccagaacaggggtgatttgcatttcatctacatactcctccccaagcctccccctaactcccgctcgccagagcccccctcctgcgtccctttgcagcccctgaaggactggggccaggcaagactgcgcagtgggtcccgcaggggcaggcacccacggtggctgcactccgccctttgccacgtaccagtatcctcttataagggaaatccttcaggcctctgtttcggggggagtcgaagaccacggggaaggctttgtgcggggcctcagtgtagccaaactccatctcatcctgggaaggcgagagaaaaaggcctctgtgaccgcctcggtctcgcattgagaaggggctagcgccccaggcccggggtgggcagggcagcagaccttccccaagacctcgagcgggcaggaggtccctgggggacccagctgggggagggctctgcctgagccagaggccccggtggggagcaggacacaccgagcgatgccggccgtgggaggagagggctcccccaagccacgcgcccaccccgagtcctggtggccggcccagcttctctagggagacggaagctgggcgagagccgcagaggccgctccccgaagccagggtgggggacggggcttgggctgcccccccgcgcccagggctgctccttgcccacctggatccagcggtcatttcggttctcaacccgagggcagatcatcagcttgcagctggctttcagcgccagatcagacatgtcactcagaaa

SEQ ID NO: 57194 - DNA, 1413 bp, Bovine  19866881531935
cagccagaaacctgggctcctgcctccccacgagaaggctgggttagaggaggctgtgtgtctgggagaagccatcagggcgctgccaacagaaggaatgattgtcacaggttcatttcccgaagtatcatcccctcttcttggagattgcagtttggtcattaataagggctgtgttccccagccttccatccccacctccagttttggagcttcctccctctgctgcaatttaaccaagtaatttattagctaatatgtgcccagaaggtatttatatcaaatgtgcatttggaaatccagctgcatctgaagcgtgggtaacaagctgctgacctgcctggagatcaggttgcatctgagacacctgatccggcagaactcacctttcctcgaccctgaatgtgaaggactgcagcctgctgtctccagactgggagcctcttggaggcaggggattgacagatgtgagtattgccattcccactcttaaaacctttcagagcttccctaccatctactcaggcttctccttccttctgtctacccatccatccatccatccatctatccttccatccatctttccatccatccatctgtccatcataatttgctcattgcttcatttaatgacagcttaacttattgggatctaatttcttatcctccaaagcacttacattttaatatatgcagtttctctctctaatacagtccatctatatctatcatctactgtcattattatttattgcctttcaataagccaatatttccccctgtcccactagaataaaagacccacagaaggagaatcttggttttaattactggtactctaagtgccacccagtaggcacttaataagcaattgttaagtgagtgaatgaacatagatataacgtgaagaagatacagatttacaggagtaagacaaaactggaaacttcaatgcatattaagaaatattgtctggactcctactcacgatattccttccatctgcctttagtgctccttgtgaggaaaagtttgaggtcacaggccagttgggaggaatccaggcaccttacctggcattctgagctctccagcatctgaaccctgccctcctgtcctgtctctgttcacagaccatccagttggttccagtctctcacgctttgcacacacactctgagctatctttccatacctcagggcctttgcacacactctttgccttacaggaatatcattcatcctcttgtccatttggaaaacattttgcatgctgcttgggactaggttccgattacacctccttttgaaagccttcctagtcttcattcttcccgttcggggcaaaattagactcatcctctgcctctatgactcccgctatggaagaatatttcgcatgatgaattt

SEQ ID NO: 57195 - DNA, 1013 bp, Bovine  19866881736190
gacatactggaacccaaaacctgttggaataagggaggcgttcaagagaggagggaggaagaaaagagagaagggggaaaagaaaggagggaagaagagaaggcaggagggaaggtagggaggagggagagagcaaggaaggaagcaggctgtgggctctcaggaccagggagccttgcttctctgtgtgctgacccagccaggcctggccctgggatttgcacttgtaggccaaacactaagtatctgttgaatctaaatgaaggcacaatcaacctaaaacatcagggaatggaatcccaccgaaaacttcgggagaaggcctgatgatgttattccagtctcctccagctatgactaatggagttgttgttttaaatacagcttatcctggcaaccccataattcaaaatcatgtacattggtatgtttgtatgctataaaaataatcacattaggacctgcagaggtgggggggaaagctctgcactctcttcagaagaaaagacaggagaattagaagaaacagcagtaatattttcagttgatcagcgagtcctgctggtgtggttgaccagatggacagcccaggcactgttccataccaggaactgcaggggtcagaggtgccagggaaagggcagtggagggtggagggttggcttctccacagacacaggcagcagaaatgagactgcagcaaggctggtacctgctctggcctcagttttccaacaggaggaagtggaaccccgcgacagaagcaatgacatgccgtgggtttgaccatcagctctgggatcagacaagtctgagttcaacctgagttttgaggcttggcagcctgtgaccttgggcaagtgacttgacctctctgagcctcagtttctttctggaaccatgagggtggtgatagtatatctacccctacggggctgctgtgagaaataaggccgtgtgaagtccatcacttagaccctgacactggcaaatacttcaggaatagtatgtat

SEQ ID NO: 57196 - DNA, 805 bp, Bovine  19866880207325
attttaaaagtacatagattaaaatcttagagcttaaaagtaagtgggtatcttaaaattcttctagtcaaggctatggtttttcctgtggtcatgtatggatgtgagagttggactgtgaagaaggcttagtactgaagaattgatgcctttgaactgtggtgttggagaagactcttgagagtcacttgaactgcaaggagatccaaccagtccattctgaaggagatcagccctgggatttctttggaaggaatgatgctaaagctgaaactccagtactttggccacctcatgcaaagagttgactcattggaaaagactctgatgctgggagggattgggggcaggaggagaaggggacaacagaggatgagatggctggatggcatcactgactcgatggacgtgagtctgggtgaactccgggagttggtgatggacagggaggcctggcgtgctgcgattcatggggtcgcaaggagtcagacacaactgagcgactgaactgaactgaatctaatttgcaggactcatatcttcagaatatgtgataaagaatcatctacctactgtttcgaacattccacggcagagagcttactagttcccccaaagaagcccattattttattgtgggaaagctttgatcgttgggagtacagtctaacttcttacagtttcactagtaggtcataatcattacctcaaagcaacagtaaagaagcctgtgctatatactacataaaggcccttcaaacatatttaaatgtgcagattcaggatatggttcaaaggaaataaa

SEQ ID NO: 57197 - DNA, 1080 bp, Bovine  19866880357873
ataaagtaagcagagctggcgaagttcacaagcatgaacagcatgctgcaatcacaatactgagcaggatgcaaaacacgcccaagacctgacgagtaaatcttttaatctctctgaactttagtttcatcaactttaaaataaaaatatcctaccttgcctgaagagttgcgaagatatataccctttataagggtataaagtacctggcatagaatgtggggtatagtaggaattcactgaatgggagaggtactgatggtggtgatgatgaagaagaagatgatggtaatacagtccctgtatatgcgctgatgggtagagttgttgagttaaaatatagagctgacctctttctctaatccttgaaagaagtctgaaaactttaaagaaggtcccttttgacctatgactggatctatggtttttaccaggaagcccacatcccatccctgagattctaatttattcctctgaagacggggccctggctcctgtctgtattaaatgttcctctggtgacgtgaatccactgtcagcgctcagatccgctgcttagcagaagaattaattcatagctccctgtgtgagactttgccattctttagttcttcgaggtaacagactggctgcattacttttatgttcttctctctgctgactgtcaccctagtcgcatctgagaccctgaaaccatctttgagatgtgtgtcttattggtgcgcttcctcgcctccttttctcttgtttctcttatgaatctctggctgttgattgcacaagatgtgcttttgttccgcatttgttgcttggcttcagtatgccggctcagtcttcttaaatgtcaccttctcaatattttcttcctatttctcccagtgtttttacttttccatttaaaacaaacacaaacatggcaactcctgcagcctctggcagctggcagtctgcgtgcctggctgctcccaccttggaggtacagattatcctggcagactgctgaaagctgttgcggcttaaggagcagcggtttttcttctctctctcttttaaaaaatttaaacatagttactttctctt

SEQ ID NO: 57198 - DNA, 1166 bp, Bovine  19866880417847
gttcctgcagctggctgagggaacaggagccagcagaggagtatgttagaggcttagtggggggcagtgggccccgctaaaagttaatatattgagaacttagcttgagtctgtcccttcccaattccaaaagtaggaggagtgaagaatgggggtgggttagtgaggcctttagtggaacacctctttcaccacctcagccccatcattttagaaagtcaagaccagttattcttgccagtctcatctcagtgcttcctaaagaggctcttgagtgtttaagagatgaaaaaaatgcaattatgccaaacagtattgagcagaataatttatttcttttgtcgtcgttgttcctttttcttcttttgtttgggttttgttttgtttagaacattaataaatcccattctggaagaggtaggtcccagcacccagcccagatcttcttttctacaatagttatttaagcaaatgttttttattttcttccctttctctttctgaattaaaaataagaaactgtatattcacttgttcgttttgaaatgtgtttgatggtgggaagaaggtcaatgggaagctgtgaccaagtaatggtgaagactgttgggggcattgctggaagtggggaagggacgactcccagacacccatcccttatacatgaagcctcccagccaccagctgtgccctctgggagggtggccttcaccactgtctgctgtgtgggcccagtgcagcatgcagaccccacagtcacctggatggggctttccctgctctgtttctgggttctgtgcaacttcccatgatgccataggtgtgagttggcagggaattggcaaaatggttggagctggtgccacaggcgtccgaggtagctgtgctgtttccttaggctgtctggatctacttgactgtaactcccatcacgggctggaatgcccctgaacgcatagctctgctgtccggtggatgagatagctcacaccagctctcttcagagtctgtgctcagcttggcgtcctgctgtccagtttctcccagtgcccaagagtgagctgagtgacttttcaaatggaagatactttttgttggaggagggcatcactttttggaagtggtggagggtttgttctaaaactgtaggtctctgggctgtagtt

SEQ ID NO: 57199 - DNA, 661 bp, Bovine  19866880444382
cagtttgttgatattcacaactgctctaaaaaataaagcctattttttaaaataaaaatctgatggaaataaagatatctcaaagtatgcctgattctcatcagaaactagacaacttgctttccccagtaagttcctatcctccaatttaggtacaatcctaaggagaaatgagcagtgaaaaaccttgattttggtagaatttaccctgaaatgagtaagtaaatttagaatagtgtgagttcattccaaaataggaaaattaaaatttctacttttgggcaaaatatgattatgacagaataaattaagttatgcaaatctgtgcattgaaaaaatttaaacctgttaacagtcaatctgaaaaataaaaaaaggcgaccaaccttaagttgaagttgcccattttggggaattctttcaaatatatagtaaatcttctccctgggtgagtcttcatctatggctgagagaactgcactagaaataatacgagtttcgcccatatttattgtaatttcagccttcctgtaaaaaagaagatatctgggttgataccgaaacagcagacattgctttaacaggggacactcataatgactattacagtgttcacccttcaaaaattagggaatggttttcagtctccaaagtactaaaa

SEQ ID NO: 57200 - DNA, 1587 bp, Bovine  19866880541333
acactgggttttgaggatctctgatgaagagaaagagggaaagtagttaacattttcctagtgttatttctgaaggcaattttatcaaaggaaagcagaggactaagaagcaaagtttcaagctttaagcagcgctgaatatggtgacatcacttttccagatcagaaacctgtaaagcatttggatctcctgctcaggtctgtaaaatagtcctgaagaggttaatatctccagcaagattcccaggccataaactccaaccagcccccggaaatgctctttttaagcttcgtaattcaaaccacacaacaagactgcacacaaccattgaaaaaaaggagaaacaaaacttaaatgccttgaaaattatttctgggatccagatgacaactaaaagaaatcatttactacagcacaaaagtctctaggccaaatccagataaagagaagaaagagattaaaaatcagtaagaaacttcagaacaatatgatttctttgcctctccaacactggctttcaactccataaaaaaagaaaccatactttaaatatatatatatatatatataactaaactaaagcaaagctatccaaaaatcatctcatccaaacttttgtatctttataccatgaagatattatctgttttgttaatttttgcattttttctctttgccattttgtttagctgaaaagaaatattctgatttggggggcggaggaaggggacaattcagaatgtaaaaatgttttttcactggtgaatgctattgggggatggattgagaagagttataaatttgtattatgtaataaagagcctcccattggggacatagggctctttaacactgcaatttgccaccttgtgagcttatatgataacttttgcaagcagacttgatctacttcttgtatcattactcggagttaatgctaccacacaaataacctctggggcattctagcagaacgtttacagtcaagaggagaggaaatacataaagcagatacttacaggtagtggttttccgtgccaagtcaaaagctagaaacccttggcgcaggcaggcaggataagagtcactgacccggtaatctctgatttaaagggctttgagaggaagggggaggaaaaatagcccagcgaggggaagagctgaaattccagtctttcaggtcagctgagttttagctctctttgtagtaaaaatccattaacccaccccataagaaaatatagaattgaagttcacatacacactccacagtctttgctggtcttctccgaggctgcagtcgctgctgaagctttgaaaacttcccgattgccaagcccaggactcccagggaaaagggcataatgagggatgcctgcaactgtttgcagggagcccgacctccctggcagagagccacagctctccagtcccttctgccggctggatccgcagggacaaaactgagcttttgttaaaggtcggtggcgtctcttcctagtctctcctcagctccctttctcactattagttctctactaactgctccgccactggctgagcccaagctgcctctcccgctgcag

SEQ ID NO: 57201 - DNA, 1303 bp, Bovine  19866880624143
tatagttggtaatcaacacaaataagtgtttaaaaatcatttctacaaacacatgatgcctttaaaaagatgattcatataaggttcttttcatggacaatatgaaaggtgagacccactttcttttcctttttcacttgagtatagtgtacgtataaaggaaaaagctacactctacccttctttattttaccataatatagaatacgactgacaggagcaactcagaatttatttgcaaacactgctctctctcctctataatcttcatgagattcttcagttctctcaaaactaggtttgcatcttctcttttctcttttcttattgacttaagcttatttcccatgataaaaaaaaaaaaaacctcccctagttgtaaagagatttataaaagctacggatatttctttttccagttcacttttcccttggttctctggtacccagcaccacattcagaaaattggattgggagtttgttttgttttttttttaatctaagaaaccattgatccatgttaagaagattaagccacatatatataaacttctttagcccaggcacataaaaaaaatcaccttttcatgaaatgtaactgttaaagcttcattaaaatttaaatcatttattagggtaaatgtctattatcttagttaatttactttgctattactgacattaaataatgtgctctgttaaattaaaatttcaacaattttgctctttactattatttgattttatattaatccttttttaaaaataacactgattcagttcagttcagttcagtcactcagtcatgtccaactctttgcaactccatggactgcagcacaccaggcttccctgtccattgccaactcccagagcttgctcaaactcatgcccattgagtcattgatgccatccaaccatctcatcctctgccgtccccttctcctctcgccttcaatctttcccagcatcagggtcttcttcaatgagtcggttcttcgcatcaggtggccaaagtactggagtttcagcttcagcatcagtccttccaataaatattcaggactgatttcctttaggattgactggtttgatctccttgcagtccaagggactctcaagagtcttctccaacaccacagttcaaaagcatcaattcttggcgctcagatttttttagaatccaactctcacatccatacgtgattaccggaaaaaccacagctttgactagatggacctttgttggcaaagtaacatctctgctttttaatatgctgtctagggttggtcatagctttt

SEQ ID NO: 57202 - DNA, 663 bp, Bovine  19866880629181
actaacttatttaaataggaacttttaatgaactaggagggtactcttactttataaaatagtttgattttaccttattgtgctgattaatgagctcatgataatagcaatgccttggaaattaaaacaaattattgcgacagattttgaaatggtttaatcataagaaagatttactttctcttttttcgctttgtccaggaatgaggttggtgtatgtgcatgatgattcagagagtcttgctgatgactttacaatccaggtgtcagatgggaaacataagatacttaaaaccatttttgtagaggtcaccccagttaatgatgagaaaccaatgctgagcaagtaagttacctgaaaagagtccatttgagattctataggaagttctaaggtctagaatactagatgcaagtgtaatgtatttcctccagagagaagtctttaataactcctgcctgttgcaactttcccacggacttaagcacctaaaaccttccgtgcaaatgttagttaacataactcctccttaaaatttctcaaattagcctttaattattgggttttcctctaaaagttctatttagttgtcagtaattcacaatactatacatacaatacagaagaacagtgtactaaaatttaagcacatgcacggtaca

SEQ ID NO: 57203 - DNA, 1012 bp, Bovine  19866880720851
ttttcactttcatgcattggagaaggcaatggcaacccactccagtgttcttgcctggagaatcccagggacaagggagcctgatggcctgcggtctatggggtcgcacagagtcggacacgactgaagcaagttagcagcagcagcagcagcagcagcagcagcaaagatgtgactgtagcccaccagcctcctctgtctgtgggatttcccagacaagagcactggaatgagttaccatttccttctccaggggaatcttcccaacccagggactgaacctgcatctcctgcttgtcaggcagattcttcaccactgagccacctgggaagaccaaagatatgagaatacttgtttccaatgctctttgccaactctggtcattatttatcttttatttttccagtatgatggctgaaaaatgataatctaacttttaatttatattttccaataaaaaagccttcattagtcactcatatatctttttctctgatttcctatttatatctttaacgattttcccactgatttgtcttttttagtaaaattgttgtatgataagtgttaattctttgtcggttatgtatatagcaatatcttctcccagtctgtccattgccttaaacttggtttaaggtatatcttaccctctggaagttctaaatttaagtcttttcttaaaggacttctgtattttatgtcttacttaaggaaggaactttgctactcccacattataaagttccatggccctctcacaaagttaaataaggagacagaatttaactgcattgttggcatgtaaggaaaggagcgtgtcatattgagtggtttaatgagtcatgattttgttctttttgtacaaagtgttttatgtatttttccattaggttattatctccttgtctaatatctggatgatcagctttatgcaattgacttataggcacaagagatatttcgaaaatgcatttcagttcaagaagaatggaaacagtttcaccatct

SEQ ID NO: 57204 - DNA, 1254 bp, Bovine  19866880740914
aactgctctctagaaatttaacttctccttcattatatcatcatcttgtcaacagccaatataaaatacattcacttaaatataaagcaaaaatttgtaaggtatctaaacatgaagaattacagataagtgaaaggactatacttgtgtacttttttgttcagtcactcagtcatgtctgactctttgtgagccacagactgcagtatgccaggcttccctgtccttcactatctcccagagtttactcaaacgcatgcccattgagtcaatgatgccactcaaccacctcatcctctgtcaccctttctcctcctgtcctcaatttttcctggcatcagggtcttttccaataagctggctctttgaatcacttgtctaaagttttggagcttcagtccttccaaagaacattcagggttgattttctttaggactgactggtttgatctccttgctgtccaagggactctcaagagtcttctccagccctacagttcaaaagtgtcaatcttcagcactcagccttctttatggtctgactctctcatccataaatgactactggaaaaaccatagctttgactatatggacctttgttggcaaagtccatttagaaaattattaaaaatagaataaaaatagagactctttggacaccctcaaagcttcaaattctccaaaagcagagacctgggattatcaaaagtatccacagagtagctaagaaaaatctcactgtaaaactagcctaaaacagttttatatttacaacattaatcagtttaaaaataagacattggggcaagtaagcattttacaagaaaaatatcaattctgagttatccaaaaacaaatcctaaaggttggcattagacatttcctcaattgagtcaaaattgacttatcaagaatcttacccacaaaaatcactgttacctagcacttcttcatacctagaggcaattaaaatgtttttagtgatgaccacagacttttatagcatcctaaagtgacttctaaatgatttttttaattctaagtatatttagaactttaaccctgttctaattcttttctaataggctatctacaaacacatattaaaaatgattatataaaatatgattatactttatgagtcttctgcctcgaaaacaattttcagcacaaaaaacaagctaaaaatattacttaaaatataatctcactttcaatttttttcctttagccttatataaaataagaccaca

SEQ ID NO: 57205 - DNA, 772 bp, Bovine  19866880822695
tgatttcaagactgactttataactacatgtaatccagacagcgtatgtttggtacaggaataaacaaatagatcaatggaacagaatgaaagtaaaagtgaagtcgctcagttatatccaactgttctgaccctatgaactacatgtagcctgccaggcccctccatccaatggaattctccaggcaagaatactggagtgggttgtcatttccttctccaggggatctttgcgacccagggatcgaactcggtctgccacactgcaggcagactctttaccatctgagccaccaaggcatcagaaatctctatttctgagagttcagaaatagacccacacaagtatggcaaaccaattttgaccaagcagtggagaaaagatagtcttttaacaaatggtgctcaccagactagttcagactttgtatgtgatgcccaaggatcaactcaatacaaattacagatctgtcacttgagaaggtcactcaagtaactcatcaaaatgtctatgtgattatttgaatgcttaatttttaataaaatgtagacacagcctgagaatagcagcaaggatttattctgtgggtaacagcttgattgtcttagattgtgggcaccatagagaatcgaagtgaagagaaatcactgatttaaactgaggtgcagctgtggccttatttcatttcagagagtaatgaagcagaaatgcagtaagagctcacacatttgggtggcatgggagcgaaagtgttttggttatgtaaaaatc

SEQ ID NO: 57206 - DNA, 1670 bp, Bovine  19866880828731
aatattacatgagggcctttccccaaatcaaaggatgcagcatcctactggatactttctactcttttctcaatgtttcattttgggtatctgggttttcttctgtaaacagccatttgcattcttttgattttgcagaagggcctacactttaaaatgcatcttagtaggtatctggtcattcatactccacattatttgaatgatttggtatataaaatacataacagagaagaaaagcatacatttgcttaacaacaatagcaatggcagcacagcaatcatcagccagctatacgagacacagactgaggtcattcaggaacttgaggatgggatgaaatgccttagaaagtccccagctcttctattcacagcctgtaaagaccagaaacacaacttacctttgtaaatatgagtgccaggtaaggtctactagaatgtctcgtagttctttgaaatcatgttttcagggctcttaataagtaagtgtctgaactacaacccagaacaaagaagcacaacctcagtggctgttccaagagacagcgcagaagccaagcctgagggcaatcgcctgctctaacagtgaactacctctgtcattctgaagctaagtgtaagacaaagatgggaaagaggcagccttagcctaattgccaggtcctctccaaggaaggggctactgtcagaagagctaaagtggctggagaatcggggattgcttgcaactttcatgggagaaccaccaaaaggctgtagcttgaggacagttggtagctagagggctgctagggttttctctcatctgggagagaaatcactgaaattggaacaggagacatcttgctttgaactaagctttacaaacccttccttcagagggcaaaagtttactcaagtcagccagaaaccaattttatgacgaaacaagtgagaaaggaaaaggtgacatcaaatcagtcatgcttctgaagatttgggaagacttccaggaatcacttttaggggaatgaaaattgaggatcaagtgttgatgggaaaagtaccataggggatatggaaaaagttcatctggaaggaaagatgaaatagttgctgagtttgagttttcctttggcttgaacatttaataagagccttgaaaacagattctaagatagaatcttagaataagattagaataagaaaatagaaaaggaaacaatagaaaatgtatagaattcaagatgcggaaatgtgatagccactacactgaaccacactggggccagtactccacacacagattgctgaatatctaagggacagcttctagtcctgaaggcaagtgaaccaagatgtctacaagaacatcacatcagtaacgatctttattctacagatgggctgaacctctgcaagtttccaaacataagactcctttccaagagccacggtttcattgacagtgaacatcttacagctatttttaaaagaagcattcatctttctgatagctagtcagtaagttacctttcaaggccaatttggccctgggaagaacacctggttgagaaacagtggaagaggaatgtgtcctgtttttactggagaagagttatacataagtctctcacaaggactaaaaaagtcaaatgcctcaaggaccagaaatgtcatgtaatata

SEQ ID NO: 57207 - DNA, 2536 bp, Bovine  19866881086744
tatgttatcttttacggaaaagatctaagacaagaggaaagaaaaaaagctggctccaggtcataccaaaaagacaatctaaagctacaaataaagaaaggctgtcacagatgaaaatggcaacgaataagccatttcatcctttgcttttatgtgtaacttaaaagtttcaacaatagacgcagccatgcaaactctagttcattgatcggtcgtttgaagtcctccttggaaggcacaggctgtaagaaagcttctggacagtccggcgtgccctcttggcggccagtcgtgtaaaagagctggagcttaggttttgttttgttaagggctacatttaccacacagtattagttgccagaagtttctcgacattgaaaagatgggcaggaatcttagcccgccaactccaagatcttccactattgcatcatttgaaatgaagcctcctcaggcaacgacttgtaaaattcaagtcaggtaaaatggcagcagctgctgccggccggcagcttcaacttcaagagcgaataagagagcgtgtctctgcggagctgccaactgctcacagcaagtcaataaatctacaggtcctgcgcgcgcgcccgagggtgctcagaccccggcgcgccagccacaggaggaagtggctaattacttaaagacagtacagagaccgcagttgaaggtcggagtcggttctccccgcgccttccctccgtctaccacccactctggaaatctgatggtgaaagcaccaatttctaggctgctgctccaggcccctagccctccgacccaaggacagctctgccttgcccgctggtgcagacaaccggagggctccttcttcctcctgctggccccctcctctcatcgactgcaagcccttcgattctgccaccgaaaacttccatagaaggtgagattcccagatcaggagacggttccacaaactccaaagcgctagtgtcggaacttcagggtcagaccggtaatgcctaggcgtccctagtaaagctcagaactgctctatactgcgggtcctgcgttccgcgcgctcgcacccatccactagccgcccggacgcggtgccctcgcttcccacgatcctaggcgtgatgcttggaacctcagcagcgcctccaatccgagcgccgcagagaccctcctcgctccagcagggacggacttcccaaggtcgggtgtccccactcgcaacccccgtctcctccggtcgggagactgtaggttccagacgggcaaccaagggggcggggccttggccgtccccgccgagctcgctcaaccctgcagagctcgctcacccctcccgggctccaggggtagtgcccacactccccaccggccagtacctcgtccacttccaactctgctccgttgccgacgagcgccatgttcctcctccggctgccgccgcccaaaaaccaaacagggtgctcggaaccaactcagtttctcagcccggggctcagcccagcgccagcaagggaggaagagggcggcccagggcccccgccgggtcccgggcggggccagcgcgctgctgagcaagtgctttccccgcccccggcgcctgcacatccgccgagcatccatttctcaagccggcgccgggtggccccctcgacataagctccgccccttgcaggcctcgccccaccctctacgaggctctgactagagaagccaatcagattcttgcaacgcgtctccacctccaggcagcatccacttcggatccacttgggcggggtcattccatgggcggagtcactttgtgggcggagtcactcgggaacctcgcaggtctctcgcaccctgtggaaaggtattgaatacctaggagtattctagcgctctgtgcggaggctattgctcgccaccggccaagagagcacaaacttagcgtggccaaaatgaaagccacggtatccccgaggcccatttgaagtgtccacctggtccctgagccaatgccaagtcccttcccccgccaagtgggcactgcgtctcgcaaatggcgaggcaacctcgcgtcaaggtcaccagtcacccagaggtttttgtcattccacctacccagacactgagggacatcgtcttctcatacagggatgatatgtttgcttctgtgtatgtctgataaattaaaaatcatgggacagatacttatgcaacttagagttctcttcttccaatatctgtcacaatgaccccttttgtaatcccaaatatatgtgcataagtcgtgtttaaactatatacccatgagggtagggatgctgtgtcttcttgaaagttgtattcccagcacctagaacagtgccttgcagtgggtgctccaaaaatattcactggcttcctttagaaattgattcctgtgtctaacacaactggaaaattatatgctgtattttaggggtattgggggggcattagtcagctttgttttacatacaataaaattcaccaattttaagcttctaacttgataaatgtttacaaaacacca

SEQ ID NO: 57208 - DNA, 660 bp, Bovine  19866881099278
ctttctttagcttttgctcagggtcactttctccaggaagccctccctgaattcgcctgcccgattccataggcgctaataatgggcgtgagccactgtggctccatggtaaagaatccgcctgccagtgcaggagacatgggtttgatccctgggttgggaagagcccctggaggaggaattcttgcctgggaaatcccatggacatacagtccatggtgtcacatgagtcagacaggactaaacaacaacaagaacaaactaggtaggtctttttttgtgttctctgttgtccctcattccagctagacaaactcatttttccaaaataccttcattcagttgctatgtattccccacactgtgctagacaggaagagttcaagagtaaacagacagacatggagtgatagtccagtgcagggattgttgattcacaaaaacgggcaggggccaagcccagcctctgcctgtttttgtaaataaagttttattggtgcacagccacacccatttgtttacatattgtatgagactgtgggtttgagtgagaacggcagagttgagttgttgtaacagagaccatatggccagcaaagcctgaaatatttgctctctggccctttcagaaaaatgtgctgaccctgctggggaatacaa

SEQ ID NO: 57209 - DNA, 945 bp, Bovine  19866881154186
ttttatttgcctaaatggccatatttgaacaattttgcttggtggaaatgacatggagtttcagttttgtgtgtatatgaagcctctagtagaagccgttaattagcattggtgaattttaacagtgaaattatgccctcttgtaattatgtctctagcccctcaaatgaagagagtttccaaacactgcactctaactccatttttaaccagtggtgaagtgacccttaaccacaaaaacactgattttagccatagagatcagagaaggggcatgacagagttagtattgactgttggtttggtttaatcactaagtcgtgtctgactcttacaaccccatggactgtaccctggccaggctcctctgtgcatggggttctccaggcaagaatactggagtgggttgccatttccttctccaggcatcttcctgacccagggattaaacctgggcctcctgcactgcaggcagttcaccagctgagctcccaggaagctcccagtactgactgttatatgtaggtttgtccacacacataaacatgttcagtgagcttggattaaatgcccacagggtgccagtgcttggcactgggtgtgcaggtttcaaaatggtgatctctgccctgcagactttagggtttagaattctgtttctggtgaccctttgttgtgattacagctgaaatggatatgaaatgaaaatgtgcttgatttattacttttttctttctacttctcatctcttctacgtacttcctgtgcagatacaggaagaaatgcacagttgtagagtctttctcaagtcttctttcaagaggatctttggaacagctgactgaaggtaaggggcatttaaagattgggtattttcctttctttgaaaaattaaagcatggttatgctcataaaatccaacattgaagtgaataagataagtaa

SEQ ID NO: 57210 - DNA, 750 bp, Bovine  19866881178103
tagaattaggagacttaaatgagatgatgcttaaaaagcttttaatatggtatctgggacagaataattgtttagctgctgctgctgctgcatcatttcagtcgtgtctgactgcgaccccatagacgtcagcccaccaggctatgagtaaaagaaaacatgtgggtttagttggattcttgccttttgttagggtagcttttattaaacttttttttttggcttttatatttatcttaaagctttatccccagaagaagattcactgtatcacaatggcaaagtgatgacttcttcttttgcatcactttagagctttatctggacttctcttgtggctcagtcagtaaagaatctttctgctttagagaccagggttcgacccctgggttgggaagatcccctggagaagaaaatggcagccctttccagtatttttgcctggagaattgcatggacagaggagccttgtgggctatagtccatggggttgcacagagtcagacacaacttggtgactaaatcaccaccacagagctctatctagtggcaaaagagcgagatttgaggtgtttgtgaaggagagcttgtatcattatgagtgtttaccacttccccttctatttcatcaagaattgcctcatttgcagccttcatcagaaatgccataatttggagctctagtttctgaaaatgagaagagaggttgattgcttatgaatctcagagaatagttgctagagcttctaa

SEQ ID NO: 57211 - DNA, 2148 bp, Bovine  19866881241045
tgttatttttgttttatttaaggtggtgacaaagcccctttcatggggcaggcttggttgtcccagtggataaaaatgatgttggatacagagagctccctgaaacggatggtagggtatttatgtggccatgagcatgtgttaatgtgtggggggagtttccttgtgttgaataggtggatacagttccccacccacctgcagtgacgaagggctcaggctctggggtcagggaggcttgaactgaagctgggtttgcagctgtgtggccttaaccagttgtgtaactttattaaacgacatcttccatctgtcacatggtgagtggcggtgagtaccgtccataggggtgtctgggagtaacccgatacataaggtgcttattattaatgcactgcttgcctaacagcacttggaacagtgtttttacaagtttaaacagtacgagcctatggtctaggtgactttttctactgtttcacaacctttgacattacggtcacttacactatagtagttactgaaacagcatgtgtttgtggacagttttccatctgaatgtaggtttttttagcttttagaagcccatcctgagttacttcttctgtaagtataagcactctttgcaaatggacttttcatacacaaaatctaactgttgctttgttgaaaaggatacacaaaatctgatgctttgttgaaaaggaggataaaatctctcctgagcgctctgcctgtcccctgcccttcccctttccttttctcctgggaacacgccttcatctggctcccttgggaggggaggagtggggcgtgcaaacaagagggcatcgggatcagaaatgttaaagcactgttttttctaatgtggatacatgttaagcagttttctctattttacctcaaattgcatttgtgctgtggccccacacccccatgttggtaaaggaattggtaaaggtttaattccacagtgatttgtctctcgtatttttctgtactgctttttaaaagtaagttagacaaaggcaaaaagagcaaactttactattagggtttttttttttttttaacccagcttctggtgtggatgagcctagagtggggctctgtgtatgctcggtctccatactgtttttgatttttttcaaccatttaaaaatgaaaacacattcttatcttgaggacagttaaaaacaggtgggccaggcttgtgcaccctggactagcccagggaaaatctctggaagctggtgtgactcctggttgtagttagactcatggagagaccactttgctggaacaagaaatggtttttgttaagattcaagcataaaaatggctaaagtaaaatggctgatgtgttacagcaccaaggcaggaggccccagggacagtgtcacggggaggcgtgggtgctcacaggtaacgctgcggccctgttctctcagccagcctcaggagaatctgcgggacaattgtggaggccccgagcgacgccgacagactgcaggcctttgcccccgtccaggagatgatgacctacgtgcagtttgctaacgatgagtgcgactatgggatggggctggagctgggactggacctcttctgccatggctcccacgtgagtgagcaccccctccacacacacacacacacacacacacgtgcgcgtggggtatggactcagctggaatttcaaaatgaactttttgaaattattttaagcagattcttgaaagattcttgagttctaagaatatttcttatttgaggttcatcttatgtttctggccaaggtgaacgaccaagacttttttgccttcaggtatatgttaacatggggcttcccaagtggctcagcggtaaagaaacccgcctgccaatgcaggagatgcaggtttgatccctgggtgggggaagatcccctggaggaggaaatggcaacccactccagtattcttgcttggagaatcccatgaacagaggagcctggcgggctgcattcctctaaagagttgaacatggcttagaaactcaacaacaaatgttcaagtgatctattagctacgtatacagctttcggtgtgacacatacaccttcctgggctccatctcattctccatagggggatctgttctgtgtta

SEQ ID NO: 57212 - DNA, 761 bp, Bovine  19866881285922
ccttgattaatgaactggcagggtaagcctcactcagatggaagtggtggaagcacctgcaatatagatttcagaatgtgttcatttgaagtattggggaaaaaaatccaaggaccatgaaattactgttgactgaaatatgaagtctccagaataaccaaatttataccacataataccttgaggatttatttcaaaatgtactgagatgcaaaaaatttaacttttcctctaagaaacattcatttatcaatcttcctggaactattgtttttctttactagatagaatccttcaaacactttgatagaagaaatgtacttcatcagtcgtgacactctgttttctattgagtactatgcacaaatcctggaaataaatagataaaaacatcccaagtggatacttgtagggccagttagagtttcctggagcacacataactgtgagattttcccttcctacagtcctttgtgtgccattttcctggcctttgaaccaaaacacagtccttgccatgccttgaacgttgcgggggccctctcctccagttggtgaaggtcacaggttcaccgccaatccactcccagtggccagcacgcacttggtcattcaaacctgacatgaaccaaagaagggtgccaaatgatttttattacttttacaactggatgtcatatcaacccactgttctaagctcagtaatcacatgcaattgtgagcctacattctaaagcgtgggactgggacctgggaatcct

SEQ ID NO: 57213 - DNA, 755 bp, Bovine  19866881296475
acaatatattgaaatgcaaagcataatacttggtgcatgtatgtgctaaaatgtcttatatattaacagcgctgatatattcaatcacagttctgtagcttattaatgagagaaccttttcaatgacttaaactgtcaggcttctctctagtaaagaatccacctgcaatgcgggagacctgggttcaattcctgggtggggaagatcccctggagaagggtatcgataccagatcagtattcctgcctagagaatcccatggacagaggctacagtccatggtgtcacaaagagtctggcatgactgagcgactaacactttactttcaagaaattgtagggtatgtgtatacctactcacacatgcacatacagacatgtacgtgaacaaaatttcggtctacagtgatgattaatatataataaagtgctttcctggatcctctcactttttattcattctttcaagtagtatttctggtgtggctgccatgtgtagaccctgggcttgatgcctggggatatgcctcatgcaacttaaaggctggagggaagacagacgagatacgaataaccacacactcaactttgcacatgagatatatggcatgaagagaagttagagtgtctccatagctctggctcagcttgatgatgttcattttgtcaattagctcagtttgttgaatttaaaaaactgatttctcaaaaacagtttaaaaagtttaatgagtgtgaatatagatcacagatt

SEQ ID NO: 57214 - DNA, 2244 bp, Bovine  19866881303722
cccaggactgatctcctttaggatggactggttggatttccttgcagtccaagggactctcaggagtcttctccaacaccacagttcaaaagcatcaattctttggtgctcagctttctttatagtccaactctcacatccatacatgaccactggaaaactcatagccttgactagacggaccttgttgacaaagtaatgtctctgctttttaatatgctgtctagattggtcataacattccttccaaggaataatcgtcttttaatttcatggctgcaatcgccatctgcagtgattttggagcccagaaaaataaatcagccactgtttccactgtttccccatctatctgccatgaagtggcattcttttattgacataaaaagaaataagccaaagagttagaaatatttttttatctctggttaagaattatagctaatcctaattttatcctttttttctaaagttttaatattttctacaattttaacagtagtcacaaatcttttcaagccactttagaaacagaattctcaggatgtactcaagtaaatattctcaccatctcttcaagatactgtatttaaggaaataataataaacccactcggcttcttaaattctctgtgatactcagtgagtgtgtaattctgaagtcatctgagagtattatgtgaaggctggaagataaatcttctctatgtccacaatgactgatgtcaactttctaatcccacaaagttttggggcgtagcatcacctgatcagtaattcacagaaacaatccagaaggagacaagtcattcccaatcaagagtacttcattttattctaccccaaaatatcaaatgagaaccagtggggagaaggttacatgttgcataacaaagaccattttcacagtcaaatttggtttgtgagctgccaggtaatcctattgcacaggattctttttttttattcttattctattattttaatctctattctaaaagagagtgacgaggggaaaattttttttattatttttaaattggagtgtaattgctttacaatgttgtgttagtttctattgtacaacagcatgaatcagctgtgtgtatacatcccctccctcttgagggacccccattttacccatctagatcatcacagagcattgggctgagctccctgtattatagcagctccccactagctagctattttaaacatggtagtattggcaccccactccagtactcttgcctggaaaatcccatggacggacgagcctggtgggctgcagtccatggggtcactaagagtcagacgcgactgagcgacttcacttttacttttcacttttctgcattggagaaggaaatggcaacccactccagtgttcttgcctggagaatcccggggacgggggagcctggtgggctgccgtctatggggtcgcacagagtccaagataaataaagacacgactgaagtgacttagcagcagcagtatatatatgggggcttccctaatagctcagtggtaaagaatttacctgtaatataggagacccaggtttgatccctgggttgggacgatcccctgcaggagggcatggcagcccactccagtactcttgcctggagaattctatggccagaggagcctggcaggctacagtcccataggatcacaaagagctggacacgactgagcagctaagcatagcacagaacacagcacagtatatatacatcaaatgctactctctcgattcatcccaggaatacttccttaagaaaaattttaagagctttgtaacattgaagtgtaattaaaaaaaaaaaaattgccagtgggagtagagaggcaaattgagaaaagctgctttttattagaactgtagcagattaaaaaaatcttaagctccagactaaaaataatacttaataagctactttcaaatatgatacccaagaatcacaaggaagataaatagacaggagtatatctgtttccctgtgacacgtattctgcctgtaggaagtatgaataataagtgccatttattaacacttctatgtcatgagctttatgtgcattatcttatttaatcctcaacatagagctagttctacttagatatacatttctgagatgagaaaactaatacttggagaactcagagaggttaaataacctgcccagatatgttcacctagcaagtggtgaagctaggatttggattccta

SEQ ID NO: 57215 - DNA, 1220 bp, Bovine  19866881354559
tcttatgggacacggtaaagtcagccatgttttagttttacaccttttaacattataataattgaataaaataagtaagcctctttttaaattgtagtgcttaactactgtgttttgtgatttttaaagcatcaactggccatcttttcctcttcccccctcaaagcataacacagtaggcagaggaaacagcagtggacagggcgcctcctctccctctcctggcttatgatgggacttgctacaagaaaagggatgtggctgctcggcctgtgtcccaccttggtgtgggggctccaggatctccaggcaattccatcgcacttgtacagtttttggaggctttcttcaaagtggaagagtccctttaattccggtgtgcagttctttgggaatgagggcaacgggtcctatgggaaggaaaggtaatttagatctgacaccctgtaaaccgatcacactgttacctcttttaggtcatcatttgctgaatagtgttttaactgagaaaactatccccaaacttgaaggctgtttttcagctcaggaaacagcttattgtaaggagagtaggaagtgaagagattttcatacctgtctggggaagtgtgagccggttgtggattcctccttatcggcttgaggcggttctgccactttggttgtcttttggggctcactaataaaggatacattggccttccttctgcgagctggggagccgtcatcttccagtttcagggaaatcaccccatgatacttgaggaaatcagcaaacaacagtgaagacaaaacaaacaacaagacagaaaacaaaaacatttgttgtaaaaacaggcaatccaaacactggatcaagataaagagataaaaggatgttttcctgaccacccaagcctctaaacaaaattcaaacaggattgtaaggaaaatatataaatataatagttatgaaaggtagtttcactagatattttgcatccataaaatacaaaaaatttagcaatcctctcagactcagacagaggagcctggcaggcctgggggttgcaaagaattggacatgactgagggactgatcacatgcattgcttacacagtatatacgcttacgttatagatgatgtctgttctatttttataaacagaggatggaggaacctgaaatcaacagaggaaataaacaggaacaaaattggcttgaataataattcataata

SEQ ID NO: 57216 - DNA, 709 bp, Bovine  19866881359946
atgttcctgtgaaggcatttgtttttagattgatgagtatttcaaagaatagactttgagtaaagcagattaccctccataatgtgggtgggcctcatccaatcatttaaaggccttaaaaaaaaaaaaaaaaaaaaagactgaagtctcttgaagaggaaggaattctgcctccaaactgcctttggactcaagactgtaacatcaactccttccgtaatcttcaggctgctggcctgcctcgtagattttggaatgtgtcagactccacaattgcatgagccaattcctaaacagaaatcagtctttctctcttcctctctcttttatcatttatatgtgtataaattatataatcctattgattgtttctctggagatccctgactaagacagagatgaaagagcaagggaaaattattattattttgtataatcagaatgtattctgcattaagacagatttacatcttttatgttattggtggaagtatgtagaaaagggtgaactgtatccaaggagagtggattcaaggcttcgagagccagaatatacttgatgtgttttgactaaaaaaagaaaaacacgttatgccctccaagaatcatcttaacagtcaacataactgtgacagcacagtaccacagaaaggacacagcatggggatcaggaagactggagctctttatgtgcgtttgaccaaattgt

SEQ ID NO: 57217 - DNA, 1269 bp, Bovine  19866881376512
tcttctaggtctgcagtgatacttaggcaccatgactctttcttagtggattgttaaaccagcagtcactaaaatggcaagaacagaaggtgtggagtcagaggacctgggtgttggtcccagttctgtctccgaactgccttatgatctgccatgtttctgaatctttccactctaattttcttttctttaaagcagggcaataatctttgtccaacacaactcccccatatcttgtcatgggcaaatgaggaaacaaacaaaaaaatatgtgaattgagtgaattagccaaattcagcctactcagtactttattggatgggcttccaatgatcagccttaagaactgagcctattaaaatctcacaaagaaaatacaactgcaaaagagtctgggctatgaaatttctatttggggcaagaaatgacactaagtattaacaagcctgagaaatatcattggcacagctaacctgccccatcccgggaatctaccatccatgctgctgagtaatacttggggggttagaatggtccatgtacgcattgtctagtgactggtttaaaggacagaatggtgtcctcctgaaagatccgctcttgagctttccttcacatcccaacacaatatgtccttgagtaaaggtgtgtattgttatcatttcattccaatagatggtgacacaagaatccatgttgaaggctgccttgcctctctttgccagattcatcgtcagcaatggacttcagaccaagcctggggtttttgagatcacactggagactgtggacacagccttacccgtggtgaccaggaacaaggggttgagactggttgaaggggccacgggcctgctctcccctgacctcctgcagttgactgaccctgacactccagccgagaagctcacctttcttctggcccagctcccacggcatggccagctctacctgcgggggatggcgctgatcccacacaatttcactcagctggacgtggacagtgggcatgtggcctatcggcacttgggaggggattcttggactgaccacttcacttttgtggccacggatgggacgaaccatggctttcttgtggatgggagagtgtggcaagaacctgtatcattcaccatccaggcaagtataacaaatacgcatttcatggccagagataaggagaacacgacttccgggagaactgtttcctttccttccttctttcattcaaatgtataaagtgtgtccacagcatgccaggcactaag

SEQ ID NO: 57218 - DNA, 1195 bp, Bovine  19866881392874
ggctgtagaaagaagtgaatgccctgcagagaaagatataactctcccatgggccaaggtggtgtgtgtgagagtagagcccaagatccaagccactccatttttctgagtctgaacaattctagcaaagagaagtcagtgcggatgatatacgtgaagttttaaagtaatctgtgaatttctaattcccctcctgacattgtcacatcataattattgactaaaccattgacatttgcctgtgagaattggagtaagtttgttgtcagtgttctttcatgagtgtgtgtgtgtgtgtgtatttaacttaaatttttttttgagggggtgaatgatcatattcaccttgtttatacgaggttgcctaaaatttccagtttagaaaaggagatcagctatttaaaaatagttcacaaatttttttaagtcctcagcataaccttcttgctgtttgggagaagtacaaaccttgctattcaaagtaggatttttagaccaccacctggaaacttctagaaatacagaatattgtcatccccccctccacccaggaacagaatctgcattttaacaaaatccactgttatgcatagtgatgtttgagagtaaataaagaatgaaggtgagaagaaggagaggagggtggtggtaccctggtttataaaggaattttgacattaaaattttattgttttctgtctttagaaataactacaaagattactcgctggagtcaagactacacttcagaattcaggcagctcttcacctctggaaaaaatcgtcttcagattgatcagaacatgaaggatggacttttctctcaattcataccggcgtatactatagattaggccttgtattaaagtggaaaaatgatcttgtgaatgagagacaaaaaactaattttactgtcaatattttctataatttgtgtggtttattcttggtctacttaagtgtttttttttttttttctctatggaatgatgatcagtaatatcttgaaaacttatattttgcatcttcaaaaggaatttcaaattaatttgaattggagagtgaagaagtcttttaaaggactcacaggtacaataaagtctaaatagattatttatttttttaaatgtggaaatgaatatcatgtaggtagtaaatggcttataacctgagccatatttagatttgttgggca

SEQ ID NO: 57219 - DNA, 991 bp, Bovine  19866881397015
atttcctatctctttaatgtgaacacataattcaaaatattttgatcatatgaaaggcagtaaatgtatgttctgctaagagaaatgtgataactataaatgtatgtgaaagaacatatttaatggatgaatgattatcacaatactaatattctcaagtaaaatgtatgtttggttttaaaaaatatgttttggagattatgaataattagcacccatttaacaaatacaacttgatattcagtatgtaataatacaacataaataaaagcaattattacttcaattatttaaaattatctcaactgccattaaaaatacaaataaaacagttacatactgatcacttgtcattttaatcataaaccatcattccttagataagctgaaaaaaaatatttattcaacacacaattactgaggacctactatgtgccaataagcaactcaggaggtacacaaacaaagcatggtcactgcgttcagctctcaggaagcttaaggactaaagaagattaggtaagtgtgaaataaatgttctagctctaaaatatctgtaacaacatattatggaagaccagagaaaagagtaattattttcacctttaaaaggctttaaaaggtgtcccaacagaacagtgttggaatttaacaaaaacagaaggaaaatacacagtttacatttgactgtcaataaattacaaccagtattactgttcacaggcacttcacaagttctatttcacctaattatctcaacaacccttaggaccagtgttcacaaggagaaaccaatgatgtacaagataaataacttgctgaaggccacataccttgtaaatgaaaggaccaagaatgagtccaggtctctgtaattcgattttttttcactacatcaggctacctaagctgagctttaagaatgagtaagatttaaatagagaaaaagaagaaaacagagaaaaaagacaacagacagaagagacataca

SEQ ID NO: 57220 - DNA, 872 bp, Bovine  19866881580272
ccaagattcgataggatgatgacctactcttctttaccccttctttttctctttcctctattccccttctctccttctatatctgccttttgcctacaagatatcaaagctcgagttttattaaaaaaaatacaaagtattttctctttattttaattttaattgcccttagatgcttggaggccatctcagtgatgctgagattatctgaattattaaaaagtgagttactttgtctgttgcctctctatcctagctcaacccagggtctcctcctaatggggccagctctggagctgtgcctgtgggccccttataattatgtctcaacagcacggccagtcaggcctacagtgaacagagtcatttgaggctctttctgtaatgtttcaaactgttgtgttgttgacattcagtgcatgtgtttgtcattgacacacaggctcccattccagctggaaagcttttcctttcatgttgaaactcttttaaggaaatgtccctacttatctccaagccagagagtggatgggagggaggcgtgtgtttaaacgccctgcatttcggggatgccaacaggactgttttcatttgctccccacaatgggagatctctgctgctcttcctgagatcctgacagaagcgtgtttgtctttaatgtcatgaggtgagatagagcagctgtgtttatggtgggagttacctgtaatttatgttctaacttaaacatctgggaagattagctgtttcctttaatttaaagacctgaactctttctttctttcttttttttttaaagctcaactcctcaaaaattttttaagcaccaggaaggcagtgaaaaatcagacgtttggtgtctagtacagag

SEQ ID NO: 57221 - DNA, 1442 bp, Bovine  19866881587197
ttcctaaacattcctcaaagacgtcttgttattaaactgaacctgagtttagagaagatctgtgcctggaaatgatcttgttgtaccattgaaggaggtcaaaatataggagagaagtttcatatcaatgtcctttccaaaaatgaacgtctcccttgaacttaaccacctgctcctttcccttccaaacactctcaaatttgagtcccttcctttatcatggataactgcacaccttggatagacttttaatcttatttctacattcataaaatagaattctaatacatgctctgtctacctcacagcagcactgagagtaacgaatgagataatgctagtagatgttctttgtgaactaaaaggtaccaaacatatgcaaggagtttgcagcactggtgtaggttgatgaaccacttttttctcccagtttggaccagtggttgctttatacccagcagaggagccccacaggcttccactttgcatttctcatgattttcttttttcttttcttacatgcctagtttggaactgaattggtcttatattgagtggtcgcggactgaatatgaggtctgtgagaatatgggcatgctacccttggagattaccagaaggggatattccatggattcagcctttgtgactgtacaggtaacaactctaaactatcatctttcaagctaaagcctaggttgctggttggtgcctttgactatttccttaaagaaactcagagtaactgaggaaacttcaaattgcaggagtgttgctctgttccagaaagtctaagtacaaaacctctttgtccctccatcatttatcaagatacattagctcctacatattctatttctaacccatctttagttttaaaatctggtctttaactcttgaagtttgatttcataagatctacccaacttagtgaacttgggccaaactctgctttggaaaggaaagttgtctgcaaacttcagtccctgtatggctttctcttagcatgcaccaagatcacctatggtctcagtggatgagaaaaatcagggattacacctatcttaagcatcacccaagtcatgcaaaattaagaggctatgtagcaatagaggcagcctgaaatataagaaattttcaataattaattttggactagtcacctgctatttctttccactgacatggaacatggagcacaaccatggcttctagaatggaaaggtttttaagaagtctctagaaaaactgcacattgggagaatgagagcatgaaaagcctgtacatactaatgctggtaaagacttcctcctcaatctaaagggggaaaaaaaagcagtgatattaggttctggggggaaatgccatctcagtaagtctcagttacagtaagttcaaatcagcttcagaaccttgtgcacgtagattatactatatacca

SEQ ID NO: 57222 - DNA, 1218 bp, Bovine  19866881994752
ctactcttgtaaaccagggaaaacaagtgaggagcccacggataaaatcataactgatggaatttcaagtctgaagatggaagggagaaaggaaaggagggaaggaggaagagagggagagaagatgggagaggtttacagcagcgcacgtcagccgtacgagttcgtcccgataaagcctgacagaaatgctctacctttccccatgttcttgatggtgatgtgacagtcaaatgccggtgacctgttgtcaccgtcccagaggcggaaggtgaagctgtcttggttcttggagtccatggccccggtgtgtgtatatctcagcaagttcaaatccacttcttcctgagtgcatttcatgccagggtacagagggacccagtccctccctatctgaaagatgccagaattagtcagcggcccaggtttcccccgcctcccaagatgtgttagtggacatcttccgtatcctctgaaaacttccaaatataaacgatttttcagggaaaccccatattccattattttgccattctacctcatattttccattgaaataaatgtattaaaataatttcagaccttggggaaaaaactagctctaagcaaagaatttttggcaaagtcatgtgataattcaactgcagtgctactaaggtatttatcataagccatcatagctgattaaatatttcaattgatgagagcaggtgggtaattgagctgttggaattaattctttaaaaattaaatgtgtttcacttgggatttccttttttctttttagatcatttagatcataccattgttcaattaataaaacctgtatttcaaaccagtttgtcactggagttatctgaagtagataaaacaaaatagaatgggtgtatttaatgtccctatgtttttcaggtttcctaaagaccaaagaaaatgatcaaaacttctattattccctacatttatatcctgagtcagcacaaaaataactacaaatatcatatatttactgttaattatactcttctaaaaataacccagcattagttaagcatatattctatacagaactcagtgcagaaattgtgccattttcaatgaaaagaggtctttatgctgagggagaacaactgagagtattagaaaatacagtaataataaatctgtctcgattaataattctgttgtattctcttaagatgtaagctttccctaaga

SEQ ID NO: 57223 - DNA, 1651 bp, Bovine  19866880447347
tcagtgtgtgctgtaacataggtgtagtaatactatctaagaaaattaatgatattaaaaatgtagcaaaaataaaaatcaaacttctttttatgaggttattcaattattaatgattcttatttatttatattttagaacacaaatcaatttcacagtggctattgattttactgcatcaaatggtgagtattatgactgtcttataataagaattatcatctattacattaaaaataaatattttcatgaggtttagatgttttctttccacatatacatacttctgaagtgcttcataaaaattcagataatttttctttttttaatgttatgaaatagtttaggtatataacactataagaaatacaagagttcataatagtcccattcaaatgtattaactattgaaatactgtctcttttgttttacatgtttttaaaaggaaaactttaaatttagttaagcttgttgtgtacccttccctttttctccatacatagctgtaattctgaagcatgtctaactataatcctcatttttatagtacttttttgtacattaatttatataaatgtaattcaagtacttgaaccttcacagcttgcttttcttttattcaactgtttttaataattacttatgctagcacatttatattgaattaattcagagggaccatcaactaaatcccatactgagtttagaaaagaaagaggaactagagatcaaattgccaatattcactggattatagagaaaacaagggagtttcagaaaaacatctatctctctttcattgactatgctaaagcctttgactgtatagatcatgacatattggaaagttcttagagagatgggaataccagaccatcttacctgtctcctgagaaacctatatgtgggtcaagaagcaacagttaaaaccccatatggaaaaattgatgggttcaagatcaagaaagatgtacaacagggctgtctgctgtcaccctgtttatttaacctatatgctgagcatatcatgagaaatgtgggctggatgagttacaagctaggatcaagataggcagtagaaacatcaacaacctcagacatgtggatgataccactgtaatggtagaaagtgaagaggaactaaagagctgcttaatgagggtgaaggaggagagtgaaagaactgacttaagactaaatattttaaaaactaagatgatagcttccgcccccattactccatggcaaatagaagggcaaaaggtgaaagtagtaacagatttcctcttcttgggtgccagaatcactgcagattgttgactgcagccacaaaatcagatgattgtttctcagcaggaaagcgatgacaagcctagatagtgtgttgaaaagcagagacattactctgccaacaaatgtccatagagtcaaggctatggtcttcccagtggtcacgtacagttgtgagagctggaccacaaaaaaggaagaatgccaaagaattgatgccttcaagatatggtgctggagaagactcctgaaagtcccttggacagcaaggggatcaaaccagtcaatcttaagggagatcaaccctgaatattcactggaaggactgatgctgaagcagaagctccagtatttggtcat

SEQ ID NO: 57224 - DNA, 839 bp, Bovine  19866880514625
cctggaacttgttttccattttcattttaatttaaaaaagagaaagaaagcaaatacaatgtctgagcactcataataacaaactaacttagtgattaaaagaacagaaggctgtgcaaacttaggggacaatcatatgcttaaattcatgcattttgagctcattttgtttattattggaagttagagaattcaatatcttaacaatgaaaacaacgcagatatgatgtacagaatacgtaaagacagtttgggaacttaagcgccttaatctttttatctattttaggactttctgggacaagtgttttgtacattgggggagattgttggttcacagggaagtcgcctggaaaagtccatagtgtaagtatttttttttttttaattttagacaatgaaatgtcaacttttcattttctattttggaagtttggaattgatgaatatgtggttgtagaccaaaactgcattttaaaatcttgagtttttttacttccaacaaatcattttgacatttttgtaaaggataatttgtatttcagctgtcatatgccatgctacaaaatgttcacaaaatgaaatgagaaaatttaagcaagaaaacatgttgtcttccttttggttttaatattatttcttagatacagtactttttaaagacaagattttacttctttgagccaatgagtatatgtagtgccaccttttatgtttaataaatgcatgtttaggtgattgagattttaataataatttttactgaaaaatttgtctgaaaagaaggcaatgtattaaatgttaagaaaagatgttcactaagaattatactttttcat

SEQ ID NO: 57225 - DNA, 1511 bp, Bovine  19866880653090
ctttaatatattttaagagctgtattttaatttttttcccatatgtattcttgatttttctgttccatcacccccattttgggaaaggttgctggaggttttaattttcttctgtgaaatagcccatatactaccacccccaatgtcatataaaaaatgaatatctgttgcaattttgttgtgtcctagagaattaaaatttcccagaaatttataagaccacgaaaatcactcatgtgatcctatgtcttgtgtgcctcaggaaaaaggtcctgactattttaaagcttaagaaaggaataataaaaaataataatcatgctaaactaaatgatattaattttccttccacaagtttttcctcacctttgtgtatgatttttttccatttgttatctaattctctccttttctgtttttcctgcctccatattcattccttacaaccaaacctatgcaaaggagagactttttattctttgcatcttaaatgattctttgaaccgaactcaaatatttatagaaggtcacactctaaatttatgaaaaatagtttctaaaattgagaaagtgatgatgataatgcttcatctttaattttacctaataactatatgactttaacttttttcaaagcacttttttcttgaataagacagacaaaggttaagtaggtctttggagagatagtactccatttaatttttgtgttaacctcatcctaaataactacaatatataactgcagatgctgaaaatggcaaatagaaaaacttcagtccatgtcaatctggcaattagtgtactacctaatgttaccaaaccttcacatttccatggtaagaatttgtgatatatatattaacaatcgttaatgtttatcaaaccgaattcaaataatctttcagatagcaagggaagtgtctcactattcacactgttcactgaacctggggtaggtaaggtgcaagcaaggaaactggaagaagattcaaggagccacaggaactgcagacacgtttattctctaatggctggtgcggcagccataatgcagccatgctgtattctctgatgattgactcagcagacacagccataacacagctgcaagggcttttcaggtagagcttatacagttttacagaaaaaaaaaaaagtggtccatgaccaaatgagtacatcatgacatgcaggcacagtgctataaatgatctcagatgttacataaccatggaaagtcattgtttatgaaatgaggcaaaagcaagaggtcctggggcaagagaacctgaccattgccatcatggccaattgctttttccctacaagagctctttaacaaaaattttgaatccctaattggtgagtttgaggctggcacaaatgttgaagttgagctttaaacaatcaaaaggatctaaggtaaaccccatctttttatttgaaatatgtgtaggaataggtattgggaaaaagaaagggtaaatatccccgtattaccaatttag

SEQ ID NO: 57226 - DNA, 1053 bp, Bovine  19866880712640
ctttactgtctgagtcaccatggaagctctttggttcagagaaagaataataaaaatatatcttccaacagctgagcaagaagacactattaaatcacctccctggtaacttacctgtaaaaattgaagcaagaagtactcttcctgctttagccctgaattttctctaagcctgattttcccacggccatacatttggttgttctgcagtgtctgtagctgattaatgatatgatcattttaaaggatttagtttagtttcaaggggtaaacttcccaggctagataacaaaattaaattattgactagcttcataggtttgtgtactgcctgttcattgaatcaggagacaaaaaaataaagccactgaagttgccctaactatgtcacaggcagcttatttcctaggaaactcccaggcaagaaaggaagcagcttattagagatgggcaaaggcgtgttgctaaattagagttttctaatccttccctcttctcccactttgaatttcaagaacactggcaagctctgattataaaatgtcactggcactttgctgctaatctattcaataatgtctatttggggctcccactttagcctttcagggtaggggcactactttaaaaaatatttttacttaaaatctgctttgaaaggcaaattcaaaaaagcaggctgattaatagatccagttggtagcaaactaagctttggtttgcttgcccaaatcactgcagataggtgactgcagccatgtaattaaaagacacttgctccttggaagaaaagctatgacaaacctagacagcattttaaaaagcagaaacattactatgctgacaaaggttcgtctagtcaaagctatggtttttccagtagtcatgtatggatgtgagagttggaccataaagaaagctgagcactgaagaattgatgcttttgaactgtggtgttgaagaagactcttgagaccctcttggactgcaaggagatccaaccagtcaatcctaaaggaaatcagtcctgaatattcattggaaggactgatg

SEQ ID NO: 57227 - DNA, 1147 bp, Bovine  19866881213717
tgagaaagctgattgctgtgtagaaatctgactaccttgagatagtagcccacaaaaccacattgataaactgtatgtagaaagaaggaaagatgcctagagaatccaggtattttagccatcctagctgtaggcattagtcatgagcaaatgagacatcttagtggatgtactagctccaggagatatgacatgaagaaaaccgaggaacccaaccaacagtcagaatggaacacatatatggctccagtagaacaattccagccatatctagccaagcaaggcatcccaggtgtggcccaggtatcttgaacaaacgtaccattctcttgtattatgctcaaattcttgacccacaaatcatgaatataatggaaggtgttatgtagcaaccaaaaaccagaataggttttaaatcatatgcactttaggtagatttgttgctaatttatttgtgttttttccattaatatcacacttctaaatcagtcctttactaaaacggagctgattgtatagttataagaagttgctacctgagtaattaagcataagcagtgaacctatgaaaagatccaaaatactatttttttcccaaaatatcaattatttccatgtattcttaccaaagcaaactcatgagatatccttccatctggaggcagttttgcaccaaaacctaaagctgggaacattttatcactgtcataatcttgaacgatttctcccactgctttcagtgccataccataggcattcagttgataaggattcatgtagtggagagaagtgggctgggcagggttgcctgataacagaaaaaaaaatgaaaacatgagagatcaagctaaaggtataatttttagacatttttcttgatatctatttcacattgaaatatcaataatatgtttttctgcccacattcataacgtgttaaatattgggttggccaaaaagttcattcaggtttttaaataacattttatggaaaaatccaagcagacctttggtcaacccaatagtttcttttggatgcacatgacagagagatatttattaaattagatcagacatgtataaaatttcccaaagatattcagacttttttcaaaaattatttctcatgtcaatgccataggcaatt

SEQ ID NO: 57228 - DNA, 1384 bp, Bovine  19866881261104
ctccccggtccctgggattctccaggcaagaacactggagtgggttcccatttccttctcccaatgcatgaaagtgaaaagtgaaagtgaagtcgctcagtcgtgtccgactctttgagaccccatggactgcagcctaccaggctcctctgcccatgggattttccaggcaagagtagtggagtggggtgcaatcgccttctccagctaaagacgttagtaagtaaataaatccataagatgtgaagacaccaggttggactatatatttttaaaatatttcagtataaatcctaacattgtaattgttttatctgctctttaaggtgataaatcccagaaagaaaggaaaaaagaagaaatatactaattcaggaacggtaagtcaaattttatgttatacattaaggattcaaatagatgaattaaaaaatatatacatatatataaaatatttggtatcaaatagaagcaactaaaaactgaactctttcattagggttttaatatgaaggtatataatacaaaattaactttctatgggaatgattgtatagagaacacctcataggacatagcaatacagcttcctgcaagttgtttaggggttgaattgtgtctgagagaagaggaagtttcattatgaattcttcatttaatgaaatcacacgagaaaatcaagcaggcctgaaaaagtgaagtaaccctgtgtccttgtagataatttgcatgttgttcttcaaaggaagtaaattggtcatagaaaggagttacttaatttttagccccttttcttctgataattttaaatataagaataatcagtcctagaagagtttgaaatagattatctttattgatttacaaaatgctaggaaatataattttctctctaacacttagaaaaaagtccagttgggattgcaattagtactagtactatatattcttcttgtttttattttcttttgttttctttcttcaggtcaccttgctgtctttcttggtagaaacagaagtttcattccttgactatattaagggagggtaagtcattatctgaaattgtttcattgcttaagcaatgctgaaaggcaagtttgaatgtgtttagaaacttcatgacaacagctgtcagagacatcacttctgtaaacctcttccaaatgatgattaagagggtttttgttgttgttcttttttgtttgtttttgccaatactgatttattgctagagtattgtcaagccaaagtggaggcaaaggaacaaacacagtttcctccaaaacagagagcttaacccctattgctgtttgttaaaaaaaacaaaacaaaacaaaagctatactagcccaaatgggcattctttgctacatatgggcat

SEQ ID NO: 57229 - DNA, 3195 bp, Bovine  19866881279121
tcctcttgcccatatcattatgggtaaaaaatgttacttaaaaaattcttaataagtcaactatgctttggtaaatacacatttacattggcaaagaagccatcttaattttaaaaattcaacttagactattggatacaaaatctacagtgattaaaactctcagacaagttgacacttattttacctgtcataatcgccattacataaagctcttactgagatcttgaatgcttgccatacaggatttagagtgtttttgacaacttctgttttatgacagattgtaaaactgtaaaaaaaaaaaaaaaagttttccagttattttcatgatttagttctaatatatgccttagcaatcatttctttctttatattttgttcagaatacaggttgcctgtccctctgttactgttatatcagtcaataaaaagatttgctgtttcaaaactttaaagattagctcatcataacatatggcaactcactccagtattcttgtctggagaatcccagggacagaagagcctggtgggctgccatctatggggtcgcacagagtcagacacgactgaagcgacttagcagcagcagcagcatcataacataaagcaatgagggaatttcctggtggcccagtggttaagaatccaccttgcaatgaaggggacaccagttctatccctggtctgggacgatcccacgttgccatgggccagctaagcccatgcaccacagcttactgagcctgcactctggagcctttgaactattaactactgggcccatgtgccgcaactcctgaagcccgcatgccctagagcccgggctccacaagagaaaccaccacagtgagaagtctatacaccacaactggagaatagcccctggtctctggaactagaaaatgcccacgtgtagcaacaaagacccagcacagccaaaaataaatgaaaaaatattaaaaaaattaaaaattgcaattgtgcaatgagtttactaaaaatgacctgaacattcaataaatcctaaaactgctgtgtaaataatctccataaaaattgtagtgacatgttgcagtgaaaagtatctatcagtcactaaacatgaaggttatcagtaattttgagaaatttattggaatgctggacacaaaaatctggttagaatgagtctaagaaagagaagagaaacagccagaatgtgtaaacatttttgagcagtttagctgtaataagaaaaaagagaacttgaggataacttaaaggggaaagattagtcaagtgaaaggtgtgttttttgtcactttttaatttttttttcaagatgaaattaagaacaacaagagtgtatgctaaaggaaaaatacattagagaaaagactatttgtgatgtatgagtgaaaggggaagaaggctagtaatgtcctgaagtagatggaagtggataggacagagggcatcaaaatggagtagtaggccttggaagcacttggattgtcattttgcagagcatttgggaagaccaaacacaggggtagatattgtgatgggatcttaaggaatttctccatttgcttgcattgtcttattaaataggaaacaagataaacagtaaataagaaagagggaaaaagtgcataactgtctgggagagaggaacattgatggattaagaaaaaggaatgatttctgaggagggtcaaaggcttatttaagattaacataatggatttatagtagagaccattcaatatgtggttctttttttaaaatctaaactgttgcttattcctagagggaaaaaagatagcaattaaagaatatataataagcagtagaatccatgaaaccttaaactagttttctgattcaaatttcagtattgtttccaccaagccatttaatctctggacatcaatcaggtcctggtaatattcttgccagtggcaccccactccagtactcttgcctggaaaatcccatggacagaggagcctggtgggctgcagtccatggggtcgctgggagtcggacacgactgggcgacttcactttcactttcatgcattggagaaggaaatggcaacccacttcagtgttgttgcctggagaatcccagggataggggagcctggtgggctgccgtctatggggtcacacagagtcggacatgactgaagctacttagcagcaatgcaaatttatgcagcagttcaagagctataaaatgttttaaatgatcttggttagaacaatacctaaattcaactttcactaaacccttaggcatgtagtgttctaaatgcagggatccctcgtatagtcatgatcatgagagtattatataactacaccatgatgaacatattgcaactagaccctataagaaaataattccattttgaaagggcactgagtccattttcctcttcacggtcaagaaagggtctctcttcattacgagatcaaagagaaacataatatgaatggatcatgttttcagtttaagatttatggcgttagcactacactcttcctggtagtagccttacctgtcgaaagaaactcatgttactaaattgacagagctcaagagaatatgtgtttgtataatgtggtcaaatgctctcaaagttgaatcacccaaagcaatataggaatcacccagggcaaaaaaacattaaaagaaacataaatgatagagaaaactctaaaagattaatcaaaattactttgaaacttctcttaataaactgactccaccttcttagtgagctacttataaactaagtggtcatctgtcattctcatttgtaaagcacttatggcagaaagtgaagaagaactaaagagcctcttgatgaaagtgaaagaggagagtgaaaaaattagcttaaagctcaacattcagaaaactaagatcatgccatccggttcagtcacttcatggcaaatagacagggaaacagtggaaacaatggctgactttatttgtgggctccaaaatgattgtagatggtgattgcagacatgaaattaaaagacgcttactcccaggaaggaaagttatgaccaacctagacagcatattaaaatcagagacattactttgtcaacaaaggtccgtctagtcaaggctatggtttttccagtggtcatgtatggactgtgaagaaagctgagcgctgaaga

SEQ ID NO: 57230 - DNA, 2001 bp, Bovine  19866881394569
atgtctggctctaggtgagtgatccaccatagtggttatccagatcttaagatatttctgtgtaattcttcagttattcttgccacattttcttaatatcttctgcttctgttaggtccatactgtttctattttttattttttccatctttgcatgaaatgtttccttggtatctctaattttcttgaagagatgtctagtctttcccattctatttttacagttttagataaatcacctaaccctttcagtcctggtgtcttcatttatgcaacaaagagacaagtctaggtattttctaatcttatgcttgttactaatattacacacatttctaattattattctcaaccatgcaaaggataaagcttgtaactgagcctgtttcttaaccttgtgccccctcaagatttgggcacactaatatttagacaaagaagcacacaactttcatttttttctgatcaattcaaaaagaaacaactgatgttttacaagagggaaagaatattgattttatttatttttatttttgaactgaagaatgacggcaaataataataaaattgcagggtaataaactatgctggcataaacatttaggaccagtaaaggaaatcatcagattctatgtcatttatacataaaatttagagagcaaacagttatcctttcaaagattttaatttatattccaaaatgaacaattaaagattgcataattatataacattgctattgttagatatgtgaatatatgtatattttccttttctgtaaaataatttcatgcttataaaagtcacctttagtcaacttgggacaaatagaacaacacatagtagaaataaaccgagtaataaataggatataagtaaggaaaatattataaagcaggtacactgttgacataaaagaaagaaataaacatacttttctattacttaaaggaaattcacaatcatttccaggaattctttaagaatttaaggccatttgttctagagaaatgctttaatttagacacaactgtcattcttgccacaaaactgtaatcctcgtaaaaactgtacatgcaaaagctctttacaatttttaactgtgtactatcagatcagaacataggagcagatttttttcacaaatgtgtcgagtattaagtcacgcagttgtatatatttaatgtgggaatttcacaaaaaacttcttgcctgtacattctgtgtggcaacttggaaaggaatacaaatcaaaagagccagtatccctttgaattaaaataatatctaagcaaggtataatgaaaaaaaagtgtttaaaacatctgctgcacagttaaatactctgaattttagtctttctacatagtattgcaatataaagacattactttttacacaaagtattttctgtgcatttatagtacacaatgtttgactttttattatttctacttattattacaaaacataaacaaactgcagtttaaatttagaacccaaacttgatgaaaaagtgcatgttctttcaggatacacagctgctaagtgtaaattcccatacttgacaaatagcataggaaaactgtttactaaacagatgcagcttcataagacaactcactgagaaatgtgaacttatttttactttcccttctttgcaattgcacttgatcagacagtcattcaaagatattgctcttgtgattatagctattgcaatttagaagacaaaggattcaatattcaaaacttgtattcttaagaatagttataaaagtactgtaatttaaaaagtagtaacatgtaaacattgatacagagagactgctttcctatacacatagcagtctaagacaatatctgagttaaaaacataggttgtgctttttcccgacaattcactggaattagctgtttttccaaaaacttttaaagattcatacaagacatcatattttgcgtcaagcatataaacagttttttctgttgctcatgcaa

SEQ ID NO: 57231 - DNA, 884 bp, Bovine  19866881573513
tgcataggctgatctattttctctagttcctataagacagtaaacaaactatagacattctccctaatcttttcctcttctcttcatccttcttctcccatccctaaattttgatgttttggattcagttaactgtttttaaacatcaaaagatctaggaagatctaaggcaactgcagactgaaccacagtgtctaaagatttggggagttttgaagtctctatcttcaccaatcttttaagaatctcaaactcataatataatgatgtcaaaacccatcaaatgtattcacctttgacatcaaaaattgaaatgattaaagcgtcattctcacattctctgtatataatgaaacgttatacttaatgtgtttttcttcagttaataagaagtctataaattctaacttcttttatttataacttgattttcttagaaaattattgtgaaatatcagtaggaaagcttttgcataccaactgccttttaaacattattttcacatataatttgttttttatatcactgtaggatttggaaggattataggatttggttcacatatatttatgctcacttaaataaaccaatgataaataatctataaagaaaacataaatatttttattaagcatatataattcttactgcattgtctagactagtgagataggcccataagcattcttagaaaattactaaaacaccctttcttttgctaaaagaaataatcagtattatctattcaatgccaccttaactatgcctttaatattctctgagagaaaacaaaagaagtaaaaatgtaaaatttttatttcagagtaacagaacagagatttttaagatttcactcatatttttaaattgctagttttattaa

SEQ ID NO: 57232 - DNA, 1139 bp, Bovine  19866880395015
ccccaccttactgactgaacaccaacaaatacagtagatatgagtctacatagctgtcttcctcactagacatccccaagttaaactgtcttttctctttccctcctggaacaccctcttcttttctaacatagaacttactataatatataatcatgaatttctttgtgtatttatttcattaatgtctgtcccctaatcacaatgagctccaagaagacaggaactaagactgctggattcaccaccacgttaccatcacatatcctgtagccagccaaataatagctgtacaatttgttgaatgaatgaatgactgaatgaatgataaaagaaaatggagattttactaatgaaacaaataccaatgaaataatctaaagaatcaaaactgttactttctgactacaccagatactgaccctcagattcttctggcattcagatagtccaaaagtttgaataggcataagtatcgttttgatgggggtgtttggaatacatagccctttttatgagttcaaattcagacctcatgaaactggaataaaggtatagttttatgtcactgagtctacattttcactgaaccatacagtatcccaaccatgacttcctggaaaaagacatcctctactccttttctactaaggaaaggtgggcaaaactactgcaacttcttctctctgtccctaaggagggtatcctatctgtgcatcacaccctcatccagctaaagtcaccacactccatacagatgagaggcctgggtgggaagggttgggggagactgccagcctggaatgatccttccctgactccaacagaggaaatctttaagctcagagtgtgactcttgaaagctgtattgttcattcttcctaagacctgaagctcaagatcaagcaaataatccagcttagttgctgcttagtgtagggaaaaaaaaatatcccaaggccatttcctgtgtggcctttttgattttggacagtgtctctttgagagacagccccatccacaaaggctttctgtggaggtgtgtgcatttcactgagatgtttccaaggagagcaaagacacctttttcaaccaaggcaaattaatgaagctggcagtcaaactctatttctagcctg

SEQ ID NO: 57233 - DNA, 1420 bp, Bovine  19866880417101
cagtgaaaagggtttcttctctgcatttcttttttacagaaagaaaattgaaccaacatggtcagtcttgagtttcacagagctctcagtctgcagggaagaaagaagaagaaagaagcaatttcagctctgtaggggagcatttcaaaaagggagtatgaggggattgggctcaattattcataatatacgtatttctctcaatttccttaaaatctggaggtctggttttaggaagttactaaaacttgaaaaactgcaggcactgcatagatacttgatggacagttataacataagatatgtactcaccacatttagaagaattataaaggtaagagttgtatagtaggcagaaccctggtcttggggagagaagagctgggtgtgcattctggcctacttgctgtataacatagggtatgtcactaaaccactctgagcctcagtttattcacctaaaaatggggatgaggacatcgaccacccaaggcaatggaaagaatacatacaattgtactgaagacaactgtaaaatgatgaacaaatgggaaattgtttatctgggaatttaaaaaccagaatcttccaagcaacaaaatgctgaatatagcaaaatctagttcaggtttaacagactgacatttgagttcttactgtgtaagagccaaagtagacctatttaatttaattctcataaataacttgtgagataatgctgttatcatatctattttacagatgataaacccaaggcacagagaagtgaggtaactcatcccatatcccccaaactagcaagtgtcaaagcctgaacacacacttgggtgatttgagcttagagcacatcctcttttttagtagactcactgcatgcactcatgatctcatctctggagtttcagctttagcgtcattccttccaaagaacacccaggactgatctcctttagaatggaccggttggatctccttgcagtccaagggactctcaagagtcttctctaacaccaccactctaatagaatggctctaaaattgtttttaaaataagcattcactttcaaaatcatactatcagggtgcctgaagaaagagtcagtatggcccaagaatacagggcaatgagataacccactgggctgtgaagtacctagatgatgaccattggtatgtcacagggggcatcctgagcaatttaggcagggcagagccaactgtgatggaaatcacagtgacatcatggtggtggcattagtaacacaccagctctgacctatgtggatccattatgtgctttggtggtgaacatctgttttattgcactaaactgcacttgtgcaaatatcagtcccctggaaaaagaaaccaaagagaaacttccagaggacccgggagcctagaccaagtcttctgtcaa

SEQ ID NO: 57234 - DNA, 1911 bp, Bovine  19866880574166
atctggagacgaaagaaattgcatgctcacctgctgtgaccccaaaactgtgttaggacacgaagttctcctggttcatgactctttgttgaccgactcttcttctttagggtttattgatcattctacctcttttaggcaggaggtcagcaaagccagtggcaggaaggggagattcagagcctaaagagagatgtaaggtggcctcttccctcaaatgtggttgcagggcacagcctcctcagtcattgagcatctgagcacatgcctaatgctagtataaagaaaaatctgcatgagtgcccctgccttaagataaccaaaaggccagagcagggagcccacgtgtttgtctttcccagtggtattctctagctgtgagacctagcctgctaaggcctgatagagagatgcaagtcttgacacaaagtcctctgctctgtcaaaggcaaaaatctttcaggagaaggaaagtactcacagttccaggacaaatcagagaatgtcatatgtggatattaatacatggtctttagcagttgctacatctcaaagagctgggcattaagtcactagacttactgctcctattattccgttttgggttaaacaaacaaaaaacacatacaatcattgaaccgatgaatgttaaaatttgaagggacacctagatgatgtcattcagcctcttagttttacaaataaggaaagaggatcagattaagtgttgcacagttctcctgagtcttgattcataacagacattaactagtatcagtggacatattctatttgcattggtggctcaggagagtcaatggggacataatacagatgaatctgaaactgtcaatcccatgatacattgatttactgagatgccaaaaggggcttcagaagtataccttattttcattggtgcttagaagagaaggttaactctttcattcagattttagctggtttctccttttgtttacattatcaagcagaggctgatgcagtgtgagccaccagctaaaggaaaataatctaagcaagactgagaacacctttattgaagtaagacagggtcttacttcagatcagtttgatttgtttctgcactgcaggaatcaccctgaaatgagcacatgcaattgaaattaattctagaatcttggaatggattgtagagaaaatcaagtttaaccttctcattgtacaggctcagagaagtcaatgattttttggggtcacgcagcgtgtgtgtgacaaagatatagaagaatgtaggtttttaactccagaatggaatgttttactcaaactattctcagactttcacaagccccaagggtgtttcttatggattttatactaaagatttatccatgcatgaagtgaaacaagacaaagatagaggtggccgtgcctgctgaaagccccggggtctaggagagcatgttggagtagaagctgaagctctccattgtggtcttagagtcgctgtgagaggggtcattggagatctggtccaaggacgagggcacggccttggggccttcctccaggtcttcgtcatgggcccccaccactgtggagacagtggtctccaggcggctgactttatagatgctgccttgggtctggaggtacctagtggatttcatttcgaacccttcatggtcaccagtactgatgaaagggcagcaccgaaaggcatgcttgaagcccagacggaacctggaaagagagtgaatggacaagtaacgcttgagtatagcctgctatcaggggtgttcccaccattgcagaagctgtttaatatgagggtatacccaaatgagactctgtcttcttattttttttaataaattgataactggagatgctaagggcaaagtttcaaaggtcagtcatcaaggtcaa

SEQ ID NO: 57235 - DNA, 1452 bp, Bovine  19866880714523
ctgtgctttgaccagatgtggctgaaagcagagccaacatgtaactatataaatgccttcctcatggtttgaagaatgcatgcacaagtcctgcgtccatcgtgttgaaggagaacagtggtgcacatcaggtttacagcccttaccagctgtgctggccctagccctgctagggcattggcaggccaggaagaagctgtatagcaatagtagaagccagaaggacctgacagccacattcgccaaagcagaacaaggaggattaaactaaggaaaccagctcagtgtaaacatgtggatggaatacttaatttaggggcaacaaaagtcagtgcccaaaacattttagtcatacttctaataaagaatcaggccatgtatggattattcacgtcagagggatgtaaagaactggcatgattatgagaagtacccaagaagaaaatgctaaggagtagggggactttctctctatggaagaggttagagttgaatttaacaaggactgttgaacacttaatctggacttggccctgagctggggacacacagcttcttctgttcttgagaaagcctatcagacaggccattgctaattcaccagtcttagttggtctaggctgcccagcaggcatggaggcagttgagaagcagattctccacaggattctaaagacccacactcaacatacataatggggtcaaagtcaaagaccttaagatggccttttgcaatggacattctttgagataattccaaagagagcatcagccaatctagaggaactgaagggatgtggttggacagcatcatcgctgcacattgtaggagggggcagtgtcaaatatggcagaacgtttcctctgagagagagagcccatcaagccttcccctgacccaccctccaacatccacttacctgataaaagtgctgtcttctcccctgtgaggaacaccatgatttgtactgtgcatgggtctcactcttatagaaatgtgtcaccctgcgtttatctcctaagtggttttccttgatattctgttcagtagggataaaatagaaggcatctttgggccatctttgttatgttacttccaaaatgtgggatccaattgctgtccttgagctatatatactgtgccaattcctccttgttctttcacagacagaaattaatgtatatcatagacacacagtagaaccatagcaactgagggatggggaaggaagactaaatgggaagaactaaaagacaagagttcttatcttcctcacctcccactaaagcactgggacatagtggaatttcctttttctcagaaagactaggtggaaccctgggaaaaggggacttgggagctaaacttattgacctggctttcaggaagaaccatgtaagcaaagacaggtagttcttaaggtttctatactatccaacctgggatcctgg

SEQ ID NO: 57236 - DNA, 1554 bp, Bovine  19866880956812
aatctccaaaatatacaaacagctcatgcagctcaatatcaaacaataagtaactcagaaggcagaggatctaaacagacatttctccaaagaagacatatagatggccaaatagcacatgaaaagacgaccaacatcagaaatgcaaatcaaaactacaatgaagcctcacctcacacaggtcagaatggccaccatcaaaaaatttacaaacaataaatgctggagagggtgtggagataagggaactctcctatactgttggtggaaatgtgaattgcaacagccactatggagaacagtatggagcttccttacaaagctgaaaacagaactaccagataacccagcaatctcactcctgggcatataacccagagaaaaccataactggaaaagatacactcaccctaatgttcactgaagcattatttacaatagccaggacgtggaaacaagctaaatgtccatcaacagaggcatggataaagaagatgtggtaatattccattatataccatggaatattatcacccagccataaaaaagacaaaaaatgccatttgcagcaacatggatgaacctagactgtcatactgagtaaagtaagtcagacaaagacagacaaatatcacgtgacatggtttctatgtggaatctaaaaataaggctacaaacaaacttatttacgtaacagaagtagagtcatggctgtacaaaacaaacttacggttaccaggggataaatgtggggaagaattaattgagagattcggattgactagacacactactatatataaaacagataactagtaagaacctgcaatacagcacaggaaaatctactcaaaactctgtaatggcctacgtgggacagggatctaaaaaaaaaaaaatgtggatatatgtataactgatttactttgctgtacacttgaaactaacacaacattgtaaatcaaccatactccaataaaaattaaaaaaaaaagaagaagaaatgtaaggggagaagttaagggaaagacatacacatagtagagatggaagtgtgccactaataaatgacttataaaagtaactattaaagtaatgtgaatgtcacaaatactaaaggtccaagagtatcaggagtttgatagccagtcacttgcacaaacaagctgtttttaatcagcttaaattataaatctgttgatttctactgtatattacagttgtgttcaaaaacgaaaaaaatttgtgactgtaacagaaatgactgatcttatacttagctaaagaacaatttaattttatcaagattacaaaacagtacctataagtcgaggaataactgttttgttgatgacagtagacaagattttcttatcagaactatcttccttctttgaatcttccatactgcaatctataaattcttctatagatgtaaaccatggcatctgttttaaacctatggaatcaaacttataaataaaattatccaagttataaataaattcttaatttttatctttatatagttaactttttcagtaattaccagag

SEQ ID NO: 57237 - DNA, 1194 bp, Bovine  19866881391070
accctggccttcgcagaggcctcctggctgcattcaatacagtggtgaacttcacctacgcagtccacaatgagtggtactatggcctgttctactgcaaattccacaacttcttccccattgctgctgtctttgccagtatttactccatgacggctgtggccttcgataggtgagcttgacctttgtggaaaaagggaaaaagtatctttaaaggaagatagcattgctatggagcttcagggtggaatagtgcatggttcaaggtggagattgaccacttgcaccactggatttgtactgacagctagccgagtcagttgttgatgggggattttaatcttatctgatgcttttcttttctgtctctctttccttttctactcctttccatttttctgtctcttttccattacatgtacatatgtgtgtgcaatcactcagtcgtgtccgactctttgcaaccccatggattgtagcccgccaggcccctctgtccatgggattttccaggcaagaatactggagtgggttgccgttctcttctccagtgcattgttcccacatagggagtgaacttgcatctcctgcattggcaggtagattctttaccactgagccgcctggaaacatccccccccccccttttttttcttcatttaactctttttttccccttccccactcatctccctgacatttttcctttcaactcctgctttgcttctttccatatattccttctgtcttctgcctttacagcctaaaggggatacctagggtatagccaagggtctggcccctgactggggtactgtgaatccttgcagggctgctcttctgctgttcagcctttggatgctttccaattttgagtacatgtaggcaaaattcctcattttcactttttcctgaagattcaggggctttttgctcccgtcttacccctctaatattatttggatgttaagagcattccattagaatcataaaatgcagaattctaattaagctctgtctatgctgctaggagttctcattcaggaatgagaggcagctatgttgttcttaaggaactccacatatagggatccaggagtttttcaaaatttctcttgccatgtaaggtcaatgtttttagactgtctgtatccatagagaaacatgcttggcaaaggcaatcaaaggcaattg

SEQ ID NO: 57238 - DNA, 888 bp, Bovine  19866881394637
tgtgcctgatgtgcaggttatcaacggcatgctcagggttagagttcaaggagagttagggatgctgcctcaaggctgtgtctctaggttctccaatgctccttctgtttttccttgctcagcctcgtgagcagagtgaattaatccccttaggccctccagtgaatctagctcccctacaggcatggtcatccattctttccctagagtgttttagagaggaagaggcctccatatgaatgatttcttctttactccgccatggcaatgcagacttggaggaaatgttaaattacctttttgtatgctccttgaatttttaacaggtcatctttgaattatcttaaaaaataaaagcaacatggttttcctgattgtaaaattaaaccttgttcatgaagaacatagacacaaaaatgcaaatcacccacgactccaccatgcaaaagtaacacctgttaacatttgaatttctctttttatgactatttcattacattactgaggtaagattctaggtaatttggtaggttatttttttccattgatattaatggaaaacatgaataatattttctcatgttattaacactcttcagtaacataatggtagtggcttcctcttaatattattccattacatgaatatgctattactactttaaccatctccctactgttgagaatctgctaattctgtatgataattttattttgttttcttgattgtttccttagggtagattcccagaaataaaattactgggccaaatgaaatgagattttaaagaatgcttcttcctagttttaaaggattctaaaccctgggcagagcaaggagcgtgtcttttctgtttgttactttatctcctcagaataagaagagta

SEQ ID NO: 57239 - DNA, 1013 bp, Bovine  19866880289695
gagataagccctgggatttctttggaaggaatgatgctaaagctgaaactccagtactttggccacctcatgcaaagagttgactcattggaaaagactctgatgctgggagggattgggggcaggagaaggggacaacagaggatgagatggctgaatgacatcactgactcgatggatgtgagtctgagtgaactccgggaattggtgatggacagggaggcctggcgtgctgcaattcatggggtcgcaaagagtcggacacaactgagcgactgaagtgaactgaactaaactgatgcaatgctcagaggacacaaagatgacaggcacagtctctgttttccaggatatcatctacagtagaggaaacatcagcaatggtatcaagagttgcttaggatcgtcatacttcatctttccccagtattctctctgagcttccctaaaaccatctcaagtaaatatgatctaaataaaacactgctctgccaatgtatcttagagacaagtctccttggcccccttctaccagattacttcccctaagccctctgcagatccacttaagcccaatgatgggaaacagacataaactttcagtggcaatatcatgggataaatgacataactatgaagaccactgtagcccagagtgatgactagtaagggattaggatgtcaggggataatttcaggaaattcttaaagggtgaggacacattacccatgcaaataagaggaaatttaggagaagggaggcagaaggggcagcctttgagaaggtatacgcaagttgactgtacaataactacaaagggcttcagcattacaagagctcaatgtgtcaatgggaggcgtgtcaaagattagcttgggctgatgaacaaaggaccagattatagaggggatgcatgtcttattaaaagtccaaatataaattttatattgaagatcatgatacccacagaatactaagcaagagagatattttaatgggagaaggaagaaag

SEQ ID NO: 57240 - DNA, 906 bp, Bovine  19866880345925
cttaggccttatatttgatatgcagtccatggggttgcaaagagtcggacacgactgagcgacttcactttcactttttactttcatgccctggagaaggaaatggcaaccctttttcccaggttcttgcctggagaatcccagggacgggggagcctggtgggctgccgtctgtgggggcgcacagattcagacatgactgaagcgacttagcagcagcagcagcagcagcagtgagaaacgttggaattcagagttacatgttgctgttgtcacacttccccaggtgttccagattgcgtatgtgattgtgaaagcagctaactcccctcggcctggaaactggattttggaacgctcactggataatgttgtttacaagccctggcagtatcatgctgtgacggacacagagtgcctaaccctctacaatatttatccccgtactggaccaccgtcatatgccaaagatgatgaggtcatctgcacttcgttttattccaagatacaccccttagaaaatggagaggtaagatgagaaaattcaccctcaatacatttaagatggcaaaataggcctgtcagaaagacttgaatatatcagtcactgatgtcagggagattttaaaataggatttagcagaagtacatttaaaataacttattaaataaaaagaaaagactgaagggtatgagaattttaactgccttcatctagtatgtatcttgtgtgtccaataaagatcagagagaggaaatgggtttaagttggaaagtcagtgattaattttaaagaaacttttctgacagtgaggcttgctaattattgaaggattgagaccttagaagaaaccttaaatctgtgtgtgtgctctaagtctgaagatagggacaaaagagataaat

SEQ ID NO: 57241 - DNA, 1259 bp, Bovine  19866880356029
tttatttgtgatgattaatacttggaggttaagaaattagatgacaagaggttgaactttatagtctaccttttatttaaaatgttgaaaactttcatgaattaaacctcttactgccctgggaaatcataaaatgcactctaattcctgcagcgcctcctgccacgttctatgctggacagacatttagttctattttaagtcctatttaaaatctatttatgtataaaacaatttagattctctgggcatgtctaaaatgcaagcactctggtacaagattgtggagtattaaaaccctgccaacttgggtcttattcaaattatattgaatcagtttgtgattctttgatttattatctatagttagattatccctatttttttaaaataggaagtcacacttattagcatatgcatacacatagaaaaatgaagtgtaaaactatgacaaggtgctctaaatcttgtagcatctgaaacttttaatgttatacttgccatttttattttactccatatggtttatcttaaccatgaacacattaaatggattccattgtgttaaatggtattttcagtgtggataagggtggaactgtatgaggacattctttgggaggtggggctgttgtagggttctgttttattttgttgacagtaatatatggtcctgtgattaccagaatctttttttggtgatgtcatgtgggaaagttagcatttattcttctttaacattttactagatctttagagtgttctaaaacaagcattcactacttagtagttaagcattccctctctttgtttgtttaattaatatattgatcggaaccaaatctataggatcaagcttattgagacagactatctgtgcctctttcaagagatcgttgctccgttccacacttttcagtaaataaaatatggacaaaactgaaacatgtggagactgaagcatccattaaagactttggcaatagcaccttaaagatatttcagaaataattccgctttattacttcttctgggccattgcatataacgagggttttaaaaagaccaaatacagctctctgatttccatttaatggaagaagtaataaagtttaattgtatacttgagcacagggcatcatttccagtacatctgatcaataattcatcgattgcctttggctcaaagtaatatttgaaagaaactgcagccagtgggagcttatctagctgtagcctcatcatctctattaattatg

SEQ ID NO: 57242 - DNA, 1331 bp, Bovine  19866880389195
tagttaagcacacttaccgtataatgcattgtacagagttacacgttccagctgctgccagctttgttccagtgtcatgattgctttgcaggctgacgttcctcagggagtgattcgagtacaagctccccatctttcgaaagtttccatggcaatacagctaactgaagaactcaaagccagtgatgtacttgccagatttctcagccaagaaaggtagaggcctgttttgttttaattattgcatggtatcactcacttgctctctctccctccccgctttttttcttttttttctaaacgatggctggtgtgaaggacttaaaatgttagcagaagagaaaaggagacctaaaaataatactgttggaatgagtcgagttcatcgcgtgtagtttgtgttcaagttgagcctgttgcaggcaggcggtctgagcattccttcgctctgtctgcagtggacttggcacatgacactactcagtattctttccagaatatggtgattggaggttaattactatgtgtagtctgttaggaaaatcactaattaggatacagtgggattaaaacaaaagatacaactttttcaatgaaatataatgaatacaaagaaacgcttaaattttaagacagaaggtataaagaattcagagggaacagatggccaaaggagttctgaagtcacaggtcaaagcacaccctcctcagtagagaccaccacgtcttcccctctgttatggggctgatgaggcaggaggagtcttttgaaagccattggcatcccttttaagctggagaataattgctttacaatgttgtattggtttctaccatacaacaaacaatgtgaatcagccgtaagtatacatatgtcccctccctcttgaacctccctcacaccttcccaatacacactttttgagacatgtttgagatatcttttcttgaattttggaggttcaaacagggtatggatatttcagtgttcaaattcttatttttagctaaaattatattttaatgctttcctttctcatttccacttattgaaataaataaatctaacttttttttttaaagtcagagacctcagaggcattagctgtttagcttctttatactgatttcatctccaatagaatttaatctcttcattctttcattcaagttttctgtcaaaatttctccagttttaatacagaactgcatgtatttaatatgtctctgctctgtctatggccctctgctagatgttgaaaagggtataaaaaatatcttaaagtgtgttccgttgtggtttgtaaattggaagaagacatgagcctgtg

SEQ ID NO: 57243 - DNA, 1421 bp, Bovine  19866880395879
aatattggtattttggtttctgttagtctattattaccatactataggagggtcttaaatagcaggttcaggtttgcagatcagcatccagtttaccctgatttaaaagttaggaaattctgctaaagtcatagtgtcaactatcctgacaaagagggtttctttggtgaaagtcatagtcatagaaattatttccataattatatcttctacaatcctagattatcaaaaagggcaggaaaacctatactgacatttaaagtgaagtaagatgatatgattaagtttttaaatatagaaggtcctacaataaatgagttataaaatcaaaatgacccagaaaaataataaatctgctatagagagttcaggcatatagcaaccttcctctgctccctgcctctccccactattccttgtggcacattccattctttggataaaaaaaatgacagtcaaaatttgctgaaaatacccacgctttcctgtatttatgtacattttcctccccttctgaaatattccctggtatccatccatttttcaaggccaagctcacatacctcaaaccccgtggaacactccatagatggtttctgacttcacagaatcaaaaggaaattcctctttccattgaaattcccactgaatctcttttataatggagatcctaatttatgacacttgcattctagtaacatgccacatatctgagtcacatctgtagccatctttcaatgtttattgattaaatgagtcactcaaaaatatttttcactagggacttcccttgtggggccagtgcttaaaactctatgctctcaattcagggagcatgggtttgatcccatgtcagggaattaagatcctacatgcacatagtatagaaaaagtctcactcaaaatcatatgctaataaaagtaaaatttctccagaataaaactatagcaatgagcactttccttactagcaaaacatagtcttaggaatattgtctaaaataaaaaagttaagttgcctctatctaccatatgatattactattccccttgctactgagaaaagacagggagggaaagagaacagaggatgcagtcactttccccccaaggcatctcatgaacagctgaagacccctaataataggaccatggctacacttcccaaatgagttcggggatcatactgtggagagtatggccaagctttcttgcaaaacacaacagtgagatcaggatggtgtgagggagttgtacccaatagacagcaccgcacctctcatgggcatccagactctctttgattgttagtttagaaggaagaggcccaggtaccagcatctgaaggcacttgagagttctcaagtgtatgtgaaaagtcaggtaattgctgtacttttggcttttgccagtatatggga

SEQ ID NO: 57244 - DNA, 1248 bp, Bovine  19866880414738
tatagcagttttaaggaaacaatttaagggggacaatagtactggaaacgagttatttgctgagatagttttaaataaattaacagttcataatgttactgtatttaaatcagagctataactatactaatagtgaatgagttacaaaaatcagtaaatttatcatctacattctgtgtttgagaatttcaaataagagcaaaatgtaggtaaagaaattttaaatgtcgcctaccgagaaataaaaaaacccacattacctaagagctgtggatggctgagttttgaactacaatattatctttgctttgcagaaagacaaggtacagtatggtattgcatgaaatgactaaaattaaccttgaaagtccatagttgggtcctgggttggaggaagtaaatggagaacataagccatagtctaggagcttagtactgccttgcccttgttcaataaatgttctgtattcaacaacattaaacctactcacttttacaacttttgcatgttagataaaatttacaggaaaaaaaaaaaacaaacagaatgataaaagagcctcagtacatttagaattctatctactcattatccccttccctttaccatttaaaatcaattaccaggcacatgtttaaaacaaacaaacaaaaaaaactaccaaaaaatagttttgtaaatgaaccagattgttaaaaagctttcctcctaaccctgaaagtcctgaagtaaatggtaggaaaaacaggtgttctcagaacagatttcaagagtatatcttcgtgaaggtcttttctttgctcagtcttgataccaggcatattactgccacctctgatgctcagaaagacacagagatggatgaaccacctgggcagagaataagagcaacttctctctgttgctgctgctgctgctaagttgcatcagtcgtgtccgactgtgtgcgaccccatagacagaagcccaccaggctcctctgtccctgggattctccaggcaagaacactggagtgggttgccatttccttctctctgttaagtggctgctgctgctaagttgcttcagtcgtatccgactctgtgtgaccccagagacggcagcccaccaggctcccccgtccctgggattctccaggcaagaacactggagtgggttgccatttccttctccaatgcatgaaagtgaaaagtgaaagtgaagtcgctcagtcatgtccgactcttagcgaccccaggactgcagc

SEQ ID NO: 57245 - DNA, 1773 bp, Bovine  19866880428094
actgggcagtgtacttgtaaggtatgcgctgctgaaatttaggaaggaaaaaaaaaccttactcagttctatgtgcattgctgttttaacttcagttatttattcctgcatcattaagctgaaaagaaggacatacgaaaattcattgccagacgcagagacttttcctgatatacagataagcactgctttttaagaacttattttcaaccagaacccaattttttttttccctagctcaaatgaatgatgtattttcgaaagtaaagtttagtttctctttacgtatttacttttcttaaacaagaataatctggaagggaaaagaagtcagttctcttaagcatcactagagaaaaccacagctaaatgataaagtttatttttttaaaaaattactcttcaaattaacccacaatcactgtacactgaaaaatatatttactgctgtggaagttcagtaaaatttcttcaagtataaacactgacattacaaacagtgactgtatgcaaattccagccctcattaatactgctaaatgatgtagaaaaacagttgattaaaaatgataagaaggattttttccccctaagatatttctggaaaatcaatcccaggataaatgcagtaaagactgggtcagaagcattagtatattttcaagaaaagtctatgcaaagagggtccaaggaaacaggaaggtgaaatctggaggggttgtgaagagtcttgagaatttaggaaaatggaagcttctgccattaaaagtcctagacaaaacaaaaagtatgatggtgcattattacatattatggttatatattatatttaatacatgctatatgtgtgtatattcagcattccaaaataactatatgaatctatattttaacatctttcttgcttttcacaactttgcatcacatcaaagtttgggaatcagtggaatttcatttcactttcaaaattctaatgactctttcataatcctcacagtggaatagtaggaaatgtgctgcttaaatgtaaaagaaaataatatgcaatattcttaataatgtatgtagttataaataaagtgtttttttagaccaatgacatgctaacaaagagattacctactctgctatttgagatgtgaatttaatattcagtgttcttttatttattttttgtttcattttctttaaaacattctcctgttatttattcttgagtttatttctctcacaacttccccatatggactctgaagaactctcctctttcttcaggtgaatgtggaagggatccactgtgacaggtgccggcctggcaaattcggacttgaggccaagaacccacttggctgcagcagctgctattgctttggcgccactactcagtgctctgaagcaaaaggactgatccgtacgtgggtgagtaaggacctgctgagccatgtaatggtataacgttagttcctgctggtgtcttttagccaggcaccaaggggcaggaggaaatggcaaaacgtttaagtaaccttttcccctgtgctcatttagaactggtagaggggccatgtgccattagatgattggagtagacaccttttttattctttctttaaaagtattcatttactgtggataaggaaatagatgccaagtgagcaaggaaaacattataagggaaatgttatgtctggggatgggaagaagctgccttctgcagagtgagagcattagagcaggaaagtagatgtgtgcctcatgtagtgaaaatctgaa

SEQ ID NO: 57246 - DNA, 1222 bp, Bovine  19866880532291
agaggctgtgcctgtgacctcagggactcaggcacgagggaaaggctgaactttgtctcactcagctatagcaaatgaagtacactttcagtgaaattgaattttctcagggaccttcgttatgaatacctgattagcccttaaaatagcaacgtgattattctaaaagttcattgtggaaggcgatattgtgatttgctgctgaacatattaaagagagaagtttatccatctgaatcatatagcttcattgaaagtagttttaacatttaatctgcgcttccagggttggggggagggaacgaatgtatttcagttttggtagagagagacttttttggatatattagaccatgtgtttgtgtaaacaatttatatttgttatcagcaatggatattttctatgaacatatttactactgaagaagtgacatgaaaatcagtaaagttacttaggctttttaatgtcaaaaaagtaaaaaaatcattaaggttttaatagttcctgttaggtatagatgtgtttccttcaccataatttttataaaaaatgtacattgtacatatatttatgtgcctactaatatgttgtggattagtggttaagatcacagcccctgaagttaaactgtgaggttggaatcttacgtctcttttaacaatggccctcagtgtcccatctaagtttgcctgttgtaaaggggagataataatgctgttcaccttgtaggattagtatgagggtaacatacacttgacataaacatgctgaataagccttgcttaataaatggtagcaacttttgctactgttgtatcatgctattaaaatataaaaatagtatccccaaaacaagagtgctttcagtaactaataacaaacattaactccaaataacaggtaatgcataacaagatattatagacatggttcaatcttaacatcttaatgtttttgccaagaaaaatgtgccgaaaggcagctggttctcacctattactgtagatactgtgtacgtgctaaattgcttcagttgtgcccaactctttctggccccatggactatagtctgtcaggctcctctgcccatgggattctccaggcaagaatactggagtgggttgccatgtcctcctccaggggatcttcctgacccagggatcaaacatgaattttttatgtctcctgcattggcaggtgggttctttatcactaggccac

SEQ ID NO: 57247 - DNA, 1577 bp, Bovine  19866880595996
agaagacacatgaagcagttaagtattctgggtgggaggagggacatggctccagcttttgcaatacttaagtgcataagttttgtgtgtatttagtcactcagctgtgtctgactctgcaaccccacggactgtagcccaccaggctcctctgtccaggggattctctagacaacagtactggagtgggttgcaatttcctactccaggggatcttcccgacccaggaatcgaacctgtgtctcttacgtctcctgcattggctggcgtgttctttactactagtgccacctgggaggccttaggctttagtaaattaacatatttgaaaaatccatatcagaacaccacgtagatacacttttaaaaatcatgtttcattacccagtaattaagttgaagagtcaccttgtcaaaacccacccaggagagactccataaagggagccaatgacaaatatattaccatctatgggtagtggtgctagactgtaaaagtggaattcacaaaaatcagtttcctccaggacaggccattgataatgtgacagatgaatgctaactaccacatgataggagctatctgcccgattccgtttggctcttcttgcattttattaaattatcattcccatcccttagtcagcttcctccttactcactattatcttgttcccgagtatctgacaaatgtcttctcatttaccctaatatgtacaatcttcctttcattctctacattagactttcttatttttacattctcttacctctgttctacaatttttccagtgttcctttgtaaatgatgccttatacactactttgcaagtatttctctttcctttgattatctttttacatttaagttcactcaactaggtattttttcctttttcttctattttctttatggttgtttcgtgtgtgttttttttttagagtatttatatccaggcagcacgcattaccattagacacacattcatttacttctgaacaatgtagctgttacttcttgctttagctcaagcagttctcactgtgcctcttgaaacctgcacataattttcttggttggatattactagtgtctttcattttctgccttctttatgttaaaactagaatctaatggagcaaatctaactactgaacagacaacattgcttagttgccgtcctcctttgcatttccaggcttacacagtttcctgctgaaattaaatttcagatctaatcatttacatgatattctcaagggtcatcttcagatactactggttctgtatatccaagggtcagtgaagtgccaggacaagctactaggagagacagtgcccaaggacagagacggtcaactgaccctggggaaaaataagtcagttctatgtgaaatttctccttaaatatttcagggggtcagttttgaaagttccaaataagtatgatttgttatacgttatctctctctctctctctcttaaatataatagtagaaatgaaaaaacattggcaacttaaactttttggagctggcggggtacagagttatttgtttaatgatcatgggaaata

SEQ ID NO: 57248 - DNA, 1080 bp, Bovine  19866880619090
tagtttttgtatttattttctgtgtatatttcttaacacaaaagaaaaggcactttgtctgaacacagaaaagctgaaatctagtctttttaataggattctcagcaattgaaatcaaatcagaacctatacttcacctacttggggaagagattactacttcagcagatttgagtacatttgctggtttgtcattttctgagctaaaggttccccctctatgcaccctgctccaacatactcatgtgctcacaaagcagtacagctagagcctatcccttctccagcgggtcttcccaatccaggaatcgaattggggtctcctgcattgcaggctgattcttttccaactgagctatcagggaagccctgagtagtaactaccccaataagacatttgcacaagcagactgcatagttcagactcagaaaggataacaaggaggcaatcagagctggagatggtagttccacgtgaactgggattctctgatctacccacaatgattgacttgtctaccctccttacttttatgactcctggacagtcatgaagaagataatccacaatgaaagcagaagaagcacttctttgtttagtgagccatttggctagcacctttcaaacatgaaattggacccataagggagctgttcaaaattatcagtgcatggcattggacaaatggtagtcttttgcatctaacaacatggtaaattagatgctaaatatattttaccaagaaagcaatcaaaatgtaggcagctaaaaaaagaaaaaaggatcgtgatgatttccaggcagttcataatggcaacttttctggactttgtgatgtttgtggtcttgtcagcatttttcactctgcaatgatttcttattctaaatattcactttattaaaagaaagtatggattaaacaccaccaggaaactaagaaacagatcttccttatatgaataaatgaatataaaatgaaagtttggaatgacagaggttttggagacattgaagggacataaacaagagtgaagataatcaaaagagaagtttgggaggttttacatccatttttgatt

SEQ ID NO: 57249 - DNA, 1274 bp, Bovine  19866880628294
actgaaggaaaagcccttcctatcttccaatttgggctggaggaaaacaatgcaggaacaagctctgcaatcttatccttaagcaatgctagacccaaggctgagactcttaaagctctttggagactgagtaacttagaaacaacctgaggtgcaaagttcagactccaatttgcatcatccactgagcagtaatatgtttgctttcctgggtagagaatcgagtcttcctccttgaaacctctgcaaaccttgtgctcttgactggcagggattcccctacattcttgagcatgagagagagtttttctaaatgcctagcaaatacattcatcagacattgctcagtatagattcttctggtctcctcagcacagtaccagacacaggtacatggtcacatgtaccatgaaaactagtcatggtatgtctccaagtttgacttatagcaagtgggtattcatgcaaagcaccggaggtcaatctaatagagcccatacagatatctggctcaatcaatgaatataaaaatggatattgactgttatttgtgttgttatttgataactttaaaaacaattcttttcaagattgatttcattaatattttctctttttattactgtttgatcatgtatgttctgaggaatggtagagagcttcaatctatgctcattaacattcacaaaaatcccactgggcacgcatggtaaggaaagctttcctcatgctgctgtctatctcagtgcaaagagcctaaccctcaaagctctgcagcatcaagagtgaatggaggctgctgactcctagctacatccctggtccctatttccagtgaccttatgtaggtttctctaaaaatctgcataaagtttgggagcacattttcccacctacactcgagttagtcattgaaatttggctcttcactagcttgtgtaatgaggaagaattttgcccgtgaaatgtgtttcatgcaatgcttctacaatgaaatttaattaatcagttctagattcaaaacagaaggacagtttccctgtgtactgtactttcattattccaagtaccttatttgccaaactgatctttgctctttcaaaagagcacagaattaaccatttgataaagaaaagctcatttctcagcacattgacctactttttccttaatttatctcctttttaaaatgtgagtgaatagatactttttatgaatatttagcattgagacaacaattgaaccattaatcaaaataataaggatttttccat

SEQ ID NO: 57250 - DNA, 1100 bp, Bovine  19866880638665
tttgtatgcaaatatgtacattcagaaacctatacactttaaataacttctcatttcctttagagaactcagcccctctgagctgaaagaataaatgaatgattcaaataaataagaatgaagataggagtaaaataaaatttgacatatcccaactttctttcacagtgttatctatttaattaattcatatttcaaataattaaataaatagaatagtttggctgatgacattattaaatctgattcatatcgcgaggaaaattttcctcaaaatataacagagtttgtgttttccaaaatataaactaattttatcaaatttgcacaagagaaaaataaaatgatactggtacagccgtatgacacccaaatgtcaaacacagcaaagtatctcactcaaagcaagagatcactgccctgcctgctttatttttctaatatatggtccactcagtacttctaaaaaagtatataaactcttctttccaactgttatttacaaaatatatatatatgtatatacttggagtaagattaataaatccttgaaagtatatatatattttttcatgatttaaaggaccttaacaacgccctagtcaatgcagttacttgtgctgttgctgaatctcactttatgatcctctcatataaattgttcatgaggggacttcctcttataggctcttgaaacaagaatgtatcttgtacatttatgttacgggtttatgatgatagattgttcttgccacagaactggaaactaccaagccagtttataaaatctgttgataaaaatagtgctcacactaaagcagactcatttaccaagcaacccaagccttctcaacaaatattcaatttcccaaataaaattagaaatgttctgctacatgagaatatgtgtaataagagcaaacatgtttttaatttttatttttcttattaaacttaaatgaagatgactctgatgaagcagcatgttttttgaatttcaggtgatacacctgtgactcaaggttgtattttttcaccataattgaaagagacataaggtttatcctacaaagtgctgtttgaatgccaatgttcatcta

SEQ ID NO: 57251 - DNA, 1793 bp, Bovine  19866880692020
ggacagaattcacagttcttacatctccctgcattggcagggtcctttcccactagtgccacctgggaagccccaaccctatgcttcaagggtcctttgtctcagagaccctttcagctcttgccatttgaagcttctttcaagggtcaaaaaggccgtttccattcttcctccatccaaacctcctttctccctccttcagcttctaattcccaagaagcaacccagcaaactcttataattaatactatctagagacaattaagcaaatattaaaccatttagctagagaaacatatagtgagatggaggattttaaaatcatgccataaatactgttgtgctttcaatatttgtagtcaccagaatagtttttaaagttgttctaaaagaaagaaaaaggcacaaaatactgtatttcaaattaggcttctattttttaaaataacttcattgttagttttgactcaagaattataaagttctgctgagagaagaaaaattataaaaatgtcaagctctattattatcagtgtccttctctgtaccgctatgtctttgagccaaagaagaggtaggagcactgcacaataaagaaatcatgaatcctgctctcaaatgagctctaatgtcctgggctcattagcacacgagccaagctattaagagatctgtaatgtcttacaaggactttgatttaggattgccccacataaaaatgacttcagctattagggcagcgattgttgaatcaccagtattaattttttttctactgccatatagtaacttactagtaaccacctttaaattaataagctagttgattacattgtatccattatttttctatgtattctcaactcctgtactcagttgaaattttgtatttcaacagtgaaagtatattaatactaaagagatcattaaaaaagacacagagacatagacaagaggcacagagatcatttggaatcagagctattctcgaagtatcactaaaatcatctcattattaatatttttacctttgcaatgaattttatggatgctctagcatatcaataaaccattcttgtcaatgtaattttatctaattcagcataaagatttacttttcaatgatgaggtgaggaaagtaccctatgacacaaaatttaagaaggcagatgcccaaggcatctcatccacctcaccttggtcagagtctttgccaataaagccccagaaagaatcaacagaggctccaaatacccagtattgaaagaataaagtttttattcactttattgaaagaataaagtttttattcactttaagtaataaatggcattcattgaacatttactatgtaccaggcattctctcagagaaggcactgggcaacccactccagtactcttgcctggagaatcccagggacagggggagccctggtgggctgctgtctatgggggtcatacaggagtcagacacgactgaagcaacttagcagcagcagcaggcattctcttgaatgcttcacatggattactgctttaatacaacaaactggaggcagacataataacccacacattacaaatggaatctgaggttcagcatagttcagtaactcacctaaagttatttgtacagcaagagctaagccagggtttaagtaaaatgctcttaatcaataagccattcaatctacaaggaagggaatgatatggatcttttacaaagtaaattttttttaaaactctcatttcatcagaatgcataagggaacagcaactaatgtttaatat

SEQ ID NO: 57252 - DNA, 1045 bp, Bovine  19866880699355
ttagttcttctctttctcagtagagttcttagaattgctgaatacaaagtgtgtgacccagcaatcaaaagcaagatgcaccaagacttttcccacagaaatgagtattttaaagccacaagtaatgatgacatcacttctctttaaaaaaaaaaaaaaagaacttgtaacaaggctgctgtcaggtgaaaaaaagaacattttaactgttcagaattgtgccattcttcataactctccttaggaaattcccttcctgggaaattccttgttcactttggccctggctggaggggatcatgacttaggcagagatgacatgaaaactgtcattttgtaaaggagatgcaacagaagacagaactgagctgcctcagggcaatgaggggtgaacatcaagagcagtaaggacagcagagtggaactgcttgtttgaaagcttacctgagctgctttggttaggaaatcaagacgtgaaatctcaaggtaaaaaagctagcttgtgacaaagccagagtgtcttggctttagcgggaaagatcatagaagaagcttttcttgcaaacaacctggttctcttacacagtatgcaggtacgtgtaaaaaaagccaatggaacctctcaaagacgtcttaagtcttaaagagttaaaaaaaaaaaattacatggagggaagtgggttctagtgtttcacatgaaaccctttctagcagatccaagttatgccatgcaatactttaggacagaagtagagaaaaacaaaaaacaagcaacaacaacaaaagcaccccctccccaccaaaaaaaaaccctaaatgccaaatccagattttaagatatgagactaactggaatggaaattcttattgctatatttattaaatatgaaatttgagaaatcaaagactcagaaaagtaaagagaatgtagtgggacctctgtctgctagaccagtgattgccaactgaagatgcccatgaccatcctagaagtgaaaaaggaaccaaatacagaaaataaaccaaataagagtttgctttcttc

SEQ ID NO: 57253 - DNA, 4164 bp, Bovine  19866880727269
tgagttttagacctatattaccaaatcctttttttttttttttcaattgttcttttagtctttgggaaagctggaatagtaaggagctaattttgtaagttgtctgttagtctaaaattccctccattccattccattatccctctttatcgggacatagtcattgtttatttgattaaggaattcttgctactctttgtttttgctgtgtgtgtgtgctcagtcctgtctgactctttgcgaccccatgggctgtagtctgccagactcctctgtccgtggaatttcccagacaagaatactggagtgggttgccatttcctactccagaggatcttcccgacccagggatcgaacccacatctcttgtgtctcctgcattggcaggtgattctttaccgctgcgctacctgagaagcccagtcctggttagtctttcaaatagttacagaatcctgctttcaagtttttttgttatgtttcttcttgaaaacattaggatttgaagaaatatgctaatgctagttctgactgagttgtacatagtcaaatgtttccagaggaaaccactttttatgagtagctatatttataagactttatttacttgttaattttcaagtaggttttttaatgtttacttttgcaaagcagtttttcaaaaaatactgcattttggctatccttactattctgccttgactttcctgtcattttaagaagagctgtttgttttatttgcttcctatcagtttttgctgatatttgataaatattaacgtcagtagtatttttcttcttactgaacctctgactctagttatctagttatcatatgagatatttttatgtcttccatgagtacatgtgtggtgttcatcatgaaagattttgttttgctgaagccatttgccactggttttgggcagaggcagaaccaggaggcacgaggtcacagtgacataaaccctgaaactctgggtgtggggccaggctgcatggggtcgaatcccaattctgccagtcattagcagcttggccttagaaggattctttaactgtcttgtaaattgaacttcatggtagtactcacttcacagggaggattacgtgggaagatctgtgtaaagcccatagaacagggaagagtttatggctagcctctgctttttttcacagtagatacagaaaaataacttattgagctttgtggtgtacaatatattctttttcatttcagaagtatttttacaaataatattttgtcatgtgttaagaaacatggccatgatccatatgcttaactaaaaatgacataaccagcaattaatgatgtaaaagttcaggccttggaagtttaaaagaccctggagatgtccttttgatccaaagcaacatttacaatttgaactagtgacagccacttataacaggccctgccttggggcattgatgggccatgctgaggtctgcaaacattgacttttatggcaggctggaatgtggggtgggtcctcttttggcagctggactaattgctgcctccatgcttctgtcctcctcctttaagaattactgcttccggtgtgccaaattaaagagggctgccaccttcttatgtctttcaagttgaatttgtaacattagaaaaaaagtacgctaccacagatagagttctttccttttgaatttatgtattatttgaaattatatatttttggtgacagaaggaatggtgaagagtttttataatgaaattatgtaatatgaggaccattttccttgaccttggagtttaagggtgatttgtctttctgattttgcaggagttagtgaccaaatgcatttttaacctgcccatacggataattgttttctagatcaatctagtcctcatttcctggtgtaagagtgctttctaaaaactgattttctttactgtgtcatttaaaagtcctactagtaattttctcttgagttgttaaaagacacagccagtattctaactagacaagtcttaccttcatttagaattgtgtggtatttgccttctaaccatcctcatctgtgaggtctctgatttttgtgggcctctttaaaatatcttcatgggacttatattaggtatatgtcttttaagtataaggatttataaatctcaagaaccccacctttttttttttaaaaaaaaaaaaaagcaaaacgaaaggaacctgctgaaaactttcctcaacttcaatggcacacttaggtttttcactgtttaccctcatttctcttctgagtgaggctagtgctttgcaaggtttatggttgctcttttaagttcttagtatttgtcatgtttttgagagtgttgtagcaaaacaaactcacaaagactgatgcatttaacagtgctcgtgatggcttctggattgcctggcaattagacctaaagagtttttaataattggcccaccaaaatgaattacttttttctcttgttttaaaattcctcattatctgtacacctgagtatcatttacagcttagaaaaaggacccggcatcctagaggcctaggctacacttgtgccaagcagaagttcccagtgtcccatggttgtggatctgtaaggtctcacattctttggcagcctctgctctcctacatcttgtctgaatgctacccagaagtccagagaagcctctctacttgttaccccgtggtggccctgtgagaaagcttgcaacagcagaaacttgaggcctccaggctgtggcttcggtggtggtgcggtggagggtgggcatgggaagggttagcagcgtggcctccaagcttggtttggggaagaaggtgtcctagaccaggtgtgatgccagtcccttcctgaactctcccctctgggtgatttctttcctgacctaaacctttcatttcatacaaatactccaagataaaatggcttgttgtcaaagttttagtcagtactgatatttaatgtctttgttttacttttgataagaggagatagaaagtaagaagttttcttacaggaggagactgggctttcccagtctattcggtgaagaacccaccctcaatgcaggagatgcagaagacaatagttagatccctgggttgggaagatccctggaggaggaaatggcaactcactgtcttcttgcttgaaaactcccataagtagaggagcctagcaggctatagtccatggggtcttaagagagtccgaggcgactgagcacaaagcatagatagggacaagtcaaggtgttgggtggattagggcagagggagcagacgggatgatgtgtggataattctgaagacacattcttttgacttctgcatttgttgctgggagctggccaagtttatccccttttttgaaagaagtaaacagaaaccatggagatctgcatggtcagttactacatctggagtcgttactcaagtccaccaaacatctgaatttttgtgttgggaaaaaaaatggtgacatgtcacccctttgacacatgctctttcggtagtcacttttgcaaagaacacttgtgtctccagggaaaatgaggtttattgcaggcatctgggtcataaggaaaagaccatgtcgtcttccctcaggactggtcacatgataagttgctctcttttggggactctattcttttctgtccactggctgtataatcatattttgagcttgagcttgtctcttaatggatgccccacttgtgtagccctctaagatcttacacctcatagcatatgagctaatttcaaatttttgaacagggatcagttttgcccagttaatttttttgagctgtctggggaagcccatgatttgaccatctggggtctttttagagaagcagattctgtcaatggggcagcttccctccaaagataacttggcatctttcgtaagctgtttagaatttgatttcattcctcgtctatgaaatgagtgtgttaaagttctgcttcacaaggttaattataaagatcaactgtgtagcttttgaaagcattcaaaaaaatgtacacatcaggcatataattgctgaatcattttcaatactctaacttttcccaggacagttcatttaaccagaattgtcatactgaacttttgctttaatttgcactttc

SEQ ID NO: 57254 - DNA, 2288 bp, Bovine  19866880770935
aatgaaataaatgtaacactgtttccacattttcctcatctatttgccatggggtgataggaccagatgccatggtcttcgttttttgagtgttgagtttcaggtggaacctagcaaatgttaacaaggaagaggacaactgacagatgatcactgaatttagcaacatggctatccttggtgatcagggggagtggatttgatagaatggcagggaaaaggtagggttgaagaaggtttaagagagatggggaagagaattgggaaaaaaaatatgaaaacactttcagagagttttgcttataaagaagagcagagacatgggttaatggccgataggagatgtggggtcaagggaaggttgtttttctttcctttttatagaaggaaacaagggactggcttttgagaggtatatggctgtgcacgtggggttcctttgcagtactaggagagacctcaaaggatgttgagtgctgacactggcaactgtaggtggtggtggtaggaccctgagaagttctttcctggatgcttccattttcccagtggaaagtagaaatcaagattatcagctgagaatgaggctgtattgggggtttaggaggtgagtaggtgtaaaaaaagtcattcaggggagtagagagtgaatggactgggaaatacagtatgatcagaaagtagaatggggattgccaggggctggggaaaagggggaaatggggaattattatttaatgggaacagatattaggtcagctgaaccaaagtctgtgaagttgtgataggagagagtagatttttgagaagatagggcaagaatcaaccagacctcaggaagaaatgcctctttgatcagaggctgtgattctggtgagctgctctatctgttccaaccacattccattctccatgctggagaaaggtcatttgttgagaggatattgagtggctgctttgtgcaactctcccaggaaggggatgggattagacaagctaactgaacaaatctgtccagaggcttttgtggaaatggagtcttgggggtagaaaactgaatgattcacgggaggaggaccatatacccgtccactggaaagctgagcatgaatgagattattcagagggccaaaaaattggggaataaccaaccttcattttttaagtgaattgacatgaggaaccaaggcagaacctcctctgtccttaccttcctcagctgcagctgcttcctcctgttctgtgcccctgtatcaggccacagcacctcctccctctcagtcctagcctgtgccttttgcttcaggtacgatcatcccctctgtgagactattatagtccttctgcaactccacaggctcttgtgtgtgtcctctgtaaatggtgtatttggcaattatgtcaggttggaccctgtactttgggcctgtgcactgtcaaaactgaacctcagtataatatcagtactgacttcaggaactggattttctaccatactcttatgaagggacagcttctcaaatatacaaatgtgactttgcactttttgcagaatacttgtggaatagaatatggccatgaatacataatttttttcgtattttatgctcagattttaatttttcagatgaatcacttgctgagattaaagtaacatacaactagagggatacctggagcctgtttctattggggccaagagattaaaggtcagtagaaaaatcagatcaaaaaatagctagtgcttatttcagatcctctaactttaatgtctaacttgcctatagatcactacagtgcactagactagtcttagagtacatttcttttatttacagtcatcatgggaagtcaatttgtcactgctctggtcatgcactggaaaattatttaatgaacactgattttctgtgtgtcatagtggagacggattatagtgtcaaaatcaagccactgtggttgtgattctgtccagtgcattcaggaattcctgattgaccttcacatgatgaacaaattcttgctgtttctcatcatgattttccaagattttcactaacttggcagtttgcagtattgatcaagtcagagttgtattcaactatttgctgcaaaatatcaacttgtgaatttttttttaaaaggtcaggttatggctattaccacagtacaatttgtgtagaaattaaagtggtgcttcttattcacattccttagaggtgtataagatgggcagggatttgggaaaactactgggagtgagggagggggagcctttagagggatag

SEQ ID NO: 57255 - DNA, 918 bp, Bovine  19866880786081
atgaatagagtgtttggttgttttcaggtttcactgaggttcttttgatgaaagttttcctttgatgtaacatttttaggtcttttaaaagtaaacaaagcacttggtgaaaaatactcagtgaattttacataacataggatctaaagataaccatatgtgaaagatctcagtcatatgagagactattttaattacatttcgataactggaagtaataactgcctttggagaaggcaatggcaccccactccagtactcttgcctggaaaatcccatggacggagaagcctggtaggctgcagtccatgaggtcgctaggagtcggacacgactgagcgacttcacttttttcactttcatgcattggagaaggaaatggcaacccactccagtgttcttgcctggagaatcccagggacagaggagcctagtgggctgccatctgtggggttgcacagagtcggacatgactgaagcgacttagcagcagcagcagcagggtaagaaacaagattttgtaaaaaaaaaaaaaaaatagtacttatcaccccagaattttctacatatatttttatagtaataatgtggccatatgatattatttatttgcatactttcaataatgtgtaccaacaattttatccctaggatgcaagccagtttgacagcaagagtcatatcataatatcaaaaagagaagagaggcaaaaacacagaaagggagggaaaatggaaagaaagggaccttatagatcatctagtcctacagttatctgtggtcacacatcagggactaaatacatcagctggtgaaagagctatccctgaaatggccagctatttctcaggccaatatttttcccctaacagaatgatgtttcttaaaaaatatataaaaacactaaaagtaattag

SEQ ID NO: 57256 - DNA, 1398 bp, Bovine  19866880794569
ccctgcattggaagtgtggagtcttaaacactggacccagggaagtcctggtgatagatacttttaagaaaagggagctcttatagatcagatatagtgacaatacatccgaagatgacgttctttcagcaaagcctaggctaacattttattaattttatgtctatacacataacattctaatatcctaatagtagtattttgattaactttattgcattatgcacactacctttaagtggtttattacctaaactctgtaatttatgcttgtaaagtaagacactgttccctgaataattattctggtctctggaacaaaattaaatattttttccaaaccttaccaattaatcttttgtcctcatttgagacggtattgtttctacataagcttattcttggattacagtttaactttctgagcactggatcaaaaattagatacatgaatctcattgttagatagtaaggctatgactttagtttgtttcaaactttgagggtctatataacagctaaaccggattcaggatcaagcttttagagcttataggaattttttttccctaaaaattttgtgagagaagaacagttttttgttgttgttgtttttccattttggcatagtttatttggccttttttacgtaggaattttaggctaaatatgaaaacatgcttcttttaatagttaagagttcagaaacaaagccaatagataggtaattaagttacttcgcccccatttgctcactctatgacatcacgtaaattacatccattctcttagattctgttttctcatctgtatgatggaagtcgttacagcttcgatttccaatcaggattaagtgaaatgatgtctacgaagttcttaaaacaatgccttgctcatagatatcattgactatctgtgcagttattgttgttaatggtttagaccaaaactgatgtgcagaagaactggaagctttctgtcctggcagaagggtggtctaagctgcctgtggttgttgtgtaggaggggcttggaggagacttaagtattggcgatagagatgggaagtgggtggcatcaaactgagcataaactagcttggtctggtgaaaagcttcttttcatttttttttttttttttttaattctcttctttttgtctctagctattccccttcctccccatcagagtagatttcatgtcagccagctactgaatcccttaaaacaaatgcaactgagattgaatgaatccttttaaggtttttcttttctttttttaaaattttaattcctaaagtacagcacttcctgcaaagtgaatatctgtttgatattttaactattttttcagtgctccatggcttggtaggcatgcagtttgatgcttctccattc

SEQ ID NO: 57257 - DNA, 1529 bp, Bovine  19866880800997
tttgtttatgttcttaatacccgcacctggggtgttctggcattatcagtgtcatgtttggattggaagtagtgaaggaagagtgtcaggtagactgcggaggcctgggaagtgttcccaacctttctataaaaatcagagttttgtccaaaattactgttgttgttcatttgccaagtcatgtccacctctttgtggccccatggactgcagcaccccaggctcctctgtccttcattatctcccagagctagctcagatttttacccattgagtcagtgatgctatctaatcatcttgtcctctgttgcctccttctcctcctgccttcaatctttgccagcatcagggtcttttcccataaattggctctttacatcagggtggccagagtattggagcttcagcatcagcccttccaaagaatattcagggttgattttctttaggattgactggtttgatctccttgcagtccaagggactctcaagagtcttctccagcaccatagtttgaaagcatcagttcttcggcacgcagccttctctatgatccaactctcacatgtgctcatgactaccggaaaaaccatagctttgactagatggacctttgttggcaaagtgatgtctctgctttttaatacactgtctaggtttgtcatagcgctccttccaaagagcaagcatcttttaatttttcatggctacaaagtcaccatttgcagtgactttggaggccaagaaaagaaaatttgtcactttgggacattttggagtcttggagcatctaatatctttatctttccttccatgcttttatctcaaaacttctctcctgtacccctgccttcaaatagatacatacacataatatgtgtgtgtgtgtgtgtgtatgttcatatgtatatatgtgtgtgcatgtgtgtgtatagacacatgagtctatatatttatatttgtattcataaaagcacctgctttttactattctgtggaaatttcttcagttacataagtatatcagattaaaatgattgggtgtttccccaggcctgtgtgcctgctgacactggaatggcaggcgttggaatagcccttgctggctgggtagagaactgggttgtcaagagagacagatgaaccttttgtgccagtgtcaatatgttttgggctttggagaagagcgactggcaattgctaaatgaatactgaggaaaacattgtcctttcttggtgttttcctcctttgctggagatgctgatatagcctatgtaaacagaagttctggaaggcaggctcattgtagcagctttttccagcctagcttgcggcagccaagtggaatgtgacaagcttgctgcctgatttacatctgcttttgctggaatactatgaagtgggcagagagcctccagtgagaataataagataatgtgtatgacgccatccaagtcactgaggatttactactgcacctgttctgggcaataccgtgctcttttgctagccaggaattccccagtgt

SEQ ID NO: 57258 - DNA, 1140 bp, Bovine  19866880906102
ttgatgagttcagacatcatttatggataaacagggaattaagggttttattcaatactagacacacagtgggaacttaacaagtattttatagtcaatactgagttgttataaaggagttgttttcactttggcagttcttttcttcttttagtccactgaaaatctaaatgatcaattttgcgtccatatcaatgcactttgggggacatagggcacctctattagtgactgtggttctactaactgactcagaaggtgggagtgcttcctgaaaaagacagtttgaacttcaagggacagtggttttacaaactagctgaggataacttgtgtaaaacaaataatcaggtatctgaaaaggagcaatagccttacttgaattcctatctcactactccatggattctgaccttgctaaaacccacagtgtcctccctacatccaaaccctatcctttggtccttaccttaatccaaatctgtgcagtatgtgaggttaatatttccatccttctagaattttcctccttcgacttccatgataccaacttctcagtttctcttgcctttccaacctcattctcagtctccttccctggaaccctacttttctgaacacttctgaaatgttgacagtcaccagagtgctttcagttggctatttgtcaggtttcagctatctgggtagcctcaagtttatatttccttactatatgctgaccactcagaaataaacatacctggacctgatttttgcctaaaaatccacattcagcaggtgattcattatatacctccccagctgatattctgaattaaaatggttatctttttactcccagatctgtattatttattttatctggtaacactaagacccctacccaatctcctaattagacagtcatcttttctcctcaccattctatatcttaccaatcaacagccctactaatttcatctaaataactctattatctgttctctttaaatgattatttattttatttttcaatgtgttgcatggctttatgagcttccctggtggctcagtagtaaagaatccacctgccaggaatttgatccctgggtcagggaagatcccctggagaaggaaatagaaacccactctactatt

SEQ ID NO: 57259 - DNA, 1760 bp, Bovine  19866880922042
atagtagaaacagtgacagactttaattttttggctccaaaatcctgcagatggtgactgcagccatgaaattaaaagatgcttgctccttggaagaaaagttatgaccaacctagacagcatattgaaaagcagagacattaccaacaaaggtctgtctagtcaaagctatggttttgccagtggtcatgtatggatgtgagagttggcctataaagaaagctgagtgctgaagaattgatgcttttaaactgtggtgttggagaagactcttgagagtcccttggactgcaaggagatccaactagttcatcctaaaggaaatcggtcctgaatattcactggaaggactgatgctgcagctgaaactccaatactttggccacctgatgcaaagactcattggaaaagaccctgatgctgggaaagattgaaggcaggaggagaaagggacaacagaggatgagatggctggatggcatcaccgactaaatgggtatgagtttgtgtaaactccgggagttggtgttggacagggaggcctggcttgctgcagtctgcagggttacaaagagttggacacaactgagtgactgaactgaactgaaggatgtttgttcaagaggcaaacagagaaggaagacaagagacagtaggagatttaatccaaaagttgtaaacactagccaaataatcctggaccatctttagtggcctagaactgtagaaatttgcacagctgactgtgaatgttaattcttcctgtgctggttagaaaaagcaaagtgagaagaaaattatctgtaacattaggtttttatgcatttatcattttaatattttatttccaatgttctattacaaatgctcaataaagtatcattaaataagtccacttaaattgtttcttaacatttgctggtgaaagaattccattccaaacaggttcagatcgattaaatgttcaaagagtttattataagagtaacagagataaagcatgggtagtggtttctatgatacagggacactcaagacatttaagcagctttagacctgatgagtttgggcaggtcataaggtgatttaaatcatttaagatgctctcagaagtgaaacaaatttatttggaaggttacaataaaaatttaagcaagacctttagtttaatttagctgaataaaagtaatttttcagggaaatacagcctgatcatttatatgttagaaatgatgaatgtggagtgataacaacatttgagaactgcaaaaactattcaagccattcccatttgatagcatataaccctgctcatctctatgctatacaaactgttaactcttattgattaaacatttatggataataaacatataaattttctataatcactctagctaaggacaataattgtcacttcagcatacccttccaatctcttctatatacgtgcttttatagatagtggaaactccaatttataaatgtagctatagtatcaaacttttttcataaattatgccagataatcctcttggtgtccagggatgcttttagttgtcctcctgctggtgtttactggggcatgaaatggatattaggctaagcatgaatactacagcacattggtggacatgaaaaaaatatatatatattcaaattatgtatatatctccacaaaaaatagcaatattttggattttgcctgcttttagttatttcattgctactaatttctgtgcatgaaaattgtgaatgtt

SEQ ID NO: 57260 - DNA, 1120 bp, Bovine  19866880946777
caaaattcctgaatatagcacagtgtttgagcaagcaaatgtaatctaaaaacattcaaataaaaacagtgaaaatttggcacatttataactgtttaccatatgatagcagaatttctatttttcacattacataaacttagcctttttctagattatttactaaatgtatatattacagaacagagtatgttttttattctctggtgtacatattctaatctctaatgaaatataaagcatagtgaaaataaatattatttgttttctgtttagacttggtttttaaagctacaaatccatctaaatttacgtagtctagatactattcagaagaaaaatgtcagtcataattgtgtgggtaatgatgactggcttttatgtcattaacattacatgacctcaatttgaattgaggttgtaagtcgatactctataaaggttcaccatctacttgtagttcatttacacttgaaatgtttatataatctttaagtaacccatattgcatatagcagtaaatattactctgctgcttttgaatggaaataaataggtacagtctaacagatttaacttataatgaagtgggctgcattctataatatgacctgctgaagattcaataaaagctcagatatcgactgactcttcaaattggtcattagcaactaactggggactttccttgaccagtacactttactgatttttaaaaataaacaacaaagtaactaataaaatttcaaaaggccactgttccttgaccacaaagcaaggcaagtaaattatgaagaggttaatttcaagtacatgatcaataagtgtaacagaaacaaatcaatggaaagaactgaaagatagtaaatgtaaattttattgatgtctttagtttatgattggaaaactctgaaacaacaaaggggtggaggctggataagttatttcttttaataagtatgtaaattgataagctctgctgagaaccaggttttggctcttctttaagccccaatgagaattagccttctgagttaaagagctaaattcaaatcttagttattggtcttgctaattcataacggtgcgtatgttgtcttcttgagctgcattttcttca

SEQ ID NO: 57261 - DNA, 766 bp, Bovine  19866880968658
ttttcctttaggatatcaagtatcagatcatcctttttttatgtctttgctattgatgttcaaatttaagaatcctcatatcctgaggcagaaggaacatttccaacaatacacagcacaattctatattctttattacctcagtggtttctctcttgtttccactctcagctaggaaaaaaaggccttttcgtgatatactgagttgtagttaaccatccagaaatatagtaaataacccacaaaatgcagttttaacttgagggagatcatacgctcctgcagggcagcagtgtttccccctttgttttgtaccctgtccagctgagagtgacccctgcagaagggatgcttaaacatgacagtgaactgaaagccagccctgacacacagatgctctgtgacccaaatatcctttttcaaatcagaattctattcttgtatgagaaagtgttttacactttaaaaaggaatgatggatataactagagttctagtagaataaaaccataaaataaaatatctaaggaatgtatggtaaataaatcataaactattttgtgtaaatttgagaaggtaaaatagggtggaggaagttgagaatgagaactataaattatatatgtgcacaagtcagccatgtaggtgatcaaatgtaagatgagtgctaccttttttccagacaattgcaaagattttctggaagtgacggagttaagggcagtttgcgtgtgagaaagggaagacattccagaggatctacact

SEQ ID NO: 57262 - DNA, 1531 bp, Bovine  19866880986060
agagaaaggtctgcatttttatgtctagtagttagggatagattaattcaagaggtgtttttcttcttctccctcagggggaatagaagttgctgttaaatggaccagaaagcttatgaagttttggtgttgccatttacaaagtatatggggtgctatacgtttaattggaaatgttttatattagtcattagtagcctggagatagccttctgttttaactgataatacaagtcccatgcttttctgcataccatgatataaatggtggttcactgagaaaaactgatgaggagcctaaaaattaatgagacataaaagcttttgactctgaccttgagatgcaatttggtatttatgatgttaaatcacttgccttcttcagagtagagaaacagctggtctgtgtgggagggatgttcagttatgattgagaagaaagaacagagatgttgaaacctttagaaacagtatacatatatataaaaaaagaaaatattacaaaattcaatgcagtgtgctgaagttcaaagactgcataaatgttgcccctcacccaaaacagtatacagttgctgtgctgatgtgaatttgtgtgaggaaaatgagtgtccaaagctgcataaatatttgcacccctgtgagagtgtgagaaagtgtgtgtttcatgttgtgattgatgggactgcttttatgccccctttgaactctgagcagaaattttggagtatcctgagggtctgtctgcctttgtatggcaggaactctgttttcttagaaaataataaggaacactgtttgtactccctttgttataaaagggtacctacagtttatgggaactggggaacttgtagaaaaatcacaaactttcttctatagcttacaaggaatactaagctttattttgaaattttggctattgtgtttccttgccttctggagtttttttggttttgttttgagttaaggagtccatagtttgacatactttcgatatatgtgtgatgaaatttgtggattcaggtgggagtagtttaatgatttatctactaaaaacaaaaagaaatgagggcaagcagatctaaaatattgtgtgattatgtttacttgaatgcaatcatttctgcagattagaggctttcactattgaagcaagaagtctgatatatcagatttccctggtcattttaagtcagaattttagaactgaaagtatcaaataataaaagtgttacatatgtgaggtctccaaaatatactaataactattacttcatagaaatctcaaaataatacagtaaaataggaaaaccattaacatttgcacaggaaaaatgattctaaagctctttcagataaatatttgtgaagtcatacttctgtgaaatactcatgagctgacacattatgtcagctcttcttgcttccatattcagaatgtggttttgttcctcagaaacaaatgtttttaaattgtacatctggttggagcagggctagctaacactcaagactcctgacttctttc

SEQ ID NO: 57263 - DNA, 730 bp, Bovine  19866881057974
aatgaacactatatattgtgtgctgttccactactttcttcctactagttctttgattcccataacaactcaatgagataggtattcatattatcattacaatcatccccatttaaacaggtaaaggaattgaggcacagagttctagtgactggattaatcttacacagtttgcagatgctgaagccatcatttgaacatactttagagtcagaaatattaactccaagagatcctaaagttcccacacagttctaaggagattcttgcttgttcccataagctttgctcacgtgctcacctacagacacctggcctctatgaaggatttctctcctatatgattcatgctccatactgatttctcatttttctcagttctttccacttataggctgtacagtacaatttggaatttagtcatttacttctacatctctctgtaatatatgtgaatcttgtcttgaacataagcccttaaggcagggattatatcccatacttggtattctctctattgatagcttaaggtctgagtatcagtaagctctcagtgaatacttgttgagtgattgactgtcaggctccaaggcatcatttctggaagaaacaactagagagatttgcataaggcctggtcattcatactaaagatttcacattaacaaatatgcagtcaatgacaaagagctccacttgtgaaaatatcaccaaagcattcatagagaag

SEQ ID NO: 57264 - DNA, 1030 bp, Bovine  19866881059649
ccttaatcttgcttctggttctgtgtctcttgttggggaaatggtggtgataactcacaccaggtgacctggatgtcattcttgactagtcttctatcatcacactagcaacccaacttctaaatctttcttgtctgacatctcactgatctttcttatagactcgagaagaagaaactaacttggatatttattatagtttacctgctttgtctcatgatatttccatatgtagccttgataagaatataatggatatcatatagtacatccaggaagtcttcacgggtcacagttctgctgattcgaggatcatcaccataatatttccattctttctgttaacgagaaaagaaaccactgtgaagaaactcagtgcaaatgcattggcaacatggcacccaacacctaaccaccttacctctgtcatttcaatttcatgcctagtcaattggccaatcagaggagcagccatatgcctgatgataatccttgcatgagcaggagttccacctcgaatgataacttgtgggttgtatgtagagaaacctgtctcttccctagcctcaaaatagatggtgtaccctgagtttaccgccataggccatcaactgacaaaataaaatgagaaatgatgagttagataaatctctgaatagccttattctaaaaacatgtttcattttgctctcatgtgacttcaacattcttgtccttaccttctttccttcaaattgttctggaagtttccaataaaaaggttccaaatggagctcttgtctcaccagatccatgtgtgcaacgatctccggatgctgaaaaatgatgccttttgtagttgtgtgctgcagggcctcatccaccagtggcaggatggtctgctcaggcttcagcgttacctgtgtgggggtaaaaacacagcagggtgttaagtgtaagtctttggaggcctcctctaaaaggactgtgtgtctatctgtggccctgtccccatatgatgaagtgttctcatgagaaacataactcatgg

SEQ ID NO: 57265 - DNA, 1099 bp, Bovine  19866881061001
tctgaaattgcattttattgatttaagtaaattataaaccgagaattagatgcatgctatatgtaacatagcttatttcttaaaattatacagtaaatgcacataattctggaaataaaaatgttcaagtgctacttggtattaaggggtgaaatgggagtcccactggaacaccagcagcttttgacatgggacctgtggttcccagccttcctgtcaccgtcagtgcttatcttttggctggctttctgtggtgttttctctttctgtcttgagtttataaactggttattcaagttattgtaatatactttcagaaaagcacacgtgttataagtgtatcttttgcaaactgaacacacccatggagcttgtacttggacaaagaaatagaatatagagcagggcggcatgccccttgcatcccctcagcatcgatgttcaggtgctaagatactctctcctgttgttttgtcctttttcttccatttgctacacacacggacacacagatacatatagtatatttagttctgtagccatagaattagcagcagtttgggagagaaaaggtgagagaaagaatgccctgagcatccttttgaatagctcaggcaagaacaggtgttattatcccaggaggaagctggaagtgacttttttgtaattggaagtgtgtcctgccctgataagaacttgtggatcaggaaacaagaggctggtaaatagccaaagggaagaaagccagaagagcttgctgtgttcctccacttaaatatatgtcatttctttagagactgcaggttttacaaaaagatagggactaatttgggatgctacttacctctatttccaaaagaaaaatactcctctaaaatatgattttaagtaggccatggaccaaaagtaggccataagggcttgtcaggcaactttatgaatttcaaggttctaggaaatttcctccattgggagagttcccctcagtgtttgaaataatattagaaagaaaggcagcagtgaaaactcagccactccagtaaaaacctctcccacaggggaattatggggtggtagaatcaaagtagtctcactgctg

SEQ ID NO: 57266 - DNA, 735 bp, Bovine  19866881163633
gaggctccatgttttctcttgtcttcattctacctttcaggagaaacccctcatttatggttccaaagaatgctgaaatatgcttccccaccctgcccccaactttttttctttttttactagaaatcccgctgtgaatgtgagcataacacgtgtggtgatagctgtgaccagtgcgtgtcctggattccatcagaaaccttggagagcaggcacttttctgaccaaaagtgaatgtgaaggtatgttccagacagtcaaacaccatgtgtaagtcttcctttcctggggcacaggtggtgtaaacacatgctgatttcaggtgaactcgtatgtcaaattcatatgcatttcatccaagacagtagctgtaagctcttttactctcctgttttaaagttttcaagattttatttttttgacaaatatttacaaaatacttatgaatttaccactatgtgagaatgcagcctaccaggctcctcagtccatgggatttgccaggcaagagtactggagtgggctgccattgccttctctgagagaattatgagatgtagataaaagcataatatacacttactgttatcaggtgtgaatctaaagtttatagcataacatatatgaacttctgaaagtgttagtctctcagtcatgtccaactcttttgtggccccaggaactgtagcccaccagactcctctgtccatgggatttcccaggtaagaatactgg

SEQ ID NO: 57267 - DNA, 2557 bp, Bovine  19866881169756
gtgacatagtggaaaagcgggaaatggaaagcaatctgagtaagagaaaagggaaagtgtggaagagccatttaataatttgtcacactatgaatctaactacctcatttttagaatgtttgatctagaaatcataaatgaaggtcaatatacaagtttgaccatttttattccatttgactgggaaaacaatctactttaattcagtagagatggctgtgggtccagtgaccatatccacttgtatgtgttctccaaacattcgctcataatgagaaagaggtcacgggattactatttacccttgagacaggtttttaatatctgtcttatgctctgggagttggtgatggacagggaagcctggcgtgctgctgtccatggggtcacaaagagtcagacactgaacttattgccatgagaaaagtactttattaatctttcagaaatacattagaatgaatcaattatagatcttccattaagataattagatttttttttcatatttgcactatgtagatggcaataaacataaaccaaacattttgagagttacagagtcatttagatttattaggcaggtgaagttctttaaaggcagggagaaaaagaattttaaaacatttaatcaatgactaaatagtttttggttgtggcgataaaactttcaaagcaagtactttgtttagaaattcatttattatctgattttttgatggattctaagagacattgtaaaattctctttgggaatatcaaaaatgctgtagtttcaacatgccaattcatttttttttcaatgtctgttgttacatactttatgaaaatatgatactgtcattcatcagatcactttctataggagtccaggtttcagatctcccctgtttggattagcttttctttactggaagtcccttaaggccaaattcaagtctgggatacagtgatttatggtaagaaatataatacatatttggtctttgtccatttctggcacagagattctaaatcccttggaatctctcagttgtgagagcaataaaaaagggtcttttgttaatgagatgactttggagggggttgaggatggggagcagcttgggatagagattggggcaggttcctggagaaactccagtctcccgtctaagtataaccgtccaaccctgagtagcttctgagatcagacgagatagggcatgttcagggtggtatgaccgtagatgaaacttcagtctcatagccaccgtccttgcctgagactgagtcactagccaatggccagcgatttaatcagtcatgactacgtaatgaagcctctattaaaaatgtaaaatgatggggttcatggggattcagagcttccaagttggtgaagcctaggagatttggggagtgtggcatgttcagagatcatggaggcttcataactcttatcccacccattgtcctatgtatctcttccatctgtctgtccctgaattatatcctcttataataaactgataatctagtaagtaaaatatttgagttctgtgagttgctctagcaaattaattgaacccaaggaagaggtggttggaacctctgagtcataggttagggcctggatttgcgactggcattttacgggggcaggagtagtcttgtatggctgagcgtttaacctgtgggatttgacattatttccaggtagacagaattgattcagttgtaggacacccagctggtgatatggaggaaaaccccacactctggaattgggtgctgagttggtgatcagaagttggatcaaagtcagaatttcaccagggtctcaaaacctctcatagtggccccacagcgccccttctccccttaatttctatgtactctaaagttagcactgactttggcttgttttgtctcgctgctatgctctggccagtcttttgagtttctatgagtcaacattcctcttctctgggaccacctccacctctctgccgctggggagggttatacaggtatatttgttctatccgattcttcccacaaccacttatacttacaaatacttatgatttgatcataagtattcaacactggattcatgctcagccaatcatactttctgtttaggaaatttaaaatttggatcaagaacagctagtccttcctgtgggagtccttgaaaatgacttctgtaatcagaatttgtctgtttataggcagccactgcaaggtatcccatctggagagaggtaagaatgaagcaaccacatagtggggagtagagatgagcacagaatagctgatgaggaacctgagggtttttagtccctgactgcacatacttatgaggggtcagatttctgttcctttcctgggttaaatgaatattatattcgtgataacatacacccttgtgttgatttggctggtttgatggatatacttacgcactgaagaaacttggataagatatatgcttctcatctcaacagtgcctgcatattttaggcgtgaaaatatttgggaaagatcaggaagataacttttattctctctt

SEQ ID NO: 57268 - DNA, 1458 bp, Bovine  19866881260341
ctgagtgtatgttgtcctgggactgaaggtgcttttttttcctttaatttttattcaccaaccgtaagatctctggaatcttagtcactgaattcctctacctgtataggtttatttttcttactctttatttattgccttcacatgcagtttcctagccaaatgactaacagttacatcaaaattacacttacaagaatcttatacttacatacatttggtataaaagtttgagaaaccacttttacatctcaaatacatatataagtttacctctacccaaatgcctcttcatcttaactttgacaatacgtccaatgaaagttttaaatattcttacactctttgagtcagtaataatttttctgggatacatcttagaaactgacaaaatgaattaccaaaacagttgggtgacaaatccatataaaagtcagattgtttcaaattatttgctttcaataaatgtaaagaaggacctattagttggtagatcattagaaataatctattaatagaccattatgatttttggcatgagatatccctgggaaagggagtggctacccactccagtattcttgcctagagaattccatggacagaggaatctgcggggttatagtctatagtgttgcaaagagttggactaagcaactaacacttttccacaaacttttaaaggagttaaaaaactatcactattacaactaatttttaaattccaatttatatttgtatgtaaacaagcttctcagtgcatatatatatatatatatgaaaaatagaagatgctaaatgtattaggaataagcaatacctatacatagataattaagctgagaaaaagctaaaactccttttctcattaagagccccactttcaataaaacaaactttgtatttattatcaaattttatgatatatttttgttgttggatcagctataacttcagtatatataattttatgtttcagagaaatggattaatctgtatcattgactagattactttaggataaatttgtaaggagaaagtacaatggaaatagaggttcaaagaaaacacagaacactttaaagtatcttaccattaatgtagactttttaagcagttcttttttttttttttttaaactttacaatattgtattagttttgccaaatatcgaaatgaatccgccacaggtaaaatagataacagggtatcaagtcactatggtatcaaaattcctcttgaaacattttaaagtattataatgtcctttgcaattatttatacttatgaaaaattttgcattttaattaaaatatgcaagatattttaaatttcatagtatttcaaacaaatacagtttgtaaaaattatcttagaagaatgtgaataaaaaaacttggagaattacaagcatttcagtacatgctgtttacctctccataatcaaaatttagaaac

SEQ ID NO: 57269 - DNA, 878 bp, Bovine  19866881346603
tggagtgggttgccatttctttcttctttaaggaaaactattatttatacttctgagaaaactggaatttccttctcacttctacttcacttatgaagagttatctgcttagaagattgaacagggaaagtgacaagctagccgctgccgggttatgagtggaaaaatatgttctttcttcccctccccgtttctgtctcccactgtcttactttttcttgaaaattatcagtgctagaagatttctgtgaatttagactttcaagttggtgtttctcaacttgcaagtcagccattcagtcccttagcttgttgctaggcaacccagcacagtttttaatgtaacccaccatataccatttcaactgccactgttcaaagatcagcttcctagggtgcttacaagggagacctcgctgcagggctagcttaagaggccggctacttgtgcagtcactgagcttaatgccctgctgtcatcattttgaagttcttaataatttttgaacaaggtgcctagcattttcacttggctctgagctctgtcaattataaagccggacctggctgggtggaccttacttggctacagtaaccctcagctcaatagataatcaaggcttctcaagttaccaaagccacctttccctggtctctattttcacaaaataattccaagtacaagctgcttaagaagtcttttagaacacgaagtacacaagaaaataaataacccgcatgctctcaacagcacatctgtttttaaagatcttcacttaatagcactggatgggccactgccccagtgcatgctgagtcagcagagattctcaaagagcccaaggtgggctctggatacagaaagcttttcccagaga

SEQ ID NO: 57270 - DNA, 761 bp, Bovine  19866881395560
ttattaataataaagtagctgaaaaacagcatggagaattgcaagttgcctagtgatttcagatctaagctaacctttcagaagtggaggcatttctcctccatcttccccaatggatggacctctattcacatttcagggctatgaataccctgcaaggtagatcatcctatttcactaaggtagttcatttcattttctagatattataagttattatattatattatatctatataatatcttatatagatattataagtttctagatattataagttaatttgtacacataaccaagcagtactccttcccctcacttccttatgtaggctcaagttccatgctacaaacagcaagttttctacctgttgtacacaccagaccttcaaccatttgtgaaaacaatcatgttttccctagtattttcttataaggtcaaacactcccattacctttctaaaccttttgctcagcttttagagccatcaacatcccagtcattcctctttgaatgaactctaatttgtcaactactctcttaaacggtgatgtcaagaatgtgctctgactggctatggtcacagctggatcattgcttcctttaatctgtatgtttggtatcttcttaatacagagagtacattgtttgccaatatatcagagcatattgaaaatgtgtttgtggcttataaaatatgtatttgtgggcactggagattgcactattatcctagcatatagaagctaatgagaagtaa

SEQ ID NO: 57271 - DNA, 695 bp, Bovine  19866881547276
agaatgcgctcttattgcaatgttctaaatgtattaagcaagaacagaacaagtcctgaagtgggacacttctgttttgaaagagatctctgtgaatgaatgaagtaataacacttaaatgggaggccccttttccgagtttaaaactctggggcttggaatctagaaagataaatcacctgcccactttgtgatactaaattgaaattgacaggtatgtttcatttatcttgctcaatattacaaagcctctccctcctttgattttagtatgttcctcctgaaatatttgctgtggtaagaaaagcaaatattgggttttacgccccacttcgtgaagtaagaattatgatgttctaatatcagagaaccaaatattccaggtttatttttctgaaaaaaaatttccttgcagatagattgtcctccatagagcatccattcttcacccctcaattcattcatatttcctggattgggggaaaagagaacacacaaaacttaatacaaaatactttcataaagcttagctttatgaattaacttcagccttttccactcatgagggaaaactttcctgcctcattaaatctttaatgcaatgtgctgcctgcacactacattattatgtgtgacatgaggttatatattgcatagtaactataatgttacttgcaatcaagctgtttctttcc

SEQ ID NO: 57272 - DNA, 921 bp, Bovine  19866881626621
acagcacttacaacaatagtgttgctaactatagaaaatgttagaattgtctatgagcaaaaggaaggctctgtttattacaattgttgctatttttgctataagaagggaaaagattatacaatagtcatatactatccaaagtaatgaatatacttataaggcaaaatacttaagcagtaagagaaagattaactaaaattctcattcacataggaaatagcaatgttgataactcctttttacagtgttttcataaattttccacaatgattgtatgttttattttcattcgtcttttatgtgaaaagagtaagtatgtttctctttaacttaatggaacttggattaaaatgggttctgttattttaatcacatcagtgttgcatatcgtgaggaaacagttttctatttccttggcagagaactttaaaggaaaaaattaagctctagtcaataagaaactatgtttatataaaaccataatttatggtttatttgattagatcaatgtttaattatgtattacatgtattttttgtactgaacatttacttataaattaatccaacccgcagcaggaatgctaatagaagcttccatccaaacataataagtaaacagaagacaaacagctgttgcaaacatcctatttttgagtctgggcctgataacaaaaaatagtttggtgaattggctgctaccatacactcacatctgttgagactgtactatttcaactcaattcttgatcactgcatgtcacatggtagcaagtagttctcttaagttagagaacttagagaaaacactaaatgctaatttatgtttgggaagttgaacttctaagctcttcatcttctatgtaatgtttagtgaatttattcatgagatgtttatatttttaagtgtactcaatgg

SEQ ID NO: 57273 - DNA, 838 bp, Bovine  19866881845170
cttacatgagtctcttctgatatttttgtttgagggacataaatacaagctcatgctctttgcatagcaattaatttagagatttgttacacttttatactttggattgtcaacagcagacacagaggttttaaaatttgtttttttttttttttaagtcaaagtattttatttggtgtagtgaaatgatatatttcatttgataaagatggcactttaacaatacaataatttatcaatgtacctttagcaactacatagatcaaatcatttttttggagatacatttttttcttttgtttctttatcttttctttgctcattagcccatttaaattcctaatatattcttgattaaatttttacttaatgtatagaatataggtaaatatgagtaaacatattcaacactttacttttcataaaaataattcaatttttctaggcttgtaaatggattagaatatatatttccaaatatattgaaatagatactgtcacattaaaaaacatttttttaaaatctcctggtctgtagttatgtcccctttctcatttataacatggtcattgtccctcctttctttcttcctccctttcttccctctaccctccctcctttccttccttccttcctttctgtctttcactccccccactttatttccagatttaccgaagtctattctatcttttctatcggacttctatctattctatcagacttccctggtggctcagacggtaaagcgtctgtctacaatgcgggagacccagatttgatccctgggttggggaagatcccctgggagaaaggaaatggcaatccactccagta

SEQ ID NO: 57274 - DNA, 1342 bp, Bovine  19866880411360
actgacatcttgatttcccttgcctatctctatgagttcagaactcagctgggaatattagaaaggggcttatgaattgaccccaccaaacaaaacaacagcatccaaggaagaactttgcgtgtatactgatttaattttatttcattaattccaggttggtttgtattgctaataccaagatggcacatgatgttaaatctgagtcaacatctcaaaggaatgtcaagtaattggaaagcgtccagaggaaacttaatagaatggtgagagttctggaaaccaggccatggtagggaaaggtaaaatgaatcagaagatttagttcaaagcagatttggctatgatatgacacagtcttcacatttttcaagggctaccatgcaaaagagtggtttaatcagattatgtgacttccaaaggcagaactaagtgcactgatggatgttccaaggaggcgtattttggctcattataaaaattatatatgcaatgactagcattggatagaagtacagttaccacctacagatggccctttatgtgtattatctcatttcatcctggcagcagtcccagagagatcagtatatgattatctccatttaacagataaagaaactgaggttctggcaggtagattaatttgccctaggtcaaaaaactaataagtggcaaggcaggagttagtacatgcatcagtcattgttctatgtatgtggtcttaaccactacacgctactattcaccctgaatgacagtgaccagacctgcacttagatgtacctgtgttgtttcaaaagaggaacagagttttggttttgtttctgttcttcttcttaatgatgcccaggtttggtttgactttctaggctacaggacctcagtaaatgtaagtgtttatagaaaataggactcagggcttccctggtggctcagtggcaaagaatccgcctggaaatgcaggagacacacgttcaatccctggtccaggaagatcccacaggctgcggcttaactaagtctgtgcaccgcaaccactgagcctgtgctctagagcccaggagccacaactactgaaacccacatgctgcaactattgaagcccacacgccccagagtccgtgtctgtaacaagagaagccactagagtgagaaccccacgcactgcaacaagagtagcccctgcttgttgcagctagataatagcccatggggcaacggagatccagcacagccaaaaatacaattagataaaattattttttcaaaacaggattcaatgaaacccagatcctttcccagtgtttcaattgccctatctaagcctttgacccataaa

SEQ ID NO: 57275 - DNA, 2043 bp, Bovine  19866880704508
gagacaggtaagatggtctggtattcccatctctttaagagtttccacagtttattatgatccacacagtcgaaggctttggccatagttgatgaaacagaggtagatgtttttctggaattccctagctttctctatgatccagcgaatgttggcaatttggcctctggttccttttccttttctaaacccagcttggacacctcgaagttcttggtttgcataatgctgaagcctagtatgcaagaatttaagcgtgaccttatttcacgggagatgaatgcaattgtccgatggttagaacattctttaagttctccccttcttaggaattgggatgaaaattgaccttttccagtcctgtggccactcctgggtctttcagatttgtagacatattgactgcaacaccttgatggcatcatcctttagggttttgaatttgaatttcagtttcactggaattctgtcacatccactagctttattaacagcagtgcttcctaaggtcctcttgacttcactctccagaatgtctggctgtgggtgactgagtgcaccatcatagtaatccagttcataactccttaaagaatcatgacttggaacagcttttgcttcaggttggcttctactgtcaatcagtacacattttagggttggggggggtacataaagaaatgtggcagtgtacctcaaaaccataaatgttattcttttacctgataattcaagatttggacatttctcttaaagaaataatctgaaatgtgagaaaaagggaagatgcaaaccaaaccagtacatttacaaagttatttaaaattgtgaactatcaaaagccatcaaaatggtgacaacattgtaaaattagaaagaaagcaacaaatgtcattaaaatgaagaaaaaaacaaaatggtgacaaatgattggtatagtctccggatgtaaaaagagattttggaaaactcctgtaaaatgacctgacaactgtctagaacatggaaactgaactaagggaaagcacccaggggatcctggtgtttggctaagactatatccatgtcacacgaacatgaaaagcactagaaggaaatagtatgtgaatggttggatcagagtacttagatttgtttttccctcagaatttgtctaatgtagttatattacttatgtaaccgtggactttaaatgtattcataatctaaaagttgagaatcatgttttatttggtggaaatttttagggcctcaagccaagcctctcaagcttttactttagacagcatctcaagtaaccctgagaaaatcgctcggaggaggtgaggagaggggccaaggttatccagaacttttgaaacaaagggcaggtagtctgaacctcagaaggttattgttaaataaagaagatcaaatattctaagttaaggaatttggggcttttctctgtatgggaagatgagggctcactaagatcattcctttcatatgcgcctcggcttcctgggtcccgtgttttcacatcctgagcttcctttcctcagggctcactgcagggagtggctgcagtctgatggctgctaggtggcagatattcttttccttcctgagtgcccttagggttcaccaccttactttgaagggttgcaatccttgatgactgtgatattcttgtttacggatatagcaggaaatattccatttctcataacaaaaccatttaacaaagagatcatattcccttgttgctgaattggggcttggcccactacagtggaccaagtgtctacttaattatggacccaagtgtaagataattacaagttcaaaaaatcttttcccttgaatcccttatttcactttgttaaaataaagggcttttgtctccaagacatataattatagcacttagggcattcaaacctacgtttgtcttcaaggcccaaaggcttatggcagtcagtcaattttcttaaatggctgtgagattactgaagagcccaaccaccctgcaacagcgtgtcaagcaccatggaggcaaaa

SEQ ID NO: 57276 - DNA, 2955 bp, Bovine  19866880724330
attccttggcttttggcctgtactccgtccccatcgctgtggtacgttgccttctcttctctgtagtcccatctccctcaacctcgcaagtgcaaagactgtggtttcatttagggccaggtgatctccccacttcaagcccgccatctgccaaagtccctttgaaagaacatagtcacaggttccagaggtcaggacctgggtatctttggaggcctgctgcaggagaattcaaaagtggatctttgaccacattctccaaagcagcaggttctttgcgctaatagtggtcctagtcacattttctttcccctttcaagtggctcctgtggttgcttgtaattccagggcagagagagaggcagtcctaagccctggtgttcgtggtcatcgggaggctggtccctgggcacctctcgatgtccagggcaagaggctggagctcttaaccagagtcggccaggcctggcgagtttaggagctgtcctacctagagcagagctttatccaaacagttcaagaattgtttgcgtttccctctatgctgcttcccattcattgtccctccacaggcaccccgtctcctctctctatccctgcttcctgcaggtgggcggttctccttccatcaagatgctgggttcactcatctcacgcctgcgacaccttcgctgaggaagccagggccctgcctgcgtctcccactcctcagatctcctccctgctgaccccttcctgcgccacacctttctataactgtatcctgtatcgctttggtggtttcctgcacaaggctactggtagttttaaacaaacaaaaaaaacagattatattaatcctagactaagaggcaatgggaaccctgggctgccttttcatctctgagacttccacagagggccagagcccgctgcagaaccagttacgatgggaccgtcacagccacgtgaacttctccaagagaggtttcgggttgcctttgacaacctgcacatcctgccggtggcgttaagaaaaactcgcaagacacaggataaatgttgactccctctctttgtgcagaaaaccctgacttccgagaaatccgctccttcgtggagacgaaggctgacagtatcgtcagacagaagcccagcgatctcctgaaatacaatcaaaagggcctgacccgtgtgtaccccaaaggacagcgggtggactcgtccaactatgaccccttccgcctctggctgtgcggctcccagatggtggcactcaatttccagactccaggtaaagggggccgactgtggccagtaaacctgtgctggggcatcattccaggcacattcttctggggccactggtgcgatgcggtggccggagcacgtagtttttcttaggagccatcagagttcagccagcatgctagcatgaggtcccatcccttgaatggtgcggtggagggaccactgggcacccaggcctttgcgtttggcaggcttctcgatggtaagtgacagacatggtcagtctggtttcagggagaaaaggaaatgcatttgctcccgtaatttaaaagtctaggagtggagcttcaggcacagctgcatccaggtgtccagtggctatgtcggccccctcctctttggggccatccctctctggcggctttctgctggggctctcttctggagataatcctctgctggaaaaagccagcatgcccaccttcttcgtgcaaagggcagcgttaactacagcgcacggcgcagaggcgccgtggtggttctttcagcctctttggaggcctgctcatcggtgctgcctcctttatatcgtctttgtgcctgcgtcacactccactgagtggagccatcatgtcctcaactggcgccctgctgcggtggcccgaggtgactcccttcattgctgttgcagacggcactgctccccgtaaccttgtgtgaacctcccttcacacgtgggagcacctgtggtgcagggcggatccaacagctttgaccaacttggccccgagcgaaaccactgcacccctgtatccaggagtgtccgggccaagatactccgccagaccgcactccatggagactgggcgggaatgcaaacgggtgaaactctttctggcttcacttcaccaacttagtttcagcaagtgcctcagtctttgatagtgaaaactggtgtcacactgtagtcggagctttccttattggtaacttctctgagtaacagagaagtgaaccaggttttcatatccttaagaaacataggcattttcttttctgcaggctatatttgtgcttcttatttttctaagggggtgtaggtattctcagcaaacaggtatcagatttcttaacaggttaaagttacctgtcagtggagtgaaacagatttttctaaagcatgtcagattctatggaaattttgtcctgtgtaaaaatgtttagctttgagtacattctggactttgtatcatactcggaaagttgtccccagtgtgaatttttttttttttaatccaattttcttccaataacatgagtttctaatgaatttttaaacccatagttttaagtcagatacctattttcacagccagctcacattatttttatcttccactggggtatagttgctttgcaatgttgtgctagtttctgctgtatggtcaggtgagttagctccgtgcacacccctccctccctcttgggcctcccatcccagccctcccggtcagtgcagagcgccgcgcagagctccccgggctacccggcagcttcccactagctgtctgtctgatagatggcagggagcgggcatcagccctggcctcccagtgtccatgtgtcccttccctgcatctgtgtctctgttcctggcctagggccctcagtgccatttttctagattccacatgcatatatgtgatgcccgtttttctcttttgg

SEQ ID NO: 57277 - DNA, 857 bp, Bovine  19866880760355
aactgaacaaccgctctttctgtacgacacccaccagaacctgcgcagcgccaaccgcaatgccctggtgagagaattcaacgtcaatgagaaccagctgcagctgtaccaggagaagtgcaaccgcaggtgggtcacagcctgcagccactgtgaggtcaggcctgggccagggcggagggcaaggctcccccttcagaaagcctgagccctgacccctcttctcttggctccatcaattatttacagtaagagcttaggtggtactagtggtaaagaacctgcctgccagtgctggagacatgagatgcaggtttgacccctgggttgggaagatcccctggaggaggacccagcaacccacttcttgcctcaagaatcccaaggacagagaagcctgatgggctacagtccacagggtcacaaagagtcagacaccactgaagcaactgagcacccacacaggctgaggagtctgcaccttccctgggctgaactgtcctcacgagaaggacacgtccatgttaagagtgaaaataagcaatcaccattactctttaaggagcccttctcaccctcccaagcacggactagtccaggggtcctattgaccagaatctccccacctccaacaaggggtgctctgagttgtgctaccgacacataaggacagacggccaggtatgccagagtcctgctccaccaaaactatctgcaagaaaatgtcagtagtgatctccctgggagatggcgtggagatgccttccccacgttattcccgtttcatcttggcgacacctgcacagtagcagtgaccccaggacatgaacagtgaggagacagatttgcagaagtta

SEQ ID NO: 57278 - DNA, 1775 bp, Bovine  19866880869672
cctccacagaggctggcggtggccttacactcacacctccaggggccgggtggtcccacatcacaataaaacaatcatttaaaagactacacacagacccacactgggcagagagaggcgctcgcgtcagaggataccggagtgtgccctcccaccacacctggaccccgggcgcgccggcgggcggaggcagcacacaggaagcctggcccccgacgccgcttggctcgtttctcttcctggtggagagaggaagcctgtctgcagcagctcccccagctcggggtgggggggcttgcggccacctgaccacagaggccaagaccgggccccggagaggccggagcatctcaagtcccacaggcccgaccaaagcagtccatcccagtcagaaagggagatgcttacacatgggcacggggccaccacctcggaggccgccttcctacagaaccatcacagcacgaacccggcgggctgtgcaagtctcccacggctgctgtaacaaatggccgcagatggagcggcttgcagtgacacacattgactctctttctgtcccgaggtcaggatcagcctcactgggctaaggtgggctacccaagtataggcagcgctggtctcttctgggggccttcggggagaatccatctacacacactgttctcagcatccaggggcctggccgtctgcactccttggctcatggccccttcctccaggacatctctgcaacctctgctcctcccacatctctatgaactctgacctctcacttagaaggacccttgtgatgacactggacccccatccccaccgcgccgtagacagatcatctagaatgacattcccacggcaagattcttaactcaagcccatcagcaaagtcactgctaccacagaaaggaacacgtccacatgttctgggacatctgggccactgttcaagccccgcctttcaactctccctatcagtgacctgcagaggaggaaggtattacttcaaaggcacccttgcaaatactttcctaggaaagccaaagcttacccctccccctcatacctaccacatttacagacaccaaggcacaggtactgggacacttttttttattgtttatccaaaaaaaaaggatactttttatttgcagcagcccaccacgtgtcaaacgcagggcaaggtgctctgcttacacacttcagagtctggtctcatcgttgccagtgagcacagaggaaaagtgaggctcagagaggttaaggaacttgcccaagaacccacagcttgcgaatggtgcatctgggattccaattcaggcctcttactcttggcttctcagaaaaaacttggctcttcttgagatttttttttttttcttttggtcccaaaaagttgttcacagtaaaaacctttcctttcgggtaggaaattatgcaaagcattcaccactgcctccactggcttagagactgagcagagaaagatctattttggggctttgcgctccagtgatctgctttcttggcctaaagctcaccaccacccactgcttatacgttttttttttttttttttctacagaggccacttcctgaggcccaaatgaggcaagctggtgggtcggctcagcaaggccagagccaggctcagggcaggacgcagggcaagaagcacggccagtgctgagcagatcagagcccccaggacccacctccaaacaaaaccggcctgtgttcaaagtggcggcatctgcctgtaacctgtcaccaagatg

SEQ ID NO: 57279 - DNA, 1675 bp, Bovine  19866880927854
aaggaaatggcaacccactccactattcttgcctggagaatcccatggacggaggagcctggcgggctacagtccacggggttgcaaagagctggacaggattgagcatctccactggatctagggcatcctgtcctcccttcccttgccctttgtatcaccctgcgctgcattttcagagcacaggcctgtggctcagggtggtgagtggggaggggactcaggtctgagttgagcctcagctttggccgctgccagctctgtgaccttccgtgggctactccgcctcaaccagtctctgttttctctcctgtgaaatgggcagaacgggagtagcaccccagaaagggcgacgaggattaataagatacagtgggatgtgatctgcttagagcaccgcctggcagatgagcccagggatcttagctgaggggattatttggcggataatttttccttttgtagccatcattttctctgtctagaacaaactttctcctcagagagaactgattccatgcctagcttcttgggcctgccggccatgcgtgccctatgcccatcactccagtctctgtctctatcttcgatggccagctgactccctggtgtctcgggctcccttttcctctccttcctgtgatgaggatactggttctcaggtttagggtccacctggaaggcagggatgatctcctgagatccttctgtacatctgcccagacccccatttccagataaggtcacattcacatttaagacacgcattaaaacccagaccgctacctgatccaaggtagattttccagtcagcgccgacatccacagtgatggtcggcttggggtcctaagagaagtggcctgggacctagaagtctggtcatcttggccttctgtcaggctgatcaggacttttgttatccttttcccaaagtaaaagccccacatgggaagaaccagaagcctttcgtctttatcttggagcccaagaagcagggcgaccctcccggtagagtttgccacggacagcgtggaggagctgtttgagtggttccagagcatccgggagatcacctggaagatggacgccaaggtaagcctgggcacctgggctccactgagcctggtgtcctccggcttccagtcctctgccgaggtgcgggtgggtccaggccgcagccacagagaatttggggggtggggcagggagggagctcaagacagcaggagcggagagaaagggggcgctgggtcttcctgtgggggctgcgtccttgtgtgaaacctttgaaggttcagcgtgtgcgtggtgacccttgatgtttgaggcctgttcagccccgtgtatcttaacaataaagctttgccatcctcttttaaatgttatcttgctctaaatactattctctaatactctaaataccatctaaatacttgggataaagcagcctggatccttcccgtgcattcactgagctcatctccctggactggaaagggccctgggtgtactggaattcataagacccagccccttccttccagaagtttctgttcttgtgggggaacctccactccagatgggcatgagcttttggggatttatcctgaaaggtctttattttgtttcagtttttactctgggggccgcccccgcggcaggtaggatcttcga

SEQ ID NO: 57280 - DNA, 1294 bp, Bovine  19866880936394
acaaggggttgatttgcagtaattttcaatgtttatttttaacagatctggttgaagcatgcaagtaattaaaacattcttcattactaatatgtggtattttaatcctggcaaatattctagatatatttttctccagtcctccaggggagccatattacagatctaaaagtaaaatactttcttaccaatacatatttttagtttgtgttatgagaattgagttgccatgtgctgttcaccatctctaggatctggtgtcctgaatagctaatagggctctgaaatgctgcccagttttgaagaagaattacttgtgttgctggggcaattgcaacaccccacacttaagttgtcatcatgcaacttcttccagggttttttgcttctaggtatgtttatcactgggataatgatggatgtaatccatcaccctcgttaactaagttattcaaagaaggtcattctcaccagttaattgctactatttgttggacatttactgtgtgtaagtctctctatattttctaaactcatgtaattctctcagtgctttaaaaagtggggacttttatatccccagtgtacatgtgaggaattggtggtgttgggaggtaaagcatctggcccaggtcacccaagtcacttgaccaggaagtggcaaagcttggatttgagactcgttcacttgaatccagataccaaactcttaaaaatcacagttgatttacaatgtgttaatttctgctgtacagcaaagtgattcagttttatatatatatattcatattcttttccattgtagtttatcacaggctgttgaatatagtgctgtgaagcctctaagagtaagaccctgtttatccattctataggtaatagttgacatttgctaatcccaacctcacagtccatcccttctccacccctcttctccttgtcaaccacaagtttgttctctatgtctgtgaatcagtttcacagataagttcattgtcatattttaaattgcataaatattttatattatttgccttgctctttctgacttcactcagtgtggtaatctctagttgcatccatgttgctgcacatggtgtgatttggggttttttcatgattgagtggtattccattgtgtatatatatgtactacatcttctttatccattcttctgttgatggacaagttgcttccatgtcttggctgttgtgactagtgctgctgtgaacataggggtgcatgtgtcttttttaattatagttttgtctggatatatgcccaggagtggga

SEQ ID NO: 57281 - DNA, 1224 bp, Bovine  19866881781816
aacactgaatatatttaagcacacttgttacagactctgagggcacgtcacaaaggtattccagaaaggtcagtagcaacagcaccctctgaacagaataccctgaggaagaaaaccctcataaggaatgtgtaataataatattaataaaaataatggcttgtaagtgtggtgagtggcactttatatacctgatccaatttaaccctctaaagaatcctgggaggtaagataaaggtctattcatttcaatatcaaacattaccatgtggtcacacaggtataatacctttatgtcatgaagggcaaaaactcattcctagaacatacactgtgactagcaaccacctcccctgcaaaagtgaccatctcctcagaggcttgggctgcggggaagtagctcaacttgttgtttttcacacaagtgcaagcctgttagcattttgccattcccatatcagtgtttcaacctctgtgaagtcaatgcaaaacgtatggaatgaagataagtacatttttggcttctgagaaattcaagtaagacatttcccatctgagggagtttagctctatgggttttggaatgacgtctactgtccatgtctgaaggaggaagacccaaggatccgaatctcaaacttatcctggtttctgttttctcccttcaggatctgtgcaaggaggtaggaaatgaagacttaatccaagaatcaattttttttttttttttggctgtgctgtgtagcacatgggatcttaattctacaaccagagatcgaacccatacctcctgtgctgaaaactcagagtcttaaccactggacagccagggtgaagtcccccaagaatctattcttaagtagcgacttgaagatccaaaggttgacatcaggtatctattctctatttttaaaacgtgtgtttcatgaaaaccacctcagtatatataacaacttcagtggtgtactgtaccacctcagtacagctcctccttcacatcgacaggatcacggaaggcagcagccacacgagaaccactgtaaccacgagtaagatcaccagcccatcccaaacaagacacttggagtcacaactcccaggacgtcttgccgtgaccatgggctttaaaccactcgactgcctcctggaggtcaaacggctgagcctcataccccagctccttcctggctttctccaggctaaagtaatgtgtgacgccagttt

SEQ ID NO: 57282 - DNA, 1123 bp, Bovine  19866880167089
ccataccctccctttgggtcgtcccagtgcaccagccccaagcatccagtatcgtgcatcgaacctggactggcgactcgtttcatacatgatattatacatgtttcaatgccattctcccaaatctccccaccctctccctctcccacagagtccataagaccgatctatacatcagtgtctcttttgctgtctcgtacacagggttattgttaccatctttctaaattcccaaatataatgctgaacattaattttaattacagtgttttggtttacttattcatgcacagaaatgttaagtttatgatagatagttactgtatttggccaggcatatattgcaagatgttgtttactcatactaattttataaatttcctttatgtggtgtacatccaataacttcattataagtaaaatacaggtttggagaaattacttgaaatgacttcaatcaatgataacttttgtttttataaaggtcacctaataaagctgtagttttttaaggaaaataaatttaacagattaattattcctacagtatgatatcataaatggaagtttctcaccatcttttaaagatgctttttaagaactattacaaaggcaatataatgagtgatttctctgtgaagatcatgaatacatatctataggatggatggaaataatcagtggtcctaagaccatgcaaatgaacactttttgcttgggaaaaaatttgcagtacagtctcacttgaaaagtgtcatatccccaaacagtttatgtgacctatatgaggaaagaatgtaaaaaagaatgattatatgtatatgtataactgaatcaccttgccgtacacctggaactaacacaacattgtaaatcagctatatgccaataaaattaaaataaagaaaacaaaaacagtttaggtgacactgcagatagcaagttttggaaatctgtgttgaatgatttaaaaagtgcagaacgtacacaggtcaaaaatgcatgaaaggaatgtaaataaaaatggtttataaaatgtgaatgtagagaaataaaatggactaaatatacttaagtatgatataattgataaatagaatgactaaattggaaaaatagaagt

SEQ ID NO: 57283 - DNA, 1589 bp, Bovine  19866880462780
ttggctgaaaattaattattcgtaagcatatgacaatttctactatttgggttaaagttgatagttgtagcatcctcagggcctggatctagccctgatacatatacgtaaggatgtggttgggaagattgcctggagacaagattgtaaccgactgattaataaactcagaagtaactgcagtcacggttggggttactgctttgtctctgaagacactgttgataatctcagatggctcacttgttccctgtcacctgagttcaggttctcatatctttaatgagatgggaaagacagaaaaaatgtgtcccccagatatttacatatgcatagtttgagggactgtagtagggaatgtgtaacgccatctggataaagacatggaatggcttctcttctgattgtcttaaatattttttaaatttcccccaatttttcatatccttcttctccctctctgtcagttaacaataatttgctaagtggccagaagataagccatctgtagccaagcccctcatcatcagagatgataaggcccctctgggaaacagctttgggttaaaggctcccatccaccgtggcagatccccatagtgtagtgaaaggagcccagacaactgggtggatgactcggtgcacacgggctgaaggctcactcaccttggcaagctccagtgcgtatgttggggatgaagccccgtcggcagggctgaggctgggctgggcacatctcgcaggggtgaccccaggcccgcccagtggtggcgcagcacagagtctttgtacacacgatgcctgtgagctgcccctggcacatcttggttgttgacctgagtgaaacacggacctgtcctgtaatctggaatgtgaaagaaggcagagagacaggttttatagccacgcaccaatctcaaaaccagcacctccaaattcataaaacaagagactttcttcccatcaaaatgctgaatgacaaaaggccagagaattccatcatgaaaactcagcatttgccgataatgagaagtgccttacaaaacttcaaatgtattctaccctagacattgtaaataggtggctcaagggctgtgtctgggacacagatgtgttttcttggcccgtctaatgttttaaaatgagtagccaacattgtaaattgggaaatttcacatgaaatttgtacttctggcttttcttaaaaagctggatgtcctggccatgctaggtctgtcacgttgcatggcggtggtgaagagtcccttctatgacaccacagcccagccacccagccctctccactcactgggcttccccacctgtgccctgagggcacctgctttaatgactcctctgtacctgtcaatattctgaagtcccgagaaaagttcagaaaatcaaaacagaaccaatgacgacacaccctgccataccgcatatatatgtatatttaggcggtctagattgattataatcatttagtactaacagtttggttttcgtttccttgtcagcctgtttagttctctgtgtagctcacctagaaagatggtactaataaggcccagatcatgggttctttccaa

SEQ ID NO: 57284 - DNA, 991 bp, Bovine  19866880558287
aaaaaaaatgacttacagatgacatcattgttgccaatgacagtaacatgaattcaactcaagccctctgatctgccaggttactctcgggcaatatgcgctcggagatttttgacatcctgaggattactcatttggcaagaggctaattttcctttgtctactttaattgagacacagatagcctcgagctctgtcccaatcaaaccactgtatacaattccaaatttttggtttgtacctttaccaaaatttcccatgaaacttatcttggtccatgtacctcagatgaccaaatgaaatgcaaatgagtcccaaagttggtggtgctgagggtggggggagtcacatcattattttacaaaacaaaacaacacaaagactttattgtttgttgtttagatacttacctatacagttcttgccatctggagtaagttcataaccttcattacataaacacttgaaggagccaacttcattaaaacatcgtccatttctacacacctgaccaaaaaaggaactgcactcatctatgtctgtaagtgagtaagagttagcttttcagagagagctctcacatatattttgtatcacaagttgcaacttaaaaacatatttattggtagacattacattacactccctcatcaacagagaaaaatgtcatatatcataaggatcaggtgactaataatgtcaatagacctctcctgttggtttaagctttccattctttccaaccaaaaaatacctcttttcctggatataagaggacacatggatttaactggcttgtccagtttgtagagaactgtatctggagataagctgactgtattcaaaggacaaataacaaagcatataaaatatagaaaaatcaattttataaaaagcactctagaattgctgacatgttttgcttacaaaaaacagaatctgaaaaaacatgttcttaactgttaggttttcggttaagcttaaggatgag

SEQ ID NO: 57285 - DNA, 950 bp, Bovine  19866880702062
ataaaacggcacctcttccaaaaagaggtgttgaaaaattcagtccggttctgatagtcatgaaacagacctgccacaaggatggttcaaaaacgaacaatattcaaataacattccccatgggaaatgctaagtgaaacaaccaaatccccaaactctgcttacaaatccagcactctccacacatgtactttaagcacagacccagcactgggaatgccagctgcacttaagctcgagcagccaggtgactaacccaaacaatcccccactaaaagcttactgatgggaacggtggttaaaagggatggaaaagcacagcagaagtgctcgagtcaacagacaagagtttaaaaataaaactgcacctatcaaaatgaaggatgagacacagataagaaaataacaagaaacagatgacaatattattttctgttgtagcattgccttttttttttttttaagatttgagtttttgtgttctgaaagaattttacatggggctctgaacacttctttgtgcattctatctgtgtaaaacagtagaaaacatccatcaaactctgagagaaacaattgattgatgtactgatatagcaatttgactgcatgctaaactcatcaatgaaggattccctcaaagtcatgggaagacactttggggagacagtcagagggaagaccttctgtcgaggcttggttagagatcagctttgcaaattgtaatctctaagtaaggttgtggaacacctgccataagactcctagatggttttagggttttctttcttcctccagagttaacagttttaaaatgatgcacaattccctagcaactctagggagaagtcaccgtgagactgaaataagatacacgaatagctcccctttagccatcacaaggtctaaaagaatgttatctcctgatggtagaggaaggtaaaattcat

SEQ ID NO: 57286 - DNA, 1807 bp, Bovine  19866881233758
gcttttgaaattaagagctgagactttgcagtctttgttctccagatccctcctgatgttcctcctgggtctgagggacaatgccaggctctggtctgatataattttcaggccagctggcaagagcatcagggtggaaagaggtgggaaaccccagttaatacttcacgtcctcttaccacattcattttatgtgacgtacaccttaggtgtgatctgcaatattccagttttcattaagacccgaatggctcagtgtcccatggcagctggccctgagtcatcttacagctgtgggtctgtggtcaagtttatctgagcacattaaggccatgggcacaggccacaaaccccaggcctgagacaagctgtttggctcccactgggagtctcaaaaacccaagcctactgcacagcaggggagcaggaagggagagcaagagtaaggggaggctggtctcccatgcctgtccacatcagggcagaaaccctgccaggatcaacagcctgcctcctggcaaagcctctgccaggctccctcaacactgcggtcaccaaaggactgtgtttttcctgagatgtggattttgaaaatgacctcctgaggtctggcaaacaactgagttcttagaggaaagaggacagggaggtgacgcctcgctccaagggggttatgaaagcagagcaggctgttcttgcatgggaatagcgctacagcagcatcagtgaatgctcagtgttcacctccatggggcaaaactgcagccaggtgtgaaatcaagtcacagaaatgtacaccccaaaggagaccactgggacaagttccaaaatgctggttccacagttcagtggtcgatactattcctcaaaccacttcatcgctgctctcctctgctggagcatgcaaactcattaccttaccaatctcctgcctctgcgtcctgcctttgttcctactctttgtcttctatctcctctcaagaccgtttcttctacagaggaagcttacctttacatatgcgtgctaagtgacttcagttgtgtctgactctttgtgaccctatggaccgtggcctgccaggctcctctgtccataggattttccaggccagaatagcgcaacaggttgccatttccttctccaggggatcttcccgacatagggatgaaacctgcgtctcattcatctcctgcattggcaggagggttcttcaccactaacgccacccgggaagcccacctttacatatgtgctgtgtatgctcagttgcctcaatcgtgtctgactctttgcaaccaatggactgcagctcaccaggctcctctgtccatgggattctccaggcaagaatactagagtgggttgccgtgccctcctccaggggatcttcctgactcaggaatccaacccttacctctggcgtctcctgcactgcaggcaggttctttacccactgagccacctgggatgcccacttttacacatacttaattatggagtatctgaacacttggtgcattttgctccacagcagagagccccagccagctgccatgggacactgtgctttgtgtgtcctgccctgaccatcctcggctgtgctcctctccatgcagtggaaagtctgctgggtcaagagagcatgatgacccagagccctcaaaccaccaaccacaaacatggtgcccagatttcccactccactagctccagacagcttctagaacccacactagcttcttccctgggtctttcctccaaaattcataaggccctgggggtagagggcaaggggaaggtgtctat

SEQ ID NO: 57287 - DNA, 958 bp, Bovine  19866881312689
tactggagtgggtagccattcttttgtccggggatcttcccaacccagggatcaaacccaggtctcctgcattgcagccagattctttaccagctgagccatgagggaagcccaagaatacaggagagggtagcctatcccttttccagcggatcttcctgacccaggaattgaaccggggtctcctgccttgcaggcggattctttaagagggagttcgtttacattttaaatacagtgctgcaaatttctttttaagaagatttaaaagatgatagttttgtgtttttaaatgaatgacctaaaacatttccccaaatttacagttctcttacttgaatctcaatttttaatatgtagtgttctttttgggaaatagtcaatgagcttatttattatttattttaaagttaatacacttttggaaatatgagtaaaagcaagcgcttttcagtttagcacagacgtttattctccatggtttatcaaagcagagttggaacagccactaatgacactgtgccaacaactttcatgagtttcatgagtataaataaatatatttgttgtcagaaatcccaaacgactaaatcctgtggtaatggaacaaagctgaagactcttcagaataaattgcaaacaactatttgacatatgaagggccattgaagggaaattttccaatataatgatgctatttttctgccttccatttaagccaggaaagaataactcaaggaatgtcagagaaggtatagtgtggaagaggagatcatgtaaggacatccggtacctagttgtgcttatccaagtagactgaagttcaaatttacattttttgttatataaaaaaaatgtggacagtattctgatataccctttcctatcatattgacgtgttctacttttcttcatttaaattagacagatttagatgagtaaatctttgaaaagagta

SEQ ID NO: 57288 - DNA, 1693 bp, Bovine  19866881318275
cagtaacttgggcactaccttggcaatcttagtcaacttccagcaatatttcatatggagttactgaagtgacatgtctcccttactttcaacctaaacaaaatggttttcatggaaagttgcacatggagttttctatgagagccgggaggaaaaagagttctttatttgaggcatgatgggtaacatcatcgtcataaacatgaagtctgtgaaaaattcgtattccaaaagaaaattatttaacaaaaagagattctgtagcttgtgatctgggttttggatcagaattaggaatattcaggtcttaactttcatttaaaagaaatttagtttttagttttcattctgagaacaagaggaaaattgtagagagaaatgacaattttagtttcaagtagaattcacagaataaatgtggagcaagaagagcacctggttgccagtatcccagatttggggcccacatgtcagggtttgtgctggaggtgcgtgtggggattgcatatctcaagcaaataaatggatgcctgtatctttaacagtagagataaaaatggtcttttctacataaaggttttatgagtattatataagataaagaaagcatttggcccttctaggtcttcgttaaagaaggcagggatatatatcacagacaatttaattatgaaatattcaataaaccatgtgatttcagatcttaaaaaaataattgtaaaagagttctaatataacatttcagttatgacttttacagtttcctataaataaaacttttttaatcttaaacaaacaaaattgacctactggaacatatatttgcctcctccaacgagagtattagcaagcaaagaaagggacccaaattcatcatcttgatgaagaaacatggaactggggatttaagattatctataattgctgacgagtctcagcctgtttttactcctccagccccagcttcacccaaattatagaaatggacgtttgagaccaagaggacttgatttatttagcataacacagtggtcaggaaattgcattttagtggattcaggtacattttcccaaatgctgagaaccagtgttgttttccccagtgccattgaatatttaaatccctttaaaaaatactaaaaaaaaaaccccgtggtgaagtaattaacataattcttgtagttcagtttctgctgaagatcactggaaaaattgagagcctccaaaacacctttctcagagactcgaaattagatgtgtgttagtgatagaaaaatctattctaccctggaatgaaagaaccaggtgaatgttttaaactttgacatgagaagaaaaagatataaactcaaatatattccttatttcttcattttacttataaaatcattgctgtttcatagtgaaatgtaaaagcaatgttacaggccaaaataaacaaaaatgctggttttacaatattgttgatatatctgtagcttcaactaagtgagagagaaagaaagaaaagctgtctcacaaattaccatggctcattgcctgaagaaaattagtctactctgagcaaaatcctgctgtagttaggtaaaaatgcaacaaaatttgaaatataataccctgatccctgactgcatttcttacaagtgttgtcagttactgactgtgtatatacttcattcaccatctaggtatg

SEQ ID NO: 57289 - DNA, 1231 bp, Bovine  19866881344001
ttgacacacaggaactggcaattgtgctgtttggtttgacattcatcaaggtctgcaatgaaagacaagccagtgaaaatccgagcagagttatctggctgtgcttcccttctcatgaagccacagagaggtgtgcattttctaccaggagtattttgtctagatttttgttggaagctttatagatttccatatgcataaggcaaggaggtttttttcccacatacttaagcagcgtaaatactatgagctactaagacaagacggctaaggtgatatataacaaaaatttttttaaaacaaaaagctgaaaggatgaattatagtgatgttcatgagctgttttcaaagctagtattcaaaggttaaaatacttgtatttgatgcaccattgagtacatggctggctacttaatcctattaagtcaaagtgaaaattgctcagctgtgtctgacgctttgcgaccctatggactatacagtccatggaattctccaggtcaaaacactggagtgggtagcctttcccttcttcaagggattttcctgtcccagggatcaaacccgggtcttctgtattgcaggcagattctttaccatctgagtcacaaggggagccacagtaaaaagtgaggcacatggcctgatccccgataagctgattctgaatctgaaaaaaaggagagggtcacacatatagactcctcatcacctttgcaggtcttcccgtcctcctgcaggacgtagccccggggacacgagcactggtaactcccctctgtgttcttgcagatgaagttgcacggttttggggactgcgaacattcgtcgagatctgagtaaaagtgatgtgaggattaaattactggttagaaggaacgaccagtctctttcctccctccatattctcactcactgttttcttcttcaacttaaaatggaaaatagccagagagaaatgaggcacacaacaattttctctaaagtaatttaccggtttaactttgtcaggtgattcttgggcaaatattgaaatatccagacaactgggttcaaaaaaagacactagattttttagattggtgttcttcggtttacagtttgagaatcataaacctgaaggttagagtttcttctctttgacatgcagatgtggcggatgttctcagtctctgagctgacacttccccaggaattgtttggcatcacagattgtgtgggagaccttcca

SEQ ID NO: 57290 - DNA, 1153 bp, Bovine  19866881395807
aaccagagagaataatttgaagcaccttaaaaaactgtccagtgcatatacactcgggaccttatgttttaaacttacagatgatacgtctgccagagacatatatttttagtgacaagcactgcatcatggcttcctgcctagttcttaagtttgagggctgatgatgacagagaaatcatttcaaaacttaccgaagcacctccgtccattatcagacaatacaaacccagggggacagatgcactggaagcccccaggagtattggtgcaggaaccaaaaagacagatgttgggatcttcatcacactcatttatatctgcagatcagcaagataatttactgatttaatcaattcaatacactgcttaatatctgaaaataatttgtccacattgtacagttcactagccattggatattcaatgtgaaacaatatattacattgtctatataattaaatatgtttaaaataaactgctactgcttcaaaagtcaaaggttatatccagtttcaatgatccatatgacccagacttttaagtcggtctccagttctctggacttgactcctaggaggtgtctgcatgtctgcctgcaggcctgagaggaccacttccatgcctcaggggcatcgcatcctcagcattggtcctcttctctgatgcccctcgccctcagcaatccacactggggagctggggtcacattctttcctctccttaattgttcaactttcataatcaagcaatatgtggcctcctcatttacactcaaactcagcatcatttgccacctggattatcacgtctcccaactagggagacgtgcttcacttccttctccccactccataccgccaccagggtctgctttctaaaacatgtacctatttgagaatctgtgcctacagaaccagggagcttagacgttgggatgagaattttatcatttccaccttaccccagaatgatctcttgaaacagacaaggattccttaccagtgatatctggccccttttcactggaagtgcttattttaatgggtggtttttaactaaatgaatgaacactacatgattccaggcacatcagaacataagtcccatggggacatcatgtgtctgtctagatcactgctgcaccctcagc

SEQ ID NO: 57291 - DNA, 902 bp, Bovine  19866881679543
tgcgaccttaaaacaagtcactgcacttctagggccgtggttctcaagtctgtgagaggaggatgtgggagcagatgtctcaaaaattcctgtttcaaaatatgacttggaagattagcagaataaaactgaccatgtattttggcagtctagtttacttcaggtaaaagagtactactttaagttaattgtagcgaatgctcatattacagttcattatcaagagagtcctagtatttaactctatgtgcttctatctgttggtttcatagtgcttttacttaccgacacaccccacaccggtggggttcagctggaaatcgggtggacagttacactcatagcgaccaggagtgttgacacacaggccgttcacgcagtttattgggtctgcacactcatcaatatctaggaagaacatttagaatgcccacatcaacatctttactttccttgggcatgctgctgttccaaaggatttggtggaaattctgaaagtcagtagactaaaaatctttaggagggactcagcacaatgaaatccttgtacacacctaaagcagtttccatatatcagacagtattcatgatggtatcatttaatatctttaataaataaataagtaaattatatcaaaatcttgcaattctgaagaaaatcatgctatcatttcttgcttgaattaaacttaaatatatgtataactgtacacatatgtggacatcataaatatatacagatattttactaatttcatgttgaatatttaaaattaagctgtttacattacaaaaaatcaatctcacagttagaaatcaatgtatcagaatgtaatttcctttttcaaaaaaaatgcataacctgaggcatagcaggctaagcagaaatttggggaactttt

SEQ ID NO: 57292 - DNA, 716 bp, Bovine  19866881899517
tcctttctcctactattgagtttttctggtcctgctctgggagttactagagctattaagatagactcatttcaggttgagctcccaggtcctgatacacgaccctgggtcttaggagccagcctcaggcctattattcatgaatgcacaggcctgagggggtgtcccaggtggcactactggtaaagaacccacctgccaatgcagaagacacaagagatccatggtcgggaagatcccctggaagagggcctggcaacccactcgagtattcttgtctggagaatcccatgacaagaagagtagtctggcgggctacagtccataggatcgcaagttgttgaacacggctgaagtgacttagcacacacgcatgcataggcctgaggctctaatttcaccccagcatgaatgagttccctcagtacagggtgctgaagtccgataggggaaaggaaggtggtaaacgcaagagcagaaaactaggcagctcgcacgggccaaggggctgcttttttgacacagtttccaggaattggccattcacagccttcactgctatttcattaatggaactcacacatgtagcagtagttgtctggggaaagctattaatgctaacttttcctatggtctgctctaaaaagtcatgtaaagcgttttcctgttttccttttggaaaatgtctacactacatcctgacatttaatctgcag

SEQ ID NO: 57293 - DNA, 1402 bp, Bovine  19866880153848
atgcctgatcttggttttctgaatgttgagctttaagccaactttttcactctcctctttcctttcatcaagaggctttttagttcctcttcactttctgccataagggtggtgtcatctgcatatctgaggttattgatatttctcccagaaatcttgattccagcttgtgattcctccagcccagcgtttcccatgatgtactctgcatataagttaaataagcagggtgacaatatacagccttgacgtactccttttcctatttggaaccagtctgttgttccatgtccagttctaactgttgcttcctgacctgcatacaggtttctcaagaggcaggtcaggtggtctggtattcccatctctttcagaattttccagtttattgtgatccacacagtcaaaggctttggcatagtcaataaagcagaagtagatgtttttctggaactctcttccttttcccatgatccagcagatgttggtgatttgatctctggctttttcttttctaaaaccagcttgaacatctggaagttcacagttcatgtattgctgaagcctggcttggagaatgccttttctaaaaccagcttgaacatctggaagttcacagttcacgtattgctgaagcctggcttggagaattttgagcattacttactagcgtgtgagatgagtgcaattgtgcggtagtttgagcattctttagcatgacccctcaaatgtggtagctattattacatgtaccctggtactaattttccctaaaaggacttaatggaatgcaaccaagcattggtgtaaataatcagatctacatccctcttcttgagcttaatcaaagtgtgtcccttctcctctgaccatcactgcttgagccacaggacaatggggtctagctgcattcacctgtgtcctccatcactggctttctctacctctttggggtttaggactttctatctgggttgggaagatcccctggaggagggcaatggcaacccactccagtattcttgcctagagaatcctatggacggaggagcctggcaggctacagtccattgggtcacacagagtcagacatgactgagcacacacgcccgtgtcttctcaggagtatttgacaacaagaaatcccatcctccttctcagaaagctgtatgattttaacccaggattgatgaaatagagaaactgcaatccagaaatgaataggcccaagaataggggctgggatgcggggcgagctctgcaggtgaggtggtgacgggaatgaagacatctcaacacacgtcttactttgggtccttccatgcccttgtctattgtaaccacgggcctgaatgaactcacaggcctcctggaggaagccaactttatcacccttttgaag

SEQ ID NO: 57294 - DNA, 1045 bp, Bovine  19866880451716
acgtttttttctcgagaaaattataaagatcagtccatggctccaagtttaaaagaactatgtattttatctagcaggtaatatgcttatttatttggttatttatatccatatttgatatttttctgatacttgaagttttatatctgtctatatccactatgaaacatttgaattataggaatgtaaaaattagaaaatagaagaacttagtatcctcaaaagaccactctttggtgtacatatgtaacatcttttaagacctttctctacacgtgaacagatgcatattaaaatggggagagttccctggatatccagtgattaggattccatgcttttgctgctgagggcctgggttcaatcccttgtcaaggaacaagccatgcagtatgtggcccaaaaaagagggggagtgggggtggaaatcacactataaatactataaacactataaaacttttgcaatttgtttttttcatttaacataatacttcaggtattttgtgcccctatattacctcagtcttcttatggctacatgttactttacagagatacttttaattcttttagttagttttacattgtaaaatgtttgtgcagttttaaacagtaacatttataaatttcttgtaattatttctataagataaatttatagaaattgaattatttgggcagatactataaacattttgtattttaatagataccaccaaattgccatagatgtcatacgtccaaatttctggtatgaaaatgtgtattgtgacagtaataatttccccttctcactgcttacctgcctataacagctcttctttcctttgtgattggctgcttctactctattgtggatgaatcttaaagttgagtcatgaagtttactagaaagaagtgataatatgccagatgaagaattggggagctcccttaggagagctcaatgtctactttcatctttctccactccttttgcaatggaggaaacatatttccactctctgcatggaatgggaccccatcttttctactttttcaa

SEQ ID NO: 57295 - DNA, 1062 bp, Bovine  19866880456676
ctttttatatacatgctgctataaggataagttcctatgaaaggaagaggcgtgtgtgattttaatttttatagatattgccagattgccattaaaaacattaaacaagtccttttttgattccatcagataaatagataagttcaaataaaggcaagcagaaattgtattaataagacattttcagaattgcgttaaagaggcagtttcaggagcaacatttcttgccaaagtgcaagaaattattgtctttgcaagtgtcaactacaaaaggttaagactgtaaattccttatcagtgtgcatctatgaatatttttcagaagctatttctgttatccaacttgtaccatttcttggagataactaacttcttaaaacttattaccagttaaacaattgcctttgtttatttgaatctaagaatgcctaccaatactcatgtcctgagatttagtgcacatatatctttactcataaaaaaaaaactcacttttattagtttttatctcagcctcatctttcgagactaaaaatttccagtattagtcttattcattctgcttcttaaatattttatgattctttgtcaatctggttctgttcagcatatcccaagtgtgggttatagtctgaaatatgtaaaggagaggacatattactggaagctgagtacacttaactcctaaaatctttttttcttatagtaagaatgaattttcagactatatttaattaccagttttcttgatggaaaaaaaactagaaagaatgtaaatttattagtcctaattttgcaattttttatgttctataaataacatatttgggaaaatagtgatacctctgtttatgctactttcaacaacatgaggtttttattcaacgcttctccctccactaaaaggtaaaaatttgcctttaaaaaaattagtttctggttatagatatttataactgagttttaaggcagcaaaagggaaagtagcttcaaatacaaaaaaagaagaaaaaattttaccatgtttaatgtacataagtaaatcaaattcagtgggtacag

SEQ ID NO: 57296 - DNA, 1549 bp, Bovine  19866880485903
ccgccccccgctccccacccccaggtctctgtggattctttctcttgattctggctgctgcttctctgacaggtgtacttcttagctccagggacctggaccagacagccctcagctctcacactgcctggtgtgccttgggactctggatgttgcaaaaatacatatggtctggagaatgcaaaaggtcacaggcttatttttagataggaagaatagactccattttaagcataaagaaccctataataggacgtgccctcttactgtgttgtttgaattctggtattggtctctgtctttgcctctcccccttcccaccctgcctggcccctcccctccccctttccctttctctgactttctttccagcaaattacactttcccatgacaagaagtgctgtcagtaaagaaagcaaacacataacaaggaatttaaataatagaaaaaaaaatttcctaaacctcgaaacatctttttgtttgcaaattgacagggtgagaagggtttttcttgctttgcagagttgaaacctcatctcctctgagttcccttcactctgggagctgaaacctgtgaaagaattccctcttgcttcagatcctccatgttgggatattggtttctttcccccctcccctcaaaaacttttacttttgacctcgagaaaaggtgtctcatcttttgagaggttgatagagagactttcagcctgagtctgtatgagagagagccggagacagagagatggggagaaggagaaacctcagccagagcaaggcctgggcctttctcctaccaactcctctgtttgatttccttcccaccagggacagaggctggaccttgttagccactgctggagtgaactgaaactattatccataccttttctcacatttcagccatttctttcttcttctaaaagcaatctgggataaggataaagtcttcctcagagctggcttttttctcctccgcctcccatggtgaccttgttttgcattttgtagttgaaaggacatgaaataaactttaaaacttgcctgattccataaataatcatgggcttcatagatacacaccagcccacaatggtcagtaggaccacgctcagcacatgaaggcaccaaagataaatctagtttgtctttgaatttcaaaagttccatctcccagatggaaccctcaagcgggcctgccttcatatatattcaataccagcaccaacgggatcctaattaatgagcttgttaattctccttgccatctggggacaaaaactattgtctggtctctagccattgtgtatatgtgtgtgaatatggaatctccagatttcaaatcacagtatcagcagattatatagtcttttctatcccttaagatttttttaagggtagatattctttcttataatggttaatcatcagaaacaaccttttataaaggctgcctgctatatagcttttcacaatggacatgcaatgatagatgttagatagttacgtccttgtattttcaagcgacttacagaaaacccattt

SEQ ID NO: 57297 - DNA, 1468 bp, Bovine  19866880528984
tcttacctggaaaattcccatggacagaggagcctggtgggttacagtccatggagttgcaaagagttgaatgcgacttaacacacacaacatacatgtttaactaatagattgagagctctgactatattaaaatgaaaacttctgtaaatcaaaattcaccattaaaaaagtgaaagataagtgagactggcaggagatatttccagtgtatgccactggaaatctgcatcctactaatttgaaagcatcccaaatctagaagaaaaagaatttgaaagaaccggaataagagggagaaactaaatagcggatggacaagtgtgaaaagatgggctctcttactggggactacagaaataaaacacaagttaaaattaccaggggatatgatttcaaacacacaagagtaggaaatattcatatactgataattctaggaattggttaagatgaagaaccaggtgaaatgacatttctaagtgtaggagggtaaattatgtgcgacttcagggagcagtttgacaaaatctcttaagtggaccatacagattctctactacccagcaatccctttcctgagaatgttctctggaaaaattcttgcatatgtgtacaagttggttttcacaggaaagttgatagcagcattattggtaactgcaaaatataggaaaaacctaaatatgcaagtagaatgaatttaattaaattatagtatacccatgtcatggaatataagactgaactgaaaataaataaactagagatttatttatcattaaaacaatgagataaaaattttaattgaaggtgaaagtagcaaaaggatactgtgtgatactattttatgaagttaaaaatatgtaaatcaaccctatatataatttggaagaatatatagtcaagtaagggactgaaaatcaccaagttcagcacagtgtttatctctggaggtaggcggggagaggaaattgcccctgaaagaagatacatggaggcctcagaagtatttgtaatattttattgcttaagctgaataaaggctatataactaccaattatagtattctttatacctttttgtatgcctgaaatattttactataaaacagtttttaagtgttccagacttgataaatcaggaaggtattgttaaaggcaaatgcttaagtgctggctgagatcaccttgacaatccagggcactactgagacactactgtgggaagcaactgttgaaaagaagctaaccgtaaaaagatatgaagcacattaggaagccgtctctcataagagacaagcaacagacacagtaaatgagagagttttcagttgagatactaaagaaagcagagcagtttccaaagaacttcaaaataattaagttaaaaaatgatcaaagagataaatgagtcaactgaactcatgttagaaagaagacacgaaaacagaataagtagacttgg

SEQ ID NO: 57298 - DNA, 1719 bp, Bovine  19866880567973
attcccctggagaaggaaatggcaacccactccagtattctcgcctgggaaattccacagacagaggagcctggcgggctacagaccggggtcacaaaaagagctggacacaagttagtgactaaacaactctgcttccaggttctggcccacaaagatgggccctcctcctctgccacagaaaccaccttttggaagcccacacctgctgagaccattggcttcactgcctcttccttataaataaaactccaacttcccagccaagcttctactgacaaagctctaactgtgtgccaggcactcttctacaccctttgcccatattaactcatttaatccacataattctatgcagtaggtactattattatccccattttagaaataatgaatcccacagtgagccctcaggaaatattttctgaatgaatggataaagggacacgcataagcattgacaccatgtactacaggaggctgtttccatgccaagggaagccagcagaaagtgaggaactggcttgccaaccagttatttgttcctgcactccaccaaataacccgtttgcctgccattggctggatattctggctttgtgtagacatctcctggctgggaggaaagccagagttaatccctcacaaagggttgtttaataataaccagaaactggagaagagcagaaaggaacacaatgatcccacacaatctgaggaaaatggactgttcaggcccccagtgcccaccctgtcagcaagggcccctggtggggcctgaggtttcttaatttttattacaaaaatagaacatgaatatgtctctcctgattatcaccaccaagtgcgccgggaaaaacatccacagatgcatattactctaatgcagcactaatgcctgcatcggaacagaaaaccaggtcatctttgaaagtctataaatggacagccctctctgtctattacttatttatgtttcccgccttttgcttaaccagccttcaggcccaaacagggaaaaaacaccatacataaagctaccagtatagataaataaaacatcagactcacactggtagcttcagccctcactgccttggagggggtggccttcagcagctaaatattatacaaatgaccagcaaaatgcaatcctataagaggaggcaggtcattcctaaggtatgtcttcttccccaaggatattcagctttgactttctggacaaccttcttgttggctgtggatggaagacgatgattgcaaagtgagtctgaacccaaatctccttgagttgaatgaactgcgcttgatgttgaattcatcaccagctgaagtttctggatcgcctccaaagctttccccactggccttccctgcagtcacccagcctcagagttcaccaggtttaacacagtcatggggaagtccatacatgagagaagtcatcagagtctccctgagaagttccagcagaaagacaccaatgcctgtttcaagcctaatggatgtccctgtgggacctatggcactggaggaagaccttctggggaaagggaaaacgcatctctgggagcaacatcacttgccttgcctctggcttctcccaatagccctccatgagctggaacagaataggttttactctcaccccattctcagggtagcctggtgtgtagaatggcttgtctgcagagatctggtgtgatgagcagcaca

SEQ ID NO: 57299 - DNA, 1299 bp, Bovine  19866880608431
tggtatagcacagggaactgtattgaatatcctgagataaaaaccattgcatctgcgttcagttgtgtccgactcttcgtgaccccgtggactgtagcctgcaaggctcctctgtccatggaatttttcaagcgagaatattggactgggttgccacttcctactccaggggatcttcatgagccagggatcaaacccacatcccttgtgcctcctgcattggtaggtggattctttactgctggcaccagctaaacaataatggataagaagagtacttttaaaaaaggatatacatataagtgaatcactttgctatagagcagacatcggacataacattgcaaatcaactatatgtcaataaatatatacattgggtcaccttaaagagacactatattatgaagcactcagtgacgggccaagcaccagaaaggtattatctcatttagtcctcaaaacaatccactgagggggaagttattattagccccactggcagatgagagctgagagaggtcagtaacccgttttcaggtcagggagtcaaattcctctcttctggatatgtctgctcagtgccaagtgttgatcttgaatccgtgaaggagaaccaacctgagaggcagctggcaatggtatttactgcttcacagttcgggcctaagtcctgactaacacggattcgattaccaagtgtatctttaaataaacgtgtgctccagcctcttgaattcaaacagcaggcgtccatggcataattacgctggctgtgacacgagcctagctgcgagtggatttttattttaacaagcttgagtaggtgcacgcgtgtgggctgggctttttgcttgctagtcaatacttgaaagcgggcttcaacctttaatttaagcattcgcttgtagcaccaacagggctacagggtttccagtatcaaagacacgctcctccatcctttcatggccctgcttctgtaagcagcgtgattgaactgcagcaccacagaaccttgttttccctcctcccggcaggcgcaaacactgctgccccattcatcttggcgacatcataatgaagtccccgaatcaatttctaacaagcaaagcgcaaaaatccaccgaaggagtcttgtagcagatgcctttcatatatcaacagctcatgagaggtgaagtgcctgcacagaaacccaaactgtaccatagaagtgtcttttgctacatctgaaaagtgttttttttttttttttctccccttcactgaaagattaagagaaaggaagatactgagaaca

SEQ ID NO: 57300 - DNA, 3185 bp, Bovine  19866880626922
cagaaggtggtagtttttttggagctggttccttagcacaggtgtccccaacctccaggatctaatatctgatgagctgaggtagagctgatgtaataataatacaaatagagtgaaagtgaaagttgctcagtcatgtccgactgtttgtgagcccatggactatgcagtccatggaattctctaggccagaatactggagtgggtagcctttcccttctccaggggatcttcccaacccaggaatcgaacccaggtctcctgcattgcaggcgtattctttaccagctgagccacacgggaagcccagtgcacaatgaatgtgctatacccgaatcatcccaaagccatcccttctccctgctccatggaaaacctgtcttctacaaattggtccctggagccaagaaggttggggacctctgccttagtagttttttcctgaaaaataagatgggaatgggactggaaaatattgcctctcaatgtcagtctacatcagaatcaccaaaggagtgtgttaaaagtcagattgccagaccccttgccccttgactttctgattcaggtctgggggtggtgcctgagaatctgcattgctaacaagttcctaggataccctgctgctgctggtctgagaccacactctgagaacttctgggctggaaagaccccctcaggcctccactggggagagacttcattacaaaatggaagacaggattcgaggatggaatttaaaaatccattcacaggtgcagcaggcaggtgggaaaccccagcacatgcgtgcgagggtcccactgtcatagcattggcatccagcagtcccttttacaggaggcgggcattccagctttttgagtaacctctaaaaagataatgcccctctgagcaaaagcaaacaccaggaggcttaaaaacctggggtccctgtgcccgctcctcaagccagcagaaaatacatatatgtcaagaaagtgcagtgtaaatagaaagcagggcttgatttccaccagcccgagtcaaagaatctgctgaggaggccacatgacacacgaaatgaaacccaggtccttgatacccagaggacagaaagggaatggaagatccaagaaaatccaaacgttcctgaatctctacagtaaacacttctgatcggatcctcttgctattttggaacatacatgaagttcattaactggtacacattaaacaggaaaaggtagaggaaaaaaaaacatggtgctggaggacaaatcagtaattgctccttcagagcaaaccaaagttactgagaaaatctcctataaaggctctgtcaaaacaagtcacttaaggattagtgagagctaaatcctccgtcagagagatttttctcaacagtcgtaaatgggttttagtatcagaaaatcttagaaaatatacttcccctgcccctaccctcctctcgtaacggctctttcaatactttggcatcttctggaagcacagtgtttccttaggctgagacttctttaaaaaataaaataaactctgtcatttgcagcagagtcagtggctggaaataaattgttacagacactgtatttcagaggcttgcccatacaacacacatgttcaagtacagtcctttcttttcttggcaatttccctgagaaaaattaatatagggctgttagaagctaatactcctactttatcttttttatcttttttttttttttttcattttggactccttccttaaggtttaactgctcaatttgtttgtttggtaatggcaagagctgaaatttaaatttcatttttgaacatgagtagctggttacttatttttttaattagaaaaaggcaaaccctgaaagcactatatgttttccaatggtagcctatgaaaagcacacattttaatgctatcagtaaagggtcatcttatttactctctctaaaccatcaccaggacttgtgttctatttctgaacagtctgctctggaactcctattgatggattatggaggtctgtctctttcattaagctagtgtgtagaaaagacgtacttacaccataagctcttagaaacactggcatttatccccacaagagggggatcaggcaaaggcattttcctatctgcctcttagatggttacactccattttttctgaccaaatctttgttcttatatcagctctcagagctaatgcatctagatgtcactagtgccaatcagtggaaagctaacacacttgcaaaatgctccctgtgtgagtcaggactgatttcactctttggatacagactatgtttcaaatttctcatttctaccattagatcccttaaaaacattcatctgccatgcaaaaatatttttcctgacatccaaatggcaaatcttagttacaaacctgttttgaggcattaatatactcggccatccctcagcatagtgtatgtgaggaggtgaccaaaaaaagaccccaaattgttcccatcccaacacaccttatgtctaaaattttgccactgaaatcctttatgatttttaatgtctgggactatccttttcatattaagttattccaagagaacctatttaatctatcgaatcagtaagactatagagaatttagcaagtcttttattttggtggtaaagccaagagaatttaggcttgggattatacagacctgagttggcatccaggagccgtggttttctagctctgggaacttgggcacgtcatttcatctctaagaggctcagttttatcatttataaaaggggaataataatacctaccaccaggaataaagaaacaggaaaagcactctgcgtggggtctgcccccttgacagtgctcactaatgtgaattccaggggccagttgggtggggagagtgaggtcagggtagattatcctcctcaggttgaccagcggtaacagaaacagggcacactctggaaagggagctccaggagggggccactccagtgtgtgtgtgagtgtgtgtgtgtgtgtgtgtgagagagagtgtgtgtgtgtgtgtgtgagagtgtgtgtgtgtgtgtgttgttgttgttgtttaaccaaccagcagcagtggacacaagtccacttgagagagcagactgcagagctgaggaaacagccacagaggagagaggacagcgttctgccca

SEQ ID NO: 57301 - DNA, 1152 bp, Bovine  19866880674560
tgcttaagctcctctttaatggccgatctgttccagagcctcacttatagggaagaactctgaacagttgggttaacttctaatccaagagagaagagccaacttctaacattctgcatatagcctaagcatctacatactgtccatcatttgcctgtattcatacaagagtaaaaccccatgatgaaatttcttgtataatcaccattaagttagctcacctcgaaatgccagacttaggaaacttctggaaccaaccctcggcatcaagatgaggctgggataacctcacactgaataaagggaagttctacactattctcatctgaaattcatcactgttcccaacttgtcactccactaaggtatccttaaagaaatggagatcttagattgggttccctagagaatagactcagagaaactgagatttatatacagaaagctgatgggggaatactcttaggaacaacagctataaggggtgaaggaacctggattgggcaggagaaattgaactgtcatgtagctgcaaccggagttcagcagacaccacagacagatcagaagcaggcatacagtttttgagagagatcctagattgaggcaaagggactggatattttactctaaatcagccagccactggatgccagctgtgcccagagaaaagcatcatcttgggcaaggcagctccctttagctaaagacaaggctcagaaaacaagtcagctgtgagccactggcagtcaacactctgggccccgggggaaataagggcctccatcctgcagggaagaatctgggtggcacaccatagcatttgcaggggagccaaaatggacattaaattttgtgaaaacatgttttctttatttaaaatgacacacattttattgcttagctaggatttaaactaataaaatatatgcttggcctcagcattatggtataccagaattgcaaatgctaaagaaaaaaaaatatttttttctgttgaataaggttcttcattagaatttctggtcctggatatgtgcattataaatcatgtgtgtgcaattccacataatgcattatttttccacacatggacattccagagagttaacacatttttcttaattaaaagaaatagataacacatttcca

SEQ ID NO: 57302 - DNA, 1526 bp, Bovine  19866880703876
taaagaaagttccatctgtttatctgtcactgccaagtgccaagtttctctatgaagtgcaaggaacaatttccatgcaacagctcaagagatgcaacgtgtgtttgcccaaagccatggcacagtgacatgcggctcctttctgatctcacaggctaccagccatttggcggggtgtatacctggctgggaagcctcccaggaaaccacagctcctgcaaatgactcaataaggtggttcgactcctgtgagtcaggaccaagcccatggtccctgtgccaaggctccctgtcacggttgagatgctctgggcttggctgacatgaaatactgaggacctctggtgttcacctacagaaggatggactctctttctgacaagtgaccaggacggcagctgacatcattcagtggcccttctcttggagagctgggccttctatatcaagcccgatttgagttttgatggctttctacattaggtgaccttttaatttaagagctcactcttgggactcccctgaaagtccagtggttaagactctgcacttcaaatgcagattgagggtttgatccttagtctgggaactaagatcccacatgtcgagtggtgcagtctaaataagtaaatagacagatagataaaagttcaattttccttcttaccaagggcttccaggttgcctcctaaagtcatgaactggtggacacaaaatacctagttctaagttcctacggtgaggaacctgaggaagacactcactggaggccttaagttctccccatctgaatttaatcatcagttcaattgttctccagcaccatgacaatcataccaatatccaacttaactttccacaggctctcccaccgatggaatcacgtccaaacttcctggctcggtattcaaattcccatctatccttcacatcttctctttctctatgagtctacctgtaacctatgttttgggaaaactggaacactcactcttctctcaagcaactgcctttcccatccgtcatgctgtgccggtcccttaacttgaaatgtcttctctctgcctcttgaaattctgcccacccttcaaggctgaggtcaaatgccacttcctctcccacacacctttccccatcattttttgtgcagcccctttgatctcacaccacaccatgttggtacttccctatcggcccacagcacctagtcttgaagtgccagcctttgtatgaatgacttgcatctcctcctggatggcatatgatccttaggaaatgatgggcgtgaggagggaggatattattgttgttgttgtgtcactcagtcgtgtccaactcattgtgaccccattgggactgtagcccaccaggctcctgagtccatggggatttcccaggcaagaatactggcatgggttgccatttccttctccagggatatcttcccaacctgtgtctcttatgtctcctgcatggcaggtggattctttaccactgagccacctagaaagcctaggagaaaggat

SEQ ID NO: 57303 - DNA, 1748 bp, Bovine  19866880722931
ttatcttggttttgaagatcttttttgtacagttcttctgtgtattgctgccacctcttcttaatatcttctgcttctgttaggtccataccatttctgtcctttatggagcctatctttgcatgaaatgttcccttggtatctctaattttcttgaagagatctctagtctttcccattctgttgttttcctctatttctttgcattgattgctgaggaagggtttcttatctctccttgctattctttggaactctgcattcagatgcttatatctttccttttctcctttgctttttgcttcccttcttttcacagttatttgtaaggcctacccagacagccattttgctttcttgcatttcttttccatggggatggtcttgatagaatatggcaaagacgtggttactgaatcaggagatactcggtcacacaggacagatcaggagcccagtgatgggaatgaaggttggcaaagagcctgccttgattccagttactgcacaatccatcgaaccaaaagatgtaaaaccttagcatatctaagaatgatatgaggagaggaatattcttattctatttgcataggactttttgaaaacagattgctttttcaatatttggaccccttttttgttaataaaatcgcccctatgtctataaaatgcaaatctatggttaccaaaggtaagagggaaggggaaggaacaaattagagtatgggattaacagatgcaaactactataaataaaatagataagcaacaaggatttactgcatatcacgggtatttatatccaatatcttataaaaacctataatgaaatattatcagaaaaaataattaaatggctatcctgtacacctgaaaccagcacaatattataaatcaactgtattttaattaaaaaaaaatccctaatgtctgaaggtcttggtttatatctccttagatccatattaactaattgcaccaatattgaattgggactcttttcttcacccatttctgtatatagtgtatcatgtgaacatgtccatgtgcaatcacacacacatacacacacacatttcagtccagatatgtatataacttaaaataatttaatctaggctttgacttaaaactgaatcatcttttttataatggcgaagaatgtacagcaaatgtaaaattcacctagtggtcaattttatgtcccttgtttgcaattaagatcacggggtgagcaagtttgcttgtaactgaagcacagactcttggctatttgcaacattttaaactttaacaagtgagtgatgcaatataaatgatgctttaaacatttatgcattgggtgggaatctatattaattataaaacaaagggccaagtcctagaaacaaagaagcattagttttttcttcctgagttgccttactaagaattagatccctaaagaaaaggcatgtacacaggaaaggttctgtctacttaccagcacttgatttgtgtcttacctgggaacccaggacaactcatccgagaacttcccgcggtctgttcacacagtctgttctgtgccttgctcatgccctccagccatcacacactgtgcatctgagaatgctgctctctgcacagcgctccttctcagggtccctatggtaaaatctcacatattcttttttttaaccattaatttttttattggaggataattactttacaatatcatatatgtttctgccatatatcaacat

SEQ ID NO: 57304 - DNA, 3559 bp, Bovine  19866880785255
ctgagaaagagcagatgatgctttacaggaaaggaggggaagaaaggtgggactgtaggcgcgccagccctgtttgtgtgcccctggccacacatggactgctcttcctcctcttgctcactaacagggagactttttaaaagacactgctttatattgccccactcccatttcctctgtatctccccaccatctatttgcagcttctgatggcattttcaggacttcattttttttcctctcaaggtctctttttcttcatcttttgccttgttccccgatttcttagcctccgctatttttcctgtctacccaccacctgccccaaacctctgtttttctggcctaagggtggctgggtggggagttgcggatgtctgggagtgaatgccaggagacagagacaatagttgtgacttttgttctccacaggccatgacgtccctttccctgagcatttgcttctgatttagaaaaatcagctttatgagtgtatgtttttatagctaacgtgatcagacattccagctgtgtcgaggattttaggtctagaaaaggaatgaagtgcagagttgggatgcagagcaatcctttgtcagttctctggttggccaaacacggtcgtgcgccctgtgccgcagggcctgccttgccctgtcctcctgctctgctccacctcccctgtctaaggcctctcctctgtgcttccccttggatgctctgggtaccttgagaggcccggagaagcaacctgcacagtttggttcctttaagtcctcctcttctgatctctgctttcttgcttctgtgaagttattgagagccggcccttagcttctcagtactgtgattatcatttacctaggaggtctatttacagtcttgctgccaaaccagagagtctggtgagagatccaggatccttaatttctgaccagctcctaggacctagggatgtagagaccacagtttttcttaagacctgatactatgtgcctgctaaaaaaaaaaaaaaaaaaggtgattaatctgacaagggtatcaatattaatgagctaaagagaaagccaggagaggaccttcccttctcccccaagtgttctctgtgcagctacttcctagagatagctcatttcctcatttaacaaatatttcccaagtgcctactgagttccaagcaatattctaggccctagggcactgcttctcaaactctaaagttcatacaaattacctggggaatcttgttaaaatgcagattctgattcagtaggtcagttgttgttgttctgttgctcaatcatgtcttactctttgagaccccatggactgcagcacaccaggcttccctgtctttcatccagagattgttcaaactcatgtccattgagttggtgatatcatccaaccatctagtcctctgtcatcacatggatcacagccttgtctaactcatgagccatgccgtatagggccacccaagatgaatgcgtcatagtggagagttctggcaaaacgtggtccactggagaagggaaaggcaaaccacttcagcattcttgcctggagaaccccatggagtacgaaaaggcagtagatcaagaggtggggctgaacattctttgtttctaacaagctcccagttgatgatggtgtttctgttccatggagcacatcacagctgataagggtctagaccagtgcttttcataggaaacatagcctgagctacaaatattagccacaggttgttgtttagtagctaagttgtgtccaactcttcaccccgtgaagtgtagcctgccaggttcctgtgtccatgggatttcccaggcaagaatactggagggggttgccatttccttttccagaggatcttcctgactcagggatcaaacccatgtcctaccttgcaagtgaattctttcctgctgagcccccagggaggcctgattagccacagaggcaactttaaatgttttcatggccatgttaaaaaaaaaaaaaaaaaaagtgaaatggattttgaaggactgtgttgcttaacccagtgtgttcaaaataccgtcatttcagcaagtaatcaacataaacgttgagagacacacttgaagtcttcaaacgcaggtgtgggttttgcacatcttgagcacatttcaggtgggagtagccacattccgagtactcaagttcacgtgcagcatttggctcttgtgtgccccagggcaggtccaggcactccccttatccctggggagcgcagcacagtgactcagaaaatgcagatggtgctaccattgggccagaactccagttgtagggctatgtgatctcctttcatgaggagcagcctcagtgatacgaatcgtagaccagcttgtttcccatccccatgtgaataagtgaaatagaaatcccagtgcacaagcccattgtcctccaatcagagaatgctcgctgtttgtgggtgggtgggatttccttccctcttacctggtaagcccatcctgctccattaaaatggactcttctcaaactgctgctgagttaaggggacaggagaagccagggccgcattctgactctgtccaggtttgtgtctgatgtccagtttttttaaatttattattattataattattttttatttgggtgtgttgggtcttagttgcagcacatgggatcttcgttgcattgggcaggatctttcactgcagtgcatggagtctctagttgtgataaataggctcagtagttgtggctcgtgggcttagttgctccctggcatgtggagtcttagttccctgattagggactgaacctatgtaccctgcgttgcaaagcagattcttaaccactggaccaccagggaagtccctgctgtccaattttttgaagacagctttactctgggtaccataccttgtgcagcattgtaggttgtcttgacaccctggccagcgtggtaaaaacgtgagctgagagcacaatgcatggtgcttatgagtccccgctccacctcctggttccaccagtcagagcaaagggaccaggttggaggacatttaaacagaatctttaccttgctcacctgctctcttttctattccccgtcccccgtgctctgcttctatagtgttttgaagggactttatccttggtgacaatgcccgggatgtggccagtatggctgctctgggagacctgtgttataggcgcgaacctagaacatgatgcatttccaaggttaggtcgagttttctcaggccctgtgcctggtgcttgactttaaatgcctctatttgattaaaatgaattctgaaatcaggtttcagggctgatgcaatgatagcaatttagcgtttatatagcactttttgatttatgtaactttttaaacttctctcatttttacaaagttcatgacaggtaagtgtataccttgattatgtgtggttaagtcacttcagtcgtgcccgactctttgtgactctatgggactgtaagccgccagcttcgtctgtccatgggattctctaggcaagaatactcgaatggg

SEQ ID NO: 57305 - DNA, 1790 bp, Bovine  19866880788710
tacaaattcaaaatatttactcttctgaccctttacagagaatttggctgaaccttatattggaatggaagtctataaagctggggactttactgtgtttactgctgcattcccagcagctagaacaatgcttgattcatagtaggtgcttgataaatagttttgaaaaaaataaggtaaaatcttttgtttgtaacttcttctactttgccctagacacagcttcagtctgcaaataaacagaattttcatatgagctatcccctaaagactaaaacctataaagtctaatattcaaatatatgaattttatgagtagtgaactcataagatgagattttttatcaattttgctcagtatttactgaaggctgggaaactctagatgtataaaataagcagttggtttaggtttttctgccacctctacttcaggacctgatgctttggcttactaaaattagcattgattaccactgacattgaaaactagtttgttttgaatccctataaagttaattggtaagtcattggtaattgtctagaatagacagacttctttgcattttatatttaccccttcctttgtgaattactctgcaaaagataaattccctgatattttacacttgtcaattacctgcaaaatgtgtttgtttgtttgttttgctccagaatgtattatttggggatgtttcgaacagcagttggtaggtatctctagttgtaggtttaatagagctaatacagctaattggagataggagttgttcagtggaaggtactttacattccagagcaaacttagaaacataatagctactgtggctttcttcccccgccccccacccagtccttacagtcatttatctttgcagtgaattaattaatttccttttattatctggtacttagtcataaaatgttgtcattctcatgttattcagcgaaatgctctgaacacaagtgttagtatatctgaactatatcagctcattgctggttgcatgagcatatttggaaattatgccagtagaaataatatgtaacattcaataccaaagttctcctggccttagaaatatgtgcaattattctagagagtagatctaagtggcttgaccagtttattcactgatatatttatccctataacctagtttgtgctgaaatatgtggctaaatgattaggatactagaaacacacagatcctttacccatagaagattgcacattggtgtgaaagattggaagacagtgagaaaattgggtgaatagttaaatcaaagattaggaagaggcaccagcagacattggaggaggggaaaaatcagagaagaaacttttaggatttgacacttgatgtgaaacctgaaaaaccaagaaagaaaaatgggaaagcctatgagaccacaaaggattatgaaagatagaaaagaaagaaaagatgaagggtattcttatgagaaagtggagaagggcattccagggaaaaggatagcaggtgaagggcacatagcattgaacacttgagaaacagcaaatgggagataatagctgggtgtaaggaggagagaacaagacatgagcaggggagaaggaccttcgggcttgttaagcagttgcactttgacagtctaggtggggggcaccctgaaagaatgcctggatgtcctgccagagggaaagaactgacttgttggaatgacaattcaacaagcagtgctgctagagtttggggcagcaggagtccctctgcctgtgaaggagccacgtctttcatcactag

SEQ ID NO: 57306 - DNA, 1049 bp, Bovine  19866880797970
aaaatcctggttgcttgttgggtattctctatgtttgcaagtgtcgctgattctacaattgatttccttctggtaagaagggggaaagatattttaaatgaccaaactcttgttcttgctttattctgtatactttgcagctttgaacatcagattcttcactacaggataagttgaaaaatgccaaacatctttagctagagcattcttggagggaccagtatcacatcctaatgttactgtgtttttatggatgagcatcagtgtttgttatttgtatgcttctgttgctaggaagcttagctgaagggctacaggttgctaattttgtttctgatacccatccaccaaaggccacattaagtcatacctcgtatacctgttatgtgccttgatttatttttcttcttgtgttttatgtatcattccacctaaatagttgtgtgtgtggcatctcctagattccatttaatcatcaacaacagaaaattcctctctcctaatttgtatctaatatagaaaagcagccttatctcagagtgtatatgaattacctcagcatggacattatcactagctaataataatgacaactattatttgtatttgtattgtacccgataatgtataaaggacatttccatcattgaatcttcactagggccttaagctgtagatattcagatcattccaactttccagatgcaaaaactgaatccataggaatgataaaagattatacaaattgcctatcaaatgtggacagtaattgaggtttgaatgctgatctgtctaactccaagtccagcgtccttccaattcattctgcatttaaattcctggaatttttctagtgggataggggtgtttgttgcccattctgggccatagcgattggactcttgttggaagcacatggcaaatgccctgcactattgtatcaaaacctatccagctacattgtgagcttgttgccacaccaaggtgctgtcatgagatgttttaatcatcacttcctcctccttttttgacatcttcttgttggcaat

SEQ ID NO: 57307 - DNA, 4373 bp, Bovine  19866880811545
tggcaggcagattctttaccctaagccaccagggaagcctggatattctttaagcacaaggaaaataatctcagatggaaagaggatggtgaaagatgtgaaaataaatgaagataatgtggatggactctaatttgtaggtgagtgcagggacactcaggatctcaacgtagttttgagatgacgtgggccctaagaactcgagaaactaacaaacaaaagttccttccgagacagaagccttcactcgggaaaaatcattagtggtaaagtctgtattgagcagaacaagacattaaaggtaaaggaaaaataagttttcagacagttgtggtagaggggaaaagaggaagcagatagtagaatgtactaaagattttatatgcacacacgaacaaaaaccaaccttcatacatagatacatatctagtggtaacaatgaaacatgggcttagagccatgagtctatgaatgctgtcctgggacagtcccacacaggattgttatcctacaggtaacaatctaaacagataaacccatctcaattaaacatgagaagcaaaagaggattgttgatggaagttcttacaaagttattagagaaaaaaaagatgattgctgtaacatttctacagtcagaaatagtaagaagaaagatgtaccaacagaacagaggaaagctaatatgttcatcctttgttctagaattctcacttctagaaatgtagctcaaaggtgcactaggaaaagaatgaaatgtttgtgcaggatattcatatcagctctaaggtatttattggaaacagtcctcatgtcccttaatagggtatttattaaataaactgtacatcttcagtagcctactatgcaacaattataggcacacattgctttactgcacttcagagatgctgttttgggtttttacaaatggaaggtttctggtaaccctgcatcaggtaggtcactcattgccgttttccaacagcattttctcacttcatgtcactgtgacacattttggtaattcttgaatatttcaaaataattatatttgttatggtgatctgtgatttttgacgttactgttacaacttgctgaaggctcagatgattgttagcactttttagcagtgaagtatttcttgattaagatgtatatacttttaaagacaaagtcattgcacacttaatagactataatgtaaatatatctttatataccctgggaaacaaaaaaaaaattgtgtgagtcacttttttggtgatatttgctttattggggaggtttagaactgaaatatacaatatctccaaagtatgcctataaaaagaatcagaaagctctaggtatgcaactataatgtgatatccaatatatattaagtgaaaatggtcattcagataatttagtgaccaaaaatttatatcatgttcagaaagaattgccaaaaaatcttaaatttcatttaacaatcacattgttagtaatgatattgctgttcttactttgaacgtattagatagtatgataaaacacacaagtacttatgtttgtattagataccaagaattgtagcataggaggtacaaatgccaatcaaagaagcaaaaatcttataataaaactgcaattgtgtaaaaaagatgcttgaaggttttcccgttgacccgagatgtgttagcttgactgtcacaaaaaacaactctgcagtagctggaaacatatgaaatatgttaaaatccatgaatttaaaataatatctttttaaaagagtgttagtcaccttcagaggatgctagtgtatcattattctgaaaacttttaaaatttcaaatatctgtcttttccagtacaaactgtatttcacggtaatgctagaattttactgttaccattttgcagcttctaggtgattgtgaaaacattagtcactcagtcgagttcgactctttgcaatcccatgggccgtagcccaccagaattctgtctgtggcattctctaggaaagaatactggagtgggtagtcattcccttctccaggggatcttcctgacccagggattgaaccctggtctcctgtattgcaggcatattctttaccttctgagccaccagagaagaccttgcaactcctaatgaaatagttaatctaggcagtgatcatcatcaatgactgctaaaatcattaaaagatcagtaaggaattttgatagaataggttgttgacacttgatgaagcaacagaacaattgtagtatcacaagaagaaagataaccaaacatcattagcctcctgattgaagtgggaggtatactttaccacatacaacatatgaagattttttttaaaatgtgcctgaatctgattaagctactagatcatttaataggaattgtaggggaagcatgtgttcaatgatatcatggggatgcaaaatccagaatgtgggaaaattccacaggataactgatctagtttcttctacaaatatctggtggatatcggaattggcagagagtaagggagaggtgtgactgagcaactgaactgaattgaactgaagggagagttgttgacaaagaaaattgagagacatcggaccaaatgtagagtcaggatcttggtgggatccttattccaataaacagttgtaaaaagaaatgtatcagattagaaaattttaacaccgattaggtatttcatgacattaaggaagtgttaattttattgatataattaatatgtttaacagaattcttttataagcacatatttatagataaataccatttttaattttacccaaatttgttctgtcaggaatgagagcattgtttttcagttcattaattttggttttatatttatgaaatttcattattttgaatatgttatcctttacctatttcttgaaaaggctatgaatgatatttctgatttttaataattgttctcatttttgttgcttttttaaataatcagtaattatctctctaatttcttcttttatccaacagtttgggcagttttaaatttccaagtgcttgcatttattattgtttgttgactttttgcttaatgatttctaattttatttccttctaaacagtcagaccttagtagattctgctttgtactttattgatattttctttgtgtattaatttgtagtccgtctttggaaataccccttcgatccttgggcgggaaaaggtatatctttgtagtctatgtgtatgttttcagtcattcatgtatctttgtttcagttattaaatattcatactttctacatctctttctttacttagaaatagtgtatcattgaccaagtacagttgtttctttcaaatttttcttttatttttcagttttgacaattttaatgttatttggcatgtcacaaatcataatctattcatcatggatttcatctttttccttttaggtttttttttttttttttaattcagtcaagccatgtggcttgtggcttgtggaatgttagttccctgaccagggattgaacccatgcccttgacaatggtagtacagagtcctaacccctggactgtccaggaatttcctggacttgatcttttgttcaacataggattcctttttctatccaatgctttttgcattgacttttctctaacacttaatattgttaatcctttatttcttgatgtcatgtcccattgtttctctttaaacctgtttgtgtaagaatgcctcacgtaaacagtgtatagctttattttattttttttttactaaatgtggtattgtttaatgagaaactactatgattgactataccaagaaattttctatatataattgcacttttaatgcttagaacaaacctaagatgatgaccctattatcattattttactgatgaggaaattgagtttcagagaggtgatttacacagatagatcttactcactgcctgaggctatcagagtatttttctctcaaatcctaagctgtaagacaatttcatggtgtttatccaaaatactctgccagactaaggagaaattttgctacttgacaagacagtttattcctgaataaattaaaactgtctggagttcttccacaaccaaaacagtacgtaaaaactataaccttcaatggcttcatgtcccaagatacagtaaaaccatttcctatccatttttcctcatactgctgagagttgttttccctgagtggatgtgtgaaaaaaggtactgattgatgttagaggctggtgactcttccacagttgcagtttccttagagtggcaagaggctttcttcctggtcacctaagtctctgcgagagcatataaagtgtgtggaagggaaatcca

SEQ ID NO: 57308 - DNA, 1006 bp, Bovine  19866880820919
tgcaagtatggcgtggatctcatcttcagcttttcccctcctcaaagttactaattcataccagcacgctaatgcctttggaatgtttattctcttcaagttggaggctccagggtacacaagaaaacaggcatagagcatgatgagaaacacatggcaatagtctagttggttcacaaaacacgttaagcactcaagatttactgtgggcaggagggaccacacctcattttaggaacagaaatatttttgtccaataccacaaagtgattttgctttaaaaagttatcttaagatatcaagaagagaaaaacataattttaagttgacacacagtccatcataggcttgtatcatcagtgtgagactaggagtacaggtgaggctatgaggatggaagaggtaaagcagggccttgacttcctttatttagggaagtcctgaataagttctgtcctgggttctctttcattgaatgactggcttcctaatgtggccataggtgttttcactccttaggtcccatcccaccccaatccaatcttctttggcttgtagtttgacagtttttgtaaagcaaatttgaaattctgattaggagggttttgcgtgaaaaaccaaccccaatatagccaggacaaagctagatgacatgtctggcagagtggaagtaaatgatctccccattcattggccacacctgtgttccatggtccccaccctaaccccgacacatcagctttaggactgatatccatctccaaatagtgttgggcacacagcagaccattttctgaaagctgtgctagggtgctaactagctagttaaagggatagtcctctccagagggcagggttgaggcaagtactcaatttcctaccatggagtcttctagaaacatgcagctacatacctctgacaacatttaaatacaaaactctagatccatatgcttgtcctcacctcatttagttctttagaaattaaggaaaagacacaccaccc

SEQ ID NO: 57309 - DNA, 1933 bp, Bovine  19866880865892
aataataagatattgcatgtaataaccagtgctactcatacaaagtatagttcatggttcagagctgatctataagcttgttgctaccagttcgagacaagataaatatagaacttgggaggattgtttagaaacttacaacattttgagaatgtgatagatcccttcaaaaatgaaaagtgttaaggaatttggtaataataaatctaggtttttatattttacatgtctttttatttcatttttctggtaattcatttttatagtgtaattgagtcataaatgcaggagataattttaataagggcccaaaatgtaaaccaaaattttgttaaataaaattcctatgtctacacttattcctagacagagatggctgagctcaaagagtcagagaaggattttaaaacctcaaacgcaagaggttgtcactggggagaaaactgaggccaaattgtacgtgagtgtataaagccacatttataaatagttcagggcccaacagaagtgttttaggtagcaactggggagttaaaaaaaaaaaagtaatgctctgcgatacattagaggaaggtaggaacagatccttcactatagaaagcttaagaaatactaatttaggcaatctatattacttggtttgggaaatgaaaggtttgggtgatatctgctatagagtacctaacactatataacaaatgcatatagcaaatgtaccatatagtacatagtatatgtaacagtacattggaggaacagagtggaccaattctgttcgtgttggaggaacagagtgatcactatggactatggtggtttgagcaggatttatggagcaagcagcactttaaattgcaacaaattataggtgaagaataggagaaaatcccaggattgagctgcctaaaattgggaaataaaaggcctataaattctcctaaggttttgcatctctcttttcttaatataggcacccctttccattacgatgactaagatcaggaagtggattaaaatcttttcatttcctccttggctttgaagttccttaaagaagggatttagaatataaatagtatgattggtagaatctatgagtgaaggagaaaacgtaaattaaatgtcttctcattttcaaaattaaatagaagagcttgctcctgcctaaaagaaagaaaaactaaattaaaatgtttggcactaaaagtaatcagaatatttgatcaaattaagaaaaactaaacccatcttaaacttcagtacctttattttcaaaaggcatacttttatttgaaaacatataaagacagtgtttgggctcatgtatgaaaaattaatcttgtgctaaaaggtagacaaggggctcagcctgatatgctttcttaaatcaaggagttattcaaaatcaagaatttacataaagctaaattaaaacctctatagcacatgaagcctatgggaacaggactgtactatggctaagccaaatcaagtcacttaaacctagagatgaagagttccagtccatgagaagctaagacttcccggggggcccagtgtaagacagatgtaggtaggactaggacacaggaccctggattgggacttaaatgccctgagatcaccaaatttctaacccgtgacacttccttgtgtaggcttctctcactgaaactagacattgcaaatcattcgtttccagctacttgccttctcacattcctgaacaatttaaggtcttctcatcaactacaagaagcaggcaattgtcaatgggtaatggaacttcagacttgggatcaccaggtggcaatacaaggctgttagggggagggtgaagtcttctgctcaggttcactttgcccagcaatacataagtcctgagtcttcaaaaggctctgaaagtccttagatcataaagtccatcacacat

SEQ ID NO: 57310 - DNA, 1488 bp, Bovine  19866880880659
tggtaagaaactgcctgccatgaaggagacacaggttcatcccttggtctggaagatcccttggaaaaggaaatggcaacccactacggtattcttgcctgggaaattccatggagagaggagcctggtgggtcacaaagagtcaggcatgacttagagagtaaacaacagcaacaaaacaacttctcctgaaatgtcctttctgccttctctgttaactgaatccctaaatttctttaaaggtctgttctattgggttagccaaaatgtccattccagagtggattgccatgcctttgtccatgaggggactcttctatacaatttttatttattacaaactatatattggagtcacagaaggcaatggcaccccactccagtactcttgcctggaaaatcccatggatggaggagcctggtgggctgcagtccatggggttgctaagagtcggacacgactaagcaacttcactttcacttttcactttcatgcactggagaaggaaatggcaacccactccagtgttcttgcctggagaatcccagggacgggggagcctggtgggctgccgtctatggggtcgcacagagtcggacacgactgaagtgacttagcagtagcaatatttgagctctcttagtattttgcacccctcttaaggcacctggttcaccttgtgctgtggttggttgaagatctgccttaccctctctggtggaagatccattcctagaaaacaggggtttacccttgcacacagtaggcacacattagacttagtggatttgagaaatggtcttaatcataaggtagaatgtccacacagtgattccattacacaacatgaatgaaaacctaagtgtttcaactttcaatcacttgaaataagcctttctttcttgggtaaaggattagttgacatgtatgggctgttaaaatttatatatgcaaaaattttgttgacacttattttctttgcgtttcttagagagaaagacaaggaaaattatggaaatatatagattttccttgggcaaggggagctttctacaacatgcctaagaaaaagaagacagaaaattaaaaccaagtgcccaggcaacaagtttcctttctttcaacaaagcctcaagaaactgaagctggacatgatgcacaaaatagaagaaattcaaaagaaaatgtagcagctcttgggcatgggaggggctcccctatcctgctgcaaggtttgtagatttatagtcagagccaccccaactagaaaagtccagattgagaagacccctttgttcaacctttattttttgtacagttattgccacctcttcttaatatcttctgcttctgttaggtccatactatgtctgtcctttatcgagcccatctttgcgtgaaatgttcccttggtatctctaattttcttgtacagatctctagtctttcccattctggtggtttcctctatttctttgcattgatcg

SEQ ID NO: 57311 - DNA, 1560 bp, Bovine  19866880894100
ggggttttggttaaattgtgtttgaaagccttagagtcccccagacgaactatggcaaattgaaacgcaaggagcgctgttagaagtcatacccgcaaactctgggaaattacagccgacagttattagtcatccttacgggcaatagagactgttgtttaaaaaaaaaaattcaaatctgatgctatgagtaaagagctgttcttccctaggccggataataatattgccaggatcgatttaagaaattaataggagactttgctctgggctggcagaaagcttcctttcttgtcaagttcagccagcacgcaggtgttttttattgcactgggaaccatcaatacatagaatcccaaggtacttacttatttaggcaaaaaatgcaggcactgagggggatcgttaaatttgctactgagaaaggtgattggtcccattcagatgtttttaactggggagcctggattttttgatcgctgacttagatcgggttgattatcttttgtacctctctgtttgctttaaatgtagcaacctagataggacccttgtttaccatctagctctggggcagcagggtttgggccaccattatagtggaaaggacatggatgtgggatgcttttcccgtgtcccagagacggcatggaagcaaggtcattgcctaaagattcacagtagtgcactcagaggggaatgaattctaggttcctgcttcgtggttagtccatatacctgccttcaaaaatgctgccgctatccaatattatggacagaaactgggagaggaaaaaataaaggaaggagggtttgtagaccaacagcactccaacaaggtggtctgtcctgcattaggtaacaaagctatgccccatacattcagagccatctctctgctctttcccaccatatgacacagctatctgacctgtgaacatccaccccacccccaaaccaacgctgccagtacccaaccaacccttgaagcaggagtctgcaaggtgaatttcctaacaagctgacttttcaaaggtttttcagctcttgaaaacatgaaagccgtgtttaaaaatttaaggatctgatatgtaccagttctgtggagcagcagcaggacatagctctttgcagtgccacgattccccaaaccccaactctttaaattaagatgtttgtgacagctgcttgggcttaatggaatgcacgtaggattggccattaattattgctcttgggtttttgcacttactccctgtgtttcaccacaaaagatggtattattgtgtaaactatttttagtgctttttaaagaaaccctctttatttggggggcttccctggtggctcagacggtaaagaatctgcctgcaattagggagacctgggttcattccatgggttgggaagatcccatggagaagggaacgggctacgcactccagtatttgggggtggatttttttttacttttattgtaaaaatgtccccacatactcaagagttgaaagacaatgcagtgctctggtggacccatcatacaatttcaatagcaatcaa

SEQ ID NO: 57312 - DNA, 1531 bp, Bovine  19866880913641
ggggttgggagtggtgggaagtgggagggaagatgtgtaggtaagaagaaaaaaaatcactgaaatattttactggaagtcttcttagttttaatgctggccttgatcacattattgtaattgtaattatgtccttatcaccatctctacttttctctgtattcctcctgcctccttggagatcctcctccctgacatattgcaaaagcccgaccatgcttatccagttctgatgcattcctcccattcctccttcattgttcttataccccgctggagagtagcagattgaatcaatatatgttaatattcagtattaggaatgttggtggtcctaaaatccttagcaactcaggggagttgtgttatttaaaaaatagcaaggcacctttttgaacctaaacattgcaatttataacatttgaggctatggaatcagagagccatataatatccaggcagcgtgaaggaagatctcagatgaggccaggttcggtatccttattggtcaggggcgttaagatcactgcctgtggaactcgcctccctaactccatctgttatctcaaagcttaagtcaaggctttccccagaaataaattgcaactgccatggaagggtgtgaccatcaagctaaatttttttagttggagttttatgattgggaaactgcctagattttgtgatttcctgtagtgcgaaatggcttgcctgttgtaaatgcccaggaaatactgctgactcactggctttgatcatgaacttggtttgggactggggtgtcaatatttaacatcctttgagctattaaaaatactgtatcgattgatacgtctgcagtcgtggccattagtttcctgactgatttctaatttaagtatttttcctggcaaggtagatatcctcctacaattgttattgattttggggtttgtaggctcttcctgcaccgatgcacctagaatctggcctttgtccttcctttgtgtggggctgtgggcctgctgaggcatatcttacaaactgagggtgtgtgtatgccagatgaatatcccaggctctcctgggctgccttaaacatctctacattcgacagtatttattaagcatctactatgttccactcaggtattccatctactatgttccactatggcttccctggtggctcagatggtaaagactctgcctgcaatgcaggagaactgggttcaatccctgggtcaggaagatcccctggagaaggaaatgacaacccactccagtattcttgcctgaagaatcccatggacagaggagcctggtgggctacagtccatcgggtcgcaaagagttgcacatgactgagaaactaacacctcattttcacttcatgttccactcactagtataagcacttagggatacagcagtgaacaaaacagaccaaaaaaaaaaaaaagcaccactctgctctttaggttttaaatctagtgaggagaaaaacaaaaatgagtgaattgtataggcagtaatgattgtaaactttacg

SEQ ID NO: 57313 - DNA, 1659 bp, Bovine  19866880921635
accatttcatctggtgatactagagtaatatttgcaaatagatgcaattctcatcttgtgactcagaaaattaaagctgagagattgtttgcattgtttgggatggactacagaactatctagttttgttcctgctctgctcaaagagaacttgggatgactgacttgtaaatacaaaaatcaaaatgcttcccaacagcagtgcaacttgtccaaacaggatgaggctgaatcttttggttctcctaaaaaacagtaatcttggcaaactagccattacttcagtatttttcaccagtaatttaatatatggaaaagggtctgcaaactatggatgtgaattgaaatcaacagcatttcatggtggctcattcctaaatagagccctttattactatccctaattattctcttagctcaccaatgatgagaggtattagaagacattaaactgttgatgagaatgacaatggacatatcttctgatgttaactcatcctatgaaagagtaataatccttgtatttaagattcaaaatggctgaaatgatgtcatcttccagttaatacacttaacccggcagtgataccacagcctgatgaattggctttccagctttgtgatcacagttctcggaattgatgcaccaacccctgccaaaaaaagtgctcaactggcaagaaatttacctcagccgagacaagacagatcattcagcagcagcctccccaaaataaagaaaatagagcaaagctgtgtcctcaaatagtggaaatgacctctgaactacagcaactcctgttttgctcttttattattatttttatgtttttatatatttgcaccaggtcctagtcatggcatgtgggatccctgatcctggggaatgcaggatcttcagctgtagcatatgaaatctagttcactgaacagggcgagaacctgggccccctgcattgggagtgcagagtcttagccactggaccacccaggaagtccctgctctttttgcttaatgttctctgatcaaggaaatagtttccatgcaattcagctttctgttttcttccaatagttggcttagtttacatgttttcatacaactggcttggagggagtattttgacacagacattttctcatttatcagaaggctctgaactaggcagattccaggctctgtggggagtgagttataagaatgtaagagaagaggatttgcctttatttgtggttatggaaatatttctgcaagactttcacaatgaactttgtcctacaccaactcttctctctcgactgatgcttatagaaactttttgagcatggcaaaaaagaaagtcacaggtattccaactcctccattcccacaactctcagacactatcacatacactcccaatccctgcaatataccccaccactgggatataatcttaatttgtaaagttgtcctccataaataaactgtggtacatccagacaatgtagtattatttagcactaaaaagaaatgagctatcaagtcatgaacagacacagagataacaaatgcatattactaagtgaaaaaatcagtgtgaaaaggctacatattgtatgattctaattatatgacattcatgaaaaggcacaaccatggagacagtaaaaggctca

SEQ ID NO: 57314 - DNA, 1744 bp, Bovine  19866880924782
tgagtggtttgcatgatgtgtttagaagctttaatcttgttaaccatcatctaaaagtgccacacacacacacacacgtatgcacacacacataaacacgtgtacacttacacacacaaacgtgcatctatgcacacatacacacaaacacatatgcacaggtacacatagacacgtacacacactgctgatcattttttttaaagctcaagaaaagccagtccttgagctctgacttccacacttcactttcagaagggatccagagcctgtactaaacagaaactgccttggtgacgacttagtgccctgtgtctattgtggaaattcctcagctttgtgacagacttattattttattgcaataaatatttgtacagttccttttggtgttcatcagtgacaggcacatggtcttggtgagcccccttttccaatattaatgacttcccccccggctgtctgccaggctgtgtgctttgggttagaaggaggtcaagacatggatgtttaggtgaatttcctgcaacccaagctttgtgtgttaagttctcactcttccactggggccccagttatctttttcaagtctgtttgcaacatggtggcagttttgacaggaaagtccaacttagaaaaccaccactattcatccgaatgtgcttaaacccaagactcgcattcacatccagtcagaaaaccctcttctaaagtggtttttcctattcaatttgtaaacccaacttttttttcatttaccgggctccttttataagtggggatcccctatttttaggtgaatgtctttacttctctactgtcatgctcaccttaaattccagagcaagagaagagcatttagaaaattggtaggcagagcggctgcatctgaatgtcacatcaaggatgaggtgagaaacctgagcactctagaaagattcttccattggtggctgatggatgagcaagataaatatgttttcctagtgatgttcagaccaccgtttatttcttcctgtacgtgaaactagttttttttttttttttctgaaactagtttttaaaaatgaaggaggacaggagcctgatatttgttgaactcttaatttgtgcaaggcactgtttgtacatttcctcatttattcacaataacaagtgcatgggtgagtgtctttagcctcataatacagatgtggctcagagatgagaattgtctggctagtaaagggtgttgctgaaacttcaagcccaagtcttgcatcatcttttccttgtgccagtgtgattgactgcctcctttgggttactaactgcaagtacagtcagaagagagggaaggaagatggtactgaggaggtctggcaaggagggaagattctcagggaacatagtagttcatagaagcctgctcttctgtaattgtgtgtggcctgtttctggccctggtgagaacaatgttaagtggacttcatctagaattgtgtttcccaaagttaagtccttggactagaagttgtggcatcacctaggaacttgtaagaagtacagaatctcagagcccaccccagacctactgaatcagaatcagcatttttaacaagatctccaggcaattcgtatgtgcattaaactttgagaagcactagcctaaaggcttgtgggaaatgataattaacgatgctgactgagtagttctagtgtagcgtaagatcatttctgggtaaaggcgattctcctgcattag

SEQ ID NO: 57315 - DNA, 1006 bp, Bovine  19866880965593
cttttagaataaagtagaatataaagttgtgaatgtgtaaatacctagtaataccatacatcttccaggtcatcttagcagaactggcttttacagaaactccgcagtgacactggtctgtaggcatatcttagagatatttcaaaatatgctgtcactgaaattaaaatacaaagcactcaagtgggtcaccagcagcctgggtcacgaggaacagaatcctttgcccctgatgtttaccaataaaatgttccgatgatgtcattggtgcaagcacaagtcgtatggcgtatacagcctccctcattttcatctttcctcttggaccttgtgcatactgttgctggcaaccatacaagtggcacactgaggtccagacaagtctaaataatttttttcttaatggagtagatcattaattcgtttttagtatcaggtttcataagagcgcttttcatgtggcctttgaaattcctcaggtatgatgtgtttcttggtgtgcagagatgggactgcagcagaaaatgtcatgtattctctagcacattgagagaagaaaaacattactttttccttcttaatttgaatttcgggtaaatgaattttataggtaattgcttcaattgcccatttaattctatttccagagatataaaaatatgcaaaacgtttccctactcaccgttgtttttgaaatgagatgacatagcacctgctatacgaagccacatttcatatggctcaatgactagactgcctgcctttgtgaataatggttggaattgttaataaataggaaaatgtgttcccatagatttctttacttgttttgtagccactctaacatatctagtcagtatttcagaataatactctgtccttaccttttcttgattgtctgctctatttccattgagttaattactgaaaagtttagtgaaattataatgaaaaacaccttgataatccactgggtttcagttatatatattaactggatttactg

SEQ ID NO: 57316 - DNA, 1938 bp, Bovine  19866880981837
aaccctgaagaacggatagaatgacagagtgctgggcaaactgatacaagtgctctctcaccagaagatttttctggaggccaacttggcagttatactaaaatcctttaaaaacatgcctatccactgaactagaaattactctttaaggaatatattttaaaggcatgataagaaaggtacaaggatttacctacttggatgttcatcacagcactatctgtaaggtaagacacatttataaacatgctaaatgtccaacagtagtgaactggaagagtcatgttggatatctgtatattcagcaaccactaaaaatggtatttcagaagtacaattattgacatacggtggtgatagaaatgtactacttaataacaaaaaaacagctaaagaactaaacacaatataatccaattttggagggaaaatccatatatttaacacagaagaaacctttggaaaattatgccctcaaatgaaaacaaatgctgatcttttttttttttttttggtttgtttatctgtgctttttgatttttctatactatgtgagtggaaaggtattcgagctacacaagaagaactattcactacatctgcttttttccctgacagctggggactctgtggattaagtcatggttctgatggatataacctcggtttccagttttttccttttggagaccaacctaggatgggaggggcaggcactgaccttttaccaactctctgatgtctaccaagctattcactaaccaacgtgggcaaggttaggggcccaggatctcaatctctctactatacttcaaattttcctgatatcaagtctgatctctactgtgaggcaatccctcttttctcaaaatatctaaagctgtttttatttttttttccttaatgtgtttcttttctctgtgacaagaaagtgagaagtaaaactttcttggcacttaatagacttcaagaaaatataaatggtaacagaggcagacgatccttaaaaagagataccaagaggtcacctgtctatgtattcggtcgagtcagggacatataatctctgccaaggctgaaaggtatttcgttctttcttgagactataccactccatgtttgctgtcactgcaggggcttgtttgtttgatcagttgctcagtcacatccgaccctttgtgaccccacggactgcagcacaccaggcttccctgcccttcaccatctcccagagcttgctcaaactcaggtgattgagtaggtattgccatctaaccatctcgtcctctgtcgtccccttctcctcctgccttcaatctttctcagcatcagagtctttgcaatgagttggctctttgcatcagatggccaaagtatgggagtttcagtttcaggatcagtccttccaatgaatattcaggattgattggtttcatctccttgcagtccaggggactctcaagagtcttctccaacaccacagttcaaaagcatcaattcttcggcgctcagccttctttatggaagtggaagtgacaaacagattcaagggattagacctgatagagagcttgaagaactatgtacagaggttcacaacattgtacagcaggcagtgatcaaaaccatccccaagaaaaagaaatgcaaaaaggcaaaatggttgtctgaggagggcttacaaacagctgagaaaagaagtgaaaggcaaaggagaaaaggaaagacatacccatctgaatgcagagttccaaagaacagcaaggagagataagaaagccttcctaaatgcacgatgcaaagataagaggaaaacaatagaatgggaaagactagagatctcttcaaaaatgagagataccaagggaacatttcatgcaaagatgggcacaataaaggacagaaacggtatggacctaatagaagcagaagatatta

SEQ ID NO: 57317 - DNA, 619 bp, Bovine  19866880983480
caagtcactggcattggctagagtggtggcaagaccggaacagggtcttccaacaccgggttccagaattttgccagaattctcttgggtctcatttcagatgggagatagaattgatgagagtattatttagtcatacagtgagaaggtattcaccagcaaaggaaggaaatattccttttccttgtacaagaatcccagaaaaactgcctgtcttctatcgtgcttattttcaaatgaggtctgaccttgtagctaagactttcttccgctgctgactctgctcaccctccttctacttgattcatttgggccccagtggccctgtttggggaaaggcccatctgggagcactcaatacattcccctgtcagggagaggaaaagagctacccttgcagaataaggaaactttcaggagggctctggccagaagtcaacttgcagtctgagagcagcacttgatccaacactggcatacatgcctgttgctcattacttcacaaacgctgctgcatatctttttactcttgcccattgccatgaatcctctgaatcagcacgctgctcaaattttcaaccattcaacatgcaggcacctcacatacaattattgagca

SEQ ID NO: 57318 - DNA, 1046 bp, Bovine  19866880985537
aaacgtgcccagcaaaagtgctcagtgaatacacagcagggagacttaggttctttccatttatacactgcagaagacagagtcttgttaaatctttattaattgattcttcccacttccaccctctgtaccttttcttagacctccaccccccacctcaacacacagctgttcctaagtgtctcagcaaccaagtgtattttcacacctgaacccctgcaatgccttgatcctggaccaccctgttataatcatttaacaattacatattactagagaggatgctaatggggtaatgaggaagggagcagttcgcttcgactgggagcagggtaccatcatgttactcacgtctggtagctaaacgacatgacatcccttttgggaaagtgatggtgtccactccagtttccaggaaagaagattccacgacctcaggcagcccatttctatgttaaaaatgcattgtgtcccctatgaactgtgggatggtgttctcttccacctgttagccacaaagaccaattgaaggctgatgtctagaccagggcttctcaaagtctggcccctataccagcagcatctgcatcacctgggaactagggagaaatgcaaattctcaggccctctctcagacctactgaatcagaaactctgggggtggggtccagccactggtgctttcaagatacccaccaggtgactgtgatgctcagtacagtttgagaatggctggagtatggactgggagtagggaggttcaagtgtacatactgttcatcaatgcagaaccaccttttatttgacccaagtttcctgtgtttactgctgcttgtcaggaagaaatattcactttaatttcacagtttgtgtgaactgtcagctggagaggatgggatacattttcataggccactaggcttgtggaagctcaggctatttgactcccaagaagtcaaatatgtcctaccacaacctaattaatgaatttgtcaagagctgttcccctttgtgaggattttagccaagatttcaggacagccctc

SEQ ID NO: 57319 - DNA, 933 bp, Bovine  19866881002660
ccaactaaatgaggatttctagaggaagggtctggggatcttcagttttaacaactttggtggattcccatgcatactgaagcttgagaaccattaagttaatccattttaccaagaaataatgtaagcataaacctcagaaaattgtctccctgtggaatgggcacatcaataatacagtaggaaagaaaaaaaaagaaaactaataaagcatctctttgagaaaatacagaggaatcttggaatatttgagattttcatgatgaaatctgtatttacaaagaatcgctgaaccaaatgccttgcaggtttttgagaagtccgagataactttgctaatgtttgaggttgagaagagcccaaatatatttgccaggagcagactgccccctcaaatttaacccagcatctttaaggaaatgcaaccaatgtgttcatgatagtcctgcctgaaattcatcaaagtgtaatttttgtaacaatgatttggtagccctttagtatttaaacgtcttttgttccccgtttagaaactggaagttgcctttggtcaaggactaactaaccccaaacagagaggcttgagatgattctaaaacacaagccccacaagtatcctgtgagtctcctgcaggctctgggcactctatttagagctggaacctcaccttcaaatatcccacttgccttacaaaaaaagaaggcatttaataacagcagcctgacatcctgaaagagcattgggctgggagaaagcgcatgttttctctcttgggttttccactgtgtggctttgggcaggtattttaacctctctgatcctctggtttttttaggtttaaatgagaggattaaactctatgacctttggggctaaagtacttctctatctaaagtattgtaaccattactgcaactgctgcctagaagctc

SEQ ID NO: 57320 - DNA, 731 bp, Bovine  19866881007425
cacacaggcaaaacctgggctgctcattaaaagaggaaacaggaaataagcatcaaagaacaagtgctctggacgatgtgttcatgttacatgtatgaatcatctctgaataggagggacaaagactgtttttttttttttctccttgcaggcttgttatgtccataatgcatccaaagtggtaatgtggtgtttgttaaggctgcctgttgaaaagctctccaggtctccccagaaatgcaagccagtagcagagctgatggggtgcataatgaacagtctcttgtgaagctcaaggatgattttcccccatcatctatttgtatgtttataaatgagtaatgaggtcaatttgggacaggcaggttttgtgccatgatttggacagatgttcagtactctgcaaagcacagctgcctggtctaagtggtgcctcttgccaaaagtatcgagcattcaaaggagaatgtgtcaccagggactgttcagaggagcccactgatcatcagggaattggcttgtatcgatcctttgcaatcacatttacacttgtagaacctgtggtgctaagagcaaatgcacaaaattaaaagacttttgcacttggcaaataaatatttgatcgacatagttgtcagtcttcacttgttaatatccaaagatattcatttgtcttctgttaaattagcaaaactaagctttgaacctgtcatgactgaggtgtctgagct

SEQ ID NO: 57321 - DNA, 1224 bp, Bovine  19866881040679
tatctaccgagtccttactgtgttctagacattgggtacagtgggtggtgccaccatggcctatacctgataagagttttcattctactaggggaggggggaagagtgagcagctgtgaacacactagctaaccatgaagatacattctgtagcataagatatgacatatataagcccagggaatatgacagagtgtgactgaggggctacttctacatagaaaacggaaaaacaactctttgaagaggtgacatttaatcaagaacagaatgacaagaaggaccagccatgcatagatctgggcaagagtcagatcaaatgaacaagagaaaagggcatgggttatatgatggagacagcaaacaacaaacagaaggtagccagaagaggcagccaatgggcaggagaggcagctgggaaggagcctgctgattaagaaagtcctctctctactgggctgctgaggtgggtcatctggtttctcccttgttttttaatagaagcaaggggagggacacagaagccatgtccaaattacaggggcacctgcacctatgaaggaggaggtcgttgtaggaaggctgggtaccacattttagcatcctgaaagcttaaagccacattctgcttcatgtgccaactttctctctcagctttcatgtcccagggaaaggtgcctcagtgtgttggagttgtagcctctgatcctataaaccactcctaagtaatgcagaagcaaggtaggaaggaaaaacatcccactgcgatctcagctgtatttcttccacatggcaagtttcattttgtttaatttaacaataaactcattatattaactcaattcaatagaagcagcagggggatttctcctaatttaatcttgggctttgaggagccttgctcggtgctaaaacaatgccatgcagagagattaaaggacttgtgtcatgttgaaaaaaataccttagagtttctgagcacagcccacctgtaatttaggaactggtcagcccacttcttactttatccaaagcatcatctagtcagagagctaatctctgcaagcaaatcattctcgtgaacgatgtcactgtagggtttaaactctgagaagagatcttttcatccttagagctgatgctccaatttgaaaaggagttattggatgcacccagccagggaatataaatatcttgtgcttaccaatgtcacaaaagggtttt

SEQ ID NO: 57322 - DNA, 1741 bp, Bovine  19866881043726
ataagacctgacaattgttactctcacatcttcattcattcacctcaatattcttgagtctcagcttaatcacaaagtcatgcaactgggaaagcaaaaccacacataagagagagatgaagacctctctgtgaaaagaacagacaaggcccatactaagttcagttcagttcagttgtgcagtcatgtccgactctttgcaatcgcatggactgcagcacgccaggcctccctgtccatcaccaactcctggagtttactcaaactcatgtcctttgagtcggtgatgccatccaaccatctcatcctctgtcgtccccttctcctcccgccttcaatctttcccagcatcagattcttttcaaatgagtcagttcttcacagcaggtggctaaagtatctctactaagttagagaaaggatttgatgtttcccctcaacccctatatccttcttatcctggataaacaatgttgaagatggatcttaagtaggagtcaagaaactataagattagaaaaggatgctctatttcttgttcatattagtaagtgacagaacgcattcaaattgagttctagtgactccaaaacatatgtgggagagggccaggatggtctgtaggctttggagggttctgtttcctggaaacatgggcttaaggaataggagtagacagaactggtgaatctctgtgtggctcatgtcctctgtggttaaaatggaagcagtcagggcagaattcttcagaaaataaggcaatacattttgagaaatatcacatggggttggatgggggaagtactactaaaacaactattcaaaattaatgtgaagaagttttactcagcatatagttttcagggatctgataggagggcatagggagattgggagggagaggacaagccacaatcataagcttactgatggatgagaccatggtagaaatgccctagaaacatttagcaaagagtccctgtgggcagcgacttaccctcacaccattgttaaccaatataagggtcaagggtgatccacatcctacttaggagaacaataagcagcattttgtctccaggctatcatgggttgtccacagtacaacagaaaccctgcctgaacttgagaggtcggccaaatgcaaacatgtttcacaagcactattttcctacctcatcttcatctatccagctttaggatctcacagacaagatctcggagacgtgaatatgaacacatcatactcagaagtcctcaacacagaaaatagagaactctgcattcagccacctgggctgaactcaaagcatatgtcccaatatggacatggtaccttcacagctcttatctgattgctgtgcacaaacgtggattagaaatgacatgatcactaactttctgagggggaaaaaggggaaatccagtagagtaactgggtaaaaagttagtaatgaaaggtaagtaacccagacagggagtttcctgagcaagcataccctggcagttttagccatgctcctctgacggcgcccttttctacttcagttgatagatatctgacccagtgcttgaccatctactcaaaccacctcctgccatttcaccaggtagggacgtcagcaaaaagtcatttcagtggaagtagcaacccgctttccaaaacaaccctccacacttcaaactaaacaaacgactaagtaaacccagattacatacagctttatcaggaggagtttgt

SEQ ID NO: 57323 - DNA, 1996 bp, Bovine  19866881100649
ctcagctttctttatggtcaactctcacatccatacatgactactggaaaaaccatagctttgactagacggacctttgttggcaaagtaatgtctctgctttttaatatgctgtctatgtatatatatgtgcatgtgatctatatgtgtgtatatatacatacacaaatatgtccacatatatgtacctgatgacattgtataaactgaagtgcatcagtgaaaagcagaaattcagcaccagaggtgcccatgaaaacagccctggtgcctccatcttatgctctcaaaccttagaattttcagagatccgacaaggtcttggctttccatgtgacctagggaaagtgaattaagagctgtctcaaagggcagagagagcttatttgacatcacagttgggagctgagcttactatttcagttttagactgtaggtaatagggaacatgatttgaatccaggggtggattctgaagtcatgatttatcaaacctctaccacagttgcccaaatgctcttttcccttgtttccaactagcacacacctactcatctttttagattctatttaaatatcacttatctgtgaagccttccctgacgcccagggagggacattttcttcctctgaatttccatctctctccatacattatctttctctagtacaccatatatgacatgatatcacatgggattgaacctatatacaaccaagtagaccacatggtaccacttttgaatccccacagcccagcaagacatatgggtcatttacagaatacaacctggtgatataagtaagaaagggaatcttacaagtagacacacaacttcagaaagagcagaactccaagcccctaaagagagtaccactctcttttccatctctttgctattagatgccatttgtcttgccccttgttcctattttgaataaggacccattgctcccagaagtaaaggcaatgtaatagtcacttgtttgtttatcccctgagccaagacccagggtgacgaggctggattgcacacggggtgtgggcatcagaaactgggaagtctcaccctgcctggcctgtctagcttgtatgcttgggcaagtcacatagctcctgtgggactccctctcctcaccctgtggtaatgactggcttcacaaggtggctacaaagcttaattaaggattgagaaggaggcagaaaatacaaagtgcttcatacatgcaaaggatttttctccccatatttatttttggcctcagtaggctgcggtaggaaatgttgatgacctggaagaagagtctagcaaaaactgtgactactattctcatcctaaatggctcccgtggtactggttgaggcatggacctcatacttatttcttctattccagtacattctgtgacccttactgttaacttcatgtgtacagttttctacctactggcctcagttttcctgactccaaggactttctttatgtttcctttatgctcagatgtattgttgttgtttagttgctaagtcacatcctactctctgtgagccaaaggactgtagcctgccaggctcctctgtccatgggatttcccaggcaagaatactggagtgggttgccatttcctcctccagcagatcttctagacccaggaatcgaacctgcatctcctgcattggcaggtgggtttttcaccactgagccacttgggaagcccctcagatgtattatgatgccttaaactttaatctcagtctctgcactatcaaaccactcttagaaacaaggttcagtgatagtacaccagagtttgtgaatgaatccataggggctggtccctgagccagaagacacaagggcttgtgaagcctttcacaggtgaccccccaactctgcctggcttcgtaaatgcccacctctcttctgagcacttggaggcctcagtagagtcacagtttccattgctgccagcgcctgaagcctcattgccagtt

SEQ ID NO: 57324 - DNA, 3635 bp, Bovine  19866881134660
ttattcagaggatgctgttcaagctacatacacatatttaatggcatcaatgtggaacacaggcacaactttaatgaataaagaaaaagcaaactagaagcagctcatttatatttctggtaaaatggagttagactaagaccaaactatggtcagagtagcttggttgtggtttcagctgtcactcatctagttttttttttccagtgtagacaatatttactggcagatgttgagtacaagaaaaatggtagcaaatccagaggggctggaaaaggaggcagggtgttctcccctcccttaattaggaggactctgtaatcagatcagtggggcaagagcatgtgattttggccgctctgggcccagcacccctcaaagctcccaggaaggacaactttcaacatgtggaaagaaagcaacactctggaaatggaataggctgtgtcccagtccagatacttgcccctgcccacagcatacctcaaaaaccttcacagctcagtgtaggggtgttaaagaactgggccaagcctacccctctccaaacacaggtatctgccatatgcctcagctcccttcctctcagtgacctacaaggttggactactaggtcctgctaggggcccagctcaaccaagtgagtagtttccatagttccctgagcctagttaaggttaatctcacctctcatctgttcagttggaatcaaagactgagatctcttccagttccaatactgagacctctaatatgactaaaatagccaacttaaccaaagcttgagcaagtcaatctcttgctgttttgaaaaactgtcaatgatgcatcacttaccacacactggccttatcattatgtatgtgtgcaaagatatgctacataacaagattactagtcaagtttctaaaaacctagacatgtttaccctttgagaaatagaacgtacctgtttagctttctgaatgaaccaagaaagcctcgggttatgaccagtttccaaataactcaatctccaaataagacaacctggaatccaagtgttactaaacaagtggaaatctaatttcttgtattatacttctgagtatgtgaacaccatgtcaatggtctggggaacaaaaagaaatgcagccaaagatcagtgtgtacttctgcactgaaaagtgttagttgctcagtcatgtctgactcttgagaccctatggactgccaggctcctctgttcatggagttcttcagcaaaagtatagcaatgggctaccatttccttctccaggggatcttcacgacccagggattgaatccgggtctcctgcgttgcaggcagatgctttactgtctgagccaccagggaagccctgaattaactataggaacttataattactagaggcccttattgaatataactggcctagaacacaattctctgccaacacaggccttagttgacttaggaagcacagaaatcagtcaatttcctggtctccatgtgttcccacactggtgcagaactttcttagaagctaactgctacactgacctggataccacctgaattatagcaggcttctgcttccccaaattgtttttgcccatgttttcagactatcttctttgctttttcacacttctccaatgactgaaaataagattcacaagttacacagtgctctatcaggccttacagacctaaataaacatccccatcacttttgacaaggccttctcccagttcccttactgtcacagaaatggctctcaccactggtacagacttatttcccacactgagaatttctctcagtattctttatggcgtagttcaagttcaccattccataaaatttctagggactacactaaacatgtatgacacaaactgtgtatgaataatttagcacataaactataaccatacgctgtacatactataacactatgatcagaaagtcttctttctacatttggcataaatgttgcagtgctcattctggccagagaaactgagtggttgactgaggtgttgttctagggcaggctgtcctagaagaccaagtaaacacgatctactattatgactagtaataatgctgcctgtttgggctactgtatttttcaaccatttggtatgccattaaatcaagttagaaaaatcatgatctgtgactttgttttttaattctgaagccttatatcagacagtttacaaatctgaactaatgatatagcccctctaatcctgctgagttggcaaaagcatgattaccaaccaccatatacaagtagttctacagttgcatttctgaattcctgtttaagacaaccttgaattataacttagtctgactttgtgaagaattaacaagaaaagtttgttaacatatcttgtcacagggaatttaaaaagcatctgatcttaaagatcatctacagaatgtgaggtgctaaatacgctttatttgatgctatacataaaccacactaaaatgcctttcattaaaaggctaaattttagatagagaattttaattaaattggcatagtttataaaaccaaaaagataaagtggactttgtcagtgtattttcaatccttgccttaacaggctaatgaacacaacttgaaacacatgtgactcctcctctgtttatgagacagtgaaggcaccttttcagtatttaaatatattaatataaccagttatagaaatctaaatataaaaccaatctcttataggttttgagaagcaatgcaccatctccctaaaaagtttaatattccttattcaagttcaatcatctctttagaatgggaaaaatgatagtacttgttgaaccggaattactatcaaaattaaaaaagctgaccatattcgtttaaccacaaaccaatcttatttaaatcaggactgtccaaaagaattattccatcagccgttcatgatctgaattctagtatatgagtcaatttaaatatggtacacataaaaagtcatgagacacttctgattcataataaataaggcagtggccaactattactcattggtagcttttttgagataagctatcaagtcttccctctctcccttcttcttaatgccagcaaagatcatctttgttccagggatgtacttcttgggattctccaagtactccatcagcgtctcctctccccaggtgatacctttgttcttgttggcgtctgtgtaagagaatccaggagcctgacctgactttcgcccaaacagaccatggaggtttggcccagtcttgtgcttgcctcccttttccacagtatggcactgggcacacttctgaacaaaaatcttcttgcccttctcaacatcacccatttttaaatcgttcttcctctgtgcgcgaccgagaagttcccgctcacaagccgaacgtcccgctttctaataatatgttcttaaattttatttattttgatttcttttccttgagcatggtggatgagttgctattatatcaccctttactgttcttcataactttcctggaagaataagaaactgaaagaaaggattgcattttgaatatagaaagtaattcatgtttttgtcatcttttctttggggagattactttactatcattgtataa

SEQ ID NO: 57325 - DNA, 870 bp, Bovine  19866881139098
tgctgactcttctagaatgggaaaaaacaaacaaaaaaaaacgagaaggaaggttcaggacagtgtgtggcctcttggacagaatctcatgacacgggcttctctgagacttattagtaaccgaagcggctgtgcgaatatctgtatgtttctctcaccttcctgggaagttactagaataacatgggaagccatcaggaattttttttcttcttcttaaatgattcattttgaaaaactagtttcacactgctttgaaaatgactgggggacaggactagtttgagaaaattccttagagccctttgcaaggttccctgtagatggcggatgagggagggagaagaggatgattttaccaagagtttaaaaatatatgtatttgtttgtatttgtggctgcactggctcttcagtgctgatgggctttctctagttgcagtgagcagagctacgctctagtggtggggggcagtggcttctcttgtggagcgtgggctccacaacatgtgggctcagtagttgaagaacatgggttctgtttccccgtggcatgtgggattttcctggaaaacagatcgaaccgatctctcctgcactcaaaggcagatttctaaccacaagaccaccagggaagcccctcatcaaggatttttaagagctgggaacacccagtggacaggtatgggagtttttatcatgggcctgtaatgatttaatcacattacaagagtctttgtaagagacaaagactaccagcaacaaagatttcttgtgaaacgaggtttttgcctcttgctgataaaattccctgggagcaggatcctgttttggggggctacaggccctctctttggaagagcatcatatt

SEQ ID NO: 57326 - DNA, 1249 bp, Bovine  19866881244800
catttgtaaaataagaaatgtgcttgtataaataacaagtttctattatatagcccaggaaactatattcaataccttgtaataacctatgatggaaaagaatctgaaaaagagtatatctaattgagttactttgctgtacaccagaagctaatgcaacattgtaaatcaaccttactttagctttttaaaatgtgcttctaaataacatatggattaaaaaagagatctattgaaaactagaacgtgtttcatattgaataatcatgaaaatactatataccaaaactcatgggttgctaccaaaatgtaactaaaaggaacactgacagctttaagaaaagactaagcaatgaacattaatgagctagaaagaatctagctcaaggagttagcaaaaatgaatgaatcaataaataaatgagtaaatgaatggaatccttgaggtcagtactccttatgcatcttattacaccttcttatttacaaaacagtgcttaacaaataacgtgggacttgatgaacatcagctcagatttgttcaatctgaaagtccttgattctgaaaagatggtttttccaaactctcaagggtagagtattcccagtctggttgatctgccaagataatccacccacgtgtcatttaacttcttagagcagtagattctgacttggggaatgaaagatacctaaagagtggtggatttatttggtctagttgagactgccacagtgtccgcttaggttagcactttctcgtctctgggcatacggagaagcattctgtttattctactaaaaatgtgttggaggtgaaggttaaagatgagtgcctttgtgccactgttattaagcatatagctttcaatcattagaagccaagaacagggcctggtcctcttccttctacataagcaaatgtctattgcaattaaagaaagttttgcatgtgtaagggacagaggattgggctctggggacccattttactcaaggaaaaagaagtgactttaatttcattaatggtttccaggatgattgtgctacaactttaattctccattaaatattcatgccgacgggcgcttcctttcctgcctttagtatcattcagctcaagctgacactaacctgttttctatttcataactgaatcacagggctttttcaggagaagtcagcaaagcaatgccacctactcctgtcctcgtcaaaagaactgttggatgatcgaaccagtagaaac

SEQ ID NO: 57327 - DNA, 1032 bp, Bovine  19866881286956
ccacctaaacatctaacttcattatatggatgataaaacatacaggagaaaaaaatgtacccatttttttcactcatctaccaaaaatatttccaattttactctttgatgttttatcatatgcatataggtcagttttatgtttttgtaattatagtatagattcatagtggtattacttttttcctatataatttccccatatcaggcttcacctgtttgtctgaaggaaaggctaatggaagttacagaggcaaatttttttgtccccctagtgctgccttttcataagttatcaatatgggaatttgaaggtgctcctttaataaacagtaaaaataaagggaaaatatccttctctttggcatcctcttttcagttgtgtttaatgaccctgaaagtgcaagtgaaagtgttagtcactcagtcatgtccaactctttgtgaccccatggattatagcctgccaggctcctctgttcatgggatatgccaggcaagaatccaggagtgggttgccatgtcgtatttgatatgttatgactaatatgctctcttccatactcaaacgactctgatcttttcaaagatcagaaagagacaatcgttgaacaccatgtccctgacatcctggtgggcacattataataagctgagttccagtcacacagcaactgggggaaaagtactgttactctcatttacagatgaggaaaccaaggttcagaaggatggtgctccctgccctgctgacaggtgacaggacaagattcagagctcttttcaacttgccacctgactttcctcttcgaaaaatcttcactaaaaaaatattagtccatgcatcatttccaaggcatatgagaggaaaggcaaggaagaaaaggaaatggacaaggttttacagtcagtgacacatacatatattacaggcacacagagaatatgaaacaaatgtaaatgtactcaaaaattatgagagaggcagctgtagtgatacatgttaacaggaggcctattactcataattga

SEQ ID NO: 57328 - DNA, 2099 bp, Bovine  19866881300012
atacagacgctctggaggcctttatcacttccttcacttttagagctatttattaattgaaataatagttatgctaccccttgcctcagacctactttcatctgtttagcagttgctttctacgaaacacaaaagagctcagcgatgacaccggtgtcttaattaaccattgaacaccttctagagcagctgtcacaactcttgtcacttgaaagaaagcacagtggttcctgtttaaaaaaaaaaaacacacacacacacacatatacggcgggctggggggaagttgatctaatgagctgtctttgacgtgcgtgaagaattacattttttatcatcatgctttgcactcacagagcaatgcaaattagggaatatcaggccactctgaaagaaacctgtgaatttacttttctccctgcctttcagaaaaagatcacattgcacagtggctcagggaagtggtccaagatcagagatgataacagggctaagattttgtgtcagttaaaaaaagaggaggggctgatgtaaacttatgtaactacaatgtttccaagcctttccagccctggggtgtgaatgaatcttattaacatcaagatcagagcctcaagccctcacctgttagtgcaggtaatacaatcccttacaaaactcatcccaacctcaccatttctttgagttcccaaaggggtgttttttgtctgttaaggaattagccgaggcttccactcaggactagattgcttgctattccaagttccactagggtcagcaccattgtcttggcccaccccaaaccacaccactcttatttttcttgagtgttacttatgtgcttctgtttcttcttatgattaactgctggcccagtgtaccaacctgttcagatctttcattaccttgacaattgaatagcagtctgtgttgaagtgaggaatatttctgtctctgggcttataggagtacatcaccatagtaaagtagtttgagcccggagtgttctggaaattgatgagagaattctttaagtttgtacacataacccttttctcttcaaagtatatacagctcctgggaagtaggtctaccgggtgggtttaaacaccagccaccatcatggagggcttccctgatagctcagttgataaagaatctgcctgcaatgcaggagaccccaatttgattcttgggtcaggaagatcggctggagaagggataggctacccattccagtattcttaggcttcccttgtgactcagctgttaaagaatcccctggcaatgcaggagacctgggtttgatccctgggttgggaagatcccctggagaagggaaaggctatcgcaaagagttggacatgactgaacgactttcactttcacttttcaccgtcatggagtgggggaccatcttcccaatatgactctcagaactgtggctgagtctaattggccctctcagattttcccatgatgacccttatttttcatctccatctcctgaccttcttccccactctcttcttcaagccatcatatttgtaggtaaacacatctgaatctccagtgttcctaaagatcaagtacacctcccttcttgaggaagctctttaaccctcatgcaaattaatacttacaggaaagacttgtctgacaccacataccatgtatctgcagctccatcctgtcccagcgagtacctccagatcataaaggtaaacctagtaagagaggaagctgttgggaaaatccagagtgaatcttgggatggataaatgtgcagatggcataatgattgactcatttcaaatatattactacaagttacgtaggcaacatggacaccaagtaactggtctgaaaattcctcaagagccaaacaaatgctgttcctgacactgggcctcaagtccagacttggcacataatctgagaatgccaggaacatcatggcaacacaagggttgttattattggcctcttgtttttcaaaacaaacaagatacttgattaacactatatatgaatgccaaaggcttatttaatcagcggaccaggaaagcattttatagcaggagtttgccctggaaatg

SEQ ID NO: 57329 - DNA, 2961 bp, Bovine  19866881404532
aaacattttgtgggaaaacacccaggggtaaatgacatatggctggtgctctcagtcagaaaaataatgaaatacattttcattacagtggggcaagggctctggcaaatggaaattcaaggacatatagaggaagtgtgactgcagacagaacatgttggggaaaactttctagataaggtggcacccatgaggcttgaagggaaagaatgagcagagatttcaaccatagggggaggggtgatcatggagaagtcaaagactgtaattctctttgctcatgcccccatcatggaagtaatgtgtcatatatgtctttgctctcttcaccttgagcatcccatcgacacaacgtgccaggctttggaataaaaccagcagtttacattcagccaaaggttacccacaatgctttctgggaatttgtagctgaaggtatgcccattgctttccagtataaacagagaaactaagctggcatcaggacagaacatggtagcatggagccaaggagaaggcctgcctggctgctgaatacgccctgcaaaatggcacacaggtgctatcatgcagctatagacttcatcagtgcgacaaactgaagtgtgttgacagctgcggtaaaacacacttgaagttaaacataattaagcaaaatgattagcactaaatagaagctggcagtgaagaactctggtttctgaaactcaatggcatgatcacagcctattacagctgggaaggggtctcacagatcacacacattgtatctatttcacaggagagaaaataaggcccagggaaatgaagtgaaggcaggcctgaactgcaggaatgatctgagcagctcaccttagcttcttaggaatcaccacttaggaactgtggcttcctgggcctcagttttttcccctgttaaatgggggtgaaaatgctagttccttcactaactacttgccagtgcaaggcttgaaaatgagacctatgtacatttctaagcaaactgttgctgtaacttgtacggcaaggtatgttctgggccagtctgctggttagtggacagaaacgccagatatatgccttgacagagaaagatcaggtgagatttttttctgagtaaaaaattgttggattgcaatgcttggtctctccccatcatatcagagagtttgataggagttcatgtatgaaaagagacctgcaaatacgtgcaatgcaaacagttctcatttctgggaggaattccagagtgggactggagtgaagcagagatgggcagcagaaaggagagggaaaatcctggggaaacggtacactctgcctgagtttccctctgaattttcagatgaggatggaagggaggcaggcaagaggttaagaaggaaggaaggaataaaatatacccccaacccccctaaaaaaagcaaaacctcagttcagtcaatacacaagaaataacagcaaggttgtaaacagtgctgagaatgggactgcaggactttttcatagctttggctggctcacaatcccctcagcgtggtgcttctccgggttccacgtctcaaatgctctaattatactgtgcagcaaaaagaaggcctggtgctcctagatgtgagtgattgcttacttgccacaggaatgttctatgctttcataggcttcattccctggccccctgcccctcttcccccacaccaggcctgggaatgaactgggcactattttagatgtcttctttgcaggaagatgacaagcttgtattaggtctcgcctcttacccaggctcttatttgtgcctgagatactctcttctggcttccctacctgtttgtctcctgttcacctccaaggccaagtttagagcctacctggactccattcaactcagcttctgccctgagtccctgtggaatgaatactgttcaccggccagtctcctggccaccatgtggctgcctaaaggtaataactttgtcttcacatctgtattctctacatgcttcaaaggtggggctttgcttctcaaaatgtttatggtccagcagaatcagcattacctggagcttgtgagaagagtcacaggctccacccagacctgctaaatcagaatcttccactgaacaagatacctgggtaatactaatacacggccatgttcaagtttaagacgctggatggaatagggtggggaacacttaatcagtgatcctggaatttacttgaggcaatcaattattcctgatgacgttctctctcttccaagaggacaccaccaacagttaagggaatgcaaaccctccagcccttctcctagccctgcagtggctccctgccgtgaactctgcagagcttggtggccagtttccacgtacctaccacctacaccttctactttcaaagaaaccacaacctggacctggaacagaactggatgtgccaaaaggcctgaggacatttcgttgaactgtggctggcctgatgggaagctggcatggccagaaatgttaagagtctttgctcttggggtttcaggctttgagttgcaaattcaatggtccggatcgagatcagatgagtcagagaaccatccaaacctttagctggggactgaaaccaaatctgtgttctcaaaccattctaaatgtgttgatcaccggttagagtctgctgtacaatccaatccaaaagagtatagttatttctctaacagtggatgcattatttgctcatcaatggaaaatctaattgtagcatcaaaggtcaaaagttgcgagagaaacttgacacctttgagactatgccaaacctcaagctttcaataatatgcgctttcaggtcaaactatctgaggaaaatagaggctatttgccccaaagtccagcataaatacacatgaattatactgtccttcaaaaatagtggaactgtttgacagactgttaacagcctaagcagttg

SEQ ID NO: 57330 - DNA, 2487 bp, Bovine  19866881420988
tccataaatgtgagcacagatgtagtccataaatgtggccatagatgtagccatggtctgagagtccctccctgggagccaatggaccttgggtctgtctgggctcccctggccactctgacttctgactccgcccttttcctgtcttgcatgacatcacagcgcctgctgaacttcctctcccatcagtcggtggtcacttcctgggtttcttgctcgttatgtatgcttgtccatattcttcttgctttgaatcatttttgttttagttttgttttcacagtaagatcgttatgtaaacctgctgaaagggtaaatttaactcattttactgttactataattattactgaagtgagagttaggcaatgccaatttgtgttgctatcccgtagtaaaaaggttcaggaaggtgttcaaaactgctttctctttatactcccagagggcattagcagttatggtgcagaaccttatatatattatttgattgacagtattttgcatacatactaataatttggaaagtacttcaaaaaaagaaaatgtgggtttggggataggaaacaaaactttcttttatacgtttcctaatattttcacttttgacgagtttgccttttgaagcatgcttagttactatcaaactattgtgatcccatagttggaagaaaatctaatgaaaagtaggctatttttattaactgtcagatttcacaacagtggagtgttccattttgatccaaagagatatatagcaggatttattcagcaagttcttggtatttataaaagtgtcaccaatgaaaacagcacacatttatacaggtcagtcctataactgtacccggcaaatgacggtaccaaacgtatggaccgtgtttccccctgccagcagtgcaattggactttatttatagaacagtaggtaaagtcgacgtttgttctttcaattgtttgcatttctgacagcagtactgttacaggcaaatgtatctaaaagccagaggaaattctatgtatgtttataatcactaaagaacaagtccttaagtattatacttcattttcaaagaattataattatagcacattgaaatttactttttatcattcatctttcaacattacttattgcagtaccatgagattattaaagataatattgagaagaaggaaaagtctgaactggaatgtttgatgcctataaaacaggagcaaagatgattatactttactatgggagacaatattttttaaacagcagtaacagtctaacataggagacactttgtggaatcatttttcttttgccatgatggaggtcatggtttattgatcattcaaacatccgttaagatataaaaaaattaatagttttcttgttgacatgtatgtatgctagcatttaatgtggttatactttggggaaattaagatgaatttatttttctggaatggcatggtttctataaaccactctgaattatgcatttcactgaatttctgcttccattttatacagagaatcgacagatcagtgagcaaagtacttcttttttaaaggcttgaatgcaaatctgatttctcttttgtaaaaagagggagggcaggaaggggagagagagaggcgatggggaatgcccagagggacatgaagtctgcgcatatgttccagatcctctagtaatcaggatctcagcacccaccccccagttccagttcagtgctgtttttccaaatgaaaacttctcctttgccaatgatgacattttactgaacaggaatgacacttagaaccattcggtggcaggaatcaggagtcaggtctgctttctctcaatcatcccatgctccttccctctgactccgctgtgagcactggaacttcgggctcaggctgtttatttgtacactgtacaaaagtgggacttggattttcaaatgttgactttcattgtgtgattaacgtattaatatatcaaaagtctttggacaccatctaacagatagtaaacagtatagcaacattggctattaatgctattgtttttgtagcattagtaatttgaccccggtttctggattttccaatgaatgatcaaagctgccatggcacccaacactaaactggcttctgaagagattgcagctgtattccctccagagaagctggagcactgcccctgccagtgctgcttcaatctgctagaagtttccttgacaaacagtctagattgacttctcccacatgtggatcaaaaacttcaaagacaactgcattaacagataaatacacaaatagtggaaacattttgctgagacatgaacgggatctggtccactagaaagttattgaaataggcccaaggtaaagcaaagtgggaatgtttgagacggtcatgttcacacctagtgttcaaagtggtctgaccttgccactcaagcagaacgcgctaattcttcccctaaaacacactggtgagg

SEQ ID NO: 57331 - DNA, 1130 bp, Bovine  19866881435724
aaaagaaatgagaaatgatgtgaaatcttctccacttccttgtgggtttataaggttgttactttccgccagagctgagtcagagacactatcaccaaagagaaatgttgttttaacttagtcttcctggcatttctttctctgcttcataaccaaatcctaaggtttgtcatcctgttgttgagaacttaacagagggtatgctgtgggaaggggctgagaggtgctggaaatgactgcattaagtgggacagcttgtcattcttcctgtgtttatttaacaaatatttatggaagacctattagcagtttgctgataaatgtttaataattggctctccaagtgggtgggggcagggaagtcctgattttcagtgcctgccaatttctgtggtgtaaacacttccattgtaatcggtttcaggcaactagtataaatattcttgcatgcagcattgagaggaattaggcagaattgttgcagaccctagtccaggtacgagagatggacctgtgcatatgacagacatgattcctattcccataagaaatcagagcctatcattgggaagatgaaatatggacaatattttccacttgatcctagcgatcattttaaagggaaagccagagtcagaggtactgaaagacagagacaaaaagactgagatattccttctacacatcttgatagattccgaaatccttcggccatctgtctattcctgtgtccctccatccttatctgcctctctgcaatggcagtcccagcacatgggtatttaaaagaacatcagatggcagaaggaagtgaaaaaagaacaaagaaaagtgtgctacttctcggtgcattttagcaggaaagcatcacaataaacttcgtatttcaggggtgggatcttcttagcataagaccttgtttcctttagagattcagaactctcctccacaatgtttttgcaccaaggtaaattagaaataaagtcactgtgaaccaatccgaaggagagctatgatgttttgaaaggatacccatttcactctcactctgataaggaacacaggtaccttcaggatccaggtcttaaaccttttcagtgcccccagactccttatgggtaatgttttag

SEQ ID NO: 57332 - DNA, 1397 bp, Bovine  19866881441733
gggcagatgacatttttcgggttgcagtcccaatgaggcatttgtgaaaaggaaaaaaaaaaaagttctacaaaagatgtgagaattatattcatgggtctgggttaatgttggtctttttaggttgtcccagaagctagcctctcatgtctgtgtcattttcttcttcttctctctctctctttgggatacttttttctgttctattttgagccccacagcacagctcttttattccatttgtcagccacagacgcacatccagttgaaaagcattcccagcctccaccgccacaatgcctctgatcctgtggccactggagcctctgaccacacgagtctgttgatttgtggcttctctgttgttttagttcttggtgttaccagtgggagaaaagctcaaatgaaggaggaatgctgtaagagtaaaccagcgctgagcaaggggtgctgcccgtctagtcgggtgtacacaatccctgtgttttgaatccatggcggctgtatcatggtgcccctcaggtgcgtcatggaatcggcttcccaagtgccgaatggtctttctaatgaccttttctgctgccttctcttttcccccttttgtccttaagttttactacattcttttactttgtgcataaacaaaacaatctaaatactgtagggatgtactatccaaagtgataaagataattaacactgctgtatgttatatgtgaaagttgttaagagagtaaatgctcagagttctcatcacaaggaaataaatatttctatttctttaatgtatctgtaatgagatgatgaatattcactaaacccattgtggtaatcacttcatgatgtgtataagtcaaatcattatgctgtacaccttcaacttgtgcagtgctatattcaatcatatcccaataaaactggggggaaaagagaaaaagtaaaataagacagtatttttatattttacaaaacagcctatatatatatatatatatatttttttttttttttgtaaaagtaacacaggctcattggagaatctttgaaaaatagaaaaaaaaaattaaaagatgctgattatctttaatactgtcactgactggtaatcatattcactgatgcattgcaatcatttcacaataatgattacttacctactgtgtgaattgctttggataccaagaatgcaggaggaatcaaaagggcaggatccttggactcacagactttcgttttttttaagtttatttatttatttttggctgtgctggatcttcgttgctgcacggacttttctctaggtgcggtgagcgggggctcctctatttgcgttgcacaggcttctcgttgtggggcttctcttgctgcagagcagaggctctaggacatgcaggctt

SEQ ID NO: 57333 - DNA, 1406 bp, Bovine  19866881694898
cgcacagagtcggacacgactgaagcgacttagcagcagcagctgtgtcatatctttgtaagaatgagaactaaatggtataatatgtatgtcaataacttctgtgtgtgtacatgtatgtgtgtatatacatacatatatatatatgtatatggagagagagagatttatgccagttttcacagtctttatcatcaaaacaaggtgacggtttcttttttatctaaacaacatggaaagttatcctaaattttgcttttccatggggtaagaaaatatgtaaatcttcttgtaaaaatgtactctaggtgtggaagaatcaaagcgaacaattacactgaggttcactgaggttatggaaagtagcatattgaaataattactttcaaaatgtttcaaaaacataaaatgttaccctaaaagctagctcatgttgctgttacattggtgggttttgtttgtctttatagccatttgctcttatattaactcaacagattacaaatgtggaagtaaaagacagttaaaatcccccccaaaggaatttttttgtttgtttgtttctagaggagaacacagtgaaaataggagttacttgctggtatttgaaaagaaaaaaaaaggtttcatcttttacctctctcactgcactgacaggcagggctcttatctcatgactgcttctaaaaattgttatccatactatatagaatttgaaataccttttaatatataatgatataaataaaatatatcaagaatattttaattattagagaaacggtgagtaaagtacgcaggactgtactttgaatgatgctcttggttgattatgacctattagtttatcttttgaacatactggcatcactttatactgctctggaagttattcaatgtttttaagcacataagactgaagaacatatacattttgaacaaaacaaaatgaacaatagtgaggtttacacacacgcagttctacacagttcacttgtgccttggagggatagtattatcataattattaacaatacaaaacacaattttgtcccagtagtactggccaccctgttttaagagttttagaagatccctgagcacattgtttgtttcttataacccgaactccaaaatgatagggcttctattattgatatcaagatggattgtcattcacagtaagtcaatcgtaaggtgcttatttaccctttcttttttccaccaatcagcacaaagaactgtcagaaaataatgttttattattattatcttcaaataatagcattggaaggacacatgatttaaacaatcaatgttggaaacagtggctttaggattattatctggctgcccctcaacaataactagtgattcaatcgacattccttagccaaaaacaaaag

SEQ ID NO: 57334 - DNA, 884 bp, Bovine  19866881727321
cctccctcccttcattcatccacccctctacctctccctctccctctctctatatgtgcatgtagttgaatatacataaattaggcagttaaacttatttccttgccacttgcaacaactgattgtggtcttcaacctgaaaagtccctagaagggcattgcccaagcttgtctccataactttcctttctcactgcttccatggccagacttaatggtcataccttcttttgatgtatttctaaattcaagcaggtatcaaattttgtttccagaaagacctgtataaggtaactgcttatctctgccatgactatgtgggatcatagagtttaacctttcaggccatgttctttttacctccctagactctcttgggagatacctctgtaatccccaagtattagcaacattactctttgcactttagttaaggtttaaagatctcctgtattgaaatgttttatttcttgggaaactcactgtgattctgattacccttgagtagactcagcattaatgtgatttggcttggtgaagccttaaccatatgctgatcatacttagaagacctatgtttggcatttattttttcctctttctcatctcaatgctgtgccctgtttatggtgctacaactggcagttttactaagtcaaatcaccccaagaacgcagaaagaaaaaagattgagaaacaagtaggggaggaggttgaaaaggacattgactaatgtatttccttatttagctctatttccaaatttagggagcccttaagaagcataattgagtctcctacttataaaagttctgagccatattcctccagaggaacaggctaataccatctgccaataaaggggccgatggcacagcaggtgt

SEQ ID NO: 57335 - DNA, 1016 bp, Bovine  19866880367159
tccaaagtaacagacattcccgacatttgacatggtgggcacgtgagcactttgcctgaggtcgggggagaggaattctttcagttccaccaccttccaaccctcgagagggtctccaggttcacacacacctgcctcagagagaagagggtttctctcccaggtccctgcactgactttgaaatcaggcatgagtctcactagggcaggacaggtgctctcctgatggtccagttgatttttcagcttcaatcctgttaaccggatgttaccccttggagtattgagtcgtccccaccagattcttacatacctgcttaacttccatgtgagagatttatatgtgagtttgggcacattatgatcctgtgcaggcactcagcagtgtttgcaaattaagattgatcacatgggcagccacttacacatattacttgtgtgtgtgtgtgtgtgtgtgtgtgtgcacgtgctgagtcactcagtcatctctgactctttgtgactccatggactgtggcctgccaggctcctctgtccatggggttttccagcaaaattactggaatgggctgccacttcctccttcaggggatcttcccaaccccgggattgaacccatatctcctgcattggcaggcagattctttaccgctgagccactgaggaagcatacaaattgcttagtgagtgaagtcgctcagtcgtgtccgactctttgcgaccccatgggctgtagcctaccaggctcctctgtccatgggattttcctggcaatagtcctggagtggattgccatttccttctccaggggacaaattgcttaaaagtcattaatttgtgtcattaacatgtttgatggacgtcattggaaacaaatcagctcatttcagggattgtggggacgtgttgcttctcgcgtttccacatgatggatcacgaagtgatgggttttccagagagtggcccctccaccacctgctccccaggaccctgaggaacgggtcaaactgcagatt

SEQ ID NO: 57336 - DNA, 1960 bp, Bovine  19866880412855
attgacagttccctgtgctgtcattctcagatgtaggggttcattttaaagaaaatatgcaggacaaaaagacagtgcaaaaaatcagtaccacatttggactgtgtaggtgagaaaaagaaatgtttaaaatgacgcagtttaaaactccctcagatcagtttaattgtacagttgtcaaagtaatatgtgatatcaatgaagaatatttgttgcatgcaaacggttgtttctttttcctaaaaaactactgtcattggtctattaaacgtgcattttaaaattaatgtagtatgttctacagacttctcaagaaactataataatacagttttttaaaaatttatgttcaactttttaaatgtgaattatagtttgggctgcttcaatgcagggttatttgtatttgttaagcagaagtaaccaaaatcacttctgttccaagctccgctgtggtcttggagccttccaggctgttgctgggaggagagtggtgagaggaagtgagacgctctgcactcacggaagtcctgtgaacgctctcccggtgtcgcttccgctagtagcggtgagcaagccagaagtttctccattttgtcacctttggtagctgtgcaatcgccttattgctgaagttgcagttaatatgagaaccacagtagaatttttctgggtttgggtttttttgccttgtattaatttcacttataccaaagtattgggaagtatgaacttctagactgtagctgtacttcatgaaaagactgttctgtgatattttactttgttttactgtagcttcagattatctgaatattttcctaatagtctgtgggaatgctgatctgcttttgttacgcagtaggaacgtttgacactgtttacatagttctcatggaacgtagaatttttggaaagccacatatgatacacattttttgtgtatatatattagtgtgaataaaacagtaacatcagtgcatttttctaaagcagaaaacttctgtaattttcttgtcttccttaaaagtattcctttgagttcagtgttcatttacttttcattgtgagcatctgctctatggttaatgtctaactatagcatttgctcctaataatagaattaggacagtagagtttttgaactgcagctgaccccagacggcatatgttccaaccaccttattctgcatccaaggacacgacactaaatgcctttctcaggctgctggtggcagatctgggctggagtatggttccacccactcccttttggccttcatttctcgacaccagtgctattacttttcacttaatttcctcccaacttccccaactgatgaaataaaaataagagttatttatgtatattttaataaaatcctgttcgatttttcaacttacagctggttttgtctgtattattcaacctatgttttctgaacattgagcagaggagaaacccttgaaccagtgtccatagtagaaacatacaccagagcagttttaggagtcttgtgattttaacccttcagaagataaaacgtagaatttgggggcatgtatttatatccatcttcagtttcttaaaaaaaacaaacctaaagtcaaaacagtaagtaggtctgagggcagagtctctttatcagcgtgttgctcactgttataaccaccctgcctagcacagtctcgtcacaaagtgaggcacttgccaaatatttgttgaataaaacaattcagaaaatcagaagtagaattaaataagagaccttagaatgactgttcagaccaaaccctttacaaattacgtgttttctttaattttgctttctgtttaatatatttattgtttgttgctgctcttgggccttctctagttgcggtgcaagggcttttcgctgttgtgacttctcttgttgcagagcatggaccctaggtgctcaggcttcagtagttgggg

SEQ ID NO: 57337 - DNA, 1444 bp, Bovine  19866880447185
atttatcatgcgtctagagaaggttgatcaacatgttcttcatggatttaagtccaggtagaaaggactactcccctcctctatgaagtcttgcaggaagtagcttgaaaaggacccctgatgccatgttgcatgctaagttgctccaatcatgtccaactctttgcaatcccatggactgtagcccaccaggctcctctgtccataggattctctaggcaagaatactggagtgggttgcgatgccctcctccaggggatcttcctgatccagggattaaagccacgtctcttatgcctcctgcatggcaggggggttctttaccactggtgccacctgggaagcctgatgacaggttacacttcaagaaaacaacattggcactcttaatatatgcagctgctgtttctctagaccttggcttccctgagccctccttaccatatttcaacttatgttcaagtcaccactgaccattctccatgtcctactctatcttttaaaatactcattagctttctagtgaggagatcctattgggtctgttctctgtgctgagagagatattttatattagaacaacattctttcaaagctggttggtgtattatatttttgactgatgcagctctaagcttctctctttcgtttgcctggcctgacagtttaattatcagctcttcttccaaatgcaactgatcagagcttctcacttgaggattccataatcggttaggatatacctcagtaattttaactacctgcctcgcctcctgttgtagaaaaactcataagccactcaagagctctaaacagtcttgtattcaccgtgctgcctcctttactataaggataaacagcatcgctccactccgtttaactcccatcagtgacacatcttgagatttacgctctaggtagtgcccttatctcccacttcacacgcacagcctgcttaatggcgaggtgagctttctacccaaagttattaagtgacttgtttaccttcacacttctgaagaaatgatccagtattttgctcaggtgccaatcgcatcccaagaaactgctttttcttttttcccctttgaatgtggaatgtttctcttctgattgaattcagactattatcagcagaataccaacaaagtttggagcaagatgtttaagagatatggaaagcatccagaagaaagtaatgaaaatgaataaaaggttacaaaacaaaactgataaaaggataagtgaactgatacaaaatgtctgaggatgaatcccgtatgctacctggttcatcagtgcaaaaatgttgtgtgcttataaacattcatttacctaaatcacttagtgtctgttcacttagaaagcagagacattactttgccaacaaaggtccgtctagtcaaggctatggtttttcctatggtcatgtatggatgtgag

SEQ ID NO: 57338 - DNA, 3396 bp, Bovine  19866880496581
cccagcattcaagtgaatatctgaaaaaaactcacacactctgatttcatcaactgggaaataggagttagactataatacttgtaaagtactccatattaaaaacattatatcccactataatgttcaattagggggaatctttgcaagcctccaacatgggatctctgaataacctgtgaaagggaggccactacaaacaataagattaagtggaaataggatgaaatattgtttcaccaattacacaaaatatataggaaagatatgagaggaaacattgccagcttggcaaatgagcacttctttcccatttgaaaggattactgagtttaagttaaagatctgatggacgcaaggctgtttgaacaccactagcctccttttccatcaaatctcttctgccaaccagcagtcctcaactttggcccttggcattcatgaactagccacacgcctctccttgggctttaaagcaatagctgaataagtgactttagaaacacttaagagggggtgtgcctgctggcttgtacttttcaaaaacttttcaaggtcatgatagcagaaaaagaccgagtaaactgatccagattaaaggagactaaaggcaaatgacacctgcatgcaatgctcacgatcctagaccgcatcctagaacaaaggggaaactgttctacaggagatgtggaaacgaactgtgtgtgagacagtaatgtcataaggatgttaactgtactacatcagatcactctaatgtagttatcaatgagaaggtagctctcttaggaaaacacctgctgtcatgtttaggggacaggggcatgttatttataactaaatctcaaacaaaaatatagataatatatggagagaggaaaaatgacaaggcaagtggagtaaaacattaacagtgaatatggctgaatctttgctttcatgaccttcacgtatactggacttccattctgtaaggttggaatcatttccaaatagaaaagccaaaaacaaaacaaaaacaaaagccagtaacaggaaagcactctgttagagggccctggacagtgtccccatttgtaggaagaagatgcccaccatttgtttacaggggactttcctttcaagaacagtggtcaagaattcactcagcagctgaggggccctggctgctgggtattctgcggctctaaaactagaagactgcttcccctaggaatcagtgcctgcacatctctgtgctgtgtgctgtgctaagtcgcttcagtcacgaccgactctttgtaactctatgtactgtgcccaccaggctcctctgtccatgagattctctgggaagaatactggagtgggttgccatgccctcctccagggactcttcctgacccagggattgaacctgcatctcgtatctcctgcattggcagctgggttctttaccactagtgccacctggaaagctagtgcatgcctctactgaaggttaaacgggcactgcctgtgactttcaccagacaggcaggaaggtttcccagccacccagccggccgggcatcagctgggcaacatagtcctttactgcaaagggtaagacatgctgcctgtggtcaaggtcagagcagagctgaagagagcagatgaacacttctgaaatgcatagaataatcagatgctgaactgtaagagactaggcaccctgagaaaagatcaggctgcatggaagcggcaagactggcttgtcccttggaggatgggaaaagtttagattgtgtaggcatctcgggaagtgggttcagtgtgagcaaagaaacaagagacgagacaacagacgaaagggccagcagggtgcagaaggggtatccgtgaggcaggagatggaggctgcagctggagtgtggagtggggtgtggcagggccctgaaagggtatgacgggcagaggacacctgggccccagatgtgtgacgccatgctctgcccacctttccccatcacggtggctggaactctgcccctgaggcagctgctacaaagaacaagcaaaagctatagaaggcacccagaggttcacagccctcgcccgcatctgctggtgaccagcatttttcccgggatctcggtctccccaggaagggctgatgagggcaggggacccaggacacctgcacagagctcctccggccctggagagatgccaccccagcccatctgcgacaccgactcccaaacctgaggcctgtcgaccgtggtctgcacacggacagatggcgggggtggcactggtgtgctgcttctggctggagagccctcccggctggacgcactccggacaggaggccggaagggggatgcggtccacgtggtccggggctcccagtcatccccctggatcttgtggtacacgggctggtgcgtctggtactcgccctgctgagctgggtagtgtgtcttctgggcttggtggaaggatggctgggctgccggccgggtgacattctgctcgtgtatcacagggatggaaatgtagccccgggggagctggtgaccacccaggctgctcctgccagtggaggcgggcaggctggctgaggaggaggacgaggagcagtctgaggccgctggagactgggaccgctgcaagacacagaatgcagacacatggccctgtgaacccttgcctggctctccgactctgcccacagtacgtgcctgctcagggtggcaggcttaatacaacctcccacctgttaagcctttccagtgtccacatgtactgttaagactgggaactcaggagtcaagaggcctgggctcaaattctcaacagcccgacagctttgttgttgtttcagtcgcaaagtcacatccgactctttgcaacctcatgggctgaagcccaccaggcttctctgtccatgggattttccaggcaagaatattggagtgggttgccatgccctcatccaggggatcttccggacccagggactgaaccttggtctcctgcattgcaggcagattctttactgttaatgagctacgtttaaagtacagaaaagagtaacccctcctcacctaacttgaagattctgtaaaagaatcagtgggtgtgtctggcaccagcaccacccacaggaagtgctcacgaagtttaaattattgttgtcatttcctttcctctttcctgaactctttcctgcttatccccagagaacccaggggccagtgggaaccacgtgcccatgtggaccaaggcaggccaggcccctctcccttcctgacagcctactttctattttggaagagcagaagagtgtttccccagctggcttctaaggcccctgctaggttaaatttgtaagattgtcgactacgcatcacttttattttacaacaaaaa

SEQ ID NO: 57339 - DNA, 1271 bp, Bovine  19866880541625
tagccaggtctatcacactggatctccctgctcctgtgaatggaagggcccaggatgggtgtgcacagatgcccaccatgtggggctctctccaagcttcatgatgccagagcttattagctgtggtagcagcgaggtcttctgggatttttctagtctataattggcttttactgttgtgggttctgtgcatgtcagaaataatgaggtgacatttggatctgacatggcatcattagaggactggtaatatagattatgaacatgcattcacagaagggagaagaataaatcaagtggaaaaaatgcttgagaagtaatgaggattgtgtccaaatatatacccttctgatgtacattaacaccagcaatgaataattcatgaccctatcctccagaggcttgtaggtgcccagctaaaataacatttctctggttatcagaaaaacccatgttgggggcctttgttaagaagtctgaagattgtttgtgccacacgtggggttgggtgggatgctgaattagttcatcaggagtgggaggtatgacctagctttccaaaatggaattatcctgagcacaattttctgtgcctctacacaattccagcaatattgtgatttttgaaaaaaaattatttagcaatttataacagtcattaaatttctatgacttatgaatgagaatcattttcccctcccagaaacactgcaagttttatattttatcgcactcaggaatgaaccagtgcaaatgtttgtctctggatatagaagtccttctctcatgtgctggatatttatgacagtttgcacagctctgctcattataaaagtcagaacttttagcaccattgttcagaggaaagggaaggctgggagctacattggtggcttgccagtttcgcgacaacctttccttgtaagtagaatgccaatccagataacatgttttcagatggcgtacctttcacccccaaacctcccaccccaagccagtatatttagtatcccagtgatggtggcactagtggtaaagaacctgcccaccaatacaggtgacataagaaacatgggtttgatccctgggtcaggaagatcccctggaggagggcatgacaatccacttcagtattcttgcctggagaatcccatggacagaggagcctgttgggccacagaccttggagttataaagagtcagacacgactgaagcaactaagcatgcgtgtacgatagccacacactacacgcttttggggaagggggat

SEQ ID NO: 57340 - DNA, 774 bp, Bovine  19866880565385
tcattccacatcacaaaggcagaaaaagactgcatttaggtaaagagaaaatgctataaaaactcatttccttcctgtcattttgtgacctgtcatttaatgatttgggttcttcctgtcatttgcattttaacactaagctcttatttaagtgcctactatgttcagaacctgtttactaaatatttggaggagctataaagttacaaaagagtttcttctccttgatgatttcttgataatatttgatatttgttgatacaattgatataattgttgatataatgaggaatgggggaagttggtgataaagcgagatgcatacattttgataaaacttggtaaaagtttttggaattgggaagcagagttaattttgaactaaagaccaaaccatcaagaaataaatttgatgctcagtcaagtgagctgttttttctttggtaactataaacaaactttttcttttaaataaattttattgaacaaaatggattgataatattccaagtagggtttaggtttcttttatgtctattaatggtgtatattacttcttattcataggtttaaaagaaggaaaagtaatcatgccctcttaaaattttttttttctttaagcttgcatcatgcttttcaaacataacttttgaagttaaaatgagaaatttgatactttgatattcttaagattttgaattaaaatgtgatttattagacaaaagtagagaaagtaaaggggcagtagtttcttcgtttttaaattaggagttt

SEQ ID NO: 57341 - DNA, 1049 bp, Bovine  19866880614497
agcaggacacgactaagcacagcaaagcagtatgggaaatagcctaaaataaaatgcaggagtccaagcttgcatagtagaaacaccatttaaaggaattggttaagaatttgcagcattttgtttgctcctgacaaggcaaactgaagcctggattaagctagaaataatgttttccatagtgcctcccaaagactaggtaccacacaccctcagagctgaagcttgtggggctcatcagaagtggcctgggaggtcctgcagaatctgatggctagagaccctgtggactcacataacctcaaagggcttctggacagctgttcttatttagacaacattgggggatatttcccatgagtaatcaccatattttattcacatatatttggaaactttgagtgtagtcgagaatattttagtcttttaggaagcaagtctccaaatgtgcttatcacaaagcctttgagttttcaagtcactttggaatgagaatatttttctcccaaaccatgaagtctaaatccagctcgtgtttttgcactggaacactgtgtttccccaagttacccatgtgcttaaggctaaaataatatatttgggatagtaaagtgcggagtaaaaaagcataaggcatagttgaatcaagtcagtcttgagaaaaggttcctgctgggagcgagctctacccgtggcaaaggtcatgaggaaggaggcttggcatacgcaaaggcgggatcgagcctcaggagtccccctggaaattctcgagcatctacccccaaaaccagaggctgcctacctactgctttgtgctttcacctacacctctgactttacagggggctgtcccccactacctctctctgaaaaaagagttagcttacagctccagttaataattcctgggtgtgacagtgtttcaacctacaaactcatttggaagtcctctagcctgcctgaataggtttttccagccacatgtgattgttcagagcctcccaactgtaagaggcaggagatgttctaaactgtctaaacacagattc

SEQ ID NO: 57342 - DNA, 1255 bp, Bovine  19866880625798
agctgggcacgtgcagtcttaactcatttagtctttatccttgtgccgggtgacgccgagccatactggagactgagaggcacaggaaaagtcagttataacgactctgtctttagtatttgttcattatggaattttttgcattaattttgttttttcaatatatttttgcatgaaaatctcttttatctgatgcctgagttttgtggcatccccttaaaatttgcagctgtgtccattgtctccctttccccaccttagtcccaactctggtactttttttatgtgccaggcaatgagctccctcctgagatacaagatcaagacacagaggagctttcagactagtgagagccgactgtgcaaacagtcacaacacagcagggtaattacaagactgcgcacagaaagcaatggggacgagttgccgttgattcaaggtccctggaaggagggcttgagggagatctgaaggctgcctgtgggtcggccagtggatatgtgggtggcggaaggatgtatggggagtgttggaaagtgacaagtccctacttgactctgagcctcagttttctgcatctgtaaaatggaatggtagcacccacttcataaggttgttgtcaagaatgaatgaatgaatgaattccctgtgttagcccagagagtagattctggtgtataacctgatactgtgtcttagtcacagtggtggtgatgatgatgaaaataatgctccttataagatgacagtatctttggatcacatacacagtctctgaactttgctttgcagacatccacgacagtgatgggagctccagcagcagccaccagacccccaagagcacagccaaatgggcctcttccctggagaatctgcttgaagacccagaaggcgtgaaaagatttagggtgtgcctttttccttgttgaccggaaatgacacaccacacaaagaagtttagaagcctgtaggggaaacacaggccagtttttgatactgtccatcccaacttgagagaaagaacttctcacctgtcatgaccaacatgggaatgctttcccgggtgctcatggaccagcactgaggggcttgcactgactgtgtctggtttttatataactgggaggggtggggatgggggaaagaggtactgtgcccactggcagaatctgcaaagaatttccagctccgtgacacctaggaggggggtggtcagggtctccctgacatgaaggtttgttctcttgtgtg

SEQ ID NO: 57343 - DNA, 562 bp, Bovine  19866880768886
tttagccctgtgaacacatcacatacaaagtaatcttatttttttggaaactgttttctgtctaattgcacaccatatgcttgatagtaaattttgggtgggtaggtggggaatcttggctccagaaatatgttttatctatcttgacaaatactttctgtgaaccctcttagttaatggtcatttagaaaattggacagtgcctctcatacttttttaaagcagtagaaatctcatgtcttattatcagtgtcagcaaaactaatttggttaagtaattaaaatcaagcgactgaaaaattgttttcttgcttttgtaggtgttcataatgtgactgccctgagcaacctaataacttggcagaaggtggattacgacttcagctaccaccagatggaatttccctgcaacattaatgtttttattacttcagaggggagatcgctcctgccggtacgaggggtcattttgaaatggagggcagttattggagagagatcgggacttctgctttgtttcttggcactgcatattatcaataagcttagcttgtttcaaaat

SEQ ID NO: 57344 - DNA, 516 bp, Bovine  19866880772718
ctaaaaatacgtttttgtgtgcggtagaagaatatgttttagacacacacatatttaactctgtattttagtttgaggcattaaaaacacattaaaaaatcaaaagaatatacagaaatataaagtgaaaattaagtttctattctctttcatgccatttctgagtgtcccccccaagccctattcccattcctcaaaggtaatcacacttcctgtgttttgtttcagaaatgttttgggcttataaaaacataatatctctcccactctccccattaaaagcccaagtgggatacattcaagtctctctgcaacttggaccttttctatttaacagtatcttttttttttaaattagcttatttagaactctctaatttttaagctatttttaaaattgaaaaataaatgcataacagagaggaagtgagagacagctgtttttggacaaatatgaaattatcactgtaaaagcctaattttctttcctctggaaggagaaagacgagatacaga

SEQ ID NO: 57345 - DNA, 1850 bp, Bovine  19866880817894
tgcctagagtctgttaaagtttgctcatgttttaagaagacatttttggggactttcctggtggctcagatggtaaagaacccaccctataatgtgggagacctggggttgggaagatcccctggagaagggaacagcttacccactctaggactctggcctggagaattccatagacagaggagcctggcaggcaacagtccatggggccgcaagaggtcagacacgcctgaacaactttcacttcactggtgatccagtggttaaggatccaccttgcaagccttgcaatgtggggaacgcaggtttgatccctgatcagggaactaagatcccacatgctgtggggcaactgagcctgccagttgtaactaccaagctcgttcactctggagtaggcaagccaataagtaagttaaagaaataaataaaaatccttttaaatgcaaattttatgaatgaattaggcttaaaagcttgaataggttgtatcaaacatccagcaatattttctgccttctttaaatcagtcatgaactcacttaagagattagaaccatacaactataaataaattgaaagtaaccttctctaaaaagattttaatacttttaagccactgtgaaacaagtttatcattaaatgcagcattatcaactacttggtaggtttttacagaaactatttccctcagggaagaactgtgagtaataaaaaagcttaagcatactctgaaaataattttctatcaccacttctatttctggtggctgagacactgaacgctataaaaccgagaggtgaaaagatttaaatagagacaatttcaaaggcgaggtgatatgttcagtacacattcaatcctttatttctaacattatgaaagcatactgtttttattaagagaaaatcagttttctccatcctcccctgaaaaaattgttgaataaatatttaaagaatttaaagtcgcccaaataacccaggtaagtgattccaacataaaccacacagcctgagtcagtgtgttgacttgcctgtccggtgccaacttcaaaggcctcataatcaacacgcacagaagagacggacgctccaagcgggagtctcctcttggactcgttcgagtctgagggaggagaagccatgtctttagctttctgagcactttcctcctgtccttttgctgaagtggccaccgctgccttcttttccgatgctgcttttttctcttcctgtgaaataccaaaatttcataacataactaagggggaaaagttatcagctatcactatgaaatacccatatcaatattaaggaatgattagtaatttcttaggcctaagaatgaaagcattgtggtcaattagagaaatgtccttttagagacacatactaaatagtcaaggaaaaaaatgccatgatgtctataagctactttaaaattcttaagaaaaagaaaattaagaacaaagaaaaatgtggcgaaacagctacaattaaatctaaatattagctattattatactctgtgccctacactttttatgtaatttaaaattttaatagaagttttttttttaaaataccaacttcttcctttatgatctcaactttagccagataattttagaagtacttatgtaactgtaaaatatatacttcctataaagaggtgtcggagaaagcaatggcaccccactccagtactcttgcctggaaaatcccatggatggaggagcctgttaggctgcagtccatggggttgctaggagttggacacgactgagcgacttcactttcacttttcactttcctgcatggagaaggaaatggcaacccactccagt

SEQ ID NO: 57346 - DNA, 795 bp, Bovine  19866880831066
ctaaatcatattaatataattagattactcaaaggggctgattttaaaattgtttacagaatattgttcactcaaaacttaattcatatttgtgagacttcagtaaactttaatttttaatatccttgctttaaggggtttttattaatttattataaaccacatgaaaccttttctgacaagttggttgaatatatagattaaatgccacagtttcatagttgacatctttagtatgtttcagtttagtctaattgggggaaaaagagaaatcaaatctttagcttagcacttcatttaaaaatactagttttagacaatcttggttacatttgggctgtcagtgtttaaagtaagagtaaagatgaaatagacactaaactctgtcttaaacatgggaaggaaaaatagattttgtatcactttttcataggtgaaaaggacacggttccctatttctgtgcccatttcgaagaacaactgaaaatttacaaaaaacaggtgggatttcatctgtagtaatgtgttccttcatatttttagaaatggttgtgcatctgtttaaatttgaagataacgacatacggctcataattaagtaaaacggcatttgtcatgacgttaagaaacacataagctaagagtattctttaacaattattgagtcagctactttaaactgttttagatgagattagtctactatcagttatcacaatctgagatatgtctagagtaagatagaaaggcatctttcaggtccacctcttgaggtaacaattagaaataaccttc

SEQ ID NO: 57347 - DNA, 4083 bp, Bovine  19866880850850
attctgcgtaggttttagaccttggagagaccttagcagtcatctctggggcagtgctcctgaaccgcttgacgtttttgttgtccttgactttggacattgttaattgaactctgcacttattcccaccaggcttggatccagcatcctttcaatacaatacaaagcttgatttatttagggtgatgcttatttataacccagaatcaaccaaacttcagcttttgcttatggagatgtggagctcaagaaggagagatgacttggctaaaggcacagatctaggctgggattactggcatcctggctctaggctgagattttttttcttgccttagtatatggttagttttagataacttttccagaaatcctgaaaatggagcataaaatttaatggctaaaatataaattatatgaaatacagtcttttttcccctataccctggaaatttcctaaatggttcaaaaattgtaaagaactgagtatctaaataaacattgttaagtggtaagtctaacgttgggcaacctgttatattctaagaataatgagtagattctgcactatctagaatttggtgatgtaaccagcggttcatttaaaagaggggaacaagataacttgcaaatactcaagtgcctgccatttgcaaagaatagagtatgtctcactttgttgagccctcctcttccacatcatattgatcttcgagggagagaagtcttctgaagagagatcttagttccctgcccagaagttgaacccgggtagcctggattaaaaccagaaattctagctgctagaccaccagggactagaggctagaagcaaagtgtgtattagtggctcagtcgtgtcccactctttgtgacgcaatgggctgtagcctgccgggctcctctgcccatgggattctccaggtgggaatactggcgtgggttgccattcccttttccaggggatctacctgacccagggctcaaatccaggtctcctgcattgtagcaagattctttaccatctgagccaccagggaggcccagaagcaaagtagccctgttttttccttccctttgaaagtaagaatgtttaaaggagtcaaaaactataaatacagctacaacattaattattattatagagaaacagcatcgtatatgggaaagcacatagagaaacaatttgcttaagacagaagcaagacagaaatatatacacagagagaaagggtgtgggctcccccctctaatgaggaagagcatggtaaagagatgatttaaatcctttatatacgacagtcctctttggtctttgtttaactttggccaattatctttttttttttttttttttaaatcacacctgactggtcggtcctaggaccctccccaagatgtgtgttcaacattttgtaaagatagatcccactgcagaggcctgtgggtgcatgcccacatttattatggggtagtgcccccctccctttttgacccccaaggattcttccagcacttgtgaagacagggaagttttccttgacttgaggagaggtcatcttatcttttaacttaagcacagctcagttttgccactagctttgtccttggagtgtctgggtgggaacaaagcttcaatttgactccacttgacaaataccagctgtccagcccaggggcccatctatctcctacttcactatcgacacttaatgtgtacaattgcttttattcccagtgactttacagttcttacatggggaagctgcattccttatgaccattaaccagaaggatgcagggtcatgtcaaagtggcagattggcttagtacagcctagaaatcagaaaaagaaatcagtagagagaccactcatacctaatattagccaagggcattcctgttcttaaactaaatgttgctttgtctactagccagccttattagacattagcaggaagaacttaggataaattcagtggaggtggttcctactggaggcggcaggaggatgtgcttgagaatcctgccacgtgcctcccaccagctcctctgctaacctcccctttcttcaccctcatttcattctttcccctactctcctctctgtctgtggttgttatgtctttgccaagccctcaaggtagattagtttataactttaataatgtggtaaagaacctggagttattttgcccggaaaaggtgtgtaaagaaggctgcatcatttttgttcgtgttttcctgtaagcagccatctgcttactcatcattgcttttggaattttagcctttgcattggaacaagtttcagattacttttagcttcaaggataattaagtctataaaatgtatgtttgttgctttttggttgaatgtagtaaatagagggggaaaactggaaaatgggatggaaatgttctagaaaattaactcaaagtagatctgttgaaaattctgtaggggtattaagatacaatttcctaaggcagcttctgaataagaaaaaatagaatgcattatggtaatttgaaagaggaatcttcctgttgaagaaaacatagtttctgactttttaaatttattcttagctttccaataaaatacccaacatataatacacacatgtatgtgcacgcacatgcacccatacacacacacacacacacacacacgcactgagagactgactggggaaaaggctaaggcaattgagatcttacaggcagtctattaaaatttcaaattttataaaagctttgtattaataagtgtaagtggattctttacttgagcttgaataaattggaaagaatttagaattaagattggaaaaccatgcttcttcttccttttaggtagatttcagacttgcttagaattgagcagtgaatagtctcataatgtaggctttagtttatgccttgaaagtgaaagtgatacttgctcagttgtgtctgactctttgggaccccatgtactgtagcccaccaggctcctctgtccatgggattctccaggcaagaatactggagtgggtagcctttcccttctccagggaatctttccaacccagggattgaacccaggtctcctgcattggcaggtgaattctttaccatctgagcaaccagggaagccctgttcatacaaaggccttgatcacaatgagcttcttcctcctgaaagttgaccactttttgtgtctcccaaaaagcaagtgtcacaggtgcttctcgcagtcttgcagggcctcccagaagctgctcagttaaaatgtctggctggcacaaggttggccaaggggcaaggtaggacaggccaatccaaatgttgactttggaatgagaactggattttttcaggtaagaatactgcagagtgttgccatttcctccagtggatcttccagactcagggatcaaacctgcatctctcagggcaggagggtagagatattgtgaggcagaagggctggagtcctagctttaggaattctaggcaaggcacttcatcctgaacttcactttccatgtctatgaaatgggaaggttatttattatcaggctcaaattggctgtgggtgagatcgttctttaaatttcagaacactcttcaggtgtgaggggtcattaccatagtacccttagcctcctgtgcatgtgcttacatgttcccagcatgcatagtagggagttcagtaagcaggaagaaaaacaaccaggaagcagaggaaactcggtgacctcctttttgccaaaggtaaagggcatttatgggaaatccctcctgtggttgtgcctggagggcagctccacctgctcagctagatctttgtctgagcagtccgcttcctggtgggtacagcctccagaaggtcatgtacccagccccagcactgctgttatcttccacatcgaggtgtgtttccttgctgtaatcccttcatacccaggctgtccatgcctggcatcaacagggaaactcttgccaagggccctctggccacagagcactccccccacctcctgcctggcctccattacttctttcctttggtgagggggacagggcacagggca

SEQ ID NO: 57348 - DNA, 792 bp, Bovine  19866880885846
caagaatactggagtgggttgccatgccctcctctaggagatccttcccaacccagggattgaacccacatcttttatgtctcctgcattggcaggcagattctttaccatctgagccaccagggaagccccctagtaggtggagaataggccaaattttgtataccttgcctccttccgcatgggcccatttccagctgtgagatgtaggcttgggtggacacatttggtctgaaaatttctccatgacctattttgtattgatttttattttatctcttttaggggagttgacagttattctttggtgggtagcatttactcccaaacatctgcctcttgaattccagtgagttaatgttttaacacttgcagattggggccaattttatttcaattttactgctaaagcagagtggttatacttgaatctcctgaaagacataagaaaaaaactactcaagaaagagcaaatttggcagatggattttccacaagtcataaatagtgatccaaaaaatatatcttaaaccagaacactgctcccttcaccctcccagtgactaatgtgcttgtcagaaaagagaatttcacagtgagcatcttggatttctgtcattcataaattgttgtagttcttttggtaatctttgtcacaccatgcttctatatcttttcttttttcttttaaggccagatacctaatcaaatccccttttacacattcattacttctaagatgatagttgcgatagcatctagcatcactttctagaattttctaatctttaa

SEQ ID NO: 57349 - DNA, 1477 bp, Bovine  19866881055285
ctggtccctttactctgacccatctctctcactcccatccttccctcagactcaaagatgagtgttctccaagcttgccctgcttacgctgtcacaggtccctccagtgccttctcctggcctggaaagcctgtctcagatgccccctccccagaccacctcctgatccctcagctaacagccagttctcatttcctttgccactgtggtgtcgcatctgccttgccctgatgggtcctcttaacatgactttgctgaggccagaccctcagcatcccgtctctcggtgcctcctgggtgcaagtctgcaatgtacttacgaatcgcgtaaacaaatgagagaatccacagaccagtctttgcccttggtagcttacctggagcagaagaggggatgccagttcagcacacactagtgggtgccaggtacgcaccaggctctggacatgcagtcgtgggcagaatcagacaggactcctgctctcctgagggttccaggcatctgagcacgctgggatcctgggaccacaaagcgcatcgcggttcaggagagcctcccgaatcagggtcgagcggtgtctgatgggaacctggggtggcccagggctggtggacgtgagccaagggatgtcttggcgggggatggctcggggattcttgtgtggaagggaggtgatcacaagctctccaaagcccctcacccctcgggcctctgggcaggaggaaaggccccccacccggcgtgtcctcatggggctctccttttgcagctgctcaccaaagatgcaaagcagaggctgggctgccaggaggaaggggccgcggaggtcaagagacaccccttcttcaggaacatgaatttcaagcgcttagaggccgggatgttggatcccccctttgttccagatgtgagtagctccccagcctggactgagcctgtgcactggtttatgaccttcgactttgctaaatgtctgtgagggaccctggaccaggggctgagacccgtgggcagggggtggctcccatctgccagtagcagagcatcgcctggtctgaggaggtctctctgcacccaccctagcttcatcacctctatgaagttttcatttccagattcccaggctcctagagcccttgggagccctcccccaccgatcttgaactcccagagggcagggcccgggtttgtctctgtgagtccctgaactgcagccccagagcatgtttggcggacaagagagatgaaagagatcaccagggttacagcatcaggtccatagcagcactgacaacagcctcctgtcctagtgcctcgattgtccccattttgcaggcgaggaaactaaggccttcaggggttatgtgactttcccaaagtacctaagcaccacagctgggaccccagcccagggctgtgtgtggcagacgagcctgcatggtgacctaccgcttctgactggcctctgatgtggga

SEQ ID NO: 57350 - DNA, 1518 bp, Bovine  19866881055935
ttattatgtcccaagtaatctattcctgaattacttgtgaagagacaaactgctctgtagtgtataagctacttaggtcctattctaggatgatgcacttccattgtcctagctctcaaatttggaaatctgctcaggtttagtcttttaaacctttccaaattaacgtaattagaatttgtgatccctagatgcacatatagtacacgctctgtgacacctttttttgagggggttaaataaaagccacaggattctacgtgactaaaaactaaatctgaattattcgtgtctggcattgtgtaaacatatttttaagttcattttgctggacttcattaactacttcaggatctgcagggctcttctgaacctttgccactgcaaagtttatcccctgggttaacccagcctgggtaatgttagcaacctggaccatagaacttcgaatctttgcaaaaggagagactgctctgctgctacagctctctgaaggagaaggagttacatgaagccctctctcaagttcaagcgtgccagattcagagccgggggtcttttgagatacaactgaatgcactggttcaactgacaaaaactgtgggcctgatgcagaaaaagacacgtctaattgagaaggtcgagacggtagctgttccgtcgattcaaactgagtttcttcgctagaaacttgattggtcatttgatttccttcctcactagcctgctgagaaacagagctggtttctgatggctgggtcattttgttttgtgcatcttgaacaaatctgtggcagtaaatatccacaggcttagcaaatccagtcaatgtgtgtatgttgtcagcagaaggacttttcttcaaagaagactcgtggccttttccaagcccactgtcatgagcaatagtaacctctgaaggaacatgaatgctgatatcagtgctgctaatagactgggatcgactgcctaaccgaggtgccgaagcaataataccacaactaggaagaacatagtctattggccctacattctctgaagagttagttagctgcctgtcttcatcagacttggaatttgtaagaaattcatcagagtgatacgagtcattatctgaagagatttccccttctgactctgcctgggctttattatccatcacacttgtgttttccatggtttcaagactactatctgatttccaaagatttacttttaagtttggttttagaaagttaactttcatttcaggttttgtgaagtttcctagctttcgcagattgccaatgtttacattggatttggtctgtttcactttttgatttagagatgaaaatttgctcattaaaaatttttttccctgggccaaagagccttggttttgagatctgatgccaatgatgtcttcatgaggtttactgctcttcctacagattagaaaagaaaaaagttaatttcccatggaatccatagacagttccgattattaatgtaagtaaaactcaagtggcctcaatt

SEQ ID NO: 57351 - DNA, 1316 bp, Bovine  19866881060861
agcacatgggtgactctctcatgcccccacccacactgggcacacacaccccagtttgaagacttttgtcacagggctgttggttaagaatatcttgggagcccaaggttttgaaaataaggaggaatggtcttgatgacatgccctccccccgcctcccacatctcccaatttatgcttttgttttgttttcattcaagtgagaagagagtcagaaaaatttccctaagggttgaaaaaagaatcctctacttgattgtttttctcttaaaaaagaaaaagaaaaaaaggcatccctccaagttctagcctttctattaatactagggagaaagagaaccacggtgcctccctggcccgaccccttgctatagcctctctgtgggtgtgggttctgtgcccactagccagctgtctttccaacctggtggtcggtggtggccgattaattgaaatgaggtctcctgcccttatttggaagggttagcacatcaaaagcatggaaattaataacaatggcaacaaaagtatgttgtaataagtaaccacatacagaccccaattatcactctgtgagcttgcatcactggattgggcacatgaaccactccccatgaggacagctgccctcagtttagtgaacaaagccagttggttgagaaccaaatcctcagtccagatgccatgtgtggcatccgcacaatggcttacccgcattacacaccctgtcctgttggttattcttcaattcacagagaagagcttttattaataaaaccagacactctgctgcctctcccccttacagtggaaaggttctctttctcatgagcatgaccatgtcttgtaaagagaagagagaccttggagacaggaggtggtggctgcgtctacagctgcgcctggtggctatgctttctcccaggctgtggctcagctggagctgggggaagtgccaggcttcccaggggccccatcccaaagtgggtctttgtcctggaggttaccattctctcccttactattctctgacccaattctacagctgcggttttgtcctcaataacttctctccattcattcccaggcctggctcttgccttcagggcatccggagacctcgaggtcttcccatccctggaggaggtctgtcacctcccagccccaggggtgctcagtgacggactaaacctttgcctaactccttttcagtcaccctccagagtcgagaggatacctatggcagacagcagcacttgttttaaattaataccgcagggagagaagtgagcccaagatggtcttgacccagagag

SEQ ID NO: 57352 - DNA, 2050 bp, Bovine  19866881106156
ttagagagcatttccagtgaattctatctcagatgaaaaataacgtacagcatgagatgctcccctaaataagaaaactgtgtatagatgtgcatgggtgtgtgtttgtataggggtgtgtgtgtgtgtgtgtgtgtgtgtgtgtgtgtgtgtgtgtttatggccagggctctctacccaacactaatgttaactcaagaatattaggccggaacttccgtggaggtccagtggttagactctgctctttcagttcagggggtgcaggttcgatccttggtcagggagctagatctcacatgctgtgtggccaaaaaaaagaaaagaattttaggctggttattagcattgaatttgaccttgaagctcacccaacttcaaaccttaaattttgcaggtgaggaagctgggttcagagtggtgaggtgaccattctaagattccacagcctctatgtagcagtgaccagaggaactcagattccaaggttttaatcttttgaggggtttccttacctagtgtaaaaagtgcatggcataggctttgttttaaacggtttcttttcaaaacgctgtctttctctgattagaatttgacttgccatctttatttgctcaggacacagggtctctggaactcaggacttcggcagaaaccagggaaattcaggaaaaccaggatgagtctgtgaccctgttgcaagggtttgcagcttttcatctggatggttttgtcctgtttcctggtgacctgtgacttctggcccatgctacatgaaaggaaacagataactctgttctgtgacaaagaagagacaagttgtgactccctctgggctgtgagcacccaaatcctgctcccctacacccagttcagtctgtcctttcaggctcaggcacctcctttcccaccttccctgaccaccgtggtggttgtcagacacctcagtgattgatagggatgatttctgtacgaaccatttcaccctatgccatcaagcactgcagtgatttactcaaggtctctgatttcacgtggatgggtttcgtcccttcgaagatcttgcaagccccttgaaggcaggaggtaaggccactgtgtcctggacaggtgaggatcctggcctctggagcccatttggttcagagtcctggtgctctgcgctttgttagtgaagtaatctgggcaagtcatgtaaaactctattttctcagtttacttctgtaaactggagaataatagtactcacttccggaggtgtcatgagaattcactgatacccacaaactgcatatagcagcacctgacacatggcacattagctaccacgagtggggtctcagtagattctgtgcttgttggctgatttgaatgcatattcacatggctaatttccttacctttaactttgacttgcaagttctgcactttgaaagtgagccttgatgacctagaggagtgggatgggagttgggagggaggctcactagggaggggataatataattatgctcatatgtgtttatggcagaaaccagtacaacattgtaaagcaattatcctccaattatgaaaaatattttgagagaaattgcaatggaatttaaaaaagaagtgatcctggtggtggagaacattccttgccacctaggctgttaaaggattctgtggggttcgttagaattctaactgcactggagcttgccttgaaatagaatctttaagcataaggccatctgagagtgtccgcttgaagattactctttataagtaatgcttttccatctttgaactgaccatttagtatcagcaagttatcaattaaaaatagtttaagagcatgttaaaaggacagctaattttaattcattggaatggatctttattttatttgatacataatttgagttttatggctgaaataaaaggttaaagctgataggtaactgaaacagaatatgtgcaaagtgggaacttaacttttaattttttatataccttggtgtaattaataaaacatttcttacagcagaattgcatgactggatga

SEQ ID NO: 57353 - DNA, 1106 bp, Bovine  19866881166660
tgggaaaatacatgataaagaatatacaggtgtacctgagtcatcctgttatacagcagaaatagcacaatgtcgtaaatcgactatacgtcaatacattttttaaaggaataattgcaagaatacccaacccttaatgatggttttctctgagacggggagaggagtgacgatttcagagaatctccctcagccagtcagacatttcataatatgcaaatgtttaacagtgaatatatacactcccataagcagaaaataagcaaatgaggctgctagtcaggccaagagtttatgctgcagtaccagtgctacagttaaatgatgctgtgccaggaagcaccaccttaacccagatggggtcttcccaggcggctcagtggtaaagaatctgcctgccaaggcagaagacttgggtctgatccctgggtcaggaaaatcccctggaataggaaatggcaacccactccagtattctttccagggaaatcccacggacacagggcctggtgggctacagtccatgaggtcacaaagagctggacatgacttagcaactaaacaacagcatcaacaaagcacaggtggagcctgaggcccagactgtgccttcttcatttcctgtcccctccctctgcctccagatacattcaaagaacagtgctgaaacaccagctactccctggtaatgaagtccaagttcacctatgaacaatcttgccttatacctctttcccaattcaaatcaagggcaaaccattcatcattccagcagagcccagaaaactgcatacactgatcttctgaattttatcacctgctcttcaaggaatattgagcccttatgacttgacagtgatttcattacaatttaagaatatcatatataacccattttgcgatcctgtcgctaaataatcagtaatacttattattgaaacagatgtactaatgaaatggacaggtttgagtttatcaatattcttcttgggttgattttatctttttatgtcaaaataatgcaaaaacagaactgaaactttgcaaaaagacaatttttcttctttgatagtatcagtaagagccaggagtctaactatatagat

SEQ ID NO: 57354 - DNA, 956 bp, Bovine  19866881281963
ggctgggagtatgcaaagacagggtgcggccggctcggggcgccttcatgaaggacagggatgggaatgtagcctggccggagctgggggtacacggcatgaccttctctagtgggcagcagcctggcgccctcccgcgaaggcccatttgcagaggatgcggtttcctaaaagtgagaggagacacacagacctgttagaaactgggaaggaaacagccctgagcaggagaaagcataatgccatgtgctccgatcttccagagtgactctgggccccacagtgccagctaggacagctgagcgcagaaactgtgggtacctcccctgatcccctacttcttccagacctctcctcccttgctgaagctgctgttggcccaggagtttaagaatcagaagcatcaagagaaagtaagagacaagtaaggtatctgtggagcacaggagaagttccggtttcccgaactggtaagacaggtttttgttctggatgacaaggcagccttgcatacaggagagtccccgacagcctcccaaaccttcagagacccagatcagaagatgctaggagggtccaatgccaacttgctaaggggattacagccagcatctcggcttcctaaacggtcctcacatttcctgacaacgcagattcacgtgggaccctgacacaggccacagcccagaaatctgcagagaaggggcagcggcgggcaggcagcttcctcaggaatattttcagaacaagaggcaagaaagggagatacccaaggaatgcagaagaggcacaggatgagaacaaaacccggggattagttgtgctggtcttgtgatgccaacaaagcttgcttggcgaggagcggcttggggtccctcctatgtcctctcatgaagttctcccttcagtggcctggctattttgggacccttgagaaggccaagttccagatgtac

SEQ ID NO: 57355 - DNA, 725 bp, Bovine  19866881371596
ctgaagacagcagcatcatgaaggactatttgaaaataagggcagacactttgtcctctcgacttctaaacctaatttgtcagtcaaagcaaacaagtcaacacaaaaaacactaatctctccatctagtaacctgaggcttaaaatgatacaaatcaactcatgtatctcaaaatgttaaacattatgctaactgtcagcacctggatcggggaagctcttacctctgtgatcattttacagcttttacagggtccaatctgactgaataactgaagaataagaacttctgtcacatctctggagaggttacctacgtatctgtatgggaagagaaaaaaaacaactatcagcaatctcccttcagctctgactctaaagcattatcatttacacatcatctttcatttcaacttcctctctccaatcaaatttttccaattaagcctgattctttgtatgtaagattaactctcacctaggaaagcataacttcttagggcactaaagtatcacttcaaaagactttataaagagcaaatcaatgtgattttgcaccccaaagcctatatatcattttctcgtgttagaataaaaataataatttaaaccagtctcaagaaaactacaatgtttagatgtgaaacacaattcaaaataatgtataacacacacagtaccataaatattgactcattaaaacacccaatcatagaggggtatca

SEQ ID NO: 57356 - DNA, 734 bp, Bovine  19866881404558
ttatgcatagaggttaatttctcattatctcttaagtaaatgtgcttttctttttaatagggaatcagaagatactgctctgttattacttaaagaaatttatcgaacaatgaacattagtccagaacagccccagcattgattggacttcagcttaactgtgtgagtttattttgtgtataaattctgaaggcttcattctgaggcttgtttttttttttttgggtgcaccctgcagcatgtaggatcttagtttcttgaccatggatcaaacctgggccccctttgttgggagcagagtcttaactcctggactaccaggggagtcccatgtctttctcttcctctcttagtcacctggcaaaaaccataatcctaggagacccagttgtctcttactctgaacctcacctgagttgcagcacatggccagagaaaagtcaggcaattgtgttaaccatactcgcttcaaatctatgaccaaaacatccagtgggcagtaaagcctgcagtatggttctgccacacttgtgctggtaaattcccttccccacaccctgaggtgactcttattttgctcctctctctcctcacgtttcccacagcccttgaccatgaccctactctcacacactttggagagaagccagagaaccccgctctgaccaccgccaactttacccactcttctcacctttgtatctttgtgattttcccgcatccacccacccatc

SEQ ID NO: 57357 - DNA, 1366 bp, Bovine  19866881476911
aagtgaaaggtagtaattagcagtacaaattagctattaagtgattccaaaatttcaaagtgagaagatgaccttttcacttcttacctggcagtgataaattgggttctgatttgagaagaaaaataaagccctctaacacattatggattttctttaccttccaatgggaactgagccaagttaattaaaaatatggtagaaagcaggaatttcacgatgtccctgggtggctttctcacctgcctacctggaagggtcaccttcctcttcagcccatcctcagcaccttccctcatagttatgagaaggaaaaatgggaattcctagtgcataatattttatttaattactggatgacctggtaaacctgtgtttgtcgtgacaacatttcccactctaattaaaaattggctgaagatacacacgctgagtgttcattaattcctctaacaaataatttcactttacagtaaacatggcattgtagtcccagtcttggatattttccatctaaaaatgttgccaagttattcttgccattttgctgagcaaaactacacagattccaccatgaagagctaaccagacccctcacctctattagcctgcagtcatgctaagcaccttccattgctgcttctcctggaaaaggtacccttggctcaagaactgtatatttctcttatatgcctaaagtctcttgccacccgtggtcttgacgcaattgcaatctaggctacttctttacaagtcaacgtatgaaaaccttttttctgcactttatggtgaggccgaagattttgacatgagaaggcacagtgccacaggtgggggcgggggttggcacggagacaaaagtgatgatctctttaacacaaagcagcagatgaacacagtgattcatgctatacccacggggcttccacctgagagcacaactcagaatcaccaaactgcagaagtaaaaaggacctcagatgtaattaagcttaaaccaccttacttataaatgacaggacaaagactattaatgcgtatatgtggaatctagaaaaatggtacagatgaacctatgggcagggcaggaatagagacacagacgtggaggacacacatggacatgatggtggggaaggagagggcaggacaaattgggagagtgggactgacctatatacactgctgctgctgctgctaagtcacttcagtcgtgtccaactctgtgagaccccagagagtggcagcccaccaggctaccccgtccctgggattctccaggcaagaacactggagtgggttgccatttccttctgcaatgcataaagtgaaaagtaaagtaagtcgctcagtcgtgtccgactcc

SEQ ID NO: 57358 - DNA, 1434 bp, Bovine  19866881609396
tagagtacaactgtgacaggcttcaggtaattagtctacttgtgcatactgactgcagatttctctaactagcagtaggtcagatcccattcaatgtacgcacaatacatgtgtacacacacttagatattcgtatcacactgcatttcatctcacttaagacaccattgattttttttgtcactgtcagagatgttaaaattaaattttaacatctgccttagaattggtaatgtacacttactatagtatatggaggtggagcttcccaggtggcgctagtggtaaagaatctgcctgccaatggaagagcccttaagaaactcaagtttgatccctgggttgggaagatcccctggaggagggcgtggcaacccactccagtatccttgcctggagactcccatggacagaggagcctgacaggctacagtccatggggtggcaaaaagccagacacaacacagcatctgagcacacacatacacacatgtatacagggaaagcagctacagtctaagataaaatatctaaagtagaacatcataagggcaagaaagagatttctcacacattgaaatgaaactgatgaaaggaaaccaatactcggcagtggagttcatggcctttgaaagcgttccatttacaccactgccaagggacgctctgggggcttccctggtggtccagtgattaagacccatgcttccaaggccacgggttagatccctaacataccacatgctgtgcacccaaagggaaaaaaatttaaaactgactgtgtccttaccttgatgttgtcaccaatttttgttggatgacataaatatcaaagcagagaaatatgagactttaaaactatttacaagttcaagtgtaggagttgtacaacatggataaattatgaaaggtcacttcaaacccttctaccctcaagtggctgattgtgcatataagttaataataaaaacaacaaacaacaacaaccaacaaatgtttctcaaaacactttctagtgactttccactttctcacattccattctttcctaaacacactccagtcagtttctaacccaaccacggcaaggaaattttgtgctgagctcaccaatgacctctctgccatctctgtgatcccttttcttcctcatcttgactttcaagcagaattcaacacagttgacaactctcctcctcttctaaatattctcctctagattcaccatatgctcttggttttcctatttcctcactggaaatctttctgaaggcatttttccctcttaactcaaattatcactgtcactaagtgttggggaaagcctggcgagctgcagttcacaggatcacaaagagtcggacatgacttagcggctgaacggcaagtgctgagatgcaccagggctcgcacctaggccccccactctctcct

SEQ ID NO: 57359 - DNA, 1439 bp, Bovine  19866881638069
ttttcattaatattgtgtatggcaactctcttcttggctgagcaccagcaataatgaagttaatcagacttccccccgctattctaattgcttttgtggtccccagataaatctgcaacacctgttggcttaatcaaatatctatggcccttctggagtcaactcaccagccgtgcagccagagagcttaggagaaatcttggtcgaaatagaactaatttgatgacatcttgggaagattttcagtgctatggctctggaatgaaatttttgtgaacctagctatggtggcttgggcttttaagacattttggtgaaattttacaggttgaccttagtcagacaattatgttggcaggatgtagaaaatatgagaaaagttttcttgtcccagatttttcccaagcaggagctaaagagctagattccttaaaatccttaatcattcccttaaaatccaagggctcctctggttcttaagaatgccctatttatgagcagatatctccagcaagtccagcattttaaacatctatcagctaccacctcaccaagacatctagcctcgatagggctctggtgagggagagagggcccccgaaaaagggacaagttgagaacaaacttacctttgcaaacaaaattacctctgtcattttgctcagggtaaacacttctcataacatttgaaggggttattgtcattgtcttttattgatgcactttataccttatatacatttactgattttattcaaatagattgaggtggctccacaaggtataagggaaattaaaagatgcttgctccttgaaaggaaaagttatgacaaacctagatatcgtatgaaaaagcaaagacatcattttgctgatgaaagtccatatagtcaaagctatgacttgtagtcatgtatggatgtgaaaggggaaccataaataaggctgagcgccagagaattgatgcttttgaattgtagtgctagagaagacccttgaaagtcccttggacagcaaggagatcaagccagtcaatcctaaaggaaatcaaccctgaatattcacactggaaggactgatgctgaagctgaagctccagtactttggccacctgatgcgaagaactgactcatttgaaaagatcctgatgctgggaaagattgagggcaggaggagaaggggatgacagaggatgagatggttggatggcatcatcaactcgatggacatgggtttgggtggacttcaggagttggtgatggacagggaggcctggtgtgctgtggttcatggggtcacaaagagtcggacacgactgagtggctgaactgaactgaactgactcaatggacatgagtttgagcaaactccaggagatactgaaggacagggaagcctggtgtgctgcagtccatggggtcacaaacagctggatatga

SEQ ID NO: 57360 - DNA, 1348 bp, Bovine  19866881718007
cctagttccttctctgtcactagactacatcttcactcttcaccactggacatctgaagtaaagtgagacactgcaaatcacatgttgccgtttgccttctggtgacaagccagggagtccctatgctgtctgatgagaagcagctgtagggaaagctgctctgatcaaagctaaatgcacacatcttactaaaaccctagtgggccgtgctttataataccatggtttgatggtaagtacaaataataaaagaaaatattgtatgtactcattaaaaatgtggtgtagctcactcttaactagtgataatgaagtgtcagctgaacaccaagtgctaatacctgattgaactggagcacctccagctgtgtccatgatattctgggtacaataaaaaaaagagataagaatttccccaaatagtgctagaactccatattaggaatgctttgttgagatatatgtgacaatattcctggaatggtataagttacaccttggtttggtatgttaatgttgaaatgtgcatgactgttaattttgataatgttttctgaggtatgaatggtatgggggtttaccattttcctagcaataatttcttggtattgttaatttttaagtgattagaagattccattttggttggattagataattatgatcaaaggttatagtactatatcctaaaggaaatcaaccctgaatattcattggaagggctcatactgaagcagaagctccaatactttggcctcctgatgcaaagagttgactcattggaaaagacccagatgctgggaaagattgaaggcaggaagagaggggggagacagatgagatggtgggatggcattaccgactcaatggacatgagtttgagcaaactctgggagatagtggaggacagaggagcctggagtgctgcagcccatggggttgcaaagagttggagacgactgagcgactgaacatcagcaactgtagggtagcggctgagatatggagggcgggaatgtcttccttgttactacagtgccaagtgtgcctgcttgtcagccaggagcccagggtttaatttccctggtggtaaggctgcattcctaacttctaatacaacattgtaaacaaactcgacttcagtgagaaaaaaatgtaagatatggaggatggggatcagaattgctggagtgtgagatgtagccctaccactttttggttgtgggatttgaagccttagtgtccccttctataaaattgggataataacaaaaccttccttctccagctgtcatgaagattaaattagacagtgcatcattgcggaagaccgcaggagaactgtac

SEQ ID NO: 57361 - DNA, 1479 bp, Bovine  19866881778787
caatcccaactatatgaatcataattcatctttgtgaaccagtgcgtattttgaatttgtatctgccatattacgattgttcgtatgtaaatttttccctgtaagctttcataaaatgctttttctgtttctattccagtttctaaaagattttatatgcagaacattgaggtccatagacttaagatttagaaatactttattgagctgtgtgtgtgtgtgtgttaattgctcagtcgtgtccaactctgcgacttcatggactgtagcccaccaggctcttctgttcatgggattctggagtgggttgctgtttccttctccagggcaacttccccaacccagggatcaaaccccagtctcctgcattgcaggcgcattctttaccgtctgagccaccggggaagctcatattgagcttgagtatgtgcataatgctgatggcttggtccccgaagtgattgttcattagtaacctgtaacaacttgcttcccttaaacagaagcaggcgttgtaaatgagagagagaaaaaaaaaagttttgtatacttttttctttcaatctgttttttatttaaaaaaaattttttttcacttgaattaataactgctttaatttcagaataagtaggaatgcttatcaacagatttctttatgttcagattgttggttgggtcaagatcgttagtttcagttatattcaaggcactttggtcatatctaacagaacgagaattagactagctcttagaagaaaaaggtcactgacgtgtggaggagagaagggagtagtaccttatcactagcattttagagaatttaaagcaatagtaaaatcacctaaaagtctgtctgatgttttgctgtcaccgggattcattcctctttgtctgtgcccaccttgggcctccctgccacctggcccttgttcagtcgctcagtcgtgtccaactctgcagccccatggacggcagcacgccaggcttccctgtccatcaccaaactccccaaccttactcaaactcatgtccattagtcagtgatgccatccagccatctcatcctctgtcatccccttctcctcccaccttcagtctttcccagcatcagggtcttttcaaatgagtcagttcttcacatcaggtgggcaaagtattggagtttcagcttcagcatcagtccttccaatgaatattcaggcccctgttaggccattgaaaaaaaaagtaatttattttaaggctgtagaacccaaaggcagggcaagtggtttgataacccaggagactactgagtgaaattggaaagctagcagaaatccaaccaagcagcacatctcagttttctcccctaggctatgttcatttctgcgcacaaactttacctttctctagtccagggctcccagtttcacttgtcagttccaacctgcttgacctagcatctttattttttcaaaaaatattttttggctatg

SEQ ID NO: 57362 - DNA, 1519 bp, Bovine  19866881867794
taccattatgtggcccagaggctggtctagaccacccggtagccacctaagtgatccccccaagtgtattcttgctcctcccctatccattctctacccagccactgatcattaaaaaacatgaatcgttcataccctccctgctttcatggctttccaaagcacatagaacacaatctcaacttcttatcatgtcttgaaaggcctgtggcatccaggccctggccaccctacagtctgggctggtccagctcttccttgctttccccatcttgctctcttctgcccacactggtcttgttttagtttctctgccaggacctttgcatgtattgttccttctcagtcactgctctgtcccttctctctcccagcctcattaatgctctcctgccaggggatcttgagtgttaacctcaaatgccttttttactttctaattaaaactgctttgtggctgtggttaataagctaggtgtccttctaccatttatctccagggtctgtacccgagctgtctgagatgtttcagatgcccagctggtcaagtcatacatcagtaggagccatggaacacacagtgctttagtgccactctgatatgagcttgaaatggctccttaaggagcttgaaattgttcctttacaggtccgaatatagcaccagcctttgacctgtgcttccggaaagccttaaagcatctaaagttttcatcaactgcatcagcaccttccttgccgctgtgctttcagggctggtctgaggccacccaccatattttcaggtttctattctcatactctttaatttttccatgaggacttctagagtttttaatgatcaaatatattatacttgtgggggaaatcaggttatcttctccatgacgtgaaaagacagagctgattgcttactgagctgtttgccacgtggatcagctgtatcagcaatagcccgtattgggaggtggggggacagagtctgggaaggactctgtctcacgtattcccccaatgatgctggaaagactaccattgaataattcctctgtgcaatgcactgtttgctccagggctattcttttttttttttttttttaatcttatgcaaatatttctttgagtgataatcaagtttcagaattctgtgcttccttctggagtgagttgggaaggtgagggcagagctgtgagtgttgggggtccttaaggatggaaactatggttgggagatcagggagggaggggtgggagactcttctacaccctgagaggtggaagactcttctacagcttttctaacacccactgttctacgttatctagggtcagcctgcttatataatcatagtggcctggtggtgtttttaggagatgagaacccaggtaggtgttcttgccaatcactcactgagtttaagcatccacttcagccttgagatgcctcttgtgtctcaggtgagctgaaggtgggcagaggaatttccgcctgttatttcccaggtcatcaagccagaga

SEQ ID NO: 57363 - DNA, 1566 bp, Bovine  19866880920584
ccccagaagatatgtgaagttccatagttgtcagttctcaaaactgcttgagggccctacgttatctaggttatcatatttttttaaaggctttgattcactactgcactctatctgaaaactgaccacattttaggagtatttttctaagttaagtcttaagttatggcaactgtcaatgttgtaatatctattatttgaattcaaatgagtgattacatgtaattttattgtcttgcaaacttctaaagatttttttaaggctgaattacatttaagattctataatatataggatggtggaaaaagtgatctgctactaatgagccacatcattttggggaaagcacttaacctctctgaagttttgatcagaaaatgatagtagttggacacatgatctttaaggactcttttttaaaagtaacaattgtattgcctagaaccagaaaatgctattttgagggattatttacatggtcacaattcaactatttctgaaaatagcttggggcctcccactgaggaaaaaacaaaatttttcttctcttaagttggacaaagcaaaaggaaatctgagaaacctcatgtgctcacatatagtacacaatttgcaaaagtgctgtttggaatctgtctcctgctgaggctctaatggccagtttcttcaacagagaatttacacatgaaatatgataatgtttggcaatgaaattagcataatcatagatggagcaaatacagagtacctcaaattaactcaagaacaatcacaatgatattttgcatggtgaaatagcttgttaggcagtattaaagcactgattctttttgttcctggctttattgttagtaactaaactaactcagctttagtagcattttgaagaataatcagacttttgtatgtgctaacatatcaggtctatctgggggtttgaaatacattttatatatttatttatttattgagatatacttatttgatttattcacagaaaaaggaatttacagagatttcctcaaaaaaaaagaaaagaaaaaaaatagtaaaacatgctgttagaaaacagggcccttaccccactgcaggacagaaccatcctcataaatagataagtttttaattcccttagaaacacacacacacacacacttacaccacttcaaactccaatgtatttccttagcaacaattcaagtgttcccttattttgtaacttaagacctattagtatttaggcatatagtgaaatgtttttatttaatttttatataatacttttattaatataaatatgtaatctatagtaacataactttgacatttgataatttatttttctgttgtgtataaattttaaaataaattacaaaaggatcttattaaaaaagaatatatcacaccatcactttctcttctatcacactacttccatgtagaaattcatccaaatcctcctggatactgtttttagtttgaaaatgctctaaaaaatacttgcaactttcctctatgtgaaatttcagagtaaatttttctttatctgaaagaaaatttctaca

SEQ ID NO: 57364 - DNA, 1577 bp, Bovine  19866881223854
taggtttgaaattgtttcctctaaaatgttaactttttaatttcataactgtgatatgtaataaagcagtttaaaataacagattagcatagcttttgaaggcatttgcaatataatggaagtaaaactaaattgaaattcaaagtctgtctgcacttcttcttatgagcataatttatctttaagtggagatatggagatgaaacctaattcaggagaaaaaggaaggaactatggaacaatagaaatctgggcttgaaattttggttggccatataataattgtatgccttgaaattacctaggttctcaatgtaaatttcctcatagataaaataatgataataatgtctatctttcaggactgttgtgagaataaactataagatttataaagtacctagtagagggcacacataaagcaaaaattcagtaagtagtcatttataaaaaatgataattatcatgactactatagaaaattttatataatttcttatttacatttattaaatattatatgacataaatattaatttaaatatgaactgtgtgttgatgctagagtgcataatattaaagtaatgttagtcatgttattttgatatttcatgagtttttattataacagtaaccatgtctgcttaatatgctcaactgttaggataaaatactatatacaatatttctttgaaagaataaggtatgatataaatatgagttagctttacaaccagaatgaaatggcttcacattaatggatttgccatcaaaagaattgctcaaaatgtgcaaaaccaggtaaactggatccatgaaaaaatttgtaattatactctttcttatttttactacatattacacttggcactgtgagaaacattttaaaagtatgaaatgtgacccttttttgtctcagaaatttaaggaccagattcacatatgaaagaaatacactcttaaaaggtataatatatagcttataaaatatgaatatttttctccatgaatgcaactaagttttaaataaatactggactttatgggcttcccagtggctcagtggtaaggaatccacctgcaatgcaggagacttggggatgcagatttgattcttagttctggaagatctcctggagtgtgaaatagcagtccaatccagtaatcgtgcctggaatattccatggaaagaaaaccctggtgggatacagtccatgatatctcaaagaagtgaacatgactgaattgactaaaaacaatggtgacatttacatttgtaaatatgtaggaaaaaagtgaactctatggatagcaaatcattaagggtttttttgtttgtttgtttgttttgtgaaggtccaggtatctaacatttgagcttgaagtttagattcaacctagagatattgctctaagcagtaacagatcatgttcacttagctgagaatggcaaggaacatcaaccaggcaatgaagagtaaataaagaacactgcagacatgtcactaattgtagtgaaaagtagattctgagttgatgtggtcaatatcacatctgggtaggtaaagattatggag

SEQ ID NO: 57365 - DNA, 1690 bp, Bovine  19866881404680
tggctttttcccacctggtataaattaatataactcagttataatttggctagatgtcagacctagaagaaactgaaggaaaaatgggtaaaataacaatgaagtgattacatctagagtgaactcccaggtccttgcattgttattattgtttagtcactaggtcaagtctgactctttttcatccccataggctgtagcccacaagctcctcctccaggggattttttctagacaagaatactggagtgggttgccacttccttcttcaggggatcttgacacaggaatcgaatctgtggctcctgccaagtctcttgcattgcaggcagattcttcaccactgagacactggtgaattcccaggtgcctgcatatgctatgcttaataaaaattatattttctagagctatccagtttcttggtatatgtacaaaactcaatgattttttttctcactaattgcattagtggaatcttccactttttctcaacttccaatttaaagttggttaacactgcagagccttgaattctataagcatacgctgctttcctattattttgctcctttgcttatgctattcttgcttcctggaacatctcacaagtgccagcatggagaactcctacttgttctttaaagagctaaagtgaaaagtgaaagtgctagtcactcagtcgtgtctgactctttgctatcccatggactatatagcctctgttcacagaattctccagggaagaatactggagtgggttgccattcctttctccaggggatccttctgagccagggattgaacctgggtatcctacactgcaggcagacttatattgtctgagacaccagggaaggtaaagtttcatctaaccctagcaaggcttgtttcactccttcaagaatcattcttcattcgtgaatgaatttatgtccctttttttcttgaataaaaatgaataaatgaatgaatgagcttatgccccgtcatgcatttttttgtaaaagcattcagattgtgccatggtgttaaactgccttgtttctggctcctacatttaggcattcagtttctgttgagggtcagaattttgatgatacttattcatcttaaaatctccaactttgtatataccatctgttgggtagaaagttttttctcatttcataggttcatctggctagtctatgaattaaattgacataagacacattaaaaggagaaaattgaaaaaaaaattagtatcatgtgtacatggaactcagaaaaactttaagactaagagatagcatgaacagagtgaatttatttgtatttgcagaatataatgcataaaaatgtacatatacaggtatattatatataaaattatgtataaagatgtgttttatttaaaaatacataataaaactccactatgctgagactacaacatcataaagacaatcaggcttacttcagaagaagaaaaacaacagaactatacttaaaataataagaatttaatacaataatcttggaaataaacaattcatgaattgcaacattttcaatgtttgacataatacttacatggtattccaaatctctgatgattttaatgaaatggaactaaagggttttatatcaagtgttagaatatcaattcagggattgcaacatttacactggtttggataattctatt

SEQ ID NO: 57366 - DNA, 2104 bp, Bovine  19866881580012
caataaggctgaaaacagcttttgtcttactgaatcccttatcatatctggggcatcttcatgaaggaaaatagaagttaggtgacacttattagataaacatctaaaataaaaacaaatgtgggacatgatagttttctctcatcattctcaggagctatacaaaaattaatgttgcttgtggtttcaaagaataaagtttactttctctccctagccttgatggaatgtgcttagcacagcatgtgaaaaaggaaaaaaaagaaaaacataggcattaatctcacaccattacattttagaagcctccttgataattatctcagtgtctactatctctgtagccaaaatctgagatatagctactgcataatgaagccaaacacaccataggaagagaatagtgtttttgctctgatactgcaagttagctgtatattgtgtgcagacatcaacgaacatctttaagcatattaaaaattgagaatacctcaaaagcattgactattttaatgataactttttttattttggaagtgaagcccagtttcttagccctttattgttgcatctatatctcaaaatgaggagcgacaacctcaatgtcctccttatgggcagaattagaatcccttgtaaagattattaagtgtttcttcaatacttgcttgaatagcaccctaagtggggggtcctacacctgaagtcatctggtcccattgtgtatagctcaatttgtcaggctatctctctctttggctgaatcttctctaagtattggagaaggacatggcaatccactccagtactattgcctggaaaatcccatggacagaggagcctggtaggctacagtccattgggtcgcaaagagttggacacgactgagtgacttcactttcactttctcctagtataccactgattagcaactgtttttacaacataaacagtgctctgtccagacattagtgcttcaaactttaaaaaaactcctctttatcttatttttcttaattttctcttttattgataattatcatttgttataattcttaatcatgtaacttgtttctagttttttatcatcctggacatcctgcttcagatttgccttaatgtatcaataatccttttacatatttcattcagaactgaagactgtattccaggtgtgagcagatagctatataacacagcaaagtgtgatagagatggtatttttgttagtgtaaactaatgctgatttttatagcaatcatattttagaacttgtcaactaaactcttgagatttgttttcagtctcatttcctaaaaaataattttagatagatacttaattttttttttttggttgaagagttaacattatttctgttaaatttcaacttctctttagggcttgaatttgctactcacaggtgtatatttataaccctaagattccaaggtctttacctcaaatggtcattacaaatatcgtaggcaattgtcatggactgcattttccaataaaatgaattccttctgtatgtcattgtcaatactcatagcacaatgcttctttctcacaaacttcttctaaccttccctaaagaatttaggcctttcagtcatgtttcagttcaagtcaggtacagactaaagggatgttttaagaattaagacctgtacttttctcctaaatgtggagcttttgccccaaattttaatttttccctaagaaagtaagattaaggaaaggagaatattaaaaaagatgcagtacattcagaaatgggatttttacacctacaaaataagcaggtctattcaaagaatcctcatcaaaataatcaattaacaagtaacattagagtcatttgtggtatagaagagggctagaaatgattcacactctaaaggagcaaatattctagccaggatatttagcaaaaacagatgaacaagtacattaaacattttacatagattattcagctaacaacacatcagaagctacagataagtggatgaataattgtgaaatgagtgtcacagatgatgaataacagggttgcatgtcagcatgggccaaggaaattctgtcaggatggatggca

SEQ ID NO: 57367 - DNA, 929 bp, Bovine  19866881755495
ctagtactcctatctggtttaaaaaaaaaaaaaaggcccagatggattttaggttggaagactcttactctctattttaagcatataacagatttatactgatatttctgcttcagttcttagccaacctcattcctatctgagactgcagggaactgaaggcttgatgaatatattaatccttttgcttatgtatcctgatttttcttctgcaaactcagtaatacctcattaatactttttatgctttaagaggcttaaagtgtgtactttgagtcaaaatacatcaatacctaccaatctcaaaagagactttgtcttacttattaatttgtttaaaatttagctccttaccttacctgcctactgagaaatctctatccaggtcaagaagtaacatttaaaactggacagggaacagcagactggttccaaattgggaaaggagtacatcaaggctgtatattgccaccctgcttatttaagctatacgaagaatacatcatgagaaattgtgggctggatgaacacaagatggaatcaagattgccaggagaaatatcaataaccacagatatgcaaaggacaccacccttatggcagaaagcaaagcggaactgaagagcattttgatgaagcaaaaaaggagagtgaaaaagctggcttaaagcttaatattcataaaactaagatcatggcatccagtcccatcacttcatggcaaatagatggggaaacagtgacacactttacttttgggggctccaaaatcactgcaaatggtgactgcaaccatgaaattaaaatatgcttgctccttggaagaaaagttacgatcaacctagacagcatattaaaaagcagagacattactttgccaacaaaggcccttctagtcaaggctatggtttttccagtagtcatctatg

SEQ ID NO: 57368 - DNA, 1111 bp, Bovine  19866880352850
atcaatacaaggccattctctgttctcagataatagcgttgagactcctggggaatgcagagtccatggcccaggtgacaaaggatcctcagcgagaaaaagccgtaaccagaagttattgcctaaatttttgttctctttgcattttaaatttcctctttagaattcattccagtctgcttgtttctctcctgaaaattcatgtcgctcttccaaagagttctgatggaatatggaatgagatgccctttgactgtttagctgtgaattgagagtgcagaactcactcttattaacacagcgtttcaatagtccatcaactattggaatataaattgaggatctgtagggggcatatattagctgattcctatcattcctttttgaccatctagacctttctctccaggagcaaataagtagaaggatgcatcaaatgactttttcagttccaagtgaatgaagcacaatgttaagtagctttaatcaaaaagtacagccattgaccatgtaaacatgaaattcagggacagaccactcttctgcctgggctggagcccacacctccagcagggcctctctctgtacttatatctcagcctggctcaactccctgcagcttcaggtgggtctcatcttcgtttgggcatcaggatctagacagtctcacagttacagcttctggccaagcacgcctagaggaacaggtttttctttcagtgtccacacgctgattgcaaaagcatctgcaagggggcctgatgaaccagcaccagtggccagttgttgttctgtccctcagtcgtgtctgactctgtgcaaccccatgggctgcagcagtccaggcaatccctgtccttcacaatctcctggagcttgctcaaactcatgtccgttgactcggtgatgccatccaaccatctcatccactgtagtccccttctcctcctgccctcaatctttcccagcatcagggtcttttctaatgatttggttctacacatcaggtggccaaagtattggagtttcagcttcaggatcagtccttccaatgaatattcagagttaatttcctttaggactggcggtttgatctccttgcagtccaagg

SEQ ID NO: 57369 - DNA, 1773 bp, Bovine  19866880510982
ttctatcatgttctttaaagggagcttcttaagcttttacaaatgaattaggtctctttcattggaaactcaccaggcagactcttgcaaagccttacagagcagccgggagcctgagtcattcaggatttaataagaatagcatttatgggcaaagcatcttatcggaacctctaggttagcgggttccagggccatttcctccggttctatttttcacattgattgtatctcggctcaagcacgtcatccagctgaaaattagcccgtgtgtttggaaagggcatcagaagcactgtgtggacgggcaagtttgtgacgatgttttctgaggacagacctataatttcagagctgggcaaaatgacactttgatggaaagtgtgcttgcaaaggctataaaacccggttttgcttttgaattatcccccagccccccaataaaacaaaccataaaatgtcagccggtctattttaaaaaaaaacagcacagaagtggctctgattcagactgcaaaaaagggccatggggacatatctgcacgtgtccctttgcagggggtctctgagtgtctgcaatcttatgcagcaataaagacaaatgaaaacctgctggaaaaggagccacgtctgtgaaatgaacatctgtggatattttacccctagggaaagaacatgctgttgacatcacggaggagtaaagggagatggacaggagaggccatgtttctatcccaaatctgctggtcctgaggtcttggcacaacgcccagggtagagcctcagtttccccatctataaactggataataacatgcactccaggtagttatggcgaggatgttttcatcctgctcactgttaaagcacccaaaagcgtcccaggtgactcagtggtagaggatcctcctgcaatgcaggagatgtgggtttgatccctgagtctggaagctcccctggagaaggcaatggcaacccactccagtattcttggctggagaatcccatggacagaggagcctggtgggctacagtccatggggtctcaaaagaatcggacatgacttagcgactaaacagcaacaaagtacctaaatctacatcctaactattacaggaacgttatcatgttctgaaacacagatttgacggtgtcagtcacctggtccagaaagttccgtatttcttcactgctctccaagggggtcgcatgtagagcattacaggcaggactggggaccgaatgaaggatggccagttctgagcacagacaagacctctatttgattagggagccaacttcaggttgttggacttaggaggcaactcttggcatcttccttcaggctggctgagtactagatgtttctgtccaatgtcagtggggatttatgagagcaaccagcccagtgccaggcccacaggatacagacttgtggttaataacatagggttgggctatcagattgggcaccagggaataggctgcaggcagtgaccaagctggggttaaaatgctgggattcaccttggctgtagaccttggtggccagctggcatccattcagcagaaagacgatgggggacgggcggatgagcttggttcttgcattttggggaaggctatggactgtccttccacaaactgggtaccaagactgcaaccaggcatcattgttaccagttagatttcacttctgtctctcatctctcccctgcttcctgtggaaagcagggaccatgtacagacctcagcccccaacacaatgcctt

SEQ ID NO: 57370 - DNA, 4243 bp, Bovine  19866880523523
tagctgagactgaccatcctggtgcccaggagtgcctgtgacacactcacttgcctcaaaattctatttacccctcaagatgttcacagccctccccaggaagcccctcagctcccagaggactccaagcccatccccttgggagcccttatccgggatttcctgggcagcctcctcaccccacccagcccagaggttcctgggccctggctttcctcccagctcagcccaggagggcctccccagtgtgcccaggtctgtgctctctcagtgttggggtccctcactggcctcatggtggtggtggtggtttagtcgccaagtagtgtccgactcttgagaccccatggactgtagcctgccaggctcctctgtccatgggattctccaggcaagaatactggagtgggttgccatagctgtgtcttctacttcctgtgcatctgatttttcgacactgggatcttgctgaccttggaggggctgctccttccaggaccacatctaccattcctagatgagaaagcaagtatgcaaataaccaacctggagcccacacctcaacctcctcctccatctggcactaactctctgggccaccatgcccctgccttcatcatccagcaccaggtcccaggaaacgagcgactacatcccagagcccactgaaattattcaaactattagccaatcctaagcctgcttaccctgcctcacccattccttcccgtggaaaccacagtaaaggctcctgcccacacttttcctctcatgccctctgcctcctggctgacactggggcttctccatgtggccctgggggtgtgatgtgccctttccttttgagaactgtgatcaactatcatttcaatgacaatcttatcctgatctgttggccttatcgtacctcaaattttctattaatacactgtatcttaaaacagggcatacagctggtgaacgtgggtatttatactaaaagcttttaatatatttgtctttggatggaacatgagctgtctgggtgtcacagctcccaccactccctcttttatcgcatgcacactccttccagactcaggagactcatgagttggtatcccggccagtgatctcatgctcttggtggctgaaatgtgaggtggaaggaatgacgcaccctctgaagggggtaggaggtgtgtgtacccagggatggggccctggtgaactcaggacagggaggaagagtgggtttggttcttcaggccagcttcactctgtggaggctgtgaaggtgtcttcagacctcagcagaacccagaagtaccaagagagcccgtcagggcctgagaccccacctctcttgacacctcagtctgcagtgtgagagacagaggccaggagaggatgggaaagatggaggcaatgcaggagcaggagagatgcctacagagttctggaatgttcctgcctcgcatacctgaaactccacgtctcctgaccagcatctccccacttctcctcctgtcccctcagccctggcaaccaccgttctgccctctgcttctgtgagtttgacaacttctgatgcctcatgtgagtggaggtaaaaaggacatgactccatgaaatagggaccagagactgacaaaaaggacattcacttaaaaaggaaggaagggagtttttaaacattagaactgtgaaggcaaatttttaaaacatcagtagagtggcaggaagagaggaaatccctcagaactggaacagaaagggaagagatgaaaataggcgagataagatcagaggatgaggtggaatggaagcctgacaagagttcagaatggtgtgagggagaaaaccgaaggtagaagactttgaaagaagtggaagtgattggagaaatatctggaactgaaggacacgcattgccatgcaggcaaaggccattcacgtgcggacggatgaagagaggatctgaaagctttcagagaacagaacaggccacagctgaaaggctgggactagggaaggcctcagacttctcaagagccatgctgctactaagacgaccatggggcaaggctttcaacattgggagggaagacgcctttcacctagaattctagattcagccaaatagccaatcaagaggggggatggacagacaacatttcaaacagctaagtctcaaacaaaactattttccagggaccctttctcagaaagttactggagggtgtatgccaccaacatgaaggattaacccaagagaaaggaagacagaatacaagaaacaggagggacacagtcgattcccaggctgctgtggaagggagaccccagcagagcagctgagccccattctggagagcaacccacaaagccaaacgctacaggcaaagggagtcttcaaggggaaaaaaaatggaaacgttagacagcctaatatgttgacagttgccataggagtttacagttctggcgggaaatttggacatacattattaatgctacttaaaaaataaagtagaaacagcaacaaacaaaaacacttaaaattagaacatctgaaagagtggaaagtggctgccccggggtagccagaatgagggcgtggaggggcaggccggagatggctcgttttcactataagtaaaagtgtttctcactatgagccatctcatgttttaaattatgcacgtatgttagctacacacaaattgaatgtataaaaaggaagttagatttaaataggactgtgtgttaagatgcctcaaggataaattctcttcagcactggcaggggcagggtcccacgccggcagcttctcagagcctggtgtggagtgaaccaggttcagatggggctgagaagtagcgtcctgggagagaagtgaagtatcagctaggggctccacagcgtggactcaggtactcaagggatggacccttggctggccgaggaggtgagggcttccgagacctggtggggagcacagccccaggagcctggggcctagacgctcctttgtaccctctctgagatgtgctcactgggcccgggcactgaggtgaggatttagtgcagaccctgcaccccagagtctcaggagccacggcaaagtagggtgctgaacgccgcccggggcccttgcatgctgcccttccttcctggggagaggggcctccggctcggctcgagccagaaatctatacttctaatatgatgagattgtcttcccacagacatggattttttttttttccccgatagcccagccagaaagcaagtctgacttcccgtgtcagcacatttccctttcatcacgagccacgcacatgctggcctggcccccacagggagcccagacccccggcccgccccaggggtgacagccactcacgcaccctgcgcacagccctcggccggtccccaaagcttcatccttccttctctcttccctcaagcagtggacaccaccattcccatcaggcactggaaggaaggccacttcgaggatgaatgttgggggccagagaaccccaggccccctctctccacacattgcaggtgaccctcctggtgcagtgaccctggcttcctcatatgtgggccttgagtccccaactcctccaggcagtgtggccagggcctcagactggggggaccagaggcgtaggccatcagattggcctttgagtgcctggacagtcagccaagaccaacaccaggagctcccaccaccctgacccctccactgggtctgaccccatccctccccttcctaggcagacctttaaccttctggttcctcggctgggttcctcctgctccagctagcatgactattttttgtaaccattgggattgaaacaaaaaaggatttttctaatgacatttccctctggccccaggcagtggaggggctcagggaggggacttgtagtcttggaacaaggttaggagcagggaccaggccaggcggatcagggcttgcatgcacatacattcagatgctagaggaagccccctttccatccctcccagccccagaggcctgtgggcatttcccacctgcaaggtgccatcctgcttgtgtccaggcgtgcatgggcctctgtctggtacagtggaggctgtccaaggaggcctggtccagtctcagaggagcccacattctggcgggaggggacaaggagtgcagagggcacagaccaaggtgggctcaggtgagcaggcggtctgcagggtctccag

SEQ ID NO: 57371 - DNA, 1805 bp, Bovine  19866880576538
attggaaaaaagtggaaacattggcagattttatcttcttgagctctaaaatcactacagactgtgactgcagtcatgaaattaagatgtttgctccttggaagaaagctaggacaaacctggatggcatattaaaaagcagagaaatcgctttgccaacaaggtccatatagtcaaagctatagtgtttccagtagtcatgtatggatgtgagagcaggaccatatagaagacggagagccaaagaattgatgccttcgaattgtggtgctggagaagactcttgagaatcctttggacagcaaggagatcaaactagtcaatcctaaaggaagtcaatctgcatatttattggaaggactgatgctgaagctgaagctccaatactttggccacctgatgcaaagagctgactcattcgaaaagactctgatgctgaaaaagattgaaggcagaaggagaaggggacgacagaggatgagatggttggatggcatcaccgactcaatggacatgaatttgagcaagctccaggagatagtgaaggatagagaagcctggagtgctgcggtccatggagtcacaaaaagttggacacgacttagtgagtgaacaacaaacagcaactacctccactcccctagccttccaagagactgaaatgaaacagtaggtgacaaatcactttgcagactgcaaggggctatgatggagaagccagggtttctggtgagtcctgaggtctcaggagatgggtccctgaggcagctggctctgatggacggccaaggctgaaatcaactgaggctttccaggtgtcacagtggtgccaccaaccaaggatgacaaagagtccctccccaaaacaagtcagaatgagtgttttagccattgtccataaagtgttgcaaagggatcctttttaattcatttgaatgaattcgtgttatctgagatggagagagaaatgacaactcactccagtactcttgcctgggaaatccacagacagaggagcctggcaaagagtcccacaggacttagccactaaacagaacaacaaatgttgcctgagatgctcattactggggtgaccaccactgaggggctttctggaacactggcctttcggaagaaaaatcaaaaacaaaagacgaacacggttcaaggagacccaagacaagctggtctccctaattgctgttactttaccattgctattaaatcccttaaatttactctttatatcttcctctataatccatagcccatgccatcatttcccattactagcaattctcattcttaataagcactgcatgacttccatgatagttttacagccggtacatatttagagtctctcattgttcccctgagacatgcatttgtttctggttgctctgaggcactgatggacattatatctcatccctgcactccctagcaggtgaccttgagggatccaaggtatttctgtcctcccagtttctggaggtggtcacatctctaatctattcctgggagaacagagccattagtcccaggaacaaatgacaaccacagaaaacctcctggggaaacagaaagacatgggtgccttgttctccttcacaacaagggcttgacggaggcaaagctgtaacttttacccccaaccaagccccctctccagccttccatgggtgaggtccatccaggtcacccacctgcaacaaagatgcagaatcacattgctcaatctgaatgcagactctaccacaacttcacttgatttaagtaattaaaatcatgaagatgctgaa

SEQ ID NO: 57372 - DNA, 1420 bp, Bovine  19866880592795
tgtcattctcacaccaggatgtggacaatgatgtcttcggatgtgaaaccttcagacacgttggactcgactcaccacggcaggacacagaccagaaacttacacaggtgtctgttcaccaggattgaaacaaaaaaggctttctagtcaacccccaaaatacaactcaccaggacccgccccccgcacccacccagattcccagagcctcaaaattgccactgaaacagtctctagaaagcattcataacaggcttaccatgttcgtccagcaatatgttgtctggcttgatgtctctgcaagagaaaacagagaagctgaaaatatgattccttgagtgcatggaggagcacatgtcaaacacgacagctgtggacagatacctgacaacacccagtgtgcttgtatctcccccagcgtgaaggctcagacagcaagcaggacggttattattattacgaaagcagagccccatgctcttacttttctcttcctggaactgcaagtggattgtgtgagtatgttttttcctgaatttttaatgatgtctggccagttgactcccaggagtgactgctcactgagccctgggtctcttcggtgggtacagacaattttgcttcctggtggaatttagccctccctccttggtaggtactaacctcccaggtttaatgtcctttgttccatagacctgggaattgcagctctaggagggtcagtaacttgtccgggtcagagatggaccacagcctctgctagtttttgtatgatctcaggagatgggacatttattatacagaagtgaacggagcatgcatttctaaaatctgtgattttaatatggagcttcagaaagcacatgcatgttcatgatgagtacatcagggttgaaggtgtcaattgagtttcttgaaagatcacacccagcaatcaaccagtttttgcagtttgtgagcttaggaggttttctacatttttaaaggattgtaaaaagcaaaacaagacacacacgtagcacacgaagcaaaaatgaaaagaaatgtatcacacacactgatgtggcccttaaaatctgaaatagttattatctggtccttttagaaggttgctgatccggtttagggcttccctggtggctcagatggtaaaaaaaatctgcctgtaatgcgagagacccaggtttgatccctgggtcaagaagatcccctggagaagggaatggcaacccagtccagtattcttgcctggagaatttcatggacagatgagcctagcgggctatagtccatgggatcgcagagtccgacacagctgagcaaataacactttcacttttagggtaacagtgggccatgtgcagcaaaatctgagctaggcagtttctgaaaaattcagctctcctcatctttaaagcaa

SEQ ID NO: 57373 - DNA, 2685 bp, Bovine  19866880611318
caacaggcaaaagactctgaaccacatccttttctaggtctgcagggcccacagggtcaagtcagatgagtaccctggccctacggagttctcagtcttgtagggctgaagaaccatgaatggaaatgcccttgaggcataagagaaaaggaagatacttcaaagaagggaaagccaggtaccgaggggcccacagagatgctccacttgggaatcagggaaggctcctgggaggagcaatagcagaagggaggggcttcttggtggagtagaatttgggcagcagaggtgagcaaagaggcaattgggaagcaaactcactcttccacagccagtcccacgtgctggtgtctcctctcctttgcagagccttcacacccatccagagaggttgagtaacttcctccaagtcactcagttttgttggtagaggcgactggagaagttcaggtttcatatcctcagagaggccttcctggactgcttctgcgggtctccctctgcctgtctccctcacgccctgtctggtcacgccttgtctaccccactgggaggctggctccaagagggcagtgaccttgcgtggctccctgtctctagcacctggagcacagcgggggcccaaagacttctttcctggggttccgtgtggtgggcacacattctggaccaggttccctggtccctgactctctgaggtccttttgtctccggatgcctctctctcagctgccttctgactccaccagcctggtcttccaggtgtgcagggcccatcagctgaacacagctcaggcctcctggtcagggcgggcgtcccccctgcacatttctgatcgtcttaggagacgcatacggagcaagaagataattgaaaagattatccggggatgggactggtggatggttgatttatcgcgtgtcatccctacttcagggtttttattagaaattgaagaatggcttcccaacttgagcctcggggctgcgtttaacctccagccgtcatgccgacctgcactgttttccaggctgtctgcagtcatcacatctcagagctctgggtgtgatcccagtagcagcagcagctaccctgcgctgagacccagcctccccgcttctccttcttctctcctccctcctccccttcttctctcctccgtccagctccagctccccacctcctccttccacttctcccttcccttccctctcctttctgtccttgggggagttgaaggaggtggttggtaggatgggagggggctttactgagaaggtggaggacccgtaccgatgttgaagtcgactccagcctagatgcttagccattatccgggactcggctcaaatgaccttcttccatggggccagccttgattctcccctcctgtgtgtttccagaactcctggctggcccttctgttcataggaatgcattcttcccacctggcactgcagttgcctcctccctctctgtaggggcagaggctctggacgagggggtgtagtttggcaggggcttgacccccggggggagtgggagcaggatgagaggccctgaggtgggggcagctaacctgttgggggtcaatgacaaacaaggaagatcggctggggaccagtgtcataatccaggtgagactacaacctggttgagctgtgaggctttgagatccattcctttacctctctgaatcttgtcatttctcatttatattctggtgataatgacacccaccttagatgctcgccttggaacaatattgtcaactggaccagcccatatcaacttcatctgaaatgcagatctcaggccctacctttgacttgtcgctgatttggaaagtctggagtggggccaagcaagccctccaggagactcttgcacaggagagtagctgctgagagcaatacccgggataaggcaggtgaaggcgttggcgcagagaggcagtggggactccatgtcccttcttgcgtgctgtgatgaagccatgggttttgttctgatggcaagatgctgaccagaaaggagtgtgtgatccggggtctgtaacagcaaatgccggcagacacacagatctgcagagcgccttcccttcccaaggcctcctcgagcttcaaggaaggaaacagcccctggggcaggccctactgagggaatgctggaagctccaatctgagaaggaaacagcccagggttccaagcagcctgggaggaagccttgggaaggaagggcagcaagctgcttgagaatcagtgcagggtgatctgagctccttttgtgttccgcctgtttctcatcactagacctttctcttagagagaggtggattgcccgtttactacccttaaggaaggtgggggcccagagctgtgcaggtaatggacacctgcacctgggagagagagagagaggcaaggactgacagttcctactgtgggccagagatctggggagaagcctgggtgaagacagaggcagagatggggacgatacagtcacaaggaaaggaacgccatgggaagtgaaagagcctggaacaccttctctcctggagccgttggaaggcacaggttcagctgatgccttgaccttggacttctcaccgccagagctgtgagagatgagctttctgtggtttaaagccctctatctgtgatcctttgctatgtcatcc

SEQ ID NO: 57374 - DNA, 1324 bp, Bovine  19866880669206
catgctggacactagaaaacacagcctttagagtccactgattcccattcccttttctttgtacaaatgagaaaactaagcttaagattggttaattcactatcccaagtaagcacaactaaagcatatcagagtcagcctgcttcccagatcgaaagtgtttccactgagatatgtagaaattcatctgccatgcctcaactgtcctagaattaagtcataaaagtgttataaaactcttcagtaaattcttgctaaaaccaatggattgcctgcagctgtttactttggtgcttcactggggaagcacaatctaccccccgcatgaaagtcaaataagatttctgcaaattcacatgtgctttttcctgataaccaaggctactgtcgtactttaacagtgaaatgtctttcttgaaaactcgtaataaatgccagctatcaaacccaccaaaggctgaaagcaaagccaaagtacccattcaatagtaggaggggtggttctcttcatcctagcccagcacacttccaccctgagtctcataatagtcatgtaggctcatctacattgacatgaaaagcagtagttatttggtattttgaccagaacagagctttgtttgattgccttgaagcaaccacatcctgaatactggctgtttgtgtacgttctacatgaatttgggtgtcatcaagatactgccacaacctaagagtgacttaaacataaattctcctctagaaagcttgcatttttcttcagaacacccactatacccaaagcttgaatatatttatgctctgaaccacaggttctgagaaccaagccagcagccaaagagcagcacagatgaagacagaaaaggaaaagaaaactttcaggatataatcaagtaataactcatgagggcccaggctaacggatctgatagtactgacaggaaagggtgcaaagggctcagggccaagatcaccactgactccagggtaaaatgatacacttctacgtggtgccagttgtgttgtgggttaagggagttgcttcaagttttcttcagccacaaaacgctcaacattagggtaagtgacaacagaaagtaatgatttaagagaatttttaaaatgttttgttgttgttgcagaagttcagccctccccatgggactacaggcaaactttctaaattctctggatcataactcttctaagaaatctagagaagaacctcaaacgcagcacataaactctgtccacgtttctggctgaagtaactcacatgcatagagcagactgtaagcagtacagagcagaagaaaaaaagaaa

SEQ ID NO: 57375 - DNA, 1072 bp, Bovine  19866880699871
gaggggcaagggggctcagattgagggaaaaaaacttcacagttcaggagcccgttcagaattacatattgcatttagttgtcatgtgtgtttctttaaaaattatataagttgctttttacttggtagtggcctatgcttttattcattcatttccatttcttgctattgtgagtcagtggcttgcaatttaaagcttttctccccctgagaattataactgttttttaaatgactaacagatctggtgatggaaaacacagaagtccacgcacacctggatttgaagcccaaacctaccatttttagatgtgggatctgggcaactgctctacctccttgagcagcaattttcttttttttttttttaaatgaaactttattattgttatttttcgtatgtacaatattacatttctacttctgtaaccaccacagcatgctttgggatcacctgcaaaccttaaatctgccgatgctgagggtcgttgaccccaggaagtgggctcatcgttctccgtcctagactcacaagtggaaatcagggggaaaaacaggagagtgactaaaacagtaattaggggagaacagttatgtttaaatctgaaacactcattagtcttgaagaatggaaaccttaaaaggcaatttatatgcaaacacttccaatgttctttctgcaccaggctgcactctgtcattagcttgccaaagaccacctctaagaaagatttttccctctgcctttttcttctttcttaattgccatgctttctccagcttccttgtcaaattaatgcggactgaagccacgttcttacccagagccttgtccggcaacaaaaccgtgcacttcattattccgccagcccctgatggctctggatctcagaatgtaaagccagaagcagccttccaggtgccatgcacaacggcctcactttcctagtgagggagccaaggtctgggcaggagaaggcacatgtccagggttagttccttccttcatcttttatctgacagatgttattaaatatttattgaacaaccagttcacacttggcacaaggga

SEQ ID NO: 57376 - DNA, 1051 bp, Bovine  19866880701862
agattggggtgctttgagtgtttgagctgccactgattcgggctgagcttagcaagagacccttccccttgacatccctctgcgcacaagtagaatgagggcctggaccagaagctggttaagagctttttaacactcaggacagtggagctggcacatgggccatcaggacagacacccagggctccttgccagcatggtgcaccacccatgggacatggccatccgactctacccaagcctggtaggacctgagttcccccgccaacttccacagtccccatgctcaccacacagacacacatcttacccagccccgcagcagctcgtaggctgtgacacccagggaccaccagtcaacggggtaggagtacccagggcctccgtccacatacacctggaacacttccggcgctgccaaagacaggacaaaagacatcactgggcatctcacttgacatgcatcatgcccaagaaggaggacatggggccaggagctggactgtgaggctcacatcccatcgacgatgctacgtagttactaccatctgtaagtcacaagccagcttgagacaagctgcaggcaacgcaagcaaccccatgtgacacctggggcagaatacagacagggcgccccgctgcagagggcggtctgctggggagtcagggaaagcaggcagggaggagggtttggtggagcatgaatcatggtcagcatggggaataaagtctgagttaagaggaagagcctacaccgtcacggagcaggaccctgtggggctcctgggcacaaagactttctgtgcccgccgattctttgatgacaggaaatgagcttcactcagtgtctgtgaccttcccttagctccaacctgtagtttcaaacagatgcaaagcaaggatgggaggggatgcagagacaagggaggaacagactagaaacaataatgcagccttggggcagagtcctggtcccctcccaagcgatacacataacattttggagctcttctgcagatactaaaacccccaccaggtgggagaaattaag

SEQ ID NO: 57377 - DNA, 1509 bp, Bovine  19866880737804
gggaagccgcagtatttttaaggtgatgtaattacctgttcgctggtgaaagtgattttggcagcagagcacctgatagactcattatggagtgcaagtgtgtctattccaggaaacccagtttacaaaaattccaatttaccaagaaacagaataagcaggaaaagaattgccacagacctgttattttaactgctagagctgagctgggccttggggaccatctcatccaatgtttttcccccaaaatctttttgctcaaaatccaaaacatagaacagatgcaagtgaagaacagttccccaggttgcttaaacctccagcagctggagaaatctttttccctctatgaactgttgaatcattcctgcagagtcctttgcttttaggaagcaaagcttgaaaatcccttgctttatgggaactggaggagcaaggtcagagagttcacttcaccccaggtttctaacttccagctcagcgatctctctgcttcactgagggataggaaggcagcgttcgactcaagggccacctctctcactttgctgggttaataaaccaatagatgctcgtctctgtggttgagcccaccacttggcgtgcatccagaggttcttagttctgctgcaaactgtaggccctccatgcatgtgtgtgtgtgtgctcagtcgcttcagccacatctgaccctttgcaatcctatagactgtagtccgccagactcttctgtccacagactcatccaggcaagaatactgcagtgggcagccagtcccttctctgggggatcttcctgacctagggattgaacctgggtctcccgcattgcaggcagattctttacccactgagccacctgagaaaccctaggacctccataaccctcctctatttcccatcacccccaccttctctgtctactgaaccttaaggagaaatgctgactggagtcaaagccaagggtaataccaggtgagggaggtggttgggaggaagcagagagggtagaagtcttcacggtgccatagtgtggattttagggctctacctgcggctgcatgcaaagcgcattgtgccaggtcatgggcacaatgtggcctgacgttcagaatctcctttcgctcatgcccttgagtactctggcagtggttctcaactggggataatttgtcccctaagggacgtctggcaacatttggcaacatttcagttgtgggggtgattccagctggtctctagtggttagaggccaggaatgctgctaaatactctctaatgtacaaggcagccccccacacaaaatggtatccagacccaagcaaccatagagctgaggctgaggaatcctgtgctttgcaaccaccagcccagaccattcaagagctgcagcaaaactgggcattctccagggaagaatactggagtgggttaccatgccctcttccaggggatcttcccggcccaagggttgaacctgcgactcctgcattctacttgtggggagag

SEQ ID NO: 57378 - DNA, 792 bp, Bovine  19866880746132
aactgtgagacaaccacttctgtggcttaagcacccaggctgtggaattttgtcacattggcacaagcaggccaatatggttggcttttgtcctgaggacactggggaaatacagaagggtttaaaaagtggatcccagctatacaactgtgaatgaaagaataaaggaaataacatacaaacatacaacgtggaagatatggcatttggggggaggggaatgtttttctaacaacagggtggagaggagtgtggaggtaattccaagagtgttttataaataatttattgccactgcttacgcacacagttttcctcaggagtcataagggacttgctttgttaggaaatgccaaaaggcgtcatggggacaagggtccaggaccagccctgttacttctaacccccttatcctggaatgtactctctaggatgaatcaaggttggcaccggtttataggcagagaaagtcctcaggaagctcatccagaagatggactgagacgtcattgtgggaaaatgggaaatgcaaatgagtaatgacgtctgttactaataaactggtcagtaatggatcatttgctctggccaagcttgaaagccattcacgagtgagcctgcatttcctctgatatttagctcttaaagcagtccatggaagccagcaaattcctctaacccatgcctcaagccaaacacagactaattaatatgaaaggaataagtgtgtgtgcatgctagttgctcagtcctgtctgactctttccaaccccaggactgtagccggccggg

SEQ ID NO: 57379 - DNA, 3021 bp, Bovine  19866880752530
catataataatcatagtagccatagtttacattgaacatctatcaagtgctggtctcccatgctagatcccttcatctgcattatcgtacctttttatcataacccttttggaagtggctgagtgccaaagaattgatgcttttgaactgtggagctggagaagactcttgagtgtcccttgggcagcaaggagataaaccagtcagtcataaaggaaatcaatcctgatattcattggaaggactgatgctgaagctgaagctccaatactttggccacctgatgcgaagagcagactcattggaaaaattccccacctgatgctggggaagattgaaggcaggaggagaaggggaagacagaggatgagatggttggatggcatcactgactcaatggatatgagtttgacagtgaaggacagggaagcctggtgtgctgcagtccatggtgtcgtaaggtgtcagacacgactgagcaactgaacgacaacaacaacattctacataggagaaaatagtttagaaactttaaagaattgtgcagagttgaaaggctaaaaagaaatagaatcaagttgtggcccctcccaaaggtctacttccaaaacccagaccatttcatctttgccccaaggacaatatgtttgttcttacttctccaaggacaatatgtttcatgttgctgctgcaaggagttttggtcaaatatgtgaattttagagactgactgcctgatgtgggtgtaacttcgcgtttcctagaaggcttaaattatgcatcattgaagcgcttccattggaaagttaaaatgtcaaacacacgcccacagctcagcacatacgtaatctagcagccatttccttgaaaatagcatcttgttacaaaggcataatgtcgctgactgaatctccagcctacgtatgcaaatgtaggttctctaagtgcatttgaggaaagaaatggagtctggttggggccaatggcttgagcgctgagacatcccccttccatagctccaggcatgggtcacctaacaaagaggccaattcagcactgcagttcagcaaagatgaacatggggtgacccctggatcactctgcaatgagccatttccttcttttcaggatagcgagcatgtcttttcaagtcatctcaccatcctggacctcagtttcctcatctgttcaatggatataataattgtgcctgcttcataggattgttgcagaggttggacaataatacacaggtctgtatagtcaaagctatggtttttccagtagtcatgtatgggtgtgagaattggactacaaacaaggctgagtactgaagaattgatgcttttgaactgtggtcctggagaagtctcttgagagatccttggacagcaaggagatcaaaccatccattcctaagggaaatcaactctaaaaattcattagaaggactgatactgaagctgaagcttcaatactttggccacctgatgcaaaagagccaactcattggaaaagaccctgatgctgggaaagattgaagacaggaggagaaggggacgacagaggatgagatggttgagtggcatcaccaactccatgaacatgagtttaagcaagctccaggagatggtgaaggacaggtaagcctggtgtatgctgcagtctgtgggattgcagagtcagacaggactgagtgactaaacaacagaaagtgctcagagcaatgagccagcattcaatgaatattagttatttatcatcatcattcattatcacagtgcagtcagttcactctggagtgatcactgactttggtgtctggtagcttgcagatcaaatgcctgctctgttgtttattagtcgtgtagcctcagacaagtccttatgctttctgaaccttagtttcttcaatctttctaaatgctaggtgcactgctaagcacttttaatgctttctgtcagctcccaacaataccaggagatagattatagattaaggttcaaagaagttagggattccctggtggctcagatggtaactaatctacctgcaatatagaagacccaggttctatccctgggtcgggaagatcctctggaaaagggaatggttactcattccagattcttgcctggagaattctatggaccgaggggtctggtgggctatagtctgtgggctcccaaagaatcagacacgactgagcaactaacactttcagagaagttaagtgaattgctcagtgtcacacaccagtagttggtggaacccgatttaagcccaggtctttctgtctccaaagttctttctcttaaccacctcactaagctacaggggttggaaaccctatgtcagagggtactagggaggtctaagcaagatctgaaatgtcaaatgccagttaacagtggttaaaatgaagtggtgctcaaatatcctagtagaaatattttatcattatgattatggacaatagccacatagctgtcccacccctcttttccccttccccttcctcatcaagcctttcccaggatgtcctaacccattgtgcgtatcttgcttttcacctcgcctgtccttacgcctgcatgacagcccaggcctgtctgctctagccttcttgtcctgggccctgctatcctttctgctccaccatctctgtatgttcgcaccttagctggtcttacatcaaaaatcccaaacccttccttttccttggagacttttcttgccctcacctcagactaaacctgaactcctgtgcttttgcattcttacaagtgtgtatcatgaactccacttggggcttgattgacttgccagtcattcccttgttagacattagactccatgaaggcagagatgggaagtggagttcacagtcatgtgcccaaccctgcagtagccactggtggatattcaacagcagataaatgggcatttaatacagtcttaaatctgttccttgggacatagtaacacattacacagtgtacaagagtgtattttgatta

SEQ ID NO: 57380 - DNA, 1515 bp, Bovine  19866880788576
gataagtgtctaaaaccttggtgctggagattggctccaaagagcctagtacttgtagagctcaatgtgaggttaactaatttaatccattgtcaagttcagtcaaagagatgagaagagaacatttaatttcaagacgcgtaataaaatcttattaaggtgggctccactaattcggaacatgaagcaattcagagaggtaaaatgaagcttttgaggagctgatttataatagaagcaagattagagacaccagttccaaaccacataggctactaataagttttcaaatattcaggtgtgtatggtcacatagcaaccaagatatgctaataacaaatgttattattcattcattaaatagttcattaaaatattttccccatggtaccgctccctctctataccttattagactttctactccccgcacaatgttgatatacatgggcctgcctcacttgagctgtttttgcacgaatcaccgccacgcatccttaaattaaacagcactcactgcatgcctgatgttcggatgctccccggatgtgtggttgagaaaggcggatggccactcatctgcatttgaacgtctcatacagggtctctgtaaagcttgagatgcctttaagcataacatccagacctgaaactggtgactggctcagggttcctcagacatctcattattcctgatacaaagctcaagagtgctggcaaaatggaaattgttagagtgctttagactgatgttccctctcactgcacctcatataaaagttcaggattgggagggagagacaggatacaccttctttgtataaacactgtgcacagcaggaattctaaaccagttggacatcaagatctcccactgggggaattccctcgtggtccactggttaggactctgagctttcactgtcaagggcctaggttcaatccctggtcggggagctaagatccaacagccatacagtgtggccaattaaaaaaaaaagaaagaaaattaggatctttcatcgtgtctctcacctaaacacaaagagaagatacagagtttggatgcgaggcacctctccacacatggtccctttaactggcacctccttcctcttcttttttgctccctgaaaccctgcctcttcctgggaatagactatgatgttggcatggtcaatagatgatgatgctggcatggtcaacagacatgacccacggaggactcttgggctatgcggctgaatgtcctgcaatggaggtgggtggggtctatttctaccctccctcctgcccaaaccaatcagtcccccagagactgaagcatagcagctctctttcacttgtccttcaggacacaacctcatgtattcactcagaaagaatttattgaacaaatgcccaataatcttctgcaaaaaaaaaaaaaggcagtcttattgggaatcaaagacacatgcattaaaacaactataagagatcatcttgttttgcttctgaaattgcctggtgaga

SEQ ID NO: 57381 - DNA, 1058 bp, Bovine  19866880832348
ataaattcaccttttgcctaagtatttttagattcaaacagtttaactttagaaagtcttgtattattacgtataattcacacagcaattctttagcttggactatctcttataactccacttattttatagacagagaaaatcaagacccagggaaaggctatggtttatcaaggccacagggtgagtcagggctgcaagcaggtcctgctgctggtgttctgaatcagagtccaaggcctgggtgatatgtcgcctgtggattctgggcagactgcatgtgaaatacagactccagccttggtgctagttctgtggcctttgctcacagttactatgtcttctttgcttcttttagatattataaggttcttcaaaagttgaggcttttagaccaaaatggaataaatttaggttattggttatgaaaaatttcaaggttatgaaaaagatattatccgaatagagtagatagagctctatccagatagagcagagctgctgtaaccagtcatagaatgtcacgtggagaaatgcgtttggccacctttcctattgtgactcttcctttgttttctttattaactgatttgcttgctaattgcgacacacgtcctcgtacctatggggctttggctatatgagagatgattctgtgacgtgtttactccattattgaacatacaaaaattccatattcattgctaattgggtcatctcagttactaaagaggaaaacggcctcctggcatattcagatgaaattatcagtttcaaaatattcatctttttctcttctccctgactacttcagtggaggccctcacaatatttgcgtgaactaacgaatccaagatctcctgattcattcccctgctagagacgccttctaaaacaaaactcaaccatgtcactttgcttcttagagggagggaggtgggagggggcttcaggatggggaacacatgtacacccgtggctcattcatgtcaatgtatggcaaaaccaatacaatattgtaaagtaattagcttccaattaaataaaaaaatttatat

SEQ ID NO: 57382 - DNA, 1889 bp, Bovine  19866880872529
tgagctcatagcagagacattacttctccaggggtggtggctggtggcctggcaagggagagccctggcagatggaggggctggcaaatggaggcctcggtaattgaaatgactgatggtgagtcatgcacacacgagcagagtgggaacagctgtggagggggaggtggaaggcccatctgtggaacctttccagaaacccagatctgtttctgcagagacaagacagcattcatcagaaccgttctgcccccctgaagacagacacacacacaaggaagaggctgagccagggcccgggaagaagaggaggttgggggttgggcctggggtgccttcatctttgagtttcattggctatattctctgctttctcttttctctttaattccctttatattgttcattccacctgggtcacagtgccattgcaggttcatcccattcttgatccacttgattctgaacttctttagatggttctgattttccatgttgatgggttggcaaactgactcatggaacaaatctgatgtgcctactgtttttgtaaataaatttttattgccacacaaccatgctcatttctttatgtgttgtgtgtggctgctgtcacatgaccaaggcagagttaagtagctatgtgtcccacagactgaaatatttacctcacagcccctatcctgacccctgtcatctcccatctgtctccatcttctccaacttcctggagaactaaagcctctttgatatgccccaggctgatcctgccacttttgccagctcagactagtgagagcagaaccagaataagaaataggcttttatttttctagccatgtaacaaagagaggcccatgtgatattggttgtgtatttgttgtctctcatctggatacttcctttaattccttcttttttttcctccctccagctccccactttttaatccccaattccttttatgtacatttgttcaaaaacaaaacattatctgagttgctatgagttgctatgatgttacaggccctgctgtatcggtcaggatgggctaagctatgctgcagtaacaaacagccccctcttctcacggtctctaaacagcaaaggtctgtgtgttgttcgtgctacagttcatccagcctggcctggcagagggtcctgtttttcacagggatccaggcctgtaggttgatgatatatggagatgtatcatccatggtgggccagagggaaaggaagctcagctcccaaacaagaagcatccatctctggtcacagctcagggtgagttacagggctctgtccaatcacaagggggtcaggaaacgtgtttcgaccacgtacctaggaaggaaggagaactagatattgttgagtagaatgaatgataatcaaacaccggtgatatagagataaataagaataaatcatgatctctgttctggaggagaaccaagtgtcacacatgatttattgagttcttactgtatacacagcattttgtagttgttatgacctttgatcttcacaccagtcatgagaaatttccccacttacaggtgagaaaactgagccccagcaagactaaatgactgaatcactcatgggtgggacttttaggcataattctggcttcaaactagagctctgtctctgatgctacaagagcccccaggctccctggtcaagctctgtctttgaattcccacctgtgacttccaatgcctggtcattgaggtgggacaggaaggaagatccatttaagaattcattggtcacctcatggtgggttggaaagagatgagagagtctaatcttggcttgagtcatccaaagcaatcccttccacttaatacgattgtgttgttcagtgtctgaccaattat

SEQ ID NO: 57383 - DNA, 1293 bp, Bovine  19866880901876
catattgaaaaagaatgcaagcagacggtatttactctaagtgaaccagaatcaagttttaaataaaataggcttaacttaaaagataacaaaagctgatctagcagattaaaaaaaaataaataaaaaaaacacaacggtttggcacagaagacatcctaccccggagaattatatgagcctcctcagcatgaccatgctacataaaattacaggttaaatctgctggagtttatagctttaaatgcaagtctggtgaatgcttaatcattctctctgtgataggagcagcagccccgagaatctactcaggaaaactgaagtcagaaaaagcatcccagttcttattttctgtgcctctatttggtattcgagacgcaacacaaaatcgtattctcaatcccttgtcagattcataggagcagccctagactgtaacttccctggtttatccacagttaaccttctgtggacagaagacagatcctctcagggcagagaagcagatggcttttattttattgatttattttgcagggagtcaaaagaccgcacaaagccttaccagcatgtgagccaggcaagagagccagatctgtaagctggctttgtctagaacatggctaacatcaagtagctcagccacgctcattcaggaggctgagtgacactccacattgtgcaggagaaaggagagtgaggtataatacttacttcagaataattcagctggcagtacaggactgattcctgcagccacaaagagtcatgaagagagtttctggaggcttcccagcctcagctgtctgatagggacagcagagtgatagagcacaccaccttgtcatctgtaccccatttccacatctggaggtcttcctggttggaaatgagtcttggtggggaggctggggtggtcagattaaacacctgactctgtctccttgaccaaaggcctcacccagacccggtaggagaatggagttcttatctgtcttctttgggcagtgggcttctgaagacaagggtccagtgaaatttcctccgtctttcagcacctgaaaaatcttttttggtaaagaatattttatggagttgtaagtaggaagagttaagagctgaccttctatgtggaatgaaaacataaacctctacttacctttgaagcatatatactatgtattagccttaattatgcatatggattcacttacatctcttctaaatctatagctgtgtagctcacataatccttgggacaaatataattttatagatatagacacagagaac

SEQ ID NO: 57384 - DNA, 1612 bp, Bovine  19866881039972
catttcacatgatatactctgtatataagttaaataagcagggtgacaatatacagccttgacatactccctttcccaattttgaatcagtccattgttccgtgttcagttctaacttgttgacctgcatacagattttgcaggaggcagataaggtgttctggtattcccatctcttgaagaattttccatagtttgttgtgatccacacagtcaaaggctttagactagactagcctagcctttttgtttagcctagtctgccttaaatgtgctcagaatgctgacattagcttatcattgggtgaaatcatccaacacaaagctcattttatagttaagtgttttttttacctatttgaatatctacctttcacactggagttttcctcaaatgtttagggatgtttagtggcttgtttggatgactggattaagtttatttatttattttttaaatttatttattttacttggaggttaattactttacaatatgatagtgcttttgccatacatcaacctgtaagtgttgaatagctcatgtagtttattgaatactgtactgaagtgagaaacagaatagctgtctgggtgtagaatggctgtgagtatatcggctgtttacccttgtgaacttgtggctgatggaactgcagcctcttctgctacccagtatcatgacactgcatattgtatggttgagaaaagatgaaaattcaaaatttgaagtgtggtttctcctgaaaccaaacctattgattcttgattctttttctttttctttttttgttagttgtcagatatgctaattccaagagttctttctccttctctgatggttcctttttcattgcaccttattgtgtttttttgttttatacagtatctcctcctaactctctgaggatattaattgtagttattttgaagtttcctcttctctgcatttatttctgtttcctctgaagtcctttgatgtttttattttctctctgcttttcattttgaaggttttcttcaaatggctactggtcattgataaccattaactgatagtgaagaaggaggcaataaaaaaactggttggtaggtcctgggcctggagggcaccccggtggagcatcagacagctagagctggtggagaagctcctccatgggatgatcacgctgcaactggacatgtcagtgtctgaaaatcttcactctctggggcctcttcagtcttgtgaatgggtgttgatcttagcctggcctctgaggatgtggctacaggacaagacatggaagttgggacaccttttatgagtcagacctttctttattcccctgctcatttcagccatgtgcacatgtccacccttccctgtgagtgactcagcatcataaggctgggagtggatttgtgggtccaacagcgtaggtgaagagtgtcagctctacatcccctagcacagcccatcttcagtggaccccagtctttccgtagctggagattctctgaagttctgtgagtaactggcttgccaggctcccctaaaggagcactgacataagaccttccaacagtccattcagttggctcctccttctgctggcttttttttttt

SEQ ID NO: 57385 - DNA, 1428 bp, Bovine  19866881204197
atgaagatacaaagccaccttgccaaaaagcctaagaattacatgactggaggtaaaagcaggaccaccccacataattagaggggtccagtgcaaaatgagaaggcagtggcaacccactccagtactcttgcctggaaaatcctatggacagaggagcctggtaggctgcagtccatggggtcgctaagagttggacacgactgagtgtcttcactttcacttttcactttcatgcatcagagaaggaaatggcaacccactccagtgttcttgccttgagaatcccagggacaggggagcctggtgggctgctgtctgtggggttgcacagggtcggacacgactgaagtgacttagcagcagcagtgcaaaatgaggggcttcctccatgactcagcaggtaaagaacctgcctgcaatgcaggagatgcaggagacacactttcgattcctgggttgggaagagggcatggcaacccactccagttttcttgcctggagaatcccatggacagaggagcctgtcaggctgcagtccacagcatcacaaagagtcagacatgagtgagcgactgagcacaacacgtgcaaaatgcacatgcagacgccctgttcaaatcttgttaaacttccctctcagctgtgtcttcctttccctcggtagaaggaacagagggagacacgacagaggacccctcgactcctctctgtggtctgcttctttaacctgtccctaaaaatgtaaagctcaacaacttgtagcgaggagactccagctttccgacctggtctcagttcttccgctttctatagaatttccccttctcccaaccaagattttcttatttctaaattaagtactttaaatttttttggatgtattaactcgaacttcaccatggaccaaacctgagctaattcttttgtacacatcattgcactgaatcctcacaacaaccctcagaggtagacttgatgtttgtcccactttacaggtgaggaaaactgaggctgagcaaagttgccatacccggggctagtttgtttcagatagacctgaggtcccttcagtgttgacaggctggaacgcggtgactcttacacattttggcagcacactcccttggatgaaatacttccagagagactgggccctgaaaatagcaactcttaaaatattaattctctgtaatgctccacacagactccgctttctaacgaggcctcccacattcctagtaaaatcagagaagggaaatctcctccatttgtggttccagtctgggccctgccatcagcggtggctgggtggctgtcaggtctcttttgcttccttcctttgccagctgatcagtacctgccatgtctggggctttagaacccgctaaatgaacctgcttggctccctctgcacacagatccacg

SEQ ID NO: 57386 - DNA, 1593 bp, Bovine  19866881427147
atgtggacctggggttctgttttattgagggtggaggccttggggtttgtgggttcactctttattagtgaatttaaaacataaaagcaggaatttaaagtatcggaagagaaataaatgaagcatgtggcccaaatagtcgttaccaaaatcaaccaagatctttaaacaaaggaacctcagtcaagggaggaagcctggctctttatctcgccatatggctggcaatatgtttgtttgagatagccgtctttgaagtgggtgcctttttgaaatggatgtctcagcaatcaaagcttaagtcaggcacttgcgttacaaaaaagaaaaaaatcccaacaactatcaggctttacactacactagtaaatactgcattttgacaaggctgatctatactgacaaaatctgcattttgtatcttaccagctaatgctgtgggaaaatgtgctaaaaagatgttgaattttaagttgatgaactgtgtacatggtaattacaggttgcaagatggtgatgatgataaactcggcacgtataaatctttgccatggttacagtggccacaattataggaaaagatattgatatggtaggctacttggacctttttgtaactaagtgtaggtcagaaggaagatttttatttcttcgctgtgaaattttcctgggcagtgtttttctttctttaaattgttatggaagggctgggtcactgggggaaggagggcaaggagataagggaaaggggagcttcctggctcaggcctcaccatctgcagtgatgctcttaggatgggctgctctgtctagctaggggactgctgagtttctgaactgtaccctggaggcagttgacctcatttgtgtggacttcatcccccatgtttctctctatatactcaggaactggaacgtggcatggtacaatgtgcagaagtccccatggtatatttgttgaaagaagaaatgaacctcctaccatttgttacgttgagtggctttcctcatgtcagtttatcaaccgcatggaaatttcatgaccatgaaaataagttgaatgcaacaaaaatattatgtttcactaccctgtctcaccaccctgtccacctccctcctgcacacagtcatgtccttttatagtccagccctcttgttagcccctctttatcctccaatctcaccccagccactaagatgtcattgcagtaggcctgtttgcccattcaactgtgaaggcttgtatcattaactcatcatgaaccatacccactgagcccagtcaacttcagaatactcctggaggcacccccagtagcttatctccaatgaccagagcaggcactggaggtgaagcctctccctggttgacctgttgttcagactgtgtacctcccttccatctttccaagactgcttcttgtctcttccactcaaggttaaatgatcgaaatagctcttgcctgtttccttgcctaagacacacctggcagctttgtacaacagcccaagttccatgtaattctttgcaaggatgctctgctagaaaggcaggagattgggatcccttggtaacatcacagtatcttaggg

SEQ ID NO: 57387 - DNA, 1104 bp, Bovine  19866880352158
ggggcagagtggatactttgggggacttgatggctgtgcccagatccgagccctccatcctcacatgaggacttcatctcttgtccccagaacagggagagagaagccgggaggctgtcgagcagtggcgccagtggcattacgacggcctgtacccatcctacctctacaaccgccaccacatctgagctcagtttgagggacacagaagattgagcctgagacacccgcttacccctggtattcgggcacctctcccgcacacaaacaggccccttcacagggcctcagtcacctagggccttctgttctcatggatggaaacgcccaggcttgcgcttcttggcagatgattttctgaggtgagcaaaggcctgtggggcctcttggtatccctcctagaggttccctgttgcttcaccatcgctcccacactgagactcctggtccacagaaagatgagaaatcacagtagagagaaaagatcgtgtatctgcttacagcttatgaataaaaacgctgagtcaacactgtatcgtcttcttgaatctcatgctgagtggcgccaacttgtccctcccaaatgacagtggggctcacacagacttgggtatcaggaagcttggacttgggagcatgtctcactatttcatcagcctgtctcagtagttatgtgactgaaagggacctgtaaatgcaactgtttgggtaaaaaccattctctgagcccaggtgcttctcacgtctctaaaaagtcttaaggttcaatggtggtttcttaatggcatcaatcaaaagccagggttacagtgaggccagctgtaaccaaaagtagccagcagataaggttcagttttagtaccatctcctttttcttcatagtgttagtttgctagagcttccgtaactgggagacttaaaatgaacacttatcctctcacagttgtggaggctggagtctgaaatcaaggtgttggcagggccacactccctcccaaggctccagggggaggtcctctctcgcctcttctaacttctgggggctcagctgtcccctggcttgtggcagcattgctccagtcactccttgcaccatcacatggc

SEQ ID NO: 57388 - DNA, 1933 bp, Bovine  19866880446889
aagtcctgggtttactcttaaatgaagaccccagccctcaaagaagctctcagaatgtcttacattgaggctgcatatgaggctgaagaaatgcctccgtagtaaaaaccatcctgacacagccgttctctcaggctgatgcctttgcgagcaaacttctttggaatgcggcctccagagaaggtggactgcaaagtcagctcgcctggcgctaagcctcttgtactgggcctggatgtgatactgacagtattcacagtcgttctgtgaagagaaagagcagctgtatcaacattagggcaacaggccggggacaatgttaatggacacaactcctttctcccagcctcacagagagctagtctgtgggcaaaaccctctcggctaacttctgagatcattctctatccacagctaagaagcaacttagaagttcatcctctaggtaatggggtggagtaggggtgataaattggaagatggggattcatacacacaaactattatatataaaatacataactaataaggacctactctatagtacagggaactctattcaggactctgtaatggcctatatgggaaaggaacctaagaaagagcaggtataagtatatatataactaattcactttgttgtatacctgaaacgaacacaacattataaatcaactatactcattagaaattaagaaaaaaaaagttaaggggactgaactctgaacacactattcaggtacaagaaaaagtggtacttttcactgccttcgtcctccttctacagtggaaataaagttagtttctagggtgaatcttgaaaatgttatgccaaataaaagaagtcagacacaaaggtcccatgttgtatgattccttttatggcatatatccacagagacagaaaacagattacaggtcatcagggaaatggttacttaattgctagggggtgttttttaatggggtgatgaaaagattttgaaacctgaagctggtggttacacaataaagtgaatacactaaatattactgacgtaaatggttaactgtacataatgtgaattttacctcaacagaagttacaaaataaaacaaaatcaatttcctttctgtttctctggttgactctcagacaaatgctacccttacagtgaaaggagcaaagagaaactatgaagtattgtcgaactgggtgaaacttaacagatgctgacaatggaggtttaatggtccagcatcttgtgatctgacaggtgcacttcctctgagacctctttccaactgtctccttcctccctgtttcctgctcactagttcatctgttagacagcaatgagagaaataaaaagagatgaaaccagaacctattatccagtcctttcaaagagctctaagaagtactacttcacatgcacttggatggttgtaatcaaagtcagacagtaacaaagtgttagagaaactagaaccctcacatactgctagggagattgtaaaagccacctgggaaaccagtttggtggttcctcaaaaacctaaatacagatccagcaattccgttccaggtttatagttgaggcaactgaaatggacttccacataaaaacctgtatatgcatgttgacagcaccattatccgtaacagtcagatatggaaaccacctaagtgtctatcaaccaatggataaactgagtgtagtctatccatacaatggagtgttattcaaataccaaaaggaatgaagtgctgataaaaggctttgtagcatgagcatagcacagatgaatcttaaaaacattattctaagtccaaagaagctagatacaaaaggctgtacattatacaattccactgtatgaaatgtctagaataggcaaatctatagacagaaagtagatgagtagttgccaggacggaggagaaggggaa

SEQ ID NO: 57389 - DNA, 1642 bp, Bovine  19866880492469
ctgtaaatattattttctcttcctgtctcatcgtttcacccagttcaaaaatctttactaatctggggtggtgacaagcaatgcatcagttctctgagctaatgctcccgattctgaaatgctcagaggaaccataggaagctgcattggctgctctgggggagaaggggcagaacatttactctggttccttctcctaatgtctcagaggggagccctctgcgctcctaattgtgcatctaagtgaacataagagcgcccctaattgcacatcaaataaataagtaaatgttgtctgctgaatacgtaacaaggaccagcgctgtcatcctccccccacggagagatttcattaaatatgggctggtgagggggctgcagcaatcagtgatgatttacagatattgaatattgcttctaaggtttctttggagccacgtgtttcacactgttcttttttttaatgtatatagcgtctgataaagcctgatggacggatctttattctgactcttcctggcgccccaatcagaaagcattttctgttgtaaatgataatgttttctgatgattcaatggctgggctcaccacaggattggggagtgcagactacagccagaggacagagcacacagtgccggggtccagccccggctgatccagggtatttgaaggagagacggcataggcgacctatttatttaaatattttatcaaagatataaagagtaataggatgaggatagctcagtgaggaaattcagtggagaaaagaggctgaaataaggatagctcagtgaggaaattcagtggagaaaagaggctgaataattcagccagaaggtaagagaaagaacgacatggtgagaccaagtttcagtgaacaaggcccgcactttattttccaaagtagtttttataccttaagttatgcatagaggataatgggggaaggggtagagtcatgcagcaacacagctcagcttggtgctggtgggaactgagtctcgagcgtgggagaagtgaatcacctgaaacctttggccccggtgctcccaagaagaggcagattgtcccagagatcagagctttcagaatttttcaggctctgatctaaggagtgcaaggtcctcctctaaaagagggagccctttgtgatcgactttacccagctttatttatctctgccccatgtgatcctggttccacaggagttaacaaacaatgtattttctgtatagatcatttaattttcattcaaatgttctcagcgaagtagaaacactcttgcttgtaccaacacagctgtctgagactgacatgccagctgatgcgcggcatgtccccactcatggtcacttaatgtagtggcatttactcttgtttgatgcttctgtgtctttccttggccataaatataacccaggatgaagtttgatcttttacttcgagtgtccaagtgcacttgaactgacaagttcaactgataatgtttcatgattccctgaagtcaaccggacagttatttagtcactaagtcctgtcttagtgagaccccatggactgtagccctccaggcttctctgtccatgggattctccaggcaagaatactgcagtgggttgccatgccctcctccag

SEQ ID NO: 57390 - DNA, 2652 bp, Bovine  19866880506377
aaataataggtgtgaaatttatctgaacttctctaagaatggcgctgtataaatcctgggaagaataattaaaatactggagtttaggcaataattcactacaacctgtagccatacccactctgggctgcctctgtgaaatagcttgattcagtattgtgtgaattgctttttttaaaaaatctataaacatggaagttgttcatattatatatggctagcattttgagtttcttggtatgtgatagtatttccaaaattttagagttaaatacaaccagttttctttaaatgatgctgtttttcttctaagctaaagaaagatttagaagcattgaactgaaacttccttattaatattaacataatgataaataatatttattaaatataagtaaattttttcttgaagtatagttgatttacaatgttgtgttttaggtgtacagcaaagtgattgttatacatatgtagatatgtttcatgttcttttccattatggtttattacaggatattgaatatagttccctatgctttacagtactagtctttatcgtctaaatattttatatagtagttagtgtctgctaataacagaaagaaacaaagttaacaagttaacaagaaagctatttctttctgaggcttgcctttcttcaccttcatttctaaaatgagaagaagcataccaaagccttgagaaaggattaatttataattaacagacattctgatgataatctattcagactgggtcatgcttagatattttccacagtagaacacttgaactgtaaatgaagactttgtaacccattgttcaagatttattaaagataagcataaatgatttgctccaggggaaaacatttagcatgtagcgactgaatgatcttcgtgacctgacgcgatgtgtgtcactgttcttgtttggagacgttcacaaagaactctggaagacagagcagggttctgtcatagggctgctcaatgcaaaccccatgaagcccaaggatggttcagaggaggtaagactgtttccatgggtttgtttgggttttttttttttgtggtctttataacttggctgagttctatcaacaacctttatgctggtctacctccaggtaataagtcaagcttttgtattattttcactccattttactggctttttgtttgtcgttcatttcttacctgccagtattctgaatttcagactacgctagaatattttatgagaacttatttcattatattttttcaaattcattccaagcttcctggaatttattttttagttcttgggctcaggttcccttccatctcctgtgaatatccttgatagcatcaggaaggaagggtttatagttgaggagggtttgttccgtttgttatcataatcatagctgcaacttaggaattttggtttttaaggtgacttttcaccgtcttaagcagcattagaatttgggttactacctactgattctctagtaaactgcaaacctaggtacattgtgaacactaacagtttctccacaggagtcaacaagaggctattgcttctgttatagacacattatatcaggaggagtaagagacaaagttgttgcattcattgctttcacaagagaatagcaacaaatcttcatttattggtttggaaggtgtttggccacaagtaacagaaaagctgtgctacagttctttgtaatggtagacgctgaagtttttgtttttcttggatagtaaaaaatccagacataggcagtgtcagttcagttcagtgtagttgctcagtcgtgtctgactctgcaaccccatgaattgcagcacgccaggcctccctgtccatcaccaactcctgaagttcacccaaacccacgtccatcaagtcgtaatgccctaatgccagagctggtgtccatgagtctctcagatttccctcttggtcacaagatggctttgaaaccctagccatcacatctcccactgaagccaggaagtcagccagcctcttcactctgcttttatagaaaagcagaagctttcctggctaccttccctgcagaatcctacttcagtctcattggccagagtggagttacatgacaatcactagctgcaaagaatgctgggaaaacagggaacctgctctatcactcaaggctgagcgttaggattctgatagtaaagatgcaggagggaacagagaactaaatgtcttctctctctcccatttctacaactgttttacagggcactggcttcaaatcccagggcactgatgaaaaggataaaaagcctaactcgtgccaaccgttattatatccattcttgctggtgaggggccatacctttgtttgcttttaattcccactacctctttttctacagatgtgcttatctattgatcatcctcaaaagatcttaattatgggggaagctcttgacctgggaacctgtaaagcaaagaaaaagaatggagaaccatgtacacagattgtgaatttggtaggtttaagctttgttggggggggggggtttttgctaaagaaagaaactaataggaataaattttaggcactttacctgtaatgacctatttggaactgagtttcctacataataggaagcttcaaagtga

SEQ ID NO: 57391 - DNA, 754 bp, Bovine  19866880549493
ctgggggtgaggggggaggcaggatgtgattccgcgtaaacaagtcggagggcacatcaggaaattagcaaacaatgacacttggagagcggggagccttctttggtattcctctcctgtggtttggcggccgggtgggggaggacgcgtctccatcaggccgtgcggacacccacccggaccagtggtcgtggtggtttggggttggtttgcttttttcctcccctcctgcaaaaaggagaaaaggtggtggtggctgttgtaagaccgagaaagaagctcattaggtgtccaagcccagagaagaattgatgacatgcagcatctttcccgaatatgttatttgggcaggaaagatgttttcgaatagatcacgtaacagtcagataaatatcattaaaaagaaaaaaacaaaaacaaaaaatccagccggtccctgacgatttaacaggtgtacaccgcggtctctgggcttgggtttattttatgaggggagaggaaagttgaatagtcttgcctgtgttcggtgacttgttaaagagtctttatttttcctgatttgacttttcaaaaaacgataagaatgtaagggcagacaaaaaattatgcctatcaaaatgcattgtgtcactttaaattagaggcaggtgactttttctccccgtcatgtcacaagtcccaatattgagtttagaataatcctgtttaagtgtcgtctttaagtcagcttgaagtcaaaaccaaaccagagaac

SEQ ID NO: 57392 - DNA, 2128 bp, Bovine  19866880583488
cttgcctggaaaatccccatggacagaggagcctggtaggctgcaatccatggggttgctaaaagtcggacacgactcagcgacttcactttcacttttcactttcatgcattggagaaggaaatggcaacccactccagtgttcttgcttggagaatcccagggatgggggagcctggtgggctgccatctatggggtcacacagagtcggacacgactgaagcaatttagcagcagcagcagcagcaggtgagggagagtatggttggccaactgcattatgaaattagataactaagcaacttgccacagtgctactaggggatgagaggacagggcttctccactataattacttatctttctgaacttcattttcttcatttgtaaaataaggggtaatgatcatacccacctaatagaataagtacgtggactaaaaagacataagaaaacatgtgagggctaaaaacaagcctggcatatggtgatactcaataattttatgtatcattatagtcatttctgtaaatactcaaaactacgttcattcattcactcactctttcaacaagcatctttagcagttatgatgctaggagctggatagtttattgtattttgtcactgttctttatgtctttttaatacgcttagaaatagccagtaacaaacaccagttcctcatactctcctcaactatttaccatcctcaatgtattttatttgttccagtatcttgccaattaagcagttagttgaaaacagagccaaggttttattctttatattaaaaccaatactattgattcatcatagaatataccagctgtttgcatgccaataatgatctagaaaaatacacaaggctgaaaaaagagaaattgaaagtggcttcgttactgaaggaggtgttattgtaaggcagtcatttgcaaaataaagataatactacactggcacagattttgagagaaataaatgaaattgtatgtcaagatgcataaacttattattataagtagactcattattatagattttgtaataaagaataacatggtaccccaaaactaatatatgtcaattacactttaattttttttagtttaaaaattattttcttttgattgatgaatatttttagtaaaattgctaagagagctagagataaatattactctggatttagatatgattttttattgtattgaagaaaggaagttatccaagatttattaatgggcactagtgctacatccgtcatctgtacttcctgtttctcagatttgtatgtcttcctttgcttccaagccccttagcctttcaaaaggaaaaacatgcttttagaccagaggttgctcaaccctggcttctcagtagcatcatctaggggcttttgaaaaacactgatgcccaggccttatcccagaataactaaggcagaatctggacattggtcattctaaaagctttccaggtgatccaatactgagaatcactagtagcaaatgaaacaccacctatgctatttaaaaatcacacacttgcaacaatacactttctgatgtcagcttctctcctgacgtcattttgttgagcatgacctgcactcaggacacagcactgaatgtcgactgtcatggcatcccttttttgtatccccatcaccctttaactatacttttcttagtgtggctaatagtccaccttattgtgtaattatttttgtatgtatttaaattatcttttagaatatacctttcctgaagataagaacaatgacagtgccttttaatggcagatctttgctgtttcagttgtccaccttacgatttcactgtggaatgaccctgcatctcatttctcctgccttatacctcccttctgactaatataactatttttaaaaatttacttattttattttggctgtgtcaggtcttagttgcaacgtgaggactttctgttgcatcatgcagggtctttcgttgcagtgcacagactctctagttgtggcacagcttccagagcacatggactaagttgttgtcatgcacgggcttagtttctccacagcatatggaatcttagttccccaaccagggattgaacccgtgtcccctg

SEQ ID NO: 57393 - DNA, 1743 bp, Bovine  19866880590281
aataaacagagggtcttggcatttctcattctgcccccggagtgtctaggcttcaattttgttactttgacctgtagcctgagtcacccaggccagcccggaagccgctgtcttcgtaagtgagcaggacacactgggaagcacctgctcgccctgcactgccatcggcctgctgggggctggggagaggggaaggggggtcctggtgtcagcaggacacaacatttgcatgatttctttgtctctaaaatgagaggagtttgggacttccctggtggtccagtgcttaaggctttcccttccaatgcagagggtgctagttcagtccctggtcagggatctagaatcccacacgcctcggggccaaagggccagaacatgagacagaagcaatattataacaaattcaataaagactgtaaaaatggtccacatcaaaaaaaaaaatagctaacataagaaagagatgcacaacttaagaaaaaataaaaggagttgatatatgtataattgattcgctttgctgtacagaagaaactagcacaatattgtaaatcaaccctactccaaaaaaaatttttttttaaattagaggagtcttaaatgcatattactaagtgaaagaagtcaatctgaaaaggcatgcatattgtatgattccaactaaatggcatcctggaaaagacaaacctggttgccaggacctgggataaatagatagaacacacaggatttttagagcaatgaaaatactctgtgcaacactatatgattgatacgtatctatatgtgtttgtccagacctatgcaatgtacaatccaagaatgaattctgagggaaactatggactctgggtgattgagatgggtcagtgtaggttcatcagttactacaaaagtaccattccagtgtgggatgttattgataggggaggctgtagggacgagaatatatgggaaatccttgtaccttcctctcaattttgccatgaacctaaaactgatggaaaaaaaaaattaaaatcttttaaggcaaaatttttaggggagtcacctttcatagtttccatggttccttccagctctgacagctgatgacagtttctcggctcagaaggtcattttgtcagtgctcagcatctctcagattttcctaagtggggatggggggtgatgctgaaaacctaaattcttcggaggagaacagagaacaaggtatccgcttttgactcagaataggggagagaaccacagctgtgctgctggttaagagtggagttggctccccaacccagggcactttccaagtcacatcactgagcatcctttgatgacggggcacacctgtcaaggtaaatcatagagagatggggtccatccctttcaaggaatttgcttttccctttgtcttcagatgaaacagatctcttggctcatgtttctctcttctggtcccctgcttacccgtgcttcttttgatgtcctaggacaagcaggggataccgtggtggctgggtctgagctacaaaggcatcttccagtatgactaccatgataaagtcaagcccaggaaggtaagcatgctctccgtggtgggctagtggggctccggtggagggaggaacaggctgagaagtgacaaaaattgtagccatgcagcctcagggcctctgggctccccagtctcctgataagtgcggtgtacacaaactactccaaactcatccgttctgccttctctgg

SEQ ID NO: 57394 - DNA, 742 bp, Bovine  19866880641448
aagcctggcttagagaattttaagcataactttactaacgtgtgagatgagtgcaacagtgtggtagtttgggcattctttggcattgcctttctttgggattggaatgaaaactgacctttttcattcctgtggccactgctgtgttttccaagtttgctgacatattgagtgcagcactttcacagtatcatctttcaggatttgaaagagctcaactggaattccatcacctctactagctttgtttgtagtgatgcttcctaagacccacttgacttcacattccaggatgtctggctctaggtgagtgagcacaccatcatgattatccgggttgtgaagatcttttttgtatagttcttctgtgtattcttgccacctgttcttaatatcttctgcttctgttaggtccctaccatttctgtcctttattgagcccatctttgggagaaatgttcccttggtatctaattttcttgaagagatctctagtctttcctattctattgtttccctctatttctttgcattgatcgctgaggaaggcttgctggttaatttcatgctatgctattttactacagttaaaaccttttaggtaaaaacaagaagaagcaaactctggaggcagaaaagaagaaatggcctttgcaagattgagtggatagtctttcactggcagaagcttgaggagttgacgcaaagagattcaattttttttccttgatggttatctact

SEQ ID NO: 57395 - DNA, 2310 bp, Bovine  19866880672038
tcctgtgtttgtgtgtgtgtgagagagagagacatacatacatgttcttaatccagttgtctgtggggcacttggtctgcttccatgtcttggttattataactagtgctgctgtgaactttggggtgcatgtatcttttcatatttttgttttttctggatgcatatgcaggagtggaattgctgtgtcatggtggttctatttttagttttttagaaactatttttcagtagtggctttatcagttttcattcccaccactagtgtacaagggttccctttactctgtatcctcttcagcatttgttgtttgtaggctttttagagatggctgttctgacttgtatgaggtgatacctcattgtggttttgatttgcatttctcttgtaattagtggtccatctagtcaaagctatggctatggtttttccagtagtcatgtatggatgtgagagttggactataaagaaagctgagccaaagaattgatgcttttgaactgtggtgatagagaagactcttgagagtcccttggattgcaaggagatccaaccagtcaatcctaaaggaaatcagtcctgaatattcattgtaaggagtgatgctgaagctgaaactccaatactttggccacttgatgcgaagaactaatttatttgaaaagaccctgatgctgggacatattgaaggtaggaggagaaggggacaacagaggatgagatggttggatggcatcaccaacttgatggacatgagtttgagcaagctctgggagttggtgatggacagggaagcctggcatgctgcagttcatggggtcgcaaagaattggacatgactgagtgactgaactgaataattagtaatgtagaacatcttttcatgtgcctgttagccatatgtatgtcttctctgagaaatgtcttttcagatcttctgaccatttttggcttgggttgttttttgatattgagttgtatgagctgtttgtatattttggatattaatcccttgagggtcacatcatttgtaaatattttctccaattcagtaggttgttgtttcattttgctgatggtttctttgctttgcaaaagcttttaagtttaatcaggttccatttgtttggttttgcttttatttcttttgccttaggagactgattaaagaaaatactgctaagatttatgtcagagcactctgcctgtgttctcttgtaggaactgtctttaacttttgacattttaactgtaatgtgccttgatgtaggtatgtttaactttttcagatattgccctaacattttccacagcagctgtactattttacatttccagcagtgcacaatgggtctgtttctccatatcctagccacgttattattttctgttttctgttgataatatccatcctgatggttgtaaagtggtatctctgtggtttggtttgcatttccctagtgattagtgaggttgagcatcgtttcatttacttattggccattgtatattgtctgtttaagtcttttgcttattttaaatcaaattttctgttgtagttaactcgaagagctacagttttatagttttaacccttacatttaagtctttgattgattttgagttaatttttatatgtggtatatgataagggtctatctttaaggcttccattttaatcaaatgatcacaaactagaagtgaataaaatgtggagtttactggtttgttaaaaacatagtgaagtctaggacgtggttgagactctggctttatactgttgatgttgccagatgttgtggaagttgaaagcagttggagttgttagaggttttcagtgaaccaggaaaatgggtggagcacctggtcactttctctaggcctcattagaaaattacagcgtttatgcagattcttaattggatttgtcgctcatattttttatttttctgtcagactagctattatatcattatatattcttttaaatttgaatatgttcataagaattgactttgaatggacagtagtgatagctgtataattattgaaatattgtttgagtttccttatggagaaaaaaatgaattatactcattatcagaaaaaaaaatcagaagtgaaacatcaatgaaatttcatacgaggtgtaactttttacctttcctcagggattgaggaatgatctgaaagcagctttggataagattgatcagcagtacctcaatgagcttgtgggtggccaagagcctggagaggaagacacccagaatgatttgaaagttcacgaagaaaacaccacaattgaa

SEQ ID NO: 57396 - DNA, 1581 bp, Bovine  19866880672509
tttaagagaaggaatatatagggagcctggatgactaaatcatgggctattttgtccatctgaatttatgcctttaattttttttattacacacagagggattgtttgctctacagtgtcctctgaaggctactcaaaattttcttttctagcatctcctacctataacttaaatatttattgcctaaactacaaatacaagctctccaagtggtcacaggccagttacttctgtatctccagactcagtagttgatgctaaataaacatttgctgagaagcgaatatactggctttagataagccccatagatcaatattgctgctggttccatgactgccctccacgtctggacgctgctcccgccgtaactgaacaatctttgtatccaatgagaattcacctaggccaggcccgggttcccctgtactttgggaggctttgggaggaaaaggtcaggagaaagattggattcctaagaccccttctggttgcctcattcttttttctcttagctgcacacaggaagagttctgctaaagcccttttctggttctgaacagaaggtcctgttgtttgccacggcgtctgaaggtctcagcgggctgtctccgaggggtaatgaatgctgaatgccacgttcccagaagcagctattacaacccgggcaccgaggttgtagccattgattttctcctcgatcgcacagtactgagcatttaatgaatggaaatcccaaacctatttccaaataaattacattcccagggctgcaacttgtggtggtttcttctgcaattggaaaaccgcttttctgcttttttaaattgcacatcagcttgtgactggggatgctcatcgactagccccttttcacatgtctcggtccatgctggtcctggttctagtcaagggtcacaggactcaaaggtgctgctgaaccgagggttctcttcactgtcctggcattgggtctaaaacggatgcaattccagtgtgatatgggcatttaattaaccagataaataacactcccttatcagtacctatccacggctcaattaattacgacacagcatgttgttttttttaaaaaatccttaatcggttcttcaacttagattctggcttcagagtgcctgtgaaccttctaaaatttaagcactaattattctgtatgtaaacaattgtaggggtgagggaatgtaacttcttaaatttcacaagggtctgtgattaaataagaggttaagaactattcattttcctaattggtacgtgagaatacactagaactgtacatggctttgaaatgtgcaacaatggcttaactgagttttgtatctttctccttcaactttctaaatacttcttaaagtgttcttacacagatactcatttacaacatttgacaaacaatccttaaaatttatgacaggaaattaaaattaaaatttaaatatgttacaattaatcatgacttcaccttgatgggtatttgactaatagccctaatagcctaaaagctgttcagttattgctgttgatggtgggatcctctgtcaactttttattttaaa

SEQ ID NO: 57397 - DNA, 1336 bp, Bovine  19866880749597
atctgacttccagtattcaaatagtgtttgctcaataatcaaaatctgatgaaggagaaaaacaaacatttgtgtatatgtgtatatatatatatatatatatatgtacatttctaattagagtttcactaattggtctttggttcagataattggagaaatgaacaacaaatgacttctgaaaatgggcttgttgtgtataggtgcctttttttttaaaggaacattttagccaataatggtgaggacaaatgaaatgaaaaactccgtgtaccccacagcattctttgagctggttttctgtcaaagaatgcaaaatatagtgtcattaaaagggatattatagatgtatctgtactagacacacaagctcctgtccccgcccccagccccaccaagtcatccaggctggccccttggtgtgtgtttcccaattagcacacacttacatagccaccgtttaataacccctttgtatgttgccttaattataataattatacccattgagtgaggatagagatgggagcatagaatgagatgtccttttgaatttgggagaaataaagtttaatcattgccttgccataatcctgaactaaagtgagcagatggggaggtctcaggggaggtattgtgagctcttcaaagccatctcgttcttctgaaatcaattgagagaaaatgcagacctggcctcatccagaccctggcaaagtgttcttcactgctctgtcttcccttctccacactaatccattgcacatacctgccagattaatcctcctaaaatgccacattaatcatgttattcctgcacactgatcttcactgctcctaattacttagagaattaaattaaaaaccacatcccactgctataggcccaccccagcaggactcacgtcctcatatctgatcttcgccttcaggtacctccaggccggtccctgtccttctgacaaaccactcagcttagtgtttctcaaacaattcctgaacttcccccaacacaaagttttgttcacactagtccccaggctgtaattctctttgccttccttgctccagtaatcgctgagcacctgtggtgaggaactgtgtgtgaaacgtccttcttccccggggcacacagcacttgacttttttgatcatttttggcattaatttgtccattaggcatagactcctgtgacagtcacttatgccaggggtccccagctttcaagatctaatgcctgatgatctgaggtggagctgatgtaataataaaagaaataaagcacacagtaaatgtaatgcacttgaatcatcccaaaaccatccctccctgcca

SEQ ID NO: 57398 - DNA, 1006 bp, Bovine  19866880765582
ctgcgtaatagtgaactccataggttgggagagactctacgatgctcatgtagctgtgaaaacaaaacaaaacaacacacacacacacacaacgtggttattcagcagaactggtatcatacgcacattggtgtctgtgtgtacatgataaaagttctctgaatggttatttacttaaaaattaaatggaaccaccatccactggagtctctcccagaagaactgaacaaccctgacatgttctatgtgaacacacacacaacctcatcagcactgggaggggtgaggtacttacttcacgatggcttggcctctggtctggccgttgagtttcttgtagtgctcgatgacccggtcctcactagaacgagaggaaaaggagtctctaccttagtctccaggtgacagccccgagccctcctcaggaaaagactgtgagccccacatcctcacaagaagttccaaggagccaacagctcctggaagaatgatttgtcctggaagcagcattttgaaacccagccgaagtgagatgtccagggcgacagaagtaccaaaagagtccactttcccctcagaggactcactgctctttgtcttgagtttggctcaggttcggggggttagactccttgtgggagcagaggatgaaaggagcacgcatcccagtggggagggacagaggacgaggacaggcagacagccactgctgggggtccacatggatgcttcgggcaacctcggtcaggccctcctcccctcctaaactccagctgcccagtcagggggaaggaggtgctgacctcaacacgacattcatggcctctctaccctgttagcagttaatagctcagggtgtccaaggaggatcggaaagttcgggaatttggggctggttaacacaaatcaacctcagataggcagatgacaccactctttcggcagaaagtgaagaggaactaaaaagcctcttgttgaaagtgaaagaggagagtgaaaaagttgg

SEQ ID NO: 57399 - DNA, 1357 bp, Bovine  19866880773349
catccatccatccatccatccatctatccatccatccatccatctatccatccatccattcattcagtactacacacttcctctggaccagacactccaggctgcagaactagtcatgagctcttagtttcctgcacactcttgttgactcagagaccttgggcaagtccctggaatgtcctgaagccttggtttctgcacacctgaatggctttctccctgagaaccgtctggagcctacctttcatttgctcattcgacactttgcaaaatatttatcaaggggctgttgggtgccaggcagcctgctgggcctggagggacctctgtggacaggagagcctgagttcctgtttggaggcagcacaaagccctggtgaagacagtgtatgcgtgtgtgctaagtcacttcagtcgtgtctgactctctgcgaccctatggactgtagcccaccaggcttctctgtccatgggattctccaggcaagaatgctggcatggttgccctttccttctctaataaaaagttaattatggcaaattctggatgatgggatatgagtacatttaatgtaatgctttgtaactttctgtagtttttaaaaattgctcaaacaattaaaaagtgggggaatgtatacatctaggaactaaatgtatacttagcatgattttcaattattccattgtggattgaatttcatatgcaggaagtcatctgattagcttaagtagtgtagataaagagatctagcccagtggctagcccagtgagataactaagtagatactggcccctactttcttagcctagtgccctccaagaagcacttagggagaagaaaggtagaaacaagaacaacagttacatgtaccaggcaaaatggtgaatctgcagtcattttaactgcattatgaatgtggagtgttttaactctgcttgtcaatggctgtttttcacagatagacttcctttctttcctttttcttctttttcgcataggggaggaagatgatttgtctctgctgactgcattgctggaggagaatgagtcggccttgggttgtaattcagaagagagtcagcccttgacccaggaagatggtgaacctgactcatatgatgagctctttgatgctgatggtgatggtgaatcttacacagaggagactgatgagggagaagtggaaaaggctgaaaaccaaaaggagaatttggccactctctttggagacatgggagacttaacagatgaggaagaagctcctacatcacaatcaactaaagagagggtcatccctgctcctggtcccagtcaagggaaaactaatcaggagttgcaaggtgccctaacca

SEQ ID NO: 57400 - DNA, 790 bp, Bovine  19866880787126
cctgaaaacgtttttaaaatgggttgctgctatcatgtgtcagagcttcataacccagccaagtcccagaatagatttagaaagtataatttagggctgaggcagccaccaaatgcctgaaatgagtaggtcctgatttgaaccctgagtgttggggtttagacctattctgtaaaagcagatggattttggattgaactggaagaaatcatgtttttgacatcaggctctgtctcaatgagtcctcatggcatttcttatagaagaaaatcttggtcttatctgccagttgggctgaggaaggtgaaggcctttagtaatgcaaacatggtgctttatgtagatcctattgatcaaagggtttctatctgggacaattgaaaatatccaccagattagcacatacatagttcctctcctcatccgctttcatcttacttttgctgctgctgctgctgctaaggcacttcagtcgtgtccgactctgtgcgaccccatagacagcagcccattaggttcctctgtccctgggattctccaggcaagaacactggagtgggttgccatttctttctccaatgcatgaaagtgaaaagtgaaagtgaagtcactcagtcatgcccgactcagcgaccccatggacgggagcctaccaggctcctccatccatgggattttccaggcaagagtactggagtggggtgccattgccttctccgcatcttacttttaggtacatcaaatttaaactactgaaagaaaaactttaaaggcagatgtgttgtgagtc

SEQ ID NO: 57401 - DNA, 2134 bp, Bovine  19866880791290
ttatcactagcgccacctgggaaggccagtagaaaagggcaagataaaatgaaaaaaacaaaaaagttataaagatttcagaggcagacatgcagataggctattagcttaaagagaaagaaagcacaggaaggtcttgaacctcagggagggtgcagtatctgaagagttcctcatcttcttggaaatcctggaccttggaaaccactttctcacttggcacatattctgattttgcgatggtgacatctctcatcaccaacaatcccaatggtttcacctcctttctgcagattctttgaaattcattcctagaaaattcattggtaaatgatgtcagtaccacaggcactaagcaccttcctggccttccatttgttctgtggaaggactcgaagacttgggagtggtttttctgcactaaatggtcctcaagccccaggtcaaatagttctgatgacaggaaggagaaaatggccaactcagaagtgcccgcctcctaactgtggagttgaaattcgctaccagaatttgaatagtccgtagcttagtggaccagtggggaaatatttgtgatttggtttcattagaacaaaaaagcaaacacctccctagcatcaccatgtaccaggccctaagaactctgtctctactttacctgtttagtcctaaaaaccattctaggacataagtactgttattttccccattctgcagatatagaaacaggcatggaaaggttaaggaaattgccctatacctacaatattaactaaagagactgagattaaagccagacactctggctcaaacccaggttctaacaagccacttcctaacaaacctgatccctgaaaaatatctgaacacacacaaggtaatcctacccatagtcccattgcacacacagaatacacattttccgttatataataaagtgttacttagcaccgaaagcgttgaatatcagcatcagacaccaaatttttaatgacaagaaatccattttcttcatagaattttctctgttctaggcttagaacattattctcccaagtgtacctaaagggaggaaaaaaatctcaaataaatccaatttaaaaatcataacctaacattatgtatcaagaacctgagaaatgtttgtactcttccaccaagcatttctaagactttaaggaaataatctgagttttttttaagttttaaatctaaaacagtaattactgtcactaagatatagaataataattaactgattatatcatatccattcaatgtgattggattaaaaatgaacatacttattaaattaaggacattgcttattaaattaagatttgatgacagtgatataaaaccaagacactatttgtttccaaggaaaaaactataaagaaatacaggaaaaatatttaacagtgatttccttaatagaatggcattatggatgattttttttacttcctcctatttctctgattttaaaattggctctgtaatgaataaatatggtttatcaaagaggaaacaaatttaatatattttgtgtttttaattgtctggttcatgcattcacagaagaaatccaagtaacaaaaatctaaatatgtgtatagcacacacacaaactcaaatcaccctatcccttcctctggtttggagttgccactctatgagaatagtccacagacatcaatgtcttccacttcaaaagtgacgtcaagataaaccaatgatgctagctggacatcagagtgaccaaataacaggataatttaaatgagatttaccatgcctgaattttacaaaataagcttatgcattttctgacattttcacttctttttaaaatttaaaatacatagaggaaaagtctttgtcttaaaaaatttccaattagaaaaagtcctgggttggaggacttgtataataaattctcatcatgcaacctgtgttttatatcctagttaccatggtcggggggcgggggaaacctttttttacattgaatggttaagaattaaaattatatctacttactggaattgttgaggatggaaagtggctggagaaccaggccttgaagccgggtgagatatctaggatgtgatttaaggcaaatcaagtgaag

SEQ ID NO: 57402 - DNA, 1278 bp, Bovine  19866880855797
cacacactcacacacactcttgaaagccactctttgagggagtctagctaaaccagtattcctagctgtccttgctgagcacacatacttctgaccctaagacactggactgaatgaagagcagaaatcttccttttgaagaacttcaaacctagcctctccatctagtaacacctaaaagaacttcatcttcttgctttgacattttttggaagcgcattccctaagaatcagttgtctacaataaaaacctctaaaaggcaccgagtctcattctcccctggggttcaagactgttgggttcagatagacttatcacacacccctaccccagtgattctctacaaacaaagctccctttaaggccttctccattaaagcttccatgaaccaaaaatctatttgtattgtatggagacgctaaaagcgttaaataaatgcatccaatttctgttgcctagaagcaattgcatatttaatactgacccaacagtttgacctattgccgccataaaccaataggtgttatcttgctcagctttaaagatagttttcagtcaagcaataacaaaaataccttgagcatctcttgggacctttttttttttttttgctttgttacaggccaatgtactgatgtgaattctcaaatgaaaaatcaatgagataatgaaacccaagctatcaggcatctcttagttaaactgtacagagaaaatgcttcttctactctttgcttcccatcctacctaagcttaaagaaaagaaaaagaaaggttgaggaagagacctgatgttgggaacgagaggtgttacataaggaaaaaaaaatcacggacagtgaggaatccttatccttcatactgttgggtgtaggaaaatgtgaccttgaacccaacgcaatcagcaggaaatattttaatgcatggaaattggtggcctcagaagtgagattttgtttcctttttaatctatcccttagcttttgcccagatgttgagcagttatcctcagggacccagggtgggttactggtgcctcagtctttccttttgtagcccctttgtagtggagagattttacaggcacataaagtcgaagggtcgcgggactccaggtgcaggaagagccctcccagaggatttcagaaccccgtgtgtgtgtgtgtgtgtgtgtgtgcactgtcattccttgcagaagtggggttgaggaatctgagtagaggaagtagggggaggaagttcattttctctccaaggccaactattcagttacggg

SEQ ID NO: 57403 - DNA, 1750 bp, Bovine  19866880937722
cctggttggggaactagatcttgcaagccatgtggcacagcttaaaagaaataaataaataaaatgggaggagggctttcctggtggtttagtggtaaataatccacctgcctgtgcaggagacacaggttcaaaccctgctccgggaagatcccacatgccatggaacaactaaggccatgcaccccaactactgaacctatgctctggagccctggaattacaactacagagccagtttgccctagagcccgtgctccacaacaagagaagccattgcagtcacaagcctgtgcaccacaactaagagtagcccttgttggccacaactagagaaaatcctgtgcagcagtgaagactctgtatagccaaaaataactaactaaaattatttaaaaaaaataataaaatggggggcttagtggttcactggttaggatttggtcccttcaatatttttatagattatactccatttaaagttgctaaaaatattggctatactcactatgctgtataatatatccttgtaaccattttattttttaatcttcaaaatatattaattattttcaaatggagaatgagcatccatagacaatacaagcttctaaaaacagataattaggatgaacagttttgaaaaataatgatctctattatattggcaccaatagtggaattttccatgggacaattgggttatttcttatctatacttttttattttatgcctttgagtttgtatctcttagtccccttcccctctcttgctgctccccacttccctctctccactggtttgttctctgtatctttgagtctgtttctgttttgttacagccattcaattgtattttttcagatttcacatataattgaaaacatacaatgtttatctttatcttatttcattaagcatgatacactttaggtccatccatgtggttgcaaatggcactgactccatctttatttcattcatttcacagaccccactaataatacagtataaaatatttgagacaaggagactagaagggatgactagacaggaaatgttaggcaaggaaaaaggggaactgatctggtatatggtctgtccccttaatttgattcccaaaaaagtccaggaaaacaaggtatcagtaggaattgtctgctgggggattgtctcaaccagggcttcccagggctgatatttacaaacctaccaggatacaagctctgcttctcaaattttagtgtccagaaattcaacttttcttgtgtccccagactaggatcaggctctggagtaactggtcaaccacaatcacaacaatgactaatgtcaaaactagcaggccaatttcataatctcctaacaactgaaccacaatacctatgtctacctctcaaagcatttgtttgctttgaatgcatgtgtttgtggtttcctagagatggttcttggagatgcatctgtaaggaagtgaggaaggcaggatttggcacagagagaagctggactgcagagaagttgcagctaagatcccctgtggtccttggggagctctggagctggaatgactctgtagctttgcccccaggttgagacaatggagctggaccttggaatctccaggcagtcattggtggtggaagccccctggaggagctctaaacttggctgaggcaggtccctgcagccagagtctgtgtccagtgagggaggcagctgtgtgcccccagttcagggcaggtgggg

SEQ ID NO: 57404 - DNA, 2546 bp, Bovine  19866881050305
attacaaaattaaagacatactagaaaaagtttatatatgatgataaattaagaacaattacaaaaaaaaaacaaaacaaaaaaaaaaagaacaattacgtagaatcagtgtttataattaatcatgtttaaaggttggtctatttccaagacaaagaacctgattatgcaaataagcaggttgtaaaccctgagaatgcgctgagcttttcctgattccattttccccgaaaatattttgtatttcaacacctggccctttctaacacccactgtgcattccaacatctaaattagctttttcaaatactccagaaaccactcatcaaaggtaaaaggcccccagttaagagatgaaagtaccaagttacaagtatgaacaagctctgctccacaccatttgctaaataacactctaattagatccactttattattttttaaagtttcaatgattatgaaacctccatctaccaaactaacaatcccaatttacactacatcaaaatacttaagtcaggtgttctcagagtggagtagtccacaagagcccctggggtcgttaagaccctctgagagggtctctgaggtcaaaactattctcagtacctcaggtattatttggcccgttcactctgttacattgacactgagagtgaaaagtgagtctcctgaagacttcacaaccatcaagacaatagcactaaactgtaccagctgtcagattcgtccatgctgagcactaatggagtgggggcagtttcacttaactacctccttgaagttgtaaaattattaattttactaagtcgtggtccttaaccacatctttttaatatcctgtgcgacaaaacaggaagtacacataaagtgcaaagccttcgtaaaacgacagaagtgaacgaccagaactggggcggttcgaaaaataccgacagacgggaatcggtgtgagggacagctgggggaaagagaactgccaaagtctcgggttttcctgcaattcccacacttccatcccaaaggctcccgagtgagtgccaagggcacagtgggtctagctgcggcctctctggggccgcggcggggttctggctgagccccacccagcaaggaccctctcagcaccgttcccctctccccaggccctccccgacgcactcagctcctccgtcgccaacgcccacgaccccaaggctcctcaccaccaacaggttcctgtcctccaccagctgccgcttccggaggatctccgatttcagaacgtccatcttgctgtccgggttgaagctgtctcaagttttctttctcccgctccagctctctagaccaagacttttcacccagccagccgccactaacctacttacacacaaccagcccaaacaccggaggacaacaactgacagggcggcttccggcggaagctgaggtaagcgagaggaggggaaagagcgctccagggctcctattatttacgtagtcgctgagggccggcgccccctggcggccctctccgacagcgtgcctatagtttccgcggaaatgcgaacaaacatggaaaatacgaacacgagtcttctaaatggatgctgcattaaaaaaataataagttatatacctatgtcaactatacttcagttttaaaagaagataaaggttatactttttttgtacctgctacttgaggtgcaaaagcttcatagcggaacacttcatttatgattactgaagtcagatctttacctgctacacaagaatctcactttggagttcatgaagctaccctgcgtgccaaaattaatgtacgcaagtgagaaaacccagaacaataatactaactcataagtatagagtaaaaggtgttcgttgctggccggtgaaactacctgtaaacttagacaattacagtacattcatttacataatttcagaggtaaatttgtccctcctccctgagttctagattgctcgtatatcttagtgataattgaacatttcagttcagttccgtcgctcagtcgtgtccggctctttgcgacccaatgaattgcagcacgccaggcctccctgtccatcaccaactcccggagttcactcaaactcacatccatcgagtcggtgatgccatccagccatctcatcctctgttgtccccttctcctcctgcccccaatccgtcccagcatcagagtcttttccaatgagtcaactcttcacatgaggtggccaaagtattggagcttcagctttagtatcagtccttccaatgaacacccagaactgatctcctttagaatggactggttggatttaatgtttaatgtttaaaagtccaggggactctcaagagccttctccaacaccacaattcaaaagcatcaattctttggctctcagctttattcacttttatcaagagactttttagttcctcttcactttctgccataaggatggtgtcatctgcatatctgaggttattgatatttctcccagaaatcttgattccagcttgtgcttcttccagcccagcatttctcatg

SEQ ID NO: 57405 - DNA, 980 bp, Bovine  19866881094667
tgctgtgatgtgaatgtgtaccttctggaatccttgacttttgttccgaccgcatccatggatgagcaaagggtgaaagaagacggtgtctcccttctccatcaccaagtgcacccgggcgttgtttttgtcatagtcctggatcccgtggaacatgatgttgactcctccctaaaatcatgagagaagccaagttcaaaagtgaagaagccaagaatcaaaacttttatcaatgattcatcagggaaaacaaagcttctctaagttcttccaagagaaagagacaaataaattagattttaaaaaaattatttataccaaagcttctcagttgactggttttagaaagccatgagttgttaaaatcagagatactttagactggatgaaaaacttggaatttccacctatggttcattactgaatgataactgaagacccagatcagctttgcattttgtgggaatgcaggagatcatctttcctggtaaacccatgctcattctttcccagcatgctcttctcctcacctggaacttgcatcagtcattcctctattactcagaagtatctcttaagaagctaactcagagagaggctcgtctccccaaataggagagagaaagtactcagtatttctgagctcaaaacccactcatgttacatccagagtaaagaaagaaagtaaattaaaatgttacattttaaaattatttcaacctctgtttttcaaagtcactgcacacaaagaaaaaaaaaaaaaacccacaactttgttttcaaactattttcaaagttaattactgcattagctagtggttatatcttttatggaaaaaacctaaaatgagaagctttcaagcctttttgggtcttgggcactatcccatttcctttcctaagactatcccaaacccaaattcctttgggggaatgactacttcccgactatactatggtgagtcttgactcctgcccag

SEQ ID NO: 57406 - DNA, 1217 bp, Bovine  19866881109908
agcatcagctcctttgtgcatcatctagagccacagtccccaacctctttggcaccaaggaccagtttcatggaagacaatttttcctcagaccaggggtggaggaatggtttggggaagattcaagtgcattacatttattgtgcacttttattattattacattggctccacctcagatcatcaggtattagatccctgagatgggggactccctatctagaggtcaccacctctaccgtgtccaaacccagagagttattgtgagggtcacatgaaaaacagatgtcagacactataaaatgcaaaatgtttcagagactgcttcacacatggttggtgctcagtgcatgactgttgaatgaggcaactttattccatgagcccatgtatcttatagacagagagaaaggcagcttgcttcgtgtaccactgaaaatgaatccattgtcccaggtgtagtctgccttccactaaatgaaagaggcatgcaagacttgacacacagtaggcacgtgagtctgagtcgactctgggagatggtgatggacagggaggcctggcgtgctgcgattcatggggtcgcaaagagtcagacacgactgagcgaatgaactgaactgaactgaactgactgaggcagacttcctgagagtcagtatcttaaagccttgagtgcattctcacaggaatatcaaagtcctttatagccctgttaggtgtggtttcagggtaatctgtctggagacacagacaaacaagagtaaccttgcccgttcttcctcccctttggattctaaaagagcagcctggagaatgttgcaaccggggctgtgattctattagggtccagcgaagtagactgtagatgaacctctggcttgtatctatgacttttttgtttactatgattattcattcgtggaaatggctctttgcaatggaatgctgtctgcctcagaaatctaatgatgagggttattaatccttgaagccagggtgatcatcaggtggactgaggctgaaatgattcaccattgtataatattttgcacagttgtgttcattatataagatcttttctcattttcttctttccctacccaatgccctactcacatgtgagtgaggacaccagcaccctcacacaccatgtaacacatgcagcacgtaatcacaagcacctggaatatttgagatgggatgttgagcctatg

SEQ ID NO: 57407 - DNA, 1604 bp, Bovine  19866881123842
gattaaggttataagaacctaggtgcctggtaattgagggaacatggagacacctgctcagagcctaaagaagaaagaagaatcagatatatatgggactgattggagcatcgcagggtttttagtgtaaaagcatggaagtcttttttttctagtattgattctgagacaccttctttaaccactggaagtaacagaacagttgactcttgagaattccttttggattattctcaaatctgtcatccattcactgaatcgtcccaaaatgcttcctaaggaaatatagttcccacccctccctacagcaaatcctgctgggatttttattgggattacagtgattcactggtttagttcctgaagaattgacatcattacaacaccaagcctccagtccatgaccagagtacttccctatcttgtttgaggtcttgtttttctcatcagagtattctacttttcattgtggagatccgtccacctttcactagatgaatctctaggtattcgatgtcgtttgatgctgttgcagatctcatgacaggggccccttgaaggcacaccaatccatttctaagattttgctctccatggcacaagaagcaaagtaataagcaacgtttcctttcccagggagtcaaagtgccttgtgtaaccatccaggtagaaaaggtataatagcttcactgcgggaaacctatttcagagtccaaacattgcagcccagaaacgattcttctgaactaacgtaaatgtctccagttggcatttcagcttattttccttttgtttggtttacagtttgccttacacaatggtttcctatctagcaggctgctatttgaatcagcaagcagatatttctatgctgcatgtaaaaattgggataacttttattaggagggaatttgctcatgattcagtcttgcattcaaaaactacaataaaaatctcattttattttttaactatatgtgcttagctaaaaagaccaaaagaaaatgcttattggtggttacctctgggtgactaacttatggattatttttatacctgtctacattgtcagatttttatgataaacatgcattatctttgtactaaaaaaaaaataaacactttaaattgaaagaaattaaaactatgtattaaaatgactggctcaggaattccctggcagcccagtggttaggactctgtgctttcgttatcaagggtgcaatttcaatccctagtgggagaactaagatccctcaagctgtgtggcatggccaaaaaaaattaaacaaatgactggctcaatttacttccccttcttggtgcaaaatatttatcaaaatttgctagtgaaattaaaatggatgtatgacacatcttaagataatcaaggaagagaaacttctctttcgggcatgtacatttccctgtcagtctttctgaccagttgcaaattacccagagtgctgagaagttgttcctcaagcttggagccccaagcacctgtttatttcacactccgttgattccaggggtaaatcccacatccacagcgtgggcttctgttcagttacctttgggtccagatgtgcatcccttcgtca

SEQ ID NO: 57408 - DNA, 1904 bp, Bovine  19866881175911
acattttcccagtaatgggactcactgtatggttctctaagggcagttagtttccattcaacagatgaatcaaagggcaaagcagttggataaccataaagataacatctatatacagtttttgctttttttttaagaagcatgttattcttcaatcaaagatagtcagcccttaagtcttcatgaacaattctaaatgtgctttattaaatttaatagttcttgttaggaaaactcatcatgaataaaaagcaaattattttttggcattctgatattgataaaggaaagttctatttcactaatgtacatatagcctttatcagatctttctcaatttatctctgaagtatgtttagagcttaaaaatttttaaaagaggaagttcagtgattagaatgagattgactcattttgaagatgattttcacaactccagtgattgctcctgatacactaatgcctattacaggaaagaaggctctaaataattcaagaaaaatataaaagtattgtgaaagctgcttcaggctgaatgtactttgtgatggggtatcacctgtctctgcttccaaatgtgtgattgacatgggttttgaacctaggacctaagctacaataacaaccggataggaggaaatgaaccagctagtccagggtggaaggctgtcaccattaatgattttctaaggctaagtttttagtctggaagaacttcttaacaatcgtgcgtgtgttcatggataaaaaacaaacatgaactcttctcatcaaggaggagataaaagttcaagtgattttctagtctaataaagtcacgagacgatcattttcattgcctccctttattaaagacccaagctagcagcttgtctttttccaatgtgaaaggaatgctgttttaaaatagcaatgtatttcttatttaaagttgaagagtaggaccacacttgcatcctatataggcctgtgggagttctcagcagggttctcatcctatgccatctggtaataatagcccactcgttctggtttattttaggaactctcccaacaagttggggttcacagcatcagtgtactcagacactaaggcgagttcgctgtggctgacagaacatgtcgctaagttcgtttatggccgtgtgactctaaaatggtaagtcagacagttgtcttagatgtcatttagtatcttgggctgtgacgaccttcgagctatgatattaaaatagaaaaacctttgcagagtgttaacctatcattacagactcaatggcacggcactgcaacccaattagcagtgtggcttgcatcctcgcatctataaaatagaattagcgtgagcactgctcttttttttattattagtttgtgtttctagaaaggtgtgacttatctgtagggttctgctcatttatgtccatctacaaaggatttaattacattcttttagctctctatgctgaggaaattgaaaacggccgcttcgaaattacaaatgttaacgaaattagtgaacagaatatttactccatcaccctctcctttcggagagaatggaaacaagctgaggtaaataaggcctaagattttcagaagagaaaattctgggcaaggagagcattaagagttctcctttcctctttcccacgtgtattctgcaagcttctctggttttcttgggcagaactagtgaagggcaaagtgtataaatatggcacagtgtctgaaagttacatattagcacgagcagctagaaaacatcacttacatcggaggctggtgattcaagcacgatgccgaatcctagaatgtggctctccccaggggaggcgtgctcggccacggggagactggaattatcgggggcccctgcagccttcttctcagcttccaatgca

SEQ ID NO: 57409 - DNA, 1504 bp, Bovine  19866881210723
ggatggaggagcagttagtaacatgcatgttctgaaatatttatcagtaggcaaatctcttaattgtaaccattatattctgttatgaatgatccactaatttctcaatttcattctccactgtttctcattcaagcttattcttggtgtctttttttcctctccaaatgcctagctcttcagttatagaagggaaaaaaaaaaaacctcttgtgaaacaatctacttttccttttttcctttgtattcttgtatacacatatccttttggttccatatgaaagaaagtaataaaaaaatttaaaaaaggactttaagcaaattctattctacttacatgccctgacctaaaccaactacctactagtcttctaatcgaattttcaaagatcttcaaagagtcccactggatatatatcataattaatgatcctcaatattagaaaagtttttttctgaaagcactcctgttgtggctttaatgtatattctttgctccgttgcagtacaccctcccatagataataataacatatattcacacagcacaaattcaggttaactcttgacaaagcttccttctgggcacagaggggtcaacaggttctcaacagtggggtgaacgctcaagggatgtttggcaacatctggagacatttttgattgctacaacttgagaggtgctactgacatctggtgggtaggggccagggatgctgctaaagatcttaaaatgcacaggacagtgactgcaacagagaagtgttcagactgaagtgtccacagtgcccaggttgtcaaatcccggatttggaggaataagggctgcagggtaaggagagaacctcagaaacagctacaggaaattcaactccggtatcaactgtgcggtttaaatggttcagcgtctcatgggattagtcaatgcagagtgagtttagagacagaaaccagcctggagatcatctgaggtcttgagaattcttacccacatgcttttagttatactttggacctactctttactttatcatcagattaccaacccagtttgcctctatttttcatcaggtaaaaagctgtaattcactatttgggaattacattttggcttggccagcttcactgtcaggctcttgacatacttccctggcataatgtgtgggatttatttgtaatataaatttctggtttgttagtccctggctctgactttagaaactgccacatttggggaggagagggttggactttcccaacattaacaagagagcttgaatgtttttgtccgtccagaaaaatgtctatgtgtcaaatgtcaatgacataaaagtattcctaatttcatagcaggcatgactaaatatagaatggaacgaaaccttccaatggctttgtggagccaagaacaataatgatctgtggtactgcagagtgagtgtccttgcctgacaacttttaaatgtattgcctgtcttttcagcaggatggccacaaggggagt

SEQ ID NO: 57410 - DNA, 1406 bp, Bovine  19866881225107
aattcgtctagtcaggctatggtttttcctgtggtcatgtatggatgtgagagttggactatgaagaaggctgagcgccaaaaaattgatgcttttgaactgtggtgttggagaagactcttaagagtcccttggactgcaaggagacccaaccagtccattctaaaggagatcagccctgggatttctttggaaggaatgatgctgaagctgaaactccaatactttgaccacctgattcgaagagctgactcattggaaaagaccctgatgctgggagggattgggggcaggaggagaaggggacgacagaggatgagatggctagatggcatcaccaatttgatggacatgagtttgggtaaactctgggagttggtgatggacagggaggcctggtgtgctgggattcatggggtcgcaaagagttggacacgactgagcgactgaactgaactgaactgatcccgttcctttacattttattttttttacttttattttttggtcaaataggcatgtgatccccgatcagggattgaacccatgtcccctatattggaagcacagtcttaaactctggactgccagggaagccccagctatcccagtcctgtctgagatttgtcttctctagaccagatattcttggtttcctccaccagcccacattcatcttcctgattgtctctagtccttgtaaaaggtggtacctggaacccagttgtctgatcacagccgaccagagcaggccctttccttctcttatacagaagatgcctgaagtggaaagaaaaatttaagaattttttggcagtcatgctctgagtataatacaggtactcatcacactgaatataattctgatttaaactcctaagccattcctacctgcactgctgctaagctacaagcttttctattctccacttgttcttggacctgcacaagacctcagattgctttgtgattattgtttcctcttattgtcaggaaaaaattgtgaaagcctttgaaacaggcaaaaagatgactgtttccattcagtgaaattgctgggtgtcatctagcagattcttcttgggttgtctgattttacaggggtctgtgtctttcagtttttgattaaactattttgcaactatcaattgtagaacacacatggttctaatgagaagaattctcatccataaagaggcaagaatttggtctggtgaacatgcaattgattttcaccctgtgaaagaagctgctagtctttcatctattagcaaatttatttcagtattcctgattgcttttatatgtgtcccttctctcggtttcccttggagccaattgtaatgttttactgcctcattgttatttaataagttagttaaggacacatgttcattttatatttg

SEQ ID NO: 57411 - DNA, 1873 bp, Bovine  19866881260245
gtggcatgcatataatacacattgtacatacgggacttaagcatccatggattttggcacccatggggatcctgaaacccatcccccacagattccagactgtttatgactttttccccttctttcacattactgtttacttaggataagtttatagacataggattaccagtccagaggaataacagttttatatgcctcgtcatatacagccatcttatttcccaaaagggttctgccagtttatgccaacagtcaaacttgcatgtgccaggtcaacacaattttatcaatattagtattatcttaatcgcttatctaatttagtaggtataaagtatgttctgcaatttaggggcttacgtgttacttgaacgttttccactttgtccatttatccatggaggcttgaagttacacttttatttgggaggagctctttctgtggtggtggatttagtgccactagctctgctcattcaaataaaaattttattttttattcaatagaaattgtttacagttagttgaatatgacattttcctctgtcctttctttttaaaagaaacctttgaaacattaaaacgatcactattttaaacatcaaagaggcagcgtggcaggccttggcctcgaggggagcaggttgaaaagtgctggggagctcagtgtgaagcggaagtgccagccccagcgccgctagtgcgaagcggaagtgccagccggagcggccgcgtgcaccgctgcacgctgtgcggctttgctcagataattgtcctgctcccttgtgtcctggcacacaactcccagagcttcctttgtgcttctagggagctcttctctaggagctgctagctcggggtgcaagaagttgactcaaagtaggattggagctttcactaagacccaactgcattgatccagtgagcgctgaggcagttagctggaatcaccatgagaacatcatctctctgtgtaattttccatttgattttttttaaagattttttttttttttatgtggaccgtttctaaagtctttattgaatctgttacaatattgcttctgttttgtgttttggtttttttgtctcgagacgcgaggggtcttagctccctgaccagggatcgaacccacacttcctgcattggaagtcttaaccactgaaccgccagggaagtcccctccatttgattttgagttaacaacagaaaagtgaaatacattaatacacttgcagaattctgtcagggggccaatggaccccctaggaagcattttctctgcccataagacacatacacatggactggagcaatcagaaaaagcagtttcagaactactagcattgatagccagtttcatttggaagcacaggatgtggtgtgcaggatgggccctgccaagctccatcttcaccaaagaatgtcatatggatttggagaatagccactgcagaactgacatcttttagaaatatactcttttttgtccccccctttttggggttatgttcctatttcgaatatgcattctcttttttcaaatgttaaacaatatttcatattttctttcagtcttcacagaaaaatattgcactgctaatcacgtggataaacttcctggcccaagagactgggttcagattctgcaggatcaaatcaaactggcgagaagaaggttaaaaagaggctcaggtatgaataagctgcaagaaaataattgcagaagccctcaactgaattcttagatgttgcaaaatacagttctttactctcggatacttcattgtcttttgtcttttgaaggagaagctttatataatgtgcctggttttgtgttttaaaatcttattcaaataattttaaatt

SEQ ID NO: 57412 - DNA, 1355 bp, Bovine  19866881263597
aaatggatggaacccgtaccctgacctgctggtacacaaataaccgtaacacagacatacacatccaggaaggcttcatggaggaatcagcaaataagcttaggggaaagtcaagaacttcagcttgtttcaggctgtacagtagtcacagctttaaatcacacaggggtggtggagaggcaagaatggcccagggctagaatctgaacatcccactggattccttggcccagtctcttcctgtgggtgggctgagaatggctcttcattgtaaatgaggtggtcaacccaggatgcttgtgttgctttgagtcccaaatatctacaagtcttttttcttctttgattagaaagaaaaaaacattctcctcttgttaggctttcatcacttatgctgtacactcatgtgttaactaagcatttccccttaaataaattgttttgacatttctttgtgttgcttctgatccatttaataaatgcagctgaggtctctgccacccatggctagacaggcagaagaaacaaacttggccaggctagcctagggagcgttcacttctcagcaagatggaaagattcctgacagcaaataagaggttgaaaaaggcctccaggggtgacatttttgcaatctttttgtgggttcagttcagtcgctcagtcgtgtaacccctttattcctagaaagcatgaaatgcttgccatttccagaagttacgcgtctttggagagagcaaagaggagctctcattttgctaatagcaaacctcaggtgaatcgttaagggacttctgatgacagaggtgcttccagtaaagatctggaataattgaccccatggaaaatgtacttagtgaagcagaaaggacaggtaaaacaatagttagcagataactggagaaaacaacttgaagtttatgtgctgatagctacaaactctttaagcagtggatgccaaaattcttcctactgcaacccggtgccaagcctttccatacatcatacttgggactttccgggtggtccagtggttaagactccacctgtcagtgcaggggacatgggttaaacccctgattcagaaaggtttcacatcccatgggcagctaagcagctaagtagtactgcaactactgaagcctgtgtgcctagaccagcactctgcaaccagagaaaccgccgcaatgggaagcccatgcaccacaactggagagtaaacctccgcaccgctgctagagcaagccctcaagcagcaacgaagacccagcacagcctaaaaaaaaataaagacataaatgaaatttaccaaatacatcctacttagggcgctgttcctttaaatgaggtcctgg

SEQ ID NO: 57413 - DNA, 2861 bp, Bovine  19866881280608
cctcactgagcctgacagctgcaaggatctgccaccccaccctctcccgcctagtttctcctgtttgagaccctctgaggcctcagtatcttccttcttccttggctttcccctctctgtctgtcctagtggaaacaccgtgggcaggcatgtgacagcagctgccacgcttcccctccactccctgtccctccatggggactgacagacgatcatggcactgaccccccctccatgggattactatcagagacccaccagccagaggaaatggaatccccaaacaccatttggagggtatggtgttacatgaagcaaaaaggcaagtgacccaggctgatggtgccccctaggcaggggctggctctcacttttaaggtcagtcatctctgcatacagggaacccagaaacaagccgacggccacagggctccctgtctcagagaagctgtcagcctgcaggggccaatgatttcagagtaaaggaagacatcccctcacgccctgtctgggtgtatttgtggtcccttatcaagagaagccaggtcaggaccctgatgctgccttgtcccggggccctgggtactgcgtgactcaacgccaccctcccataaggagatcacgcagggcgagaagtccaagcctgtggaatgcttggggaaaatgagcagaaaggattactgggtgatgatctggcattattgtgtaccactcacaactttctaactgcattatgtgcttgtttattaatatttcctctcttaattacagtctggatttggctgctacggttagtcccattttacagatggaaaattaaggcagcagagcttcctggattgtcattaccccgcagctcagagacatggctggggtcctaaacctgctgttctgctcactaggctgcaatgccttccctggctagtgtggacaggatccctacggcttatttaggcctgaaggttgtccactgcatctgtgtatgggcacttttttttttttttaagctatgcatcatgacaatggttcatgctactggcctgtttgtgtagaagctgagctgtagaacctgggggcacctgcttcaaaagcatccctccctttgtcttgtcatcctcctaggacatttagacagtaacacggtgcctctgggtccaaaagggtgggcctggtcacagagatgcaaggggctgttctggcaggacagctagagacgtggatgaggatgaagccgttcatgctgacaaaagagagcaccagcgtgaaggaaggagtcacggctcagtggtgatgtttgcacacagagcaggctgtggagataacccagaagaaaacccagagacaggaaggagagagatgaaaggaggacttcccagctctgaaaggagcagccagggtgtaagcaacatttggaaacatacaaatgagataactgagggattcgttaggctcaaagcaactctgactccagacaagccagcaacattacagcctctgccggctaatgcatttcaccaggtaggaactaccagttttgtgaattatctccttgcagctccagtcccttcatcactggtttcctgaaaataaactgctgggaggacagagaaggtaaggcccagggagcatgaggaattcggtagagggcaatttgtttccacacaaaaggaaacaagagtgccatctggggtgtttgtatgtgcacgctgccaggctggaagtctggaaacggacacatgcaaagtctttgtgtgttaaaccagtcttgttctttgaaggcacattataaggctctgagcactgtttatcacacctatgctaccaaaaagactggcaacaaaacagttcagagaaatgaaaccgagagtgtcggcacacaggtggaagctcccagtctcagggttcagcccttttatttcctgtccagctgcccggtcacttggtctcttggcaagacatgatttatgtcctggagtttcattctgctaatgccctccacagtaacatgcaccccatgccagccaaaggagtcccctgaagccatcccggatgtctgaaaaactagtctgacaactggaaaggtgtctggtggctcagataataaagcgtctgcctacaatgcaggatccctgggttgggaagatcccctggagaaagaaatggcaccccactccagtgttcttgcctggagaatcccatggatggaggagcctggtgggctacagtccatggggttgcaaagagttagacacgactgagcgacttcactttctagacaagatgaaatgttattaaactgtaaacttcataaagtgcattagagaaatgctgaaaagtcatatgttataatgcaacaaaattgacttgttctgtgatttatatcttattatttttaaataaaagcccttacagaagcctaacaaaaagtgcttttggttacagagccataagaatgattagggaagtggcgttttcctttcaaaggatagtggttggggctcgctggccctacagtatttcaacacactacccagccatgcaaaccccactccactgtgacctgaaccacaatccgggaagagttcaaacgcctgattcattgagaatcagtagtgtagggcctaacagatgaactatggtgtaatgttacacggcagctacatcgggagatatgaaacattgtgggaaaaggaaagaatcaacctccctcttctgtaaagaggaaagccctctcatcctcccacatctcaaaatcccacacatcctgtcatcaaatgacaaggatcccaaagcgaaattctagcagtccatgaagggatctccaaggaggcaaggcatccaaagtaaattttagaagtttt

SEQ ID NO: 57414 - DNA, 1681 bp, Bovine  19866881300472
tcttccttgaccttgttgcatccccccatcccatgaaacaataataacaccccctgggcaaagacacacggtgtgatcaagtgacttgcccagtcacatagcactgagcagacaaccttgaacccaggttggcattgtttcaaagtccatgatcttaccaacaaaattagtactgcctcaaggtagagaacagtcttgggggacaaaaagcacagctgaaggacacatcagtcagacactggtcagggcttgctgatttcaacattaattccaatcacagccaaaagggaagagaaagtgagtataaatgatgggcacctggtggcctagaaggacctagctattctagaatccatctaaatccagtatggggattttccataaacctttgttgaggggcctggaaaaagaagtttttttgttgttgctgcttgtttttacttttttaatcaagagccaaccttgattttggtggttaaatgagtttctcaaaatgactaggtggaaaagatctaatgctgggaaagattgaaggcaagagaagaaggggatgacagaggatgagatggttggatggcatcaccaactcaatggacatgagtttgagtaaactccaggagatagcaaaggacagggaaacctggggtgctgtggtccatggggtcacaaagagttggacatgacctagcaactgaacaacaacaatactcacgaaggcacattccaggacccaagaaacaccaggacagcaatacgtttatgaaaataattatttagggacttccctgatggtccaatggttaagaaatctgcctgccaatgcagggcacacagattcaatccttgttcaggaaggatcccacatgccgtggagaaataagcccaggccccacagctattgagcctgtgttctagaacccaggatctggaactactgagcccacaagctgcaactactgaaacccttgcgttttagagcccatgctctgcaacaagagaagtcactgcaatgagaagcccaagaaccacaaactagagaaagcccacacacagcaacaaagagccagtacactgcagagaagacccagcggagccaaaaaaaaaaaaagagaattatttaaaccaaagaaagcattagtctaaataggaagtaaggattatagaatctttcaaatgaatacaactgtatcatagaaatttggaaatagaacaaaataaaatcaggtaccatttgaattctatcagataatcagctatcatttgataacatttatatacatattttataagcatatttctagactttgcaataattctatgcatattatttcatatcctgccttcttaacaatattatatcatatgcacttttccattttgagtaatagttttcataagtttatttagttatataatatttcattaagtgagctataaccaaaattaatttaaatcattctgctcctgttggctatttagatcactgcaagtttttgctattataaattattctgcagtgaacatctttatgcaaatggaattttatttgcataaagtattttagattcattacttcttatatttactaccactctaggccagatcttaagcatcacatagctccatgaatgaattcacatgctagtcggtctccctagcttctgatctatcctgcataaca

SEQ ID NO: 57415 - DNA, 1782 bp, Bovine  19866881305512
accctgggctctccgcaccggatatgagaatgcatcctcttgaagagaatgttgtcaggaaccaggctcatctgtttttacacatatggaattctgatgacctcaggagacagaaggggtgctttcctctctgaaagcagggggaaatttgaaacaaacagtcccccaaagaagaaagaaatccgttgtcctaaaagtaagggaaggaaatgaccatctctctgtttagacttttaggaagaaaaaaaaaaaagaaggaagaaggcatattcccagcagatctataaaagctgtaaggaaaagttttggcagataccccaggaataaatatgagggaaaggtctgaacccttctttatgatgagagatatttatttgcctcacaaatcctcaattatgaatttcttacagaaaagatgtcctaagagaacatgggaaatagagccacctggcagatttcaggataaatgtgtgatctctggaaagcgtctcagggaatgaaatgtgattttttgtaatgtgaaaagttcatgctcggaaaacttttcattagagtcagaaattttaaaaataaaatagttcatgttaaagagtattgaaatgggagcactttgaaaataaacaccttttggtggcagctaagagtctctgggactcagaaaaaaaaaaaaaaaaggactcactggcactcttagcaaagggtgaagagtacaaagataattaaaaagaaaaatagagggaggaggagagagagaattgagcaacttatttaaaaaattaacagcatctcaaaagaaacctggagtagcaatactcataccagacaaaataaactttaaaaaataaaacactgttacaagagacaaggaaggacactacctaatgatcaagggatcaatccaagaagatatgattgtaaatatctgtgcactcaacatgggagcacctcaatatataaggcaaatgctaacagtcataaaaggggaaatctacagtaacacgataataatgggggactctaacaccccatttacaccaaagaacagatcaaccagacagaaaataaggaagcacaagccttaaatgacacattagaccaggtagactcaattgctatctataggatattccatcaaaaaccagtaggatacactttcttttcaagtgtgcgtggaacactctccagcatagatcacatcttggatcacaaatcaagccttggtaaatttaagaaaactgaaaacatatccagcatctttttagattacagccctatgagagtagaaatcaattacagaaaaaaactgaaaaaaaccacaaacacatggaagctgaagaatatgctactaaataaccaagagatcactttagaagtcagagaggaaataaaaaatacttagaaacaaatgataaggaaaacacaacaacccaaaatctatgggatgcagcaaaagcagttctaaaagtaaaatttacagcaatacaatcctacctcaaaatacaaaaaaatcttaaataaacaacctaactttacagatgacaccacccttacgccagaaagtgaagaggaactaaaaagcctcttgatgaaactgaaaagtggagagtgaaaaatgttggcttaagccaacaagttcaacattcagaaaacaaagatcatggcatctggtcccatcacttcatggcaaatagatggggaaacagtggaaacagtgtcagactttatttttttgggttccaaaatcactgcagatggtgactgcagacatgaaattaaaagacg

SEQ ID NO: 57416 - DNA, 817 bp, Bovine  19866881342764
acttactgatttgaggggtaaaacagtaaaaccacagctcctgtccactgacctctgatggcgggggtggaattagggtgggcggagcctgcagggggaagggggaaggatgacccttgctcacttccactcttttttccgtcttggtgcagaagactctcaggtcaccagcacactgtcccccttacagtcccctcacaaggggctccctcctcggccaccatcgcacaaccggccacctcctccccagtccctggagggactcaggcagatgcactatcaccgcaatgactatgacaagtcgcccataaagcccaaaatgtggagcgagtcctcgctagatgagccttacgagaaggtcaagaaacgttcctcgcacagtcactccaggtgagctgggccgggaaggccacacgaggtcactgtccacacttggacagaatccaagggctaagtagcatctgctagtctcaggtcccccgcaccctgcatgcgcctcccctgggctgccttctagcagggctgtgccacagcgccctctgctgcccacctgccagaggtgcagatttgtcattcgtagggaaatttgggggttttggctcacaatccatgttggcagcagcttgcttgaatgtccttaaattccatgggaattaattaggaaatcataggcagagtattctgaaatggccaatgagagtccactcataagaatcccaaagtggctgagaaccctaaaccatcatccaacagaattccaaagccaaacagctgtaatcttagctgtgtatttccagttcattactcagctgatatg

SEQ ID NO: 57417 - DNA, 906 bp, Bovine  19866881427990
gcaagaatactgcagtaggttgccattcccttctccttttctctgcataggggaaatagtcttatcactagctcagatattgacataacctttgtcagctatctttaccagatagattttataaaaagtcatgtgaatcctaaataaaataatctttgcatagtgcagtgcctgcgtatgggatttgagaggagagaaataatgtgtttttgtattattgttaaacgttgtagtggtactagattgccatttcattaagacttggtgcgtttttgccattctcataagatacgtgttaagcatgttagtgttcacctgaatgagctcgtgggtatcggcaccaggttgcttcagctgcaggaaaacccggacccagtgtgtgttaatggcagtccatagacagccaggttgcagagcagacggaggtcgacctgtggtagagattcgtgtcactctgtaggacagaggcatcgaactcttgttcctctctgagttattcccaaatctccactaggcttaggagtgactttgagaggaataaactccggatacctctgtgggtgagaaagatacctgagaaaacatacacttgtgattctgtcattcggggagaaagtatcttggtatgctttgacttgttaactaccaccgttccttctagggcagtaacagacattacacaaacttgagccaaaaaggtatgtatggtttttgtcctttatagaaaattactttttgactgacagcctctcccctgcacctgccacactctgctttgggatcaggctctgcagaccacatttctcctctgcgactggctttgtgttaggttctaccgatcatgggccacgtgggagacaggagcccctaggagggaagggaggccctcttcctccgtgttcacta

SEQ ID NO: 57418 - DNA, 985 bp, Bovine  19866881499458
cttctgctaaggcattcagttttggtcttggtggtggtgactcatcaaaaaagaggacatcatcctccttctgagatgcctcttccaaagcttgggcatctgcgtggttggggttcctttcatcttggggaattcagcccccgttggtggagatcgacaagggggctgctgagaagaggatggcatagctgggctcttgatttcactggagctttgcagaaagctttataaagaaaaaggcagtcacaaactatgcacacaagcacaaaacacacagactgggagattgcaggcaggccaccagctgataagtagacgttagtaaaataattttccatccttggttattcagattagcgcacagtaaaaacaaaactaacctcactaattcttcagttaactgatttttcactgaataaatgctaattgtttcaccaatttagaactgattactaattttatcaattggctttctagtggggtcggtatatggagcatcttcagccctgaaggtttgctgtgccctctggttagctgagatgcttcaggaactcactgaacctgtgtattttgtctattctactaggatgaggtaacacacacgatacatttggaagtcgtagaagaagggtgctgttaatataattcacactgattattttatatatgggcttttttttagttttaagatgatattttatttttctactatagttgttttacaatattgtgttaatttttgctgtataatatacctcctccttcttgaatctcctattccttcatatgtggcttcaagggctatgtaaaaacaacaaaggtcagaaatcacttgtccaaacctctcattgttgagatgaagaaactgaggcccaagaccccactgcccattaagtgacaggctgaggactagtaccaggtaatcctgagccagtcttcttttcactaccatattatccccacttctgtaagtttcaggctgagt

SEQ ID NO: 57419 - DNA, 1381 bp, Bovine  19866881571787
atcatctggccccacagtatcctgggaacgtggggccacaaggggcgaccagcggtgaggggggcaggcctggcctccagtaactcatggccccctcatgagcttgtggaatgccagcttgttggctgcagagaaacaaaggaccctggtttgacttcatttgtcaaaatgttcatcgaagtttgtttgtagcagcagctgtctggggtgagaaatagctgccacgggaggggagaggtcagacaccttatctaaaaggtcactttatctcccagcataaaactcacatcatggaagataggattccctgataaacactgttctccataggggtccacagttagtatgtttgagtggcctggagtttggaaccagagaagaaattcaaaattcctcgttgatatcttctgtccacatctgggaaaatccccataacactaaagtggaccccatttgatatgagatgttttagatgtccccttctcagaatttagtattggagaatggtgtttttgctattgataatgaatgccagcttctacattcttcattgtgtttaactgaatagctttgacttatgtgcatgctcagttactcagttgtgtctgactctttgtgattccttggactgtagcctgccaggctcctctgtacgtgggatattacagggaagaatactggagtgggttgccattttctcctccatgggatcatcctgacccagggatcgaaaccgtgtttcttgcatctcctgcattggcaggtggattctttaccactgagccacctgggaagcctttgatttatatacagatcctgtaaataaaatgcattttcctgagcaacatttgtaacataagatgtcagcttagaacacacggagcactttggaagccttttatataatacgtggtccagggcttcattctgagaccttctggaatctagaggatccaataaccttttaaaagaatggctgcacacagatggcagaggaactcttcatagcccgtgcgtgcgtgtgtgcaagttacttcagtcatgtcctactctttgcgaccccatggactgcagcctgccaggctcctctattcatggaattctacaggcaagcatgctagaatgggtttccatgccctcctccagcggttcttcccagcccagggatcaagcctgtgtctcctgcattgcaggtggattcttgacccactgagcctcttgggaagcccctttatagcctgaagatcatgaatctctgccattcttttttaaaaggttactttgcccaggatgctattatcctatacatttacatttcagggaatagatacagattacttttatgtagaatgagtattaaaactctacatattatgggaat

SEQ ID NO: 57420 - DNA, 884 bp, Bovine  19866881752894
atatcaaagtcaatttaaataatgttgaatgatactcttcaaagcaacaaaggcaaagctaaaatctattagcaatattcctgttcttcaaaataaattcaaacaaaccaacacacaattaatgtttcagctgaggttacaggaacaaattctgagtcccataacaaagcatccaagtcagaggatagctctgttacctgtgacgttctgggctctttcttacctcttttaagatccccgtgtgcctcgattttgcttttagaattgtctgaaattcctcagattccaggtaggcaagttgctctctcctttttttcttggcaggctccaattcatcctcagctagagcagaatgaaaaagtgtgagctgtcacagaggaactgcagagtcagtgtgcctcaccaactcagcttcccccagctctgttccccgccataagacccttcaactgaatttacctcccctggtaccaacaaagggaggctcttagaagaagtgaactgagaagtacaaactagaatggagggaggggatggaggtttaatcactaaattagaatctctttttcaccttaaaataagggccaattatgaaaagaggtaacaacaacaaaactcctatctacaaattgaggttaaagtgacaattgtcagcttcagttttaaaaattaaaatagggcaatttaaaacaaggtctgctcctttaaaacaaagtaaatctttatactaacatataggtgcaaagatccaatgagtaatctcaagattttaaattgtacataatttcattttaattcaacatgattataaaaaacaatcagttccagctgcagaaattctacttaggtactctccatagaggaaaagtggaaacaaaataatg

SEQ ID NO: 57421 - DNA, 789 bp, Bovine  19866881922692
agagatgtctggaaatgactgaattatcgagactaactaatgaagaattttctgtaatctgtggagaagctttacccaaatctgggccaaaggttacatctgcatttggcagaccaaccaaagtccttgaagttcctaccaacagttccatctcacccgagatttgcagttaactaatatgctatccaacttctctttgatctgcatggtgagaaaaccctccctgtggtgtgtttaatttttgtgagaaagagaacacttcaaacaattttcacagtttaaattctacagagatttgcataaaacccaaagatgaaatcatgttatagtaaagaaccccttgaattgtttccaggccaaaatactggagtgggtagcccttcccttcttcaagggatcttcccaaccgggggatcgaacccaggtatcccacactgtaggcaggttctttaccagctgagccaccagggaagccccagtaaagatccccttgaattggtttcacggtatttcagaaaacagttatttcttaccagtatttctatgcaaaaggaattcttctatacattgcaagatttcatttaagtgatgcccaagacctggcaatattaaccaataatgacacacatcaaaataatgggttatttctgatgggaggagggcttagactcagaaaaggaatgagggaaacttcagggatgctgctagaaacttcctgttatctagaccttgttttacatcttgatacaaaatcacacgtacatgaagaatcactgagctgtacagtta

SEQ ID NO: 57422 - DNA, 903 bp, Bovine  19866882215493
aaaattatctccttttggggagaaggccatgctgtatagcatggggatcttagttccccaataagggtggaactcgtgcctcctgcagtgaaagcacaaagttttaaccacggaacaaccaggtaagttttacctactgaaaaaatatgggctttatactaagcctccctgagaacaggtgctttagagatttctctccataatatctcttctaacgaatttgctatagtgcccggttatctcttagagtaataatctacaaatcactggtgtcttgacccagaaagcctcgagtatcctccacagaaatgaacaagaaaatgatcggccgaaaacttatcagactgtctcagctcaaggaaaagatggcaagtgagaagctggaagaaatagactgggtgacgtttggggttatattgaagaaaatcactccacagagttctaacagtgtaagctattttattaatcagctgtttcatcacagattggcagtggagactcacgttcttgatttgttacctagagcccatcagtgtttcattttgtagtcattgctagtaagttcttaaattgccacaccatcacctggttggtaccagagggggagatatgtaaggaaggccgtacttaaagaaggtctggttgggataggtttcttgagctttttattgtccacatcattcttactcattttacttgttgtttggtgatgcctgtggatgccctacggctctgagtaatcccccttgtggaagggggagtacgtcctcaaagatcatttgaagagccttattagatgtaagatgtcagtcactgaagtcctgatattgctgacctgtgccagtacaggatggtacatttcatttgacaaatattacaagaaggtctgataaattttaaaat

SEQ ID NO: 57423 - DNA, 2330 bp, Bovine  19866880712006
tattccactcttaaatatcagagtcagttctacataactaagaactgcacttggaaaaactgcacttttaaaaacttggtttttatgacatttaaaagataattgaagtatggaggaaactatcaggagatgaatgcaatataatccagagttataaatgcaaattcagagaatttaaattcatgattgacaaggcatacaatggttattacagaccaattgacaaaaatcctttacttttgtgatctattttccactcaagaacaacttttgtctaaatccattgttctcccttgagttttatcttttatcttgttcaacagtttatttaatttcaaagacaattagataagccaaagtaatggcactacagatgtataaatgtatcctgagatgaataaattatagacatttcaataagtaccaaatggaaactgggtagcctatcccatctccagcagatctcctgacccaggaattgaactggggtctccagcattgcaggcagattcttcaccaactgagctatcagggaagtctatgaaatgaaaaaggagcagctgtttgcttgaacacaaatgggtttgttgtttggaataatcatcttttttttttaaccaagcactttggccccttttgttacttactgaacaatttaagtgagtaattttttttaaattaatttatttaattggaggctaattactttacaatattgtagtggtttttgaagtgagtaattcttaatgtactggtctttaatgtctatcagtaaatctaatgatttttctttctcaaggtttctcaatgtttctcattgtcctttttctttctcaatggcataggtatgtgggttgactctttatatgtgaggcttaaaaccagagaaaaatatgacctcatagaaaaaaaatacatatatggcaagtttttctgcaaatgaaagaaatatttttcaatacaatcttgcctcactttgttaggccctttcctctatagagacatcagtttgaccatggtggagtttttaaaaaatacttgtggtaaataaaaaaaacagggttattggtttaaatacctttaaaaaaaattataccacttcactcctccgaacagcaatggattcaccattctacacaagagagaaaaaaaaaatttatgacattgcattaaatactttgcatgatctgaccacagtcacactgatttgggttggttactggggaccttaaatggtatgatatatacaaagatcgtttaaagggaaaccaaacagtggaggttaagagttgggacctagagtgcattagcttagggttaaaatgtagcccagcgcttgctagtttagcaactgcaaacaaattaattaaaatgcctaagctttgtttccctctctaaatgaggataatgattttaccttttccataaggtcataaagaagattaaatgagataataaattcaagtgcttggctgagtgcttgcgtttatgttcagtacgtgtcctactctgcttttgtggctacgttattgttgttgttgctgggatttttattatcttattctcatacatttgcccttgaagttccatctatctagagtgagtgctctttcatcatctctctgaatggtcaaattctatcaatcacccaagactcagctcatctaccacctatatcactgaattttgcctgtctagagaagttaattctcattcctcaaagacactgcaattcttatcaccgatgatagacatctgtactgaatttttacaggcttatttaggtatttacctttccatgtatttctcagctatattatagtgagctccctgaaggcaggtactgtagttatttctacatctgacagtttctgcatctgatacagagtccttagcaatgaatatttgttgttcatctcaagctccttccccactggatgaaatggccggagttaaagggctacataatctactgtgctggcatttattgtatgttgctgttaatgcttattatatcccatgcatttgttctaagcactttaatgttttatttcctttaatcttcacactgactctatgaagcaggtatttgcaattcatttagatctgaagatactgaggcaccgaaggttaaaaaaaaaaaaattttcctagtgtgaaataatagaaattatatatattggtctctgctggcagttcctgacacagacatcctaaaacccttgtaattttctgagtgataagagcactaagaggatcttttgttctaatacttggtctttgatcctagttcctgacccagctcttaaatcctttggaatttcctgggt

SEQ ID NO: 57424 - DNA, 995 bp, Bovine  19866880747594
ttatattgagtatcttttcaacctgaagtgcagacacagtgcatgttacctgttacactgcatccatgttgctctcatcaggagatcctctgatgaaaaataaaggaaatttgggatgcaaacttcctctcaactttttaaccagggcagcttgccttcctctctagaaagtatatatcacacagccatattaaaatgggcctagggatggggaggtaggaaagaggttctagacggagggaatatatgtatacacatgactgattcaggttgctgtacagcagaaactaacacaacactgtacagcagttatattccaacaaaaaataaaataaccctaggattttactactgactcccatagatgtgcattttggttgcacgaatagataatgttagataaaatgtttggattaaaataatatttgctttaaaatccacattcatgatgtttaaaaatccatgttcatgttttatatttcaaacaatatgatgtttcaaaatgtatataattagctttcaaaatattttttcatttaatttgagaatcagtgtgtttaataggtcttaaatgaaaaacaatttttttttcttaagcatgaaagcattgttaggtaaatgataactccaaaattaaatgaaagtattaagaaagagattgcaataaaaatagacttcaatctaaagggggaaaaatagcagttaagactggacttaaagtaagttacatgtacccacttgaagctgagtttaacaaaatatgatttatgtgcacagcatttttgctacataatttataaagcaaaaaagtggaatgtagtcagcatatggtgacttggtttggaagagagaatttaagcataataattcagcctctagtttatgccttatttgaataaagtatctgtcttctctctgcctgctcccaccctcaggactcaatcccttataaaaacacactatcacattttatgtattttctgcattgctttcat

SEQ ID NO: 57425 - DNA, 1524 bp, Bovine  19866880832201
tgagaggtctgcttgtgttatacgtcaaggctactgtctaaaggagaagcacttagaactgcatattccttaaagaaaaactgacaagcagaatgagtgtcagagctaatactctaaaaaataaaaataggaagaccttttgaattttaaatcatctcacagtctgtaaatataggtttttcatttaattgtagaaactctcatgaacgttttacatatcagcaaatatagcaggtaatgaactgttgatttgaaagaagttcaggaaatgcagagcttaactgaattgtctattttccattggaggataaattgatgtagtaggagaaggggggcagtctattgattcactccccaaatccctctgatccctactgataaaagaaagggagtctaagcctggttttcatccaaagtataatcctgtgtagagagaagtacctgggtctcctcaaatctaatatcatcatcacaatagttggcctcgtgacctattttgagttttatcagcacctcatgtataaaatagcagttgaatctgcacatagaagcagattcctgccatgtgctaaatgaagtgctgtggattatatcttgctggtaagagacaggaatacagatagtctttcctaggatttttccctttcactcatttctgaaattaagttgaggctaggctgtggtagagattcttggttccaaggagaggtggaccactttactaacacctcagccagtcttaaaatgctaagttggatcctagccgagtcagcatagtaagcaaggagaggaggatcacagtgaactgggaaagagaagagactccattttaatatgttaccggcatacctaacacctatccattgtacacctgttatgcgccaggcacagtgtctggtgttgtcggatcagaaggtgaattggacacagttcaattacttggaagaagtaaacaagcaaatcagatccacaccaaaaatgcaatcagctctatgaccaacatgcaaccacagtgctaagagataacacaggagaatctaagtgataaagaaaggaagttcccccaagatctgagtgatgagaataatacatcatgccttttacatccaggaggaatatatggatgcttgatctgcatgactcattggacagacacaaagcaggatctaaagcaaaaattgcaaatgttgagggtaacaaagaggtggttagaggaacagagggtacctagtcagtgagaggacctgcgtgctgatcaaggagttaacagtttatcaggaaagccctgcagactcattgaaggatgttaagcagaagattgacgtgtccatatatgtgatttaaatatagcctctggtggctgtggggaaggcacatgtggggaaccaagaccagagcaggaagaatatttttatatattattttcttattggagtatggctgctttacaatgttgtgttagtttctgctgtacagcaaagtgaatcagccacatgtatacctgtatcctctcttccttagatt

SEQ ID NO: 57426 - DNA, 1449 bp, Bovine  19866880966648
taataagagtttcttagtaaaatttcctcccgttgaacttaaataggaagaaagtcattttaactaagggaagtgtttggccaaaaactggaagactaatactgtaaactgaaatactgaatatttcttttctttaagttaaatgaaaacgcaataagctgatacataagaacaaatagaatagattgctcatgcagcgatgtcagggtgcaattacattagacccatgcaaatcttcatttgcccgactttcaaacattttaacgtaaaatttccacaagtttataaaatgtttatgtttataaagtaacttgatgtattttttcctttttttgggtttgtgtctctgtgtgtttgtgtgtttctagtgagtagaacacagccagaagcagcgaactatttttggagaaaaaatcatttttaatttaaatgtgggctttatagacaagaagaagaagccctgattgcagttcatttcaacaaattaaaaagagcctacagggaaaacttactggtaggaagaaatgcaatcaagtgtgcaaccatattgatcttcaaacacaaagccgaatagagaataaaatacagtctcaaaaacccattcatttctgttatgaggatacagcagatgctggtttaagtacgagaataaaacaaaaagcccattgattattacagctgatactgacaacattggatatacataactctccatagtttgtaattgttcgtgtcctcaggcgaagtactaacccagagctggcactgagccacttttatctgaacagactctcacacattaaatatttaggtttcagcgagggaggaaaagggaaggaaatcaaacagattcaggggactatgtgcgggagcatttgtcagactgtaaacacagcatgttcaaagcccctcttttgctccccttaaaacttctcttgtctttctttgatcgacagaagtctcctgagcagagtttataaattaggccaaaacaatgacttgagataactgctgtcttaactcctaaacagaaatattatttttaggattaattcttacagcagaacagtgccttgtttggtacagaaggatgttgtcagctctctctgtagatcctcgtggtatgagaagcactacttgctcattcagacagaggaagcataaagggttctagaatgattgagaaaggggtgatgatttcaagaggcaaggattgaacttattgccctgagaactgttctccctccctccttcctcccttgcttctttccttccctaattcattcagtcaacagaagagcatgttgttgtgtagttgctcagatgtgtccgacttttttgcaaccccgtggactgtagcccgccagtctcctctgcccatgggattctcgggcaagaatactggagtgggttgccatttcttctccaggggatcttcttcgctcacag

SEQ ID NO: 57427 - DNA, 870 bp, Bovine  19866881157888
tgtcctgcttgatttactccagggcttcctaacacaccttgcttctagtcctcccacctcacatttatcctgtgtcttgaaatgcacatcctataaatgatcttaaaatgactctcttcgtcctatcatcaaccgcagcttataaaattgtcttaaaagcctaagctgtcatttaaggctctcagtatgccgaacaaaactgtgattttcctatcacatctcccactctttaggagttatcttcctttggaaggctaatgtatatttttctctaaatatgtcagactctttccagacctggtgattttttttcatgctatgaatgcattcctgaaatgcactcttatctcttcttcatcgtgctaaatcctatccagttttgaaggtacaagtctttctctccatgaactcatccaagactatgccaattttagtgaatcttacttccccgaagtcctacaatgctatttaatttttttttttggtttatttcttttggtcgtgctttgtgatatgtgagttcttagttccccaaccaggtatcaaacctgtgccccctgcattggaaatgcagagtcttaaccactggactgccagggaatgacctccaatgctatttaattaacttatatggcatttatacatattattctgtcttgttaattaactttttaatatttgcctatcctgtctttaatttcctccaagataagtactaaatatcaataatcatttatatgaatattaagaaatgtctaattgaactctgtacatagtaagtacttaattaaatacttcatgcattaattgagtggtaaatgaaattagcgcttctaagacaggccaaattggagcaccttcaaaatttct

SEQ ID NO: 57428 - DNA, 842 bp, Bovine  19866881428313
tggggtcctttagttattatcattcatgattcagcttaaatccaaccacttccatgaaaagggtatcgaaagccgtgctgtgccctcatactaagctgctttagtcatgtccgactctatgcgaggctatgggctacatgaatgcaaaagctctggggtgctcaactgggctccatctcaagtgctaaaaatcttctactggcttattttgaaaaattatttatacaaagtcatgcttgtaacattctgggctctcgtggttattagatttcacaccgaagagggctgagggctaagagtatcattacaaggagaaacatgagggaggcagatactcaaagagtctgaattcacacctccactggagatactgagagaaaatataggcctgagagctccctggaaggcgagataagagaaattatagatgagggagctctttgtggcatcatagaacgatatctgctcatactcgtagtccaggaaaactccaactctgtgcacttgctctctcaaggagacccttttgaaaggggggaaagtccagaaggtgtgatcggttcccatgagagatcctgtgagcaagaccttatttccggagctgtttctgacggtggagctcctgtacacgcccagctgccactgcgccgccctgcccacgtccacctcccagtagtgccgccctgaggtgaagctctgcgcacccagcacggtggcactgaaatcaaatctctcagggtgacccgggtacaccccgctgcacgtttctaagtctcacactccttagatcctcggacaagaccagatagggatgagctgttttagggtccaaagttataggt

SEQ ID NO: 57429 - DNA, 1372 bp, Bovine  19866881428998
tttacctggagctccttatttaaaattgcaaacttctgctttctactagccccttggcttgttccatataacatacaatgtatgttacttattttttgtgcctaggagagcatatgctctatgaggcatattttttttttggtgtatctactcactcgtctctcaacccacaagtagcctagaatatggcaggtacatcatgagtgcccagtagacgttagctaatcaattagaaaggtctggtgacatatggggggtacccaggaaagaaatggttatgatccaagtctctacgtacttcacaactaattctcttattctcttggagaattagtcaaagatgtaaatgtagtgattctattgctataaagagagttctaggccattttttgaggtaattttctgatcatggctggaattgagactatattaattggaatacatttcatctaatgactgctatctcaaacaggtgcttgctgaaaacaattcaggctgatcactcccacccagaagcggttgatctatcctggtgtaaaccttcaaggaggcaactaaccggacaccatggaccagcaactgaagaaaaggggaacgacacctagccagaaaggcctggggagaagagctaccagcacagacaagtcactgccagcccagcaggaacctcctgacacaacgtgcatcttatatgatgaggatgtgtgctatgaggctagcttccgggttgtcaaagatgatgccttctctgactgttacatagaatgcataataagaggtgagttttctgaacctattgtggaagaggacccactccttcagtcctttgaacgtctgaaagaaggatcagaacaagacctttctcaacaggttcttgcggcaagctcacttcttgaatcttccttggaatacatgaaaagggacgcaaaacaagaatttcctcaacaggtggttggagagaatccacttcttgagttttctgagtacaagacaagcaagaagcttcctcccggaggaatacccaacatggactttccagaatctaaacagctcacaggatgcactaggaggccaagtacaaataaagaatatggtgctcctgaaagacatgcctgtcctcacaacggatgcacaagagagttccagaataaaagatccctgaggaagcatcttcgagttcataatccccgagatcatgtgtgtgcagaatgtgggaaagccttcaaggagagtgcaaagctaaaaagacattttctggttcatactggagagaagccatttccgtgcactttccaagggtgcggaaaacgcttttccctgtccttcaacttgcgcacacacgtgcgcacccacacggggagaagccttttgt

SEQ ID NO: 57430 - DNA, 1229 bp, Bovine  19866880485811
tatactattaccatgttctgagtttgagagctgccttaattcttcacatttgctgcatttcagtacaaatgtggaaaagacaaccaagcattccttcttgtaaatgttagtattaaattcagttgtgtacaacacaaaacccatgttcagagcagcttaattaaacaaagtgttattgtctcacaagccaaatatacaaacctgctgtccaggactggttctatggctctgcaattgttagggaccagcccctttcccttcacagcttcaccttccatcctgtgtttagaagataggcagtgttaataacgggttgcaagagcatctattcagacagatggatggacttgatatttaaacccattaccatgtacattgcacatcaacctgtacttaccctcccctggaattttagacaacagcacaggcttcaccattcctagttttgccctttcaaagcattgttcacaccacagataagtagcttccctagatttaaattgtctgatggtgacctccccctttagcttcaaatatagaagccaaatactttctgacaaagaattagagacaatctcctccttttctcctccctcctccttcaaagagctcattgctcagctcctgcaggtggttggatattcagaatcgaatttcttcctcctgaaaagaatgtgagtgctttccaagagttaaggttcaagaacttaatccttgactgagaaatatatttctttttttttttttttgagaaatatatttctaaagtgaaattagtaaatatcagttgaaagccactgctacagaaataataaatttgaactaaaagaatatttaccattttctaccaatttattttccagtggggagataagactaacacagcttgtacatacctttactcacacacctttagaacagttacagttatccattctgcctgttagaactgttgctttaaactaatagaatctggataaagttccagcagtataatgtagatcatattttcccaagcattagtatcagaaccacctggagtggttttaaaagctaccaattcttaggccaaatctcccaagtattcagattttatactctaagtaattttgatagcaactaggtttgagatttggtgttctaaactgaccttggtgtttctatgctcactttgatcctatctggccataggaaatatttaaatatattcaaattattatgatctatat

SEQ ID NO: 57431 - DNA, 3241 bp, Bovine  19866880569880
tggctgtagggatttcagcctccaggattacacttaagggtctaatagaacttgtttcccccttggctacacagaggcaccaacgaggatcttcatccctgattacattggggtaatctgtcaatcgaaagatgttattaaacttatccagaaaagaccaacaagccatgtttaggggagagaaaaaattacattttcagatgccagcatgccatcacaaatagtctctaaagtaaccaacatagcttaggcaacattaaaattgaatcattggaaacactaaaaatatgataacaagagatagcacatcattcagttttatgcaccctgtcacataaattatgtgcagctcgagtaggttatgctcttttaaatttccctctgggcacagttttaatggcagcccacaagttttgatatgtcatgttttcattatcacttagttcaaaatactttctaatttccatgacgtctcttcttttgatacatgggacacttaggaattagaaccatgttgcttgatgtccaaacatttggagatttcttggttttctttttgctcttgatttcttgatttcactttggacagaaaacattctgaaaatttcaattctttgaattcttggagattggctctaagagccaggaagtagtccgttttggtaagtgttctatatgcacttggaaagggtgtgtaatagtctatgattgttgggtaaagagacctacatacgtcaatgagaccaagtctgctaattacattgctcgtatcttctatgcctttttggtcttttgttttatcaattacacactgcgtgtgcatgcgtgctaagtcgtgtcagtcacgtccgactctttgcgaccctatgaactatagcccgccaggctcctctgtccatgggattcttcaggcaagtatactggagtgggttgccatgccctcctccagaggatcttcctgacccagggattggacccacatctcttacatctcctgcattggcaggaagattctttaccactagtgtcccatctgcttatgaatggactaaatacaagatccagtctggatgacaaatgctggagggtgagggagccttcaagaataattacaatgtgtttaaattttgatgctatataaacctagtaatactatttgtaatcattcagtagtgggaaataaaagtgtatgtcacaatagcatccaatgagaatttatgtaatttttattttgctaaaatcaaaagaagtacaaataaattgttcttggatcctaggcttccatagcttcttcagataaaaggaaaaaacgaacaaggaaaggactgaatctgtatgaaatcactatcaatgagttacataaatcattacaaagtctcatggggaagttcatgaaccatttttcacaaaaatggagagagactgctatcaccaagtacatttctattctggctaattcccaacataactttcctgggaattagcactaactcacactaacttgaaagtattttataagtggttgctattctgacccagtttcatggggtcagttacattttagtaataagatgtgaagaaggagtttgtgactctagggtacacattgactaaaactttatatttacagacatgttaatctcttaaaggtgtgggtggcaggattcctcctccctctcaggtctttgatggggtgagagactcaaactagggatcaatgctcttcctatattaaacctccacaagggcatccatggacaaatctcagtgactctggaatcaatgttagtctcttaaatacctgtacctctgttaaatcagaacactctttgatattagtgtcctttagggttagtaattggatatgcatcatcattttttaataactatctttcttcttagaatttcttccttttgtctgttattttcctttttgggggaggatctaagctcttggttctgagggtgacctgatataaccttgctgtgtatttgagctagcataaagattgtcctaaagaattccctacagagactctcctttgtagctgatatttctaaagataagatcagatgagaccctgagctgattcctgaatccacccagatatttaactaagttaacttaagggtaatttcctattcagagatttgatgtctttatgagctcattcttaatcatctcttataaggtcaattaacttcacctttttctatatatgccagctagcaacatcatgtatgaccttgaccacaacaggcctggctacataatataggattgaatatgcccaggtctggaaaaataattgacagcgcatagcccattgaagctaaaagagcaatgtcatttctgtctgtgagggcaggcacattaaaacataaaggctaatctgtgggctcacagggccccactaatccttgccaaccataagctgctttgcaaattttatcatgaacttgcaaagcttgtttgcagctctctaaaaatcacagaatcgctgaaatgtttggttggaggaccccgtaaggtcattgactaacagagttcattaacctatctctagtcgcttttccttaaagcatttctgacagagaagattctcttagtctcaaatttctcaagggaaagacagtccataacctctttcgtagtcccttctattaaaagacatttcaaagatagaaatttttttcttattgttaacttatacctttgttttaaaaaaagagcttcttaaaaattaaataaggcaacagaccactggggttagaagaaaaaaataaatcccataaagaaaaccaatctaaagaaatatgttaaactatatccacgattttttcctcgactcttattttaaatatttgatgatgctttgtgtgatggagttttatccatatatccatatccataaagctctttgttattacttccctatatttccagacttacttccaatcaccctccttttctttcaattataaaatttcaaaccagccggtaccagttgtatgatgataccaaaatttacattttttttaatttctcaatgtggaaaactaattttgttctctaagacatatttttcttacttttcaagcttctctgacctcatttcaatcctgtttgcgtaacatcatccccaaacacaatcctttctatacatatctggaatcagatcagatcagtcgctcagtcatgtccaactctttgcgaccccatgaatcgcagcacgccagg

SEQ ID NO: 57432 - DNA, 1662 bp, Bovine  19866880875959
gaaatcccatggacagaggagcctggcagactacagtccatatgcttgcaaagagttgggcatgacttagtacacatgcaggattaatctcaaagctaccaattactatatgatggggaggggaactgagaaaacttcctgacctgattgacctgacctccatatgcacacttagaagagacagcgtatattggatttctttggtggaatgacctggttcacaaagcatttactgacccttttaatttggcttaactaatattgcatcatttggattctattacattattttcttttttcctctcctcaaattccaattactcttttgctgactgatatccaaagaggaatttgtttcagtattaatttgttcatttattctatgagcagaaacaaactgcttcgtaccaggtgctctgtggcaactgcaagaaatgatctaattcctgtcttcaaggagttcaaggctaagaaagagagcatagacatgcacacagatcacagagaggaaagggccatagcagagctgaatgggaatgagtatataaaatagctctttaatgttgatttagtcttgaaggaggcaaagggtttagcgaagtagatgggctaataaataagaatgaagggatgggactgccagtggttaagaatctgcctgccaattcagggtacacgagttcgatccctggtctggaaagattccacatgccacagggcaactaagccagtgcacgacaactatggacccggtgccttagagcccgtgctccacaagacaaagcaccacagtgagaagcctgctcgccgcagctggagagtagcccccactcaccgcactagagaaagcctgcgcacagccacgaaggcccagtgcatccaaagataaaaaaaaagaatgaagggatgaagtgcaggttgtctaagaggaacagtgactgttgaagcatcaggtaaaactgaggtggtgagggatgagagtgaccaagccaacttgagtcagaccttctgaagtccaggagagaggatttaaacctggattgtggtatatatcagccttaatttgatagtgaacaaacagctaataatatgcccatcaagttgagtgtatagggaaaaatctattcaatctccttatctataaaaatgtccaactatgcttatatgacatgaatacagccaggcaggatagttaagaagaatcagtcaaattgaatcttactacatagattccataagaaatggctggcaacatttcaaacttttatgagttgttctgatgccttgcaaacaccatcttaatttcttaggaacaaacctagctgaggcactattacgtatgagaccagctgtgtatctaatgtatatagttggctctctgtatccatggattctacatcctcagaaggattggaaaatactcaattagaaattccagaaagttccaaaaaacaaaacttgaatttgtcctgatctagcaaccatttacacagtgtttacattgtattaggtactataaacgatctagagatgatttaaagtatccaggagtacatatgtagttgctgctgctaagtcgcttcagtcgtgtccaactctgtgcaaccccatagacggcctcctaccaggctcccccatcccgggattctccaagcaagaaca

SEQ ID NO: 57433 - DNA, 1249 bp, Bovine  19866881058264
tttactacagggttagtagaggataaattagaatcacctagatagcttttaaacttaaaaattccttaaataaatgtgtgtgtgtgtgtgtgtgtgtgctctgcttgtgctcattctcttcagtcatgtctgactcctaagtctcctcagttgtatccgactctttgccaccccatggactgtagcctgccaggcttctctgtccatgggagtccccaggcaagaataccagagtgggttgccatgccctcctccaggggatcttcccgacccagggatcaaacccacggtgtctcctgagtcttctgcatttcaggcagattctttactgcagagccacccaggaaacccatgaaggtagaatacttgtatcttatttttctttaatcaataatacaaaaattttggcagggtatatatgtttattttgagagagtatatatactaatatatatatatgttgctgctgctaagtcgcttcagtcgtgtccgactctgtgcgaccccagagatggcagcccaccaggcttcgccatccctgggattctccaggcaaaaacactggagtgggttgccatttccttctccaatgcatgcaagtgaaaagtaaaagtgaagttgctcagttgtgtccgaccctttgcgaccccatggactgcagcctaccaggctcctccgtccacgggattctccaggcaagagtactggagtggggtgccattaccttctcatggatatatatatatccatgtttgtattgactttttaaaagataacattctgtaaggaaagctatatttaataacataggggagtattcatatatccctttaagctcagttttttcatctgtaaaatagggttaatataaggctagttataggtcctttgtgtgtattaaatttaataatcccaataaagtgcagaacatgtatttcaaggcatagtcaataaatgttggctgcaattatttcatattgttattattatcattattatttgataactttcttcttcccttgcttctgtctctccctgaagactgtcagctatctataggctgttggttattcactggccataacagtaacagctttcgtttttcatagaaagttgctgtttttctcctcactctataatagtttcaagtttatgacctatatcattgatttgatactttcaatgaagataaatattctgctattttactttgtttcttttttcagatccattttcacagaagccacat

SEQ ID NO: 57434 - DNA, 1726 bp, Bovine  19866881077831
ctgatttttcaaacatatgctagatacgaggaactctcttgtttcgattttttcctttccaattgtaaaccaaaatctaaactcttcttaatgttcaaacacatctttcctgttcactgtaaactttgcttattaggttgtttataaagaaggaatcaagtacttgatgattcttgctacacagtttacctccaacaattccagagacccacggttcctttagtcttaagctttggaaatttggctgtgaagtttctggttcgctaatttcattagtgacttttagatgcacggagcttgaaaatcttaggaatattaacagttactttgttaactgtgttctcaagacaaaatgatattaaatcaagcaagagagctattgtttcccatcctgacaagaagcaaagaaaatgctgaaatacattatcttaaatgaagcattttaaaaaaactgaattgctttgactagaacaagtctaattttataacccaaaaaactgccaataagggaatttttatatacttttgagatatatattttttactggaaaactcctgagttaatttctctaaaagttctttgttaacactttctttgcaaaatcgtacaaggaaacaggataaatttatatcaccataaaataatgaaaactgtagtgtactggaaacctaattttggaggcatatagacacaaatattcatctccctgatttttaaatttggacaagttacttaatttccttaaagttgagttgtatcatctgtaagttaacactaatcataccttcaatgtaaggttattattattaaacaagaaaatgtaggaatgcttgggacttccctgctggccagtggttgagactttaccttccaatgcagcaggtagaggttcgatccctggtcctggggctaagataccacctggcatcccgcccaaaaaaccaaaacgtaaaacagatgcaatattgtaacaaattcaatgaaggcttaaaaacatggtccacatcaacaacaacaacaaaaaatcaaaaaggaaaaaaaaaaagacaaggttatgctaaacacagtacctggtatattactttctttgttttcttattacaattttcaggtgatatttggcatcacaaatgagaatgggttcccctgagcagtaggttgagaaaaatcactttccttcagttcagttcagttcagtcgctcagtcgtgtctaactcttggtgaccccatggaccgcagcacaccaggcctccctgtacatcaccaactcgtgaagcttactcaaattcatgatcatcaaattggtgatgccatttttctatggttgagtttgtgtccacaaaagcacagatttttcagtaatcatgactagtcactctctgtaattcctgccatccagttgttgaaattccccattagagtgtcatctgaccagctcagaaccccgtggatcattagcttcaccacaatatttatgacatgcagcaccatatgtttggaaacacaattctttctacccttgtttttacttaattatttctgaatcctgcactacttttgattacaatcatcatatactttactgtctagttttctcttctctagctgctctaaacctcatgagaacagggaatcaaccctttctattttaggtttaaacataactccatatttattttctttaaataatcattcctgcctagtttgttaccctagtaaatatt

SEQ ID NO: 57435 - DNA, 1168 bp, Bovine  19866881111228
tgaaaaatttgaacccaatagtttggagacagctttacagtggaattttcctgagaagattactttaaaaagataaccttttctatgacattatttggatataaattattttgtcctctacataacacgcctcatcctgcacactattgtttggggatctctgtggaaggatgtgtcaaggtaattacagagggaggaagtgccattgccagaagctgattcattaatttccagacagattcatggcttgcaaatcaacagctgagaactcagaatatcttgggtaggagtaggagtggttgcagtaggttcagtgacaggcacctcttatgtctgtctgggaatgggtccattttgcagaatgggtcagtgttcagtgctttcattcttcatgtatttctagaattaaaggaagattctatttaaattgagttgaattagaggttttttaacagtaattgtgaccttatcatttcctatcaatattgctgatataaaaactgtcagcccaccagactggtattaatattctagtagttaaatttgtgttatacctataaaactatcttttaaactaaatcagttgtagattagttagaattggtaatatatcagctggattgtttgtaagaaacagaaagctactgtagttagcttagactaaaagataatttattagcaatatggtaggcagcctttatagtgtcaaaagaaaaattgaaaaatcaatactcagagtaaataaataaataaagagtagtcccttagaataactaagtgaaacatctctgtcaggtgacaactcctcattgtggaagagtacatatgttgaccttccctctaagatcaacagtacaggatctaaaattcaacagtacatgaactgatagcatctagatgtacaagctagatttagaaaaggcagaggaaccagacatcaaatcgccaacatccaatggatcataaaaaagcaagggaatttcagaaaaacatctacttttacttcattgactaaaataaataaagcctttgctgtatggatcacaacaaactgtggaaaattcttaaagagataagaataccagaccaccttacctgcctcctgtgaaacctgtaactcaggtcaagaaacaagagttagaatcaaacatggaacaacagactggtt

SEQ ID NO: 57436 - DNA, 928 bp, Bovine  19866881287114
actggagtgggttgtcatttccttctccagtgcatgaaagcaaaaagtgaaagtgatgtcgctcagtcgtgtccaacccttagcaaccccatggactgcaggcccaccaggctcctctgtccatgggattttccaggcaagagtactggagtgggttgccattgccttctctgatatatactccagtatctattaaaataatttttggtatagttatcatctctgctgtgctgggaactccatgaaaggaagacttatacgggatgtattcctggttgtctgttctgagcagaaggcctggctcacgcttctcaatgggtgaatgaatgagaaagtacagtgtcggtgtttagttactatttgctgaattgacttgattaggccactgaaaaattgagctccctcaagtatctgttgttaaatgtcacttcagacttagacagcagtgatgaatcatggcttctgaaagaccatagttaaaataagcatccgttgcctgggaacagagcaagtcctcccaacagttttatggattatcttatcaggttagctcatatcagcaaaaaacctctatgagcatgggaaagaaaaagagagaaaagaggaaagataaaatcatcataatctcgatggtcatttgtatagaattttaccatttccttacactttcttcacctctgatttctatcacatgataggtattattattattaatggtgttatttgtttttgttgtcgttgactgctttgtgaccccatggaatgtagcccaccaggttcctctctccatgagattttcccagaaagaaatactggagtgggttgtgatatttccttctcccagggatcttcccaacccagcatggtgcctgtatatccctgcgttggcaggcagattctttaccactgagccaccaggaaaacccca

SEQ ID NO: 57437 - DNA, 1278 bp, Bovine  19866881328510
tttaaatataaattgatttattttaattggaggttagttactttacaatattgtattggttttaccatacatcaacgtgaatccaccgcaggtatacacgtgttcctcatcctgaaccccccttctcacctcccctccccgtaccatccctctgggtcgtcccagtgcaccagccccaagcaacccgtatcatgcatcgaacttggactggagatttgtttcatatatgatagtatacatgtttcaatgccattcacccttttcttttaatgcaccaacaattcttctatttgctctaatcttctttgagaaataccctttgcttctatagctaatttttttcttttaaagtgaacctaaagaaatactctttatttcccctaaaaaaggtaacatgcagttttttttttaattgtggtttttatttgccaaaaaaagtctctctttaatagcaccacatgtgacaatagtgatggctactcactcaatgactgttgccctatttgtccttcagtttaagatttgtgacaaaaacagaaggccatctcctccctcaaaccgaacagttttctctgatgtcatggaaaagagcctttctccacatcctcactggattttcctgttcagtgtttagcctagcagaaccaaagcccacacgttattaaccagatgttctgcatagaattagaaaccctgaaatactggacagccaggcccccttagaaggaagtattcatgcagactgatttgctctctgctttagacccaagtcacatgaggttatttacaacctatcatttcctccctgagtgggaggaatgcttcacatattatcaataaaggcagtgtaatataaagcactctcctactctcgaacttttgggtttcagtttcccgcatcctctaaagggaaacagcaatgcctaactgaaaatttggcataacattgattctttttttaaaaagtgatggtagcaaaagtagtagcaaatgaagaaaaggtgagcaggagtgagagaggaagagaaggagggtgggagaagagaaaatatgtgagcaggagggttagcagtgtcaaatactgctgaaaaaataagggcaacaaggactagcagagaagactttcgatttgacatctcgggttcgtcttcttgctctaggaaggccttgcagcagtcatgctgaaggatacaggagcatgtcaaggggggtggaggcatgcagtctgagtgctctcatcactgggcccataccacgttgcacatctctatttacata

SEQ ID NO: 57438 - DNA, 1327 bp, Bovine  19866881578525
cagtctaaagataccaaattcctccttgtactgtcatgatgcccacaaggcacactagaatctttcatttgaataaagcctaaagcacatgaaacaagctctattaaactttaattgctattaggaaagcatgacatttaaatctagttaccattttcccattgattgatctctggaacttggaaagtatttagaagaaataaaaatcactaattaggtaagaatagcagagtttgtgttggaagtggagctttatcagagaaaaaatgttatcctatccaaataaagagggagtccagagaactgcatgtttgtgatagaatccaagtagcaccaaacgtatacatcagctggcaggtttgactgagacccagtcgacccaatcttattccattaccaacacttgttcattcaagtcatcttctcatagaatcacataagtgtgttgatttgctcctttgtctttcatgcttggggtactatattttcaggtgcttgcagttgggcacatgttcagaggacttcactgtgtctcatttcccccaatagagagaatagtgatagaggagccacctggaaaatggaaaggagaggtttcccaaattttcttttttagtaagctactgaaatattgaatataatgtttccaattgtcttaatcttttaaaggaatttttggaaacatgttggtcagtagttttttaggctattgtttattcaatgaatgaatatatcattcatctagaatttagtacagctaaattacagcatagttcatagaaggcaattaccaattttttgttaacccagtagatgaatgctagttcttgattaattatgagacagttataatgtgaaagaatttggggtaggtgataacagaagatgaaatttgaacaatccatgtggaaagaaagtgttaggtaaaacataaggttaaaaataaatatagagtgggaaagtttggggaagagtaagtcatttagaatttaaggttcacagagaagtggaatggtgcgagaaaggtgaaagaagataggcagaaaccaggtcatcgagggtctttcttgctggacagagtagatggaatttattcattggtgagtcactgaagatttctgagctgagggagtttatgacctggcttgcactttaggaagattaaactgtcagcagtatatgtgatggattggagtgagtaggtactagaggcagggaaggtagttgggaaacaatttcaatagtgaagataagaagtaatgagaacttgaacggaaagcagctgggaatctgtaaagaagaagattggagtaataggagaaggtag

SEQ ID NO: 57439 - DNA, 1157 bp, Bovine  19866881693190
tatatggaggtatttgctgagatatagttaacattttcattatagatgttacaaagctgaatgggtacattctagggaaagttttggaaacgtccatgtgcaattgtacagatttagcaagactatgaatgtgtgtgagaaatgtggaattgttatgtggaaacttagggacatgaattctagagttactacttagtgcctggaaaaccttgtgcataacctctcagattcttaattcattcatttgtgatgggagataataatttgcatgggtattgagaagatttgagggccccatccccccaaaagtaatttcagcgcttatggcagttactttatgattgttagctattgttatcactgaaaaatctacaatatttttgtcagacccattttcttctttaaattaacatttttgcttgattgtatttagttctgagtttatacatgggtattaatttgcacaattttgtaatatgtaaagtgcttcaagcactcagagaaaaagtattatgcaaatacaggacattattattcactgcattgatgtgtgaatgctcaaggctgcagacatattcatcttaaaggaagtattaacttctaaatctacatgaaccttacaaatgcacacttaataaacactgacaatttaaaatgtttcacttttctgttaaaattgaaaagacaaatgttaatgtaccacagaatttatgacaagattagaaaatgccagaattcaaacttttagtattaatttcttgcaaattaaatacagacaattataataagagatcctgcctatcatggccaattataaaatgttgcctgtatatatttgagctatgtacattcactattatattattatattatcatcttatagttgcattaatttgacacagcattcatgtatattttttaattctcataattctcttgtgagaaagtcaaggataaaaatttttcattataaatgagaaaacagaggcagagagagcttaaatcactggtctatggtcacattagagtctaagttcataccatattcactttattggtgggcaactcagtttagttcagtcgttcagttgtgtccgacttttttcgaccccatgaatcacagcaggccaagcctccctgtccatcaccaactcccg

SEQ ID NO: 57440 - DNA, 772 bp, Bovine  19866880500418
tggattggtctgccaactggcactagcagtaaagaacacctgccaatgcaagagacataagagacgcaagttcgatccctgggtcaggaagatcccttggcggagggcatggcaacccattccagaattcttgcctggagaatcccatggacagaggaacttggtgggttatagtctgtagcgtcatagagtcagacacaactcaagtgacttagcatgaagcatgcaagaaaaaactgcttatctgggggatgtctcccatgatcgtaaattactgatctatggtttacaatgagtccccattttgaatgataattacaatctatttctgtacaattgtgtccatgtacatatttccactgaaatgttgcaaatgtcacccagataaactttgcttacaaatttcacagggaatcaatctataatgaggctgccctgtaaaatctactgtagagtatcctacaaatcagcattgcacagtgacattcagcaggggggccctgtcttcattagggggggatgtgctgagccctgtgtaccccggctgttgcagcttcttgctgacagatgccactgcctccagcctgctcaccttcctctgctctgtccattgtagttcttatcctctgactcctttggtgcaaaatgctccattattttcaatttgtgttatgcccatctcctgcctcagcctattaatccatgccagccacagagacaaagggaaacacatgattgcaccgtcagtatcaacacagttgagtttcaatca

SEQ ID NO: 57441 - DNA, 720 bp, Bovine  19866880835811
tttttaagatgtcatgcccaacaggaagccaccatgtgagcaaaacttcagtcttatgaaattataattaaattaaatcgtatctggtagcttacatgcaatatgtattacagtggtgctgatcatatggaacaaaacattatcagctacaaagaggtataattagcttattcttgcaatatatagtcacttaaatttaaaaatatataaacaggaaagaaaagctaaaaaatctgaagtaccaaatttaatttaattttttaatattaatgaccaggttgtcctaacaagctggtttactattgaaattagcaaatggctatccttatataatgatggccaggagaaaagcaagaagcattgactaagcacttctcttctgaaaaatcctatagacgctgcatgtgtcatatctcatttaactgtcattcactattgtcctcaattttcatacggtttaaaaatatgataccaagaaagaatgacctggtgcaaaacagctattaagtggcagatctgaggtctgaatgctgtcagatgccaaagccaatattttgatcactgacatacaaagtgtcaattcatccttggattgtctagaaagtcctggatgaattagcttattcattgcaagttcttaaccgatttgttctgatcttgacataacacagataagccacttaagagtttaaaaccaaggagtgaacaaatgatttatga

SEQ ID NO: 57442 - DNA, 997 bp, Bovine  19866880903673
tacttctctttgacctagttctgttaccagtaaaactttgtttttgtcatccagctaagaacaccctagttttgccctgatttgccacattgattcaatacccaaaggctttggggttctgcaagggctaggcatccctctctttgtttcagaattatccagttatgacttgatttttccgattcttggatttttgtcaaatctcactcatttctccatccatcaattcttcaaatgttcatgaaacatatattgtctgtcacatgagtcttacttcttcataactgtgtgttgtcatcttatatgtaggtaagaacctctgaattttaaggccgaaaagactatctatatccccagatccctacagatagattgctacttccaagtacacacagggggaaaagggactttttcatcatacctttctttttcttctaagaaatcacctccttaggtacagcagtattgcgctcagaattttgctcatcattcattacaagaaaaggacaaatttcagaaaaatgggaaggaaacatcagtggaataacttgatatctctttgattacacaataatgacacccaggcaaggagagaggcagaattacaggcaatattctcagcaagtgattgtgtggctgtgccgctctttaaatcatggagaaatttgtgccatcacagacaataccatttgatttcaagaggcagctatcattagagtttccatgttttaatcttgtttgatgaaataagtgtttgtaattctgtatttgatgctgtattcttaaaattttaaggtaacctcagttacttatttttacaagagttttatttttactgtggctggaataaagaaaaatgtcattttctgtaggaatatcctttatatcagcagtataatcatctgctgaattaatagattaatcttatcctctttctagtcacctgttacaagtcatttaacacctgcccagcatgtattctattccagggttttca

SEQ ID NO: 57443 - DNA, 1473 bp, Bovine  19866880911275
caaagtgatattttataaaaaattagacaacggattttctcttcagtatcttttattgcaaataggtgctatatgttcagcactgtgtgtccagtcctgggacttggagatgctgcccggaaagcaacaagtcctatcttgccctctaggagcttacatttgaattcttgaatcattcagtagagcctcttcctttctgactggaaaagtaacattgctgttgccattctgtctatgcaaatattttccatcatttcccagcattttcttttaaagagtttcaattatggattatatccacacatcaccatttgtgttcattcgtgagtccaatgttcccatttctgttttaaaaagccaatctttggcagaggtgagggattttgtaaagaaaaatatgttactcccgcacctagggagctactcatccttgagccctctcctcaagcaaagatggctatgacatgccttaaattgtcaacactcagggtttcacatgtgacatgaaagacagtttttggtgttgttattcagttgctaagtcatgtctgactgtttgtggccccatggactgcagcatgccaagctcttctgtcctctactatctcctggagtttacccaaactcatgtccattgcgtcggtgatgccacccaaccatctcatcctctgtcgtccccttctcctcctgccctcagtctttcccagcatcagggtcttttccaataagtcagctctgtcttggcatcaggtggccaaagtattggagcttcaactttagcatcagtccttccagtgaatacatgctttggtttctctcaaatgagaatccactttgagaggcatccaagctacctcatgacaggctgttcaaagataaggagcagattctggccccaaatcatccccttagagactttacagacaggaaactagaagactaagacagtctcacaagggccatcagagtgtgaaacgaatgtaagtgcttctctttacagtcacaaggttaaatgtgagctaagatatgcactggcttttacaatcattaaggaagcctttttcattcactttgtgcacaagagaattcaatgtctttgtaaacatgtataaaggctgaatttgcaaggcattttccccatgaaatcttcctagccgagatgttggctatttgccacaaaaatagcctctgcgaaagcctcagaacctcacagagtgtgggtgacagagcccggcacccgcccagaggtttgcccttagaatgactccactgagagcctcctacaggccatcctgttaaaacagatgctactgaagaaacagctgttgggggtgattttaatggtagatttcatcctcttagtgaggagacttcctcagcttggaagctttctgctgcttgactctaaatttatttgatctgtttcacagaatataaaggcaacaaacccatctttctttcattccttctttg

SEQ ID NO: 57444 - DNA, 1408 bp, Bovine  19866880927674
actgccacttatatctatcgctgtgatttttctcttctaaattaaaaggaaagaagtgtgaaagaaactgtaaaatcaggctatgataagttcgaatcctgcacactctctcttgctctcgatctctcatttttaagaaaacttgtttttattattttttttaatgtcagtgatgtagtccattattaggagttattacccccaagtgcttgggttttgctatcaatatcactagtggaaggaataccaaaaaggctggtattagtggtttttactttatccttttcatgtcatggaatataaaacctagctctttaaaatcaattcctaggatgttacctgaaaggatccatcttatgccaaatacatgtcactgtagaaagaaatgtagtttgatgtgtttcttaaggtgtttaaaatggtacattcttggatcattagtgtgtgttgtctgtggacgacgacataacgtcctcatgatggccagtgtggattctgtcttgaacatccatcatctagtcgttctttgaacgaatatgcattaaatgtcatcgtgtaacttttgagccagataccatgctgctagttattgaacagggaaggaaaagaaaggaggaggaaaggaagggaaggaaggagcgagggaaggaaggaagaaatggaagaagggagaaggaggggaagagaggaaggggaaacaggagacgaatgaggaagggctggtaagtgacaccacaaaatttgaagtaacacagtcctgaattggaacccaaagttcctcacttataaattgtatgaatttaaacaagttacttaccctctctataagccttagtgtcctcaagtgtaaaatggggataattttattacctgtaatactgttgagagacttagatgaggagattatagttgtcctcaagaatattattaatgacactgaggtccagtccctgctctcaaaatactcagtctagtgacgctgaatgacatcgaatgagcaaacaggtgactgtgatgcagcgtcctgaagcaggggtgctctgggtgccagaatacgtacatgcaagtgcttgaggaatgtagtcttgatggtttagagcatctggaaggctcaagccaaaggatgcccaagaacccttttgtgaactgcctgattgctgcaagtattctgttctgttcttctgaagttctgggagcctctagatctaggcacagaaactgagtattgattattcataggctaactggtttcatcagggatcatttcagactattgtgtacagggcacaaagctacatcctatgaaattaagagatgaatgaaatgaaattcctgttctcaagtcgcatacagctatcagaaggagtttatctactttgtgctctcagtattttaacaattcaaaaga

SEQ ID NO: 57445 - DNA, 1293 bp, Bovine  19866880969079
ggttgaaatgagtttctggcatatgaaataaaattatgtcttcaatctacaaaaatttaatttacagcttagctgattggatggagcattttaacaccattttggaggtttaagaacagcaagtgccataatcctctgagtattttgatcactagcacacaggcatgtaacatactttgtgttcaagggaaacctttatccaggatgcaaagctggtgctgaattataatcacattcaaaaagattgcaagcctgtgggtattaagctttgcactctcaagcttagccaagaagatttaagcaacctactctgggatcatacagttgatctgatcagagtatttggagaccttgaagtttatttttatcagaagttttgcattcagggtctcaaacattagaccttttcagtactaagcaaaagtgtttccttgcaactccagcaatgacacttacaagcagatgggattcatgagagaaagaaaaaataaaataagagagagagagagagagggacagacacaatagtttacccctaaataaaagaaaatcttgaaggcctaaaaacaacttctgatgtcttcgatgttattccagatttctttgctgtatttgtctgaaaaagatttatcagatatttttgctactcaatttaaataacttaagtaatttaaatgacagatgccatctgtatcctaaagcagtcaactattttgctgaacttctttttttgttgttgttcagatgaatcagggagttatttatggagcaggtgttgctcatattcagtctctaataacagagacaaggataaaatagagatcaagttcagaatttttttcatctacacttccataaaatgactactgaacatttataaattaatatataactgaagaatgacatgaggtactcatacatgaatttctcttcattgtggatgtgagaaaataaaggtatacacagttcaggttctttacaataactggaccaaggttcttaaacctagcatcacgtactctttatttgttcttttgtaattagtgactatttggggagcgtttctgttacattaacatagttttgattgaaaattataaaggactatgatgatttctgacaaccagtctataccttctcatttatttatcatttgtttttccttttcttttttttttttaaatcaagaaaacatgcatataactcaaaccacagtttgttgataatggtccaagagaaaatagttttgtctttcaattataatgaagtaaaagaagtttcccaaatgggatc

SEQ ID NO: 57446 - DNA, 2824 bp, Bovine  19866880974021
ttaaatttgtacataaaatggctaaacacaaccctaagtatcttcaaatgcactaaagtcaaaccatcttcattgcgaatgttttgcttacgtacctaccactcaatagaaatcaaacaaaactaagcctctggcaattatttttctctttattttgaggcgggttaggagccatatacatatatataccctaggaattgcctgaactacctgggaatgtgctttcagattatccctctctctagtcttcacaggggtatccttgccagtgaagctctttgaaacaatgtttagctaatgactcaagaggactactcagaaccattgaagagcacctcaaaaacagatgctaaatggacttctgtcaggttctgctagtagagccatcagtagcgcaccaagttggaataaattgaattgaaatcaacaaaggcacatgctgtttatagcattacatcaactttcccttccctttagaattcagagacagtttatcataggataaacggtgtctctatgagtacttctggaagtccagtgcattctctaagcccaaaggaggatataagaattatgtgattcagatcttagttcttttaaaatgttattgcatgaatataacacattattgtgttattttggctgatgaattatcattatgatgtcccactttacattgtctgtatcaataatccatattatattaaacaaatctatgcagagaaatgtttttattgggggatgcagtgaggaaatatgagcatctggcaaccacaccttgattcattttagcccctagagtcatggtatggtgcattaatttctcagtttgtaatttgccagctgcatttaatggaaccaattttcattacatctgttctatggttcaaagagctcttttagttgccaaagggggccagcttcacacagattctgagaggggctaacacactgtttcttaaagtattcaataaccaaggatgattcctagttttacagcaaacacattatttttacagaggcaagttttatattcatgacttaccactggtagatttcaaattaaaaatatagcatgcccttttcccaggcattacatattgattttcatatctttcttcataatacccactgatctcctgtctttgcaatcggtggtagatttattgtttaccagttaaaggaaacataattatgcttaagcagatcctctttgtaaattgcaggtggttagatgaatatttcttagccaattatggaatttatgaatggtttttaaatttattatagtaagcattatttatggacaagagcaggttatagcacttcatagtgtgtagtgggagcatttttaatagtagaaatggttttgcttgggcaactttacattcttggtgtgtaattttaatctccataaaaatatgtcgctgttgtgtaataccaaatgtaggattccagttgaaagcaactttcaatgcaaagggttttctcatgggcagaagagaaatttaaaatgttctacagtgctttgaagttttaaagcttcagctgggagaattataaagcattaaacctgaaaagtttctacctgatggtcatgaaatagcgaggctatatgaaaactgactctgcctcacttcctcaggcaatttttttccttttcaagattttcaaaaatatcatgcctcatgttatattgagaagatcatcttagactttattcttctgaaatcattaaagtatacagcataattgtatttatactactgaaggttcaatggaataataatctgtactgaagaagtcaagtttgttcccaagttagaggtgatttggtattttgtacctagattcaaatgatcattttttgtacgtgcctaggagtagaaaaataagcagtttacttttagtttccaaatgtattgttctatttttacattcactttccctaatggttttgccacaaagaagtgacattacaacctttggtccaggtcccaaagtaagaaaggaacaaaacttaaactcaatgcatatgactccaaacaccacacatccactattatcgtattattaggtcttatgtcaggtttctatttctagcattggaaacataggtaaggagataatagtaactttgaaacatagtgaataacttaacattacaagactgttttccttccatcaggctcaaaatataatttcacaactagtaaccttaaacaatgcttcccaggtggtgctagtggtcaagaatctgcctgccaatgcagagtctgccaacccctgagtcagaaagattccctagaggagggaatggcaatccactccagtattcttgcctgggaaatcctattgacaaagaagcctggtggtttacaatccatggggtagcaatgaatcagacacaactgagtgactgagcaccagtatcattaaaaactatttactgaccccctaaaaaatccagcaggcattgataggagggctgtaaaacacaacagagacaaagcccctgctccctatgaaaccaggtaaaaagagaaagcctccggaatgactcagtgccattattctaagatgcatgtttctcaaattttagcatttttgaaatttgaattcatcttctaaatgatggcatcttagtaatgtgtctaacttagttaacacttacttttctcttttccagtgataatggataataaaataatgaatggtattatcaactataatttagatgtgataaaatacagaatataatttttaaaatgccctgagttacttatacggggtaaacatttacaattttaattaactttttaat

SEQ ID NO: 57447 - DNA, 1697 bp, Bovine  19866881027755
actgcattgatatgggaaatgagccagatgcactaaccattgaaaccaaacagtgaagactatcattgtactgatgggaatgcaaaagcctgaagacctatgttaaagatttccagtttataaatacataaagattatttttaagtgaaattgtgtaaaatccctttcaagtctgagtcatcaaagaatgtcaattaaatttcaaggaagtgaagacgaactgaatacattcaaaacaagaacaattgtgattagtgtaagtaataacttttatggttttcactctgtgaaacattaaggatttgacattttaggaataatgcaggctttcttgcatcaggagtgatgctgtttcactaatttggttagcacatgggctcacttaagaggcactctgtactctaacagtggctaacccctgcccattcatgtccccacaagacctggtttggggtgcctggatggtgctccttatcatgctggtctccctgctgcagcacaaatgcttgtaatctcattaccactggcatttgctcttcattaggtgataattataccaccagtcagaggcttgcttcaaatattttgtttagtgcagtttctccaaggtcaagttgttgtgatgagtggataagaaatgttggaccactttgagcactgttgagagggctgccacattcagagataaaactaattaggacgccattcatgctacttcatcaccgtgacacaagcatgctccttaacatacatctctagtttctgctttctaatgaaatgaagagcttccgacttgctaagagccatgctgtttcagcagaaggccagtgggagagaagaacaaggaggaaaaggaaacggagaatccaactggcagtcttggatggagcaatgggaagtgaaatgatggaggtttttgaaccagaggagacgattcaaggtacgagaaggtcataccaaaaaggacaagcaatgaaaagatgtgtgggggcagaaaggcatcactgggaaagtgagaaaggaagatcatctagcagccacatcctggacagatgacagaagggaagccagggagcaaagatgatcagtacccaaccaccactcagtcatttttatcaggaagaacccgccaaagtggaagcaacacaggtcatgcaagcagagcctggccatttcatggtttatttttatttatttaaagagtagttccaaattccttctagatgaatggaaattttatcttgtgttttggcagaaagcttaagccatggaataaatgcattgcaagttcattagcatactatttcaaaggaaaacttctaccagctttggaattatgagaaacagaaatcttagaaatatattttcccttttgtgttcctgggaaaataatttttagaaaatattttttaagaaacttctgagtataggagaaaggaaaaaaataaagcacatggctgaggcaacataaaaaacaattcaacaaatagttttggggacagaaccagagcagtagaattacagagggtaagaatgtaggttatccttcagttagaggcagatcttggcctcattgatttctacttgtctgtcattaattcaattaaactactagctgtttcagtagctaaaatgtaaaatgaacacaataatggcatgctttagccaccatagtaattaaataaggcaataccaat

SEQ ID NO: 57448 - DNA, 2170 bp, Bovine  19866881040106
cagggggaatgtatttagtgctgtttgtaatctggtattcagtcctatgaatgatgaaagacatttgaaatctaaataggagaatattattgtattcatttttaaagagagggtaaagaacgaatatttgaatagtacagctagcttacttaacattagtacttagctagttatggaaataggatattaatctgtgaaaatctccaagagggtagcagatgctggtagtgaacaaaatgactagaaatgtcagagcagtttgcttatgtggcagattatatttttaacaaggaagcaatggatgaaagacttttgactctggcttttctagggctctctctgcctggactccttcctccctccctttctcacctcccgttcactacctctctggaagtctactcattcagcaagactccaccattatcatctcatgtgaaatttccaaggttatcgatctcctctcacactgtgatagccagtgtaatgccctagcccccaaaatgtccaaatggcaattccctgctgctgctgctaagtcacttcagtcgtgtctgactctgtgcaaccccatagacggcagcccaccaggctcccccgtccctaggattctccaggcaagaacactggagtgggttgccatttccttctccaatgcataaaagtgaaaagtgaaagtgaagtcgctcagtcgtgtctgaccctcagcgaccccatggactgcagcccaccaggctcctctgcccatgggactttccaggcaacagtattggagtggggtgcccatttgccctctccgggcccctattatatgtcatgtaatgtgttaggttccatgtgggatttatagatagatgctaatcttgccctcaaggcaaagagaaaagcagttcaaaagtcctgaaatgggaatttcttgtcaaacacattagaaaaactatgatattccaaaaggggaaaagaaggaaaaaagaaaactttcccagaaactggatctataggacagatatattaataccctttattcgcatttgactccagaatgtgcttttcaatcaatgggtttggtagcccaattgggaacctaatcattgtctttatatcatctctgcaatgcaaatcacaaacagatgtacttcatatttcattactttatgaatcaccaacttctgattgtgtttgaaccacctcttgtaacaatgccttctctctcaatacatagtacacagcttagacacacacacgcaggcctctgatttggacagtgcatgcttctttgaaatgctaagcctttccataacatactgtctttacagagtgaaaggaatgtacacatactagaccagcataccacagaagcaagcacccatattcaaagtgttgaataaacatctcagcaagtagataaacaggtgctaacagtattacgtgcactacaatattagaaggtgaattttatacacatagagtttatcaacaatgtgttatagtattgtgagtgtgtgggtttctcttttgaagctttcaatcaatttctctgtgcctctctagtggacactcttcccttgtgggcatctgtccaactggacatgaagcttcttgacggcaagactactgtctttgcattctacatggaacctaagacattggatggtatgtaataggggcccacggctcatttttcaatgcaataaggaaacattttaaatatttaccatgaatttatacttatggctaaacttccagtgggtaaattcttcatattttgtgtactttctgacatctaggagataagcataatttcaaataagatttttaaagatagttgagaaactggaattgcagcacataaaataacagtgatgatagtaccttgagagtcccttggactgcaaggaggtccaaccagtccatcctaaaggagatcagtcctgggtgttcattggaaggactgatgctgaagctgaaactccaatactgtggctacctcatgcgaagagttgactcattggaaaagactctgatgctgggagggattgagggcaggaggagaaggggacgccagaggatgagatggctggatggcatcaccgactcgatggacgtgagtctgagtgaactctgggagttggtgaggacagggaggcctggcgtgctgtattcatggggt

SEQ ID NO: 57449 - DNA, 2066 bp, Bovine  19866881048362
cgattggaatcagattgttatgaatatttcttgagcagaaacctggaccctgccccatggctgtcctgttgtctcttgactttctttctgctttccctcacttccataattgtgtgcttagtcactcagtctgtttgactgtgaccccgtggactgtagcccgccagggctcctctgtccttggagattctccagacaagaatactggagcaggttgccatgccttcctccagaggatcttcccaacccacagatcaaaccaaagtctctcgcactgcaggcagattctttaccatctgagccaccagggaagcccatgagtgggtagcctatcccttccccaggggatcttcctaacccaagaatcaagccaggatctccttcattgcagactaattctttaccagcttccctaattagtagcccttttaatctgccctttggaattcagggagggtctaggaggctgaaaaatttttttttcctataaacaaaaaatgggggacaaggaaaggctcttttgtacgcaagagagctctacagggtcctgctcagtttcagtagtaagaagcagttggatttggagtcctttttggagaaaagaagtggaagaactttctgatggattagatatgaaagttgcagttaatgcctaaacatccttacatttatttgacattagagcattttatttcttttgccaaagtttttgtctatatctataattatgtttctgtcatttgtaagcaatacaaataaatatcaaacaggtgagcttatttaacagcattaatcttataacacaattaacacaacattattaaaactggagatgaatgagcctgattaaagcagcatcagggatttgtagaaatgtagatactattgttttgttttcaaaccccttcaaaatccagatgttcttgcctttgttctttttttaggctgatgttagtacttaatagttgggtatattgaaaagaaacatgtacatcatgttttgtacatgttgggtgtataagaaacatgatgttagtacttaatagttgggtatattgaaaagaaacatgtacatcattaattatttggatcaatacatcatttctataaatttggtgaaagtacgcctctatatgaatactgttagtgcttccagaccaggtatattcttaggaacactgatttctccttactaggtcaaatttgtctttttttcaactataatgcatatagtagcacatggatgcatgatttcttccaggaaggattgaatgtttactacttataaacataaataagcttttctgtaaagatagaaaggttgacaaaactcacacttattttaaaggactgatttaatcacaaatctggtctttagcttttatcctagttcagtgtttggaatatagaccatgtcttctcagtaattaaagaaattatgattatcactaatgctccatgaacatgccctgtagtgtctgggtgagtattagaaaatttcaataaaagttgattagtttgtaaatttcaatcctaattataaatattaatacttatgtttattattgcttctgaaaggaatcagcttatccccccccacacacccatgtgtgatgaaatataagcttagaattgatccctcctgaattgtaaacattttttaagaattaagatagaaattgactccctggttgaactgaataatgttttcacaccatcagtgccttattgaatgtctaaaacctaagaagggcatagacagatgatcaatgctcctttcctttacattccgagtgcagatgtgaatttgcaaacagtaactgatcacttcccagaaaaaaagttatgattctctactagagtacttggttttagcaaatgtagtttgttgtctgcttgataaggtcagatgactagaaattacttggtatcaatagtaaagtagaaataatgctataatgtggtacaaggagacccagatttcagccttatgcattcagccctttacatagtagttgaaagtccctggttctcattctaaaatttcttatcagtaaaaataagag

SEQ ID NO: 57450 - DNA, 1081 bp, Bovine  19866881102251
taattcagtactctcaggaaacactgccctttttaatccaatggaaaaaaaaaaatctacgtgcctactctgtgaagacatccatttttgaataattctgcacaccagaacctacaagtaggacagaataatgaaagctatttcaaagatgtattaactactaatgctgtggaatgtcctagaagaatcaaataattcagtggcccaattgtctaaagaactaatgacatggcagaaataaagaaattgactacttcctcattggaaagatgaagatttatttctaaattgcccgttctcccatctaacctatcacccaaagggcagtcaatggtaccataggctggaatgcctttgatatttgatgtgatgataatctctgactcacatgtatttattttttgaagaggtaaatctgaattgatgaaattctagaatgttcttcctttggaggcactgcagaaatgtcgtctcagagagcttgggcagaatttgccacttaaaatgaggagggagaagcttgctcaggatatataaattatttctcaccttcataatactgagtattgcaattacccataatgctggaacaagaaagggaaaggccttccaaaaggcagcagtgattttaaaagggggaaaagagcatgtctaattgaaggatgctgcaagatatgggtgtttaggagggaagttgagaagattataaagcacttattatgtatcaggatctgtgctggcacatgggattcagtagaaaacaagtttggatatgattctttttgctcatatttcatacattctagttaaaggggacagactgccagaagttacaagtctgtgatgagatgctgtgtggaagagttttttcttattcgagaaatctggctagcatccaagtttgagaactggaggggcaaatacctctcattttaacaatagctccaggaggggtcaagagttagcatcagacttctttgtcccccaggaaggctgcaaaacctgccccaccaactcatcccactatatataagatggcatcaccgactcaatggacatgagtttgagcaaactctgggag

SEQ ID NO: 57451 - DNA, 2801 bp, Bovine  19866881111937
caatctcatctctcattgtgtaaaacttttgaagtcaaagggctgaaagtggagcatgcctttgttcctgctgtgttccagagtgaaatatgcttttgattctgaagttattatgtaaattctaactatacaaggtccattatcaagtgctactttctcagtgaagccttgtaacattcacagaccaccatgtttctttcattggccccattcatgatctttttcatatatgctgacagtccactaacttgctaactccttactctactgtgtaactttatgaattcctaaggctcaggtgataatgaatactcattaaatgtgcctgatgataatgacagcaatgattttgataaggattatggcctggaatgtgtattggtttggagtaaaaaatggtcgtatatttagaggaactatgttgaagaaactaaaaaacatagctcactggtgggaaagttcatttaaaaaaatatgtattggttattcaaatttttaatttttaatatatttttctgttaagatattttattctggtatttattacacttacacagggaagaggctaatggaattcaatgatgcatgatatgtatgtcatatattttacagttcaacatatatttaatacaaacttgccatgatattcatatccttaacatttcttttacaattttgttcctatgatagttgtgcttaaaatatcataagatataattgcatgtatgccatggatccctgtattaaagaatgtgaaaaaattaatatatcagtgttagattttttgaagtgttcatagtgtgggatggcccagttcttttgtgctaaatcttttagaaattatccaactccactgaggtggaatctagttctttttctcctctaatctaaaccccagggccactgttatatgagcattttatcctgctaaattaagaagcccatccttgttgttttgtgtgtactttatttaggccatcagcagacaaaatggaaattgtatttcgtaacccacagtgtggtccacaggggaaatgaggagttgataagtatacatccagtacacttactcaaagtgataattaaaactggagcacagaaatgcagaaggaaacttggaacgaaattgtcaatctaaaaattgtcaatttaaaaatcttgcctaattttttctgcaaaccgtggttcccaataatctatcacagactcacctctgtccacctgggttcaaattagaagaagggaaaaaaaaaacatagaaaatgtgtctgtatgcagggagccctgctggtgccacagtagttaagatagtattggcattgcccccattaccttctaggataaaaaattagctaagaggtcaaatacatgggtgggttcatgtttatattaattagttaatctattaaattattttttgattcagatggaaaactgtattcttccactttaaagaccaccttgaaatagttatttcaaatgttttttgctcaaatacaacctgccacacttcctccagaagctaggctgtgatatatggctgtgtcgaatctttgtctttccggtttctacatcttagcattctactttaagaaataaaattctataattattgaattgcaaaaataaagagaacatatgttgatcaatttctgccatacatttttatttcctgacttcagattcagtttttttttttctcaactgtcaagcaaatactatagaaagtaatctttgttgtagcatcccaaaacatttttttagccatatgtatactgttgaaatggagaaggcaatgacaccccactccagtcctcttgcctggaaaatcccatggatggaagagcctggtgggctgcagtccatggggtcgctaagagtcggacacgactgagcgactttactttcacttttccctttcatgcattgaagaaggaaatggcaacccactccagtgttcttgcctggtgaatcccagggacgggggagcctggtgggctgccgtctctggagtcacatagagtcagacatgactgaagcgactatgcagcagcatactgttgaaaacatctaaaatagttaaaaactgagaaatgatttagatacatatctctgggttcaaatctggacttaacactaagtggtcttaggcatattactgaaattgtctaagttttaatgtcttcatctaaaaaatgggaataaaaataatacttaagcttagacacttttgtgaaattttaatacataagcagagcttgtcccagtactcatcccaaagtaagtgcttgataaatgacaactcttaacaaaatatcaggtacccaaaaagtagttgagcaataaaacaaagcttccaaataaggcattctcaaaaccaaagtggtacaatgaattaaatgaacatgtaataaaattatttttgtccaatgtaggtatgtaagaactttgtagatgtttactcttctcctggatgtataatgtaaaacacctttagaacatttttttctgagactaactccagtactttggccacctcatgcgaagagttgactcattggaaaagactctgatgctgggagggattgggggcaggaggagaaggggacgacagaggatgagatggctggatggcatcactgactctatggacgtgagtctgagtgaactccgggagttggtgatggacagggaggcctagcatgctgtgattcatggggttgcaaagagtcggacacgactgagcgactgaactgaactgaagtacagggtaagcattaaatgggatacaccagggtcaa

SEQ ID NO: 57452 - DNA, 1233 bp, Bovine  19866881146158
taatttcaattaaagtatttaggatttaaagcatgaggtagttacctaatgttttccctttcctcctcatttcataactttgatttattcaaaactgaccaatccatatcagacatgtcctcatctgcctaaaaggtctgccattagaacagtagcatatttgcctactttatgtaggttttccattggtgcaaatactactatgtgatataaacagctagatttttttccagttagagtgtttttgaaatagacaaaaggttaaatgttggagtgggccaattttgctttcttttttatagaacatggacatacgcttattctcccttcagtagtagcatgacctacataagttgtgtgtggctgtgattttctcattttccccagtgagagagagaaatatcgttcccccccttccattgccctcctgttgccacaaaagggaaaaaaaaaatgatcacaggagctttgaatacaatttttgttgagcttgtttttttttttttcccccccctctcctcaccttaggtgaccagatcgatagacagtccagcagctgagaaaaaaaaatcagatgactggaatacagccagaggcagtttctctagtgtggcaagaggccattctgatatgacaaaatttaaagtaaatggcatccaaggagacactggtttctcaataaatgtacaaagggaaatgcaggtattaaagtgactcctaaaaacactaatatctgaattgctcctccaaaatatcctctataatgaaatagagttttcaaggccatgaatgatttcccatcttcagaagttacaggcgtcatgaagactaactcgtatatatacggcaagagccgcaagttcctgttcctctaccacactgtgggcccaagtggctgcgtgtgtgcccagccttttcacagtgagcagctcacatgcccaggaagcgaaacagaaaatccggcctgcaaaccagctgcccgcggtgctgcagacacaatttgccttccttgtctgtacaagagctgcagctcctaacactcgactggttctcagaaaggatgaggacacagatatgtccagcctgcttccctagtcagggaagtgtgtttatccattcaagagtatttactgagctcctgtggttggaaaggtatatagacatcatcatatcacagaaatctcagggaagcgggcgctttaaagcttgcttttgagcccaaggtatgattat

SEQ ID NO: 57453 - DNA, 1307 bp, Bovine  19866881178836
tgtggggatattgatttataacggaaagcccagaaaatggaagcttcattttcctggccaaaaatatagtagaaaagatgtgacataaaatatatatgtgaaatgcccatggcatttatctgcaaacccattcagaaattaacttgtaaacaaagctctttgtatattatgtatccattcattgggcagtggcttttaaagtctaaaagtaattatgaaaataaatttcaactggttttggaggctgcatttttcattccatgaaaagtttgttagaaatggggttcaagtccataggctagtctataagtttataccaaatatagtggaaccagaatactaacattatttctcataaaagtcaataaactgaagtttaaatggaaactttaccatttccaagagacttggcctcaatttcttccactgcaaaactgagataatgattcagacctcatagatttattgtgaggaaaagcacttagcccgggcctagctattgtatatcatgggagatggtaggactatggccaaatgagtacaaggtggaatttccagtggaccctaagcctttagatacggctgcaaatcgacactggtcatcatttggggttagaatcatgtctggtattttcaccctaagcttctttgtctatacacatctttgctgcaaacattgttgccatgtaactggttggctataaggcacttttgctataaaagataaaaaacaaaagagagacacttttttgtttgctgatttgtatcgttgtttagcattgcactttgactttgttactaaaacatcttccttcagtaggagaggtataagtttccagctgctaggaggcacgtttgtaactgagctttgcattgcatcgtgaaagcctctacacacttgtttctctgtgttgtcacccacctctttatattgatagacgttctgtggaaaatgtgggttcaactctgcaccttggaggctcttgtcctctttctcttccaatagagtgtgtttgaaaataagaaaccaactcaggacaaatcattgtcatctgtcagctcgagaaagccacgctgtcagctgcttgaaaccaagctgtcaacccaaactgtcaaccagttattttatcttttatggcaaaattgccttacaactgattgcttatgcaacaaaaatgtggtaaaagtgctcacggcaaagacatcagtgccaaagaagcttttggttgaaatacctgtaatcacttagaataactcaacactggctaaaaaagtaggagcatactccatgtgcacacacatatgta

SEQ ID NO: 57454 - DNA, 926 bp, Bovine  19866881181698
tattgctaataattttcggttgctaaaatgagtcgtcatcaaaagaacttagcaccttaagatctttgctgcataattgaaaaagatgatcatagccagccctattttgtactgttccaaccataagttattctcatatttacttagagtctaaaaccatcataaattagaccatatgctccttttcacccctcagcatggtcccccatttgcaatattgtagagaaatgtatgtgaagcaaaccaaagtggcctatctcttctgcaaagtctacttatttcttttttcattccgcaacaactgaatattttcacaaggaattattttcctttttgacacttgtgggcaggtattattttttctctttgtttataactttggttttaggattaaaatcatgacagaatttccagaaaattataaatttatgactgtgttccacaaattgtttcccagaagactatttcctttgagtggctgtctgtgaaatcttttaaaactaacaaaagaaaaattttatttcatatattattcttttttcctaaaatagatctaataaataaaaacaacttttttttgctattttactacctgtaaaatcaatgacaaatttatttttttttcctatgagtgctcctcatgtttaaaaaccaagcttctgttactgctcctgtacaagattttaacttcacccccttggactttataataactactcattggtcaccccatgcttggcatcctgttccatttcttcccccaatactggtgtgagggttatggtttctaaagtaactctggccacgttccttcctggtgaacacttacaaaatccgtcttcctgtgttggtacctgagtgttcttcccaaggaacctccatttgccttccaaggctcctctggtctctctgcttcgtgacttagg

SEQ ID NO: 57455 - DNA, 1250 bp, Bovine  19866881432990
tatgtgtgtgtgtgtatatatatatatgaacagttcttcctaagaagatgcatttggggacttttttccctagaaaaatttatgtggataacagttcatcagttaccctgtgacacttagcaggttatcttaagtgaataggtttaatcattttattattattttctttttttcttttcttttctcatttcttctttggcacaaagggtctctgacagttctgttacatgtattgctttactctctacctttgatagttttgaaaggataacataataactacttttgtcaaactcaaatggagaagattcaggagctttccattttatgtaggaactcggaaaagttgtttgacaagattagacaaaaggtcttctgcttccctggtggctcagagagtgaagaatctgggtgccatgcaggggacctgggtttgatctctgggtcgggaagatcccctggagaaggaaatagcaaccccttcagtattcttgcctggaaaatcccatagacagaggagcttggcatgttacaatccagggggtagaaaagagtctgacacgactgagcgactaacactactacttctagacaaaaggtcttctgattactagtctagtggtctttgcacaatattacattacttttcacattgtgtcccaaaccacctattatgttcacagagtcacatgaagacacagaaatagaaacagcactctgaatgaagttgattacattttatggcaatcaactgggtctagaaactttaaaataacacacacattttaatgccatatgtgtctgtgaaagaataataaagaataatgctggttcttgtttcatggggtttacagtggggcccctttttgtcccataatttccctaattagtctcaattgcgttctccctctaagttcgcaggccaagatagtatctgctttattgccatgggaggaaaacttgctcttattgagctttattagatactccattctctcatttagaatcctattaagtttccccttggcattttctaaatcaattagttttagctttacccttcttaatatgctccttttggaggctcctcatttgagtccctaactctggtatttgtagttgcctttcccttttcttttgggcaaagatttcaatcaattttccccgcaatagtgcttcgctggcgtcccacagagtcgaatctgtgacctcaccattatcactgtctgctaaatattcagcccatatgt

SEQ ID NO: 57456 - DNA, 752 bp, Bovine  19866881791120
aaaagagtctttgtaaatgtgctttccttatgactttaatttcatgttggcggattcctactctcagacccctgtagacttcctggtccgggaaaaaagcttttctctggggtcccctgagtaggtttgtgacaactgaaaatgcgcaggtaaaactaacacagaatagtcatttcagagccgattttctgcagtggcaaagacaggcaagcagtttcttacccaccactggttccagggagatttttctcacagcacccacccagcccacatgaaacactagacactgttggcgagtcctttgggggataatttcattttcatcctgtttcacttccccttagtctttggaaaggagcatttacattcctctggaggagggtgtagtggcccactccagtgttcttgcctagagaatcccatcgacagaggagcctgatgggctacagtccatagggtctcaaagagttggacacggctgaagcaacttagcatgcgtgcagtgctcaaacctttaacatggaaataaaacctacccaattcagagagtgagtaaattatcatgtctttggcataagacatgactggtttcttcaattaaattcagaccgaaattaaaagcactcacacatccagataaacaccaaagcacagtgttagaaaagacagaaagaatagtgtagaaagtgtgcctggcaacaagaacagccctgtaacatattagcagcattgaagatatattacgctattca

SEQ ID NO: 57457 - DNA, 908 bp, Bovine  19866882019574
tctttcctatgacctttaatttttccaatcagtcttaggaatgcagcgaatgaaaaatcaacacaagcgctcattctgatctttgggaaagttttgtcacactcggctgcatctggtagtttgactttggacagaatctgaaatgaagcttaatgtgagtgctatcaagtgattctaggaaaatgtcagaatacaagagaagaaaacaaaggtcttctgtgctggatttgcattcccttctgaaatctttggcacttgatatcagagagggagttgtgttatttattttcaatatcctgcctttctcttcttccctgtccgtagagaggggccatcagcttgctccccacagctcttccctccctgtgctggggcattgtgtccacccggccagctgccttcagagctggtgatgagatgagagctgtgtctcgctggagaggggtgggtggggtgtcctgactaggtctccctgcctgccacaaacttcttgttgcttccacaaggctcagcttccagggatggccagatcaatgtgatacccggtctcacgtgtgctcctctgagcagggtccctgcaaggaacacttgttgtgagtgagtaccttgaccttgacctcgtataaaacatcagagttcaagttcaggtaggacttgcccctgggttggtggagccggacttatggtgtaacattttgagcacttgaacagcattacagctaaaaaaaattaacctcaaattcagtgggaaaatggtcaggacaactatttgtcaataaacttcaagtataaagtataataatctttctaaacttaagaatgttaatcattgtaaaacagcatattcccatagaacacatctgattcgtttaaacttacacagctgtttctttgagacattttatgtt

SEQ ID NO: 57458 - DNA, 1522 bp, Bovine  19866880189346
gaagttcaaagcatttgccagtgtatttaacaactgaatattagcaaataaaatggcaaacatagtaatgaagctttggatttcatatagataattaatttgtcttttccatctatcaagagtagaaacttacaaagcaactcctaacaggggatagaggtggtgaatggagtgatcgaaccatttattcattttgtgttcatttattcaatcagcaaaaatgttttgagtgcctgctatgctttgagcatcgtgttaggtttcatgatcatgatcagagaatactcaatgtttggggaagcaaccatttagatcttgacttggtctcactggtcttttaaacactccatcagacaacctaaaccatattgaacaagatggacttaatatacccctcagttcagttcagttcagtctcgttgctcagtcgtgtccaactctttgcaaccccatgaatcacagcacgccaggcctccctgtccatcaccaactctcggagttcactcaaactcatgtccatcgagtcagtgatgacatccagccatctcatcctctgtcattcccttctgctcttgcccccaatccctcccagcatcagggtcttttccaatgagtcaactcttcgcatgaggtggccaaagtattggagtttcagcttcagcatcaatccttccaatgaacacccaggactgatctcctttaggatggactggttggatctccttgcagtccaagggactcgcaagagtcttctccaacaccacagttcaaaagaatcaattcttcagcgctcagctttcttcacagtccaactctcacatccatacatgaccactggaaaaaccatagccttgactagacggacctttgttggcaaagtaatatctctgcttttcaatatgctatctaggttggtcataactttccttccaagaagtaagcgtcttttaatttcatggctgctatcaccatctgcagtgattttggagcccaaaaatataaagtctgacactcctctcagctgctgccctgacctcggacgtgggaacatattcctcaggtttactaaaaggataggttaaaagggcttctgtggtggctcagaggataaagaatctgcctgcaattcgggagacccaggtttgatccctaagttgggaagatcccatggagaagggaatggctacccactccagtattctttcctggaaaattccatggactgaggagcctggcaggctatagtccatgggattgcaaagagtcagacataactgatcaactaactcatttttactaaacgttagacaggcttcctcctgactttaggtccctgaactctctttacttagaacatttactttagaaaactttctatcataaattatttctctgtccctttgaataaatctttctaaaagcttcttgcccttattacaacccaagaatgtctttctcaagggcctgaaagctatccctttgaaacataatcatcaaggagacagtatgcctatctcccagt

SEQ ID NO: 57459 - DNA, 1031 bp, Bovine  19866880369681
caaatgtgttcttccttttggaacaggttatttgggagtctctgtttcctagcatagaggccagatggcagcagtcacagattgccatcctctgcatgctggtagttgtcaacttcagatgctaatgtggtatcagaggcaactactgccaaataatttttaaatctatatatatgagtgaacatccactatattctaggcactgggcaaacagttataagcaaaagctgattagtattgttttagtagagcttgtggtttaatgaggctttaagaagctgtgcaatggcaaattttatcctctcttaaactaattctgaatttttatagaattctggatagcataatttggattaattggggagaggtagggagtaaacatagggaaaatgagcaggtagatcagagtatcttctttctcagacacagtaaggggataggaagaaaaaagtgggtggttatttcctttgcaatacttccctttgtgctatacatcactcacccaagggattcaatctggcagtttcttcagtcatatctaattaaaggtcatgccttagaataggagaataatattaatatgtgcacaaatgagaagttgaatggggtataattatatgacttttgtctgtgccactggaagggtggatttaatatcagctcagattggggaaagattttaggggaaaaaaaatcagaaatttaggtgtcggttatgcaaagttggagacatccatttgagaaaagttgagtaggcagttgaatttgaatgtatgagttcagaagagaggactgagcaagatatataaatttggcaaacttgggcatagagatgcattactctttgagtataattccaaaaggatagattttaagaagaaaagggaatgaactagccaaggatactcagaaggagtaaacataaagtgggaggaaaagtaagagaatagagattcaaggatgaggaagtgatcgattatgttaaatgtagacaagatatgtcagaggcctcatgcctgattcctgcgttg

SEQ ID NO: 57460 - DNA, 4619 bp, Bovine  19866880424671
aacatctcaggacagtcttcacggaggagtgtaccactggaggcacttgattacacaatcatcctgggggtgctgaaggaagctcctggccactggatgttttgaccgccatatattttaggcgatgttctgtaaacaagccactcacactgcagtgtcatcaggagtctggtgctgtgacagttgcatatgctgcaaagttggtcccgtagaaagagcaggcttttcttggttttgctgttctcactaacatttcccagcttcccagatggaacaatgataaagaatccacctgccaatgcaggagattcaggagatgcagattcagtctctggattggaaagatcccctggaggaggaaatggaaacccactctaatagacttgccttggaaatcccatgggtatagaagcctggcgggctctagtctgtggggtcacaaagatttacacacgactgagcatgcatgcacattggtatttccaaataaccaaagcaattgtaggaggcaaaaagaaaacctggagaactcatcaccatgctgctcctcaagccctacttccctagtccatcttccttcttctcttcagccttcttatgctggattgataatttctttcaagttaccaattgataatagactgattacttctttccttaagtatttaacaactgtttatttatcactaactttctcagtgatataaccttcatgtttttattggttttgaaatattaatgtgacagataaaaatacaattgtggcaaatcaaaatataatttgcctacgcaactcaagttttgctaaaataaatgttttcctcatcagaaataattttgtcattcaacccaacttaggtctgcttgcttgaggtggtgaagaaagtacagtgtttattgccagacaccaagtaaggagaacagtcagctagtgttcagaaaactcaaacttgtcagtggctttcaaggaagggtttttaaaggcaaggagaaggagagggtcgtatgcaactggctcatgtacgtccttctggttggttggggctgaggtaacagaatggttttccaggaatctcaagtatcagttttctggttcccactagtctgggatctatgttctggtggtcagcatgtagtcaacttcttcccttgtgggggtttcagtgtctgcaaaacaactccaaggtatggcttagaatatgactaagagctcttgaggaatgaagtgtccttgactctgtttttttggctaagttaatactattttgtcttgcttgactgttttcctaggacatgcaggatggtgtgtctgtccctgggaaggcccagagggtgctgctcagtttcatagctggggttttcagcttcacttagaagtaatggggagaaaagtttctactccatttccctgaccaaaagtctagctttgcatttaaaagtgcttttctctaagcactgtttttctggcttttaaattactcttttgaatcattatgttctaggttttaaaagcaagaaacaaacaaaaaaaaaaatgtttttttctcttctggcacctacattggtgtttcttttttatttttttcctttcctttttttttttttttttgccttctttttttcctctcttcatctttttccctttctagttttccctcccttccatttgttcacttcctcctctgtctctctggctttcctgtccttctttccttaagtaatttaacaactgtttattcatcactaactttcccagtgatataaccttcatgtttatattggttttgaaatattaaagtgatagataaaaatacaattgtggcaaatcaaaatataatttgcctacacaactcagttttgccaaaataaatgttttcatcatcagaaataattttattatttattttaaaacaatgtaactggtagcaaaatggcacatagacaatagacagacccaaatcccatagggttacaagaactaatattgacttcatattttacttgcatgtgcaagtgtaagtaatttaaaaaggcaaccgcttgttaaaaggcttttataagtgtgtttttattttttaaataacagaaagactaataaactatcatcattatagcaagctgatctgaattctgttaaattttaaatttggactaatgttcatagtcaaaaataattattttaaaatttatgaaacaaattttttattttcatagaaaatatagtcatgtcctacctagcataaaatcctagtcttggcaactgtcataacgcaaaaatactcaatttgagatattggaggaaatagaagatttcataaaaccttacatttattcttaaacacaactgtaacaggtaaagacatggcaactcaaagaaagatcatatttaaatttcaatgtgcaaatatgaaacaagttcattaaatttattattgtcctccattacatatatgaattcaattctgccttcagtttgaataatttatatgtgaatatgtctatcaaatgtatttcacctgtgttcataacatatacacatgtataagcataccatctttgttttaagctatgtttctatttccttgtttggttaaagagaattaaatatagggtctccctattttaggggaaattcttgatgttcatgttattctaaaatgaaagtaatataaaacactaaacaaaaacaacaacaaaaaggcatttcatatactcaaagccaaattatacaatagctataatctaaactttcacattttatactttaaattttatattcacagaattatggggaatattagattttatttatttattacctttaatcttattttcttttcaatttatctgcttctttgtgtaaagaaatgataccacgtctctttctagttttaaatgttctactttctgttgaaataaaattcaaagtaaaattcagaaaaaaaaatttggaacaaaaatatcttttaaaatttttcagtatctatttcatgggaataacaacacattccaactaccttgcaaactaagctctgtgtttttcaacccgtttctgaaggggactaatgcatacaggtaagagcactggagtcacaaagggtcaacttttcttttataactgtcaaattctttatggtctgcattaaatttaaatggcagaaactaccttttctttttggccacaccacacagcttgcaggatcttagttctctgaccagaaatagaactcaggcccttggcagtgaaagcacagaggcttaaccactacaccaccagggaattcccccaagctacctatttttattgtgtatgttttccacacagtgttaaagtacagttaaattagataaaacttttgatatagcattttctggaatatgattattttaatgctaaaggcataaatgaggacttctaatgttttgaaattctttttactctataaaaagcataattatacctctattaaagtatctttctaatgaaatatactatatagatatataaaaaatgttaaagctcaaaattttaatgaaaatcattacttaacacttcagtttcaattcttggattaaatttaagtagacaaatgtgtttcaagaattttccctatgttaggtatactcttaggagaacaatatgttaggagaacaataaatatttgcttttatacttttctttgcatataatgtgtgtcaaacataaggacagggaaaatttcatgtagttaatatttattttagttggttttgatttcttcagagtaataaaacatgctatcaacatgacaaattctaaaatggatatcatatcatatgaaaaggcaacaaaaaggttaaaatgactgaagaattcatattctaaagaaaactatgatccttacacagaagtcagccacataaatttgtttatctgagtaaagaagactagacatagtatgatgagctgtttttatagaacagcaatgtaataggacatatttaattttaagaggagcaaccatcttttatgtccattgggatgcaccaaacatagatttctactttactttcataaagccttaatactttttaaaaaattggtttctacaacttgcatcattgtcaaacaaggaaacatcaggtttaaatttttgtgttctgatttaggttttcaaaaccattccattgatgtctttcaaatattaataggaagagtaccaacaagcagtacttcacatttcaaaatacgctatacttccaggagaatagatttttttaaatatgagagaactggatatattccaatatagtttatttcatgccagcaatgctttttctttcctaagatctaaagttgtttcaagcaacatccttggaggggaaaaaacaagaacaaccacaacaaaaaaacccagcttattattattatttttttaatcaaagctgagtttcctctcaagagtcctgaaccatggtgttgcagatgttgtttttttgactgggttcactgttgggtagttaagccagtggatctgggttggattaagtatctaataaaagaaagcaaatgactgcagtagcaactaaaggcaaagctcatccaccctgacactttagactgttacttaaagtttatt

SEQ ID NO: 57461 - DNA, 1906 bp, Bovine  19866880685965
atatatactgaaatagatttggaatttttttttttttttaatatctttattttccaattaggcttctttttttctcaaaaatgctgaagttggctctccatctctcctgtgagatgatgctgtataaaatatttctctaacagggcatgttttgttactgttacacatatctttagctgatagacaagtagcagtagattttatctaaaaaaatcaaggcaacaaaccataatgaaatcacttgtccagtctgttcctggattatgattttaatacttttatcttctatttttccagttctctgttatatgatgaaaaagagttttaattggtcgagtcaattaggattttccaaatttatttctcttttttaatgttaactgtaacctataaattcactataatcttttatcactaaaactattcatttttaagacctatcctaatcaaataagtgaaatatatgccacaatattagaatacacacatcacacacacacatatgcattcacagctctaacatattctgcttataaagtagttcttaaaggaatatagaaaaccataatctacttaaatctttctttaaaacttgaaaataatcccatttttctccattgttttgaattcacctatatttctattttaagtcatttgacttgtacttgactcttgaatcctgatgttgggaaagagtgaaggcaaaaggagaagaaggcagcagagatgcttggatggcatccctgactcaatggacatgagtttgagcaaactcagggagatggtgaaagacagggaagcctggcatgctgcggtccatggggttgcaaagtgtcagacatgacttagcaactaaacaataacaaatttgactcttggacccagattttctcatttttctgatatggactgttccattgactttaattatattacttatatcttaggtagaaaggtagattcttcttttctcattgaaggatagaataaactttacatacaaaatatggcatatttcagtggtgtttttccagatatgaattggaaatggaataagctctttgtgcaactctctgatgagaattgcagcctgtaaggcagtacactgcaatcctctattttcaaaagagaacaagaatgattacatttgcaagtcaatgaagagagtgacatgggaaattctttgttattaatgttctgctagatagccatttaccttaaaggaggaaagttttaggaaaattgaaacagtaaaaatgctactcagaagaatgactatttcatccaaaagttgctcaggaatgtatttatttgtagagcccagggatatgtgaaaaaaaatgaacacccctaatagaaaaaaaaaaaatcaaatactccaaaccatgtgcaaaaagtatgtttccctctgtatataataatcttttggtttcaccaggctgtatgtgatagctttaatgattagacttatttacccacatttcactgatataaataagcatatatgaccacagaagtccccttagttctcttctaatcattagtgcaataattgattccagaatatcttgttcacaagaattacaggtgagaagaacaccatgcacttggacgtctggcagaaggagaagatgaatgcttccacctcaaacatttcaaaagctttaaataagaggtctacaaaaatatatatttgtagtctcagacattagatatctatataaattttaacaaaataaaattctgaaagattttatgatatttcatattcagaacatttaaacttctcagtggagcttcttaaagtcttggggaaagattcacattcaatgtaaatattgttcaatcatcaagctgtgtccaactcttcacgaccccatggactgcaccatgccaggcttccatg

SEQ ID NO: 57462 - DNA, 2208 bp, Bovine  19866880740559
aagcgacttagcagcagcagcagtaatattggcatttcttaaatgagggaagattggttcaggtgttgccttgtactaacctcaggaaatttccttcatggaaacaaaaaatgctccaggtaaggttagcctcaacaaataagctgaactgaatttgtttgtctggcgaggctggttttgtctgagtagggaaatagcaaggctggtctccactggtttttcattttaaaaaattctaactgaactctcccttctttatgtttctgcccataaatgaagttaacctcaagccctaaacaggcttgcttgttatttgctattgatttcatgtcccaagttgcaattcctctgctattcctgaataaactcatccttttaaaaagattatttaattttaatggaaggatgattgctttataatattgtgttggtttctgccatgcatcagcatgaatcagctatagttatacctatattctgcatttcccttgtagctcagcaggtaaggaatccccctgcaatgcaggagacccaggtttgattcctgggtcaggaagatcccctggagaagggattggttatccactccagtattcttgcctggagaatccccatggacagaggaggctggcggactacagtccatggggtcacaaagagtcagacaggactgagtgacacagcagagcacagcacatacatatgttccatccctcttggtcctccctcccaccccatctcacccctctaggttgtcgttgtcataaagttatcatttggcaattttgagttgcttccttttcccttttcattttggtcaacaaagccatgtcttgtaaatacgctattaaatgcatattattaagaatctgcaagaacaaaagcttagcatttcagaattgtccctgtaatatttgtaaactttttcttaaatagaaactatccaatatgacaggatctgttgcttcataattatttggacttaacagagacatttttgcatgttaaaagaatcaaaattccctgacatgtttcaatatttctcaacaccctccttttgcttatcttttgatataaaatagctaccaaaacaattactaaattcatgtaagcttgaaggaacttagtgaagtaatttaatgtctttttgtgtcatgggtaaaattcaatattcatctgagtccaaaatcaattgtttctttgatgatactctcccaatgtcattgcagaataaactatgggatacagatgatgatcaagggtaagtaagtaatttgctttgtgtgcacaatattgatcacttctgtagatttgcctgtgttgtaattgccacatcttatgttctggtatggatgactgcacccacttacagaggcagctactttgtgctgggcatgcagatgaagctaagtggtgggaaattttggctgggtgcaaaggtgatttgtcatccagcaccagctcctcaatcttgtaacatggcaattgtttctgttcccatttcttaccaactgatatgctttgtccaaggctttgagggctggaaactactggccttggtacctgcatgatgaaattgggagaaaattgttcatatgcaaacccataacaaatcatttatttttcactattgcattcccacagagtaactcttatgctttctgtaatcatttaatacttcttgatatgaacttactttcattaagtccatgcaagcaattctcaaaactatatacccacttaaaaaatatcagtagggaatcaataacttcagatattcaaatcacttctaaatctttatttatatgttttcttttgatattaaaattaggatggagtcaaatttgaatctcataattatggtatagtttgaatttcatagagggaacacagataatcatgagagcccagaaattttgtgatagactcaattcttctgtattcagaacaagagtccttaccagcttgaacaaagtttccagaatataatcatctcagtagaaaaaaaacaaataatgggggtaacaagcttattaaaaaagacagaaagaaaacttcagtttatgtaaatttaggaatgatattctggatggtaattttattgagaatcataaactctgaagacctagccctacatgcagaccttctaaatgtttgtatgctgaaagatggagtgtaaatgtttcaggtcaaagatcctgaagtaca

SEQ ID NO: 57463 - DNA, 1592 bp, Bovine  19866880797059
gattttgtgcattatgcacaaaatgcataatatccaaacctcttataatgaaaattcaccacacttagaaagcttttgttaaatctatagttttttttttttttcccaatacagtaatcacttataaaaagcatcagttctgaaatgttagcttcatgatgggcttatttctggaaaagaacaaagaattcatcctaggactcctagatcctggtgattctgcttattatgccacaggaatggtaaatctaagtgttgttgggtttatgtttagaaatacaaagtaacgctgccatagagttactccatattttaaactcactaaaagaaagttaagtcttctggattaaatattttaaatataggtattcttaatattagagaagaaagtgcttttgaagagtctcttgttcccaatttgggctaacagcaagtagattaccataagtcttatactttttaaagtgctttttttttttagagttacctagataatagttctaaacttgtactttcttttatgataaaaataaaagcctggtacattttaggaaatcatctgttttcttgaatttttattggttgaggaaagttgcatccataccaagtataaaatagattaaattttatttatattgtactgcattatgtcaataagaagaggaacatggagagttctacatgcttagtacagttaaagctatttcttagaaactatcttttttctttaagaagttaccttttggaagaagactaatgcctttcatctcgttcaggaaaatatgattaagtggaacaggtacttaacttaattttgaaaggcatgtgcctgccttttggatcttatttcacacttctctatgtagtgccatctctagatttatgttttctttttttgccatcattgcttttatcctgagcctatattatgtaggctcatggggactccctaacagccaatgcaacttttggataatttctctatttttcatcagctatttttaggggagataatttgtgaatatatctttaagttcagaagacaacctgagattttagaactaaacctaatgaatataactgaaaaaagacgtttatttttagcaatgagtatattgcctccctgtataattttagattgtgaaagtcagtcctcaggtggaagttcattatttgccacaacatacacacacacacacacacacacacacgcacacacgcacacatacacatgcacacgcacacaccaacagatacagcttgccaaatgtgttactttgttttctttcatcttttcctataaatctagtttccaaaaaaatatcagtcttcatgctcacttctacctggacccacccccagtccaacagcatatgtagcatttttcttagtttcccactcctttcctgctccccaagttgttctttgtatcctttaatgctttatgtgcaactttacattgctagctgactgatgttcggcaatgcctctgaaccgacacagagtaggccatagcctcccaaagccactgcccatgcataagcagtacagccggctttttgaatgtatttttcctgtttttattttttatt

SEQ ID NO: 57464 - DNA, 1405 bp, Bovine  19866880926997
atttttacttaaatattataatactttccaggtcatctcatgatattttgggttttatcatttcaggatcacccaaacattttaagagcatgggctgtaaaagattttgctccaaattgccctttgtatgtccagatcttaaagcctgaaaataaattccatatcaaatttgctggtaagtttgacctccaaatgagatcctttaaaccttttccttaaattcttattgtcattgtaagagttatgcttctgaagttagtggtagtttattatacccatgttctgtagaacaggatttatttttatcatctacttgttataagagaattaattcactttaaaatgtaaatctttgtgttaagtccttacttttttatataacttggtgattttggtaactgaacttgctgaacacccctagaagcttaattagattagctctgatagttgagtatgaaatatacacacaagtttcaaatgttatatatatatgtagatagataacactttgctatatgttattttatatacatataaacttactatagaatagaataatataatgtattcagataatttaaatagatttaatttgagggtagatattgaaaacaattcaagaaaaagatacatgtgaatttttcatacaagtgctgcttttaaaataattatccacatgagattatactttaaactattagaatattgaacaataaaatggtactgtatcatttcctaagtgcttctggaggaactaattttgatccagagataatttatgtactttttttttcttcaaatataagaaactttttaaaaaaaataaaatttaaccttaatggtctgaaacgtcaaaagtctttaaaaactaaatcattttaagtatgtatttgcaaaatgtatttccttcagaagattcacacatcttacaatgcttatctattagtatatgatatttaaatgaaattttataaacactgggcttccttggtggctcagatggtaaagaatctgcctgaaatgcaggagacctaggttcaatagctgggtcaggaagatccccctggagaatgggatggctgtccacttcactattcttgccttgagaattccatggatcatggagcttggctggccacagtccatggaattgcaaacagtcagacacaactgagtgactaacacttataaacactaagaagttttaaagtagtgatattgtaaagtaattaacctctaattaaaataagtaaatttatatttaaaaaataaattaaaaaaaagtagtgataagagtactataaaattattgctattcaatttgttctgagtcatcttttagtcttcctactaatgacatcatttttttctaaagaagtatgggaaataaagcaatgactctcaa

SEQ ID NO: 57465 - DNA, 1393 bp, Bovine  19866881137569
ttctgttatttatatgacaatcccaggataaaagaaaaagaagcacaaaaaagactcaaatataagaatccagtaaatctacaaaggtgttaaaaagccttctccacttgtgagaaatgtaaatgtactattaacaggagagtcaaggaccgtggagaaagagaaaacagcctgcctgttctctttgctgtggatgtgctaacagatttgtcagcggcagaaagccactcatggattaatgagtccctgtaaccatgtccagtcttttctccaccccataaatctgacctgggaagggaagtaaaaacatggggaaacaaagagggctccaaaagaagagttaggcaatttgcaaggtaaacctataatctttatttagaaagatagccaggctgatatcagttgacctttggagggctcaccatcgtcatttacagaaactgacaactaattcttggcaatgcaggaaggggaaaaaaaaaagattacactttatttctaggtcaaactgtcaatatcaggctagcgacttgttttaaaaaagcactacttatcattgagattgcttaaataaaagaaatcctattgtaattatataaagactgtataatgtatattatatgtgtatctatttataaaattcactgatttaggtaactactaagtacatcagtatatggcaatattttaagatttaaatattaaaatcataatattttgaaaaacaattttctctttttatattttacttatttactcacattcactgctatcatttaaatagacatttaattttacataacatgaattttctatctcatgaagattaactatacccagttttagaaactcaattcattttgagaagcaaataattcttgccatacacatatttatgtgcttttcataattttggtcaatactcacaatactgagcttaaactggaatttcaaaaatccttcacatagttatttctgccttaatgcaatttagttttacatgaatattgatttgtggcactattttcaagatcactgtcacagaaaaaaatcttttgaggagttttatagtatggactttgacaagttttattttgttttttaaaccaagtggacatgcatctaaactatgcagagtagaggacaaaatgccaactaatcaaatatgtcttaaataccaacacagaacttgattactaccttcccgagtgattcaatggtaaagaatctgccagcaatggaggagagaaagggcgttcaacccctgggtcgagaagatcccctggagaaggaaatggcaacccactccagtattcttgcctgagaagtcccatggacagagacactatcaggctacatacactctatggggttgcagaagagtctgacagca

SEQ ID NO: 57466 - DNA, 609 bp, Bovine  19866881306105
ttttgaaaagtagtgttttagaatctagtgtttggttgtatctattggctctgcacaaactcaaagggaatttggagaaaccactgagggaagtatatcgtactttataattcctttcaaagttagagttaaggacctactgctagttgtaaaacagttatgtgcagctattggtctgacatttattatttcagcaatacctctgtgtagaagactatataaaagatacattatttacttttattcattaagatcttcatttttttttttatttttcttggttaattataagccctgtttttgaaggcttataattaaccaccccaccccaccactctccgccaaatgtgggatgtgggatcttagttcccagaccagggactgaacccatgtctctgcattaaggctgtggagtttttaccacaggaccatcagggaagtcccagccttgtcctttaaatccatatgttttcatagtttgttagcaagaagacaatattttgggtaatgtctgtggtgcacttatcatatgccaggcactatttgaaggactttacatgaactagcttatttaatctgcaaaacaaatcttgaaaggagatttgttat

SEQ ID NO: 57467 - DNA, 974 bp, Bovine  19866881433168
tgaactgaactgaagtggaaaaaaatttgtttatgtagaaatataattgtaagcattcaatgtttttgtttctttaggtactcaatcatgtctgatcttttgctaccccatggaccataggctgccaggcttctctgtacatgggattttccaggcaagaatactggggtgagttaccattattagtagtttatgtgtgatttggtgaaaatatttccataaaatggctgggaaacatagggtctaactatgctgtccatggtggacccttgtctatttatcacactcttttccagcttgcaaattgctaatgggtagatcatctccaatctcccaagtcttttcatctctaaaatactttgaatatgaaatatcagagaactgatctttacagatacttgggaagagtctattatgaaaaacaaaatgtcatttaacatgattcagatacaatatttgaattaacgtattgaatattttagcaaaactgaagaagcccttggtgtagagatgggtcattgaattctacctctacctttttcctgaattttcatacatgtattgcatttcagcttattcctctctgtcagtactctatttgaaaattatcttaaaaatggcaatttttatgaaatatttcttaatgttagaattcttcatttagcacaaaaatgaaaggaaaatcatgagtgtttttattgcttacaagagaaaagctcaaggactatttgatacatctatgcaaagtattcagttaattaacacagaattttgaggctcagaaaaaatcactacactcaacagaccttcctgacaccacatcatagattgattcttaatggtagtgtagaggtaggtgacagagaaggcaatggcaacccactccagtgctcttgcctggaaaatcccatggactgagaagcctggtggactgcggtccatggggtcgctaagagttggacatgactgagcga

SEQ ID NO: 57468 - DNA, 805 bp, Bovine  19866881514404
tgtattttactatgagggttttttgtgcttgaattccaaaggtcactccctggtcaagcaactttgtaagagaaaaggcagagttaacttggccaggatacgagaatttggaaagaacatttgagggctgttggtgaagtagagtaggggtggggagaaagagggaggaaaagagtagaaaaagaagagaggatgtcatgttaaaccctgtaaagaagggcaacaagagtgaatggtaggaaaagccactaggtttggggttacagtattactgtatgttgggtctgggcagaatctgctaaatccaaccatgttatcagctcattctgtatggcactggctggacacagtttaaagaaaccacaatttctgccagaaacaaatttcttcttccaagaaaatcatgtgttcatgatagcaaaccaaatggaacagataagcaagaccaagggtatttgcctcttcaaataaatgccatcaactttatgcaacacattttctttagatgtagacaactactgtaagtagaaaatatttatttatttgttcaataaaatttcattgactgtctgtgtgccaggcattgggtacaacttaagcaccccatgtggccccagattcataagaaatcctacctatttctgtagtaagacagctcatttgaaccatctccaaaccacctacctagatggttccaataagcattgttgatacaaaggttaataagtcagtgactgcattttgatataatggacacagataccaaggggtcaccatttgtgtatccatccttctccctacattt

SEQ ID NO: 57469 - DNA, 1155 bp, Bovine  19866881551089
taagaggacagggtaatgagtagggagtgattttcgtgtatcagcaaatagcataagtcaatacagaaaagctattttgcttcagacaagatcaagaattatgtaagatttccacatacaaaaatgagtagggaatcaatgatttctaaagttatgatgccacacacttgccattaacaaattatctgtagacagacctagatactgtcacacagagtgaagaaagtcagaaagagaaaaacacctgctttcagtcagcctttctgtcagcgcatcgaccatttttgaatacagatttccttcttgcacagctggaatacagtgctgctttccagatagtggaaagtcattaagggcacacaggtagaccacaacgtgattgtggaagactgaaccatgaaatttactaaagggtaggattgtttaaaaaaggtttgaattgttcagaactccttttcttaaatatcctaaagtaaatacagaaaagattattttattgcctatccaggattgatttacacagtctataaatataagagtgattaccatgtaatgtgggagctattgcttctgcactaaaataagcctctctgcctccaagggtggacattctgctaccaggggagcagacttgattttctacttatcttttaatgatttcctgcaggcaaaaaaaactgaagccaacatcctgctgacatctgtttgttggtatgggtcttatttagaaccccaagtcctaggtaattattcgttttttgttggcagtaggattgtatagatcacaatgttttgcaacatgtaagctgtaataaataaaggaataaacaaagctcttttcttaaacattcagttacatggagcacccagaagacaaaccagagagcttatacggttttatgctagatcgtcactgaatagaatttatcattatcaaatgaaatattttatatttatcaaatttgacatttgatatttaaataaatgtatcactaatgataaatttgacatttctcattaacaaatggaaggcaaagaaactgctagcgttttcttttttttattttattttattttatttttaaactttacaaattgtattagttttgccaaatatcaaaatgaatccgccacaggtatacatgtgttctgcat

SEQ ID NO: 57470 - DNA, 1303 bp, Bovine  19866881827269
atttaaatcttgtgaaagtaaatgacttttaaagctttacttaaatctattcttagtcatttagtggttgaatggttcacagtcttagaattggaagaagtgtgatgcctgctcatgtatacacacacacacacacacacaaaccccaactggtaatttattgatttaaacaacaatatcaaaataaaactcaattgttagagattgtctattctccttgaagaagaagcaattttcatggcaataaacccactcatgcttataaacagagcttaataagcaaaggttatgtgagagatttataacacaatttgtccagtcggtctatgtaataaactcttttcctgtaaaataaaaacaaataacattcaatttttaaaatttaccccatttcgtgtttctctttgaaagctcttttccaaaggatatttgatttctgtaaatcaaaacccagggctagagtggtttcatgcactggccgctgctgtttacagctttccaaagagccgttacctagcaactgtatagaagaagcttccagtagtttaaatcatagacgagctcagaaaatactgtgaagcagaccttaaaaaaaatttctgacttgttaaaatgtaattaacaaatcgactttctgtcaaaatagatcaaaatagatttgatcatgtctattgataactttataactttaattataattgcttatctgaaaagctttcaaatcaaaaatgataaaaatagcaataaaatagaaaccatggatctcacataatcctgctgtttaaaagtcacagtcctgaaaactgtttccccttccttaagatggctactattaacagtttgagtcatgttgtcacacttttttgtgcatgtgtgtagtctgcttttgtatcagtggagttatatccttttactccttaaaattttaaactgtgtcattgacattatttcaagatggcttattgaaatttcatttttagtaatgccgaattgtgatgataaacatttagcatcatctaagtgatccctgggtcaggaagatcccctggagaaggaaatggcaacccactccagtactcttgcctggaaaattccatggatggaggagcctggtgggctacagtccatgatgccacagagtcggacgtgactgagcgacttcactttcacttttcactttttccagtgatctaaatgaagatgatcaccatcatctgtctagcattctgatcggcattttgttctcattatctactcttctcctcagaaaatcccatgaggtaaatactattactattcacat

SEQ ID NO: 57471 - DNA, 702 bp, Bovine  19866881877338
taaaaaaaattactagacgtttagattcactgatcagagaacataattccatttacatggacctgtaatgtctacagcttctaggaaagcctccaagtttaaaggcaaaaataaaaatgagtaaaaatgtaacttcctttaaactcatgatttatattctcattgtgtcttgaaacaaattgaaataattatttgcacacctaaagcaaataataacagtaataatctgttccttagattttatcaaatctcaacgatttaaatccagtctgatatgatttatatccaagtgatatgactttattacttgaaacacacaattctgagtgaacatacagagctacttgaaattgatctctttatcaagatttaatattcctcatgtttgaataatgatttcctttggagaattgataaagtttgcaccctttttttcccattgtttctttcatcaatcacagaactgcaagtaattggatgcctttttggggacagagacaatgagaaaaagcataactgttagtgatttaaaaactttttaattttaaaaattaatctcacattaaattacattttgagcaaagtattaaaagttcctggttcgaaactcaattttgaagtatctgtgttatatctcaattgcagtatatgtaagaaatcataattcataatgaacaattcaattaagcacaaatgacttag

SEQ ID NO: 57472 - DNA, 2090 bp, Bovine  19866881877348
ttcacaagatttaaatataagactcttattaaatatacagaattcaactcagcttgacgttggcaacattaaaaaaacagatgtatttcacttcaggtaatactgagtataaaacacatttttgtgtttttctaattacttgaatccttatgctatgttaatgctgtaacttttttaatgtatcacactaattaaaagctcaaaagaggaaccaagtttcctatatcctagagcaaaacagttttaattttattaacctttttctctaaaccatgtcacaaaaacagaagtattaatatttttttgaaaaattgctgacttcagaactcaatttatttagatgctaatggaaagcatttctcactagtttgtgatagtaattgatgtcatgaaaattgagagtgaatgatatatttattgaattaccttaatcatattgcaataataataatcccaaacaatatttcaccttttatgctaaatgattcatatacatgtacgtatgtgtgtgttattaaagctcacaaaagctctatgatatatattgtgttaaacagtttcagataaggaattagactttcagagaggtaatgtaacttgcctaaatccatattaaattcaaactgcctataaagaactctacaaaagctatacaagtctaaaattgattaaccaagtgcattacaatatatgaatcttctagtggttttcctgtctcctgaacgttctttaaagcttactacttgctaccagatggataagtggctcaaatcaccactaagttgaactgatgattgaaaaaatacaaacaccatgttactcaaactccaaccatttaatgacagagtttggaaagaattggccaatattatagctggactaaaatgatttgagtcactgattcaaagagcttctgaaacacctctaggagacttattagtagcaaatatacaatgataaattttaggacaagaatgcaagcactctaagaatttaaaaaggatatctttctttccctcaaggaatcagaaaaaaaatccccataaaagtgatgtgtaaactaagattttaaggataattaagagtctttagttgaaagatgaggaaaacatgcagtttcttaaaagttttcttaaaatttcttttaattttcttaaacataaatcagagaggtaggaagacatttaaatttccacggagataaattaacaaataaagattttaaaatgaaggggagaataatatcacaaagttgcagacagggcaccaggcattgggatccagcaaggagatgtctgtgtatgttagtcgctcagtcgtgtctgattctttgcaaccccctggactgtagcccaccaggttcctctgtccatggaattctccaggcaggaataccagagtgggtttccatgccctcctccagggcatcttcccaacccagagatcaatcctgggtctcccaagttgcaggcagattctttaccatctaagccaccagggaaaccagcatggaaataaggaaatactattgtaacgggagaaaagcaggaaagagtgggtgaaaaggaagtgacattggggagatacggtagcaaaaatctgaggaaatctttcatgcattgttttcccccatctaagaattaagtgatgagctaaagtttgaaactgtaactgcaagagtaagagcgtgttttaataaaagaaaaaaaaagtgcacactgtgaagggcctgtgagctgcaggaccatgaattcaccaataagagtctgactcactgcgtgaattttgtttctagtggcacttactcagccaaggagcaggagaaaaggatccatccatgtaggattttgtttatgtgtatgtttgctattgtcaatcaggagccatcaaaaatcacaacaaagggaaacagtatactgatatgcagctatgacggaccgcaaagtccaggcggtttacagagggcaggacaaacaaggaaggtgaggcgcaaaagactctacactgatgaggcactgagctggcttctcagctaattgtgatgaaagacagatgtctcttttcaatttccaacttatgcaaacacatat

SEQ ID NO: 57473 - DNA, 630 bp, Bovine  19866882127482
tgtcctgcattggcattgaatatttaccactgaggcaccagggaaaccatagaggattttatgtatatgtatctacattttatataaatgtatctactacaaagatgccccccggggtgtaattgaaaagcatccatcttcagtggataaacaaagtcctacagtatagcatagggaactgtatttaatatcctgtgataaaccctaatggaaaagaatataaaaaacgtatgtatatttgtaactgaatcacttttcagtccagcagaagttagcacaacattgtcaaccagcaattcttcaataacaaataaaagctttcctcctttaactatttttgccgtgcaatttctttaaatgtactgtgaatttattttctttttctttttttttttttttttgtgaaccaaactcttgaaattttattggccactatggtaattggttgaactttgcaaataaagggataaaaaattcagtgtatgtgagggtaaatttattttcatttctggttttcttgagctggttatttacctttagcaatttcatttaatatttgaatacatttactactggcttacagcagctaaaaacattacccaccacagccataaaatcttattggctttt

SEQ ID NO: 57474 - DNA, 1008 bp, Bovine  19866880385572
cccccttggacctgtcggggccccgcgttggctcacggccatcactcttttgaccccctccacgtatttgtgcccctgcgccctgagcaaaggccccttctctccccagcctctcattatccctcctgcctgacttctctggacctctttctctgatttttccttcccttgatattttcctttctctggaaagctctgcatgctgcaaaaacagtatttctcagtgccatatgcaacaggaagcgccagcacaggacggcttgtctttccttcttggttgaaaagactttgtagagagtcatcttgtttgaaatgtttaattcattggtgtaggtttctatgttttcagaaggaaatcgtccttctgttgtcagcagaaccagctttgctccctcttgccacacgcccttggccctgtggccaaaacacagaaaagtccttcctttcccaccctgtgcttccagctcccgaaagggccagccggccagcatttctgtctttaaactttcagcgtgagctgtggccaagacacacatgtgcagggtggcaatcttgtggggcaggggcctgcttgtgggaatgtgccccccccccgccccccacaaccgaccgccccgggggaggggaagaactcatcattcctggaagggccttgggtgatgtagactcaaaagagataaaacctgcgggcatgccggcctccaggagtgacaggagcccaggatacctcgcttgggctagtcctgagaattgaattgcagccttggtgagatggtggttggagttacaaatcaaacccagagatggtccatttacctgatcaggttcttgtcaattgcactgattgattctgattgggtggttctggacatgtgcttctaacagttcgggctccaaagacaaagagtcgagacagggtggccgagtggatcttagccagaggtgcgggtgggattccagtcagcacaggagaaggggccgctgatgactgggtgacgttttctcagt

SEQ ID NO: 57475 - DNA, 1474 bp, Bovine  19866880536542
tagtagtaggcgtggaagaagctccactcctcgcactgggagaaggcagccgcgccgatgcacagcgtcccccatgcaggagaagaagcccacggtcaccatgttctccatggacacctcccgtgttgcgcaggccacagcacctcttgatgcgcttcagcaggtagcgcacgaacgtgttcatccgctcgcccaggctctggaacatgaccagggtcaggggaatgcccagcaccgcgtagaacatgcagaaggccttgcccgcatccgtgccgggagcagcgtgcccgtaacctgcaaggaggaggtgagaaaggggagaggcagtgaggcagggtctccttaagtcagggtggagtgcggtggggtggatgtgggtattgcagttgggatgcagctggggtaacctgaggcggggtggtgggaagaacaggcaagaatcaatgaagaaatgttcctccatgtttggaacacttaatttaggggaggaggagtttgggggttattttactgttcttagagtaacacgaaggttttccaaagaaaagcagcatattcactcatatgattttgcagaaagctgcagacgtagccagcccaagggagaaaaatgaaatacgcccaccatggatcatccctaagagcaaacagtcaaagaatgctaactgggttttcttgttgctgttgaccaccatgcttgtattcttaaataaacgctgggtctaaggccaggttaggtggacaggtgggtggaaagcccgggaagtgtggatccttgcacctccctcactgggagcagtggggccacccagggaggtgggggcatctcagaaggtaagagggtgcacaggctggaagggcatgatggatccacctgagtcgtttctatgtgtgctggtaaagggggagaaagaaccccagtttccacagcctcaaaggtggtgccagaaagctcagcatggtctagagaaccccctgcctcctgcccaggctccccgtacccagctcaggtagccaatcaactagttagtctgtgtgacccgcatcacacaccacctctttctaaccttgtgctgaccctataaaacagacacaatgcagacacaatgcatccgacaccactggcaggaaaacagttatttaatagcagggtaactcgatttcttcagaattgggatttaagcccagagttttcagcaaatgaggcttaaaagcagaggtcttgaatctagaggtccctgctgagtggagcataaacaccacaggggcaaagatgtttacctcttttgtgagaaataccgagcacacaaaatacctgtttaacaaaggacagaatacatccatgccactgtgtgaatgcggccctgtcagaatcgaggggacacacaatcctgaaagaccccacaattgtaggagcctctgaaactcttcacgcagctccacagaacacccctctgtggattccctgcatgag

SEQ ID NO: 57476 - DNA, 1099 bp, Bovine  19866880710978
cttttctttacatcttctgcttctgttaggtccatacaatttctgtcctttattgagcccatcttggcaagaaatgtttccttggtatctctaattttcttgaagagatctctagtcattcccattctatcgtttccctctatttctttgcactgatcactgaggaaggctttttttctttttttttttcaggaaggctttcttatctctccttgctattctttggaactctgcattcaaatgggtatatctttccttttcatttctcttcttttcacagctatttgtaaggtctcctcagacagctagtttgcttttttgcatttcttttccatggggatggattcctgtctcctgtacaatgtcacgaacctccgtccatagttcatcaggcactctgtctatcagatctagtcccttaaatccatttctcacttccactgtataatcgtaagggatttgatttagggtactccaacagaggttttgaaaaataaagtaaaataatgaatgcatttaaggaccagcacctgagcaatcgggcagggcgagctgaccacacacatacggcactccctgatttgggagaaccgccctccatacccggcccctaggctgtcccaggggctcagggttcaagcccctgtcctgcatcagcaccccccccaccaccggtaataagctgggtgggaggggcttcctccaatatccatcaggtgaggggcgggaagagatggggactgtccacctgggtgtcctgactggcaggattctcatgctgggagctggaggttaattaaatggttatttgttctgccttccaaatgacggaaatatgcaccctaaagagctttcaggaggaaaaaagtgctgcatgatgattatttaatattttatgggtccataaacacagcaagcaccgcacagccaaacgctgtcaacctccggctgccgggactgcccgtcagcaggtggctctcagtggactctcctgactcccagcccctggtggcggcagcccagggtccctctgagttcaaaccccccgagaccaggcaggggctcgggacccggctccatcctccggagtcagaacgcg

SEQ ID NO: 57477 - DNA, 892 bp, Bovine  19866880782538
agccctctccacccgctctgcctggaattatgcccacaccccccacctgctacccagagcctctcccacccttcaggccctggttcacctgcccctcatccagggggccctgtggtcacctggccagagcgccctcttcatccacctggcacttccttcacccccagggctggaggaaggtctcttgccacagtgccgtggaccccagctctccgggagctgggtgctctcggcatcaacctggggcccccgagggtggtggctgtggtccccacccctccagtggcatccacgcatacccaggagcaggcagctgctgctgaagttacgataatcccggctttaacagtctcgtcgtcagacagggccaggcccgctctgcggatgaggggtttggggacgggcaggtgtaggtcctaccatcatccttatcaccccgtccgactgacgaggggaggagggaggaacagaccggcgtccgccactcgcaggtggcagaggcgacagtcagacccagacaggctgagcccggcgcggccaggaatgcatgcgaggcggccagtgtgtgcggtcagccgggtctcagcacgggctctcctgccggctcgcttcctctctctctctctatcccattgtttgattcccctctattctactgtgctctttaatattctggctgtgacccgctaactttatttcatgacccactaatggatcaccgcccacagttcgacggtcttcctgggcagggctgtgtgggcccgggcaggtgcagtgggcacggggggtgcttggggtgggcccctgggctcaggggcacccactcggccctgggcatcactgcccccgactcggagccgtggctcaggagacctgcttggcagccccaggg

SEQ ID NO: 57478 - DNA, 1058 bp, Bovine  19866880183356
aaaagaaagcccatgagaaaatacttgaggaaataatagttgaaaacttccctaaaatggggaaggaaataatcacccaagtccaagaaacccagagagtcccaaacaggataaacccaaggcgaaacaccccaagacacatattaatcaaattaacaaagatcaaacacaaagaacaaatattaaaagcagcaggggaaaacaacaaatatcacacaaagggattcccataaggataacagctgatctttcaatagaaactcttcaggccaggagggaatggcaagacacacttaaagtgatgaaagaaaataacctacagcccagattactgtacccagcaagaatctcattcaaatatgaaggagagattaaaatattgtattttagtgtaaaattcctctagttgtaatctcatggtgctgccagtcttgtcctcatggtagttgtagaataacagtgtttatcccccaacacaacaccttctattcttcccacagaagatataaaaattcccagagggagaaaattttcagtaaacagtggtgtttatccttgataatactgtttattctttttccttttctgaacatttcagttaataactttgtaactaagggcagaggaggattctttttggaggtgtattagttagagatttgtgttaacattcctgagtagaacgttgcaatctttttggagttaataaaacaatcttttattctgggtattgtgcactgtacatatctagccctgaaaatcggttaaaacatttctgtttttaaaataaacagagctaaatttggcaataagagctagtaacacaattattcacaattatgacagtattctttacaaacataatacatagtagggataaatgactgattttttttttcagtaatattccttattttgaatttgtatattatcatttgtataaagcagtaagaaggatttttaattaataggttaaactttttgaaatcttattttaagcttatatgtacatcaagcaaatacaaacatattagggtatatccacatgtttaggtttt

SEQ ID NO: 57479 - DNA, 1171 bp, Bovine  19866880286696
ctatggtttttccgtggtctgtatggatgtgagagttggactgtgaagaaggctgagtgccgaagaattgatgcttttgaactgtggtgttgaagactctcaagagtctccttggactgcaaggagatccaaccagtccattctgaaggagatcagccctgggatttctttggaaggaattatgctaaagctgaaactccagtactttggccacctcatgtgaagagttgactcactggaaaagactctgatgctgggagggattgggggcaggaggagaaggcgacgacagaggatgagatggctggatggcatcactgactcaatggacgtgagtctgggtgaactccgggagttggtgatggacagggaggcctggtgtgctgcaattcatggggtcgcagagtcggacacgactgagcaacagaactgaacagtcccttacaattttgaggaggaaaatgcttgacgcttctatgtattaatacacaattctatacaaatataactataagcctctgtatttcagggaccacaaagacttctgagcaaacagtgataacaattactataactgttaaaaagttgacaattttagtctaaatgtaggggcgggggagaagaaacactttcagtatcactgaaactgcttataaaaaatacaaatgttaagattatactggtctttaaagtttcaaagacgatgtaattagaccttcaataactccaaagtctattatactacggatttaaaatatacttttcctaaaataatcttccttgcaatgggatggtttatattacaaaaggaaaggagaaagatctatgtagagcttagaaaatgttggcaaagcaaattggtttatgtaagtttaaataaaacattctgcttcattcaagcttacaatgctcaataaggaaatcccacaaactttgtctttacaggtgcaatgggagatcacaacttgtaaagtatgaacaaatataaaagcaaatgtgaaataagattagacaaatacaggcccagtagaatatagtaaaataatactcaagttattcaaatttatttgagcccccaataagactatggtatcccacgttaactgactttcaggagtaaattaaaatacctatactggtatatacaatgtattgatactaaagatacaaa

SEQ ID NO: 57480 - DNA, 2555 bp, Bovine  19866881003899
ctaccagacagagctttgacctggtcattcctaaatgctttgactggcagtcagattcttgttccgggagcagttctagcaagtcataacggggagtggtgggactccggggacccgatgtgccagtggcatctggagtggggccagtcttgtggagtgagcccttcacccatggagaccgtgttaactctgggtaacaagcgtcagaactgaatgcaatgttggacacccagctggtgcttctgagagttgttgaagtggtgttggaaaagttgtcaacataattgatgtcagaagcttggtggggaaaaacagcatgaaagtgttattccctccgttgtgtctgactcttttcaaccccatggaatgtaacccaccaggctcctctgactgtagcattctccaggcaagaacactggagtgggtagccattcccttctccaggggatcttcctgatccagggatcaaacacaggtttcctgccttggcaggcagattccttactgtctgagccaccagggaagcccataaaacagcttaacgtgacgaattcccacaaagtgttaacataggttaacactatgtgccacctctgcagggtgcaagggttcaatccctgcttgaggaactaatactctgcaagccttgcagtgtggccaacagaaaccccgcaaaacaaaaactgcctcccctcacacagcgggattgcttaaaaggagttcctgggttaccacttcctggtaggtttgagaccttgggtagaataagctcaagacgtggtgattcggatcatcatttcggtttggaaacagctcctcctgcctctttcctcccataacttccattggaatcactgaaatgaacagaattttagctatcagcattatttcaccctttagtttatttaataatggactttggctctggaaaacttctcatatgtccaaggatatatatttacccaaaagttcaatgatagattaccaaagttgatacagttgtagacttactgcataagggcctccttttggagaatattcccagcgtgggagtagtggtttgccgccctcttgtcaacgtggcatgccaggctcagtcactggctttggctgggaagacctcatctccctttctttacccttggatgtgtggcagaaatatcagcattgccgtgtttcccatccgtagtctggatattgtgaaaatggtgtcagtatccggccttaaaatatatttgtgtactcattctccagataagagaagtattttgaattttatgtttaatccattgggaagtaaagaaatatctcatctccctctttaaatttacagcaggtgctaatgcttttaaagacccagccgtgttacaatttcccctttatttcagttttcccggagcgtctccaataatgaactctgacatggtggcacgtgtacggatgcaggaaggagcctgaccacgttggcagagcaggtcacatgctgtcttcccttccgtccttaaaatgtgcatttatatcacatacaggtttgacactgaatgttgaaaagcaaagtaggatctgctacaggtccctttaaattttatagaaagcatcgagatttttaaaaggttacttaaatgtacactatcttaaaatacttgactgttgtcaataaagtgttagtatttgtgaaagtattagtcccattcagaaatatttcttatatttcctggaaatttgtggcataataaagcatatccagaggttatgtgtttatgatattattttccaaacaataagtttattatccttaggataaacatgacttgtttccttgatttcgggcatatattaacttgcgaattactgaagttatctgtttcatctttctaaaattgttactgattttgttgcactaccgttacctttagagaggaagaggaaggctttccggggtgtatttctaagggaatttactaaatgcaaatagcttgtcaatagagaaggcaatggcaccccactccagcgctcttacctggaaaatcccatggacggatgagcctggtaggctgcagtgcatgaggtcgctaagagtcggacacgaccaagccacttcacttcactcaccctcacacggttaaggaaactaagctaagaggtgaaagatgcctgcaaaaatctaactctgctaatgagtggcgaagcctgcatttgggctcagtcatccctggcggctcaaatgataaagagtctgcctgcaacgtggcacatctgggtctgattcctgggtcaggaagatcccctggaggaggaaatggaaacccgcttcagtattcttgcctggagagttccacagacagaggagcctagtgggctagagtccatggggccgcaaagagtcgtacagtactgaagcaactaacacaacaacactgatcccatctcaaagctcacagcctgccctgcgggagcactgggcaaggggctgagagagctgggacctgggacccccgctcagacctttcttctctttgtttgggcataaagggtgtccacttgctgttcatgta

SEQ ID NO: 57481 - DNA, 1543 bp, Bovine  19866881090576
atgcttttaataaaggagaaagctacttggtgtcgttgagcctatggggaaaaaaaaaaaaaaaagaatatgatccagttaggaaaggtagatttaaatcactaaagaaaattatgccagtaattttcatgttaactgtattctgtgttgaagtatgcaaaactactcagtataaattatagtcaatccatatatgatcagctgctgtacatgtttagatatatactatgggacatgaaatttacagtgtttatatgaccatataggcttttatccagggaaatatttgtgtttctttaaaatgtaaactattaatattttctatgattaaaggtaaatgatgtcatcagtggacattttagctttatggaagcaaatttttaagaaaaatagtagaaaggtgtctgattccttttattattcttgtagtgcagaagtataaacaaagatatcagttagaggcataggaaagttcatttgaagaacctgcaaatcacttttggtaagaatacattcatcttatacaagtgttcagaaaattgggaaaattatagccttttgtagcagattgaaagtttcatgtataagtagttcaggacagtaaacatcactaacttgaagtaaaattttgccagtaattttcacattaaccgtatttattatttgatgtaaatcagttaatcagtgaaaattgtaattgaatgaatggacatttcagaatgctaattaatgatcaatagaagcctaagagtacctcttgtaactcttttgagagcagtatatcttcagttttgttaagcagagtaactcagttaacaatttgaacataactgtaaccctaatttcgtatagggcatcctgagtggctcagtggtaaagaatctgcctgccattgcaggagtcttgggttcgatccctaggtcaggaagatcccctggaaaaggaaatggcaacccactccatacttctcttacctggagaagtccatggatagaggagcccggcaggctgcagtccatggaattgcaaaagggtcagtcatgacctctagtgccttaacaatttcatatatcgtgaaaacatttggtggttagttactcggtagccatatatgccaggcattgtgttcagtgctgtatttatttgattccttaaacttacgcaagaaagagattgggagattaatttgctcaaggtgacaaagcagtgttttgtaccttttgctatgacatacttttatgacataatcactgtcctattaaatattttcccagtggttctcagagtctggtccccacactggtatccttggcttcacttagaaacctgttagaatacaaattcttgggccccacccaacaacagaataaggtgaggcccaacaatctgttttaacaagcccttcaaatgattctgatgcaggtcaaagcttgcaaatttgcattatgcatttctatttttaagcaaagatctttggtctttcttttgtttttggacattgtataagcaatataacaagaacttgtggggggaaaaaagtgat

SEQ ID NO: 57482 - DNA, 2580 bp, Bovine  19866881159904
tttgattctgcacattctctgaaagggttttgggaacccacaggggttcctttggaccttgttttggggtctgctagtttatcttcattttattagggggttgcaaaatggtgatactccaattcttattacgttggaatttgttagttggagagttttataaataatgcttctcttttatcacctgtttattagtaattaccttgagatgttatttgtacaaataagataggctcagtgcttgtttctttccctttagagagatggaagctttattgtatgtttcaccatgtaagagaaaggaccatgaagcccccttttgtactaattgaaaccattgcttacggttagaatctcctagaagggaagggaagccctctgctaatacatttgagttgccttcttaaattattaaggtgtagtttgtatcttacaggttgcttatttagtaatatatcatataacattgtaatctctttaagaaactactagaagaagctaaaaaggattgaaggcttccagggtatctgatgctttgagaaatgtgtgaagattaacaagattatgtctgtgaattgtttaaagctgttgtatattgtgagatatattactgttaactccatagagggaagaatataggctatcttatggaatgttaagttttgctacagttagattttagaaaactgaactttctaatctaattccagaattgcttccccaatttgagcactcttgaagtgagactgggagttgtaagctgtcataaatgataaaatccagaaactgaaactggaatggaatgaagtctggagagagaagatatgtgtcagagcagtataagcaatagattaattaggcataataaaacttaatttcttaattcatcttccccacaaatgaaaggggaaagtcatcttaatttcttacttgtgtgtacttgagatgaaatgtagagtcagttttcctgtactaaacagtttttattttaattggcttttggaatttttatgatacaatagaaatatgttgagatgagtttaatgagccaaccatctatagatctttaaatatttggcagtttaaatagctatttaatgtggcctggaagtgagaaggatgtgagttgaaggatataagttgaaccaaacagaataatctgtcagcaaaataaattttttctagtagaacttaatgtcttgtttttggacctggtgaaaattattttagagattaaaatttaatagcatagttgtggttagacggtatctgttttagttttatttgtagactataagaaaaattttaaaatatttatatatatattttttgaataatatttgcataataatattcaataaatattgaataatatttgtatttatagaagttcattgaaaaaagttaacattttttgggagaatcgtttgagtagccaccattattccatggaaaaatacctgtttggaaaataaattaaatcttttcattgttttttttttttttttaaattttacataattgtattagttttgccaaatatcaaaatgaatccatcacaggtatacatgtgctccccatcctgaaccctcctcccttaaatcttttcattgttttaatagttttttcccccttatatattgggggtaatatatcaaacctctttatagttgaaccttataaatgttgttgaattttggaaaaatatttggtgagcttgtccttccttcctggaagctgaagaattttctagtttttaatgaagaatgcagtgattggatgttcactacaaagttaaaattttttttgattaaagtagtgaggatgcacatttactatgtttacacaattatcaatatatgtttgttttcagtctttttttttcttaaaggataagctttggaactttaccaaaaaaaatgcttactttgactttgaaatactttagtatcacatttagaactttaaaatagtttggtatcacatttaggactttcttctgaatgctgtatttaaaagctttaaataacttttgaaaaacaatatatgaccccaaacaagctaattccatgggtttaaaaacgtaaacaaaaatacactttcagcgcatgttcaagtaaatatagattcaatttcttagtttttttttttaattgagatgtaattgacatataatattgtatttggtatgcaacataatgatttgatatgtatatcaattcaaaatgattaccacaataaaattagttatcatccatcactaaaaaaaaaacacgtggtatgataatttatagtaactgataatctgtctaaaagtatgacatgaccctaaagggtcaacatttagagaagacgtaaggcagtaaagaaccttttttgggtttaatttgttacttttttgggttttaatggaggattttgtagaggtgcagtgaaagactgggacttccctagtggctcagacagtaaagaacttgcctaacacatagtgaaaaatagggtcattctggtcttcctgggatcccaggtggcacaggataaagaattctgccaatgcaccaggaggtgcaggagacatgg

SEQ ID NO: 57483 - DNA, 1154 bp, Bovine  19866880678042
ataaaatggcatagaaagtagtaaaacactagtaaaagaaattaaaacaggaaaatagagaaaaaattcttatcagtaatgtttctgtacacttgatcttagctacataaacatagcttgggcagttaattaagcagttgaaaaaagatagatgaggagtgaaggaaagggaaataaataaaactctaagtgaaaattttctgacaaatgtgccttcttggttaattttcacatccagagctaagcaacatctgcatcacttgcacttcctttcattacccaagcaccaatcacttactcgtttatcattcctatacatacacatattactaaaatgtgatgattcgtcactattcattgatcaaataacattcagaattaccttccaaatgctttgcatgtagaggtgaccagatacctaaaaatgtttgacgcttccttttcataacagctccatgaaaagattcagtaaacctgattccttttaatgtctctcattagcaaggggactgtgctctctcactctagataggcctgcatgcctctctccctccatgcctgttcattccacatgctttcatgtgcaaatggacacaaattgctgtcagttgggaacattcggaaaccatttgccttgattttccttaagtaaaatataaaaagaactaggagcaaatacatgggactattatgtaagaagactctttaatatgttgcttgggtgctcagtcccaaggaaaacactgtttataagttgagcagatcagactttgtcaattagaacttagaccaccatccttctggaaagtggctacttttaggggagtgggttgtatatatgaaatggaaagaaatatggtctttacatgagtcatttttgcagccttctcagaacctacccatgggtcaactgcaggtattcagaaactgtttattgactgcagtgggcatgtggacttctgttttccaagttgcagagtctcatttagagatgttgttaaaggcgtcctgctctattatccctattagaagtttgtagaatctttaattcacagcagccacacatctaaactttgttctgagcaaactgctgaaggcagctgccctgacatttccctccataggtaagtagagctaaagacttgggctgaatt

SEQ ID NO: 57484 - DNA, 1276 bp, Bovine  19866880920404
ctaaatccttaagttttaaagttatgtatacttcatgcaccaaaaagaaattcgaaggctttttttcactcttttttggctccctaaatattttgagtagtttatgtttctttgttatagagagggctctaagtccattttgtttttttgtgggagtagaaactgggaattgtgctttgctaactgtaaacaatatcaaaaactaaagtatcttctggatttggatcagatccctaagtcaatgagattcagtagcttcttatattggcaaactatgttcccatctaccaaagatgaaaaatgggccaacaagtagcttaaggatttttgccagatatttacatataaatcaaaggtgatgtctccttaaattgtacttaatataggaaacagtctgtttgatttcaaacttaagtggtatttgatgcagtcattgcctgttcatgattaaaatcttgcagaaagcccaccaatgatgagcaatctaatatttgcggtctcaattgtaaactgtgccaatttcatgaaaatcatattaccatagttggatccaggctaaccacatagagctctttcccgatccataattacataattagattatttttatcttaaagaatactttaaggaacattttctctatggtatattattaaagaatcatgccttcttaaagtctctttgtaagccaagaaacccacatgttacacattataggggaaaaaaatagttttcatgagatttctgcccagctttgaatcaaggttcaagaactgtattacagtctgccagtgatattttgggagtgaagagaatacagttgcagagcaaactttattaaaataattgatgagacaagatattggatgttaaaaaatgctattactctcaatgccaaacctatctttctcaagagatagagttggacatttgagataagattttaaaactatattctctatatagaaactgcatctgctatcataggctgaggggaggaggcagtcttgatcttcaataagtctattttgttttaatgtttggttattaatatatacaatatctttcatcctcattctcagttttatataagccaaagagagtgtaaattcatcaatactacacaaaccaagcatacagagtttggtaactgactgtgaattctggtaaattgcttatatttctctagaaatgtcgatttgcagatctcatgcttgatatgctagaaatgagtgagaaagatataactcaaggtaaggacacaagtctagggaaa

SEQ ID NO: 57485 - DNA, 2425 bp, Bovine  19866881054166
ctctgctgtcttgatcttgtcctcctttagttctttttaaatggaaagaataataagacccaattctgtttatgagatagtacacaactattttgcaaagctctttaatgaaagcacttgattatattaataagaacataatattttaatatattccatattattatttggaatttaaataatacccatcttagaggaaatatatgagctttttaatctttgaactaattctgctatcacattggttatcactcaatagcattttacctctcatcactagtgtatacgaatatgttgtttattatgaatttgtgattaatgcttctgtggtgatcatcccagattatttgcttatttataaaaatcagcaactgatctgacctgatctgatctgaacacgtagtattaaagttttcagagatgaatgatatgttattatgaacaattcacaaagaaatttctacactaccaaaacactttaaaaataaaattttaaatataaaattctctcaattacatattgaattattagatatattctattcaatcaaaatttattatgtgcaaaatacccacatgtaaacaagtaaattaggatcacatagaggaattcaaggcactaaaattcttaacaatataaatattttcacattaaaatagaccaaacaacctattttagctgtaacatataaagaattttgaagttgtcattcccattcttgaaacaagaaaagagcttaataaattggaaggcaatgactagtcttaaactcatcagaaaaacatgtctgcaggatacatttatcactccaaaatctggatatttggatgaatccagagagttacctccaagaactgcttacctgaagcagaaggttttggagctataaactttaagtaacacagaacggtaattttgtcaaattgattaaagctaagtgtgggttagcctgagagttaaaaattcctgatttccaccaccttgaggggatgagatcaccaaaattttcatggacactaacttcaggaatcctgcccacttcttacagtcaagtgtcaagaaatattactcatagatctgaagagtgagggcaaatgtagctattgtgaagtatacccagagcctacacaaaggtctattctcaacacacacacatataacaaaactggtacggggagggaggagggaggagggttcaggatggggaacacgtgtatacctgtggcagattcatgttgatatatggcaaaaccaatacaatattgtaaagttaaaaaataaaataaaatatataaaaaaaagaaaaaaaaaaaaaaactgtctcacctaaaatgctggatggggaaaactaagagacacatgtgaatgtcacaatccagagcacgtctcattaaaagacagatatttaattgtaaaattttataatacttactcttccctcagctttaccaccatactaagagggccccaggataaaaactgtgtagaaccattgaaagagcttcagtgagaacagaaaagttcttaggaaagcttgaaaacaagagaagaggaaaaattaaggaaactagtagaatttaaagtctaacacatacagaagtatcagaaattaagcaggcccaactcctagccaaagtaacatacagctacattaaaatctttgtctcagttcctgttatccaatacactgtatacaaatttaaaccacaaaaaaaattacatggcatgttaaagacaagagaaacatagcctgaaatgacaaaacaaacaacagaaagattcagatatggtgcaggttttgcaaataaaaataactacataggaaatgtgaaagatttatgattaaaatattaaagactataggaaaaatagaaactatgaaggaataggtggataatgtaagcaaagagaaagaaactctaagaaataatttaaaagaaaactatagaaatcataaacattacagaaatgaaaaatgcctttggtacaccagttagacacagctgaggaaagaatcagtgagctttaagatacatcaatagaaactacacaaaatgaaaggagagtgaaaaacggaaaaaaaaaatatatatatatatatatatatatatacagaaccatcaaaggactgtgggacaatgtaaatagatgcacataggtataattagaacatgtaaagataagagacaaagagcaaatatatatatatatatttttttttttaatatatatatttttgaagtctccacctgtgagggcccagcagtcagggtgaattggcttcaggcaagagttgaagagccatcttcctacttaattggcctgtgaaagtatcctctgctctctttccagaaagaaaaagcatccctgccattcgggtcacggggacatgagcctcaacctcgtctctgtgggatttcagct

SEQ ID NO: 57486 - DNA, 1652 bp, Bovine  19866881325542
cacacacctctgaggtcatggttaccttttgatcagggcgtttgcaaaatagccaaagccctgaggaaaccatgaagtttgtgaaacatttgtaggttctgacaagcttccaagcttcctggtgggaatactttgtgttcttttccatcctgctggaggaaagcagtggtttatggacaatctcctaggcaattagaattccataattcaaattaataaccccataaaatattgcagattatgtactgaaatacttgttttttttaacctataagtaaagtactattctcatagtgattttgaaattgcttggaattcatcccagtctggctgaaaacaatttttttaagttaaagacatttgcaataaaaaagattgagtttaatgaagattttttaaatttacaattagattttaagattagtgggacatgaaaaatatttgctttcactggtttgctttactgggaagtcaatgttaaggtcaagtttttcgcaagctgaccttttccaagtaggaaagggggaaatggcaggaggaggcaggaagacaacttcattttttcatattcctgttatgcttcatcacattgtctagtgaaaggaatgagtaaattaggttttgggtttcatgcactggattatgtgtttttatatatcttcctgcttttaatttagtagggcagttctttccattagaagatgggtctcattaaaagaaatgttattatggaaccgtgtgcattaggtttaattttcactcaatttaaaaagaatacttgagagactagtgcatggaagctcaagaaaatgattagttggggttccttttaaagagaggagctgaatgtgtgagaattagcgcctctggggcaaataaaacaatcaaacagtcagaaatggggttgtcagcttcgtgtaaatgacagactccactgctctattttcagatctcttgcctttctttaatgaccattcccctttctcttgagacagcagacaagaatagctaggggtagggggagaagtaaggctctggcccaacgagggtaggacccctagagggatgccttcagtattatattctggcaccaagagcaaagtcaagtctgtgactgagatgtggaatcctattccagcttgagcctttacttagcacaaaggtccttaaacttcagtgagcattagaatctcctggagggcttataaaacataggttgtcagtccaacctctagagcatacagtaggtctgggagtggaggcagagaatttgctttttttttttttttaacaatttcccgtgtgttgctgttcctgggaccacattttgaggactgacccagaacgtgcttatgaaggaccagcaggctccaaatagattaagtgcatatacacatgcaaatatgcataaattaggttttccttacaaattagttaggttgtaatcacatctgaggactgactgtagttctcagtgtttagtttattcttagttgccggaagaaatctaactgttagaagatctaacacagttagatctcccccatccattctagtgcctcaatctggaaagctctttagttctgcaaagatatttctattctcagttgacatcatgggaatgagatttattgaaagaggcaggaggagag

SEQ ID NO: 57487 - DNA, 873 bp, Bovine  19866880481419
ggattttccggcaagagtactggagtgggttgccattgccttctccgatctcatcactagggcttcctaaaactgatttaccctgatgcctggtggcctttggctgcttttgtctctgccaatctggacatttcccagctggctttagtgagcaatctgtcctctcttctgctgcctttggctttgacttcattgtatctggtcctaggtctgtttgctttgaccttagttatctatgagatagttgactcttaactgtgatctgattatcttatttttctcctatgattcctctcttgactttccacatttgaagacctgtctgtgtatgttttccactgatatttatatttggcacaacaagatagttagctttgttaagtaaaggtcagtcctgggtctttggtcctgaaaattatggttggacatatgaaattcttattatattttccaggacaccaagtatttctttaaactatatggtttgagggcataaaaattattcctggtttacagtcaaactccattagtgatgatgattaatcataataagaggccaaattaaagctataacattgttcagagtttaaaatggggcaacaaatctctttggattaccaagggggatttcttttctttcttttttttggggggggggggatttattttcctaaatgttctgcaggtagtttaaactaaaaatgtgcaatggagtagtattttgaagattattgatatgctttttaattttgcctttcagagtacaagaccattgtcttggtttgcctgaggcaacagtatgccagtgggacattaagatttgttacagagggaatactaagagaatatacccaaaaaataaaaataagaaag

SEQ ID NO: 57488 - DNA, 1825 bp, Bovine  19866880607256
tgggtgttctttggaaggaatgatgttaaagctgaaactccagtactttggccacctcatgtgaagagttgactcattggaaaagactctgatgctgggagggattgggggcaggaggagaaggggacgacagaggatgagattgctggatggcatcaccaactcgatggatatgagtctgagtgaactccgggagttggtgatggacagggaggcctggtgtgctgcgattcatggggacacaaagagtcagacatgactgaatgactaaactaactacgaatgtctttctctggggcaaagattaaggagatttgctaggcatccctttcaaagcttagagtgtctgaaactccgggagttccttacctgttacacaagtctagtgtgcatgtagcatctacctggactgcttcttatcatcctcataggatctgggggcaaaggaagatgatacaaacatgacactaacatggccgcttttgctgtgagtaatgaagttctgtgcttctaatcttaagtctaatgtcttctattgcttctttgtaagcacaacagtctaatttgttaatgtgcaacaggttaaagtctcatactcttcacagttcttgaaaaccatgtgaattttgaggctgtgttcagtccttcaagaaagatgttctctgggagaattaaaccttaatgtctcaatctatccattatatgctcctatacatgcggaatggtagtatgtaaaattggaaaattaagataacagccatatctgaagatagggcttaattttctcatggaatccagttgaggacaagtgtttggcttcacatattccctgactagctggcactgtgaacatcttttgcaaacacaagattagggatagttcttcagatagtaatagatataaaacattgttctcttctcaaaacattaaatatgttatttatgtcaatattagtagtttgaggaagcagttctcataaaatcatgatgttctaactccatgtctttgatgagtatgatatggagagataaatcctaggagttagttaaaactgacctaatggaagtgaacctgaggatggcaactgagcaaacttgctttttgttggcagacacaatgctgaagactcttaggggctatctttgtatccttgccctttcccttgcttgttaaagaagaataaacagcaccattatctctgcagaagccaagggtatttaaagcagcttcagaaagttgacataatgacatttctaagcagaagaaattctatcacatttagtgtagttagaaagtaatatttataaatttatcttttctactgtatcataaaccaaatattagctgctaacacacagccagttgtggatttgggaaaagtttccccacgcgagtgtaggggacagaaaggagaggaactaggtatatagttttcccacttgtcttcacatcattttcacagtccataatgaagttctcctgacatgaaataatttcatccttaataaggttattgtttggatatctttgtgtagctcataatttgaatctttagattacaaagatgctagaccttggaaggaaagagtgagcagtccatggggtcgcaaagagttggacacgactgagcgactgaactgaatatcttctgtcttctttttctttacctaaaagccctgggctcttttcttctgaagattttgatgagtaaccaaagagctgcttcatatctaaacctcttctttttgttgtagcctttcattcttctggctcttgtgttttgtttcactttcttcctttatggaacattttctggtgttcacg

SEQ ID NO: 57489 - DNA, 2051 bp, Bovine  19866880644040
ggtgatagattctgtgtttcctttaacatttactgtggagagaggaaagttcatgggagctgtggtgccagctgaaaaaaaatgtgaagagaacatttagaaggtggtttggacttgagagggagcatgaaaagctgtgttgacaaatccaaggttctgctttttaatttgatattaatctgtcagaacaactcatttgatttttaaacaatttttaatgatgctgccttaacctatgttcccagtatcaaatgaatcttcagagtcctttgatgcaggttgagttaattaggtttagatcagtgatgttactgtaaattattacctccctatacatccagctttgaaccttaagtattaataaatattttagcatttgtagtttcctgacaaaaatgatctgaactaaatgataccaggttttgttgttgctgttgttcagttgctaagttgtgtcctattctttgcaaccccatggactgcagcacaccaggctcccttgtcctccattatctccaggagtttgtgcaaattcatatctattgagtgggtgatgtcaggtttatgtaattcaaacttttctgagcttaaaatatggtggatctaagctgttttccctcacagggaacctttaaaaactttggatcaagtaagtgatatgaccagtgagatattttaggcagaataatgttgtgtttgagagaagaatggactggagaaggggaaaccgcatggtgggcaaactagttaggaaataaggccactaataggtacaaggtcatgttatttgctttcttttgcagagaggctggaaaagagggcgtcaatatgaaagatgtactagaggtattaatacagttggcaagactgcacaaataactaacgggttttgggtaagtcaaagacaattttctaattttgagtctggatgacaaggatggatgacagttcttttcattatgacataaaacacaaatgcttgtctcattttatgaatctgaagtacagatattgagtaacattctcttacaaagttaaaattgcatatctttatgtgtaaaattcccatgattctctcttacttgagaaaaaaaatcatgtcttactttctgacggcagatctgtgaccagaagtcagatatgcacacagcactcatgcaaatagaaacagcatgaattaacagcaggagaactttatgaacaagattcttagtacatttttgcttgaaagcacaaataaatcagttctgtagaaaatctctgtcctgataaaacacctcccctcaaggtaatgagggtgctttcctcacttattacttgtctaagctttaacctttgtaacttcccctgagtcaacttacaattccagttttagtgtgatgatttatgtattatattattaaatattcagtataaaatgtactttcttctcagtatcccctaaagtcattttagctagaggtttttaaattttttttttcacccagtctacccttaaatctcaaattaagattgttaataatagaggaataaaagggcattttttttctctctcttttagctccttaggatacttgaatattttctctgtaggtttgaaaggaaaaaaatcctactttaacttttttgtagagctggaagacctgttctctaactcacgttcaaatccataagtagtttctcaccatgaccctttaactgatctctggcctgtgaattcagcagtgagctgaatgtctctgaaacagtttactaagttcagttcagttcagtccctcagtcatgtccgactctttgcttccccatggactgcagcataccaggcttccctctccatcacccaccctggagcttgctcattgagtttactaagttagctatgaccaaaagtaaaatacagatgctgtatttgggtaataagcaaaaactgactatcttaggtgaactagcttaaattagcaatatttatgttcattttggattaattattgggtgcataattttactcagtcgatctagaaatcctggaattttgacatgatactaataat

SEQ ID NO: 57490 - DNA, 1712 bp, Bovine  19866880874779
ttactcaataaatatgcattgctaaatgcatgagtaaatggaataggacagtggatttattattatttttttaaagattgttctattcttgaaaacattaggatctaataacctgggttaatttcatctgcaacaaagaattatgctattgggcactgggttttctatgtccttttgaactctcaacactgaatactgaccattgatattatatttgcttatcaactgagagttagttcattaacacattcttcccaagcttttcagtttttaaactcaaactatttaattttatagtctgatagtcattcagatttccctctggatttcttaattagcctgtgttccttaaataaaaatgtattttccaatcatcaatattttaaactcagagcttaaaagccctattgaaaacataaataaaaacagatatattttaacagtgaaaattattaaaaatgaagagtatattgtaactatagcatgatcaatgtaagcattactcagtcagagataatccctaaaaggattctagagtagtttcttgaaattttattttaaaacaaggtcatagctgttttagtacacagaccctatttggctaaaaaaccagcaaaggatttgagtatacatctgagttccttcattaaggaaatactgcagccatatatgacacatcaaacatattcaaatatccaactacagagactctagctgactttcagtcccttcagttcacaagctctctagaagaactgagcattgatgggtttttgcagaaaactgtctacattatcaaccccactccacaaaagtgacttggatattatttgacttttacagatttttaaagtcagaaaggatatgaggctacatgccaactctacaggggtcttttcattagtaataaataaagtttgattatgtttttcatagagatctttacagtcatgaaagtctgctatctgctccattaaaaataaagaaatcttttagggataatctcaactatattcacataaaggccttgcaaagatgtttcattctaatttgggagcacacaatgaatgtacttctttgcaactagcatttaatgccagtgcttttatggtttatgctataacgtttgtttctttttattcaacagaaaaggtcaatgtaactaataattagaactatgactctgagagaagaagactgtaattagactatttttcaacaaataatgaagtgtcagaaaaaaagaaagtgagttcttggtgtcagcaaaactagtttacacatagacaggaaaagtaattctttctcgcagatgcatatgtgggtgatcttccgataatctaccttgaacaataaatatacataaaaagtactatctagatattcaactggaggggtcccaccgacatctagcgggtaaaggccagggatgttgttaaccatcttacacacataggatcgtatcccacaacaaagaattacccgggccctaatatcacatcggttttaaggaactttgaataatgtcaaaaaactttcctattctgaaattaatgagtaagttttaaagtagtccatagtaattaaaccctataagggggtggtagtctactgacattctgagagagattttgtagccatcatagattaaaagaaagaaagtaagggatatgagactttttagaattctaagataatacttgatttcagga

SEQ ID NO: 57491 - DNA, 930 bp, Bovine  19866880879899
gatgaaattgctgcagaataacagccttataagcagcctagcactactgtgctttcagtgtattattcacccattcagtttctctttactctttggaggcttcacagggtttcacagcatctcttctgaactgatgatattaatgatgccaataggcaggccccagagattgctgttttaagaaagctttactggagcaatcttaatataacttcctgagtctctttggatttttaaaattttctttggctctcttttccctttgctcttgagaagcccacaatttgctatttcttgttgctatttacagtttctcctctactgacactttggattaaggttgttattaagttaccattccattcctttggcacaaccctatctccatacattgtaggtagaaccttgccagcaacctgctgttcacaaatggggaactacagcagaagccaagcaattcctttgttgctgtcatttcagatactttgagcgctatcaatgtattgagtatacaaaacagaaggcgcctaccatctacatgcttacaatagtggccttcagagataggaaagctcttagggcaaacagagcagttaaaattagtgagggcagtgatataaacaaggtctaaaaataaagtaaaacttgttgtgctaagagcatttgcaaaatgaattcttcagctttgaagtcatcttctctatctctatttattctgttagcacgcctcacaaaagtttgaagttctttagacagagtctgatattttgtcattcagccatctttctcctggcccttgacaagccaggattcagcatgccacattctctgaagagaggtgtggccatctctgatcctacaggagagctcccgcagggctgcaagccaggcttcgagcaaggggtgccaatagacagagtggttcgcaat

SEQ ID NO: 57492 - DNA, 1579 bp, Bovine  19866880892068
ttgtttaattgctttaagaaaaagaaaatggtttttagtggctgatattctgttttgttgtaaagctgtgtttatttattaataaatgtccttctttatacctcagagagtatattgtaaaacttgctgtgaagtagatataaaaatataagaaaaaagaaaatgagaaaaaacccaaagaagattaacttttgtttaaaattttaattaattttatatttttatgtattttagaaatttgttttcagaactctccacaattgaataagccactttgttaattgctttggcatgaatactgaaatattgagacttaaatcaagtagttagtgggctactttaaaagtattaattctaagaatgagatatgaatttttaaagttcttatacagacaaccaaagtcctttgcctgtattataagttaatgattagaaatttccaaaaatataatgagccttaaatacatcttcctctattcattttgctttaattttctttcctcaaacctctattttttggcattttcttctatgtgtttaatttggtcgcttttgtaaatgcaattaagattttggcaaatttacagaagaagctgagaaactgctgtgaacacaaaggcagacataaaatagccattttggtaaatttgatagaagagagctaaatctaccaagcttttctttgaaaaaatggatagcagaatgtaagacatgccttcagctggctctaattgaagatgtatataaagcaaagatgctggaagccatcattatgactctttctacttaacagcaagcaaatacactggcagtaagtaagttggggtatatgtctgtgaaagggtataaatgagcactttctagaatttcatgtagaaagaaatagtaggaagaaagaagggccatttagcacaatttagagatatcttatataaaacaaaagtttgttagaaaatgtatttacagcaatagcccttggctagattctgaagttggtaaagttttgacctgtattcatctttctttcttgaggtgcaagcttctccacatcctatgtctactcccaaatctgtggtacttcttgtgagtctccatttgaagataaaactatacaagaatcactgcttttatccacagccagatgaaggggcaaaatcaggtagtcaggcagctctcaagagtccctgtacataaaggaccacgcaacattaatagggtgctaagacatggctggtaatgctgcagaaaggggattcccttccaggatctgagtgtgggctcttatgtaatacctggaaatgaattgtctgaggtgatacatgtgctgacaaaccaagagaatttattgggaagaggtgcctggacagagagctggagtgttagggaacccaggagggctgctttgccacatagctggcagtcaagggtttttatggtatgaccttagtttccaggttgtctctggcaaattattctgactcagggtccttcgcagtactgcacacattggtcagccaagatagattccagtgaggagaattctgggaggttggtagtacatgtggtgtttccttttgac

SEQ ID NO: 57493 - DNA, 1060 bp, Bovine  19866881148824
tcgcatgtgtgtttgagtggcataaaatgaacaactggctccagaatataagtatcctccaggtcagtgttcccaagtggcatcaagggcagaaaaaccaacagtagtttgattctttggaagattttatgtaacattttagagcagccaatatctttaaaaaactctctattgagtaaatgaatatttttacatacaagtaggaatttgaacataagaatgacaacaaaaaccagaacccatgattctataataataatttttactttgtgtgtgataaagtagctgtagtgataataggaatggaatgccaagtcacttagttgcttgacaggcgtatatatttgaagtcaatgggcataggatacggatataagcgtggctaatattctgtaggaggaaccacaaaatagattttataatttctgtcactaagggctttatcttcatatctagacaaactctcagagaataggaagtcagggttaatccttacttgtcacatttactgctatacttggctacaatccaatttgatagactataaaaatgatgatttactcaatatattttaaacagagtagtaatcattgtaagctatgacatacaaaggccattttcttatggtgaacatgtctcaggtctacacaaagagggaaaagaagttcagaggtgtagctatgctgggtgaggggctcaataagtactgagggaggtactatgtgctgggaaagaagaacgaggtgggaatttggaaaagtgttgaaactttgggaagaggagactgagggcaaaccacacgtcttgtgacatttgattgaggtcatcaagatgatcacagccaaatgagggagacacacggtgttatggagtagagagactgccgagttttaactcatcaaatcaggttctagagactcatcctattctggcactaatttgctctttcaatttaagcaattgactttttaaagaatatttatttatttgactgagtcagctctttgttgtagcacatgggatctttcaccacagcctgtggattctcttattatggtgt

SEQ ID NO: 57494 - DNA, 1531 bp, Bovine  19866881173840
ctgatgggctgcagtcctggggtcgcacagagtcggacacgactgaagcgacttagcagtagcagatgaacttggttttggtttctgaaattaagtcattccagaaatggaaatgtcacttttcagtttaactttaaaagcttcctgttgttgactatatatatagtcatgtgactatatactatagtatactatatactatagacatgtgactatatacacatgtcaataatccattgtttaacagtgaaacccaggttcctgaaaaaacaagcaggtggagagaggacaattactcatcttaggagatgagatttttgaaagggacttttatagaaagttttaaaacacatttatttccattaaatattcccaccattataagcaacaaatacactgtgaaatagtcatggagatgcagaaaagtcctttttctagcttatttcacagcaatagcatttctcttcatacctcccttacatttttgttaacaattatttattattcttggttgtgctgggtcttcatcgctacgcacagcctttctctaattacagtgagtgggggcttctcctcttggctgcagtgcacaggttctcatcccatggccttctcttgttgtggagcacaggctctagagggcacaggctcaagttagatgtggcattgcctggcttagttgctctgttgcttgtggaatgttcccagactagggatcaaacccatgttccctgcattgaagtggattcttatccactgtaccaccagggaagtcccctcccttatatttttaaaacactttaaaactttttaaatcacttatcccattgtaaagtttaaaaactgtacatttcccttataaaagcccaactgaaccaacatacactaatattttataccacccatgtatttattgaattttgcttgtcatatgatatataaaccaacaaaataactgaacttaaaaattttctaaaactacatataaaaacaactgttctgagagctagatttttcatttgagttgtaaggggaaaataatttacaaacataaagcaagtgaaatttttcatatatcaagtcaatattactgatttttaactgggtgtttcttatataattagagtgccacctagcggggaagtacattagaccaggtgtgcttcagcaattctaacaagacagttccctaattttccatcttgctagtaaagctaacctagagaaggaaatggcaacccactccagtattcttgcctggagaatcccacggacagaagcctggcgggttagagactatggggtctcaaagagtcggacacaactgaagcgacatagcacagtaaagctaagatatgagatgatgattgtagttctgacgaagaaggttctgtacagaatggagggaaaatatagtcaccctgaaagccaatgttgtaattatagtttgttttctgagaactgcagactttcttagcataaagattctcagcacagatgactgtccattcctctgccacacacaccaaga

SEQ ID NO: 57495 - DNA, 659 bp, Bovine  19866881370063
atttaaataatgatgctaaattttaaaatgttaaaactatattagagctttaaaaaaatatccatctacaggactattccggtcggaaagtcaccaatttgcaatttctccagtttgggcccacctgattcaagaacatctccctcacattatacgtggtttcttaaatattaagcattctgatcctgaaaggaaaaaaattgtgaagactttaatccaaatggtctcataaaccatataccttcaacctaagcataagtatacactagtgatttgcttttcatttcactccaaatggaaggaatcactagaggattcttctactgcttactacaaaactgccaacatctgttcctattttcctatttcctctgtcttatctcctgttacaatggataaatgattcatgctcctctctaaggccgatgcatactttcaattgtgtcgtcaatcttttcatattcctttttactactaaaagccattgccttcgcaatgcaatgatgtttctctctgtgtctctgtctctagtgatcctcacacagcacaattccttagtattttccacattcaacagcctccactcccatcatagtgttctcacttcaacactctccatgaggattttatcccccaaattccctgaaaatatcaaaagc

SEQ ID NO: 57496 - DNA, 1409 bp, Bovine  19866881408926
tgttatagagataacataagataacatgtctcttcctatgaagagtattttattctttactaaagttgcaatctttcagccatagattaaatcatgtaattttcagaatgttttcagaatattttacttttctaggaatactttttccgttaaagttgcaatgaagcagaaaggaaccacaaaacactgcaatttctgttacatcaattcactgatattaatatttagcttcactttgccaacagccacctttgaagcatgcttattgttctttgctgtatcttatttcaactcatttatttcaatgttagcatctgagcctttgcagcatatctagttatgtggaagaaaaatcactgaaatggtctactgcattactgaaatataaccaggcattattatctctgaagtactgccatgacagccatttgcatagtaactcgaagggtctaattcgcttcaacaatgtcctgtgatgggcaagggctgatgtatgagctctgtattgagaattacaatcaaatatatcattttaatgtacccaaatggatgcatgtataattccaaaatccataataactagtgtcatcataccatggtagctagaattttcatgcttatattcccacgaagcccacatagtttccctaatagtgcagttggttttaacattacaatgcctagactgaaatagactgaaattattctctgccatgattgctattaagtgacaccagagcattaaaatgaataaccatgagagagaaaggccaacttcctaatgtcttgtggaatacagtgctttttgttttaaaatacagagacaagaatcaacctcaattttcttcatataatccatgtaactgagtgactcattttctccagtttacacaaaaatcaactgttattccattttttccaatatttctctcaagtacatgttgaatattctttttaccatttaacagagtttacttttttttttaataatgcctatataaatattttccaggaagcttgtgttttctttaaaaagattttctttctacattatgcacaaattatattgggtttactccatgagcttttatctaattttcatgtaatgagtttatatatagtctacttgattgtatctgctactaaaacagaaaaatcctaaggtgaagaaagaataacctctatgtctcagcattgcagaattttttttttaatcttatgatgctaatgacagtgattgggatgataatgttaaaaaaatataacttatctgactcttagtttacagttttacagaattaaatgacaggcataaatgcaaacatgtttgagtgacttttgtacacttactgaagacaaaccatggagaaggcacacacagaaccttccctcctagagtttacagtata

SEQ ID NO: 57497 - DNA, 1029 bp, Bovine  19866880536099
gatcacatgtgtgaagcattcacaccatagccgtggatagatcggctgccccgaccgtgcccagccagggggacaccaggcctgatatctgtgccacatcaagtgacactctctgccttccctgcatgagcctgtgggcccagccatgctgagggctgctctgtggcccctgaagcaaccccactgaggaggagggtgcaaggctggtgcgcagccaaggcaggcctggggccagctctgaccctgcagccggccgccctgccactgtgctctcttgctgtgtttgcaccaggacacgtggctgacccacctgtgttctcccctctcttaggtaaaaaggttagtcctcagtctactggaaagttccaagcagcaggatctgaccacattaattgcttttctaagtgactttcaacaagtaacactaaagagaaaaggagcattttctttccagaaaaatttctctggtacaaaacaagagactacttcaacctaaaattctccctggagggtcaggaatggggagtctcgaagccatgccgtctcacggtgcagctgggcctgtgttggggcgcctgacctgagggtgcccttgctgtcgcactgcctggctcccttctgagggctctgagcacaggttgggggcggcgcagacagggagccagcagccccgagcgcagtgagtgactgtctccttggttccagggttcctgaccatcaggatatagcttttggggccttgcagcaggggaccaactgcctggacacgttgggccacttcgcccgatggtgttgtcggcgtttacgagtgtcacaatgctgggggcaaccaggtacgtgcgtgggggcgccggggaagtgaggggcctgaagccgcacctcctttcaccgccctcctcctgagatggccaccactcacagctggcctcggggtcagaggggacgttctcctggagctgtggtcagccttgggcaggctctggtgcacagggcgggcgacctgggtctcccctccccccgtcctcctct

SEQ ID NO: 57498 - DNA, 753 bp, Bovine  19866880642206
tgtgaaaaaagtcgatcccaatttaaggtaacataatttggctccattgtgttcttgcatttaggaggttgactaacaattacaaggataattataacaattttaggttcgtctgcacactgtcatttcattatcctccaacttattgtgcttgttcctaacatcctgctactacaaaagaggaaatcgaatagatgcatccttaatttcagctatattttatacttggctctaacacaattccattttcagattgcctgaatacattagaatgtgaatttcattgccacatcccactgcaatccattcaatcttagagtagtttagaaaaggaccgatcagttgggaccaaaatgatcaatatgttctccaccacccttgtgctctgtaaactccataccccatcttacccttcagcttttcttttccttgcaactgagcccatcagtgcctgagacttgggggctgctgtcactagcattttttcttttttactattattgactactatgtatctattaataaaaatgcatagtacaagccagtacaaagcctttaccccaatctaagtactcagtaaatgattataataaacccaggatggcacagatccatgccatgattttcttggcatgatttaaaaattcaaaagcagtaatttggggttttttccccctttgggagttttgactacagcaggtgggacccggaaatggcaaagatttgtcgatggttgggggctggcaatggaat

SEQ ID NO: 57499 - DNA, 1200 bp, Bovine  19866880885667
ctgcattggcaggcgggttctttaccactagtaccacctgggaagcccaatagtaaagacaaagatgtcttaacgtaaaggaacccaagggacgtttcaagtacactccaagtgaaaggcactcagctatgtctgactctttgcaaccccgtggcctgctcctctgttcacagaattctccaggccagaatactggagtgcggagctgctcccttctccaggggattttccgaacccaagtctcctgcaatgcaggtggattctctgagccaccagggaagttgtaagtacttttgtaaagggtccctttgtcattgcaatttccttttctgctgtttaataatgtttgagctgtgggttcccttaaatacaaacattgaaagataagaatggttgacttttgtcctcctcccatgagattagatttttcaaagaatcctaaatgatgaagcaattatgtaaatgttgttcaacagagccaattatcacactatgtatgacctagggacctacgggggaactgctcaggtcatctgcaaaggccagcctcacggcttctcctgatgtaacaagtccccaggagctgacagcctgtgggcacaggagggacagcctccatgtaagaggcagcaggcatcacccactccacggcctagagctaaagaggggcaggggtcaagcccagcctccagagccccacctggggcccccagtatgcccaccttgctgcacgggcgagtaggcattggtcaggaagcggaagtgccccttgttgtaccagcagatcagggacatgctccccttcatccggatgctgtgctggccccgggcaggtggtgtggctgggctgcttagcatggagggcggcaggccggtgcagtcactcttcctggagctgagcaggccacaacagtagatccctgcgggtaaagggaccgcacaagcctcagggcggctcccctgcttccccaggagagatgggaaattttggagttttcatcccagatgtgctgcctcccccacacttctgtatgtatctaagatcacacagaagatctaacacaagcagagcatcggcagtaagacagcagttctcacggccagagggcttgcgacctgccagtacagggctgaacctgtggacccattctcccatctgcttctagaacttctagctcacatgatgcacataactcaggc

SEQ ID NO: 57500 - DNA, 1007 bp, Bovine  19866880997499
gaaatggcaatccctccagtattcttgcctggagaatccaatggacggaggagcctggtgggctacagtccacggagtcacaaagagttggacacaactgagcgacttcactttcactttcactatacctcaataaagtttaagaaatgatgactagcagatctggggtgttcaagccctgcacattattaagaaaagtctggcccttgacccgtttctaggagacagcttctaagccttggaatatgttgcctcataacagtatccttatttaacctgggccttaatgcatatcatataatttttgatgacagtgtgatctatggtgggagtcttaggccatgaaaaaccagtttgacttcaggtgtgactggagactgaatacctaagatcagccaggtatatctgattacttatctacaatcagtaaaatccctggagactaacacttggataaacttcgctggttggctacattccatgtgtgttggtatgcgtcactgtttgaatcattaagtactattcacatgattccagtgggagatgaccactgaaagcttgtgcctggtctctcctggactctacccatatgcctttttcttttgctgattttgatctgtatcatttcactgtaataaaccataaccaataggtgtaataacttttctgagttctttgaatctttctagtgagcaattgaatgtgagggggtcttgaaggccctgaacacactgtgttattagcatggtaacctttgttgttgttcagtggctaagtcttgtccaactctctgccaccccatgaactacagcataccggttttccctctccttcactatctcctcaaactcatgtccactgagtcagtgatgccatccaaccttctcatgatgccattctctattgcctccttctcctcctgccatcaatctttcccagaaacagcgtcttttccaataagtcagctcttcgcatcaggaggtcaaagtatggagcctcagcttcag

SEQ ID NO: 57501 - DNA, 1454 bp, Bovine  19866881409609
cctcacacctcagactggaatttatactttataatgctttgaaattatataacatttctagatggttcaaaatactctcaaatatcctgtctcataggaacttcacctgtctcagacgcaagtcaaatagggttttaaatttccactgttcttaaataaaagcagagaaatggaggcacgttgctcggggattttttaaacaagtggcaacaccaacaatgggccggaacttctcgagctgggcccacggggaggcgcctaaagttcaggtagaagcagcaggcaaatgcagggggcctggccccacctgcactgggctccaggacttggcgcccatctcaagatcaaagcctcaagatgagctgactcggggggaagacctctgtaaatacagagcatcaccggctttaaaagaggctgagtcaaggaaaccagtcctccccactgagagcccggggtgccccccacctggccccagaccagcaggggaggatcggggaggaaagattagaaagaggccctgaaatagagcaactggctgctgtgtgtggacaacagggcagctattggaggggggtcacttagagctccctttcccatagtatcaaacaaattcaggtggatgaagagttaaatgtggaaaccaagcaaacaagccaaacatcagaacactgtgtaagtaaatattagttatatctgatttctaggtgagaaaggcatttctgagcttaaaagcaatggaagacaccacaaatgaagagaatgagaatttaactacacaaacttaagtctccttaacttaaaaagaaaaaaagagaaaaaacaaaaaaactctgctgaactattgctgctgctgctgctgctaagtcgcttcagtcatgtccgactctgtgcgaccccgtagatggcagcccaccaggcttctccgtccatgggattctccaggcaagaacaccggagtgggttgccatttccttctccagtgtgtgaaagtgaaaagtgaaagtgaagttgctcagtggtgtccgactcttcaagaccccatggactgcagcccaccaggctcctccatccatgggattttccaggcaagagtactggagtgggatgccattgcctaacctcccagaaatagacaaacaattgtcatttgtaatatttagtaaacagcaaatacaaagtcatgggaaaaacagttaatctaagtgggaagctgttccattcagcagaattaaggaactgaaaacggcaatgtcaactaccaccgacacaatgaacagagactttatttgcaaatattaatgtctattgtggcaaaggcacaaaagagtcttctggtccgagtatgaactgatacaaccttcctgaaaagaaggtgacaacatctatctcagaaatgttcaaactctctgaccctgtaattctgctcataggaatttattcttaaggaaaca

SEQ ID NO: 57502 - DNA, 1225 bp, Bovine  19866881431705
aatatttattgagcatgtaaaacataccagcaactcttttcagtgttagtaagataatggtgaataaaaaagacccaaaatgccgatcctcatgagaattataaataaatagataaaatatttagcatgctgcagggggatacatgcaatagtgaaaaattaagtcagggagagggaagggggatggggataaacaaagctccatcctcaccttgaagtccagtcaactcaaaggataataagcaaactggaggctgaggatgagatactttgttcttgtctctgagttcatcttcttagaggcaagatcaccttttttacccctcatccaaagtgacttaaaaaaaagaaaaaggacactatgagcagccacccttgtgcgtgcatgctaagttgcttcagtcgtgtccgactctttgagaccccatggactgtagcccaccaggctcctctgtccatgggattctccaggcaagaacactggagtggattgccatgcccttctccaacctccttctaaagggacaatctatgaagatcagtgcaagtggcaaagccatgagaggtaaatgcagtgaccctcgggcagtttggcagtggaggttgtctacagccaatctgagtcttcccaactttaaggaaaatgcaacaagctaattgggcagaaacccaaaggactgagagggtcctggtaagttggagagatattagaatttagcatttggaagactttgggaagaagggtgtttaaatcaaacccttctgagggaaagtgagtaagagattttgtgggttgtggccagttgtaaatttattttaatgccagagtttttaaaatgcggattttacaatctatgaatcagttttatttatgaacttaaacttaatctattttcttcctgttcccttgcataaaataggctgagcttgcctggtgtgactcaaactgtgaagcagaacaattgtgcaatatcagagttctccaacttgtaaaattcaaatttgtctaatttataaacaatattcatgaatggttttctaggataaaggcaccgttcttccgacacacttctgggcaattccatccctgtgcagatcctactgtgctcagccaggtggggagcacttcccagtctccgctgatgccccagagccagggacagagggagtacagcactgcccttcccgtgaggctctcagaactgacttccaccaccctgtgtgt

SEQ ID NO: 57503 - DNA, 1146 bp, Bovine  19866881596611
ttagtggaaagatagattctttggctaagagacagtgaagagcaggcaatcctagaggtttgaaaggtccctgaatgtaataccaacaatacttgtgcaattgatcttggaagaaaagggactggtacctaaagaataagtatagatgcccagaaagcagagctctgaaccaggagttctaaaggtggtgtggaaatgatgtaaacagtttggcagcaagcacaaagagaaaggacagtccagacacacaagaaaaacagcagtacagaaaaggtcacagttagctgggcttgttaattaaagaaaaaactaaagcaaactcaaaggattttgaagcttgttttgtttagtttaataacttaaacaatgtaaaatgattctccaactaagagagatcattcaagaggacacattatgtagagaggttggatggagaaaacacagaacaccacgtacccaggcatttgagagaacacaggcaaggggcctccacagtggaaggactcagtctaagtgtttgaaatattaatgtgcacatcaccttatatcttcttaaaatgcagatttcataagtctgagaggcaccctgagatcctgattttctaacaagctcccagatgatgctatcttctgagtagcaagagtgaaagtcactcaatttggccttgaaacaaatcacttaaaaaaaaaaatagcatgatgaattgactgggaagggccagagtctaggaatcatgaatgtacagttcacacggggctggttctcactcagtgctgagggaagactggcctgtgtgtgcccaaaccctagagaatctagtcttgtgagcagagaaggcacctaagaaagctgagaaaccagcaagaatcttcacacagactgtagtgtcagggaagaagaggcctggggagctgcagaagaacaggccagcccagcagcagtactgtcagtgagtgtggccaggtcagttaccaagaattactttggaagcgtctcttctccctctgatgactggtagacaggtaggtctggaaagtgcactaggactttggcagtttttcataacatgcttgtggactgtgtaaagaaatatggattacatgctatttacaattaagaggagtagccactagtttaataaccat

SEQ ID NO: 57504 - DNA, 2987 bp, Bovine  19866880256822
tatcttttttggatgttagttctaaacggtcttgtaggtctccatagaaccgtccaacttcaggttcttcaacgttactggttgaggcatagacttggattaccgtgatattgagtggtttgccttggaaacgaacagagatcattctgtcgtttttgagatttcatccaagtactgcattctggactcttttgttgaccatgatggctactccactttttctaagggtttcctgcccgcaataatagatataatggtcattggagttaaattcacccattccagtccattttagttcgctgattcttagagtgcaatgttcactcttgccatctcctgtttgaccacttccaatttgccttgattcatggacctgacattccaggtttctgtgcaatattgctctttacagcatcggaccttgcttctatcaccagtcacatccacaactgggtattgtttttgctttggctccatcccttcattctttctggagttatttctccagtagcatattgggcacctactgacctgggaagttcctctttcagtgtcctatcattttgccttttcatactgttcatggggttctcaaggcaagaatactgaagtggtttgccattcccttctccagactctgtagtttacagttgtctatttcacatggatgcaaacttattttgtttcttccttttgaaagagatagaaatacatacattttctgtacctcacactgaaggctgtgttactctgctccagaaaaataccatatttgcagagcaaatgcaatggatgttgctattttgtaaagtttagttttctactgttctaggcaattatccatcccttatttttaacagatgttaaactggtgtcataaatgagaataagacagagactactacttctgccttctttaaatctttgtaaatgacattcattatacacagaacaagaaaccaatggggaaggatctgccaattagcaaagatgtgcaatccaataatatatttagaggtctcagaaaagagcacctgatgggtctgtggacatccatgtgccagatgaaggccagaattctgtttattatctggctccctcccatgtcttttctattaggaggactgttgaatcattctgggcctcaggatatcagttttagttttgactctgagtgaacagtccttgaaagttctggatatttctctttatccaatgcatagtcccttgagtaaagggtcttaagaatctttggaaaaggagtatgggaattatgacttcatgctatcatgacactgcttggtgccacctcttagagatctgtcctgtccttcagcagatagtcttcaaacaaaagtctgagactcaacccagttctccaaactgttcaagagatggtgagtggaaagtgggagtgatgtagagggaggaacagatcaaggagggaaacctgaactagtctgctattcatctgttcttgatttattctcattgtgtaaattgagcaacaccctgcccatctatcttgatgtgggaactccatattctatttatttactctatcttcttttttaaaagtaatacccagttttgccacgcctgtgttcctgcttattgcaatgattgcacctgcctttcttctggtcattaagtgccacttcttggtatttattatttagagattctgtcattcacatttttatcaggaatcctaggtctttaatgtcatttccaaccttccctacagaagacagctaccactgagcttctcagtgatactgatgtacctccccatagcacattctttagtatttggtaaatggagcatctgatgggctcgcccctagattatagttagctggtggggtttctgaccttacatatttattttttctcaggcatgcccaattcactgagtctttgatctcttcatccttcatctcccatgggagttctggaatttctacccacttagcataggtcataaattttctcaaatttctaagaaccatcctggcagctgctaataccatttcctaggatatgtgccagggttttaaattctgtatcacaggaaagtgctcttgtatcaattaactattgtatctcaatgtgtattctgtcacctgttgacaaggaccctcaggatccatgctgtgcatactctcccagctcctgcagatccttcaccaacttcactgatagcccctccatctcttagcaccccatagcatctctggcctggtggtgctgatatgtgaccattaacatttgtctggttgtcagggggactgatgtcagcaaattcacagggaaggcaggattatttatcagaaacctgcctcttgtcaggtctctacctggtctacaagttggactgtgcagagtagatcttataaaaagagagatagagccactttttacaagcccagggagaatctaggaaatctgatttctgaattgcatctatccaggtattacagttgtagctctcaggattcttctctctctctctctcttttttttttaatgtggactgtttttaaaatctttgttgaatttgctacaatactgcttctgtcttacgctttggttttttggccctgaggcatgtgggatcttagctcttgtaccaggaataaaactcacatcccctgtattggaaggcaaagtgtcaaccactgaaccaccaaagaaattccacaattgtgaatgttcttctgatcatggattaggagatcaaacttctctgaagtccggtgctttcatgactaagtgccaggcctggtcctttcctgtccttgctctctggctatagagggttagatatccttaaattttgcataagaagccctctggctttccctttttgcctggaattagtgattaatcaagtatactatttgctttcacttgagcaattttaaaaaacaaattgtatggaagatctgtttcatgctaggccctgagtatacacaatgaacaag

SEQ ID NO: 57505 - DNA, 1835 bp, Bovine  19866880351857
tgtttatgacttttttccctgcatggaaaagtaagattaatttatttttctttctttactttaaaaccacattcacccctccacgataataaatggatacttagcctaaattcagaaaggatgtatgtcttactgattattgatccttttgatactgtgcttctttctacttcattaaatacaataacttacctgttatatttaccctttgaaccctggtttgctttcccatttaattttttttttttttccctttgctgtttgatatttctttgttcagaccagacctggtcttgatccagctgcactgtgcttgtgttcaagttcaaatacatgcactgaatcatgatggtactctctattaacttataagcattagagaaagtcagtttaaacagggatagaaatcccaaaggtcaactgccacttatactgaaacaacagctccaggtaaacactgaagtcgtttctttagttaagaataatgagtggccaggagccctctgagtgcaggctgcagagtctttatgcagcttgttttcagtcttcttttgccatcctgaaaatcacgcgaggacttaaaaatctatcatagagtataaatgctatcatacacacaaataattcaaagttttaatgaaatcctaaattggaagataggtttgcttcttcatttttattttattttttatgttatatgtctgttagtctacatagcttcctcttgtagaactagcatcacacacacacacatacacacacacacacacaaatacacacacacaccctcatatatacacaaaccttaagcaaaggaggtggctgcaaatagattttctcaaaaataacaaatcaacctgtaattcttcatgttcaagtttattcgcttcaggttaaaatgactgacctgaagatgaattatctttttctttttagtttttatttatttatttatttttttttttttgagatctgcctaccctgtcagggttctacatttggcatcattacacccagttaatgtaagacagcttatttttgcagtgtggtgttttatagattttttttattgcaccattaagagcattttgatttctgcaatatttccaggttttcttgtcacaacattccacagtctcactttgtgctaagcctcatagcattcacttacatccagttttctacctcagaaggccaggtaatgagatgagcttccagaaaagaaattgcaggcttagtttcttacattagagtccaagcagattgttttctcttcaaacattagccaaagctcaattcacagacatttcctctggtaagcaatcactgcagtttagtgtccagcagtgagttcataaatgtatttgactttcaatttttaaactgagaaataaaatgtctattttaatacactgtggattttaatggaaattttgtggaatttttcaacttctcaataaagtaaaaatattgtccatttatgacacagtaggcctattttaagcctagtgaaaaccattacgagtttagattattgatactgactacatctggcaatattatagaattatttcaatgacagaaagcaacctccagatttgaagtttacatagtttattactgtattatctgtgactttttactcaaagtacatacatatctcaaaaatactagttgagatttgtacctcattttgttattgcctggagaatcccatggatggaggagcctggtgggctgcagtccatagggtcgctaggagtgggacacgactgagcgacttcactttcacttttcactttcatgcatggagaaggaagggcaacccactccag

SEQ ID NO: 57506 - DNA, 1034 bp, Bovine  19866880381463
tgaagctgcagagcctcctgagtggtccagcaggcgtcctgctctcctgctgtgaccctctgatgctccagataccgggctgtgggtatgaggtgggttgctccaccatgttcttctgtgtctttagctgtgatcagttttgattcaatcaaactcaagctcattctgtgattccacaggtatttgcttcgcatctgccctgtgccaaaccatgaggatgctggggttgaaggaactggacaacgttctctcaactggatgatggggacagaagtgctgtgggtggaaaagaggacctctcttgaactaactcagccacatctgggcctgtttgcatcgttcacacacacttccttttcccatttaagtgcttaaatgatttaaagtggtttaaatagaatccttgaaagtccctctcctccccgtttcttcctaaacagctcctacacagccttcagggcctcgttcaagggttgcccactgaagtacttacacctgccgcttcctcccatccaacaggtagagcatctcctcagtcagcccacaatacgtcacacaagtgtttggtggagcacaatagtcattgttttcatttgcctctgagccctttgggtggagcaaggacatggcttcctcatcatcactgaatcccaagcccggagtatttactggccccagtaatgtttgttccatgaatatttcttcttattgaggtctgacaggagaaagggctgagaaaaggaactgatacccatcaagcctgcagcaccttcagttataggcccaacgcctggccaggttagcataaatctccacactaaagacctctttacttccgttcctgaagcctataccacatgccaggctttcaacaaaaaattacaaggtctgccagaaagcaagaaaacactgaagcaagaaaagtctgaagagacaaagcaaacatcacaaccagactcagacatgacacagatgttaggattatcaggcaggggaatttaaaataactataattaatatgctaagaactctgt

SEQ ID NO: 57507 - DNA, 778 bp, Bovine  19866880449188
tcagttaaataatcaagggaggaggcaacttgagatgagttattgtacatacagactggctagccatgttaattacttaccaactcccttcttcaggctgaccaaaggcattactcaatgcatgatctttatttattacctcccggttttttatgcttcatgaagcagtgtatagtaatttattttaaaaattaatagtgtagcgattcactttgggaaagcatttataaataatttttagttacaacattaaaaaatatagcctcagtaaagtggcattcctgtctctgaaagattattgacatttttatgtaaggcagaaacctttaatgagatctcaatcaaaaaaatgcttcattaatgacataagaattaatcgatgctgatcaaataaatctaccatagtccattctggatttcactttatgagtagctgcccaggtcaaaacactaacaaattcataagtgactactaatagcatttcacttgactatgcatttgtatctggctaattgtacaggacaatatttgaaagtacttcagattataatttattgtagtatagaattccttggagaagaaacacagcaggcaaaacaatataaattaagtcttaatctaaaataaaccatgcagaaatacttgaaggtatatgttgtattttatgggaactttggagaaaaaatagacaatttctaaaaaataacagcatttgggattatgttgaaaatttttgcaaagaatttgaaagtaagtaagctccaatatgatagcatt

SEQ ID NO: 57508 - DNA, 1559 bp, Bovine  19866880502372
attacatgaatatttttgcaaaatacatctacttttcattattgaaaggccaattaattcttttctattactatcctcagtgtcatagaatagcttgcaatcaataatgatgaatcattataaaatattataccttgctatatttttaatctgtttctcttaaagaatttttagatactctattttgtaaaacttacaaaaaataaagaaaaaaaagttacacctatctagctccttcaccagagaaggcaatggcaacccactccagtactcttgcctggaaaatcccatggatggaggagccacataggcttcagtccatggggtcgagaagagtcagacagaaccgagcaacttcactttcacttttcattttcatgcactggagaaggaaatggcaacccactccagtgttcttgcctggagaatcccaaggacgggggagactggtgggttgccatctatggggtcgcacagggtcggacatgactgaagcaacttagcagcagcagcagctccttcacgcattatttcccttgcctatattctgttgaggactaacacagcttcacaacttaaaaaaaaattattctaataaaacttgtttctactctctgaatattaatgttttacttttgtttttcctcacacatcagcagtccttttccaattctgcagcaagagccacagctgtgcattttgaaaatgctattcaccttaaaacttctctcacactggaattaaaaatgagacaatcctccttttcccaatgctatagagggatggttttaccaacacattagttatttgtataaaaatgataaggataggaatcagactacttgagttatattgaaaatactgatattttcaatcaaattgaagaattatatagtctaacacatgaataagtaaatctgtgactatttagattgcattttttgtcactgatttatatcctgagggacccagatgactccctgaaatatcatgatctgtttttgtttctagtcaagatactaaaatttatataaaatattcaggctgacttgtatatgaactaattgacagatgtagggattattatttggggattaatcattgtgctggtacattcaagtacacgttagacaattctaagaaagatttccttgtcttttctctctagcattatctattttttattaaaaaattatgccaagcccatattctatgctctactgtttgaaattatgctcaaataagcagataataagtggagatgaattatggttgaagatattttataagataaaactttttccaatctgcattaccatcaacaaatcaataaagtaacattttttgctatagtaatatacttagcaacacgttgcatcacttcccagaatttaaataaaaagtcatcaagttcgatgcaggatacaggatgcttggggctggtgtactgggatgacccagagggatggtacggggagggaggtgggaggtggggttcagatggggagcacgtgtacacccgtggcggattcatgttgatgtaggcaaaaccaatacaa

SEQ ID NO: 57509 - DNA, 1293 bp, Bovine  19866880523968
actgtggacacagttgttatgatgctattaatagagattaataactcatggggaatatgtttagatgagtagttagcttagtaaataataaaaaaggctaaaatatttttactgttccacatgtaaaactgtctcagtctgcctactggttatttcttttgaattaccattgtctctacatccattatagcaactggatcatcaggtcttgccttttatgaacagtgtatggctctaatttaaaggtcattagaccaagtcacttaagtgacctgccaagggcatgtacccaatgattagccaaatgagagagaattccttgttgggcagaatgatctttcctgtgctgcttcatggagacaacttgataacactcttttcaagacatggtagaaatgtagcaaaagagtataatttccagaacagtcattcttgtttccagcggagtctaacttttaaaccactcagaatatttctcttttttttttccttcaatctcaatctaacatcacaaatgaaacctagagctcccctgaaacaaatgaagatgaagtttagaatcatgcataaagaaaattttaactgaagttggagaaagttgccaagatcagagttacagagtgaacgaaacagaaaaatcctaacccacttgtcttaaaaatggtttttctatttgtattcatggcagggccaccaaatcagagatactgctaaaaataacttatcaaggggatttgaagtagcgatagttttctaaaatagaaaaaaaaaaaaaagtaggaatagttaaaaaaataattaactttttaccatggaaatgtttaaaccagaaactggagagaatggttatatacgttaaagccacttcaataattaatagaatcttgccaatttttatttcagctgtaaggattatagtatgtgtctctaactgctaaaggcattattatacagttactatttatcacatttaacaaaattagcaataatcccttaatgttttcacaatcctaatagaaaaaaatgacacattaaattgggctaattgggtataatttaatggatgaactattttgaaatatgtagatagggtctagggatttcacgagtaacaagtggcctggctccaatttgggaagagagtgttgcttttacaattctcttgtctggaattcagcagggagtgagaatagttgcctacactcagagaaaggaactataaccagttcactgggaatgctgttttccaagaacattggatttgtttttttcaagtttaaatttaaactacta

SEQ ID NO: 57510 - DNA, 1081 bp, Bovine  19866880543082
cgcacagagctggacacgactgaagtgacttagcagcagcttagcagcatggaatctagaaagatggtgctgatgaacctatctacagggcaacaatggagaggaggacatagagaacagacttttggacacagtaggtgtgggagaagatgggatgacttgagagagtagcattgaaatgtatatattaccgtgtgtaaaatagatagccagtgggaattttctgtatgacacaggaaacccaaagctcgtgctctgtgacagcctagatgggtgggatggggagggagatagaagggaggttaagagggagggggaatatgtatagctatatgactgactcttgttgatatatggcagaaaccatcacaatattgtaatcattcttcaattaaaaataattttttttaaaaaaaagatctcactctttatacctgttgatttctaccctgaaagcattttcttgacattctcttaaaataggttgtcatttgctcctggttgtggtaaaatgttcatggtcaggcaggactcacagtatcggtggatacttttcatttgagcttggcaaaagcaagcctatattgtggctatagattattgacttttggtatcatgtaggactactacttcttttaaaatagtcaactcctagcaataatgtttaaaggtttctaatgacttaacaatataaagattcatgctttagcaaatgccagcgttaacgcagcacctgaaatggaaaaatgttagaaacaaaaatacatataaatcaacaaatattcctcgaatctggtcacttcatttttctgcagaaaaactatctcttttttcttccaaattcttatagaaatttattttctatttttcttcctttcaactttttagattctgttttcttctcagtacatcactcttttctcaactccatcccataaacacatgtacatatacacacatacacacaagcttattcacacattttctttttcttcctaaattgagacagcttttttcaataaacacagatctggctctaaattaagtgctattagaaatgttgtaaactcgaaatatttcc

SEQ ID NO: 57511 - DNA, 3169 bp, Bovine  19866880814219
atagatcttatgttttggtgttatcacaaaaaaggagggaaggaaacttttggaactgggatgtttatggcatagattatgatgatggttccatgagtgtattcttatttccaaactcatcaaattgtatacattaaatatattcagcttctatatgtcaattataccttaataatatagttttgttttaaaaaattgagagattaataaaaggtttgacattcatgattgttgtttagttgctacattgtgtccagctcttttgtgaccctatggattgtagcctgctaggctcctctgtccttggaattctacaggcaagaatactggagtgggttgcctttcccttctccaggggatcctgacccagggatcaaacccacatctcctgcattggcaggtggattgtttaccactgagccaccaggaaagtccaataaaaagttagcaacaatttaaaagtttagaacatttgatagtatgagtcaaacaagtgtatgaagcagattcatccctctggccaacaatttgtgacttttgctctctgaagagatgatatgagatgttccaaagaaagaggaactttaaggggaaaggagagattctgctagaccagccagggaaaggattgtggggatgggtcctgagaacagtgtagcaccacaggcagtgccctggaagagtcctgagaaggtgagaagatgtcctcagatggaagggctgagaaaaagccccgagacaagtctcagaaatcttcctcagttccacatgttcatggcatcaaaacgcaagcttgtgaccctgaataatcatggtaatatgacactaaacatgacagcctatttcaaattgtcctggatattatacaactttcagagaggaaaggttctttaaaatatctgagatggagtgtacagagaagatggataatgggaaaatgttaagcacaattacattgattaacagaaagtaaaggctataatatttttgttgaataccaaatgtgggttcacacacacacacatacacacacaatatgcattattcaaattattattttttccaaataaaagcatatcccctgatttcaaagagttgcatgaaaataactaccagagataaagaacagaaacaattaatttatttattttctccttgaattgatccacttgagcatgtgttcctcttccatacccatgacccttctttcaatatcctttctaagtgtggaaaataattgctgcccttttgttatgacaggggtcttaactatttcatagtgtttcagagacacggtctccttttagccatttcactaagaactgaaaccttttagttctcatgagtaaaaagctagtgaagatttttatgagataatttagatcatattaactcttcagccaatcataaaccctatattttctcagcagttttatatttcccagtttaaaatgtgtgtggcgagttggtaccatgtaatggattgaagtatggtcagtgacttaaccagagacttcaggctaaccgtttctttgctcatatttatctggatagactaacacacttagacacatttagaagattcaatttacctaccgaggctacttgtagatctgtgtagaagagctgaacatttaggtcatgtcagaactgaacatgaatgcttatattaagcctcagtatacaagttcccagggcttaccaggtggcacagtggtaaggaatcctcctgccaatgcaggagatgaaaaagactcaggtttgatccctgggtcagagagattccctggagtaggaaagggcaacccacttcagtattctgacctggaaaatcccatagaccgagaacctggcaggctatagtccatggggttgcgaaagagtgcaggactgagcagacaccaaacaagtttccgtgtgtccaaatgtcatctactgtagcatagcatgttgaaatttgtgaacaaaagaacggtcctgtcctcattttgcagtgtgtggtttaatataacgtatatcagtgatttacataaaagttaattagctgaaaaaacactactggacaatatttttaagtgcagttgcaccaactcattttcctcctagtcagtaatatgcttatctgtgagtaccatctccgattttctattttctcaagtagatggctctgggaagctcggttaacatgacaaaaggatagctatcttgaaattccttgggaaaggagaggacaggaatgatgctgaagtgccttttatgggtgccattcaactagcagctccagcctagctaaatattacaggttgtcagttggcatccagtttttctttgccccacacctactgacatagatagatgaagactggacatccttccagaggtcaccacgatatgtctcatggagacagaaatgaagctttgtgaagaacttgcatctcgtttatcccatctaaataaagctcttcacatttcctacagcttcatgacattttccagggcccaggggtctgtgactgtatagggtgtgctctgtaaaatctgaggagaggccattcacttgacaaggatgtgactggtgaccccaaagtgatgtggtatgcaacctggacagctacacgcactgacctgcagctttagcgacctctaggatctgaagctttgctttttgttactgtatcctggctgactcactccagcgtaaatgctttaatgctgaatattctggtttatacatatgacatttctccaaacatggatgaatcattgctgcccttggagtttattcattatcagaataaaaacacatgagaacaagattggatcaaaatatatatccatctctgagtgctattatagattttgtagtttattatttgttccttattccaatttatcactggctgatccagttatgagtattagggaaagtcctgaaaatgttgtgtgtgtgtcctttcctggagtgcagagaaactgtagagtattgaaagaataaagcttgaaacttattttttggggctactgttctttttgataccccaagcagagattattcgcacatctgttgatttttttttcacgttgcacacatttgcaccttttttttaatgttgactgaatcacttaattgtagaggaacattcattttaatgtaaatcttacagtatta

SEQ ID NO: 57512 - DNA, 1848 bp, Bovine  19866880856025
ataaaggctgtcttcctttctggagatttcctataaaaacatcatgaattcacagacaaataaggctgccaaagccactttcaattggcatcctatttgcaagctcattaaagcctgcaatgagataggacctagtcaccactgatctgtcagttgatatgtccaaagtaaagatgacacgtgaatgctttctcatccaataaaactcaaagcagcttaaggcttgtctcagcattagcaaagtgcttttagaaccacaagactccaaatgtaaccttaggctgtagagaaaatgatgatggaaaagaaatacagttgtatgggttttcttttgtttgcttcagtcgctgataaaagtcattgaattaaaaaaattgggcagatgtcaagcacagatcaataaaccacatggcattttaaatcaagttaagggggctgattgaaacagacatttcttatcgtaattgtttggctttatttttcatttgtttaagtgagtattcattcaaaaatatacccatttctgcatattatttttacatgataaaatttattatattagacagattatattgtatagatgtaaataggaacaaattgtggtagaatatatataaaaattcactcttgattattcttaaaattagcatttaatgatttcctattgtttataaattctctactttggggtcttcaatcaacacattcaaaaagcaatagcttaatctctcaacaatgactgaaaataaataaatgaaaatgaaattttaattcaatgagatcatattgataatttatagaatgccaagcactcctgcactcaaagaattgataattttcagattatcagataattgcatttataaatagcatacttttaattgttattacaaatgcttatttatcatattaaaatatacttgtagcatatttgcatacagataaataagatttgccattaaaactttttgaagtactgttcctcacctgtgagtgatttattaaattagtaattttgagtgttagagatgtcaaaagggaaaaataattgaaattatttttctgctgatcaacggaagttgaaattattcatgaggttgaaacactgaaagcatacttactgaatctggagctgacaggtactttaaatgctcgctttttcctgaggacattgatcatctgcagatacaagacaatgaaagggtaatcagatagggtgtcgttttctgtgatgccgcgaagaaaaatcactactgacagggcatcctttttctacagagtcagggggcagattctggagaggacgtattgagatgtaatattgttaaggagacagcccttcccagttcttcacttctgtgccataattgataaaagagaaaataacaaagcagtgccttgtaattttcaaacctcaattgaatagagaagcttctggaaccattgaaagggaggtatgtttgttcttttaaatattaactataattaatgagcagaaaagcagaaagtagaaaaactgaaaaaaaaattgagttctgaagctagttgaaattttaccctcctaaaattaaggtttttgtgtatgtgaatgtttttcttctctttttatacatcacttttggaaattccatcaattgatgggcacttaacatatggggactgcagttatgagtaagacatcatttctaccctgaaggaacttgtgaagtcataaaattagcacaataattacttaaataaaaaaggtggaatgtggtaaccttgacagaggtacaaatataactggaactgattcatgcatacacagttcccatagattatatgccaacactgtgcaaagaataaaaa

SEQ ID NO: 57513 - DNA, 826 bp, Bovine  19866880861417
gtaaatgaagtggacaaagcaagaaaatgagattttaaaacaaaacagatttggtttaaatctgtttacatttaaacagcctcaaatctgttgagtctaatttaactgatttaaggaccagaccaaaaactctatgttgttaaccagtctgtgatcataactaaatgtatgcatgtgtgctaagctgcttcagtcatgttctttgcagctgtatgaactgtagcctgctgggctcctctgtccatgggattctccaggcaagggttgccatgccctcctctaggcgacccagggattgaacccatgccccttaggtcttctacactggcaggtgggttttttaccaccattgccacctgggaagaccagctaaatgtataaggttaagatacttcctttgtattttcagtaaaggcgtagggaaacatgtaagacaaggctaatgactataagaattctgattgctaactattccactaacttgatatttatggttatgagaattaagtagtcacatttttcctatactggagaagtaagaggctcttagtgactgactaggcttgaaggctattaaatcatagccatgcaaatatctatttgataggacatgtgggtggtaatatatatgatgcactaaaagtctcctagtctttctcagatttcttccagactcacagagtaattctaaaggaatcacagacccacttccaatttcagaagtacaaatatgaataaggttttaaatttcatgttggctttcactttttacacagcgtgtgatactaacttgtttctgggatatgttctgcaaaaactggaggac

SEQ ID NO: 57514 - DNA, 820 bp, Bovine  19866880864551
tgattatatcttataaaaagaactacatttcattgaaaccctcaaatctatgctttttttttttaaataggaagttatactctctcatagcaaaagaataatgatgataataccagttcataaggaagaaacatggctgtaatgactacagtggagtcactttatattcatatggaagacagcaaactttcctcatatttgcaaacaacaggtagagatacattttttgaaatgacatataaaaatgcttgtatctaatgtgcatccttaaggcacacttgttaagccctcaggagacaatgaaacatgctacagaaacttcagacagaatcataaaacattctaacttagtatgtaaaaacaaaagagatgggtagtctaaaaatgcaatttttaacctgaattacttgtataagattaaagttgctcatatgtaaggtgaaagctgctctcaaagattgaatattttagtatgttttaattctctggaagaaagaaaaagaatatgtggttatataacactacttttatataagaggactttcttccttaacagagaaaacaattatttctttcctaatgttctttctcctgctttttgattccctggtagctcagttggtaaagaatccacctgcaaggccagagaccccagttcaaatcctgggtgaggaacagctacccactccagtattctggcctggagaattccatggacagaggagcctggcaggctatagtccatggggactcagagtcagacacgactaagcaatctgcactagaaagaattaggagtgttagaaggaaaagtataaaa

SEQ ID NO: 57515 - DNA, 1269 bp, Bovine  19866880874211
acacagaaacctctcttctgctctctttatcctcatcagcaaaacgttagggttttgttctaaataagaaacatagtattgttagatttttggcaaatcagagtttgcccttatccccaccccctcctcagcagcacacatacaaaaggatactggtgaagatcaagttcttgggagctattttctttttttcttttcccttataaatcccaactagaagcttttgtgttaagggcatttaagctgagaataccttttttgtagtgctctctttcagagcacgcaggccatgtgctctgccactattttgggatggtgatgctttccctttaaaaatgcttatcctgccctcaaaggcaccattgtctgcctgggattctcagtttggttgcttttagcccctgataaattagtaatggaagagaataggaggcattgtggctcctgggccctgttattaaattgtggtttggtgctacaatgtatacaccacagcctctgtaatgataggtaactctctgactcattgggccaggctcaatagaatcacagagctacacggattttcaaattcttcgctctgcgtcatttcatgttttcaaggaagactgaggccttggaaattcagacttgtacagcaacataaaacggcaagcagcatagcttggtccatgacatattctgtttttcatactgttttcctttgaatggaagttctgatatctattaaagtattgagaaaatgaatttaaatttagctacagacttcttctggaaaaggtctgagagtcttataaaccatttttaaaagttcaaggcagctctttaaattttttagtcagtcatcaattcctaaatcattgtttactcataagagagcctgtattcccataggactctattcttttcaaaatgtgttcctatagttttttcccttcaagcttgacccgtattatatcaggtggaatactgtattttctataaagtttttaagggagatattattttctgtgatttatggtggctcaaatggcaaagaatctgcctgcaatgctgggggcccaggttcaatccctgggtcaggaagatcctctggagtaggaaatggcaacccacttcagtattcttgcctggagaattccatggacagaggagccttgtaagctacattccatggggtcacaaagagtcatacatggctgagcaatatcagaataataataataatgggtttatccaattttaatctaaatcctaacagctacatat

SEQ ID NO: 57516 - DNA, 808 bp, Bovine  19866881247032
atcaattttttatcatgagtggtgccaaatttttatagtgaaatacattcttttactaggctgtaaatgttcttatgggaagaactatatgttgttcagctttgcttattccctaggacctaggataatgtctcatttaatgaaagagtgttagaatgaaattaaaattgtgaacatatggatgattttctaaatatacaactcctctatgtagttactatgttccactgattactactggttaaaatgttctacctgctattttgtgcctaaatttgctggttctgcttttgggttaccaacatttctaggcagttaattaccaaaaagtaatctgattctcattttaaagttccatttctttgcaaggcaaattaaaatctttaaacccaggagataaatgataaatgttaactgtataaaaatgccaatgaaaaccctactaattaacttgaaaactgattatattttggatactatttaaatcacaaggtgtttatagttctagctaatgaaatactttttggaacatctttctaaattatgatgtaaataataaacaaaactttgatcttcttttcaaatcaggcaggtacatcacccactacaaaagtaacttgttttaaaacattttagtttagaactgacaaatgaaaatatatgagggtcatattcttacctcaaaataacttttaaaataggacattaatttgactttcttagaagttatactcaagtagaactgtataagtatcaatttattagttgaatactattacttatacgccacagagtgcttataatgcaa

SEQ ID NO: 57517 - DNA, 2189 bp, Bovine  19866881264699
tggctcagtggtaaagaatctgcctgccagtgcaggagatgcaagagatgcaggtttgatccctgggtctggaagatcccttggagcaggatatagcgacccactccagtattcttgtctggagaatcccatggacaagagcctggcacactgtagactatggggtcaccaagagtcggacacaacagagcaagcacacaccattattacctttacctcagggagttattttcaatccctctgaccaagaatggttattactgagcagtacagacctctgatgaggaaagactttttttcccgatcaccctctctcacacttgctaaaaagacagacaaaagaacaaaaggaacaaatgagaatatttacactgctaagtttgcaactcagagtggtaaaaaaaaatgagtcctgggactcaacaggacatcaaaaaggaaattctgggactccgtttatgggaaagaagaaaagacgttggcatgaattctttacaaaatagcaaatacaagtatcctcccttggctaagagataaagtacaaggaaaagaaagacagagatactcatacactgttcttcactcagtctctccgtatagtccagattgttgttagctcaccagactagggtggtgtgttgtctggaaggatcatttcccagtacttcctgtctgtgttccctttcgtctttctttgcctgctcatagcttaaggcaagcctttttaatacataggcttgtgttgtcttgagttcccttcatgttttaccctctgtcttccaactctagccaagacacctcaagaaatcattcttccttttttaaaccattaaagcaaaatatcaagcatggataataagcttgagttgtttctgtatgtcaaagacaaaaggctatttttaaatggtcggcggattcttcctgttggtttggatgtagtctgtatctcacaattgttggagcttagaagcagatatcttagggcttgtgaagaatttttgcttcacagggagcctgaaatttgtcctctaattgggcatgctcatcattctgggaggtgcactttgcagagcatgttttagtcatacagatacctcttcatggctctgagagacaccttgaactagtaactagacaattcacagtaaatattaacttaacgtgtcttaggtgcttcgtaagaggtgcttctttcctattttggatgtccttaaaagattagttaattccagtaggaatctgagctcaccctgtgcttagagcatgcatatgccagggagagtgagacttaatcacagattttgagacccagtcgttctactttaaagattcgcttgcctttgtctccatggtctggatcaccctttatggtaggttgtaaatattctactatagcagatacatggtcacacttttaatcatacaaacacaaaggcaactttgggatcctgagggaaagagctcattttttcccctcctaaatttccctgaactttgaatggaagggattttgaacagctgtttttctactgaagacacatggcttctgaaacttccaagtacttaaggactaaggataaagagggcccataggtaggacttctggggaggtgagacttacacattctagaagcataagagctcagttgtgtctgactctttgcaaccccataaactgtagcccaccaggttgctctgaccattggattctccaggcaagaatactggaatgagtagccattgcctcctccagaggatcttcctgactgagcgatcaaacctgggtttcttgcgttggcagatggcttctttaccactgagccattttagaagcctgcgttctagaagaggggatatttaatactcactgtaatctgttactttccttcatttaattccctcctgttaaatctttattaagttgtatcatagatgggaggggagttaaaggagaggcagaagaatgcagaaggaatacaacaatctgaaccagtagttcatagctcactggagtgggccagcagaagaatctgggcagtggtcaccaggagataagtccttggcgggtttgtgtggtgtgaaagcattcctgagaactcttaaaaatattaataggaaaattcaataaaacctaatcaacttctccccaactcagaggaaggggcttccaaattgaacatgtaagccag

SEQ ID NO: 57518 - DNA, 716 bp, Bovine  19866881336341
ctttgtatacttgtaaatatgttatgctgctgctgctgcaaagtcacttcagtcgtgtctgactctgtgtgaccccatggactgcagaccaccgggctcccccatccctgggattctccaggcaagaacactggagtgggttgccatttccttctccaatgcatgaaagtgaaaaggaaaagtgaagttgctcagtcatgtccgacttagggaccccatggactgcagcctaccaggctcctctgtccatggggttttccaggcaagagtactggagtgggttgccattaccttgttcaaccaataaaagatttgcatgcttttcttaagggaaaacaagattcactttttccaaaaccgattagttgtttgttgttcaggaattcccaaagattctatatccttgaacatgtttatttcttaaatcatgcttaaatgatcatttaatcatttcttaagtcagttttaaattttaaaagaaaccaagaagaagaagaatttcttatatgtttttacattgtttttccttggattctttgagtacctcttcattttgaattctaaatcaataatcttgcatatgcttaaagaatcttgtacttatacacatatatacacaatatatgaatactaaaatgcatatgttctttttcattccatttttgctttatttatttattgccattgaagattaattcctccccaagaagcagctg

SEQ ID NO: 57519 - DNA, 1359 bp, Bovine  19866881359722
gttatggccgtaaggaatcgaaaaatgcaaaattacacaaacagaaagttaacaccgcgtaaaatagaacttagaaaaccgtggtcaatattttcacatttaacacttggctattgcttatcaacaaaaaataatttcctaattaggaaaaccttactaatatgccttctgagtttgagttttaaaagatcagatttcatcaagcattttaaaaatatgattaacatctaagatttctgtttatatttatacacatagattgtttgagaaatgacatggattaacttgtggagtcattatgtttgttttctgagttcacaattgactctcgaatttatcccatccagccattacttacaacctccattttggtttaaataacattagcccatgcaagtaccactgaaaaatctaattccgttcccagcctttccagttaaagaaaccaatatgttacattcagattgattttcttaaaaattggttttactcattcactggatagattcatggataagaatatagaacttggaaacagactacccaggcttgagtcccagtcctgcctcttcctagttatgatctgggcaacttacttaacttctcagtttactagctctaaaagtatgtatcaaatacatggatgataaaagtacttaccttagaaagttgttatagacacgaaaactcaacctctgtgcaccagtgccgaatcaaatattggagacagagttttgggtgaagtctagcattattgctttgccaggcaaagggggacagaggggcttgtgccttaaaaactgtgtcccaacctgtgatgggggtggatttgatgccggagttttaccggcagtggttcaagggcagggttgctgataagaatcagtgtgtgcatggcctgcatccctttaatctggcctccggtggtctccggatgatctgtgattttcaatgttatcacactgtgaccttctctatggagtgaagaatgcttttccactggatggggtggtaattctatagaagagctcaaagatatcgttatgagtatcccttgaggcggaacagagactttgccccaagactgcactattgtttcctggctgttcctcccttgtctctgcatctcctccctttcccggttagcaactgtttgaacctgctctttggatctcagggaaggtcatggaggctgaaacttatttcctacaaacaagaaacttgggacacaacagagaaaggctttggtacccggagtcccacatggtcctacttggcttcattaagaagaataaatgtgttattatttgcaaaagatttaaagcgatgctggacacctctcaagtgcactgtgtttag

SEQ ID NO: 57520 - DNA, 1110 bp, Bovine  19866881409965
agtcttttgttgggaaaatgaagctgagttataagaactgtgaaggttctaagagttacctatttgtatgtgaacaaatgaacttgccacagttctgtgggtgctggcagaggacgtgagtgtctgggtcagaaaccaagattgctgtctcaccgcaaagaagcagtaagagtctcagagctgatctagctctccaggcctgcaaagtctcttggggtgatgcagaggcccaagtaacaacatcaaagccgagaactctctggcttggggtaactaaagtgaaatgaaaagtgttagtcactcagtcatgtttgactcggcaaccccatggactgtagcccaccagattcctctgaccatgggattctccaggcaagaatactggagtgagtagccatttcattctcccaagggatcttcttcagccatgcatcaaacccaggtctcccgtgttgcaggcagattcttttcggtctgagccaccggggaagctattatcatatgcagtaaacaagcttgcttaacctttgtctataaaagagagattattttcattatatcagactgtaagtaaacctgccctctgctctggagggagatatgtctctacaatgcaaggctgtacgttgttgaaagaggacagttcttctgcttacaaaatgtgcagatgatcaagagacccatggagaactatctcccaggaagcatttccattaatgcttcatattatgatgcaaatttgacatttctggttctaatgtaagaattatttactatgaatttaattgagtgcttcaaatctggtggtttatgtcttgactaggaataggaaaaagtggtcaggaagcattactattaatattgtattatttagagaaacaagatgatcaggacatgtttatattatttcactcccacagaatttgtattagtgactcagtgcataataggtgctcaaaaaattattaggtctgtgtgttccaagaaatatggcaacttgactgacctgaagaattgagacctgcagtggtttctatagaatcccaataaatgatgtctaaaattaatctgagttggatacaatttggtgaatgatgtacaaggagtata

SEQ ID NO: 57521 - DNA, 1078 bp, Bovine  19866881497241
atacattattacacagatatgacagcccccatttatttcacattaaaattactgaaccatgaaggataatagttttaaatgtttttataccataaatttagtttctcttttcacatgtatatgacatagtaataaagctgattttttaaaaaatcagtaaataaagctgatttttaaaaacataccgttctccttgcttcccaccacttttggggttcacaaaaactaaaagtggatgagtaccaggaactggagtgatctagaagaaaagttgaatatgtggacaaattatttacattagatataaagagaactccttgttatttctactttactgctaagtcacttcagtcgtgtccaactctgtgcgaccccatagacaacagcccaccaggctcccctgtccctggtattctccaggcaaggatactggagtgggttgccatttccttctccaatgcatgaaggtgaaaagtgaaagtgaagtcgctcagtcctgtccgactcagagcgaccgcatggactgcagcctaccgggctttatgacattccaattagcaaattcaagaatatggttcatttgtcctgtaatgaggagataaacagcacagatagataatagatactagatctatttaataacctagttaaatcctgtgctttgtctccatatgtatcaacaggaatacccactccactagaacaggggcagagggtaaggcaggtataatatgaaaagagaataacctctcagtagctatgagatgaaaacaatagatccaattgtgggacactaaataaaccacctagaataaagcagaatatagtggggaagaaagttaggaaagaaagagctcaaattagagccatcttagaaatgatccctactccagagctttgtagcacatttggaatccatcttcccaacgacttgtgaacgagactctaaatagatcgtttggggccactttcagcctgagtccccatctgcacagcaaattcctcaatgctttcttttcctactcgagaagcagaatgccagttaatccaggctactgctaaacaggaattcattaaa

SEQ ID NO: 57522 - DNA, 1019 bp, Bovine  19866881709949
tccaggacaatcacataatttgacaatagcacttaaacctttgaaaattatgtgagcattttttacataacagatggtacatgtcctcacaccttttctatcactcataatacaagacaggtctactcaatttttaaaaataccttttgttattaataattgcctaagccgcttcttcctttcctttttcagaatgaagaacaaattttggtattttgagtttggcacatctgaaactttctcagccacctgcaagaagctacatgaatctgtagaaatagaagtaagaaaatgaattctctttataattctatgaaatggcttgagtgtattaatttgttgtgatagcccatggaagaagttagaattttagcaatccacatagctttacccagtattctaaaatgtcatttctgtcacttattgaaaatttagcactatctgaaatactaatgaaaagctaagtgtgagtatgcattgtttaatacagcataaaataattgagaggtggaaataactgtagatatcactggatattgtatggacagaaagctgtaagataaaagaaagtacttgaagggaaagaaaaaagttgcagaatacatggaaaaaacatattatttttaggtctcaatatcatataacttttaaaaatacagttcactaaaattgtacttactttcatgaataaaggttaaaaaatatacttttccattccccatacccattcattagctaggttttctcagttcctgaggttgccattccccattacatttgtagaaagtgaaaaagtcaagaaagagagtgaagatagcaagaaaagatagactttaaaaaggtttggagcaaatatgtctatcaaaattaaatacattgtaggactaaaaatttggagacaggctataatagaaaatgacttagatttatttagaggattttaggggttaaagaaaaaggaaaagttaaattttgataagtagtaaagacaaatgaacagaatcatgaaacaaggatgc

SEQ ID NO: 57523 - DNA, 965 bp, Bovine  19866881832071
tgcctccgtaagatgatacttagagattgtccctgcagatctttaggttaaaaaataacaacaattaaaaggatgttgaagaccaacagtaatatacatcaaagaactagcatgattacattcttatcatgtttttgtagggtatgaatgtatatatcctgaggaaagtaaaaacagaaagtatgtgtatacagagatagaagtgcatgcaaaagcaatggaaggcatatgtaaaagggcacagtcaactctacatgaaattaagatcctgccccatggaacacaaacaaaatttgtttcgtgaagtggcactcactttgaaggcagcacaatttcttggcctgcaaaatgtgtattataattaggtggcagagcaccacgagggatattaagttgtcacagtgtcacatggcaacagatcaaggaaggagaggaaagagaaagaaccactagaatagcaggaagccaaaggatatgaataggagcctccattaatgaccaacaaagccaccaggcagatcatcaagggagctgataaaaactagccagagtagacaaggcactgatattcaaatcacacactcatcaagtgacaagtcatgggttctggagaaaataaacataattaagcagtgtttttggatctcggtgaactcatagtctatctggaaagacaaacataaacacattcaccttcacatgaagcagcttggtgaacaagtgcacttttggaagcacagaggtgagaaagtgattctggctggaaagatcagggtgagctacaaagaggaagtgtacaatccaagtctgaccttgaataacatgttcaccaggagacagagaacaggacagagggctttccaggcagcgaaaacattgtggtcagcagtcaagagataacccaggcagagagtatggattgtacggtatgtcaggaatgaaaaccaaaatctgagcaaaagggg

SEQ ID NO: 57524 - DNA, 971 bp, Bovine  19866881969745
cttttaatgactaacatgcaaaatgtatccagacaaggaattttttttaatattaaaaaaagccctacacacttggtaagagctataatgctgcaagtgacattgataaatgagactatattcgtgaagatgtaattaatctgcaacagggtgagaacagctccttaggtaaatgaaactaaatcagctgtgtagtctgtaattaacttacagccatattagtccaagtgtaatgttattcattatatatgtaaggtattattttctccatatgaaagttgtaatttgctaagtaatgattaacagttcatcttaatacttcagtcatattatcataatataattgtcatccattttcattttattccatttacccctctgtttgaaaggcaggattagatgtcagttcttcacattgcatgtacagaaatgaataaattgaagataaagcctgatttattgtgattacctctcactgacacttcatgcagcaggtctattttgaattctttgagaatgtggagatgtatacaataaatattaaagcagaggtgtggcattcagtctgcactgagtacatgtaaagaagaaaagattcaaagaaagtaagtaaatactgactttgaaaaccaggtatttattccatacattccatactgaatactgaatcttcacaagttcaggcattcagtgattgttatggttatgagttaccaggagagagcttactttgttcaaagtatggtgcttttctagacacattcaagaacattttagtgaattaggaaaacaaatgagactcaacacagatctaaaacatgatttggttctagagaactgcttggaattcacatggtcaaaacccaactcatgctagtttaagctaaaatgggaataattgactcacataactgatcaagtagtgtttcaggctagaagcgggtttagaggctcaacacaatcatcaatac

SEQ ID NO: 57525 - DNA, 812 bp, Bovine  19866880500082
aaaaaaatcatctattcaacttctgaaataccaataaagcatcccctactctcaaagaccctttgcaaaatgctcttctttaccgattaatatgttaaacataattagcttcctcagacggaacagaagctgaagatgtcatgggcatcataagtcatatgttttcgcgatttacatccaaatccttgagttccgaatgaacaacccttgaggcaggcctgtttacacgaatgaaatttgcacggtagctccagccacgctctggaagggctgggtcacactggcgcttttcaacactgctgggatttaatttctgtagtatcgtcgtagagagagagcactaatcgctttttaattattctcagcttccgagaataaacgggagggagaccagttcccagacaaaggaagaaaacattgggagctgagcagagataattatgtagcagtgccctagcgacaggacttcagaagggtcctctgccgcccatccacccagacggtagaactcagccacggtcctttccccagccttcagacctcatcctcgaaggccggcgatcctgggaagtcatggagaatttaggaagctttcgtcacattttcagcaaagctgcttgggatggggatgacagagtcgtagtagcagccatttgtcatgtctctgtagaagtcagagatagtgtagctctgacacaatggcttcgaaaaaaaaaatccacaaataaacattgctgggaataaaatgctataaaccttgtgtgataatttagagcattttttggctagtttgcttttcttcattgaaaaat

SEQ ID NO: 57526 - DNA, 712 bp, Bovine  19866880729767
aaaagaaaaaattttttaaaagtcatgtatcacccccacagctgagcagaaatgattttgaaattaaccatgccacagagggctggggcttccccagtggttcatctggtaaagaatctgccatttacaagagacacaggagaggagggtttgttccctaagttgggaagatccccctggagaaggaaatggcaagccactgcagtattcctgcctggagaatgccatggacagaggagcctggcaggctatctaccgtccataggggtcagagagagttggacatgactcagcagctaaacagcagcagcagcagagggatagagctttggcacctgtctgaattggtacaaatcgttgaatccgtgtttaaagctcacccactgtgtgtatgctctgagatgatctttcgacatccacggatgctctctgatacacacacacccaggagggcgcccatgcagaatggtgtccctctcgggaagaagaaccccgtctccatcactacgatgtcctcaatctccctgcacacagtgtgagtgttttttttcagggacagctcacgtttagccttttgaaggtgaaataaggactgaatttaagattggtcattatcttggaaagactgggggaggataaatttgagcctgtctttgaatttcaactacgccagcaggctctgaataaacagccagattctcattaaacgcca

SEQ ID NO: 57527 - DNA, 1805 bp, Bovine  19866880733479
gagatggttggatgcctcctgactcatggacatgactttgagtaagctctgggagatggtgatggacagggaggcctggcgtgctgcagtccatggggttgcaaagagttggacacaactgagcgactgaactgaactaaacatgcctgaggcaggagttgttccctcccccgtggagtccggggctaagtgtctctcggggagacagttgaacatgaggaggaatggcactcgggggaagacccactggcaggacagggatgggctgatcgagatgctggctgaagtcttttcctcaggtgcctatctgagtcacagtactgtgttcatttccacataaaatatagctgtggtcggatagtgcttcttgcagcgttaattagccaactgtcctcttagaatgcaaacatcgagaagcagcatcgttggtacatgctgctggcatgtctgaaaatgttagtgaggaggaaggagtaggtgaatgaagtaactgccgccgtctttggtaatttagctgatgtgtgtgttagtcgatcagtcgtgtctgactctttgtgaccccacggactgtagcccaccaggctcctctgcccgtgggattttccaggcatggatactggagcggctggccattcctttctccaggggaatcttcctgacccaggggatcggacccaggtctcctgcactgcagcaggattctgtaccatctgagccaccaggaaagctgataatttatctgataaacattcattgacattggacttaaaatgtcacatgttgtttaaggacattttggaaaagatcatttttaatacctacgaattgctatcgtgtaggacttttacagtaatttgaggcatttctttctgtgaaactgagaatttctactttatttagtaaaatgtcttagttttataccacaaaatgctgggtggtcacaattaacgtggaattaagaatttttgcttaaggagcctgatgcctatctttgcctgaagtcttccagaaatctttttagtttataaggaaacataatacctccaccgttcttaactcacatagttattaacatgtgtatgaaaacagcccaagtgttttcttaagctctgttggataacagtataattgttctacctgggatacaggattatatcagcacatgttacaaacagatcattttctagaaacacacaaaaagagcagagatgaatttcagcgcccttacagggcccttacactcatcaccagagaccaaaattgctgtacctcaaactctcggagtcaagtgataaatgtctgctcacgtgctcaaagagttatttgttctagatttaatctcacagctatttcagtggggaagattgaacttcaaggtaaaatgtcactagatgtattttcagatctttctcaaagcttgattactctgtttatggagaataaagttttaatgattgccttgtgttcactgaaaagtcctggcgttttgttttttttttttttcctgtgattagtatcctgggaggagggaggaacatctctgtattgaagctggaagtttagcactggacgggtggagagctgaggttggggctgacacttgctcctttggacatcagtttgtgatgaatcagtcatgtactatgatggcaaaccttctaggaatctgcagtaccctgcgtgtggtaggcttgactcaggagagccatgaatgtgaaaaaacaaaaaaacaggcatagacagtaagtactgcagaaacattaccggcgtaatttaaaccagcgaatcggagctttcctgaccat

SEQ ID NO: 57528 - DNA, 2157 bp, Bovine  19866880972006
tagaaggtttctactatttcttcttgacaaggctggctatagaatttttgagattcagtgcaaaatgaaaatgcagggcctcttgttcaaaatggaaaaataccgctaacggtactgatatatactgcttcttcctttcttccatgatctgtctctccctttatcatggtgtttttgttatttaatgcttttctaaataaagaaaaattaaaattttaaatcattatcatgtactgtttatctttactttgtatattaccagttgaacatgtaaaaataagtgcatttaattagtatgcagaatcaccaacattacaaaaatagtacatgcatatgtattttattcttatcagaacagtggaaattctgcacaaaactaaagcagctggtttcattttcacttttttatatgtacacattctaataacattctggtttcagctcagtggtgaataaggaaggactcaaagggaaggaactctggatttgcacaatcttttcttgtcctctgacatctccatatgtgattggctcatagggaattaacatgtgtaataaaaaatactataagaattcctgggtcactagagacaaccatcaccttctttctgcatttgaagcaatcgctggttcacatgagggatccttgggatggttggcatcgccactcagtcaaagccatcaccgctggccatcctcccatggagtctcacacacctcccaccgatcgtgaatccgctgagattctgtgctctgggggccctgagtgctctatgtcagcagcaggcatgcctgtcatagcgtgtgtcccctgctcatgcccatgctgtattatcccatcggacctcacaaaacacaagttccaagatacaattatgaagacttttgcaacagtgacagcatcaccttaatccactaagtccttctaagtgagggctctgtgcgactgttcaggacacgtgtcccgagaaacagctgtgcttcaggtttcaatgagaatccgactcagactggccagtgtcatgtcatctccagagccactggcagcaattaggagccaatgatgccttgacttcagatcaattctcagtccttagctctgtgtccaccttctccacatcttgctccaggcagcataggacacagcctccctcggtctcatagctggcctgctgctcagtccttgcagctctttcagagacaccaaacagtcctttctaaattgtttctggctcaagtggctctgatgaggctgagactgagtctgtcaagaatcaactagaggattttggtccttaggcactcagttcctccaaagagagatccagccccatgcctgccccagcagccaagcagagcaagagccccctgggcactttgtcactcctgtcccagctggctctcatcctaccagaacattgtgttgctctggtaaactcacccttgctcaggcaggcacaaggattcagcactcacacccgcctctgctttgtggtccccttgccctgtagtgggcttctcaggtggcccttcagttcagtcactgaactgaattcactgagttcagtcactcagttgtttctgactctttgtgaccccaatggactgtagcacgcctggccttcctgtccatcaccaactttcagagtgtactgaaacttatgtccattgagttggtgatgccacccaatcatctcatcctttgtcatccccttctcctcccaccttcaatctttcccagcatcagggtcttttcaaatgagtcagttctttgcatcaggtggccaaagttattcaagtagtcatgtacaaatgtgaaacttggaccataaagaaagctgagcactaaagaattgatgctttcgaattatagtgctggagaagactcttgagagtccttggactgcaaggagatcaaaccagtcaatcctacatgaaatcaatactgaatattcattggaaggactgatgctgaagttgaagctctaatactttggccacctcatgcaaagaactgactcactggaaaagaccctgatgctggaaaagattgaattgaaggcaggaggagaaggaggtgataaaggatgaaacggcttcaatgactcaatggacatgagtttgagcaaactctggagatagtaaggacaaggaagc

SEQ ID NO: 57529 - DNA, 769 bp, Bovine  19866881257785
taacttaataacgtcatgaattacattaatacatctcctaatattgaatcattttggtattcctaaaatagctgttatttcattatggggtattacttcttaaatatactgccggatcaaatgttcacttcaagagtttccattaatatttatataattcagatgacacattatgcatataaatttcttactctctggtcgctgtcagattttaataccagagttaatctacctttataatatttaatacaattaatcctttttatatggccttggtcagttttagtaccacagggattcattgttcctttaaagttcaatagcatagtaatttcacttgcctcgtattatggggaaaattacctatgaaataacctttatcggtcattttgtaaatgagcagagagagagtggaggaagcctttgacaacctttgtcaactgggaccatgactattggtctgtttaaactttcctaaatttcagcaagaagatgtacctcgtaacttacaaacattctattgctttccctatatatcccaactttatattctcacttaccatcgacatttctctctccatgtctcccacctctttctttacctcacttggactaggtgtacacaggatttttttctacaggttctgcactgtgtaccaggccccaggaaagtagactctacaagtaatgaccaggtttgtttctagatgataaaccagctcaaggacagcacacttaaatctgtaagcttctaatccttgtcttaccg

SEQ ID NO: 57530 - DNA, 853 bp, Bovine  19866881410123
caagagacaggggttcaatcccccggtggggaagatcccctggaagaaggaaagggcaacccactccagtgttcttgcctggagagtcccacgaacagaggaggctggcgggtcacagagtcggacgtgactgacatgcacacacagcagggcaaagcagctatacttgagtacatttttaaaaactttattgctgcttctttggatattaaaaataagggcaaagtttttttaaccaaatgaaaaaaggagggccctcgtcaatcattctcaaccacaaaatctcagttccaggttaccagggcccctgcactggactcttttccttttgttaaacagacacagacctatgagaccaaagtcataggaacagagttggagccaccagaataatgtcaacaatcatggatgttcctaaaggaaacggatgactacaggaaccacggatcccgcgtcggctctaggatgcttacctgccctttgtattccactggcttcagtcctgcatagatgggcaggaagctgctggccagcaggacctagtggacaaaataaagacacagctcgtgaaatgagacagcaacacgtcctaccatctatttcacacgtcacctactaggaagttacaattgtttaaacacaaagtgaagcgaaagtgaagtcgctcagccgtgtccgactctttgagaccccatggactgtagcttaccaggttcctccgtccatagcattttccaggcaagctgccatttccttctccaaaatctactataaaaatgaaacatggtccatgtatttcatgggacacagtgaaactgaaagcattagtagctcagtcatgcccaactctttg

SEQ ID NO: 57531 - DNA, 1759 bp, Bovine  19866880869132
ctgatgccacctgttacatagttagccccacgctggctaccttgaaagatccaaagaaaagtgtgttccttattagctgctgagaagttcaaattccttctcttcctcctccttcttctcttcctttccttctctttttcttttccaccattatcacaatggaatattatcagaaccagggttctgttaattgaaatttctgattaattgaggtggatcagataacccttgtaatttccacctttatcaaacatccttctgtaacatgtgagcccactctgttgtctagtaagtagcatcatgaaacattacagagggcccctgacttataatgattcaacttaccatttatcgactttactatggtgtgaaagaaaaacacattcagtagatgttgtgcttcaaattttgaattttactcttttccagggctagtgatatgctgtacgatcgcagctacaggtcccagtcggccacgtgattgtgagggtaaacaattggtacaaccattttgtaccctttccaccattctttcatttttagcatggaattcaataaattacatgtgataatccacactttattataaaggaggatttgcgttagaggattttacctagctgtaggctgatgtaaatgttctgggcattttaagataggcaaggctatgaagtttgctaagttaggtgtattacatgtattttccacttataatatcttcaacttacaatgggtttatcagggcataaccccatcgtaagttgaggaagatctgtaatttgatctttctttgatgatttgggaatagacagtgccacaggatggttattacaaacattaacaagaagtagaattctgtaagaaaaatgaagaaggttgaaggaattggactgaatttgtattgaccccaggatgtaacttcttcataaatcctcattttcacatttttcttccaaaagcaattctggcttgcaacgacactttgttgggttctggttatttattaataatttaaccagtgagtaaagagggctttctgagtagagttgtgtttattttccttaggccccatggtgattccctgcaagtcaattctgttttctgccaggctctgtgtccagggacagccccttttggtgctattagctgttttctcccctaatttatcaccttgtcccatcctgccttattattcagtatacatcattgcaataaagcaaaaattaaaacatcaggatagtcttcctgtttaaatacctaattatgtgacaattacttttcttgtgggctgttttgccatttttacaagcttatggaaagaagagtttatttgcatttcaaaattgaattttactgatggaaaatctgcaccaagaagacagaatcagagattattttctgttagtgacagcactgggcagacaacacattttagttgaacaaacaccttttttaggagtagcttagaagaataccagtttcttccttccaaaggatacttgcacacattctggcctttagttaaatcgtacaagaaagaggttcatcaaaaggaaagtttatgctttctttaagaaaataattttaccacaaaattttattattaacatatttgctaaattatataaattctgtgctgactcaaacatttctccgaatacttttaaggttttaaaaatcattattaaagtcctgtgtcttatatcccaaactctaatacatatttcaactggaatatccaatttcacaaaattcacaa

SEQ ID NO: 57532 - DNA, 1091 bp, Bovine  19866881076516
cctgttagatccactgctgctgctgctgctgctgctgctaagtcacttcagtcgtgtccgactctgtgcgaccccatagacggcagcccatcaggctcccccgtccctgggattcgccaggcaagaatacaggagtgggttgccatttccttctccagtgcatggaagtgaaaagtgaaagtgaagtcgctcagtcgtgtccgactcttggcgactagaatgtcttaaatgctcaccgagcaattgcttgagcaatattatctctctagtggaacagaaaaggccaaacataaaaatcggactctcctcagccatttttcagcactgatgtaagccttttaagtcagatctgtcgagtttcatgttcctacctctgaagctgttggggatgacctagagaaaggcaagttgaaaagcagctatcaaaagtggggtcgggggcttgctgcgcatgcgcagacagggccgacgtgattagttggtgcgcctgtggcaaagagcagcgtggaggggagcggtccttggagatgcctgacctgttcagttctactctgttttgaggagtttccagcggcacgacagagcaagccagggacttctacacctgagaaggactacagaacagtgctgtacctgaggtaggaccccaagtcaaatggagggcagcctcactgaacaaccagcggtgggtgtcacctgtaccggaggcagtcaccgagtaggagcaactacctgtggtagatttccaggcagaactgagacaggtcttcttagctgagacaccaacaggtcattaaagcagtatcagaatacccaggtagctgataccaacaggaaacagatcaaaacaaggaagcttcttctactattggaagcttctgccccaacttgcagtgtttggtggagaacctgcatcataccttaatccgtaggcttccttgggtcttaaggatcccaaaactgtcctgtggacatcgaagttggtggaacagcaattgtgactatgggaaagaggtgcaagatgcacaggtgagatgtgtccggcaggatggttggatcttcactggcccttttaagggtttggaaagtag

SEQ ID NO: 57533 - DNA, 1084 bp, Bovine  19866881111569
taccactgagaaaattattaatactcactcacctcttatccctggtggagggggtctcattcctggagggggcatgcctattggtgtcccacgagtaggaggaagcccaattggtgggcccatgggtggtctcataccaggtggaggagccataattcctagaaagaaaaatggcaggaaaaaaaaaaagcacataaatcagctaagatggtagcataaagcacaagataatagttaaagaaataagccaggtactaagtaaagagttgaacacatttctccttgaccattgctacggcagatcatcccaattcaagagtccatagttttcattaaaaatcaatggccaaaagtgaaaacatattccaagctcctagttagggagttaggctgggccttaatttagtatcttcttaaagagtgcttttggtcatcataattttacttcccagatccacatctgtatctaagaaccaaattcttttagaattctttttagaaccaaattctccattgattccttacctggaggtggggttgctcgaccaacaggtgtaggtgcagtcccccgtcctggtggatactgagttggagctccagcaatgctggcagtagccgcaactgcagcagctgctacagtgcctcttccctgtggggtcattacctgagaaagaacgcacagacaggctgtaaatataaacacttcctcacatcattcaaatacagaaaagaaaaggctgatcatacactatttattaaacacaaagtaattatagcaattacgcacttctcccatttttctcatttaaggcgcactatcaccactatcacactctcctttaaaatgaacatgtccgcttttaacttcatcagccctttgcattctcaactctggtttatccatccatattcctcttcgctcatcagtgctgagttactgctatcatggtggcttcataatgtatatttgtacccctcttccctctacagcatatactgctttacacagtacaggatgttcactcagttttttcagtctcctcagtatcagattccaggtactttctctcaataacacttcctg

SEQ ID NO: 57534 - DNA, 1333 bp, Bovine  19866881172003
tgcactgagttgttttatagatgctaaaacatcccaccaagtggaagaagttaactacttgatgaccacgaacatgtagcccccagacttactaaatcctgaggactgataatgttaacccttgtggcaccaccctgctactacatcatcagccagtaagagggttctgcacaagctgatcacacaccttgtgactcctctccctcacttgcttgtaggtggggagggatgtggaaggggggtacatgatggaggggacaaatgtatgcctgtggtcaattcatattgatatatgccaaaaaccatcacaatattgtaattatcctccaattgaaataaataaattaaaaaaaattattccctaaaacccactggggaattaggtattatagtctttggactgagacagtatccctgacttcatggcactgtgcatctactaacagaaataaatatacaaataaggggttttgagaaggtatatttaaagtaaaaacatgttttccattgttcctactattcagatgcttgctcaatgtttgttaatgattgaggttctagagttcatttaaatatctggctaagccaatttcctttttaatccataactattttttagttattaatcagctctttagaattatattctatagttctagagaatatatacataaataaacaatacataataaacacaagcataaatactacttaatagaatttgtgacagaggtttgtcaggaaaaacctttacttattcttagggcattaatgtcacagtcctaagtaacacataatcttcaacatagcttgccaggaaatatatggactgctctttttggtgaggcatattttaagttttgggaagaaataatgatgatgccatatatgatattgatatttcatatttctccatttaatatctctaaataatactctttttctagtacaatacaatatttaaaattgaactattttgtgtttcaaaaggaacaacatttatcgtataaaaacttcatggtcttgaagagatctaaaaagctcatgtacaactttccatgttgcaaaaatgaatgacaactaatttatgttaatcaaacaactaatttatgctaaagcagaaacaaaaatatagtacactgagatcacaaaacttatgaattatcatgttggtatcttgaaatcccaacaactaaaaagatgaggaaaatctcaaaatattttggcacatatagaattttactacaataattttttgatccactatgaaattgccaaaaattctctaaaatttgacatttttccatcaaagcagaaaaaagcaaaacaaaag

SEQ ID NO: 57535 - DNA, 1680 bp, Bovine  19866881410441
caatttctcttggtttattctttgaaatgaatcagaaactgaggcccaatcactgaagacaaggcaaacacaacaatatactagacagacagaaatctaaaattactatcctgttatatctggaaaaggagtttcctatgtctatgaaaacaatactggcaggtctttggtggaagtcagcttttgtaactgaactttcacaggaatagaatttcatgagaactgcagaacaaaaatatctacttggaggtgtctcattttctcagatttcataaaattcactatttttgctttagatctatcaatgatattgatactacatttattgtctagcactaaaagattcttgatcagtaacactgagacattacaaaaatatttgacaatctcctaggggtattttggctttaaacagatcactatgtatttatgaaagactggtattagattagtgaagcaaaagtttcttggtaacatcctgcacactagaggaatctgctaccttgataaactaagttatgccgtcagtatactttcggacatgacccaggttgtattttgacccatcaatttctactctaagaagagatcctcagataatttaattctagaagaaaaaaaaaattaatcttgatgttagaatccaagccttaccactcaaggggaactctgtattgcttaccttctcaagttcccacaatgaaaagatctaacttgaatgaaatttcagagtatactgccctctgtgatatactcctgagactctgccaagatgggctcttacggtcttaaaaggaacaagctttggtgatatttttcaggagctagcatttgctatatgtaatgtaatcagttattttaaaatgtatattttctcagagtcaccagcaatttttattgaacacataatgtgccagatgttattatctcttttaattttggtaatggctggcacatctacttccactcactacagagacaaccaggaaaccacggtgaatgggaattggaatccaggaaatctattccggcactcatttccttaatgagtatgcaattgtacctactaatatattctatttccatgattgcaggggcccttattatcttgctcacagctatttctccactgcctagaagagaaactttctcatactacatgatccataaatatgtttagggtgaatagatgaatttaaagcatattatatgctggtacacagagtgatatcctagaatgtgggctttgaatccagaagttcaaagttaagactaatatatatgctagtgaagtgaagtcgttcagtcatgtccgactctttgtgaccccacggactgtagcctaccaggctcctctgtccatgggattttccaggcaagagtactggagtgggttgccatttccttctccaggggatcttcccaacccagggatcaaacccaggtttcctgcattgtaggcagacactttaccatctgagccaccagggaagacactagtataaattatttaccttaaggtggagaaaataatatctaggtttgctctaaagatgacatggtaggattatattaagcagcaaccataggggctttccaggtgatcctagtggtgaaaaatctgccttccagtgcagaagatgcaagaaacataggttcgacacctgggtcaggaagaac

SEQ ID NO: 57536 - DNA, 930 bp, Bovine  19866880364047
ggtttttccgtggtctgtatggatgtgagagttggactgtgaagaaggctgagcgccgaagaattgatgcttttgaactgtggtgttggagaagactcttgagagtttcttggacttcaaggagatccaaccagtccattctgaaggagatcagtcctgggatttctttggaaggaatgatgctaaagctgaaactccagtactttggccacctcatgcgaagagttgactcattggaaaaaactctgatgccgggagggattgggggcaggaggagaaggggacgacagaggatgagatggctggatggcatgactgattcgagggacgtgagtctgagtgaactccaggggttggtgatggacagggaggcctggcgtgctgcgattcatggggtcgcaaagagttggacacgactgagcgattgatctgatctgatctgggcgagaaaaaagagaaaaatgacatagagcatgtcaggggcctagtaccacatctggtgactgatggctgttactgggaggggagctgggtgtgtgcctgcatgtgaatgtgtgtgtgtttgcgcccatgtgtgtgtgtatgttgcaatcagggatttgccccagactgctctgctggtggggcagtctgggctcagtgttgggcagtgccttgggcactggggatcgcagcacacctccaggccccgcttcctctgctctccgcaggatggcaacagctgcaatgtgggcagccccttcgccaaagacttcctgcccaagatggaggacggcagcctgcaggctggcccaggaggcgccagcgggccccgggccttggaaatcaataagatgatctcattttggaggaacgcccataagcgtatcaggtgggccgttgggggagggcagagacttgctgctatgcgtgcctctgaccaggtcaccg

SEQ ID NO: 57537 - DNA, 1340 bp, Bovine  19866880382781
atcaggagtggagaagggtggggtggtaaagaaaatgggaacccaggaaagtgtttactaacacagcccctgcagctgccttgggcccctctcccttcccccaccaggctggcagccggggagaagtcctgggacttgactcggaggtggggggtccccgcagtagattaggggccttgaatctacggggctggtggatacaaagtctggctcaaatctttgccttgtcgccctctcccacctttagcagtctacagctacccctgagtgtccatggctggtgtgccttttgtaactggttttgggggtcctttttcctcttacagcagaatgtacaggtccggactgcagacaaggagatggggctgcggggagaggtgctggcggctgcttggggtgggacctgctgtctcggccattgtcttcaggcaacatttcattttctcctccttcccggctaataaattagagaggaggccgtgggcttcgaagggacagactccccacggacagcgggcaggcaggtgggaaggcaagtctgtgagctcttggcagatgggctcacccagtgcttggctgctcacgccacacctggtcagacacttgcacagagcccaacaatgagcagcataaaaataccctctgtgtgtgtgtgtgtgtgtatgtgcgtgtgctcagttgtgtctgacttgccgtacaggctatagcccaccaggctccatgggattctccaggcaagaatactggagtgccatttcctcctccaggggatttttccaacctagggatcaaacctgcatctcctgccttggcaggtgggttctttaccacttgagccatcggggaaggcccatatacacacacacacacacacacatatatatatcacatgtaaatttatatacattatacaaatcctccaagattcctgaatgggcgatctgggcttgagcccttcgtcctaacagttccccagcaacttgtcgcactgagccctcctagacaggacgatgtaaacagacatgcacagcctgacactgacacgcagacataaaaagaaacacacacacccagaggcagcccccgacacacacactgacaatggtgtaatgaatgcaggacggcgacagcattcagtccaaagcccacaccgctggtcgcccagcaccagggtggctgaaaggttatggagtggctgcaggcctgctccccacagtgtcctctcccaggctctcggctctgtggagctgaggtgcaacaccatgccaggcacccaggtgggagcaaatgtctcctgagacagaaaggctggaactggactcagcccttagtcagggcag

SEQ ID NO: 57538 - DNA, 1469 bp, Bovine  19866880390038
ggcctcgcctggagaaggaagccccgcgaagctgtttgtcaagggcaacatgaaaggacatccgtgagaacttccaaggtatggcagggggtggggtgctccgggggtgcgggcaggggcaggcccctagaggccctgggagtgtagctgtcacacctgaccctgggccccagcggcagtagtgggatgactgcccaccctgcgccttcctgtcgcctgtgccaggacctgatgcagtactgtgcccaggacgcgtgggccacctatgaggttttccagcagcagcttccactcttcctggagaggtgagggagtgcccctctgggaacccctgggggtcagtgggttcccggtggtacctgggcccattgtagccaggtgctgctgggcctttctcaggctggggccctcagcctttctggcctgagagcacggagctgctctgtccaggggtggccacctgggccttgggctctcgggtgtctacagagtcctagaggagaggtcccaggctgtgcttatttcatggtctgctcagcgccctctctgaacccagatcctgagccacgggcttcacgtccatcttggttatgtgtcctagtgagtcagtctgatgatgcggtcagaattggaagcctcagccaaacccggttctgatcttaattgtccggtccagctcatgtgaccttgggcagggcagttggtttctctgagccctggtggtcttgtctgtgaagcacacacaggcatacttgactatccagttgtgaggctcttgtgtgacactttgtgtgtgtggagttgttaacgcagcgtctggctcctggtcattactcagcatgtggcagccacctccatttttgtgagctgtcattcccacattatccctgaagatggaatgatatccctattttatagatgaaggaacttgggctcagagagatgacatcacttatgcagggtctcatggctgggaagtaggagagagctggggtttaaacccctgtctctctgatgtgggtggttgggttgaggattgccaggccggctcagggcttgggccagagccttgcctcccgtggtcatttatggcagccctggtgtttgtcctgaaggtgtccccacccggtgactctggctggcatgttggagatgggtgtctcctacctgcccgtcaaccagaactgggagcgttacctggcggaggcccagggcacctacgaggagctccagcgggagatgaagaagtcgctgatggacctggccaacgacgcctgccagttgctctcgggagagaggtagccaggcccttgggtgggcagggtcctcctacaggggcccgggcagtgggaggcctggcctctggcgtggccttagccctgccctggtgaactggctgtgcaggtacaaagaggacccctggctctgggacctggagtgggacctgcaggagttcaagcagaagaagg

SEQ ID NO: 57539 - DNA, 1665 bp, Bovine  19866880410868
ggagcttgcttgcagctgtggtggccacacaggtggcctcgtcactcactttggtgctgagtggccttgaccctttggcgtgatccatggttcacaagaggctttttgctcagtggccgtttccctacacttatccttgtggatcttgagcaaactccggccttttcccgagtcagtgtcaggcccccaacagacagcactcaccccctgtccaccccaccccccagctctagcacgtacttctagaacatgtgcatacatctcctcctttctggcactttccctggtctgtcactgggggtggttgctcagaggcccagcaccttctccaaggtgcatgacttgctctttgtccttcggaatctttccagccgtcagatgattcatcctgtacctgtgtgcagcgtttgtctttttttgttttttttttttgccactttcaattaaaaaaaaattccactttgggtcctattataattgtctgtcccctttattagctctttgaacatgagctgtttcatgctcatagatgtgaggggttggtaacattcattaagacatctcagagccaagcacagacttggtgagccccagacctaacagacatcttgatggccaggctgcatgcccgtctgggacaccggggactgtggcgcatagctgccttcctctctgtggaggtggagaagtaaagaaggctttgtaactcctcctcactcccagcacggcccctgacagcaccccacccgacctccagctctgtgagggttaggagaccttgtccccagctgctaacgcaggacctgcatgtggtggaaggtgtgcagtggggcttgaggagcggggtgtgcacgtctctgggctgagcctgcctgcctctcacctcctcaggtattcctggtgcagccggcggctggtggaagagcgttactcttggaccagccagctgtcgccggctgacctcattcccctggaggtccctgccagtgccggcagccctgctcagcgagaccggcaggagcggttagtggtggggcacaatgtgtccttcgaccgagcccacatccgggagcagtacctgatccaggtagggatcctggggctgactgcaggtcctggctcggggtgggctcggagcccggcttccagtggctggggaaggactgcgtgtcctggctagtgcctccattgcctttgtagcagctccagggccccctgctgaccagccctgcccgtggtccttgtgcccagctcttgggtccccagcatccctggcacaggacctgagctgtcacagtactgatggcccttgtctgtatgcggcattttagagcttgacctgggctttggaggccgcgggccccacagcctgggcacgcgtcctgcctcagccactggtgagcagcatgtgcttcttgacacccctgagcctcagtttcctcttttgtaaaaagagggagatagcagaagttgcatcaaaggattgctgagagggtttgaacagtgcacatgtcagatacccagaaccatagtgtggcacttcctgagtttgtggaaagtgccccaggagaggtggggcaggtgggagcatccttggcctccagctgcagatgctgaggctcagacagccttgttaacttggccagggcctcatagctggtgagt

SEQ ID NO: 57540 - DNA, 1018 bp, Bovine  19866880487200
ttggagaaggggggcaggggctgaccgccagctgccaggcccaggaggaggcctccagaggcacccacaggtgggattccagccagaccagagctgcagagagagagaggactggaagttctctctcccaaaccaacccttgtaccctcccccaggcccccaggcaagcgtctttctcacttggctcccgctgcacacagggcccatcctgtccctggccagacttcttccagggctgggaccctgccccccaccccatccaggagcggcagctgattctcctcccccgtccctcccccctctctactttcggaggagaataacctgtgataatttttttcttcttctttctggcaactaatggactccttaaatagcaaaaattgcggcctgtaattaagatcttgctttttaaatgattaatcattgtaacccctttgagcagcatcctactttcctctcttctcacattgaaatgcagatcattggcggagggagggaggtgctcccaagccaccgaggagcaattaaaccttcccagctgtcactcgtcccgtctgcctcccggcctgtccagacgccgccacggagagagggcagggcattgctcagagcacccaagcccgccagtggcctgactggggcctcccggagagcgtgccttcaagcctgaccctggggtggcagcccagctgctggggtggctcttggaaatgcccaggaaggcagataatgcttgctgagcacttccaaatgtgcccagctctttagtaacgagatctaattcagtgttcgagctcgccacctgagagagaggggaaggtggcccatttctacaaagtgccaacatgtatcggcccaaaaagggttttccaagccttttgtctctttgacacccacatggactgaccacatgatttgaggagggtatatcattagagctaggaggagacttggaactctggtgtccatagctgtcaacttaaaaacaaacaaacaaacaaaaaaactggaaggg

SEQ ID NO: 57541 - DNA, 2645 bp, Bovine  19866880535261
ccgggagacctctgaaatattcggtgaaagacagagatggaggtagggtggcatgcttctgaagctgaatcccggctccagcaatttctagctgtgtgacttccagcaagttacctcccctctctgagttttgtccccagaggcatgtagttggagctcagctctgttgaatacatgtcaagaacctatcaaaacatggtcaggcagaaagcagaacaccatgcttgcaggggcagagatgctcctaccactggaggtgtgagcctagactctccaactctcttagaactcaagactccaaaccccaggctttgcccacaggtcccaccgttcccttggcccatctctcattcttcagacctaatctcattcctcaggctttttgcagaggtggggaggggaaagctgggaagtgacgggcagcacagtttgcctggctgcaagaaccctgggggggaagtcctgagactgcctgatccccctcggtcttcatgggatcttcctgaaggaggctaggatagcagagaccccagtcccaggtagaacaggtgagctttaggcttgcagactggctgcctcactgttgttcccactacctgagtgcctgtttcccgtgagagggtccggtgcacgcgagcgggtgatgtacgtgcaggctgagaagactagaggagccaggggtgagaagagacaaccctaaaccatcaggctggtctggaggctttcctgcacgggccacagtgcgcctgtacttcccgggaaactgccgccagagagcgttgttggacagcgcgccgagccgcgctccggagggcggcgaggtcagtacagtgaacaggaggacagcggacacacggaaagaacaggaggagggcttagggtgggaggccgggatatcctcataactcctgcgtcctgcaagagtcctggcattgcatagccaggtcttgggcgtgagcgggcttcagcctctccagcttcgggtcttgaaacctgtggcaaggaggatgaccaggtggcactgcgcgggctgcagcagagactccaggggcgcatagtctggcctctccgccatccatataggccgcagtcggttcctcgaagtctccccgtccctccggggtccccgcccgggggtccgagtcgcggggcttcctgggggagatcgtgcaaaagaggtcgcccacccgtcctccctccctccgcggcctgcgtagaccactatccagcgctcttcctctgcgctcccgggcccttctcccacgaagggtctggtcctcctatccccggcccgcctatgagctcatctaaccgctttccctccagttctgctcctgggaagggcgtgccaatcctcgaaatggacgaagcaggtcgagccagaggtttgagtgacctctggggccaggcgtctattcaccctgggctcagggactccatagtcctggagtagaagggtaggatgggggctgctggaaggctgggggctgctggaaggctaggggctggctggagggctggctgggagccaggaaaagaagtgctaacagtaatcgaccctttctttagtgggcactggttctggaatctcgatgttttttcccgtgggttcaagctgaactctcagtctctcctgggcttttaggggctcagagtgcaaacaccttcctgtaggaccgggagggacactcgctggagtgctcggtaggccctaggcatcggagtcggattcccaggctcgcaccaccgagctgagctctcagaggggttcctgggcactctctctcctcgggtcctgaggcaggagaggtgaggccactggggagcccgctctggcaccctgggagcctgaaagtcatgcctcagaccagagcatctctctctcatccttttcctagtgatctgagtgaagacctgtcatgctgaggagacgggccttcgaagggaacacggggcgccaggcgggcgcaggacagagctgatgtgcccttctgtgcttctcccctaacactgggctgcctttcttcacacccttaactcaggagaggcttgaactgactggaagctgggggtctgggctgggaggaaagagaggaagggaaattcgggttgcaggagagcaggggagggtggcgaagtcgcagtggtgtgtgctggctgtcccctcactgcccagtcctgaggccgagactgcggcctcctcaaaagctgccccgcggggcagacgacagggtctcagcaacccccagggtgagaacccgcaggctgggacagggtcagcaagaatcatactaggcctgcatccgcgcccattccctccggaaggggagaaacccatataaccttgggcggactccaccgaggcctccacaaagggcagctgggcgcgggagtggagaggaccagagtggggcaggagcccgggtttggcgggtgcctcaatgggcggcagggacccgagcagcggcctaatggattcaggcccgccggcaatagagcgcctgccccagctctcaatagcggacaatggagtcccggggtgacctgaacaaagaatttggaagtagttaaactgcagaacacgttctgggcctgggtgcctcctttcaaaaagagctcgggagaagaaaagaaagcactggggg

SEQ ID NO: 57542 - DNA, 777 bp, Bovine  19866880587815
tgagaactactaattttattaactctaaacacctaagcatgacttttttaatgtcatattttaatatcctatgtgatgaaatgaaaattatgcataaagcataaaaagcataactgatgtatgaaaatgcttacctagagaaaaagcatttgtacaactgagtgataaactaaactagccactttttgcagagaacataatttttatgtggaacaacaactgccaaactatagttattcaaacttgtgtatttgatagacattttcttaaagatgaacaaagcgagcctgtcatttcaagaaaaaccagtgtttgcagccaatgatgacattcaaacaaaaattcaaattttgtaaaacttgcgttgacgccatgactttggcagctttccaatacaaacttttctggtggtgacattaacaaatacgatttttgtttcttatgctgtataacaaaatgtgtcaacatttggaatatgtgcataccagtattttccaaacgatcacaaatgggtagacgatccacccaaagtaaaaggtacatcaatagattttctcacaagagggtatgaaaagttcattgacctcatttcagatatcaaattacagctaactttttcaaaactactttttgttgagttttggtgcagtatcaaagaaaaataattatatgaaaaagctattcaaatacttctttttttctttctttcttttctccccctgctttattgaggtatgactgacaaataaaagttgtatatatttaggttatacagca

SEQ ID NO: 57543 - DNA, 1007 bp, Bovine  19866880590123
ccaggtcaccacaagtagagaaaaccacaagtagagaaaaactgcaaccctgcagttgaagacccagtacagtaaaaaaataataaataaacaaactgttgccaaggttggcttgagacatgttgtgtttgaagggcctgtgaatgtccaagagataatgtctggcttggagctagatatgggtgtgagtcagcgagacagcctgggagtgaggaagggagaggggcttagattgtgcgagtccagagagacaaggcacaaaggagcaagcggtttttagcctggctgtacctagggagttttttaaaagtactcactcccagtttctttgacataatcggcctggagtgaagcccagcatcactgtcttttaatctccccaagtgattccagttgcaaccagacttgagaaccactgccctagatcactgttcttcaaattttcatgctgtgtatcccctcaaggaattttggaaaactacatattgtcatattttgaagttgacatctaaattttttatcataattttaacagcagcaaaaaatataatttcctgcatgttgtatatattttctcgagaacctcagagttgcagatttggtttatttaatttatgggaaatgtctgccatataagctaatcggcaaagccagaattcattgtcaaacagccagcccaattagacttactctctgtcaaaagaaaaatctggattcatttttcagttcagataaatgtattaatacatagcctcatgacaaccatctcactttcatattctaagctaaatagacaatgcacagagccttgtcacctagaatatgtcccttagatggaataagatgctgtcccttcaatatttatagctgatgctctctgtgctttgtggagggggtctctccttcagaagtgtgctctctctaattgctcctttgtttgggtctacagtgctttgcacttgtctagatgacaaaccatgttcccacgggaatgaggaaaggtaagc

SEQ ID NO: 57544 - DNA, 1508 bp, Bovine  19866880591640
ggaggagcttccgggtcccctaacctgagtgaaacccctccaccttccatgaagctgatctggagggaacctcaggcctgggagtgagtggcagcccctcagcctttccagaaggccccacggagggcttggccaccccggaagtgagtggagagtcaaccactgcctttgacgtgagcgtagaggcatcaggctcaccttctgccactcccctggcttctggagacaggactgacaccagcggagacctgtctggccacacctcggggctggatattgtcatcagcaccaccatcccagaatccgagtggactcagcagacccagcgccctgcagaggcgcgtctagaaatcgaatcctcaagccctgtgcactcaggagaagagagccaaacagccgacacagccacctccccgactgatgcttctatcccagcctccgcaggagggacagatgattcagaggcaaccacaacaggtacagctgggatcattttcctttaagtgggtcggagtgattcagactgtagcatggtaggaagcagtgtagactcaaggttctgagctgtgcaggcttaggcaggtatcttaacctctctgagcctcatctgtaaaacagcaatagtaccagaggagagtaaatgagatataaatatgtcgagaacaaggctatatcttttgcacacagtacacacttgtaggttcacaattgttacagtcacagtagagttccatcacacaaacatttatatgtgaactcaactatcttactcggcacgagaagtactgtttagatagtgctggaaattcttctcctgcccctggctcatggaatgagcatgagaagagagaatgaatctgctgatgacatttatgtgccaatacttactttgtgcagggttaaaacctgcacagttcaagttaatatgaagcatcactccagctgtgtcctgcctttggaccctggctcctcaccccgaccctgtgcaagtaaaccctcctctgtactgtagtgatggtcttgccttgacacaaacccagaagcttctggttttcctttattttctggggccccttgcatccccctgtgtactgagagtccaatcagagaattcagccccaccagaagcaggggctcaggagggagagagtccccagaaatcatgttgacccaaaaccagccttgtgggtttctgtggcctgaggccccaccctggaggtcttggaggctgcgctgtaccccaggcagcaacattcttgatgcccagcctctccctgcgggttgcagcctctaccagttcctgtgccgaaaagccctgtagcgctgggacctgccaggagacggagggacacgtcatatgcttgtgccccccggccacactggcaagcactgagacgtaggtaagaccctcggcggccatgggggtgcagacagaagggtcgggaggaggcgtccaaggtcacctgaggtgcaggcttcttgtcacactggcgtagaagagtacatag

SEQ ID NO: 57545 - DNA, 2581 bp, Bovine  19866880593077
tgatttacactttcacttttcactgcttaagaactcacctccaagtgccttagtgacctggaatgcacacagatttggcttaagaattgatgctttcgaactttggtgttggagaagactcttgagagtcccttgaacagcaagaaaatcaaacaagtcaatcttaaaggaaatcaaccccgaatattcattggaaggactgatgctgaagctgaaactccaacaccttggccacctgatgtggacagccgactcactggaaaagaaacctgatgctgggaaagattgaaggcagaaggagaagagggtgaccagaggatgaggtggctggatggcatcaccagttcaatggacatgaacttgggcaaactcagagagatggtgagggacaaggaagcctggtgtgctgcagtccatcgggttgcaaagagtgggacacgacttggctactgaacaacaacaagaactggaaaactggctaggacaaagacggccagtttaaaattgtaacgaagctgagagacatccctaaggctgcaggaccgtaagtacagaggcggaacttccctggcctttcttggaagcagaagccgtgaaatgcccaaagcacagtactggttggtgcagttcttttcccactcattcaccgctggccacgtgccttgatctctacctgttgaagagtccccacctctggtctttgggatgcaataaagagaagagaagagaagttcatccactcagtcttgtctgactctttgtaaccccatagactgcagcatgccaggcttccctgtccttcactatctcccggagtttgctcaaacttatgtccattgagtcggtgatgccatccaaccatctcgtcctctgttgtccccttctcctcctgtcttcaatctttcccagcatcagggtcttttccaatgagtcagttctttacatcaggtggccaacacattggagtttcagcttcagcatcagtgaagggaaggtgatgcaaatttgatatgtcctgctcctctgcgccctctagtggctaactgggcccactgctttctcgccccacacccccaaccatgccaggggagacttggattccagggactcttttgcaagtcagaacacttgcctgatggtatcacacgctcacatatccacccctacctcctcacatgcttatgacagcaaatgtgcttctcaaatgtttttgagaagttgcagttacataagtagattaagtatgttacttgtctgctaacagcatatttgcttgtgtacatgtgtgctgcgtatgcacccagcccccttgctataatttcaggagcctctcaggatggagccactaatcaaagccaggcctttctggtccttgagttaaaaacagattgtggctgtagccactgctgtccatatttaggctcttacttcccagggctctgttccagaagctgcctcctctttagccagggctgactgaaattccctggggagggggaggtcctgggaggagtcacgtggactctcagctttcaggcagaagggtctctcttgccgtgtgaccttgtcatctgtgtgacttgctgtgtgtcagtggtgccggaaggcacagtgagtttgagaacggctcagggcacgagattagtgggctcatctcctgatgcagttgtcaccaccatcacaatccccagtgttctgtgagttcttactgtgtgcaggggctcctcaggtggctcagtggtaaagaatccacctgccaatgcaggagacacaggagactagggtttgatccctgggttgagaagattcccctggagtagcatggcaatccactccagtattcttgcctggaaaattccatggacagaggagcctggtgggctacagtccatggggtcacaaagagtcggatacaactgagcaactgagcatgcacacacgagctatgtgcagagcacctttcagtaacttataaaaagtagaaaacagggacttccctggtggtccagtggttaagaatctgccttccaaagcaaagggttcgggctccatccttggttggggagctaagatcccacatgcttcatggccaaaaaaacaaaacaaaaaacagaagcaatattgtaacaaatttcaataaagatttaaaaaattatccacattaaaaaaaaaaaaaaacttagaagaaaaaagtagaaaacagtgtctccatcctccaaaagctatagttctatgggaaagggaggggatgacattaatccataggagaaaataactaaaaattctgtttaattccatcaaaaccagttgagtacttgtataaggagttgaagaaggcattttaaaggtgccttaaaacagcttagctagaatcttgtgaggaccacgtggataaggaatgggagatactaaaatgcaagggtcaatgatacaagatagggtaaggtcatgcctatactgactaggatccattctgatggaagtgtcagttatataaactcacgcaagccaaaaaaggaaaaagattattagtccatggaaaagaccctgatgcgggaaagactgaggccaagagcagaag

SEQ ID NO: 57546 - DNA, 1554 bp, Bovine  19866880645065
aaattcatctgtaattattcctcagttttggctgaacattggaattgcctgcggagttttaaaaaatgttggcacttgggtgacaccccccaagattccgatatgactagcccgcaatgtgaactgaactttggagattttttttattattattattatttttaattttattttatttttaaactttacataattgtattagttttgccaaaaggtcaccaagtggttctagtttgcccccaagactgagaatgggcgctaaagcgcaaatacctgaaggacccagcagagggcgctgcctccctgctcatccttggaaacgtgcgcgctcatcgggctgctagctacaaaaaacccgggtgatgcagttaagataagggaccccagatacctgatccttggattaagaaccattttgtgttctgagactcctagaaagttaccttgagaagtaataagctgtctgtttttctgagtaacttagaggtaagtcaaacaacccaagtcttggtttctgcatttttaaaacgggaaagtgggggaagggaaagggaggtgggaaacttggtctatagtcgttctttagatatatattgagcctcctgaagtgggcaaaatactgatctggggggaaggataaacatttaaatgggatccctgggttgggaagatcccctggagaaggaaatggcaacccactccagcattcttgcctgggaaatcccatggacagaggagcctggtgggttacagtccatggtgtcacaaagagtcagatgcgacttacactttcaacacatggtggatctcattcgttcctagttcaaggaaggggacctgtgggtaccctcagataccagaagagaaaaactatgaaacaagaggccaagagactactgttgagtatttacatgtgccattatatattatgacacctctcttgattaattatcataacctaacaaggtggacatgatcagttccattttataattaagacatctgaggctcagagatgttaagtcacacatctctttgatgcctcaaagtcacacagctactaagtgatgcatccaggattggaactgggggtgtgtctgaattggaagccaggcacccctacccaccccctaggaagtgcctctctccctctactttgcaccttgcccctagcaacagcagcactcctgtccatctctcaaatcaggaaagcacccacgacccaccctgccagatgtttgtttcacagaggcaggatctctctcccatctgtctccacagcaaccctggatactgaagactgcctgggagagatttgatccccctcctctcccggttatccacttctgtccccttctacccagtccagccccctttcctccggtgaagggcacgcacctgctgagtgacaacaatttgcagccttcccaagtgtgaatgagatttctaataggactggctgcccacctgcttcaggcaggattggaataaagagaatttaagaggcaggaaatgggcactaggagagccagttcaaaggagctagacagcgac

SEQ ID NO: 57547 - DNA, 2610 bp, Bovine  19866880712746
aaaaagaaattccagggaagtgagaggaaacatgtgtgaaaaatagacaccacactagatcagcgttcaatcaaaccaggacctgctgagaaacaagtgcagacctgctatgtctcgctgagtcctgttatctttactcggcaaattcaagcaagatttcatggttgaagaaagctacgatcctcaatgacaaagtgatccctttgctgtgtaggctgggggtgaggctgggagtttggggggaatggggtaggcctgatctgaacacgtgggcactggtaacaggctgattttagactctccatctccatctccttcaggggctcccatgaccgacttgagtataaaattctcaaaggccacaactcgtgaactccagtctggtttttgctcagtcccagctctatcaaacaggacaacgcgttgctgcctgtgtgccccgctgccttggcacttgataaccatggtaatggacactcgctcaggcactcaccacatgctaggtcctgagcttcccttatctcaatcctacaaggtaggaagtgttattaccttgacagatgagaaaacttacaccaggaatagttcctgactcacccaagatcacccagtaaatgggaatttgaacccagtccctagaaccaagggcttcccaggtggttctagtggtagagaacccgcctgctaatacaggagatgtgaaagacttggatttgatccctgagttgggaagatcccctggaggagggcatggcaacccactccagtattcttgcctggagaatcccatgggcagaagactgtgggctacagtccatggggttgcaaagagtagaacatgactgaagcgaaagcatgcacgtacgcacgcatgccccagaacctaaacacttgacaattatcgagatctttggaatcacagtgctacgtcctgtgtggtctctaggaaattgatgctatgaacattctggaagtttggggtgaagataccaaaagcaagagatgagaccaactgacctggatctcttgggagtccccagatggtctcctgttttagatcgttctctctttccccagctcacgttcatcgggtaccacaccttctccactagctgccctccaccccacccgctgacttgatggagcacaagttcctgggcaatgaccagcagcatcttcccttccccagcatgccagtctgcagagatggagccactgtcctgggggatggtgtgttgtgattgtcctgtctctttgaactcctcaccctggccagtcagggcttttgttacatgtaagataactgattgtcctgactccttgccatgcaggagggagacagtgaaagggagaggctggtgggtcaggtgaggtgctgtggccatagaaaggagcctcctaacttctgacagagtgtgtgtgcactcacttgccaagtcgtgtctgactctttgagaccctatgggttgtagcccgtcagtctcctctgtccatgagattgtcccggtaagagtacttgagtgggttgccatttcttcctccgggggatcttccgacccagagatcgaacctaagtctgtgtctcctgcactgcaggcagattgttttccgctgagccaccaggaagcccagcttctaatggagaacagcacccaaaccagaggaaaggatagaaatgttgcagtcttctatgctcttccaagtttccaggaagtcccccaaagtgccaaattgggagttcaagagagcagagtagattatgggctggtggaaggaaggtcatttgttacagggctccctaggctttgcccactgcccattaggcccaaaggtcaagtgaggcagttgagaaaaaaaaaaaaaaaattcctcactgtgaagtgtctgaggcccttttgagatgagagaatggccccctttcagcagccctgcttggagccaggacagtattcccagagggagcagactgctgaatgatcatctgtctgcccagatggaccaaagcctgacctgccagggaggagactcttgattctggttttctgttttcgaattcaggggctctggagtactgcaataaataaaaacctatttattgagctcctactgtgtgcacagcttcgtgaaggacacaaagaagcactgatttgaaaaaccacagatcagaatttattcatgcaaatgagcttgctccctgatactcacatacccagggaggccaccactatttgaggaactactcccagccccttctcccagtgatcttgaattttctcagggaagatggttggatgttttaaaattaaaaatagctaatggtcatttggcattcattcacccattgcttatgcattggagaaggaaatgggcaacccacttccagtgttcttgcctggaatcccaaggatggtggagcctggtgggctgccatctatggggtcgcacagagtcggacacgactgaagcgacttagcagcagcagcagcacccattgcttactatgagccagtcattgttcttgttgcttggggatgaagaagttcctgaaagtgttcatggcttgctaggggccatcagcaggttgaccagcctggtgaccaactggtcatc

SEQ ID NO: 57548 - DNA, 953 bp, Bovine  19866880760292
tggggtccatggagaggagccccgggacaagtcggtagaactcacctcccagtagactgcatcctcaaagcagttctcatcaggtgcttgtccccagaatggtaatctcagaatgacccctaaaggaagttggaggtcccagaggtcaagaatgacttcttctctgcctacccagactttcccctcaactggaaaaatcctcccggtctcagagccatcagtgcagagacaaagggttcctgggggctccaggtgacctctggcacacactcttgggtcccccaaccacagggccccagcttctctggcatggtcacccccactcacctacgatgacgccgcccgccagggccatggccagtgacacaaagagcccggcagcctggaacctgccctgcgtgtttgggctccagtttaatttggatctttcaatgccaaaggcataggcaagcctggggtagagacaggaagcaggtcaggatcccctggagaggccaagtgactacccgctgtcaccccacacgcatgagtggacacaaaggctcaataacctctgggcctcagcctttccatctgcagaatgggggcactagaaagatcagatggtctctaagattcttatggaaggacagaggttgaggagagaggcccatgaaatagtggtccggggtgggtgagaaaggggacagagttagtcttggaccctagagaaacagtaggaaggaggaatggagaaggaaggagggaccgcctccattcttacccttcctccccatacagatcaatgttggcgatgcttgccgtcactgcgcccgcaataccgcctatgatgccaggaatgccatgcaggttgtgaacaccacacgtgtcctggatgtgcaaccgggactccaggaatggctggaaacagggcgatgagtgttgctcaggcagggggctgtggcaggctgtgg

SEQ ID NO: 57549 - DNA, 1642 bp, Bovine  19866880770842
tcctccagcccgccctctacgtgttcctgtgcggacagccgggctgcaggctcctgagcagggcctcagcccttcccactccaaccccacgctctcaactcaacagggctcggaggcctggacagaaagactgccatcaaaaaagaactagaagccagacactccaactcaggctcctcaccctagcccgagctgggcttggcctctccaacaaggggaagggtcccgagatgccagccccttcctccccgagccagagccttacgtgtgggggcaggccgccccagccgacgtgggagtactgccggccgacacctgagccaggttgtcccgccgcccgggcaccaggtagccccagccatgctgctccgagtagtgcagagggaagccgtcccaggtcagcgccatgagcttaggtgtgacccgcatctggaggctgaggagactggggccaggggtccactcagggtcatcgagccggggacacagcttccgataccacctacaccgccagcagagagtgcgtcacagcagtcaggggaggacagcatgtaacgaggaaggctctctccacccgtgacaatgcccacccatcccaaggcctgctggtgacctcagcctgacattaccaccccctcccactgggactcagccaggacccccatggaggcccctagaataattcaaatattccccaaggacagatcctgtgtcagctccctattccaggacccatacacactgccaagggcaagactcctcgccaagctccacttcaccaggggaactgcccagagcagcgcacaggtctacccgacctctgctgctccagaagcacaccagggcccccagtgctccatccctcacgggctgttcaccaaagccaatgccagagctaggcaagtgaggcactcagggcacagatttaagggggcctcctctcagggaaacacaaaattggccccttgctgttcagtctggatgcccctattttcccatctctgccactttgtggggtgagaatgaaggtcacctcctcaaggaagccttccttgatttcaccaggcagagttttaggttctgcctcgacactgatgactctcctgtctcatgatggatatcaactccagcgcaggctggctcctcccagggagaagctactagaaaggagttatgcttctctttgcccctcagaggctgcagtaaggcccagaacacagcaggtgcttagtgcacttgtagtgaacaagcccagggacccaggggtgacagcaggacaggaagatggcaggaacagatggcagcgtgttagcaggggcgcatacgcatactaccctctgtgctggggcccagaatacgggtgtctcgaggtggagggagggatagggtggcttctggacatgtgaggggaagggctcaccctgggtgtccaggaaggtgctggggccgcttgggcaggagctctgtggtccccctcagctgctccaagcaggtgcgggctgtggcatctcgctggaactcctcctcctcactgggggggccggggtctgcacagggtggggaggacaatcaggaccagggaagggtatctcagaaagaccctcccaggacctgcccagcggtccagtccagggttcgaatt

SEQ ID NO: 57550 - DNA, 1033 bp, Bovine  19866880796808
aagctggggttgcaatgagcctgtactaagatctgagtctggcgggactcaagtccaaatctggcatcacagcccctccatttgttgggcagataagttctgggcaccagctcctggccaggcatgcgtggcacaacttttgtggagtctgcatggggctgagtgtgagccaggcatggggcaggggatctttacctggaactagcagagctggctgcattccctaaaaccatgcctttgggaagggccaccacatctcagtctagtcaggccccggggtgagcaagaggagtctcaccgggtacctacgtggggtatgacctcccctcttcccacagcctgaccgcgtaggcagtgagttgaaggccatggtccaggccccgcctggctacgtcctcgtgggtgccgacgtggactcccaggagctgtggatcgcagctgtgctgggagatgcccactttgccggcatgcatggtgagcgggagccagggctggagcagagtggaggcggcctgatgcctggccggcggagccgcctctctcactgtcgccctgccccccaggctgcacagccttcggctggatgaccctgcagggcaggaagagcaggggcactgatctgcacagcaagacagcagccaccgtgggcatcagccgtgagcatgccaagatcatcaactacggccgcatctatggggccgggcagcccttcgccgagcgcctgctcatgcagttcaaccaccgactcacgcggcaggaggcagctgagaaggcccagcagatgtatgcggtcaccaagggcctccgccggtgagtgtccccccttccctacccctgggcctcaggcttgctttattgtctttgctgcgcctgtctttttgaccttcccgttgcctgagccctcatacggcctctgacctagctctaggtgggttgtccttcggttgtgatgtttgctcgcttcacagtccgttttcctcatagccgtgagttatcactgagtggttgcagggtgcgtgctctgctcctgcag

SEQ ID NO: 57551 - DNA, 1284 bp, Bovine  19866880826550
atatggtgaattgcattgattttttttcctgatgctgagccattcttgctttccttagataaactctacttgattatggtgccttattaaaaaaaaatacatatttagattagttcagctgatatcttacttaggattttcacagttatgtttataaattaaacatgcttgtcattttcttttcttaagatgtcttccatcagttttgaaatcaaggttatgctaacctcgggaaatcattttattaatgtcattcctgttttctggaaaacttgtacaagatggagattattgtcccttaaaaggcccatataattatctagtcctagggctttttgatataggaaagtcttgggttactattccaatttttttaaatctttattggtctatgcaagttttctattgtttcctgtgacagtttggtcctgctgacttccacttacatctcaagggatagaactgtgtcccaaggtcacttcacttggaatggagactaagagagtaacagtttaatgtttcaacctctacagagaaaagcaataaggaaaaggggaataatactttatctgccaccgtttctggaagacaatatattgcttagtcatttttttttttattttattatccagtcagatcactgagtttaattcacttccatttattttaattgctggaatattaggacttatttcagccatttcactttgtgcttactgcatttaccatcttattttgtatttattctgttttctctctcctattttccactgcaggaatcagatttttttaggctagattgaaagttgtatattctattttcgttcttctagctgttccccctatttaaatatgatacttctgtttgtttttcactaccaatttcttttcccttggccctcacacacctctttccagtctctacatctcctcaccatcatccccaccctgccatggtgatatcacccagaattggttcttgatcgttatagacaattttcctattttgacttaaaattttatttttagagaatgacaaatcttagtaagttatttacaagccctcatttcccatgtgtcattccttcctcgtgagaaatctaatgtcaatacgattcttatatttgtgcatgatctgttgtttcttttgttttttctgaaagtaaactctcaaaattttctcctgtgttcggtgttctaagacttctctgtgatgcccttaacttgactatttgtttgtcttgagtcaatctgcccccatttaatactctgtgaacttttaaa

SEQ ID NO: 57552 - DNA, 1070 bp, Bovine  19866880846427
ttctggagccttggaccttggcagaataccttctgtaactctaggaagtgggcaagctccagaagcaagtggtcttccttctggatttagtggtgagtattctggggtggaccttgaaagtggcccatcctctggccttcctgatttcagtggacttccatctgggttcccaactgtctccctagtggatactacattggtggaagtcgtcacagccaccacagcaggtgaactagaaggaaggggaaccattgacatcagcggtgctggagaaacatctgggctgcccttcagtgagttggacattagtggaggagcaagcggactctcttcaggagctgaactcagtggccaagcatctgggtctcctgacatcagtggggaaacctctggactctttggtgtcagtggacagccctcagggtttcctgacattagtggggaaacttccgggcttcttgaggtcagtgggcagccatcagggttttatggagaaatatctggcgtgactgagcttagcggactggcctctggacaaccagaaatcagtggagaagcttctggaattctttctggccttggtccaccattcggcataaccgacctgagcggagaagcacccgggatccctgatctcagtgggcaaccatcgggcttgccagagttcagtgggacaacatccgggatccctgacctggtttccagtgctgtgagtggcagtggtgaatcttctggcattacgttcgtggacaccagtttggttgaagtgaccccaacgacatttaaagaagaagaaggcttaggatctgtggaactcagtggcctcccttcaggagaggtgggtgtctcaggcacatctgggctagcggatgtcagtggactgtcttctggagcaattgactccagtgggtttacgtcccagcctccagaattcagtggcctgccaagcggagtaactgaggtcagtggagaagcctccggagctgaaagtgggagcagcctgccctccggagcatatgacagcagtggacttccgtctggtttccccactgtctcttttgtagacagga

SEQ ID NO: 57553 - DNA, 1599 bp, Bovine  19866880931663
ttcatttcctttttccttttcttcttggctggttctttgttctgcccctcatgctctgatgcagtgccctagaaggggagagaagtaacgctgtaacgtgagaagcctgttcagaggcagtggaaataaaaacagaaatcctttatcttctcatcaaagcctgtgttggtcatgctttctcccccgtcccactcacgggaggtaactgttggagatgggggcaagctctgcagtagagcaaggtggtgctgactccttccctttggacttctgtaatgacgcagggaacacggtgacagagaaggggcatcaagatgctgcagaactcccctgaactcaaatgccagggaggcagaggcagtggacagggccaggtgtattatggcttagagtgtggtaaatggaagaatgtagattcaggattttttgagaagctagaaatccagggtggttgatgtcaacttccagtttatcttggatatatgtaaggtgatagaaattctgggcaccagaggtaaggaaacactgggttctgcttcagagatgctgtagggctcatagtgtgctgttcctctccctttagtctcagcagaggggaaaggaggctaagaaatgtgctgaccctcattcagagtagtggccctactttgaatgacagcatggtagaagagggaaaaactggtttctgagccagagtgcttaggctcataattttccaatggtttaaaaggttatggggagaagacccacagtaagaccttgttttcaacattccctttctggaaatgtccaccctaaaggtatacaagcctgggaaacttcggggatggttcaccgtttacaacctttctcttgagaatgcttagtttcgtctttgaccaccttttggctctttctctgtggctgctccctgacaggctactgacagccagccaggagggcagctgaagcctcctgcactctagtctgagcaggcactgacctcttcattttcatcctcctcctgccgaagaaccacgtccaggatgtttcccttgatcttgaagtctcgtgaggtgctgagctttatatgcttcatcaggttcacctgggacaggattgtaaacacaggcacagtttgccaccaataaaacctgcccaggactgcctaagccatcccggataaacccttcagttcctagagaagcaagtacacacccactagacttcacatcaggtcccctgtgtcaatgtttggcttcaggccatcagatcagaaatagcaaagaaacaaaagaaacgcagtcgcctccccccagtgcagttgtgttgcttcagtttgccaggtcccctcacaggctaagtggaaatcagtagaaaaattacagaatatgcttacctttgacctcttagaaaggtggatgagaaatttttcatactgttcaatggcaaagatgagattaggaattggcttggtttcccgaagagctctggcctacagggcaaagaagagaagacctaaatttggggttcaggggtggtaaagtgctctgaaactgcctatagcagaactgcttgggctttgagggaaagagagtctaacttccaataaatgcagtt

SEQ ID NO: 57554 - DNA, 1268 bp, Bovine  19866880941921
atacacaagtatatacttcatgaattgtttgagcaatgacattatatatcattatatatcatggagcctctggaaaactctactatatacttgggagagaattaacatgaacaaaacatatgaagtcatatattattaggaaaacagttttcaccttactgacccacttaaaggggtccctggatcacgtttgaagaacctctggcctagtggctcagctggtaaagaatctacttgcaccacaggatatggtctgcaatgcaggagactgggattcaatccctaggtcaggaagatcccctgcagaaggaaatggcaacccactctagtattcttgcctgggaagccccatggacagaagagcctggtgggctacagtccaggggattgcaaagagtcagtcacgactgagtaactaaaccatcaccaactggtctaaagtagtgttaaccttcttgccagtgattggcttaggcatagttatgtgacacaagtgaaacatgaagagaattctgctgcgtagtttctgggaaggtttcctagtccttaagagagaaatgcaagagataacctcttcttccactggtcattgttgggattgaatgtaatgcctgaaactattgcagacatttcatgcctttgaatttgctgattcatgtctaactttcatactccatgtctaatatgtcagaaaataccattagctctactgttaaaatacatccagcatctgaccttcttctaccacctccacgctcccctctcaagtccaagccatcatcatttctcacttggattattatcagtttcctaattttcctgttctcattgttccccagggcaaccaggtaagtcttttttatttttccttcagggtaaatcttttaaaaagaaatccaggtcatgtcactcttctgttcaaaactttttggtagctgtccttctcttaggataaaagcctagtccttactatgaccacaggatgttcctgatctggctcccagatacatcttctgatgcttgtccctcccttactcattccatcttccctacttgccttctgcccatcaaacaagccaagcatgctcttgtcttaaaacctttgcctaatgctcttctagatatctgcatggcttagttctaactaattctcccttgattattctaggcatttgctcagagatgcattccaattaccctcagtcccacctgggaacccttacccctttattcctgctttatttattttttttccatagcattaccat

SEQ ID NO: 57555 - DNA, 1635 bp, Bovine  19866880948756
tgggccagctgtttgctgcctggaagttccgtggcctggacccgctgcgatgctggctggctggcagacggcagtgcccgctaccctgtggctcacccacgttccaactgtggggccctggagcctggggtccgaagctttggcttccccgacccacacagccgccagtacgggcgtctactgctaccggccgcgctagctccaggtcgctctataccctgccccctcccctcacgggcggtattaattattgagtagttcgttgtccctcgcaggttggggcaattttcatcttgtttttatactttccaacttaaaattatttttaaatattattttttgggtaaatcccacagatcccaaatcgtccctttactcgggtccctttgccaaggctctcaccctccctgaatcctcctgcctctctcctctgggacgtttgaagtccttgggctcatgagcgctctctgccatcgcggagtccatcccctctcccagccctggggaggttgttcccagagccggtagtggcagtggcacgaggagccagggctgcgacccgtcctccgcctccgcctggggacgagggggcagccaggtggctctggagctggggttcgggcctggtggtctcctgccccttgtacttctttggggagcagctggcccgtgtcagcatggcggaggagcctgggcaggaggtgggtccctgggcttccacgtgatgtcccagggtagggagagagatcccgccccatgttttccttctctcttggctccaaagagtctgtgttttgttctcatttttctctgtttggcgagtggccctcaggtctgtgtactattttggacaataaatggtgctgtgacccctccctccatcctgagccctcctctgtgtcacacttttttttttaacatttgcttctttacttatctggctgcaccaggtcttagttgtttcatgcgggattttcgatctgcattgcaacaggcaaacctttagttgggcatgtgggatctagttccttgaccagggatcaaacccaggctccctgtaatgggagtgtggagtcttagccactgaaccaccagggaagtctctgtgtctcagtctttatctcattcagtcttagggtccagctctctgcatgggggacggttctgtcctagactgaagaggtcgcctgggtctgtccactggcgtgggcagggaacgccatgggctgcaccttcaggctgccttggtcttgcctggcctgcctgtgtatatcctgcctcagggactgagctagtggctggaggccctggcgtgttctcccatcatcccactccgggctgtgtgtctgtgtggatccagcataagagtgggaggctggaggaggctattcctcaccctggtccccacccccatgtcagcctcaagatctcctgcttctgcacaggcatacctctgccacccacagttgatcctttagcaaggtgcttctccaagtgtggccggcaccaccagcttcacctgggaatgtgtttgagatgcaactttctgcacccgacccccagacccgctgagtcgaaaaccctggagtggggtctctcacaagtcctcctgatgcagactcaaggttaaaacca

SEQ ID NO: 57556 - DNA, 669 bp, Bovine  19866881003976
ccaagcatttaaagtacaaacacaggaaaagaagttcccttctgtctgcaaagaatcaaggtctgtaagaaatgagatggctagattcatagagacccagtggaaagaaactggaggttttggcctagggaattttggactgcgagggtcccagactcaccctttcaatcactgggaagctgtgaagagagaacaggaccagtggggctgggtgggggaaaagcaagaaaagggtctggagcagctcccctggatcctaagactcctgcacctggacaagaggggccatgctccaggtccccactccctgaccttccagcatttctgtgcggggctgtgcagacctggaaactctgacccataaagtcatctggaggtccagcccagcaggcgtccagcccctcatcctccatgccagggcctgcagggggcgaccaggacacacccagggcctcggccagcagctgctctcactccagtttctcctttgctgccactgccaggctcccctctgccagccgggtcctgcttgccaccactgcagggcaggggcagcagaggagagcctgggggcctgggggcaggggtgggttctgtgaggacctgagcagagaggctctacctgctccgagagcagaggcccacactccagtgtccgcagggggtaaa

SEQ ID NO: 57557 - DNA, 1785 bp, Bovine  19866881072922
atctcccagagtttgctcaaactcacatccattgagttggtgatgccatccaaccatctcatcctctgtcatccccttctcctgcctccaatctttcccagcatcagggtttttttccaatgagtcggctctttccatcagatgaccaaagtattggagtttccactgcagcatcagtccttccaatgaatattcagggctgatttcctttaggaaattggtttgatctccttgctgtccaagggactctcaagagtcttctccaacaccacaatgaatacctaatttacaataacccaacattctttgtaattttcattttagctctgggaatccccagaccaccttggctactggacagtatgtgaactgctctaccatgtgggaggcaccgtcttgccatttgaaagtttcagccaggattttaccaaagctggggaaacactgctcagtggtgaaagaaagctgtcaagtaaacctcacctctcttcatggatttcaactctgccaactgattctactttaaactgtttgctctataattctcctgagtatgaagcctcatttccacggatagaaggaacattatttttccctgtcgaaggtaagcaaatactgtttggggcaggggtagtgtggggatggagtggttggtctggtgtcattcatttcttcaaggcaggccgatgaattctttagaatttagaatttctagcagcctaggccctccgttaatgcttgtaattaaaagatgtctaagccaaatcagagataccacaggaaaggactgaagtctggtacactgtaagcccatgcagaaaggacaactgagtgatttaaaagggttttccaactttttgcagagttgtcaggtgccgaagcgaatgagtggtaaggtttcactgtcctatagatgagattgatacattgaagaccctagaaaatcagtgattgactaagaagacataacaaattagtcagttgaagtagaaaatggtgtttattaccataaagagccagcatacaggaatcttcataaatttgctttatcatatgatttgccatatagtgaatcataatttctgaatcattgtatattcaagcaatattatatagagatataaataaactgtattttacatgatgggcaatttaaggaaatttcaagagtattatttaagcaggtttgtcttacatggtctttagaatttaaccacataagataggatgtgctgtattttatggatttaaaaagcagcagatttcctgtgtgtgtattgcttgaatacttatttctaagtcataattattgagttctgacatcaattacacccttataattcctgtcacatacagcttttccttatagaatttactatgatagcctgttgatgatagagtgggggttgaagtgtaaactaagtgataatactggtacctcagctggcagtgtaatttttttcttcttaaccttgcatctctttttaggagctacttcttttattagaatttcaatatcctatattcctcacaggtaaagagcttcaggaaacatggacagtcacgctagagcccttggccatgcatcagagacattttcagaaaccagtcagaatttttctaaaaggcacagtgacccagtggtccctcccaacaagtggaactttgggcaccgatagctggatgctgcaaagtccagatggagacagatcaactcagaggatgttatttcagcacctggtaaacaggctgactgcgaagagttacatcggtaggtatcttcca

SEQ ID NO: 57558 - DNA, 1134 bp, Bovine  19866881128962
ttcttatttatctatttttggttgtccgcgtcttcgttgctgtgcttgggcttttctctatgctcgggtttttctctagttgccaggagcgggggctactcgtcagctgtggtgcacaggcctcactgcgggtggcttctcttgttgccaagcacgggctctagagcacaggctcaagagttgtggcgccagagcttagttgttgcgtggcatatgggatcttcccagatcagtgactgaacctgtgtctcctgcagtggcagatggattctttaccactgagccaccagggaagccgcgtgctgggtccttgttgcagtgcgcatgcgtctctagttatggtgcttgggcttagctgacccacagcacgtgggatcttagttcccgcaccagggatcaaacctgcatctcctgcaatggaaagcagagtcctaaccactagtccaccaaggaagtcccagatcatgtttcttaaagggtttatagagagtgcaagactctcagagaagggggacacggagtggtagaggagctgagactaggaggtccataagcagaagccatggaaggaacagaagcagatccttcaagcacagaggagcatggagccaggcattggaagcagcaacagaggctgagactccagggcaaggcagaagccagggcaaaatgcctggaccaagatgcacttgagggcatcccttggagcgaggccagcacctccactagccttgaaggctgagcagaagcttaccccacttctcccacggagccgccagagccaccaccatcctgaataatctaccagcctcctagacacctggcatcctcacctttctggtgaaaccttaaaataacctcacctttgccaggtcagacacctgagctggtctcttctctgcctccctgcaacctgagggagcctaacacattactacacattttcttggggaaattttagaaactatagacaaggcaagataagaaaataaagatcgcttctgaccccaccactcagaaatgaccactgataatatttcagtattctttctcaaagtcttttattctacgcacatatttttacaaaatagggtaacacaacataacatgactttctctaaatagcttcaagca

SEQ ID NO: 57559 - DNA, 2139 bp, Bovine  19866881198685
actgtaggttcggcccctcactatcgttttatggctgtaaaatgcaaaattcttgagccgtccttccctcagtctacagagactctgagagcaggcctgacaatctccaggtgatcctgatgcatgcccaagtttgagacctactgtctaacgtgtttaactattcccctgtggttggacattcaaggttttccagtttcttattattaaaacttgtgttacaacacatccctttacatgtgtttttgtgtcctatgagaacatttcttctctctcacaattttcttggttaatttttcacatttgcttttccagatgaattttttaaatatttatttttacttatttattcgactgctctgggtgttagtcgtagcatgcagactcttagttgtggcatataggatccagttgcccgaccagggatccaactcagggccccctgcattgggagtgtggagtcttagccactggaccgtcaagaagtcccccagatgaactttagaatctgtttctaaattccactctcaatggtattgcattgtatatacactttaacttaggaaggatcgacatcttggcagtattgagttttcccgtcaactattgaaattctataggattttaagtgtaattcacatacttatatgtaatttaggcatgctttgttatgatcccaaatataacaactgcaggaaatattactataatggtcttctttccctaaattttatgaaactaagaatataatcataaaggatcaagcgtatgatcatcctattcttgttgggatagtctcatttcttatgttggcctctccatttctttcattgggtccgtgtgtgtgtggctgtgctgggtcttcactgttgtgtgtgggctttctctagttgcagcgagtggggtctcctttctagttgagaaagtagacagatttctatgggcaggtttctcacagcagtgacttctcttagtggtgggtctagctgctctgtggcacatgggatcttcccagaccagggatcgagcccgtgtcccgtgcattggcaggcagattcttaaccactggaccactggggaagtctcagcctctcaattgtgattcagtcaagcccatgtcttttgggggagcaaaggaaacttttttagaaatatcccctgtggacttcgccagtggtccagtggttaagactctgagcttccacttcctgggggagaaccgtgcggcacagccgaaaaaaaaaaagagaaatccttctcaatagacttctccccatttaaagcatgctccccaaccctagttcttccagactcttctcatcaaaaagtgcagtcagcacgctccccttgaatttgaccttggtgactgcttgaccaatttttggttgttgttcagtcgccaagttgtgtccgactctttgccacactatggactgcagcatggcaggcttccctgtccctcactgtctcctggagtttgcccaagttcatgtccattgaatcagtgatgccatccaaccagctcatcctttgtcaccctaaataccttagcatatgctaaataacaccgacagacaacatgacagttccaagaccagccatcaatggcaaaaatgtgagtggttgtttcagttcaaggaatccccacctctcctcccagatagttagaacattcctcccactcattaccctataaaattgcacagcctgtaactaccaccccattttaggcctctcttgccttctgagtttggcccacattctggactgtgcatctctctaaataaacttgttttcactttattatagtttgctcttgaattttttgttgcatgaagccaccttggcaacatgtccaagatactcactagagacctgagatagaccatcctcttgtgccccattttttccacaacagggggaaggttctgagaagagttttgcaggtaagatggggccaaagcatgttttgctggaagggaaggaaggctcactttatccattatcttcattcttactgatgttttcaatttctgcctttctcctgacatttcattttactctgtaattatgttattatctttcactcccattaatacattaagtttcttgattctgccaccgtttcaaactactagt

SEQ ID NO: 57560 - DNA, 814 bp, Bovine  19866881239892
cattgcaggtggattctttaccagttgagccactagggaagcccaagaatgctggagtgggtagcctatcccttctccagtggatctttcccggcccagaaatcaaactggggtcttctgcattgcaggtggattctttaccagctgagctaccaaggaatccctaggcagtgaggggatgagctaagtggggaaggatccagaaggcagctatttttacccacaatagccttgttgtcttgcctgaaggcagcattaggagacctgcttcaggtcaagagcaacctcagtttttccaggggagtgggtgtccaagaagtgcccacagagttgcctccaggaaaatgagtcatttattgggaaactagcaaagaaaagaacttacttgccaagactatagagacattttacccaggaaccggaagtatatctttttctgttgctgccctgatgttgtcactggcaaggcaactcagctgcagaagccaaaaataggattcctgacccttaaaaagccttttgggcaacagactatggcccagaatggtcaacagataaaccaggatagttaacacaccaagggtattcctctgtgttttgaaaggtcaaagaaaactttctcccttttaaaatcctcaatcccacaccccttctaagtcagcagaacccattgcctacttcctgaatgagcagctacagagcctctgctgggtcaagaagcatctattaagtgctctgcatataatagacaaagtaattaaacatataagcatttgtacagtaaaggaaagcataaacaaaacaaaaaagacag

SEQ ID NO: 57561 - DNA, 1152 bp, Bovine  19866881267677
caggtggtcaggactgtgccagcttgctctagcaatagtacacattttactgaggctggtggtggatgcccggtctgggtacagagcagtattcctcttcctgaatgccctggcacatgggcattgccggtgctggcctggagtctcaaatgagactgcggaggtgtgggtggctacaggggcgaaaggagccccgctgaacacggaaggggagcctgagggaggtgctggagaggaaagaaaatttccatttggcttttccagcttcttgccacgtccctagagccccccaacttggcggctctcctagtgcctgatccctagtcttccttcatgaatttttcatttcaggcaaagagcccttatctctcaccggggctgctatgggagcctgctttcccagcatctggagacagagcagatgaagaattgcattaaggcagaattatctgtctctggagagaggaagggcactctgtgctcctggagggacagctcctatcccgtattactgtaggtttccatccttcagaagaaggctgggctactgttttttttttgggggggggaggctactgttttattgagatactatcgagggcacagagaagcccaccaggctcctctgtccatgggattttcccaggcaaggatactggagtggattgccatttccttttccaggggatattcttgacccagggatcaaactcccatctcctgcactgcatgtggattctctgccactgagccgccagcgaagccctccttgcacgctttgtacggtaacacatttgttgctgtctctgggtttccctcctcctggaattccctcctctcatctcctcatactatactctatctgtcctttaaggcccatctcaaatgccagtcctctttgatgctttccctgacttcccaggccaagagtgtggcttctttccctgaatttatcagatttgccctcttcacccctgctttatcagccatccctcctgcccaagctagttgcttcacaaatcatgattagaatgatggtggaatccagttttatgtgataggaaagtggctccgtgatcaacttcaggagagattattctatcatcagctaatttgtgtacctttttccccggagatttaataaactcaatt

SEQ ID NO: 57562 - DNA, 719 bp, Bovine  19866881387020
tgccttactttcttacctgaaaacatgaaaaggtaaccgtaatcgcctcctgggcttgttgtggagatgaaacatagtccttgcaagccagcaccgtggtccatggcacaggtaagtcctcagagagtcagccggtgcgcctgtaggctcgcagattctgccgccagcacacatgtgtacagaggccatcagacacacgaacctgggcacacctttgtgtctgggcgcccaaatccaaagaggacatgcaggtgggctgaaggaacccatggacacaagcacatgtgcacatagaaaatgccccgagtgctggtgagagtggcaggtatacagacagcacaggggtggctgtcccaagcccgggctcaggctggagtcctctgtagtctcctggctggctgagatgcatgggagccatctctggctcccaggcggcccaccacgcacagatcaacttgggccctaggtcagctcctccaggacgctactctgggagaggactgagttcctgcctgctctgcctgccctgcccaggtgcacatccagaatgcgacgctcgccggaggagtgggcctgggcaccgttgccgagctgatggttcttcctttcggctccctcatcatcggcttcgtctgcggcatcgtctccaccctgggttttgtgtacctgacggtgagagctccagggccagggactgggggggcggggtggtttctagg

SEQ ID NO: 57563 - DNA, 1074 bp, Bovine  19866881400661
tcctggtagctgcttgtgtccctggagcttggtttaggactggggaagcggctgaagacaatcagggcaaagggagtgggggcaagagagacccggccggtgcttctcagcaccatggccagggcccagctgcaccactgccgcctgcatctccctgcccagcactcaagtcagccccagtgtgtgcttccccataaggcctgtgctggggccctggcgccaaggcttggcgtgggacaaagtatgtagatgctagacccagtccactgtgcagagaagagagtgatccgggccagggcagatggggttctccccagtcgggcttggaatcggcctgctcaacagcctgccacctcagttgtccgtgtcaggcccacacaatgcacctccaccggaagggctccaacctggaccatttcctgggccccagtgtaagctgtgcgtggaggccggccacgagcctgaggagaacacggtcagccctgaccccgcagagtggtctccttcccaatgcctgtgccctcaaggtcggatttttctgtagtctccttcctaggagcagagctcaaagggccagctgcaagtgaagtgtaggggtcgctcattctgggagcatcccgctcaggcagggcctgggacctttgctggctggtttcatctgctccccgccaagggactcagtttctcagaaagggagtggatacgtggccctgaagacagtggcctctcacatctgaactcagcctaaatcaggcttttaattcttcctcccagagcccctactcgccctcagcaggccagtcgggcctccggcaccgccgctgtgttaccgtgagcctcgctgaggagccattttgtgcagcatcctggttaaatcacactccgaggggctcctttctcgctctcttcccccacgctccctctctctccttcctctcccgcaggtgagcagtgcttctccaccccttcctgccttctgcagccccacccttccaccctggggggtggcccagaggactagggctctggaggccacccacacacacacaccaagaaggggagatggtgcgggtt

SEQ ID NO: 57564 - DNA, 725 bp, Bovine  19866881410569
tctcttcaaaaggaaggagtagaaccagatgaaaacaaaattcctatttgtgtagctctacagttaatcaaatgcttgtgagctaaatattaatacattacattggttaatcctcaaacaagtcacaaagtgcaccggtgttgacagtagagacctatatggaatttattgtttacagagtgcgtcctcagacattacctcactcggtactcatgacagttctgtgagttattactaatgccagggaggaggaggctgaggcctggagaccccccctgggccaggcctgggaagggctctaggaatacagagaaacaagccacctgtctgtcttagagagctttcacagagctggatggatcctgatccctttggctccactgacagcagctctgcacatcctctcccatcaaagaggggcttccggaaatatgcattcccctcacaggctctttggtggcaaagtcaagatttctctcgcaattttagggtaacatccagctatgtagaggcaataaatagagtgatgggtgacattaatgacagaccaagtgaaagggactgagttttctaaattgggaaaaaagtatgcttgactatcatctccttggcactttccatcatcttactatttagaagggcacattttttaatgtcattgacaagagtgagcgagcactttatttacatgatcagaatagaaacgggaattgcagcttggggta

SEQ ID NO: 57565 - DNA, 1346 bp, Bovine  19866881424069
tagtacattaagcaataaccattttatcatatctcataattttttgagttaggaaatccagcagctgaacgtaggctggacgatttatctactctacatagtgtcaattgaagtggcaggtgggctgttctggagggtcccaggaactcacacacttcttgccctttctgtcaagtctggtgccttggcagaaagggctagaaggctgagctcagttggaaccatggacgggagtacttaacacatgcctctccaccacagctgtctcagggtagttaaattgcttatatgaagttcaagactcccagaaaaattgttccaagagacagaaagtgaagggcctgaagcctggcccctgaagctgctacagcatctcccatgtggtaggatagccacagagcatgcccaagttcaaggggaggggacctagacctcaccaagtgccagaggagaatcaaatcattgttaccgttttcacactgtgcttagtcactcagttgtgtccaactctttgtgacccccatggacttaccccaccagggctcctctgtccatggggattttccaggcaagaatattgaagtgggttgccatgccctcctccaggggatcttccccaaccccatggatcaaacccaggtctcctgcattgcaggcagaatctttaccatctgagccatgaaggaagcccaaagtaacacaataggaataaggaaatcaactctattttttagaaaaagatacagatggagagagaataagcaaaagagagagaagaggaagaggagaaaatataaaatgagcattagcatccatgaaaattatcttcaccatgtcccattctgattccagcatgcagatgagaaaactgagggcttgtgtgagttcacctggagtcagtttcctgactccccttttccacgccttcccaccatgtctatttagaatatgtgggaaattagcagctgcagttggagtcagtctggccagatgtgtccttgatgtgggatccctgccactttccctattctgggtttaaaatctctctttccggtattcttgcctggagaattccatggacagaggaacctgggaggctacagtccacggggttgcaaagagtcagaaacaactgtgcgactaacacactaactgtggcgggggtcaccccgtgaagaatgaatgagcacttcctgttcaattagagactgaagatcacctgcctcggccatgtagacaggattcccagcagcaaagtcgtgattgtacagccccaaagccatccgtcagttctgaaggaaccaaaaacaagtcatttattcaccatgctgtgggaaaaagcaaac

SEQ ID NO: 57566 - DNA, 909 bp, Bovine  19866881730177
ttatatcagctccacctcagatcatcaggcattcggtcccacaggttggggacccctgctttaaaacatttctaggttacttataatacctgataataccacgtaaatgctatgtaaatagttgcttatgtacggccagtttaagttttgatttttagaactctggaatttttttcccaaatattttcgatctgtgtttggttgaatctgcaggtgtagaacccacaaatacagaggatgggctgtatacttacatttctgtctgtctctctctcttaatgccttggcacccacttaagtaaccctcccagctcacattttctccaaactttgttgcatctgaaatgaccaagttctcttacctctctgtccacaggctgcacctgggaatttggagccatggtaaactacatcaagaagacatatcccctgacccagctggtggttgtgggcttcagcttgggcggtaacatcgtgtgtaaatacttgggggagacccagggccaaccaagaaaaggttctgtgctgcgtcagcgtgtgccagggctacagcgcactgaggtgagtgatcctggccacgtgctcccacttcctgctgccactggtcctccagttagctttcatttattgagatgtccccagcacaccagacactggcccgtgaagacctggggaaatgctagggcagactaagcagaagtgtctgggtcttgattttaccttgctttgcttccacatcatatactggagtggtcctgtcagaccccttcaacctgggatatgcagctgtattttgggggtcagatctgtaatggagtaagccaaagccccgcccctttaatagctgctgtttccctttggagtctctgagattacttaaattcttcatgctccaggagttttgtagaa

SEQ ID NO: 57567 - DNA, 1324 bp, Bovine  19866881776568
tgcttggattgaataacttgcagctcctaaagcacccacacaattagctgtaactgctcctcagaatccgcctgctgatgcaggagacttaggtttgatccctgggccaggaagatcccctggagaaggaaatggcaacccactccagtattcttgcctgggaaatgccatggacagagaagcctgccaggctacaatctatagggtcataaaacagtcggacacaactgagcgactaaacaacagtatttcatttagcataatgtcctcaaggtttgtctttgtcacaacatgtgtcatgatttccttactttttaagactgaataatattccaccaaatacatgtcaacatctggtttattcattcatctgttgatggacacttttgttgcttccaccttttggctgttgtgaataaagctgtcatgaacatgggtgtccttaaatgatattttaaaaagaaaaaagaactaacacaataccctgtctaagccctttacctatatcatcttacttagtcctgacttcaccagcttctcaaggggccaccagctggtatcatccctcccgggcacactgggcccaagtgccctctccattcagaagtctcctctgtgtttctgaatgggtctgcctcccttgatacctgtctctacgtcaccaagaacattttaccttaatcccacagaacatgttggccatccctctggactgaagtttgtctttccttctccccgctggcaaggcgatcctgtaaacaacatccacttggtacttttcttaacaccatgaatcactgtacacgtgggtgtagcatcttgttttgtagcctaagatgctgatccctaagagtattgctcttgcttttgttttcctctgtgtgcgaaccgaggtgctcaggcacaccttgaatatatgttttgatttcagtgagtatgggaggggcttctcagctcccgcctctgaaggaggaaggcacacgcgtttggtaaatggccccttccctcatgggcgctacttatgctgtgtttcctcacactgaggggcctctgggagcttctcttgttggtcagttgctaagtcatgttcgactctttgcggccccatgaactgcagcacaccaggcttccctgtcctttactatcttcctggagcttgctcaaactcgtgtccattgagtctatgatgccatccaaccatctcatcctctgttgcccccttctcctcttgctctccatctttcccagcatcagggtcttttccaatgagtcagctctttgcatcaggtatgcaaagtgttagagcttcagcttcagcatcagt

SEQ ID NO: 57568 - DNA, 905 bp, Bovine  19866881796394
cctccgggcgccgcctgaggacagagtagtcccgacagcagcacagacatggagcattacatggaggaccagtactggccggcggacccggcccatggcaccatcggagacccgggggcagcgccgggcataagggattgagggaggataatctcccctggggaacggggacaggatatcgcctggggcaggatgcctggctgcccccagggtctgaagatttgggaccacctgcccacagcatatccctcccctctctagggctgttgtcagcccttcctcccccaactcctgtggttttgcaaatggcactttatagacgccgtgaaaatggcaggtgggctagaacccagcagaagtagggaatgcaccaacggatggcatcaagccacccccaccctcatgctgtgctctaaagggatcagcctccttgggggtgctgggtggggggtgtcagtattccagagttcccttatctccacccagtgacctggggcaaagttttcttccctgttgtcaccagctacctcttcctccagtcactttctagagaataagtatgccctgaggctatacagttaaggccactccaaggccattttgtccctttctgaactagaactctggcagcaatggaacagcagagacctcagaccatggggagctgggtcctcacctgcttgcggggaggagtcaccaggtgctcttctgggaggagggaaggcagataagctctgggtggaggctggcatatgtatcttgacccaaggcaggtattcctcctgcccacccagcgctagtccctcaagcagaagtctgagaaacagtagagcagtttaaattctgggacccctctgcagaattgcccactgggatctttatttattgagagcaagaccacaggt

SEQ ID NO: 57569 - DNA, 1336 bp, Bovine  19866880099755
ttagcttctagtgtttgatttttaaaccacatacagcagaactgacttttgcgtgggcgtgtgtaccagtctgggaattttcacacgtgtgtggagtcatgtaactgtgtacgtgggatagttccaccacccaacagcccccttatgctgcgcttcccctccctcctcccctgggaattgctgaactttatccttttgctccaaaattactgcagatggtgactgcagccatgaaattaaaagacccttgctccttggaaggaaagttatgaccaacctagatagcatattaaaaagcagagacattactttgccaacaaaggtccgtctagtcaaggctatggttttttccagtggtcatgtatggatgtgagagttggactataaagaaagctgagcgccaaagaattgatgcttttgaactgtggtattggagaagactcttgagagtcccttggactgcaaggagatccaaccagtccatcctaaacgagatcagtcctgggtgttcattgcagggactgatgttgaagctgaaactccaatcctttggccacctgatgcgaagaactgactcatttgaaaagaccctgatgctgggaaagattgggggcaggaggagaaggggatgagagaggatgagatggttggatggcatcaccgattcgatggatatgagttgaataaactccaggagttggtgatggacagggaggcctgttgtgctgcagtccatggggttgcaaagagtcagacacgactgagcgactgaactgaactgacatatacacactactctatataaaacagataactaacaaggacctactgtatagcacaagaaactctacttaatattctgtggtgacctatatgggaaaagaatctaaaaacgagtgaatatatgtgtatatacaactgattcacttctctgtatacttgaaatgaacacaacattgtaaataaactatactctgataagaatttttaaataagagaatgaggagttgaggcataataatttaagttaattaatactaattacataaactgtgttgccagaagaagccatgtaaattaatggtataaataaggtaaaggggaatggattagattttcagaaataattcttagaaatgctggttaaaaaaaagtataaaagaaatagactcatgggaacagaactgtcttttttttatgatattcatatatgccaactatctaaaggacagacatcagaaaatgatggaccttaaacaacagaggaagctgaaacttctctttttggcagcctcaagagaagatgctgtctgactaaatgtgtcatatccgggac

SEQ ID NO: 57570 - DNA, 1571 bp, Bovine  19866880351067
atttgattttgcaaatactgcttatctaatgcttgaaatacaataattaatttaaaatgtacttgaattattacataattgtaaacagatcaagatctttatttactatatataggaaaactagaggtatattttgatagtgtgttaggaactaaaatactattttgtacttatggttttgaataggaacatgggtagatatagcatgagctcaaagttttaaatcaagttcaagcaaaatgtcaaaattaatttgagccttaaatacttaggtatgggtcttgaaatgagaggaaatattcaattaaggtgaataaaattgaaaagaacttctagtttcacacaatttccaaagtgtctgtactaagaaagcagaaaaatgtactgcataatcatccatatgtgttacacatgtttaaaaaaagaaaaagactgattggctatccaactacaagagacactatcttaaaagactgtctcctctcatagccactcagatatttcctatatttagatacaggcaataggagaatggatactcaattaatttgattgaaaacctgatacagttgaattttatgacatgtgaattatatctcaataaaactgttaaacataaataaataaataaacattaattcaatggcctgcctcttgagaaatctgtatgcaggtcatgaagcaacagttagaactggacatggaacgacagaccagttccaaatagggaaaggagtacgtcaaggctgtatattgtcaccctgcttatttaacttatatgctgagtacatcatgagaaatgctgggctggaagaagcacaagctggaatcaagactgccgggagaaatatcaataacctcagatatgcagatgacactatcgttatggcagaaagtgaagatgaactaaagagcctcttgatgaaagtgaaagaggagagtgaaaacgctggcttaaagctcaacattcaaaaaatgaagatcatggcatctggtcccatcacttcatggcaaatagatggggaaacagtggaaacagtgacagactttatttttgggggcttcaaaatcactgcagattgcgcctacagccatgaaattaaaagacgcttgctcctttggaagaaaagttatgaccaacctagacagcatattaaaacgcagagacattactttgtcaacaaaggtccatctagtcaaggctatggtttttacagtggtcatgtatggatgtgagagttggactgtgaagaaagctgagtgctgaagaattgatgcttttgaactgtggtgttggagaagactcttgagagtcccttggcctgtgaccagtccatcctaaaagagatcagtcctgggtgttcattggaaggcctgttgttgaagctgaaactccaatactttggtcacctcatgtgaagagctgactcattggaaaagatcctgatgctgggaaaggttgagggcaggaggagaaggggatgacagaggatgagatggttggatggcatcactgacttgatggacatgggtttgggtggactctgggagttggtgatggacagggaggc

SEQ ID NO: 57571 - DNA, 4527 bp, Bovine  19866880353855
tataaatatagttgtattttatcttctaattctatggaaggaggtacaattattactcctgatttatacttgagagaactgaggggaaaaataatgaagttacccaaattcatgaagttagtgtcaggttagtatttgaatctaaattagtatggcttcagaggcccctggcttaaccactataccatagattcactcagtcagggggaaaaaaaatgatgaatgtaaacaaataaacaccctaaatatttacaccccagatgtgtgtacctgataactcccctgttaaaacatctggtgagagtttcactttcatactaatttccatgaaagaacaagagggatattatatatttccccaaatacagggtacctttgttgttatgagtagatggctaaatctcatttttgtcattgctattataattttaatattcatgtatcatttcattttcctacattgtactgaccatgtcactacattacgaaaaggagggcatggaagcctcttagcccacatttttgaaagtactttgcatgacttctactctaacatcatattatcctgtgttggattgtatttgtcaatatcctgttatcacccatcatatcatactgcctaatattgtattgaaattaaatcttaccctttaggagtcctgtgcaacattaaaaaaaaaatgggtcttcaacagtcttcctcttagatataattgaaaaagaggcaggcatcaaaacataccgccggggagcgatcctgaatcatccaaatgatgagcatacagtgaacatcttgcaccaaaaagatgacaattttctgtagcagtgttgtcaaaatgaaaatgtctagctgtcttggtgagagacctggcaggaagatacacacacacacacacacacacacatcccttgtagactcatccagctgatttttgttatcttatgcttgaagtgaagacttcagggtctatgaaattcttaagccatcagctggattctacagaaggctcctcactgaataaggagagtgttaggaaagcagtgagggagagaggtaacactaccagagttggtgctcagtgtacacttgttggatgagtgaaccaagacaagcacccagaacataagcaacattaaatacaactatgatccaccactgtgtttcttatcaactagatatcacaagttaaatgtagtccaaactcaccagtgtctgtactgactcctagtcccacttgtaagggaccatcaaatagatacaccttcagctggctctcttaaagtctaagtgcacaagaaatacttctttccaaaagcacagcagcagaggatcaatgcatttgctcacctgactcatgcaagtctactgtgtatgcaaattctgttttgggatctgggaaaagtcctgttttggatctgggaaaagtccaggcatccagaataccccagccccatcttccactcaccttatctgctctgccaaatatagggtttatgtgtcagataaatgctagagagtactgactttttgacccatgtatgaaaatctgaaaagccaagaaatctggcaaatacaaagcatcggcctgaaaaatccacactttcctctggcaccatttaagctgacaagtttatttgagacaggcacactcacatttgaagagcaggacttgtgctaaccattctcacatcaccagcaaagtgtgttctgagtccatattgcacagcatgcttgaagaagtgtggatttttccacatcatttggtgacattttgcacagtttcatttctgctctgtattgctagaccctacctttttttccctcgcaaatattccactaatgggattcccttgagtattcagattctttcctctgcttcagcatctatttgtactgcgagtgcacaaatctgtcatgatgtgcccctcagtcaaagtcaagcctccttgactgaaaggaaaatgatagaggtgctccgctgctgaggagagtcaggggaccgcgggccagcctatgaggggatgaagagatgcgttagaattccagggagaggtcaatgaggaagactccagggaacgatggtctagctggaggtgcccgttcctaacgcctcttcccaagtccaggtgaaaggcagcttttaagtggcaggtgaaaggcagcttttaagtgggagggggtgaagaagacaattgaaaccaaaattgttttgagctcaccatttttctagctatcagttctgaggtcacagtcactaaaactggaaacttaaaaatgacttcaaaaaggcaaacgctaactagatttcacagtggatttcattttacttggctttacagaaagaatgcaggtattaaatagactgtttcctgtatacaataaggttaattagtagtgagggatggaaaatcagtgtagacataactcttttcgacaggtatcaaaaataatcccctgatccctacagaccccagctgcattgaaagaggaacaatataaaagattctttaagcacaaaatttgcaaacattctccaggtgtccgcagcacccgcgcaataggccctgagcccctgtgcatgggctgctccgcaagcccttccgctgcagtaacttaaaggcgcagctactcaccgctgaattttgaggcgcagcataaaggctctgcttacaaagcggctgggatcgcaggcggagacaggagaacaaaaagaagaatatattgcggcctgaatgggacttcccctaagctccttatcaataaggttaataagggtctatgcaatttactgatcactaagatggaacaagcctccttgcgctccaaatctccacgttggcgccggtttttaatacttttcacagccaatcacataaaagcccctttgccccgcaccccagagaataaactctggttcaccattctggcctgcataaaatcgttggtccgttattatacttctacctgccctagttaagcagattaacagttatttcctagaattcgatcaatgaggttctttgtaattgaagctggagtactcagatatgtctttttttaaaaatgcatttctgaaaaacgaatttcttttttctctggtttaattttgttatcctcaatcgtatgcatgatacaaaaaaaaaaaaaaaaaatccaaacttctatctcctctataaaatacatgtcatatcaaaaaggtgacaagagggggggaaaagtaattagtgagttcacagagttcagtagaaaagttaaaatggagtaacacattactttttatgttaagatttcacaagacaaatcttgcctgtgttttaattgcatgtgaccctggcagtcctactctgaaatgaagtgccgtaaaattaaagatgacagacgctcaaaacaagtcttgtgatcttgattagactacaaagaccacactctctctctgctgcaactcagatatcatggactgttttatttggggaattgcttcattaatgccttctttgactagacatgtttattatttaaaaaaaatactgaatatggtgatatcttgcataactaaataattccctaaaagcaagttataaatgaagaatgtttaaatacccctaaaactaatttttatagatacttatacataaatatatatatatgtgtgtgtgtgtatggatgtgggtgcgtagatgtagatgtatatattatatatccatctttgatatgtgtataacctattctaacctacaattctctattatagcctgagaagcagagcagttaatctgtcatatttccttatatgttcccaggtcaatcgaatgtgtggaactatacattatcctataaaaaccatttctgagaaactctgtcagaattttaaactttctgagcattgtctaagtggaggatcagatttgactcacacctatatttcaaaatgatcaccagatcattcaacctaaattacataagccatggtataggtgcttttacacctcacttcttcctagttcaacgaaagcaggaaattcaggggcaagtcctcacagcattagactctgtcagctctgtgttccctcaggccagctcgagtcctgcttttgtctcaagtcctctgggtcagggcttcattcttactatgaggaggtcattagtgttcatctctaggactgcctaccttctaaatctctatgattcttttactttgtccgatttcaagaacactagtttaaattcatatattttgtattaggaaacaaaaggatttatgctggttatttgggtgttctatcaacagggatatatagattcagcctagaatcaaagattggtttctagagttcatttttttattgtgcatctgtaattccagaaaagtctgtatacacattctgcttccatttctttaaatttgaaatccatattgcaatttctctcctacctaacatcagggctcctgtgagaataaaatatgataacatacattaaagactcttttaaaaatatgtgaaacaaggcttcttaatcagtagtgt

SEQ ID NO: 57572 - DNA, 1227 bp, Bovine  19866880360022
gtatggttcttagttgtctgccaagaaaaggctgacttgagcatctggaggatatttcctctgcaaaaaatgtataacttgaggccatttacacacctccttaccctcaattcaagccaatagaaacttctttccctatagtgtaaagtccaaaattccttttacaaagaaccaaggtgtggtttacacaatgaaaaaaatcccccaaatggaaaaataatattttgaaatctatctttatgataaacgattgatttacattttgtgactctaaacatcttcttagaagctcaaagggccttgcaaatggcaagactaaaaataaatttcctcctttcaggtctgttaccatttccaggtaaagaggcaaatgtgaagaagtcatagactgaggtcacgctccaagggagaatttgaatgcaaactttcgatgtgaggttcttgatgcaaatcttgacttttgctttaaaaatggcatctgggtggcaacacctaaccacctcttggaacctgccactaaatatgcttgatgacacagaaaaaaaagactaaaatgcttaaaataacagggactgaccggcaataaggtgacaaaaagttaaagagtaatttcctttaagacagatggaatttaattggaaaatgccagtggtgagaccacttgcactactgaactactgaaccagagactgtgcctatcttaaagcggatagaaatagccttctcttcctttcttcagccatctgatttcagaatcaaagactcagcccaaaggactaggcagcacccctttccatgcatacagatgaatactgtgaaggatttccttcctcacctgaattctccccttctaactatgtatggagatttctcttttgtctgcaataatatagagacagcaatttccacaaaataacgagggagattgagagcggaaggcagaatgatgatgatgatggtgataacaacaactgagagtggaaggcagataatggcacatatcaccgtaggaattgtagtcccatatgtaaaacatagaatcagtggagactggcaaaattctatttggaacacgttcttagaattctaatattgtatgtctttaatcttttagaatgtcaatgagctaagcaatgtggtgggagaaaaatcaccaggatagtagggtcataagacaataaatatgctagaaaagaattaatataagagctgtgtttatcaatttgt

SEQ ID NO: 57573 - DNA, 1663 bp, Bovine  19866880364397
ctgcagtcctctgggtctgtggttggttgaattccacattgagaggaacctactatgaattatacatggattaaccccctcttcctctcgttgttcacgggtcaactgcactttgcagatggctgaaatttcatcatcacctgttgctcctttgtcatatataggtcctcccgggagggggtaacacattgtgccctgcagacatttactctaaacagtttgaaggagtttatttgatattttaaatttagttcttgcaagtaaagtttagaaacaaagcaggaaaaggaacattgaacaagagggataataaacagaaaccaaggtattctttatgtcattcagttctactaagatcaattgaagaactattatatgaaatacataatattatgtacctagttttaggagtttaagttataatctctctctacagtgattcaggctgtttgttgactttgaatgctaattaatctagagacttagagtcccagataaggtaggcatatatgctggatagggatgcaagggagaattaattaactctcaggctaccttactcttatttgaatgcactatttacaaaccattaaattactaacttaagagatggtgaggttgcagaatgtggctttgagtagtttgcaaagaatactgtgtactgtaaggtctgcctcattagacaaaatatttgtatcattggaatgtctccttgaaaaaccatttgataaagagataatagtgacaaacaaggccactagatagataaaaggcatagtgcttgctccaatcagggaactttgagctatgcttcttatcttctttagtggaaacttttgtgtcagatgatatgggccagcctgtgcaaaactatggagaatagcagaccttctagaaattatccatccttgtttgcataatgcctttactttactcaacagactcattcctaaataccttcatgatattaaaatcccagtctattattatcagactgactctttttcttataatagtgagtagctagtgatatgccccttgtaatatttaaaaatagtgatacagctctcattaccgcatctattagccccagatttactcagccctggtctaaactgggtttctggacttttaaaaatttatcagtaacaatctctaaactctatctagagatgacttcataaatcaccaatatatgtcttagactgttggcaaatcacaagctgcttaagaaatatatgacaactagaaaaaaaccttctgcaataaacaaatagaagaaaacgtacttttaactaatgctatttctagtaaacttctgtgttcatgtggaactttggagatgagagaagttaaaatactaaatatttcaattgatacatctttatgaattttgttgatttggattttaaaggacagattctaatcttgcctttccctcatatttcctaataccatttaaaaaaagcatgttactgcagggtactttaattgatacaaaatgaatattaaaatattaaagatatctaacatcagtactaaggatttccatttctagccctctaatcctctatggaaatttctcttttgtctccgaactgtttgcctgatattcttttgcccctggattttgtatttcttttaagttgatttccctcactga

SEQ ID NO: 57574 - DNA, 1788 bp, Bovine  19866880428144
tttatgggaaaatacttttttttttttttaaacaaacctggaccttatagaaagaaaatatttcatacatgcctataaatatgctggatatatgaaatatttaccttctatcaggaaatgcatagctgtacaacatctatatctacactaacatatgctcctctctataagttattctttcagaatattaaataattatagttaattttttctatatataatatgatacttatgcatgtaaatgtatgtttttacatgtgaatggggttcatcatcaacacagacattataacttagaaagacaaaataaaaatattgagtgggtagccaaattctaatcatttataataaaaggggtagtaagtgccatctgtttaaatgtaaaaaaaaaaatactgataaaaatgcatacatgtctagtaaattgagaccacagaatagttcatataaaacaaaatatatataaaataacatattttattagagtgatattgacaaacatatactactttcataatgattatataagaaaaatctcatgagtatttttggtgatataccacaaatatttttaaacacatgtagtctacttggtgggtgtaacaaaattgctcagttttctctgctgtattttcatgaccctcatctcttagacgatacttcttgcagatcactcttacttgcatagaagttcgttcacttgagcaaatttcttgtagcttcactagtccgttgtattacctatatttcccaaactggtaaaatgctactgatactatacttgtatccgaataacttgagctcttcactttgggaccatcaccaactcctttcactaatttctttttctcttttggaaagtatttagcattcttatttatccttagtaaatgtcttattttcttctctttgtgaatctccttcagaattcattgcttaacaatgccctctatccctcaaaatgtcccttccttacaattccattttcttaaaaaaaaaatgatggaaaataataaacagcaaaatatgtagaagaatctttctttgccttaccttagaatttaagaaatgtcccttgatatgtaatatatgcagatcagtatttataaaaggagatgtaaccgcaaaaaaaaaaattcaaaagtaaattgcaaaacatagtgatatttatggcaaacaaatttttcatgattttgatagaaatttttactaaaagtggcatcgtaggatatttcacttcaccccaagaccttaaatgaagacatatcttatgatatttacattcatctaaattttgagggagggataatttcttagactttcaaacatgactgaagagatggatttagtgtgatttcttctatgtgataagaacagaaagaaaacattaacatttacttttaacaatacaaaaatctataaaatcacatttctattaatatcaaggattaatctaaaacattgtgagctgtaaccatttaaaaaacaacaaatccacaaaagatgtaagatacttcactaagagttaaagagactttcttagtggctcagacggttaagaatctgcctgcaacgcaggatatgtgtgttcaatccctgggtcgggaaggtcccctggagaagggaatggctacccagtctagtatccttgcctgggaaatcctatggacagaggagcctggagggctacagtccatggtgccgcaaagtctgatgtgactgagcgactaacactttcactttcaaacacattacaaagaagtagaagacagaagtaggattacagag

SEQ ID NO: 57575 - DNA, 1844 bp, Bovine  19866880461200
actaagttgaatctgggggtctctagcccccttgggaaaatgtattaagtctcagatcaaatcagtatgtaccatgtcaaaccattaacttctcatattatgtattattggggaaaatcaaaatagttaaaatgggtgacaatggcaaaataatgggtaacagagaaacacaacctcagccaagagggaaaatattccataactaatataaaaaaggattgtcattcttattctctcaaaatgtgtatttaacaattaacactgagaaagtgaaattaatgacattcaaaatactctgtattaatctgtatttattctatctaaacatgcacccatgccatttatttgtcatttgtcgagcttaaattttgagtttgtcttgtcaggaccgcagacttcatgattatttaatgtttgcctttattttgcacctgccactcactttgataggatagttggtttaaggtaagggtatattggagtttataaaacaaaatagagaaaatacagcttactgacttatatggggaaggaggtttataatcataactaggatttttattataatggctcttctagtaagttgagttaatcagctgagtgtttgcaaggatgggttatgtacatgtttctataataacaaaaatgaacagagatatagcagataaattgtcttaacaggttttgcttggttttagtgcaaaaacttactaattaatgcaagtgttgcaatcatttttatgacattccctgaagatggcactttaagggttatgccatatgctgattgacagcagccataattccatacaatgagactgtatcatattgtttgaagtgaggtgatattcatctcttgaaactgatcaaacatatcattgcatcaaacagtattacaatataatcacactgtatgtggagcctgccaaggctgatcatcatgttgtactcttttcccacggacttctctaatagaacttgtgacacaccactgcatccacattttcctttaagaactcagaatctacgaaagagaaaaatctgcataaaatcgtggtttggttatgctgtgtgagtgttcatttgtcgactgctttagaattacaaatttccttccacaaagatctccctaagtatacaaataaaaacctggtaagaccaagataaaaagagaagattccaaacagggcagaaaataattcaaatgccttttatttgtcttccataaacaagcaaacatggaagacatgtctttcgtaaaaaatactttttagtgtcagaaactcccaatggtgtttttcctaatgtactgttttgcaaagtcacttactatatgtactgactttggggctattgcagctgcaggtgaaaattatattagaacctattcttctactggtcgtagttgctgctgatcttggaaaagcaatgctaggatgggcagaaataaatgagggtgatttggcctattagtggcatttttagtggtatgaaattctataacagtagcttttagactgtgatataatttaggaattgccctttaattatccatccatccatctctccatccatccatccattcagtaacttgtaaaaaagccatggggatactttggggattatgttcagaatagtttacaaacaggatgctaggatgggagccatcgcctattcacactgacattcactaagagatgtgttaccgcttctggtcctccagtgctgacctgtgtgaatctctgcgatgtcgccatcctatctggaccttattaatttgcctgagccagccctagccctaacctgttaggtttagcgtccttagccttctgggcctgcagaaa

SEQ ID NO: 57576 - DNA, 2547 bp, Bovine  19866880484722
ataacctcagatatgcagatgacaccacccttatggcagaaagtgaagaagaactaaagagcctcttgatgaaagtgacagaggagagtgaaaaagttggcttaaagctcaacattcagaaaactaagatcatggcatcctgtcccatcacttcatggaaaatagatggggaaacagtggaaatagtggcagactttatttttttaggctccagaatcactgcagatggtgattgcagccttgaaattaagagacacttactccttgaaaggaaagttatgaccaatctagacaacatattaaaaaacagagacattagtttttcaacaaaggtctgtctaatcaaggctatggtttttccagtggtcatgtatggatgtgagagttggactataaagctgagtgcagaagaattgatgcttttgaactgtggtgttggagaagactcttgagagtcccttggactgcaaggagatccacccagtccttcctaaaggagatcagtcctgggtgttcattgcaaggactgatgttgcagttgaaactccaatactttggccacctgatgcgaagagctgactcatttgaaaagaccctgatgctgggaaagactgagggcaggaggagtaggggatgacagaggatgagatgattggatggcatcacctgactcagtggacatgggtttgggtgaactctgggagttggtgatggacagggaggcctggcgtgctgtggttcatggggtcgcaaagagtcggacacaactgagtgactgaatggaactgaataccactttgccaagtatgggtaaagaatacattttgtgccaaggactgggtaggatacccctgggggagactagagaagtgtgggcaaattgcttctgccaagtgtaagtaactaactgaatgaatggatgaatagaggaatgaatgagtaaatggtgagagatgctctcctaatgttgcttcatttgtaatcaagaatgttagaagcatttagggcttccctggtagatcaactggtaaagaatctacctgcaatgcaggagaccccggttcaattcctgggttgggaagatcccctggaaaagggataggtcaccctctccagtattcttgggcttccctggtggctcaaatggtaaaggttctgcctgcagtgtgggagacctgggttcgatccctgggttgggaagatcccctgaggaggacatggcaatctactccaatattcttgcctggagaatctccatggcagaggaccctggggggctctagtccatggggtcacaaagagtcgggcatgactgagcaactaagcacagcacagaagcatttaaaaaatattactgcagtttgtaaatgattttttaaggtggggaaaataatctcgagaaaaaagaaaggaaacaattagtttttatgtaacagctgatgtgctgctgtagtgaggattgagaccattttcctaagtctgtgagaataaacacacagttttcattaaacatgcctttcccataacaggtccataagcatttcccatgactctgcagttgggtatcttggctggaagaggatctggccattagaaggagggctctagatacgctgagtccagccgtgctgagagacttggcacctttatatgttactttctaacaccaaccccagcacaaaatgtcatcagaaacctacataaacattggacttatattcacataaattatttctgtactgaggtgctttatgccagaatttagcaaaaacaacactttgagtaaacagaattggcatataaatgtaagaatattaattcaacaaaatgatcatagaaaaatataatcaacagcacacacttgtaaatcttgtgagaggtttttgtgcctttgagttttgttgaacatttccatagagttcctttaagctgatattgccaaaatgctttgaattatctgctgctttaaggaatcgtagtctttgtttcattaaaacatttaggaattatattaataatcattatatgtgattagtgcctatctagtgctgaatctacaaattcattttaagagaaaacattgggatgatgaaatataaggccaaatatgattgcccctgtcagcaaaaacatggttttattttattaaaaatcaccaataaaatgccatggacaaaacatatagtttctatttataggcattttcaattctgcaataccatgatatctgcatgccacaagactgtgtctagcagggttttcattttgcctggggtatatacagaaaaagagaggtataaaatcctttttaaaatgtgcacacatcttattatgcacagcttcccccaaagtcctatttggatttttgttctaatatgacagtgcttacactgtcaatactgagtatttataagtgagtgaagatttccagaaaatgatgataatttaactattggcaataataacattataatattttcagtgatccatttggctctaagtatttattaaataatatttattcctaaaatacgtactcacacaatt

SEQ ID NO: 57577 - DNA, 730 bp, Bovine  19866880543538
tttttcgggggaagcattttgcgtcccattctttttatttaattctgccagctgtctgctaaacaaatctagccaggtggggcttacaacccatgactaaaaaaccgctagtgcagctgtccagcttgcccgaaggaagaattcagacaaatggcaggaacgaaaagattgttttgttttcaagaaagtagctactgtaccttctttggattcagttttttttttttttcccctctgtctgcttaagttaatccattacttcttaaggttttatatcaaatagaaaaatagcttcaccttttaaaatttttagtgtatttttgttataacaagtttattatgattttcccttaagtaaaagctgtcttttatattgcaacctggtactgagttgtcctctttctttgctttttttttttttgggggagagttaactgattgctaaatctttttcttctctctctttcttaggagagaacaagttattagtgaactatgactgaaatttatttctagatacagcagaattaaatgtggagctatttaaaggtgaaggttggcatggcttactcttgagcagaggaacagaacaggcttctttgcactgcatcatcgggggacctcaactgtgaatttctagtcagcaaataggcgcttcatttggggcgtctgagcggaggaccacaagggctgcgctaaaaacgaccacgtcgccatctgatctataact

SEQ ID NO: 57578 - DNA, 1707 bp, Bovine  19866880564367
gggtcagatgtttattatcttcctttaggtgaatatgactcatgtacatcccagagtaagacatgacatttagcttcatttgctgtcatttataatttctgccaaaagtaggttatgagtttccctatatttttaaagagaatttactggttaccatttaacctttcttaataaatcacagtcatctattagatgtacaagctgtacaatcatggagaaatgtctgcagggttcttcagtgtgcagagttgcctgccctgccctacaatggctccaggctgctatgctttttcacttctcatatattttttttaatagtttatctctctcctcccttgttgtcaagctgtcagtcagctgtcactttttactgctgtcagtgagcctgcctttatcgcacccccaatttgatgctgttaatctgctgtcagctgaaaaatcagataatcaagacctccgaaattgcatttacaataagtgatgggctgaacactggatggaggttttgagataggagttccagtttcagttccagttcctgtctctatctagctgtgtgattaccagaagacacaaaacttctctgggccctggtgccttcatttttaaaataagcagggcctgattgtgtgagagagagaaagagacagaaagaaaaagagatctcatttcgacttgaagtctgtttctctggctaccaaaaaaattaggaaattttattgtgagttaacagaatgcaaggtggggtatcactgtccctttaagtgtcaaattcaagcatagctttagtcatcactttatttaatttcactcctctgaattagctactgcccatctccttaaagggattcccaggtggctcagtggtaaagaatccacctctgccaaggcaggagacataagagatgtgtgttcgatccctaggtcaggaaaatcccctggaagaggatatggcaacccactccagtattcttgatgggataatcccatggacagaggagctgggctggtacagtccattagcctaagccatctccttaaaattctcttccctttgtcccacaggataattctctcattgatgaccttctgactctaatcttctcatttcaatcctgggctcttcctccattaatcccttaagtttcaaaagtgctaaaggccagttcaaagctaaagatcaaagtcatattgagaaaccagcaacaatcctgagaagcagaacctgtgtcctaggagccacctttaagactatgtcacagtgtgtcccatgctgctgatgtgtgatgtaagacgaggaatgagaactgaccacaggcatggaagtcatcagtgaccttgacaaaaacagttgcagtggagcagcttcaagagaaaacagtgggaatgaaattgaaaaaaaaaaaagacttttttagagcttttgatattgagagagaaaaaaaatttttttagaggttttgctattaagagagagaaagaaatgaggcagtagcagaaaaagaactggaatcaaaagagaatgtttttaagatgtaaaacaaatagcatttttgtatgctaataggaaccatccagaaaagaggaaaatggatgatgcagatcagagaaaaaaattactagaaaagttaatttttaggtaagcaaggaagatgggctcccacaaagaaatggagcggaccttgacagaaacaaggtcagtccatc

SEQ ID NO: 57579 - DNA, 1427 bp, Bovine  19866880565795
tggcaaaactctattagtctttgccctgcctcattctgtattcccggccaaatagtattacaatactactaaaacactacaaaattttttgtaatattttataaacaaagtaaatgcattagtatagatgatgttacatatatccagtggaataactatgcagttgttaaaaagaatgaaataggttcatatttactcatcagaaagatgcttttgatatattattatgtatttttttaatctgaaggacaatttcgaaacaatgaagacaaaataaattgtgtgtatgtgtgtgggttctacactgattaaaaggaaaatgaaccaatttcactagtacagctgactgctgaccaaaaatgagatgtaagtctattttgagaaacatgaatagatttctatgagagttaagtaaactgtcaagcctcagttactatcatttaaaacaagaatgaagaaaaattaaattaaaaatattaattgcccttcttgtctcaaattttgaagttatatgctttgtaattctgtcatcattactaacttttaacccgttgaatcataaaggcttgctctctcaactgtttcaatactcttcatatcattcccactacctagtagtgggatactctgccaacatttgcttcgtatatgaagagaactcattacctatgaaagtggctgatttatttctggacaactctgactattagaatttatttttctaatttatttttccctggaaccaaaatctctcttcttatagcttcctcaatgttctgtttccctttggggacatatagaacatttttctctcaacagcctatctaaaactgtagacggttgttcttgttctaataatttaccttgtcccctacatatagttaatgtttaaaagatctcttagtagctttgtcttgtcgtcagaggaaaaaaaaaaaaagacagtgaaattagtcagtactaatgttgattacaacttaattccaaatctagacattattggtagtgttggataagacagtatatacatttgtggttctctgtaaacattctaaaatttggggtttctagaagagagaatttttttatacatatgccttccttctctcccacattcacattacccatcatatagttaagtatattatgtgcccactgtactagaaaaaggtcagttttcattccagtcacaaagaaaggcaatgccaaagaatgctcaaactaccacacaaatgcgctcatctcacacgctagtaaagtaatgctcaaaattctccaagccagacttcgacaatacatgatctgtgaacttccagatgttcaagctggttttagaaaaggcagaggaaccagagatcaaattgccaacatccgttagattatcgaaaaagcaagagagttccaaaaaaacatctatttctgcttta

SEQ ID NO: 57580 - DNA, 1677 bp, Bovine  19866880631609
ctgcaggggagttcaattatggcccaataaatgaataacaaagcatcttatttcaaaatccctgagttttaggatttgaatatctgtaagaacattcctttcattacagattcaaaagtttaaggctttcaaatgctacaacacacctgtctctgagttataggcattgcttccgtgaaaaaatagcttaaaatccatgaaatgaaatcaactccacataaagctatcacatgactctgatcgctaatctgacttgtaaattagatgtctgtaacttccactattcagcaatccgcagattttttttcctagcaggatggctatgttggctgcaacgcactctgaccaaaaatgtgcggtagcagcagtgtcacactgacaaactgaatgctatagaccttaaatagaggtttcatttaagtcatgagaaaatctttctctgtagatgaatgacgcaaaatgtaatctatgttttgtatcctgggctgccaggatttttgttgaatgctagatggaaaaaaaaaaagactcactgaggaaaaaaatgggatttgactttaagagaatccacccacttcattctcagcactgctttcaaatcttctatgaagtgaaagtcactcaatcgtgtccgactcattgcgaccccatggactatacagtgcgtggaattctccaggccagaatactggagtggatagcctttcccttctccaggggatcttcccaatccagggatcgaacccaggtctcctgcattgcaggcagattctttaccagctgacccacaagggaagcccaagaatactgagctatgtttcaataactgatataaacaaatgaataccaaacgcagggattctaaccaaataaaatattgagtttggttcagagagaactttgatgctccagttttcttgtgattcaacagttctagaaaatatataggtttatttccagttcacacatgctcattaaatcattttaagtgaatttagttaacaggtctgaagacattaatttattattagcagctgttagtattaatttataatattatgttctatgcacattaatactgtacagcatgatttcctacttactattgagttcaacagcctacacaaaaggatattttcctaaaaaattctggctacagtagcaaatagaagcatatttacacactctaggggaaagcaaaatttcaaaaattccccaaacaaaaacttccacatgaaatcacagtccttattttgacctttttagtttaagctaaaagagatgcttaagatgttttttaggttaagctaaaaaagatgttaagctaagagatgatgcactagtagaccaatgaagttgaaaaagaaggctggcctacttggattactggcagaatgtgacaccaatatggcatcaagccctgctgtgattccaaggacttcatgactgaataaagattttttttttttttttttgagtgggggtggttaaagtaaatttgatctttcacttggggaatgtgtaatatattattattccataatgatatatggtaattgctttggtaatcaaaccttaaagatcctatttatggaaattaatatagttatcaccttttagtattgggctttcttacactaagggaaaagatctaaagagaagtatctcaaatttaaa

SEQ ID NO: 57581 - DNA, 1806 bp, Bovine  19866880653856
tcatatgtgttattgaattgaaacgtggaactgcagctttgcctctcatgtcatgtgctagaatatattttcataaagtctataaaatagattcgttatttcaaccatcttaatcataatagaaaaagcccaactatagttaaaatattgatactatgtccactcacatgtagtgatattctttaaaaacaaacaaacaaacaaaaaaagaggtttaacatctttgttgaaacagagcaaatacagaaaagtacacagatcttgagagcgttattaatttggaattattttttataaaattgattttccaggcttgtatgtttgtgactcttttctctggtgattaatcataaattatctctgttgaatttgtaaatatgaaactgagtgtaagctgtctcatttctgggtataaaacttaggacattgtttttcatctcttaacctaacctaaaggtccctagggtaggagccgagtcttagttatcttcgtagctgcagctctaggtgaatgtaaagacataacatgctttgtgctggttgtttcatataattcctcttttaacgacccattgtaattagcagcaatggactgctgaagtgcggtaatgaaaaggactggccatgaggtaaataaaagaggaggaaactgtgcttaatattacccattttactgataacggatttaagaattaactgctaacatttctccgaatgtccttcatcttctttaaaactctgtgaaaatgtcaccatcagaagaatataccaactcttgttttcgtactttctgtatgacaaaatggcattactatataatttacaaagacttcatctttgtggcttgaaagtttatgagagaataaagaggaaattaaatgaacaaagaaaggattttgatcagctagtgaacttttgcagtattcaaagggttacctgaactcctcctaaaacaacttgccagacttaaatgcagggcagtggtggagagaacagtgaaactgtactataaaaataaattactgtcatgaatattaagcaacaagaatataataaacatgactgtttgcatgattctgatttattggtattgaaatgtgtataaattacgacactcagtgtttattctagttgtttcagaatatgggccaaacaaagctgggtggacacttcccgcagacctttccatctgccaccaaatccccattcctctgctcctgtgctgagtttcttatttctgtggcatcaggaccatgtgtgagcagccattccttttagtttacttgcagactgaagtagctggcctttccaggatctggtgttacaactactacccttacgaagtttctgctctcttgcagtccaaaacctccagcttcaaagcatcacagaggccattcctacttgctctattaaacagtgctcacttttgacgtgggagggttcatgactatgtttatggacttccggggcaccagatttgggatttcccaatgctaagcagtattgtattttacaaagttgcttagcagtgggtgttctggataactagttctgctaggttaaagataaagtgagagagcattgtgtatccatgtaaaatctggtggtacctcaactcccataagataactacatgaatagcacaagcttgcacttgctgatattcacaagttgaagttattaagatttgccatcagttttaattgacactctttggaaccagatatttgttaaacagatggccagaataaggtatcacacaagaaaatagcattctccttcctcaggttttttagttttaat

SEQ ID NO: 57582 - DNA, 1783 bp, Bovine  19866880655903
aaacttaaactacagtttacccttgtaaagcaaaggaaggatggcatctctctctctcttttttaaacacagaatatcactcaatttataaataaaaataaatgaaaaatagggtgggaatgaaaacctactgttagtcctggcagtatatgttttatacaatgaccccatttgtacttttgtgctattttcaatactggtaacaaggtggtgaacagaagttttcctctaaagcattttaaaatctaatgatcaaagtctctctaaaagcaaaaagtactgatctcaagtaattgttggcaattttcagtaagtaaattcccattgtcaaaatgagaccccccaaaaatataacttccccggtataagacttacttgggttgtaaaaggaagccctatgttactgttagaagttaatccttggttgattactttacgattatttctagaatcttgtgttcaagagtcataaaagagctccctattacagatgaactgaaacctactttatctctgtggcaagtgtgtggctgcggggtgtaacctacttagaaagggacgtgtcctgtaagtacaagaaacctgcagtccagtggctgagcctcgtggcaaactttttaagaaatggctttagatttttaaaaaattcagaacagggttttaagttttaaaaataattaagaaatgtgatttctgcatgcatttctctaaatatcttaagtaaaatgtctgtgtgagagggaaggggagcacacttgcatgcacacgaggaatttaaacatttcaagtctgaaaccatttcaggtgagaagtcatgggcatggagttttgtagcagaaagagtcactttaagaaaaaaaaggtatcaaattctgtttctgcttttcagttactagcattctgtttcaaatcctgcttcaagttatagcccccaaactctcactcatattgaaagtataatgtctcatgtgagaaaaaagccaagtgttagtagccttattctagtcattaaatttctaagtgtgaatccatatgaaaaatcttatcctaaagtgaactctacatgataagtagttgagatgattttaaaatgtaaacttttaacaacaacaaaaaagagtaaggtgtaaaaatgtgaaaggagcaaattaaagaattcagtgactttctatccttttagatcttagaagcatatgtttttaaaagcaaaacagcactgtccaatggaataaatttaaaaagaaaacctcaatactctctgtataatatacatacaagtctcttccattgcctaagaaaagtacaaagctgccttggggaaaataattctctgatatttagtgagggaaaatgttacctgaaatgtgaatatttataaaacgtaaggtaaaaaaaaaatagtgtaatgtattaaatcttaatgataaagttatagctggcattccttttctgttttagctctaaatcttattacaaccacccaactagatctgtggtccttgtgatttttatcagtttgtcctggcaactgcattgtaaagctcttgattatttctaattcctgggctaacttattcatttttgagattaatttttggatacatgtcatcaagatctagaatgaggatatatatcaatgtgtataatagatttataagaaaaaaaaatccatgttaaaagtacataaaataaataatatatagaaattcttataaatgcttatgcataaaacactaatttcttaaactgacttggaccatgttagggatgcatggactagtaa

SEQ ID NO: 57583 - DNA, 1498 bp, Bovine  19866880664808
ctttacagtgactctagttagtttccggtagtttctgctttgtggctctaacacctcaaccttataagttggaaaggagagaagtgaagaataacataggagtttttcattgacttcccccagaagtaacacgtacaatttctatgtataattcattggccaggactagtcattcaatcctacctaaatgcaaggttgctgggaagtatagcttttcatgttcccaagaaagaggaatttgaaatggaatttgtctctgtcacaatgcctaagcatcaaacagtgaataaagggaaagagttaaaatttggcccagatctgatgcccaagttcagtaccatgttcccatgactctatctgatctagaaggtaaggcttatgttttttttcctgtttgtattttcaaaacacagcatatacctgacatgtggagatgctcaaaatagttattaaaattgaaggaaggaagaaagaaaggaagggaaggaagatgggagagtgtgaaagaggaatagaaggagggagggaggaagatctttattgctttttaacttcataactgattgattctttgacagctggtaaaggacagatacaatacagtcattacttcctagtccttacaatgtcttctggcagtattaaaatgaaaaagtaaaagtgtagagaccagtatagccattttcaagatttgccccaatacaacttgcaaatatccccatctatgaaagaaagtagggcttcccaggtgatgctaatggtaaagaactttcctgccagtgcagaagacacaggagaggaggggtttgatctctgagttgggaagatcccttagagaagggaatgggcaacccacctagtattcttgcctggagaatcctaaggacagagaagcctggcaggctgcagtccatagggtcacaccgagttggacacgactgaagcaatttagcacacacgcatgcacacatgaaaaaactgcggagagaggagatcaaaaaagaaagaaaaaattaagaaaaaaaaagattacatgactctcatgaggaggaaatagaggcaaaaggaatctgtttggaatgtcaattggtgtgagtaataagccctgagatctttggtgggagaagtgacatataaaggaagtgctacagcaaaattatttaataagagtactgtatttcttctttgttatacaatttacagtacaatcaaaagactgagcttttacacagcccttacaggaaaagcaagacatgggcaagcagaaataaattaagtatctaccattgattgtcatggatagcaccaacttattgagctaatactttattagtgtgctctagcttggatgatgatggtctttttattgtttttgtggtaactctttattttaagtatcttatcattatgaattcatttagtattgattgcaatagcactgatcataaagaattaatttgacattaccatgaatgtcatatgcacttatataagagtt

SEQ ID NO: 57584 - DNA, 3875 bp, Bovine  19866880704300
aactacttgatacttcttgcagtcttccttgtttatttgtttattgtctttctccccttttttaatgtcgtgtgagctccttcctagaaaaagtcttatggatcttcattcctatctgcctgacacctatgaggcactcagtaacaaatgcataagatgaatgaataaatgtgataaataaatcactcaatgtccttcacaagccatggtctgcctgacactctcagcttttccttgggacagagtttactggcctgatagaaatttgtaaacactttatgtcaaattttagaaaaagtactattgcattaatgacaaatagagtactttcataaggtgttaactttgttttatatatttcagccagagagattttaagaaaaattagcacttccttaatattaactcttcaaagaaataatttcagacttgaaagatacctataatctctgttcttgataaagatattaggttttgaaagaaggaataccaaattacctatgttacttttgtaggtatctacttttccaggaaaggttaacgatgctaactactttcaaacaatcagaaaaaaagaagggttttcatttaagatccaattcccacagtactagggaaggtgagagagtgagaggtgtgctattgaaaggaattcagaatgagtaatcgttctgaatgtgtgtacatcggagactcctcaaagcctgcctggcaatctggttttcatgtaagtttgtttttatctgtggtagggagcgttgatatttaaatttgcattaactactttccataatgaataagaagtacatagctaaacttgatttgtagcaaatcaattttggcagacagcaaaaagtcaaaaagttgtttttgtttctaaagtagacagcttctgttaggccgttaaagattttcagagaaaagaaatcattaataggagtaaccaagattagtgtaatgatacgaatagttatgaaactgctgagaggtttagggaaagttccccattttttacgttctgaaaaattgggtataatcttgtcttctacaatagaactgctccatcattctgaaatatttattttcacaatctgtcaatatttatagtgaagcttgaagaatcaccaaattgtaaggtccaaagtactgttgagaaatcattcattaactcaacaaatattgagtacctatccattttccacactgccaacagagtgatctttcaaggacaattgtgatctttctctgcagaaaatcctttgaagattatttattgcctgaagaatgcaattcaaacttctgaccatggtatataagactcttaatagtccaatctctgttttctgatcctctttcaccaatcttcttctctgacctttcttgatcatgccactccacgctaaatacccttcaacacttactgagtttatattctctcccagaattgacaactctttgtcaacaaacatatctatgcttcataggtgctgttcaatcttcctgaattagtctctgtacacaattccttgcctgcaaggtgaactcctactcatctatcaaaacccagatgaaatatcatattccctgtaaaaatgttttttctctgtatgcaagcttcccatttgtgcttccatatcatggtaaaagcatcctatgctacaaatcatactaccatcttcattcactcagcaacaatttatcaagcttccattatgtgctaggcattgaggatatatctctgaacaaaacaaaatttctaatctcatagaatttagattcaagtcttaatcacaggaaatagaataagacaattaatctatatgtttatagcatgtggtatataatactgtattacacacctttttggttagtgtggagttctaagaggattaaatgaaagatgtgtagtattgaaggggtgattaatactgttgatagttgtggccagggaaggactcaccatcaagagattttgagcaaaataactagtaatcatttaactacaatgcatctttctccatagtttgaaaacttattcttctgagtttttttgtttgtttgttttttcattacctttttgcctcatctagaactcagcatagtttctggcatacaggagtaaaagaatagatagagtctgggacttaggtgaaataattctatacaaacctaaaggttgtcaggacgatgggtggaatgctatgatttatttctgcctcttggagctttagtgctagacacagaccctgtgaggcttatagcctttaaaatgcaattacttatacaataatactgaagaatcatcatgtgtctagaaaaataccctctaagtaggcaaattactctattgccatacaggagagaaagatcatggaatattcacattaaaaatccctttattaaggctttattaatagcatgaaaaatgaatcatctttccagttccagacacttgttttcctcatgaaatgttatactgcgaactgagtattatttccttccaaagcctgttctgttctgcagtttgtatgtccaagacatgtaggacagacacttcccatatgaggacattttttccccacaaaacactagcaataccaatgatatccatgaaaagcccagaagcatctattgatatgtgggatagagctggcacttttcacaaatctacaaatcatcacaattgtatatgatgttgttatgtacaatgggtaaaattctgctcttaaatgagcatatagctcataataagtcctagggcatttggaaacataagttcagggctatctctgtaattctgacaaaatatatgtgcattgtgaagaattttggctaggtcaaatataaaataggattcatatttatttttaatgattaaaattcttctttaaaattcaaaacttatatttaagacccctaagaagtagaactggcaagaatgaaaaattaccatgattttgtgaaattctaaattctgtgtaattttaagtatgcttcttggtacactggtcaaggcaatttgtatccactgaatttattaaataagtggaaggagaaataataattactatgctttttgttggaaattggagagacagtctgtatatcattatttaacagagaggaaatgcagagtgagtgagaaattttagaagcttacatgtgagggaaaaatgaaatgattttaatggacaatctgatggagagagatttcatgtttcattcctttcacatgcacttgttgcttcagaccgagcatagccacaaccaagaaggacagggatctgggggtgaaactaaacagactgatcatatatcatttcaaaataatttccccaaaatgtatcagtcagtgagtttaacagagttatttatactagacacagtctcatgcaccggctgcccttgccagagacttctgaggagtctgttagttttatctggaaagttgtcatgtagatgaaatattttcttatagttttgtaacagtagagaataatgtaaagatctcaattcaaatgtaatagtgtctttaaaaaggattcttcagacatttaatgagtagctactaggtaggggtttttctaagacaatgaagatgagaaaaaaatatgatttagctcttcctctcaatgaacttcccagaaaagggaagctagagacataaattaatacaagaaagaacaaaatcataatggcaagacctgtaagtgttcatagagaagagaacatttccctacatgttatagaaaacaattaagtccaatgaaagaatggctgtcctacaaattgtgaaaactatttgtgtaatctatcttacgttagttaattcacatagtttaaaattttcagtattcgatttcttattagatagc

SEQ ID NO: 57585 - DNA, 1167 bp, Bovine  19866880705208
aatttgctaaaagaaaagtgctagagcagctctttgcccacaaacaattccgagatggctgcccaattagtcagtagcattctgatcctcctttcaggccccgtggccctctgaggacacaagaaggctccgatgataacctggcaacctaggtagaaacccagccaagtgagagcgtttgaagctgcagtttggctgccatcgtgtcggcgaaaagaaagaattcaggcaccatgtcatccagtacaaaggataaaaacggattcaaccggaaattcaatgtggcaccacatatgggatacatgagtgcggttatacaacaggccacatattttttttgaacagtctcctccatgtgatgctgaggacatgtgtaaccatcataacgtctctaggaatctgtatttaatttgagttggggtggtggcagggattggagatctgaagccgccacaggtttgtggcagatggctctgtgtcagctatgacaagcagccaggctcagcttcctctgcagattttcttttctctctgatcaggtaaatatgggcacactctggaaagttctacagattctgccttaggctgcaagtttgtgacttagccccatctgtcacaaatcttccctaggttctgctgtaagcagagacctgaatttaccatgtagggctgcccaagaaaaaggagccatttcaccctgtaagggagagggagagaagaaaaagcaatgaagaagcattaacgactgaaagactaaagcatgctgaaaattcatattgtaaatttgcataacttacgtcaattagatttcaaaaagccaccaagtaaatggttctcaagtttcatcacctcaggaaatcccagtttctgattggcttaaagtgaactatattttcaaccattgtggaaagctgccccccccaactccgcctttttttttttgcaaatgggtatattctactgcacacaaatttcctggtttatgttatggctgacagctatcagaagtttatcatccaacttttaacttttctgaacataagatagacaacactcttaatacatgttttttgtgaatgtgaattttacttttaagtggcgaaggcacaagagaaatgccattactattacgtggaatttataaagcacttcaagtttacaaacggg

SEQ ID NO: 57586 - DNA, 3528 bp, Bovine  19866880709266
attgctgaaatcttttttcacatttttatttccaggataaaaataatacacgagaagtacagaaaacttagaagataaatacaacagtatttttcactgttaaactcgttagccagatttactttgtggcatgcattttggaggccaaaacaatctcaaatgtttgaggatgggtaggggaagatataaaagaacattcaatccccaacgaggtataccatcgtccagagaaagttaaaatatctcagaaatgtgtagcatttagaggtgcttaaaataatgtcattcactgattttcaaaaacagctttggaagaatatatttgctgaagattttaggtgcaaataaacattgttgtaggagacttgcactttgtaaagtaggctaagaaaagcgtccagctgttctttgaattccaaggtgaaaaaatgatatggctgaatagacagatctcatggaagcatgccagttgaatgcttcattgaaaggtgaaactgttgagctgtggctattttgtgcgagtaaactgatatttaaagcttctctgtgatcttcatggatgttaaataaaatattctacaaaggcatgtcagaagaactccaatgacgatgacctagaagtatagggattgtatgaggaaatgatgctgaggaagtaattcatctacccagcctgtaaaatggtcctgtgggtgtttctgagcttttgggagggtggggggatgaggcatagcctgagatggactggaaagcctgtgagtcctcacccttctccctgttaaagagtgatggctggtgaagctctgcctcccatcaaggcctctgaaagctctgctctggtgtgccttggagcaagctgtgttttcctgtgctgccttctggcactccaccctttttctgtacactttggtctctcacccaaccacaatacctgatatccaaagacttgcaggccgtgggtatttttactggaaaataaagaacctgagcaaattgttattttccctttttctctttcttttttttccccctgagaaacaagggctgcaagttgtttgaaataagccagaagcctaatagctcctttgcttgtgtgtttgaaatggcaccctaatcactttgaagagctaatgtacttcctatgggtctgaaatttctcaactggactcccgtggcagaatttggcctggtagttaagaaaattaattactctgatcctgaggatgaagcaatagttcccaactccctgtagtaatcattaaaatgtcatctacttaggagacatcttggcatgggattcataaggtttgtgagcatgggactaaggttcaatgatccttccactggtggatccttgttctgcaggaaggctttgggagataaggtttttaagacgggagtaaaatgactttagatcttttgatttaacatttgaatgttaacattaaccactgaataatagaaaacaaagcaaaacttaacatggctactgcccatttatcactgtcttctcgactattagtgatggcccatctcatggggtatttccctcctaaaaggtaagtttttttaagctgtcccagccttctccaccatgaatcttagccttttacctagagggaaagacccagggatttagaatcaaaagacataggctcaaatcccaacctcagcccttagaaactgtaagccactcagtcatgtgtgactctttgtagcctgctgttccctctttccatgggatttttcagacaagagtactggagtggttgccatttcctactctaggggatcctcttgatccaggaacgaacccaagtctcttgtgtcttctgcattgcaggcagattctttacccctgaaccatcagggaagtataatattaggaaagcctttaatgcctctaaccctcccttttacttatctgtgaaataggtcaagtaaattcacactgtgaaaatgttaactgtggagtcctatccactcattccttcaggaagtcttaaaggagtgcctactgtattccaggcgctggactagatcagagattggcaagctatggccatggatgacacccagcctgctgcctatttttatcaacaaagttttattgggaaacacaacatacttatgtgtttatgtattgccaagtggctgttttcatgctacagtggcaaaagttaaatcactgtaacaagttgcacaaggccaaaaatagttactatccaaccctttacagaaagtgtttacctacctttcaattgaataccaggggcacaaggaagattcctaccctcacttatcctatggtttcccaggattgataaatgagtaaacaattataataaatacagtgtgatatcacaagacactatgagagcactaagcaggagctgacgtttagccaagagaaaccaaagaatgcctcccacaagagaagacatgggctatttttaaggatgtcattttggcagacaaaggcctctataggcagaaggaagactgtgtacaaagcggcaggaagaaggagaattacagtacgataaagacatggtgactcctctggaatgataaattaggaaccataaaagaggggataggacagaagcccagaatgtagtaaattagagctaaattgtgatgaacctcatatgctttgctaaggagttcgaaattcattcatagacactaggtaaatcactgaatgatctgaagcaggcagagatgtgatttgacttgtatttataaagatcacaatctttttaaatgtgaagaataactagtaggagggcagcactagatgtagtaggagtagttaagaggctgatacagtgtctaagtctgagataccattctaagggagtgacggggagaggagggaaagggatggctacaagaggcatggaggaagtagattcaatagaacatgctcagtgagtacatgcaagaggttaagaggaaagaagattccagcatggcacccaggaactagctaaatggtgaaacccttaactcaaacagagcaaaagaagaaaattagagacatgaaagaagttgaaatcttttggacatgatgtgatttggtcattgtttatattctattaaagaataagaaatctatgttggaatgcaggaaagctgattgggatctaggtatgaatctggtagtctggtttaaagatagcattgggtgaggtcatgaataaacccaagggaaggtgtgaacctagaagagagctgaggaaagactcctgggggtgtccctattgaagaagcggccagaggaagagatactgggaaaggaatctgagaatagtagacctggttatagaaagaaaacttgatggagcagaggtattttattttgtggctaaaactactgcttccagaaaagggacctagaaatttctcatggtaatgggacattgagcagatattctagtagggctgctgctgctgctgctgctaagtcgcttcagtcgtgtccgactctgtgcgaccccatagacggcagcccaccaggctccc

SEQ ID NO: 57587 - DNA, 969 bp, Bovine  19866880720525
tatgaaagtgtaaaatattatgctatataaggcattactactccaaccatcttcaccagaacagagatgctcaagagagtacaacatttaggaggaagcacagaacgtgtatgcgagatttaaagttgtctgaatgccactatttagtttcagcaaattctattctattaatatatcatctgattttagtaggagtataacctgtatgtaccaaatcgtggtcattagggctaaaacactaaagccttatctagaggaatttgttaggaaatatctcagtagctacctatgtgcaatactttgtccaaaagggcattttgtatatacaaacgggcaaaatgttgatgattgaaaggttttgtgactaaatggtatttaagtgcaataatataggagcttgataaacattggaaagtggagcagagagaattctctaagtgataactgtactgatagattcttgcttctgatagatgcttgaagagcaatgcagattcacagacaaaaccaggtctgtccatgagagtccagtttcccaaaatagcttgcaaggatccataatggagggtcttggaaaattccaatccaacatttggattggaattttcaatcaaataaacaaaaacaagagaaacagccaggctcaaaagaattgatttttctaactgccagaacaaaactctgcatttgagcctgatatctttggctgccttcagtctatccttaaatttgaaatcttataagcaatgcaaccactactttgagaaattattttgtagtctaatggatctcattgtcaggaaatggtttttgatattcagccaaaatcaagctttccagaaacaacttttatttgtgcatttccctcctttaatatttatggctaatgtagatatttcatttatgggcttcttttttcaagcttcaaattggtagatgaggaaagggaagatgaggagaatttcttca

SEQ ID NO: 57588 - DNA, 1844 bp, Bovine  19866880727341
agaccttccactacatatgcacagaaaggctccttgaaggtcaaaaagtgaggggacaccacccatggtaaatgatgccaacctacccacagtcctcgtcattagaggactaagagatgcatgcacacccatgggaggaccctgagacataccaaatacagactcgtgcatccatgctaagtcacttcagtcatgtctgactctttgcaaccctatgaatgatataacctgccaggcttctctgtccatggtattctctagccaagaatacaggagtgggttgtcatgccctcctccagggaatcttccagacccagggatctaacccagtctcttttctttgctgcactggtaggcaggttctttaccatgaggaccacctcaaatatggactcagaaacaggcaaagcaagatgattggcaaaggaaacccagaagaaatgccccataaaagtgactcacagcactgtaagggtaccagtctctctctctgaggccgcctatgggtctatccacacatactctttttcctctaatgaacactttacttgtttcactacccatctctatattggaagttcatttctacagagttgtgggccagggtcttgtcactggtcacggatcttgtggctagattcagtgctctcactgcctcatcccaatctcaatctctggccaggaactgaaacttgtgcttcaattgtgcaggcggaggccacctgagatcactttggacaaatgagtaagtattatcatgtcctgcctctcaaatctggagaaggcaatggcatcccactctagtactttttgcctagaaaatcccatgaacggaggagcctggtaggctgcagtccatggggtcgctaagagtcggacacgactgatcgacttcactttcacttttcactttcatgcattggagaaggaaatggcaacccactccagtgttcttgcctggagaatcccagggacggggaagcctggtgggctgccatctatggggtcacacagagtcgaacatgactaaagcaacgcagcagcagcagcaccagcctttcaaatcggagaaggcaatagcaccccactccagtattcttgcctggaaaatcccatggatggaggagcctggaaggctgcagtccatggggtcgctgagagttggacacgactgagcgacttcactttcactttcatgcattggagaaggaaatggcaacccactccagtgttcttgcctggagaatcccagggacgggggagcctggtgggctgtgcgtctatggggtcgtacagagttggacacgacttaagtgacttagcagcagcagcagcagcctctcaaatccactaaacttaacctagacccagttgtcatcctctgtaatactaatattataaggaagagaggtcaggtaaatatagttgaagagctaatgatggtgaacaggtaaatgctcaaagtagtcaaccacacaccattcaatgtttattcagaaaagtttaagattgtaaaaatacatatcattcaagccatatttaaaagtattacaaaatgctcagaaacctcaccctctaaatgaaacttcacaaattaagtcattgacctgcattgagttgaacaccaagcaaggtgccccttcttctaaagtaatgaatattcttcaaacagcaagggaacaaggctgctgtttgatgctgatgacattgaaaatttaggagaacggaaatcccatcatttttcatttgtatgcaaatttgtctgttccagaaattaacccccagaccccacgtcagttttcatctccaggaattttttttgccagcaccacacggtgtaggct

SEQ ID NO: 57589 - DNA, 2192 bp, Bovine  19866880745109
tatctattagtaagtattgaaacattgcacactcttggaaagtactagctttatttctttttctttttttttaaatttgtattaatatgcatttgagacatttttaaacacacagcacaaacatacttgacttatgatttatcatattttgtttttcatactttttgatggcatcttaaaacaagactttttatctcaagtttaaattgtaaaataattaagaacataatagtaggtttcaagaacatatagtaattactaatgaacatgagtacatatgtaaacatacacattattatatactaatatgagtatataatatatacttatatttaatatacttgcttcttggaagaaaagccatgacaatactagacagtgtattaaaaagcagagacatcactctatggacaaaggtccttgtggtcaaagttctggttcctccagtagtcatgtatggatgttagagtcagaccataaagaaagctgagcaccgaagaattgatgccttctagctgcggtgctgttgaagacccctaagagtcccctggacagcaaggagaccaatccagcactagctttatttctaacctaaaacttcagtactaaaatttctgatgatttaattctagccttgatttaaaaaaacaccaaaatgatatgatcttctgtagaatgatataggatatatatgtcttatataggatgatgtaacagacatatatttggcagcagctagttatttattcttccagcaagatttcttttagataaacagtcacagaaaggcagtgtaggatgatggaaggtatttatgttttagagtctgcagcttaatgctaagcctaatcttctgagccacatgaacttgggaagtattttgcgacttgcttgattcctctgaaaaatgaatttctttcaaatcatttattgagcacctaatacagagtgaggaaaacgttatgctgtataattctcatagaaactttatgagctagaaattattttccacatgatttttccatttcttctgtatcctgtgttatcatcagaaatgaatgatataaaaagtgccaacgagttttcctttcccaggaattttgaaaagatgcaggtagtaaaatggaaaagacactgtttgttgcctctttcctttggatctgtagaagtaccagaacaaaagagatgggaatagaggtaaacagtacatttcctaggatttagaggtactggaaatgtccacaagcccagcaggcttttagctacaagactgcatcacctatcataaaactctaaagctgtgtttttgtactgagttcacatttaaggtattaataatgccttcagcacaagttatttccagggaattaatttcctagtagtcagtgggttaaatcccctacgaaataacatgcaggtgacccagttgtattgacctcaggtatagaatttcagatcaatagctgcagtacttggattctgaaatataaaataatcgcaggtgtttttgttaccccaatgggtgttattagacagggatcactatggcaattgcaggttcttatcatattaatgtttgtttttggtccaaaaagaaactacttaaaaaagtaaatgccttctgttccctcttcttggaatatgtaatgatgactttcaaacatataataaaaactaacagtatttcaaacagcacaaatgatcattaattgatcttacatgaaataatatttcttcttcaggagcagagcattacagctggatgcaaaattctttttggtctattcaccttttaactctgtcatgaaagcataacagaagatctctcaatttgtgaccaaagagaaacattaagccttcacaaactgggcttggaggtagtgaggcagtaaagggaaatacttttatagctacctgaaccatgacattgactggcatgacatttgctagtgactaatcagtgaccagacatcgcttcaagcattgacgccaatagagggaactgattacccatgtggtaaagaagctgagagccaagtaaggaagagtgtagtaaccaagtaactagagactgcagaaagccactacccagctagaggggcaaatggaggagtgtccccatcaccagatggaagctggagccagaatggactaaagacatggaggagatggatccttgggtagggaagcta

SEQ ID NO: 57590 - DNA, 910 bp, Bovine  19866880758746
cctggtaggctgccgtctatggggtcgcacagtagtcggacacgactgaagcgacttagcagcagcagcagcagcatatctaaagtcactatttgtctactttgacacttctatgcagctataattttcccttttttttttcctatactcacttaagggtagcttggttcaaatgctcccagcagcttgcctctcaagtttccagattccttctcatctaggaaggctttgtaatacttctatagatgtatctgatttccttttgaaattacttttaccctgaatggcacattcctggcacatacaccaccatttctcatccaaatccccatgtagacattattgattggtcacatagctctttcagcttcagggtcgttccccacagagcagacagccaccatcagccaggtaaagctgtgtcatctcagccaaagtgggtctcttggtccattgccaccattcttttataggtgttatgaaaacaaaaatgcagactacagacacacccttatgcttccaagagaacaggaggcttgtgtctgtttcctcaaaaattccctaagtctgcctttttctttcaatctttattttaataaataaatataagtcttatagtgaagatatccatgctgtcctgtgcttagtcactcagtcgtgtctgactctttgagaccccatggactgtagtctaccaggctcctctatccagggggattctccaggcaagaatactggagtgggttgccatgccctcctccaggggatcttcccaaccctggagtcgaactggggtctcctgcatttcagacagattctttacctgctgagctaccaggaaagcccaaaatatgcatacataccctgtatgtgtcaattatatgtaaagcatatacgtacataggtaaga

SEQ ID NO: 57591 - DNA, 1905 bp, Bovine  19866880769757
tcattgaccactggtccccatcttagatgaacccggaacaatagaccaatcctattaccctccttttgagccagatcttcaactgttaaaaagttcctttgttaattcccactttagacaaatgtcaccatctacatgtgaaggggagagaggtgattgaggtttttaattgatgtggatttaattatgctaatttagacagctgtaaagcatttcagtatagctgcataatagggagagcaaatacaggtgcccttcactgtaggggcttaatttttaacctacatagctttaaaacagaaagggagttcaaaagcgtgggcaatttacaatttatagagggaggtccacccacgctctgaaatgtttagcaggctctacatgtacttaagagagagtcgaaagaaaccctcaattttgattgaaaacttcaaatttgtctctaactataagaggcaatttaaaatgatgtgtatgtcaagactcgatttgagataacactaaactagaagctgggaattaaaaaatgacctttattttcatctcggagaaagaaatctcacaatggaaatggtgataaaagctagcaagaattttaaaaatttttgaagaaagggcttttgaatttttgaactttaatgacaaggtgagttgacttcaccatgtatctgacgacgactttcattaccaggaacgtgacatgacactcagtgttatcagcgggaaaacagtttttgttcaaattgctgaataatcctgttttgatttcttggcattttatctggagtgaatgatgcagcagaccctactgaagttgtactgagtcttaaccaagtacgacctaggatcctgtttcaaggattagatgctcgagaaacactaagtagttaaatcactgctccaaaggcggcctggttttaaagggcgatgttgcacaggccggtatataacagtatgaatgaagaggaggagaatcaaagacattttatagcacttttagtgtgcatgtggcttgctgaggaagggaggtctgaaaacactccagctcttctgttctctttctcctctgggtgactcttccttcaaggcccaagctgccccctagacactgagtctctcctcctaggaggcctattgcatttctagaggacaaagagcttatcaatgaatcatcttcctttctccccggccatttccttctcaaccttgtcaggcttctcttctgtgcattttcctttgtcctacactaatcagacatgtaattagctggcaaagaaaagaagaaagaagcaggggcatctgtcctctgtttcacacagtgggtggagagtgacctttccaatcctgcccagtttttggtgaaaacacacagatttgggcatgcattttgactcaggattttactaattcttccgatcttggatgagctgtctaatttctctgacttctttgatttatcaaatgaaataatcattcgttgttcatacatttgttgactctacctatgagctgtggatgaaatgtttctactgttctgtccagcacacaataggtacaaatggtccttgatctgttcctctcatcatcacccacaacgcttcgcgctttctccatctcagcaccccacgcctcactctgtctttctctgacccatagcttttgttgttattatactttcatttatttacttatttaacttatttttggctgtgcttctcattgcggtgacttctcttgtttgagagtacaggccctagagcacaggctcagcagttgtggcgcagaggtttagttgctccaagacatgtggaatcttcctggaccagggatcaaatccatgtctcctgtactggcaggtggatgctttactgagctaccagtgaagcccaattcataacttcttta

SEQ ID NO: 57592 - DNA, 1848 bp, Bovine  19866880781628
aaaatggtacagatgaacttattcgaaggcagaaatagagacacagatgtagagaacaaacatatggacactaagggaggaagcaggagtaggatggattagaatactgggattgacatatatacactactatctataaagtagataactaatgagaacctactgcatagcacaaggaactcgcaatgctctgtggtgacctaaatgcgaaggaaatccaaaaaagaggggatacatgtatacatatagctgattcactttgctctacagcacacactaacataatattgtaaagcaactatagtccaataaaaaataataataaaatagaatttaaaaatttaaaattttaatgtttaattacaaaaatttttaatgtgatagagcaagggtttaaactcagagcttctaaccccatattcacatattttcccattgagcttcactccaggcatatgatataacctaagtaaaagatgcctccgttttctaatcttggtagtttttgcattaaataacaatattattattatgtaaataatatactgcagtataaatgtatatgttcatgggatgtaaatgtcattattcgatgataaatgcatttattgtataatatggctaatattggggctctctcaggggctcagtaaagatctgccggccaactgcaggaaacacaggttcgatccttagatcacgaagatgttctggaggaggaaatggcaactcactccagtattcttgcctgggaaatcccatgaggagcctggtaggctacagtcatggggctgcaaaaaagtcagacacgacttagtgactaaacaacaacaaacatatgtaatgataactcccattagtctgtaaacctaggacactggtgatgtaagtcacacagaactgaacatcaaatagttaggatcacaaatctcaaacttctgtgatttcttcctgagtccagcataatcaatcctctccctttacctcacaacttttatccatcacccaccagctctagactggcaactttttgataggataacaagatggatgaaggacaatatccaagattgatgtaacaagaatggagtgtgaagtgggaggggagaagtcaggcatagggctatgtaggaaattatttcataagctgctacagtcaccattaaacaaagtccaagtgcccttgataaaacaatctgtagtacttctcagtgcttattccctgtagaccacatttacatgagtgattatataggacccatttcctcccctggatattaagttccatgaggatactgaacaggtctacttgcttaccactagaccctcagcaagtagcaaacagaagttgttcaacaaatgtggttgagtcaataaaccataaaaccctgtaaaaatggcattgataatttcttcctatttcattcaaggtcgcaaatactcaccctttactaccactaattactatttactctcacaaacgtaacttaatgcacacattctatcatcatctaaatataagaggtagcattttatcatattcaaaatgatacactttctaaggaaaacagttctaccaatagtcctggtaaggtgtttagaagtcatgttgcacatcatgggcaactctaccttctctgagctgactagactccataagaatatttaacccaaggacagtcaagtctataacctgaaagattcaactggttaaccattagactgacattttttattagacagagtcattatcttgctactctacattgacttctatgccaaattttaactcagacctggtttgtgcaaggtaattatcaatatacacaccacagaaatttaaaataa

SEQ ID NO: 57593 - DNA, 1716 bp, Bovine  19866880787465
actcagcaattgcatataatgatgtgaacagtggattctctaaaaagtaagatatagttccaccaacttttattgattgtaacagccttgttccacaagtgttaaaccctgaaaaataggtgtaaagaaagcataacaaagacagaccaaagaaaaataaaaataaacagagcaggtaaaaaaaaatacccataagcaagcaggaaagagtgctggatagttcaagtactttaaatgtcatcatcaatgacttacattatatgaagttattttaatgaactaagtcatgagaagagatggaaaaaacaactcatgttatattggtgcatggattacccataggagagcaaattaaaccttacattctttactaatcaccacaagcatcagaaattcaggtagcaacacaaagaggtcaattcagaggcctgtgagtggtaactaaaactgataaagtgtaacagagcagcaagtctgatcttacacaggggaagggcagggcggtggacactgagcatataccatactctgggtaaaacactttatctgtgttctctctcactttttccttatatcaactctatgatttaacgttagggaaactaaaggtcagatagggtaacataattcgaccaacttgcccatctagaaagtggctgagccaagactgaaaatcacccaggtgtgattaataatgaacttaatgttcttcccctgcaccatgtccgcctataatacatgagactcttccctgacccccaaccctcactctggtgtactttgaactaatccatcagctcaccccaagaagtatcagccagctatgcaaacaggactcaaagaaaaaaggaagattcacctgatagcccgaaggaagaagcagaatgggcatagcaccaacaccaccatgcactagacttttccaatattctctgcagacagaaatgaagggaacgcataggaaaagtttctaatcataaaggataggtaatttatacaaaatttacaaagagaagcataaaaatctgatagttgtatataatattggttcattcagaagttgagacaccaagtcccagaaaagaatggaaaatcattttcaggttctgagctttaaatgctggaaactccttttcttcactcctagaataaggtttacatgaaaagcccaatgtttactggaagagcaaaatatgttataagcaaatagagctggctgagtcatatgtattttcatctcaaaatgagttatagataggacagctagatattttcagtgaaaataggaacaagttcctatgcaactgaaatgttttagactcttctaagaaatttctgcacaccatttactactgatgaaattgatctatgttatcagtgatgattaatcctaccctactaatattactaatacaatgaagagccctggtcacacattctaatcacctcatgagttttttcaagtggtaaccaaattgtgactatatcactagctataacttcaggtaaaaacccctctgctgtaattttcccaggtattaagtgaaggaattaagacaagatttctaaagttcttgtttcttaggtactcttccagctctgcaaagttccagttctatttttcataaaaataccaactgcctaaagttgaaaacaaaacaaatttgtccacaatacaaatgtgtttgacatttctaattgtgctatttcagttaa

SEQ ID NO: 57594 - DNA, 1347 bp, Bovine  19866880848070
agagagtgaataaaggaagataccactcatctgccagtgtaaaatagatgtcttaccatgcactgtggccaaacaagttttaaatctgaccagaatatgcctcctgggcagtggcttcttttaactttggaaataaattattcccttaaggtctccctcatcagctttcagatacattcacaagctatggataaatgtataactcaaacgtatttagaaaatttgtggatgtaacttagtaagatgtagatctaatacaatgaactattcatcaatagtagcaagttgcaagccagatagacactggtccaatgatgggaaattccctcagtatcctagaaaatgataaatctcacgatagttcactgtgatccacaacaattgagggaggaactcactatattgatgattcttagctataatttattcagggatggagactatttcttaggattagcagtaatccagttaatggcaatagagccatcttgatgaagtaggcatcagtttgagagaggtgttagggaaaagtttgagctgatagtattggaaggaagtgtgtctgctggacagaatacagaatgaaacagtaagtaaacagaatacattccaagctgttagagtcagagtgtgagttccaacctgaaataacaagaatatttaataggccaattggataatcaatgaactcacagaaatggctcattttggggtactcgtatgaccatctgccttgaatgcaaatacagattattactgattacatgtcttataattaaggtagatgagacaggtggaaggtggaattaaggaagggaggcagtcaggatcaaggagatgctcagcagagctctagttcctgaaaaggagactggcaaaaagcacttgcaccagctgagaggatctggtgcacaatgtaagccatcagaatagggaatcagaagccaagaaacaagataagggtaaaggtatgaaactgagtttcaacaaagacaggatattgagattgggtacattctaaattggattcctgagtggctcagtggtaaagaatctgcctgccaacacaagagactcagaaaacacagatttgatccctgggttgggaaaatcctctgcaggaggaattcttgtctggaaaatcccatggacagaggagcctggtgggctgcagtccatggggtcgcaaagagtaggacacaacttagtgactgaacacacacatgcacattctaaattatcagagactgagatcatgtcaagccccccaggagtgagctaaaggtctaaatccaatgccaagcatcaccaaagcttagcatctaaaaccaaaggcagagaaacaag

SEQ ID NO: 57595 - DNA, 3039 bp, Bovine  19866880883955
cttgcctgggaagtcctatagattgctgaacctggagggctatagtccatggtatcacaaaagagtcagacatgatttagcgactagacaaaaacaataggtacagatgggtggacaaacagttccagagagagacacacagagaaaaagagaggggagggaagaagagaagggaagggagaagaagagagaggagagggattgacagataacaaggaaccaaactgatctacatgcttgtggggttggctgagtctgcaggccatagggcaagtaatccgaaagggaagaccgcaaccaggctggaacctcataggcagaggctgaagctaattatccatagacagtaagaaaagagacatgaagccaaagctggaatttcctgagcagaagtgatttggagtttctgaccccagcgaagacttcagccctcttttaaagagctcagctgattagattttaagaaatgtatttaaataacctctttaatttattgaattgatgttaggacaattaagaaacaattacaatttatttaattgtatttattataatggtagctagtaagttagatacaatttgatacatctaaggaatagactgaaattataataattaagaaaaaataaaggtctaaacttgaataaacagaacgaattacattggtgattgaggacatacaaaaacataacttaaagtgaatttttattaatatggcaaacatattatggcaaacatagaaagagtaagtaaataaataactctttgtatattcatgtaaattttgaaagctgtgcttagtcttgccagacaagttatttatatttctaaatgtatgtagcagaaaattctgtgacaatttctagtcaagacaacttctgttaacagtggaaatgatgtaaccaaggctagttcggcatcttgttgatgatcaagacatctcaagaagtttgttttggaggctagttacacttctggagatttttattatagactacaccctcattatgtttcttagctttttccttttatcaaatgtaatatgatttcaaaatcctatagattttctttagatttccacatcaatttaaagccttttactatataagttttcattatcttttaagaaaatccttttcatgttgtgtaaagcagtaatgacattttcacagttagtattataacaaattttacttttttaaactttttaaagcctattttaaaacaaaaactagttgcttaggttaatgaatgttttttcagctttaaaatgttgcagtttttctcccatcattccctcaaaatggctctactgtccctcccattgctattttctttccctccttcttatttctctcccccttaaactcctcctatttttgtttttttgtagctggctttccattaacatttaagaataccctttaatgagcattaacgaaaacatccgataggaacaaaggagggggcaaaggaagctagagagggaggagaagacggaagagatgaacagcaggcattgctatcagtcttcaactaatttctgcagctgactctcatttccagagctggaccaaagttctacagtattgcataggtgaccaaatcagagaaaatgaaggatcttagtaacaaaaagtctgcaatccttgcaacatggattactgccataatatttacctttaaatggaaatggcaacccactccattattcctgcctggaaaatcctatggaaagaggaacctggttaggctacagtccatgggatcgcaaagagtcagacatgactgagtgacttcactcactcactcatgcgcgattgaaagtactgggaatctagtcactgttggtctgtttttaaattagtttatttttttttttaattgaaggataattgctttacaatattgtgctgatttctgccatatatcatcatgagtcaaccatagacatacatatgccccttccttcttaaaactctgtcccacatcccaccatatcccacccctccagattgtcacagagcaccagtttgaactccccagagtcatactggaaactctcactggctatccattttacatatggtaatgtatatatttccatgctactttctccatcatctcacgctcttccttcccccccacccacccatgtccacagtctgttctctgcatctccattgctgccctgaaaataggctcatcagtaccatctttctagattccatatatatgtattaatacatgacatttgttctcctatttctgacttacttcattctgtataatacgctctagttgagccacctcattaggactgcctcacatctgttcttgtgtgtgtgtgtgtgtgtatctcttaccttggtggttcagctggtaaagagaccacctaacaatgaaggagatgcaaaaaggttctaggttcatccatcccattagaactgactcacatatgttcctttttatggctgagtaattattgtacaatcacttcgtggtaaatagatggggaaacagtggaaacaatggctgactttattttcctgggctccaaaatcactgcagacggtgattgtagccaggaaatttaaagatacttactccttgaaaggaaagttatgaccaacctagatagcatattaaaaagcagagacgttacattgtcaacaaaggtccgtctagtcatggctatggtttttccagtggtcatgtatggatgtgagagttggactataaagaaagctgagtgccaaagaattgatgcttttgaactgtggtgttggagaagactcttgagagtcccttggactgcaaggagatctaaccaactcaccctaaaggagatcagtcctgggtgttcattggtaggactgattctgaaactgaaactccagtactttggccacctgatgcgaagagctgactcatttgaaaagactttgatgctgggaaagattgagggcaggaggagaaggggatgacagaggatgagatggttggatggcgtcaccgactcaatggacatgagtttgg

SEQ ID NO: 57596 - DNA, 1485 bp, Bovine  19866880894298
tattcaccaaatatatattggatgacttcttatggacatgatatactgaacgttaaaaatggtaagatgagcaggacagggtaccacttttatgaagttcacagtccagcagcgaaacagacatgtgacaggatctttacagcacaagggcaaccccacaatgaagacatgaaagggcctgagctaacaaagggtctctcttccactgctcatggtgtttcaagatgacatccttgatgatgatgctccaaatgaaagaagatagaacacaaaagcaataaatgcattgcgatttgagacctgttgcatatgttaaagctggctttttttcccctttttactggaagccacttattagcagggcctgtctcagtttggaggttctgcctttttgcttacagactgtctgacgcctttataaagtgggccactatattgttgattactgcacaccagggtgggtctgtgagctgcttttttctgccatgccacagttagacagaatcttctgaagttctggtctcataggtccttggagaatggttagtgtttcctaagaagcttaagtctggatgatttacatgtaacattttaaactcctgttgtgtaatgcctggactgagatttatatatactgaatacagtttttcaggtctgtgcatgacattaagttacatattgtatcagctacccccatttatacatttggctggagaagatgttcatgggatgcgcagtaatgagggtctgaaaattctgtattctacccccaagtattaataccatcatgtgcgtagatgttccagctccttaggataatctcataatcaagtgattaagtgttttgtcaacccaagttagatgtgtttaattctgacgtgaaaagacaaaagagagaggcaactgggagaagttaagatttgaaaaggtcagaattcctgaccggggttcgttttctcccattaacttttttgctttcttccaagtaaacagcctatttcctggatatgagagtttgtcaaatgatctaaaaaaattctgaaaacaatttcaatgaatgaaaaataaaaacttatactcactgtcatgagcattaaagatagtaatacgtgaagatccattgaaatgtgattatcaagctacactgactcaaaccagaagacccagaatgtagtgtgtcaactagaccacatgtggtggcagtgtgcatgttgtttggagtgtgtatgtgagatgtatcattgccatagtgtaaaagagttgaattagcttccacttgactagatgagagctcttagttcttattttgaaagcaatcaattgagcatggttaattaggatatcaccaagtagttaagaaaaaaaaaaaaaggcaagccacttattagaaagtatattttaaatctgctcacattatagtgctgatcgaaggattagaaaagaattcaccaaaactgggttgttaggtgctttctgcacaaacac

SEQ ID NO: 57597 - DNA, 1042 bp, Bovine  19866880898882
gtcttctttttgctagattaacatcctgtttgactcacctcaagctacacttcctccaaaagcgttcccaaatttctgtggtgagtcaggagatcctcaatattcagtacatatctcttccattgcaacagacaaagtgtattacaacaagctaggtatcaatgtctgtttgtctatccactagactactagactctgaagaagactactctgtctcatttacctttatctgcaactagcaaagtggcttaatgatatttgaaagtattcagaaatgtgcaatgataaattagtgaatgaatagatgagggtattcaaatgatcattactaatatacttctcattctgtgctaaaaattaagataaaattgctaaaatatttttaggaaagtaatagattattgcttcatcctggctacttgtgctggttggtattttaaagtcagtatttgtatgcctctctgaattttctcttaggactgtgaatctcaaagaaatgacattttttaataggtctcatgcactgtacccagcaacatcaggtacacatatctgttttatcacacaatgaagatgaaaatgactaagatttggaggagagagaagagaaaatcctagttcctttgcttaaagttactgtcctctcagcatatttctatcatgccttctagcctccagttttaattgagagaatcattctggttcatagtaattcttgatgctgtcctgtgggctctgacttagaattttcaaggctctattggaggcaaggaaaaaggaaaaactctataatgtataaaaagatagtaatagtagttttgataatttttagaagactgagaatagtttcctctatggtcagtatatttgaaaaaatctaggaaatttatgaaaatccacacaaaagttagaaaagggtacatgtcttcttcaaaaggttgttgggattgtgttaaaaatttgtgtctaagaatctgaaattgtatgtacaatttttacctccaagataaactagccataagatttggacaagtttcttaag

SEQ ID NO: 57598 - DNA, 733 bp, Bovine  19866880915735
tagaaaaaaaaattgaaattcattcttttttattgagatacaattggtaaataaatttgtatgtttcaagtgtataacattgtgattcaatatttgttagaatgcagtagtatacaaccagtgaaacatgaatcccagataaatcaacataaatatatctctaatacttaatattgagtcacagagtaatacattatgattccttttatataaagtacaaaagaaggctaaataaaatagcagagattcagatttttataagtatatgcacatatgatttctacttagattaatacatgcacatacatgacaaacttgaaggaaaacaagggctggggttagttcacataattcaggaaagtagttaccttcagggcagaggaagggggctttcaactgggcagaaactcacaaaacataggctttcaaatacaaaggtaatatcttatttcttaagctgaattaagagcagtgatcattttgtttttaaaaaatgcaacttcggtatactatatccattcttttagtatgctgtatttcactatataaagtattatattcacaatagacaacacaatactttatagaagtaaaaagtaagtctgagtaggaaaaaggaatcgagtctaaattttaggaaaattattctggtggacatacagaagagagacattgatggtgtctattatccccaggagaatatgaggttcgaaccgggcaagccagtcaaggg

SEQ ID NO: 57599 - DNA, 1234 bp, Bovine  19866880936819
aatattgggacagtatggtagaatttgaaataaacataagcttttcagttatataaattgttgataggaaaatcatcattaaatgatcactcaaggaccattcctatgccaaatttatgaatagtattgtaagaatgaagtttccatatcccctaagctatagaattatgatatagaaatagctagtgtttgggagtgcttactaagctgtaagccccattttaagcagtgtacatgttctctctcatttaattctgtgaatgaacctacgaggtacaatggcattatcatcacacccattttaccaggtggtaagtgaggcactgaatggtttgtcaatgtgcccaaggtgacacagctgaaaagaggcagagttagaattcaaaaccaagcattctgactctgcagcctggagccataaccattgttctgtgaggattcggggtttgggaatgaggctgaagttttcgttacttacatattaatagatctataaacttgagccagtcatttaacctcactaatattctgttttatcatcttgaaaatggccatctacctcacagagttgtttagaagcataaattagattatgcaagtagtgtttctagcactgctttgcataacataagaactcactaaatgttaatactgacattggtacatgtatttaattttgatctttagtattttgaagagtcttcctaatttgtttaaggaaaggttaccttagaaatagatgactgagttctcttagattaacatattttcaaaaattcttttggatttatagggaaaaaatagcatatggaatgacttacagaagactgaactctatgtcgtcagtctgaacttagtcatatgtcgtccttttgtttccatttataaaagtcttgattcaaaattaacatagatatattatattagcttacttagtgaaaacaaatttatccaatcataaaagagatgatgaagatagggggtcaatttatttgtttctagagacagactcctcttgccaaatctgatatgcttcagtgcatttgtcttacttcagaagacagcagaaaactcagctaactggtataattatataacttggatagtcatattgaggggcttcagctttggcaatataatgaggaattacaaagttcagtgaagttgcaggaatttaactggaattacttatcagcattttgactgggaataaacagaaaaggaacaaattgat

SEQ ID NO: 57600 - DNA, 1398 bp, Bovine  19866880941443
actaactccctaagttgcctttgggagtaactaacttgcctctttgggctatttccagttgcaataaatatataaaaccaattaatgtttcagctaatttttcacaggcttccagacataggtcaagaaaagagttacatgaaatgtgacatatgttccagtcttaaactaaggattctgttaagataagcagagttgcggccactctttattgagaatagctattcagattgtatctaattcaccaaagcaaaataaatgataatcctcccacttccttttgccagttctcatttttattttctacagaatttttttaatgatttcctacattttctattgcatatttatatgtattaacttatttagactaagaataaaagattctccaactccttcctttggcgaccttggaaagcataaagccttggttaatataatcagaccaatcctagaaaattaaaatcaccacccaaaatgcttctgcattaataaaaaatggagccagacagactgttaggtaaagcatatgttaacaaagcacagaagtggttaaacacaacgacatttccctatataggagaccaaaggcccaaatattcaataacaaaaattttagccatatgtgcacttgtgtagaacagattattaactgttatcctctgtaaatataagaaatgaattacaataaatctgaatagttttaaattattttctttctgaaatcacagccattaagcagtggtgatcattcagtggaaatattcatcaagatacatgtatgacagaaataccaagttcattttgggatgtcaaatggaggcagattctacaaatgcttatattcaaaaacattttcagagtaattacgcatttttggacaacgttttcagcatcctttttctttttttcttacatatgtttctaaatctgtgtttggaatccaaattttaaatttaattacaagcagaagaatatgcttacttaacatccaatttaatcctaaattaccctgaaattcatagaggctcatgggagtttagggtttggaagtttcctaaagtttatctaatccagtggttttcaaagattaatacgctctagaatcatgtagttgttctttgggttaccctggtggctcaaactgtaaaggatctgcctgcaatgcgggagaactgggttcaatccctaggtcaggaagatcccttacagaagggagtggctacccctccagtattcttgcctgaagaaccccatggacagaggagtctggcaggctacagtccatggggtcacaaagaattggcatgactgaacaactaacacatttggaatcaccctagaagacttattaaaatacagattgctgggtttcaccctctaagtttttgaatccat

SEQ ID NO: 57601 - DNA, 1578 bp, Bovine  19866880976360
atcttttgagctccccctccggtccttaactctaccttccatgataagattggtctttgacacttttctgtattttttctctgagtaaagctcccaccttcaaatactgttacagtggaagttaggatttcaatgaaacaatttggggggtagagtgaacaaaaacattcagtagcagaaatcattcttgagtggaaaattttagatgtgctactaatcagtgtggataaagtttcttgccttattctggcagtatctttttatcactgcaacacaaggtttaactagctctttattaatagtagtttattcttatttgattgtattattggggtctaaaactgaatttaaagtttcgggtgtcacttttacccatttctctttcacattaaatttgtgcactttttaacctacaagaagatttatgaatgcaaccctctactattgtgctttttccctcatgatcccaggctatcagaacaataacattggcagaggagattcgctttaagttttgcatattcacaagacttatctcacctgagtcacataacaattagaccaaaatgcaagtttttaactgtaaatcctttagtcttaccatctgatcttcctctcagcattgtggcatttgcaaatccgaacactgtgtattccttgggtcttgaatacatttcaggaccatgcagcatagactggaaagccatttgaaacaatggagcaatgagagagaacaatttataacattttgttaagaatttcaaatactgtgccaataagaagaactgtagaaaagagcatcacaaatttataatatagacattctttagacatttggacagttttaagaagtcatttgaattataaatgttatagtctaatagaataatgttaatgtataaataaatccagaaacagctcatgtaattacagtttcaatttatgggttacttaccatattttcacttgcataaagccaagtacaatatgtccatttttccatttaaagtagtatttaggacctcctttgtgataggtgttgttactcccattgtttcagcttagaaaactgaggctcgtgaaaatgaaatagcgtaccagctgggaagttgctagctgagatttgaaccccaaactggaagactccaaagctgttgttcttaaccaggaaactaacacttctgcctaatttggatgaagtgataacaagtctacttagaatttaggtaattagtagatttagatgtggctcagataaagactctgttgtcaagaattataatgagaggaaactaaatagaacatgaataaattgttatgttcatacacatggtcacaaaacctcattatttatttaagaaaagcttctgtcctagctattcaatttataacaaatttaatgaaatttttttattgctttctgtatccaaggcaacattgcaggtactcattctcattcctggtcattggaaaaacttttaaaaataaaactaagcaccagtgaaattcaaacattcctagcagatgggagaagaaatccttaaagtgtagaaacaagactctatgttcttactacat

SEQ ID NO: 57602 - DNA, 2690 bp, Bovine  19866880993305
cttcaaatcaaatttaagggctgagaaaggtattctagttggtcccattccttgattcaagcctccacctttggcccaaacaacagtaacaaaacatggccaggtttactttcttgaagaaaaaggaatatcctggtgagttttgagaacactgagtgaggcaaattggaaaaagacactggacccgtattatgaaagggctagcatgtccaagtaaggagccaacagattcttacctaacagataacagaaaaccactgctggttttcaagtcaaggatattgacccatatgatgagactagaggagtccaggtacatgcagacttgaaaaggctctataaccttccaagatgggagggaagcaatgctggtggttctgatatacttgggagagcagaaaaagacaataaccttagcagaaggagctggtaagcaataagtgagagagtcaagtgtctgagcagtccctctagggctcttggggggaaactgaaaaacagaaccaagtatcaaaaccacaagtgagactgggcacatacgcctcagtcctgctgcatcctaaaatcaatgaactagcaggatgcacaggccctttagaagaaacttttgtacagttgaggccgacaagaaacagtaccaagaatctcaggaaagtatcttttgtcattctacatcatcatttctactaaaattaaaggaacatgtgttcaaactttcagtccttatgaaattagaaacccagtgtctcgcaggttatcgaaaaggatttatgtttcctctagttgttttgggcttgatttcctgcttcagctgaacccacaagtcatgcatgcctgatcacttaccagtgttgcctcatcttaactttgccttgtttctaaaagctcactctaggacgtaggacttagacatttactgaagattcatggaggatagaaggattacatctcacccagcctagcagataatttaaaatttaaacttcagtactaggcattcctattactccccttcttattctccctatgccctccactgggaattttgtggggtgtctctttcatttagcccccaatttcccaccatgtaattctgcctcaacacccttctttcatattctttctttttatacatgaccttcataagtctatttcatgttttatagagagaatttggttagctctttttctgctgtgttctaaggattatctttccacaaccaaaatgctgtgctaagaaagaaaaattatgtttttgcccttaagaggaattctgctaccagctattaagtcaggcttttcccctagtatacttgaatctataacttgaacatagtggtacctcttttttacttaagtatggattagtatatctaaactgacctgcagattcgtctactgggataccctgtactgtgctggcctttctggctatcactgtctgacagcatattaggaacaccactcatgtcagaccctaccccttgcctttcctcttgacaatttatagatccaatgctatttagacaggtggagaggtaatctcaccagcgaggcaattcccttgggccattatacatgcaagatatttcctcaattcaaaaatgctattggaggatttcactgaacactccagtaaagaaattcctgaaactgcagtgttgaaactagcaaaagggctctgctataagaagtaatattctcaccaagctgttgataccatttgagaaatttacatcttgagacagtatcggatggcagtgataacaagctcctgtgtcaatgattctccatgtctgtcaattgatctcatcccaggtaaagcaggggcagtgactgtcttattgcaagataagtgcaggcccccaaactaccagaagcacccatgaacactttagtgcctaaaagagagtgaaatcctatcagaaaacaatgaacataggttctgttcagtttcctttccaaggaccatgtctgtatgcttgggagttgatttaaactgcttcttgtttttcaaatactcaaactgtcctacccacttggggaggaaatatttgaagttatcgatcattgagagaaaaaaatacaacaggcaaggatctagcagctatattaatgtacatattgctgggggaagtgcttcaatgtcctgtccctcaacctctccccagtgtttgaaagtgaagtgaaagtgtttgtagctcagttgcgtccaattctttgcaagcccatggatcgtaccccaccaggcttctctgtccatgggattctccaggcaagaatactggagtgagttgccatttcctcctccaggggatcttcccaacgcagaaattgaactcaggtctcctggattgcagacagattctttaccatctgatctatcagagaagtccccaaatccctgaacccaacaatgacagagctgtgaaagaccaacacgactcaccctcactgagtagtgggggtctcttggcaaccagggtgaaaacatcaccttagcaggtgacagacacttgagccttggctagggcattaatgaacgatattaataaagactaattagatagtgtttgttgaaatgtttccaaagtgatgagcaaaataaagccaacctaaagaaaatattgaaaagcctcccactgagcatgctcagaaagagcatttgaacttcttttatttttaaaatg

SEQ ID NO: 57603 - DNA, 951 bp, Bovine  19866881056872
agttacctggggtctccttggagacttaatgcaagggttcacagtggagggggcgtgtggtggaacacgaaaggtaaagaaggccatggaaagcccccggacatcctgggactgtgtgttccctcgcgctctctgaatcaataccctgcacaaaagttattacaggtccaggccttttgccttcaaagctgcttaggccgtatgtggcattaattctcttctgtacaaaaatgtggttgataatcacctggctaaggaaaggatttagggccagaacagcagatttcctcacagattacagaataaaacctagtttcttaggataaattgggacagttaactgtagtgaaatatgttaccctcgttgattcatgcccatgtgatacctttgttacatgtcactgaagagaaacatttacgccattatgggaggtgagatctgatttctactctgttctaaggtgtgctgtgctgcacaatacatatttttattttcttggtttagggagcctgctttaactccagaggccagttattaagcaagcacttagctcagttgactcctaattatacagttacaaaataaaatgatccgctacgactggtccccttccttgtcaccggtgagcacagtcagggccctgaactgagcttgcccacatggctgtcagagactgcagaatttccttcccaccatcactcccagaacaggatacacctctccctgggagaaggaagatttggaacagccaaagaagacccaagggttttttcagcatgacagcaaaccgaaattgtatattttccttttcttttttaaggaaaatcatgagcaaaaacattgccttaattcacatttcaaaaagtaattactacagattcaagacatttatcatgttgtcattggaaccgggaaaggttattcttgtggtacttcaggtcacaaacaag

SEQ ID NO: 57604 - DNA, 1106 bp, Bovine  19866881093643
aacatttttggaaagacaatggaagaccttttacttctaaatgatattttaccctttgttttgtgttaactttgctcgacatgttaagaaaaatgttaggagttactcaaaccagactgtaatttgagacagacatacagcttgataatgtaatttcttgagtggtcataaacacctttgagaccaagtaatttaactataagtataaccatgacaacctccatatcaaatgtggagtgtaatgcaagatgaaaaaaaaaaaaaatgctaatctgagggttttttaaaagtcattgttacttcaatttagttacttcaatttcactatgatgtgaccaagggtatatgtatttcttatgctgttagaattaaagatacaaccaaaattaacaaaaaataatttattttcacttcaaatgaatttactatacttgacataattaaattctattcctcttaaatgggtaatctacctatttgtaggtagccatatcatttaacatttttcaaaactctttgtatatctggaatactttagaatgcatttcctatatacagtttcaactttattaacatggagtaaaccttccttaggctcataatcagatttgatcctaagcaaaatgtgaaagacatttagttcaaacataggattgttttagtcttttgtaggatgtcaaggagtttattggataacccaactatgttttgggcttccctggttgctcagtggtaagaatgcacttaacagtgcagaagaagtaggttcatccctgggttgggaagatcctctggagaaggaagacaaccaactcttgtactcttgcctggagaatcccatggacggaggaacctggcaggctacagtcagtggagtgtcaaaagagttggacaccactgagcacacgggcaatgcactttcatagtaggatagtggctgtccttgagggaaaaaaagaaagcatctgagtaagaatattggtggatcttttaaaattgtcctatctttaacatgacagtaaagaaacaagcaactttagtctaaggtctgtagtctgcatttcacaactaaaccaaacctttaggtccttttctcattgcacagt

SEQ ID NO: 57605 - DNA, 1109 bp, Bovine  19866881131564
gaaggagccttgagaggtgccacctaaagcagtaattttatactaaatcagatgataagtggcaatctacatgctactaacagaggtttactagaatgggattttctaaagaagtatgtgtgggcccagtttcacttatataacaggaaaacactttggaggaggaggaggcgaaaatacacactgaatcacagagagataatcaattgaaagagagttgtactttttttttttttttatgatgggggaaaaatgtcaacaaaagttctaaactaagtttctagaagtcaatccattattttcacgttgatagggacagtttctagtatatgaatagaggaagagaaccaaagtgattttgattttgatgttgaagggacagagtattttaggggatattgatgctaagagcacttttttgctttgtctacatcccacagagaaagttatcagaagtcaaagaactgacaaaatgtgatttcagtggaggcaacacagcaataaagacaaaataggattctgggcaataaatctttttctactctgtaaatacccctctttcaatataaaggctctttaaggaaataagacaacaaagctttcagaaggggcttgatacattatttatgaatttatcaagtgaaaaaaacacccactcagacattttaataaaaactttcaactaatgtatctaattttattggtattaaaaaaaagccaattatgaactagaaagttactgtttgttaaactgctatacagctttctgcaaatagaatatttacaaaccacttggaatcactttcccaaagtttcagtttctgaaggtcaaataactatgtaactgcttaataaagaagcaaagaagtacctctaaatatctcccagctctgatgggcttatatgctgctccttaggtgaggtattagcaaagcttatttattttcatttccaaggcttttatttgctcattcccttgtggtaaagctgatttccatgatgattcccttcttaattttaataccctttttactcatcatatagacataagaattttccataaaataatgaaatccttgcaaaggaacgaagacaagtcagagaataaa

SEQ ID NO: 57606 - DNA, 1306 bp, Bovine  19866881155548
aaaatgttttttgaggctcttacatccaagcacccacattgtcaatatcacaaattatttccgttttttacaagatggctgccccaagccttcactatagaatagcagtgctatttgagcaggacttaaaatagttttaaaggtatgatttgctaaaaagcactttctacatttatatgtcacatttttaaacacaatttttctaaaaagacgactttaatgagatttatatatcacaaattccatctgttttatataatacaacttaatgacttttaatcaatttacagagttctctaaccatcactacaatgcaattttagaacatttttatctccccagtaagaatcttcattcctctttgcagtctatccctgttttcatcctcacctcaggaaaacactaatgtgcttactctctctacaggtttgccttttctggacatttcatgtaaatggaatcatacactatgtgatctttagcatctggtttctttcactcagatcagagctcctgagctttgtccatgttgtagcaaatagcagtggtctgttcctttctgaagctgaataatattcctttgcatgaatataacacattacgattattcatttgtcatttgatagatgtttggactgcttctgattttttaatgattgtgaataatattcctctgaacattttcataatgtctttgcccagacacatgttttcattttgcttaggtagatacctagggatggaattgctgagttgtctgataagtttacatttgactttttaagaaacaagcaaataacttttaaggataacacttactaactcttcctgcttagattcattcaagatcaacatgtacacactgttatatttaaaatggataaccaacaagggcctactgtatagctcagggaactctgctcaatgttatgtggcagcctagataggaggggtgttgggcaagaatggatccacgtacgtatgtgactgagtccctttgctgttcacctgaaaccatcacaacatcactaaccaactcgattccaatataaaataaaaagttttgaaaaatttttattgaacttcttataaagccagtcattgtagtaaaccagatagggtcaactcttgttttttcactttcattggaatgaagtgtaggctggacatttaaaatctcctcattattcataaacctaatgctggccactttttcaggtgtcttcagcaaaatatctatcatcttaatattatctgaaacagataccaaagggctatgtgataggttgctaccaggaatccaaag

SEQ ID NO: 57607 - DNA, 922 bp, Bovine  19866881181179
attggtttttgctcagtgactcttaaaatttttctatgcctcactttatcttttaacataagctgcaattgcattccaaagtctgtgagacattgctcaattgaaaactttgtagccttgaaattaggagctctgggtcctagtctgagccttctctaaatagctgtgcagtggagagcatgctatttgtactataagtgcacttcagcatccttatctattaaaaataaaaagaaaaacaatgcttaacctgttaacctcatctcacatgactaatgtgaaaatgtgagacatcgagtacatgaaaatgtcttgaaagatttcaaacaaagtgcaaaattcagacattaaaatcaaataaaggttttttgggggttgttgatggagtaaaatatttccatgaaactattaactgatgactttacttaataaaactgtgtgacttgccaaaaaatgaattggtgttaattataaaattaccttttaattaatgcattcattaatgatctaatcaatatcaattgaaggtttattattttaaggaggatgggcaattagcagtttaacaccatgaaaaagagataaccaactgacggatgggtccccatcaagtttaattttaatttgttttaaaagtatcttcttgaggaatgagtttaaatgcacatcactctttctcctttcagaaaatgaatatataagttgtttagaaagcatatctgaatgaccaagaatgaagttggcatacgtaacaagaaatgagcacatcttctaaatgggctcgatggtatggtataagttctattctctcacacagtaatataactggattgctctttaaattaagtgaatttgtatgtccgctttcccttaatggaatcagttttgatatactactttgttcatgctgttaggcttcagt

SEQ ID NO: 57608 - DNA, 1409 bp, Bovine  19866881181693
ggtaataagaatgttatagtcagtcatgtccagctctttgtgactttatggactgtccacgaactttccccaggcaggaacactggagtgggttgctgagcccttctccaggagctctttctgacccagggatggatctttaccactagtgccacctgggaaggtctgtacaatatatatgaatattaatagagtaagttcatggctttgcgaccaaatggcttgactgaatctgaatcctagcttcactattagtaattctgtgacctggataagtgattttctctgtaatccactttctacacttataaggtgtgatgttaacaatacctccttgaaatggttgtcatacaggatgaggaattactgcttggtgttggtagacatgcaaccatgatggtactgctaccatagatgtttgattccttattatcaatttcatgttgatggacatatagattgattgcaatttttcttctcatacatcatgcactaatgaacatcctcctaagcagaatgctgtgagtatttctaaagagtacattttagaagtgcaattttctaatcaaaggtgatatacatttttaaatgatagatattgttgtgtaatcatcccctaaaagtaactatttactctgtgaataaaagtgaatggaaaaagctggggatcattagaaatattttattaagactttcatctatgcatcaaaaatgcataaccctttttatacaaagaagtgggggattactgtaacacaacataagcaacacttgttttatattatccataaaaatcagaaagctttttatgcataatgctcatgattttcagttctgcaagtctttgagcccctctttctccagagaaagaattcatagcatattgtcttcctataatcagttattatttattaactgcagaacataatattccatcaggcagctattcataaatatctaccaatcagatgtgtaacaaatgcttactaaaattaataagttatgaaacagaacaattatgtcatattctacaggtgtggtagcagtggttctgaaatccagattgaacatagcctgaccactctaccacatattcagaatttgagatggttccagctacttttctggagttataccagagcccaaagaagaaaaaaaaaaaaaaaaaaacatactgaaagcaaatgctttaatgtctggtaatacctggtatacctgtggtgtgagaggctatgtcctcaagcagtgagcactgaatattttacagcttctggaaatacttacacatttctttctagttcttcagcatacagctcatttgaggctttatcagggatcatcacatctgatgcaatgacagcaatatccatctctgcgtatcaaaacagagtccaaaaattttttttaaa

SEQ ID NO: 57609 - DNA, 1223 bp, Bovine  19866881194864
tcagccactgtttccccatctatttgctatgaagtgatgggaccaggtgccatgaacttagttttctgaatgttgagctttaagccaactttctcactctcctctctcactttcatcaagagtcttcttcactttctgccgtaagggtattagttgcacttttaaattttgaatgtcttggacactgcctagaagaaaatctcttagtgagccgaatgtaaaccaatttagcgaatcacttgtttaatatgtttccttatcttgatttggatttcctttattcctctaaaccaccagagcattctcctccttaccaactattgtaactagattaaagttctttctgtggtttctgacattgtctgcttagcccagaaaatatacgcagaacttggagggccaactgtgaaggagtgtgttagtctttaaaacttttccaagtggttcattttcctgtgccttgcccttacagttttggactatgtgtgtgtgtgtgtgtgtgtgaaattttaaataaccagtgagaaattgaatttttgtttcttcttctagagaaaattatacaaaaaatattgaatgattattcagctaatgctcaatagacatggtaaactgaccaaaagcaggagatcatctgacagtttttttaaagcctggaggaacaagcatgtagggggtgtaccttgtgacatactggtggtatatagctctaaacagagagaagttcagttttcagcgctttatgaaatgctttctgtagttcacaatgatctaagaggtatatagaaattgctttcttaaaagtagagtcacttttatcacttagagacaaggacctagagatatgaaccaaagaaagtacttcatctaaactggtataattagtactaaaaccttaatccatagggtttttttttgtatatgaaaagtctgtaactgactattctttgtgaaggccagtcatttggaaagagccccacaaagtgtgcgacacattgtaaacactcagtaatattggctgaatgaagtaatagaactagtgttactgcacttcagcaacaggtaattagctgctcagatgcctattctgtatcattccccatactaccatctgagaatacagaggagatacacattaaacaaactgtggtaagtcctagaaagaaaagaatagatattgtgcggaagaaagaacaaccactacaataatattttaaaaatag

SEQ ID NO: 57610 - DNA, 805 bp, Bovine  19866881232824
tcatatctgactctgcgaacccatggactgtagcctgccaggatcttctgtccatagaattctccagccaaagatactggagtaggttgccattcccttctccagggatcaaacctgggtctcctgcattgcaggcagactttttaccatctgatccaccaggaagagagcagcgcaattatttttcaaacccagcccaattgccaaacaacccttatgctttctcaggcatgagtcaagaatcagtcctttgtgacctcagaccatgtactacagttgaactcctctcactaagcttcatgaagtattctgatgcctatcttgtaagaggtagggctaaaacacacagcacttcaataacactctgagtttgcctaatgaaatctctccctcttttgatatcctctatgtaataaagggattcaaagatcacaaaattagcttgccacaactctgtatatgctacagcacttccttgggatatagcagtatctgttgaatactgatatgtcaactcaaagttccactccttcaggacgcatgtctttttttatccttttagtgccagcactagcactcaacacatcatgggtcctcaagaaaatgttttttgaggggatgatctcaacaaatgacagcaggtataaataagtggaagagtacataaaattaagcaatgacggatgactttcactatctgaagaactatctgaaaatagactgctcagtgagcgaacactgggctaagcaaagcacatttggtcctccctaatttatacacctagatataggcctgctgctgctg

SEQ ID NO: 57611 - DNA, 1160 bp, Bovine  19866881233172
tgctgcatggatctgatgtagcgttttttgcagtagctagagtgagatttgaatatattaatagttctagcagcagagcccagggagtctagttaataacttatgcatggatatatagatatatttcagacagaggtaaggttttcagctctcatgttggtaatacttagagggatcgaatgaaaggggctgttcccccagagcctttgttgtgggcatgcattgtgacagtatggagccagagttcttctggttgtctacacagcctggattcaataaactgttatatatgcatattatgacaatgtggtcaaggaaaccagatttttttactctaccttccagtgcctatatagcttaaatctggtgtttatttttcttgtccccattcagtatgtaaacatattcataatttaatacaggttatgtgcattttataattaacattatggacttagttgggaaagcactcagaccacactgtatgaaaaatatgtatctttttctatattagactatatggttcagtgtgaatcctaaaggtggataatcccagattatcttactttgctgggactactttaacaaaatgccacagactaggctgcttaaacaacagaaatgtattgtctctcaattatgaatactgtgagaatcattccatccgttatggaagtgtgggatcaaggtgtcggcaggtttaccttcttcttaggtctctgtccttggacggcagaaggctgccttcttactgtgtccttacaggctcttttgtctatgtgtgcacatcccaactgtcttagtcccagtttcttcttcttgtaaagacatcaatcatattggatgaaggcccatcccaacagtctcattttaacttaattactcaaagccctatctccaaatatagtcacattatgaggtactgggagttaacatttcaacagatgaatcggggtgtgtgtggtgaggggtgggtaggggatgtaattcagtccataacacagtccaagagaatacccatatccgggctactgcaaatatgattctcagccacttctcccatcaggaagaaacaaggctgactttctaaggtttaggggaacgagcagcagcaagactcttctcctgccttcggctagacggaaggaagcagcttcaga

SEQ ID NO: 57612 - DNA, 1627 bp, Bovine  19866881288354
taagctctcgtcaccttacacaacccacttcagcatgcatgcatcagaatcacctggagtacttgttaaatcacagatggccagccgcaccccagagattctgattcagtaagtctgaggtatggttcattaattttcatttctaacattgtcctatgtgatgccaatatggctggtgctgagaccacatttgtatgaccagggcctagaacatctttctttccccatctcagtccatcaaaatccaatgaatcccttactgccattgaatgaaccagttcatactctgtgctagcacagtgcctaagggttctaaaggcttagaaccagattactggactctagctaaatatctgcgtgaacctggataagttacttaatactggacccatttccctatcagtaaaactggaaaaaataatagtgcttatagcgtatgttgatgtgaaaataaatgaacgtatgtgaagcacttagaatagtgcctgagaaggactcaattctattatgttacctagtagttcatatctttaatctaacactccacttagcatattatgacatttagagtttgcagaacaaagtcctttactagatattaagcaccctgaaaacagagaccacatctccatgaattcccagaaacataaccccaggcctagcactttatagaaattaagtataaaaacctttcaattcaattgaaattcagaaaagattgcaaagaaatcttaagtaaaactcttctaatcagtaaacaaaaccatccatttgtttttcccttatcataaagatgcataaaaatgcggtcagttattaataatacattgaaagtaggtttgccttttcctttgacttttctaaactctataattaaaacagcttcaaattgaaagattgtaaagaagaaattaatcttattggtaagtaaaaaagcaaatcccatggttgatgatagatatgacctgttagcaatagttccacttttatacttccttctcttacaatcagcgtgtggagaccagcataatccaattaattgtaattcccttttgtagagtcagtaaagtagtgcatgatactgaaacaccattgaagtcttatctctggtcagataatccacacggattttccttttccaactaccagcaggtttttataaacttcaggaaaatagaatattttgacttccttgaacttgtgataaatgtgatacacaataattgtctctgaactttaatcctttgtatatgcctagccatcagttttctaggcttctttctctgctgtacaatggtttcatgaatacacctgagtttttctctatctcctgactgcatttaaaatattgtttttccacagtgaatatgcagtattttaacacaacagagcatctcaactaagctgtttgctgctggtacctcttggacacataacctctcatccatatactcctgatccgtcttgctcactcctggcaaagcacaggaaaaattataacaatatgctgaaataaaagttatgtgactgtgctctttcacacacagaatatcttactgtactcatttaatgccttttccatcttaactaaagttcagcagtttgaggtgcaacagtaaaactagca

SEQ ID NO: 57613 - DNA, 740 bp, Bovine  19866881306218
gaattctgtaggtgattctcgtctagtggtcttaaaagtgttggtggctcagtcatgtctgactctgtgtcgccgtggactgtagcccaccaggctcctctgtccatgggatttcccaggcaggaatactggagtcggtagccattctcttctgcaggggatcttcccaacttagggatcaaacccgggtctcccacatcgcaggcagattccttaccatctgagcgaggctttaggcctttgtataatctcttatactatcagaagcaattcacctttgaggcgagccaagtgtcctaactccctctgtgctcatacatacacagagtaagagatggctactattagttacttagaggaacattcatcttcaatgcatcatgcaccgggtatagaaaaagataactaaaccacattagaaagtcaagattaaaatgaaaatatttggacatttggcatcaaatgtgctagtagagtgcatgcaactctataatatcacatgtgtattagttttttcacagtaatactaccacactattttctaaatttcctcatcaatgatttatttataagccatgccagagatcactataataataacatactataccccccataaccattttatataataggaaagcttcagtaaagtggcagtgaatattctccaatcaactgtgcaagcaaagcataattatattcaattaacataggtgggaaatggtagagattaagttatt

SEQ ID NO: 57614 - DNA, 1173 bp, Bovine  19866881336052
atagtgggactctactaagtgcagacgcaccccttattttcacttcatttcctgtcattttccctgcctttcaattacagcacggaacatgttccctaaagaccacccccaggtggcagtgcatgttgccacctgggggcggtgccacctgggctctctaaagaccatctccaggtggcaatgcatgtttgattctctggtactcagcagagacatcctttatttcagggagtcttctaaagatactctttatattacttggcttccattacaagctaagcaaaattctatttaattttatatttattatattgcactctaatgtatctgatatttttttacttgcctcattaaatattctgcttttcaagggttttcctagagaaggtatatctgggtttccatgttactatattacgttattgtgtgcataatagcatagagaggtatgaagattaattatattgtgtgtgtgtgtatatatatatatatatatttatatgtgactttcttgtcagttaagtacctcaaaaggtctaaacatatctcttgaaataaattataagttttacattttttgttcacctttcaataaactcctcttatttaaactcaggtcaataaattataatatctataatccttttaattggcaaaattagcttctaattatttatttagttaaaccctatattatagctgtataaaaaggtggctgaaaaatggcagtacagtgaatccaagcctatttttagattattcaaattaatgctgtttgtgacatacagtggtttattttataaaccttcctaataatacatgaagcatgaattagagatatgaaggcatattaaaaaagcaacaacaaaaataatacaccaacacagatgagaaaagtgaagtgaaatggaggttgcaagaagaaatatataaaaaaagacagagagagcaaatggaaagtcctaaaagataaattaatgtatgcccaaaggcaatgaatgccatttagtaataaatatactagaaataaaaatggagccaattagtatgaacaagaaagtgcaaaaataatcaggaataaagaagaggaatatccagagtaagttgcacgagacgcagagcagtatgcggaagattataaaataaggaagggagtacaaaataatagaaagg

SEQ ID NO: 57615 - DNA, 893 bp, Bovine  19866881343877
ttagagggagagagagagacggaaggacagacaccaaaaaaacccctattttaatatgtcactccactaaataatttggtaattttatttaaaaggttggggttatagctgatgtgcaaaaacaggttatttgagtgatgggcctgtgcctttatcacagttggctggtctttctccctctttcttccctggaaacaatcgcgtattggtgttggcaaggaagcagagtgtggtctagtggactggaaatcaggtgacttgaggtctggttgatttttttcccccttctactttgaagttatgtgtctccactccataaaacaggggaactgaatttctttatacacttataagcagaggtcaagccttggtaataataattttttctccttacctgatgctaaataattcaaggtaataggaagtcaatattggatctggaacaaaagatggacaggaaggttggatgatatgacgagacaagagagatagagattctttaattgagtagtgagactactgacaggagaaaaaaaaaatctaagttttgaaattccaagatctgttacaaatctgagataatcaagcaactagaagaactggcaatcccattctgggctgtagtgattgatttaaaaggctccaacactggtgggtggtcacggagtccctgatcaagacttagcaaagtcagctttgttgagcacccattgatcattatactctggacctcctaacatgatgaatgttaatattgcctcttttctaattagacctgttcttctcttcatcatgatgaaaagataaacataaggtgaggagacagaagcttgagaaaaacaattcacttaacaatatcctcgaaatggaatattccctagtcctagtctata

SEQ ID NO: 57616 - DNA, 1003 bp, Bovine  19866881353815
tgggcttaatcaaacttaagaaggtagcagagtgtctggaagtcatgaatgatgatattataaacttgaaatatctcatttccgtttttgtgttgaatcagatactctgttaggcttaattccaatactgaaagagatagcatgtatctaataatatttttagaaaatttgaggaaaaagcttaacattgagaattttattctttaatatatgttatccactgtgaaattggggaaacacagtgttacttaaactttttgataggacaccacttagagctaaaataatgcagtttttctactggagcaaagtttgaaaattgtgaattgaatgatcctgattgttaccataggccacattttaaggccaccttcgtttcactttataaagatatatttttcagtatatagactcctggaagcaacatgactttcagagttcagactgcctttacaagctgtctttaaatgatactttaaacagtttttggctgatgtgatgtgcttcatgatggatatacagaaaaaataaagcaaaaaccccaaataaaaacaaaaacaccaagaccccactatattttctttttctcttagacttatattttctttctttaatagattattataatgttttgtttattttaaaaaaaatgaggaaaattttcaagcgtttcttttggagagtagcaccactccaccatttgaatagccttggcaaataatgtttgggcaaatgcaaggctgtttccatagtgttatttctgtttgagtatgttgaattgtataaataatagtcttcacagggacatcatctttggactacatgcactttttcctctctcctgacactgttactaaaaacagttgtatagtagagtgtgtatgtatgtgttgtgtatgtgttagtcgctcaagtcgtgtctgactctttgcgaccccatgaactcctctgtccatggaattctccagccaagaatactagaatgggttgccatttcctcctc

SEQ ID NO: 57617 - DNA, 696 bp, Bovine  19866881377531
aaaatcctgaactcatactctttcgaaaacctttgctgactaaattcaaggctaggcaagataactttcaacatatactttctacaaatgcatttggttgttttgatttaaagcaatctagatccttatttcattatatttttaatctgtatctggactctctcttctttgttgtgatctgtcttagcttataactttattgaagaagcagaatatgtcaaatacacttttagacagcttttcagagtactatgagaatttctggttcatttatttcacaaacaattactaagcaataatctacctgcaatgcaggagacctgggtttgatccctgggttggaaagacctcctggagaaaggaatggttaccactccagtattcttctctgggagaattccatggacagagaagtctggttgggctacagtccatggggtcacaaagagtcagacacgactgagcaactaacactttcacttcacttcataagtgccagacactggaccaggttctagcattataagaatgtgtacatgtgctagtcactcagtcattgtttgcgacctcatggactgcaacccttcagactcttctatacatggaattctccagaatggccagcatatatgcaccaccgtggaagtcatataaagcagaagtgttgtttcagcaggaaaagatagactatgcaat

SEQ ID NO: 57618 - DNA, 1123 bp, Bovine  19866881380348
cttttcgaagtgggctgaagttaaaaaattatgaattacaagtataaacatataaaaagtataaaagtatgatttaagtaagtatgaataatacaaactgttattttgctgctctgctgtgcttagtcattcagtcatgtctgactctttgccactccatggactgtagcctgccagggtcctctgtctatggggattctccaggcaagaataatggagtgggttgccatgccctccttcagggcatcttcctgacccagggatcaaacccaggcctcttaggtctcctgcattggcacgcgggttctttaccactagcaccacctagaaaggcctttatctataactacttgccaagtgagagtgctactgccacatcctgacagcgtaatacagaggaaataatcatggacttcagaaaaagactgatatggattccaattcaggatttacattacaagcctacattctctgaaagatttttgtattccatagaatagtctttgccaagtgcttgatagagtagtttgcccctaatatatgtgtctcaatatatcacaatcatcattttattgataatactttaaaacagtatgaacagtgtattatatctatggaacaaatacctgccttgcttactacaaattcaactagcaattagaatttttgcaagtttggatgagaaagttgatcaaactgaagtctgtttaaaatcaacacctttacattacatgattactttgtcaaaatgattatttttaataaattaaaggatttaaaaaaattatgctatgtatttaaaatatattaaaatccacgtttaagtttaaaggtctgtttgcttttggttcttctaagaaaaagcagaaaataaattttacataatttgccattttaaggaaattggcataatatttataatatttacaatctttctctgatgtggtctacaatttacagaaccacaatttaggaaaaagaagagataaaatatgatcagtgaatactatttgaagagcataagtatcactgaattagattatggaaatgaactgaacaatatactatgaacacagttataagatgctttctaacatagcatgcaaatgtgaaaattgcattt

SEQ ID NO: 57619 - DNA, 1424 bp, Bovine  19866881396993
ttttatgcatacatgtatctattctttttcaaattctttttccactaggttgttatataatatcaagcagagttccctgtgctatagagtagatctttgttggttatcaatgttaaatatagaagtgtacacatgtcaatccaaaacttcctaacttaaaagggttgtctcgtttgtctccctttacctccatgataactctatgtgagtttcaggcaaaatgacataaaaaaaaaaaaaaaaaaacagggaaaaaagatctttctatgtgtctcagagctggtatgttgctgctttttctcagtttgtgtgttaacaattctgttattcagaccattgtgttgaatcatatcaggacactgagaaatacatgaccatgttttttttctggaagaatgtattttgtctttcactgctgattggaaatagaggtttttgtaatgaaagcagataaacagcataggttagagataatgagggcaggcaagaaaggtgtgatttctttttatgttgtagccatgaaactgaaaaatataagaaagagaaaaaaatttttttaattaaggtatggaaattatcaacttgaatcaatggaaaataacactttacatgaacatatatagggtggctgttttatttcatttacagctgagatgtcattttgttcaattccttggaatgtcagcctttaaaacatatatatgtatgtatgtatgtatatataggacagaataacagtgatagaaatagtaactgtaacaccacaggctttttcgaagccttccttaggattttgaagattttaaaaggtaacaaaaaatcaatttcatggatatagatggcagttctgtaagtcatttttgtgcttacctgggggagggatttgcttgtagaagttttaaataaacaatctaaatggaaaggagagattagatcataggacagaaaatttgggggattatatacatcttttctgtagcctttcttttttattccttcatagatatactcgatggttactttgtggtgggaatagcatggatattatgaggcctcagatttatttagaaaggtaaataaagctcttctctattgtcaagtaaattaaaatgcactagagcctattaggagaaggcaatggcaccccactccagtactcttgcctggaaaatcccatggacggaggagcctggtgagctgcagtccgtggggtagcctgagagtcagacacgactaagcgacttcactttcacttatcactttccactttcatgcaacggagaaggaaatggcaacccactccagtgttcttgcctggagaatcccagggatggtggagcctggtgggctgccatctatggggttgcacagagtcgaaaacgactgaagcgacttagcagcagcagttttaagaaggaattttt

SEQ ID NO: 57620 - DNA, 1669 bp, Bovine  19866881411031
tggtgtggtttcttatagatttacctttactggcctgattgacctgatcctgcacacagaggccaatagtggtctctgggatctctgaaccttgtctgggtggagttggcatcacaccctaccaacagaagtacaggataaaaacctcagtagttgcactgttatgctgagaccagtttaagaaaaaggatatcagaggaacaaacctagggttggcaataaaatcactagaggttgctgagcatggttaacacacggaacaaggagagtgacccactgaatctcaaatagctcaagttctaaaatctgaagaagtgggggaggtggataaaaggattaagggattgtgatttgggcagttcttaatataatctagccaggagatcttcaaatttcatttctgtatccaaactctaaacaaacaattaggtttatttcatgtagaaaaatgatggtgctcattactggagggacagagaaaggatcccctcctcatcccagtaaaatgtaagttttgataatttatttatattcccttaaaatatttgtgactaaggatgtggttaaaagccatggaacaaaacacagctaaatgacctcctcagagagtaagcttatgtctttggtcttaacttgtatagaatcacactaagtgaacaattttttcctgtctgcattctgaaaattgaagtgattgtccattgtcaagcaagggcttcattctttgctctaaactactgatgaattttataaattcttaatcaaaatctttgagggaaattatataatgcaaaatatttttatttcattatcttcctcgagatcaatgagtttaacctttcagtcttactaccttctgaattgcgacagatggtgtaggtggcaaatattacacatttggtaagaaaacatcatggatataaatacccttgtctttttccctcagatcagtggagagctttaagaacaggataaatacccatctgcctggaaaattgcctggaggcagggtgatggactagatgtctcagattccttctagccttctgattcagagctcctcactgttgccaaaagagttagttctggtgggatacatccaggactgcagacccttctgcctgtgtacataaggcctggagatttttcaatgagattagctaagaacaagctttccttttgatctctacagaaatattgctgcttctgaaatgtgtctgctctatggacttgaaggtgtggggctctagtgaatgatgaatgaatgaaagtgaatagatcttgctggagatgaggatcaccctttcaggggccccagtgtctttgtaacttatgtgtatgtagggggcttggcatgtagcctaaatacctaagctcacctaccaggtgataaactgttggggtcattatggcagacaatttaaaacagttaatggtactctcatctgcaatatggtcttacagtggaagctgggagtctcagtcatgggataaatgttctcatttacaatcctaatgagcaaagagacagcagtatgctttcatgttgatgtatacatgtaccgtgcgtgtttatttttgtttttatttaattttcaaagcaagccatactctccttaaaacatttttaagaaagcagaaatgtatgaagactaaaacaaaaataatc

SEQ ID NO: 57621 - DNA, 1089 bp, Bovine  19866881441556
atcagcccagcacatccccaaaatgtctttgtaaaagaaatcaaattatatgagttaattgattccaggcaacatcagcaagtgcaggtggagactgaataacaggatgtttattaatgaagtactattaatcaaaattgacaataccaattcctctttgttgtatttgaaagctaccttcagttatagacataactgttgaattttaaatcagttttaaaaaggaaaaacatgggggggcatagtaacacatgggatttttcgctgtggattttggattactggtatttaaacactggaaagctactcttaaatgcaatttgacaagcaatgccaaagatgccagtggtaattaattagcacttaattgagaccacagaacaacagaacgcagaattggtactcagtgccatttcccccttaaggctccatctcatgagggtcaggagtgtggctgcatgctgaaggtcaggaagtaaattgggagaacacattgacactggacatttcatgatggatctccttcatcctatactactgctcccggccatctctgatgagaaaaaggactgtgtttgaaggggagtcagtgttcatgcacatctaaaccaaggtaagcactgccttcatatccaaaattagttaggttgatcacttcacaaaaagataaagctcctacattgaatgttaacatgaatgagagtaataggcctgtataaaagcaaattaaatttagagtgaagtgttatttgaagttactggttttgttcgtttatgttcaatctttgtaaaaataaatttagactgggtttcttttttaatagttcggatttgtatgatgcctgttaaagactttagagatgtttgaaaattcaaatttagaaattgtacatattcccccaattcttcttcagacactgaccccctgtctttaatagataggtgtcaatattctttaacagagaggaaagaacattcttgattcataatttcattgactgagcaaataaaaaaggaaactaattgtagtctctgaataaatcttgagacactttcgatgaaaatgtatagtagcatgtcataacacag

SEQ ID NO: 57622 - DNA, 1484 bp, Bovine  19866881558982
tgatggtggtggagcagccttctactctatctatccttccccagctaaccagtacaagaactgagtcaagaatgactatgccttatttttgtttttcctcagatttcatttgaatgtaaataataacataataaataggtacaactgaaatttgtgaagcaggcaccacagatggaaactataacaaacgtgtcactgcttttgcatctttaatttataatggcataacatacagcatcttcccatcgtaactccatgtataatgccaccttataaaaggctgttatggacattacttttctctcctggctcctaggtttttttgtctaggcatccgaggggaggtagccctgttcagactctaacaacagtaacaatgataaaaatgaattgactttgttaggatcgtaaattttaaaaaaggatacctttcatgataccaatatatacttctttaattcctttctcactcagagcttccaatactgctcttatttccatgcagtcaaaggctttttgtgctctgcagacactatacacaatggttcattttatttgaccatcttctccaaacagattctgaattcactcaaattccatggatgatttcatacattacatacgccaaagggtagagaatccataggattaaatttcaagtcatttttgaaagttttcttcgttatcggctctaagtttcaacactatcgctttttgttctctctgagttatattacatttgtaaataccaagcagaaggtcaggtcaaaacatatctcataatgatatctaggaaataaatataactaaggtctataaatacccgtatacagataatatgtctattgtaggtatgtgcatatatatagatattgcttaacatactggtttccttacttgtccaatgagaactgttatctctccctcctaattttgtgtgagaattcagtgaagagatataaaagatctagtataggcttgttatacattattagaaaatttatttgagtattatctttgtcagtcagactttggcaaatattttcagaatcttttataatatctggcttaaattactccttttactgtactgtcataagagatgtaacttctgatgaaaagaaaagtttgactctttaagtaagaactgataaacaattgatgcttaacaaatatataacaataatacagctgaccgttgaacgacctgggtttgaactgcaagggtttacttaatatacaagtttttttcaaatactgcagtgctaaatgacccgcacttggtcaaatcagcagacgcagagccatggctacagaggaactgcgcatatggagggtggattataaattatattccggttttcaactggtggaagttttgccacacctaatcccctcagtgctcaggggtcaacggtaagtacaaatcaaaaaaataaacccaacaacagtgactgttttctgatgaaataaaaatctaaata

SEQ ID NO: 57623 - DNA, 1033 bp, Bovine  19866881623743
tcctagcagcattcttgacactaaacaagcacaatgagctgctaatacagcatgggtcatttattttctgttttgggtcacttctttcctctattgaaggaaaggaacatgacagctctctgttaataatgccaaactcaaaaatccattttctttctaaaatctgagtatcatgtccctttaaccacacctcctttttaatcctggcattcatttctgtccatatttttcaagatcctacttagtaactaagacatgccacctgaaagaattgagaggttaaaggaaacccgagccaccatcaccagttcctatgagcagagtcgattatgctttcagagctgctatgtgcattctcccttagccctccttcctcacagaacccgaagagcaaaacaatacatcgccccatgaatatattatcagtaccaacttgacagcctcgctgttgacgatactggttgtacttcatttccctcctgtaatccaaaaccagatccagcccccctgggcccagactggggctgtacagcagctgaagggccaactgccaatgggtctggaacagagtgtttccagcctcggcacctgacttcctggctgcctccatgtcaggtctcattggttgatgtggcagctgtgattctgacaacaagcttggtgttgggtcaagtttttgtttggctgacttactcccatagaagccattttccttgactcacccttgattactgaaaatactctttattaccttttaaaatcatgtgatatccataagtaaaaattgggattaacatttttgaaagcattacccatgactgattttttttttttttttttaatgctgaaatgcaagaagtaaagccagaggcagctcaatcctgtgtttagcacagtggtgtatcaaataccatttgtaacttcagaataaaatgcacagcttttttccttgttcttaggaacctggatgaaatgatcacctacggaaacagtttacagatgcaaaagtatgtagtgtttatatattagaaag

SEQ ID NO: 57624 - DNA, 678 bp, Bovine  19866881922036
tgtgcacctgtaagttcctattaatacacaatctttcaaaagtaaacttgagcatgagccatttgaatatttcatagctaggagggaaaaaatgattttgtcttaacaaaaatacattgaaaaaattgtcaattactaacaaatagaaaatgataaacaaatgaaaatatcactgcaaaaaaaaaaaaaaaaaaccagaaaaataagcctcaaagaacagaaagcacttttcatccaaaaatcaaatgtttaatattctcatatagtttgtatttatcatgaatttccagtttaactttagtttctttccattgctacttatggacatggatcacttttctcactctttctctctctcttctgccagttctgctatttcttatcatgtgtatctgcctcgatgagttttaaatggctaaactgtttgcttagaatccaggtgtttttcttagcagattttttttcaagctgaagctggtccctttgaatgtagtgttgaattccaaatgtccccctaaaacataaccatgaaagtaatttctttcctcatcaacacttcagatagttaatagctgcaggcacatgttataaaagaagttgctgaagaagggaacttgaagtgaatttggcatagagttgtggatggtactaaacacatgggatgaagttatttactta

SEQ ID NO: 57625 - DNA, 976 bp, Bovine  19866880824348
tagatgtttagaacattcagttccttttcagtctgtgagttgcaagaaataagagacataatttaggctacttctgttgagcatgatttcattagttatttttttttaccctagttttctttttttgttgttgttgatgttgtttatatgtatagcagatggccacaatcatagaaatcaggacagcaatcaaaggatcagtggtatgatgcaactttgtcaaggtcactggactcacccactgggaaaatagtgacaacatctgaaagcaagtgctgagcactgtatctgcttagtaatcagacaagatcaggaccaagggtgacctggaactgctgaaggaaataagggaagataaaaaaaggagaccagaagtttatttacagcaaggagactacataggcaaaagcatccttcttgctacttccagtagtttaatggtcattgcactcttgatagctccctgttcgttgggataacgtggttaattgcttgagccaaaatgaagataggcacagatttgcataagaatattctcagcttttttttttttagtacacaagaatacatgctgaaatctgagcatttctgagaaatgtcatcaaaattcaaattctcatctgagttcaaaatggtctgggtaattctaatgattttgtgcaaattcaacatgaacacattaatgaaaattatattataaacatctgtataactttttaaaatgttcaaaggattttaattttgattttttaaaccactcttcctttttcttcttgatttcattgtcctaatatcctccgaagcagaaggttttctagtttcaggtaaccaatcttttcttcatctcaggttctcaatttaggggaaaacattcattttttgttttcttacctggatgaatacaactttatgatttttttaagttgcttttattcgtttttgggctgtgctgagtcttcattggtggcccagtttt

SEQ ID NO: 57626 - DNA, 1350 bp, Bovine  19866881183598
atctacttagttcttagaaagcattaattatgaatggtgatttgcaccatccgtcttttaattattttatttgcagtgtcaaggtttgctgattcatgaaactgtaaatttgccagtctatttggagaatgaaaatagttttagctgaaagacactaataatctttataagatattttaatgctatagagaatttagtggctattaatagtaattagcaaaacaaaataaactttgtgataatcactgataaatggaaaataaaatgttatataccattcctccagtgttttaattgtaacctagaattaaaaatattgtgttatctttgaaacttataaaagacaatattctcaagaaagataaagtgataatatttttatgattttgtaaaataagttgcaataactgataaatatagaaaatgcaatttacctgactccctaactctctatctccttgctaaatctttcttacaatggttatacatgaactttcacaagaatcattgaatatatacaatgccacggatatcagaaagggtgacaatagcctagaaaggctgaataaattctgcaagccaattatcacagaagaagcaggtgaaaaccatgcctctagtaacaaaagacaatattatgcaatttatggcttagaacccagaatatgctcagaaaggaacaaactaaaagtagtgattttggtacagcattgaaaatggaaatttcagagcaaaatctgtaaacaaaagtcttaaatcctattgaccaaactgccataaaattacccatctgtaatggatagaatgaaagtgaaaagaaagtgaagttgctcagtcatgtctgactctttgccaccccatggactgtagcctaccaggatcctccgtccatgggattttcctgacaagagtactggagtgggttgccatttcagtggcccccaaaatatatgtgcacacaccaaccactggaacctatgaatatgactttatttggaaaacgggtctttgaaaatctagctaagcattttgagattagatcattctgggttaccagaatgttctttaaaccaacggacaattatccctgaaagagaaaggcaaatggagataagatagagaaaaagaaaagacatagacaaagagaggcaaggaacagattttctcctagagcctcttcaggcaacacaaatctgccttcacacttatctctaacttctgacctcctgagctatcaaataataagtttggttaagtcaaaaaatccgggtaatttgttattagaagtcacaggaaacttaaacacctaccctccccctgataaaggaatgaaagtttgttctctctggg

SEQ ID NO: 57627 - DNA, 1406 bp, Bovine  19866880417832
aaaatggtgcgctgattctatttgtgcaatgaatggaagggatgatctcagaactcaccttattctcaaaggaaccaggcttccatctgttgggaatggccaaattcaatcctaacagtccagtggaaatactaaattcagtcagtgacttagaggactccctggtagatgccagtttttagctagtttccagctttaggtcatgatttacagcccgcattcacgaggcagttaaggtcacaataggaaacacgggacacaagtatccaagtaaggataacacatctgttctcttagagaagaaaaggaaaagaggcacacgatagaaaaagcaaaagctccagtggtaaatcaagggcagagctgggaggaggactcacactttctagttctcacctatgacaatgtcgagcactcacacaagaggaaagtcgtattgcttgtgacagcagcccggtcaaggacaagaacgaggaccaacagcttctgtttttaccattgccaacacccttcccaccattgttttgaacaatatcctttggtgttaactccttaaaagccacccatctgtttccgtggaggtgactgtctattatcctctgcaaaaaagtccctgcacagtctgtctggaattaaaaaggagcagtggatctcgccagaatctcgattgtgcaagttgtcattgagaagagacagcagtggattcagggcccctccagctcatttgaaagagaatctttgccttggcctgatgaccggctgaaggtagaaaaaaagaccagttggaatacacacacacgggaggcttagaatccacagtaaaagaggttgcctccccgacagctgggatttctccacttcaataactagggtggagtacttagtgtttttctgcactgctcaaagttacaggagcatgctggaaaggcagaaaattagactttgaggggagctgctctctggttttgctcaatacagatcctcttgtgaaatggaggcaggttcagagtaattcttctagctggggttaacactgccatgattcacaatcctaatgagaatggagtcagcacagcagggtagagatgacctagacacagagggggacagagaaaggaatactttccccaagcctacctgagctgcggagaacttactttcatgctcctctgagcagacacacagactttcttcacttaacagttctgtttgactactaactagggcaactcatctgcagatctagtgcccctcattcaaatggaagtatgtgtctccaggaaagaagatacaggacacagttaaagaatacagattctagagccatgttgcctggtccatcacttcaggtccagaatccctggcacattatcccatctctgtacccaccaccacataggactctc

SEQ ID NO: 57628 - DNA, 1627 bp, Bovine  19866880576406
attacaggcaacaacatggccactgagtgtgagtgaaaatattcaagctgatcactgcaaatactaagaaacactagctgttcacaaaaatgttgactccccttaagttataattgtttctggctcatcttgatattttgaaatatacttaaaataatattccacttccctcaaatatgtttttatcattcttttcatccaaaacatgggtcctttttgagaaaacaacttttattgtcaaattgctaattcccatttatgatctatagtatgaagaattctacacaatcacagaaagtactttcttcaaggaagcagtgacccaaacacagcaaatactttttatgattagttcattcgttctttcagcaaaacctttgactggtgtctgtatgactcaggatctttttaattagtaggttggttggttaaattgttcataaaagccaggagttcaatcctgcttttacggggaacaatgtgatttgtttcaattttaaaaaaaaatatgagtgacaaatttataaaaattagttgatattataggatatagatatactttagccctcatttatttagccttagtgtaaaatgggtcaaaaatgaaaagcagagtggtaaggtgtatggacaaaaccactcgtttgactgctcttgcagacatgtcactgtaggcctcctccaaggataacatccaggcagcaccacctctcaccaccgccctgagacacgccaggaaatgcaaggacacatagctggatcattcgtacctgtgaatccttgactttgtttgtcctggaggatgcctgtgctggtgctctatttttactacattattgttttgaaattttcagcagcatgatcacaggccatatgtgaagtacaaacagaatttattactcagtttgtcagtctctatatttaaagggtttatagcatgtcagaatttctggaaacagcctcttgtataattagttgcctcattcttcagagctaatgggatgagttggaagccagagtgagattgtttatgaaaaatatttcctccccagtactctgtcagaatctgtccctctcatcagtgtaattgtcagggtaatttttgtcaggtctttcataaaaaaggaaaaatattaagggcaatatggaggaaacaaccagatcctaattggcttaaggtacatggatacattcctctcatttttattactggggagaaggtcggaaccaagtgaggatgagaagaaaaataaaaattttcatctaatttcttttaaaattgtgcaataaattgatgtcactaatacgataattgggaattttacataattgaactgaatgatgacttcactaatcccattctgtaagacagaattctattttggatgaacattcttgattgctttcttccaggtaagacccatccatctcattcccagaggccattgtttataataaaattgaaacaattttatgaagctgattacacttaaactcaccctctttctcgggtctcttttatgatttccctttgatagaaaatatagtcagagcttcaaagagtagcctagggaagaaagaaaattatctaggaaaatgtgtggtataaactagggaagtcatcaga

SEQ ID NO: 57629 - DNA, 2917 bp, Bovine  19866880602388
tctactgatctgtgccgggcagagcccaatcttttaattatgtaactttgtatttcatcattttataaggtgtgttttagctcattagcgttttttcagaatatgagagatttcctatagtgtttgtatacctgtcatgctgctaagttgcttcagtcatgtccgactctgtgcaaccccatagatggcggcccaccacactcccccatccctgggattctccaggcaagaacactggagtgggttgccatttccttctcctatgcatgaaagtgaaaagtcaaagtgaagttgctcagtcatgtctgacttttggcgaccccatggactacagcccaccaggctcctctgtccatgggattttccaggcaagagtcctggagtgggttgccattgccttctctgatacctctcatagaatggacattttctatatgcttctataaatttgacattatctgacttttccttctttttttctttctcttttaccatttccttgtttttgcttaagtttagagaaaggaggatcttggacaacagtaagattttccaaagattaaccatgactaatctgagattagttcagataattctcattaagaagaaataaacccccctgagagagaaagcagctaattaataagaaatgaacagagcaggaaattttgacaatcacaattcccattgagttcttttatacagtatatttcttgaaatttcccctaattactgaggttgaggcatagaaaactaatgagagtagtaaatctgattcaaagaaagatcacatagtgccttctaaaatttgattcccagtgtattttaaatttttcactctagatggccatggactatgtaatatcatactgcattcatgaagaaatctttgaattatagtcccagctactttctgtgtttaaccactctagatatactaatggaaaatcagtgacagttctagtcagtggaaaagtgaaagaaagaagtgaagtcgaagtcgctcagttgtgtctaactctttgtgaccccatggactgtagcctaccaggctcctctgtccatgggattttccaggcaatagtactggagtggattgtcatttccttctccaggggacttcccaacccagggatcgaacctaggtctcctgcattgtagacagacactttactgtctgagccactaggaaagtcaaagaacattgaatttagtcagcagaactggattctaagctcttactatagcctgagtgagaaggtgtatgtgtggggaagtagccatgaaaggagttttatctccccttaacaccgagtcctgtctctagcagtgttagacaaaatatattttccattctctttctatcccccttccaaaccagttcatgagcataacatcactaagagtctagaacacacctttatgggctgaatgttggatatgctgtgcttacagaggcagaattaatgctgtgcttggcaaggatacaaagaaattagaaaataaatttgtgtgagatctctatagtgaaaaggtagaaaccagtatgaaattagttgctttgacagctcagttgatatactgattataatgatcaatttaagagtagtaaaattgctttcagaaagttctttcttgagttctttgagattttctctaactttactattcttagataccatttaaaattagtcttatttttattcaacttcattttctaaaacagggaaactgatatctattgcataagaattttatttaaatatacctgataagataaatatttccagtgtgttagagatgagaattttgcttccctcgtggctcagatggtaaagaatctgcctgcaatgagggtgacctgagttccatccctggtttgggaagatgccctggaggagggcctggcaacccactcctgtattcttgcctggaaaatcctcacgaacaaaggatcctggcaggctgtagtgcatggagtctcaaagagttcaacacgactgagtgactaagcacacagagatgagaactgtagcataattaggtcatctgcttaagaaaagtctatttcattgcctcctaatggcatttgaatagttaaatgtgttttgatgggtcagaaggatttttaaagaattgaccttttattaacattttaagattcttgaaattattggcagaatcaaaatctttagccccatataatgtcaagtattttttcccctctatttaagtaagtctttgcctatgattccatgttttgttgtttttaagaacttgaactttagtcagactaatttttgcttttgatataagcaagggaaattagtcaaggggccactagcctaatgaaagagagaagaagaactaaaaaaggacaactgaaaagtggctggatttctatagacagcaataaatacaaatgctaatgatattgacaaatctctgattaattgggtgacagattttcatataattttcatgcatttactttgaggaaatatcacagtgttcttaatattagacatgaactaaatttacttagatattacagtggataaagagacacatttttaattaaaaatatgaactgtgtgaaaatcaaactctgtttaggaagccctctatgtagaaataattttttggtttaatagaattctgcctgtttgaaatgatttaatttactactcaaaatcaatgttattttactttgataaagtcagtgttaaaataatatgaaaggtctaattatcccttcctttgattacactgttagaatactcagaacacatcctatcaagaaacaggaagtaccggaaatccaacagaagggctggtttctctaagattgcaggtcagcgggatttttaatggtctgtgtgtatcctgatactggaggaatacaggatttcaaact

SEQ ID NO: 57630 - DNA, 1099 bp, Bovine  19866880675012
ttttcaagaagtttaaattcttgaagggtacagcatcacacgaattctgtgtccaatggccttagcaggaaggttgcttcggaatttggcactaaccatgccactgtttccatgagcttgagttatctttccccagattactctggttttgttaggttttccaccagcagttactgtgttgttctttgctttgtacacataaggcacatctcttgcctaaatagaattcaatttcatctcgagcatatacaccttcaattttcaggaaagcagtgtgttccctttggttccgtagaccccatttatagccagcaaagatggccttggaccacagccttccagacatatttgtcgttttagaagtcccgttcccagcaggccttcacagggtccaagatggctgaaagagcaggtattattatatttctttttatagatgaggaagctgaaataagtcacacaattattaattgcagagccagaggtgaaatcctggctgatgggtgccagaaactgggccctcaaaaaccaaaaaacaatactgagctcctaacattaaaaggtagattccctgcctgaaagatccagggcacttttctcttccctccatcctattcaacaaaccatccataccagagcagactaagaggatagtccctggggcagcatgatcctatctagacaaggcagggagagagggggattccagataaaagggggcccaaaggaggaagagaaaagtttttccttactgaccataatagatgtctgcacatggcatgaccctgtacaaagaactcactcttttttactcaagcccaaagtgaaatactattttttaccttatctcaacaatttctatatgactgactgcagatgaggctttcccagtggctcaagaggcccaggtttaatcgctgggcaggaagattccctggagaagggaatggcaatccactctaatgttcttgcctggagaatcccatagacagaggagcctggtgtgttactgcccatggagtcaggacattttgcccaaagcccttcggatgccagcttcctcataacaattagtaaccgtgagggttttgagctgcag

SEQ ID NO: 57631 - DNA, 925 bp, Bovine  19866880697778
atcctaaagagaatgggccttcaaatggcatggcatatgttatcagtctaagaaaaatgagggactgccagctgaaacttcaaacaatgagatttggtctcattctcgaaaagataatctggtaccttgtatatatttaaccgtatttaatcctcactaacaagccggtgaggtaacagtgtcagtctccattttaggaaggaaaaaaaggagactgcaggagaaaactggtctgtaagaatcagagctgatacataaacccaggactcctggctctcaatgccatgttctcttattgtactaagaatcctcttactgtactgagcctccctatctcattcacttctttcctgttttatctcctctgacctgatgagctttcccctgattcctgttgagtgcctgctttgcagctgcctctcaatacatggttaatttcccagcattttctgtgagcagatgttctgaaggagcagagctgttaccccatccctggcactatttcccacagattaccggattgaacacagtagctgctggccatccttttgatctgaaaagaaagacttccccactgggatattcctcatgatgatgtaattagcttcctagacatacctaacaaatttctttctaatcacaagggatgagcagaaaggagaaagaaccgttcatcttggaccgtgcgcagctattgccatgcacatgcatcctcctcgtgcaatgtcttctttggtgactgttcaaagattcagaggcaacaagctgctcttcaaaagcaatggggaacttcacattcataaagggggctcaggcacgattgaattgctttttcaaacctggcaaagacattaaaactgccagtcctttcagctcccaactgtcttcagcattaggaacaggtgaagctcttaataacttttgg

SEQ ID NO: 57632 - DNA, 1915 bp, Bovine  19866880802723
taacattaagatgaatggggttttaggattttattatctaaataattatcttgtttcgaagaatttagctttgctagtggagacaaagcgatggttactaaatttctgcaagttatagagatgaagaccttttgtgcttacaaagcaaattgtgattgagaacttagaagttagggaattggtttattttaagcaatctggagagttccatcgagaacagttttgctccttcagtgcagcaaatttttaatttctggaatttctaataattaggtaattatctcaactgtgtttatttcaataagcagactctgtgtacacaaaactgagcataagaacctataagattcttcctggtgtttgacttcaaatctaagctgagatgatgtgatgttatagtaaaaaacaatactactccccttgttcatatcttctggtaataataatgacctctcacattttgtgaacatgtgatcttttgagtctcacaacttactgagacaagctaggcaggttcactcatctcattctgtatgcaagaaaactgagaccagataagtgatttcacacgtctgaggtcagaaagtgagtcagtggcagaatatggagtagaccagaacccaggtaccctgactccccacccagcaccttgatcaaccccattgtcacagccttggtacccatctgtgtgaccttctcagctgaatcaattacaaaagcatgccaacatgcattctatttccagtcttcttctcccagctccatttctagttcatgctcatattttcatggagtaagggctctaacattgaacttagtagtgaagatagctgccctggggctttattgttagtgctacagtgatagcccattgggtgtccgcgctcccatacttttaacttgaaaatatgtggaagttaatgtcagagggagaggagtttggaacagtggcatttggaagcctttatgaaaaatttcccactctccctcctttctccatccattctcagctgattctgaaataaagttgggtccgtggggaaatattcccaattttggagcaattggttgcatgtagtggcaccagttacaaaatatatccttatattggctcttccgccttgcctgcttcactcttaattccttactcctatttcctaggctaggtagcctgtttcctaagctctgctttgtggggaggccagaccaagaagtaagatgtaagaaatgtgggttagatccctgggtagagaagatgtgctggagaaggaaacggcaacccaagtttatctatgtctcactcttcagcacacagacttctcctctgctctcccagttgggttactgcaatatgcctgtctgttgatccaaatcttattcttcattgctctttcttccaaggttgttttccatggtgtctctgaccttaggtaatttctttctctcagaaacctccatctttacattgaacaaggagaaccacagtatgcctgtatctcctgtggcaaatatttatagataactttgtctaagctgaccttcttggtaattcatatatacctttaagtccctcggttatgtatcttatatccacagcacctgcatgatgtgtttattttccaactgcacataatacaagggaagagtgaattgctctttctgatctgctgcatctcccatctgactcaaggttgctttggttataacatgtctgaaggagtgtgacagtacagttctgctgtagttgggttatttgttctgtgttaatgtgagactagttaaaactcataagccacttccttctttatgtcatattttctttatatgccaagtttttggctaaaccaaagcatttggaaatcaaagacaaggagaatttttcaaggatgtaagcatttttattctgcaactcata

SEQ ID NO: 57633 - DNA, 1150 bp, Bovine  19866880937300
tgtctttgcttcctgctgctctgtggtattgcgtattatacacatccacctcatttgacttatcccagttcccagatttgaacatctaggttacccctgatgccgtactatcatagcagctctgaagcaaaagcattcactcatcaccacttatggaactgtgagcatttctctgaagtacccactcagaggtggaataattggacagaggctatatataagcataattgacctaccttctaccaaattgctccctaatacaattttatcagtttgtattctcaacaggaatacattaaggttcccactaaaaattctttttatttttcttttaagaaatttgtgtcatttatgggaaaagggaagactttgccagtttaattttagaattgtatttaaaaggagtggatatggtcctgacaatattagtgtaagctttttgtgtcttctgacagattatacattagatattagcatgtgctcaaaatataaaagcattgaaacaacagtgaatctgtggccaagtattcaaataaatacttttctttaatttgtctttgaaaatccacaagtcctagagttatatcatcatacaataatagtatattttaaggagacatttaaaaataactaacccaaatatatctctgcaacttcttaagcatttccaagaatggtggtgttttgtaattgaaaccacactctattgtgagttcacaaggtaattggcagagtgggggcaggggggttcatgtcctcttgcttatttatttaaaaatcattaatattttgcttttgtatgcaggtgtaattataatgttgcctgagtaagatttttgtttttgattcatttttgtattggaggttcagaatctgaaatgccctgagagaattacaaatgacatcaagttagagaacatgacctaagtgaaaacatatgatgcgtctagctactgttggatttacatactttctttaatttcccccttgtgtgatttctggactttgtgtgactcctttattaacttcttcctaacccctaaaatctaactccctccctagcgtgcttcagagattgctttctaagaccagccatgttattgccaaacatgaatgccttttcttcagtcatccaattttaaaaactctt

SEQ ID NO: 57634 - DNA, 1293 bp, Bovine  19866880938126
catatcagttcacagaaacaattactagttccttcctgtgacagggtggagtaagtgcatctggataagtgtttgctgaaggattaaaccaaagagagccaattcttacctaaatttttgggtaaatgcacttgtgaacagattttgccaactttattttagattcaaatcgtgaatgcatatataccagcagtgacttgaggaaggacaggagattgtttgcaaacataccgtattccttccataaggaagcttaagaagggaatagtattaattaatactgtatattatgaacagtcaagttaaagcctatgtgtgcttgctattacattttttggaagatagttcatcaactgagaatgaaatgcatgagctggaaaaatgcagaacattttgtttcttttattccctctccctctgccaagacagaatggcatatggtatcaaaagaattaaaaaggattacttggcacacatggctatctgtttatccacatgggtgcatcgtttcatgaacttttaactgtggaattaatattctgtgtcttactagctgggacttttttgtgggcaggagactattcagctttctatatccaaccttaccattttctatatggctaccatagagtaagggtttaatgtgtgacaaacattctattgaacattctctgtaatgataattttttcccaaagagaaaggatattgttgcttgggaaggcatttgtatgttttgcgtatggtggattagattaggcaagtttgggagtcacagcggggagttactgcagaatctggtgtttggaaggcagtccagaaaagagtcatcagctatgggatgtgaaactgaaatctggatgagggcaagagggtcaggagagaaccaatcaagtgaaaaccaaccaaccaagaagccaaaatccaaacaaacaaggaagtcagagaacaagggtatgatatgtatgtatgtggagtttgaatttacttgctttgggatatgtccagtagcccccatctgataaccagctgctgctgctgctgctaagtcgcttcagtcgtgtctgactctatgtgaccccatagacggcagcccaccaggctcctccgtccctgggattctccaggcaagaacactggagtgggttgccatttccttctccaactgataaccagtagctcttagtaaattctaagattcagacactgcacagagttctcctttttttttttaaatgcacctgtgacaactcatatttagaaacaattgttcaagtggtagaagagatcatgag

SEQ ID NO: 57635 - DNA, 1068 bp, Bovine  19866881053891
attcatagctgtaaagtaaaaactatggataatttataacttaagaaagttttcttataatgctgtgagggcggaaagtatttcaaacatttaaaaaatgagtatgctggtgttccaaagtaaggggataaatcagaaatcttttatttattcataaaacaaagagctttattattgagcattgcctgtgaccttaacctcgcataaactgaacataatgccacctctgaaatcagccttttcttctgccagagagaaaggctgttgccaaattaccctgattgtcctgaatagtcgacaaataatcatgggaatgctttgaactcatggaacacctttcatccacaaagctcaaaacacttcaaaaagaatgtcacacattcacataatcacccaaacccctcttgctgggggtggggatggggttaagtgtagtagcgtgaagtgttccactttgttcaggaaaataaattaaagttataaaatgaaagtattttcaggtaagaaagtttaaaatacaaggatgactcaactggattgaaagcttatgaaaccgagtgataagcaagtggttgaaggtgaatttgggagaaacaggcaaataccagggctaggatgggggtgacataaaagaggtgcccacaattgcacaagtgcctcattgaattgcacactggggctcctgttctggcttcatcctagtgtcagcaatttgactagagctgcagctctgcctggtatagcattgctgcacagtgtgtggtggtggtggtaaggggcaggctgactttagatgcaaaggcaatatggtaggcattggccacagagcctgagatctgtgatgtgagctcagttcagagtggctgcaaaagcaatcctgtccattctgaggtgggatggatttgtcatctcatctcggtaacttggagaattgaactccactgcatcagatccatctggagacagagcaggtggatatagccaaccaaggggaagagaacttcagttcacttccgtagctcagtcgtgtccaactctttgtgaccccatgaactgcagcacaccagg

SEQ ID NO: 57636 - DNA, 1020 bp, Bovine  19866881200889
cattccttttaataaactcaaggattctcaaattttagcatgtttaagaattatgagccttccctggtggctcagacggtaaagtgtctgcctacaatgtgggagacccaggttcaatccctgggtggggaagatcctctggagaaggaaatggcaacccactccatgcttgcacatacaaacatggatatttttctttacaggagttttaagagattttcaaaagtcaatctaactgtacatgattttagctataggcactaactgtaaaatctgagcccttgatgaaagatgctattttaagcatttactcttaatttttaattcagtcttaccaaatacttttcaagtgctcaactcagagaaacaattattgtgaagaattgcctgaagtctttccattcactaaggtagagatttaactgcaggagtccatgagtagttttcaggagacctaaaaatgcccccaaattatatgtaacactggatttctgtggatatttttcaggagagacagttttcactaccttaatcagattttataagtcagaacttaccaacatttttcatgtcctggtacaaaaagaaaattagattttttttgtattgcatgctgagggattttgggcaatctaagttgcaaatgactttaaaattcatcatattttcttatattatgtaattataaacatgaaatgcaaagcattagagaagatagtaattattagatatgcatgtgtccaaataaaaattttcaaatatttaatgagactctttagcttgcttttgagaaccaaatttttaatattcttaaaatagctagatgcagctctccattaaatttttaaatagggattgtattcaaaatcctgagagtcaccatccatgagaaaattgctacaaataggtaacaaaaagtgtgaagccaatccaagatgaagcaaaggaacctggtttattcgcccactgagaaaaacaatcagttcagttcagtgcgagtcagtccgactctttgcgacc

SEQ ID NO: 57637 - DNA, 1327 bp, Bovine  19866881379554
tgaatctggttgttagagtagcagtaactccaggctgtgaacacaccaatgcctggagtccttggcaggcagtgtgagctatagcctgctgccagctgctgtattgaaggctgcttttgattagaatgcatatgtacatctaaaatttatagttgaacatggattcatggatcactttaaataggcagccagcccaacctttaaagttacagaaggctagagactaaattacacattaacctgagcttgaagatatgctacaaacaggtttgctttggaagtgactggagaccacacctccccagcactttgcttccagggatgttctcaaagattaaccttgggagggttagggcaaaagtgaagtaagaagacagtgatttttgccatatatccaaaggaggactgcaggtcaggtgtgaggtttacttacatatagtaagcatacagtttaaaagagctaagtagatgtcctcagagcaagaaacagattcagatctttttaggtgcagtactactgttaggtaagagctgggaagatgtctgttcagccttgtgacttcaatgctgacatatgcagggcatggttagctctttttattcgttggtattagcccatgtttctttaggcaagagagggaaagaaggagaaagaactaactttggaaatgaaaagatgcaacatttttatacagggctggagaatatataaatgaatattcataatgaatatgatttaaagagtagctaatattgtctgaagctcaccagctttagaatggttgatgatcccttaggatttactttttttctgaaagccttcacttctgaagtttccaatccttttgctcttaaactcaattctgtcttctttatttagcattggaatttgcttttgctgtctccttctcttactttgatttttcttcttcttttttaagaataatgtatcaggtgatgttctttcattgtatggacttctgtgccattatggttttatcttttacaaatgagggtcagttcattttcactgacctgactctacctgaatttctctgtcctgctggtactcatgtcagagtctgagccatcttcctcaataatctcctgctgcctttggggcacatagctcatcttccatccttttgctttttataggctctactttgtaccctaagtctatatttaatgcaccagtcactgtgatatttgcaaacctatgcaaatcttattcagtccattcttttcttgtcaagacatctgaggcaacatgcccttggtcacatgggtatactctcttgcatactggcttggtatttattttttc

SEQ ID NO: 57638 - DNA, 2185 bp, Bovine  19866881383375
cttttaatgtatgtgacatagtatattgaactatatatcgtgatggcgtttcctcattagctatggaacgcattataaaataaaatcaagctttaaaaatagacattgtgcttatggaaaccattgattgtgtttcaagactaaaagcattgagagctttaacctgtttgcagtgtaattttcttatgttcccatggttggaaacctctttaagaaaactattcattccattcatcaggattccttcattaggaatgtgattctccctcaacatatcattttttatgaaataaggcttcagagttagattacctgctggctctaagtgtgggatctagttaaggcatctctcaatgccggtacatgcctcatgaccttctgcaaagttcctctgccactggcaggattcagggcagcctgtttactgtgtgatatgaagaactgttaatggactctgttcagacctctaaagctttccataatcttttgtctacctctgttttgttttgatatgggtccccttttctatgagaggaggagacaatcattattttctcctattttgttcattcaggtccacctgtgtgagtgtttggaattgtgaatgattttgtttttctcctgacctttctagaagctccaggattcaaaccccaacttttttacatggtgagatcaatgtgttatcagtgcaatgaggtatataatcactagcctacctatttaaacttccattagttacaattttagttgttaaggatcattaaataagcattctgtggcctgagcatctaacacctcaaagtcatgcaaatgctggttcatgaattctgataaatacctttgaacagttttcggcataggacaccgtgtttttcaatgagtatgaaaaatctctcaagaatagctgattgaagtcaggtataaatatttaaaaacagcttttttcattgccaactgggaaaagaaagtatgccaaatgaaactgttggctagccctgttgtagatattatgaagagtgtatctagatgatggtcagtacataaagttctgttagtactttggagctgctgctcaaagatactaaatatttaacaaataacatgtggtggctcctatctactgaggtaggtaatcaaggtggaggagaccaagaggttgaagatagagctcttttctgtaagacatgaataattgtaatagtccaaagtacagtgacaattttggagccaggagaccagcaggagtagaagaattaagtgtagaaagaagaccatggcttgtgccaatccaggctaagtacctcttgtcaagataggagataccatcaagtccatttgtcacagagcctaggaaaaaggtcattaattacatggataattttaacaagcagcacagttcctatttcattcatagtaaagatggatggatgatcttcctgactcttaactagtccctaagaaaccactttactaaaataaatattttattagctaacagtcttatttctagtgttacaatgtcttatcttacaaactaacttttatgttcttatttaaacaactaggggctaccatgttttccttcttgaaaacacactcaatgtctgttttcaaataatgtcacagagctgtggaactggaagacaattttgatattcattataaatgacagactttaattatttgcataattcaatatagtagcatcttaccattaatacttggaatattttaggtaaaagtgacatttttggcttttcttatgcaaataaatttgctacaatcctttatttcactttgaatgcagagagtagcttacttattatatagtcaggtgggagaaatttaattattttaatctggtatcttaaatcaataatttctgcattttaatagtttctttgttccttctcctatagtcttatcttttaggattgaggcaagtttttgaaatttgttttattaaaagcataaaaggaaagaaataagtgaatagatagcaaacatcagtctatgtaggacaattatcaagaaaataaatatagccaaatgttcagctatcttagaaatcccctcataaaccacagcattgcctcacataactaataggaaccaatcaatttactctcattattttttaatgttcattcactgcaaaagtgtatacatgactctaaaccaa

SEQ ID NO: 57639 - DNA, 1085 bp, Bovine  19866881638635
tgctgtggatgctgaaacatgtgcataattagtccagtcatgaggcgtgcctggagaggatacacactcacagtttctaatgcacacatgtgtaacttggattacctggaaagctattagaacaagtgtttcaagattcagggcaggaaatttccttttagcttttctcaagtgctgttgaacaaaaagccatattcatttgcatccatgttattgcaagagcgagtcagggagttttccccagcacgttactggtcttctgaggacaacatgtcggttgctgccagatctcttctctgttagacagctacacggccaggcttcatctttccctttggatccactcctccattcctttgctgttggttcaaactttttggctccctctgtagagaattgcctcccaaatgcactcggttctctcctttgcatcacgggtctttctgaggctccaggctcctgagttcatctgctggcatcacaactgacacaccgctgggcacgatgggaagagtgctcgggagtattggggctctttcaatgggcaagtagagaaaaaacagatcgcacagaggaaatagtaaaaagactggcttttggtcgtcttggagcttggtgttggaggagaggaatttattataagggtaatcgggcgtggtgatgggccgtagatgaagagaacacactgcgggtatggacatgcttggccactcacaacatgaggaaaacagcgatggcttggggtgaacatccagatctctggataacatctttcttgttaataaaagaggccttgccagaatgccagcttgtcaaagacagtattgcagggaggaggtggccccaccttataagtgctttctggtcttcacatctgtaacctggacaagttctctctttggctcagaaggcaaaggcaatggaaatcgagcctgccaagacaataaaagctttttcaagaccgtgagctgttagataaacaattttccttctgctcccaattccataaatccactgctgactctgacttatttttgtgtgcatctcagaatataaaatcttttattaaccacaaagtaatggga

SEQ ID NO: 57640 - DNA, 1486 bp, Bovine  19866881921590
tctgctggtgttttaactcgacaaaacaagaatgagatgctaaacacactggggtcactttttttatgctttgtagttacataatggtttaactctatcatcttcaaaaatcaatttgagggagtctgagctcaaaaactcagtggtatgtttgtgatctaaaaagttgaccttcattggctatccaccttccaaacctccttgcctgtcacctgaagatacggctcaaactcaaccaaccaaaggaatccctaagctacttgttaaagtccagactctgagccccatttaagaattaatacttctgagtctagggtgaagggaaatttgcctttttagtaaaggtcccaggtgattttaaattcagccacacttaagaaccactgccataggagcagtccttatagtataaatcatgtgtgattttgttttctcattttgagtgatatatgacagcaaagacattttgtgtcatgggaactattacaatagacatataaaactttcacgaacagcctttccaaattatgtaccaaaccatcatttgatcacctttaaaaaatctatataggagccagataagtatcctatgggaacaagtagacttgagggaaaaaaaaaactgcacccctgattgcttctgaatgtaattaagagtaaagtgttcactccagccacctgtgaacaatcatgcttgacatgtgacgtggagagcagtcacttgttttagactccacgccagcacttctgtagatttatggtgatagagatagaaattcatttccttagcttttagtccaatagaagctaaattctcaatttactacttcatgacctttgccagaaaaaccagttgaacgctataaagagaaaattctttctttggttgtgtaatatgcggccacagaagatgaaggacttgaaaaaacaggaagtgttttcagcgtggtgtctcaagtggcataaggaaattctaaaaagtaaaattttggctaatctaagaattgattacagtgtttgctaaattcctccagagctaatagttactctctaaagctttttagattgacaccttaaaactaattggcttagttctttttaaagttcatcacctataattaatgaactaaaagactgggaacatgaagattttcaagtctgcagtttataatcccttggattttagatttacgtgacctttagcctctcctttcctttaaacatcacatttaggcaaaaaatggaagagaagttgctactcattgcattgacctcagaatcctagtaaatagctgaaatgtatctttagatgttggagtctcctcgtcccaagctttcttaattcctacctagcactagtatcgctctcttcaacaaaacattaatttgcgtcattttggctgacgacaaaatgaaacaaagatggactaaagtccatcttaatatcctcaaaaaatcatctgctgtgtccacacagacccagaca

SEQ ID NO: 57641 - DNA, 1150 bp, Bovine  19866879966073
atcttttaactgctcaaaggactctgcatttagacagtttagaacatctcatgcctctcacagttgggaggctctgagcaatcacatgtggccggaaaaacctattcaggcaggctagaggatttccaaaggagtttgtaggttgaaacactgtcacacccaggaattattaactggagctgtaagctaactcttttttcagagagaggtagtgggggacagcccaccataaagtcagaggtgtaggtgaaagcacaaagcagaaagtaggcagactctggttttgggggtagatgctcgagaatttccagggggactcctgaggctccatcccgcctttgcgtatgccgagcctccttcctcatgacctttgccatgggcggagttcctcacgctggctcccggcagtgatagaattccagttgagctattccagatcctgaaagatgatgctgtggaaagtgctgcactcaatatgcaatatgcactctatatgcaatatgccggctcccggcacctaccaatttgtaaaaacgtatgtgatgctagtccttgctacacagaaataagcagctgagagatgtttttaaccatgccccactccaccagaaatgaaggaataaagttttgccttttgcacagttcatttcttcctcatagttaaatcacttccatgtgtcacatgatcttgcttaagttcccaacatcatcgtgatagagttgaggagctggcatcatcacgtccactccacagcttgcaaaagcggcaaaaaaaatgagggctccatcgaggcacaccaacagtgacaaagatgacttgaaaagtaacaggaacttatggctatttcctttattaagcttgtggcttttcttaatctggcttctccttttctcaccaggtctatgagacaggaagtcaccactctgcattgggtttgttcattcttcttatttactatgcaggagagctttactgttgctgcatcctgataaagtacaaacaggatatttctcatattttgtgctctggtggtatatttattaacatacaacttattttagatcaggcaattgatttgacccagcgtgtatgctgtgtaactttaggcaaattacttaacctctcgagtcaatttctataactgtaaca

SEQ ID NO: 57642 - DNA, 2476 bp, Bovine  19866880123641
attgttttagttttgccaatatcgaaatggatccgccacaggtatacatgtgttccccatcctgaaccctcctccctcctccctccccataccatccctctgggtcgtcccagtgcaccagccccaagcatccagtatcgtgcatcaaacctggactggcaactcgtttcatacatgatattatacatgtttcagtgccattctcccaaatcttcccaccctctccctctccaacagagtccataagactgttctatatatcagtgtctcttttgctgtcttgtacacagggttattgttaccatctttctaaattccacatatatgcgttagtatactgtattggtgtttttctttctggcttacttcactctgtataataggctccagtttcatccacctcattagaactgattcaaatgtattctttttaatggctgatatcttgaggtaggaccatcctaaaggagatcagtcctgggtgtttattggagggactgacactaaagctgaaattccaatactttggccacctcatgcaaagagttgactcattggaaaagaccctgatgctgggagggattgagggcaggaggagaagggcacgacagaggatgagatggctggatggcatcacttactcgatggatatgagtttgagtgaacttcaggagctggtgatggacagggaggcctggcatgctgcgattcatggggtcgcaaagagtcggacacgactgagtgactgaactgaacttaactgaactgaggagcttattattgatttgagaactatttacctcaattcacttagtgttataaatttccctcagcaatagcttagctgcactcaacaaattttgacacgttgtacttttatttttgtttagttctatgtatttttaaaatttcctctgagtcttcgacttccatctatggattctttaagagaatgttgtttaatttccaagttttgggagattttcctcatatctttctgttactgacttctagtttgatttctttatggttggaggatatactctgcatgattttgattcctttaaatttgttgagatttgttttatgacccaggatatacattcagccctccatttccttaggttctacatctggaaattcaaccaaccacggatcaaaatatttgagaaaaaggaaaaaattccagaaagttccaaaaagcaaaacttgagtttgccacatgggctgacaactatttgcagagcctttacatggtgttgggtattataagtaatctatagatgagttacgttacatgggaggctattctaagttatatgaaaatacttcacaattttatataagggacttgaacatcctttgatactggtatctgttgtgtgggggtgggggaatcccagaactaatacccccaaggtagattattggctaccttggtggatatgccaccatgttatatctgataaactcattgtaaattgaaaatgtcataagtggaaaatgcatttaatacatctaacctgctgaacaacacacattggcttagcctaacttaaatgtgctcagaatgcttacattatcatacagtggggcaaaatgatctaacataaatcctgttgtaaagggtcaaatatctcatgtaagttattgaatactataccaaaagttaacaacagaattattgttatgtataggctgttaccctcaggagtgtgtggctcactgccaccacctagcatcataagagagtgtcctaatgcacatcactagcctgggaaaagatgaaaattcaaagtttgaagtacagtttctaccaaatatgtgtagtttctgcatcatggttaaaaaaaaaaaagtaagtcagagaaactttcctggtgatctagcagttaagaatctgtcttgcaatgcaggggatgcgagggaagtaagatcccatatgccatgtgcaactaagcccttgagcggcaaccactgagaccgtaagccacgactagagagtccgtgtgccacaaggaaaggtccctcacgctgcaactaaaacttgaagcagccaaataaatagataaataaatatatttttagaatcataagtcaaactattgtaaatcaggggccatctgtattctgttcatattgattattatgttattattcatcattatattttatagatatctattgcgtgagtgcatgttaataagtcacctcagtcgtgtctatctctttgagaccctatggactgtagcccaccaggctcctctgtccatggggattctccaggcaagaatactgaaatgggttaccatgccgtcctccaggggatcttcctgacccagggatggaaccaggatctcttacttctcctgcattggcaggtgggttccttaccactagcaccatctgggaagcccagatgtttattaggtcccattgactgatagtgtttttttcctaagtattatttatccat

SEQ ID NO: 57643 - DNA, 808 bp, Bovine  19866880363365
gcagttcttagtatgagatttcattttcttaaaatctatcataacatatttctcttaagggaaaaagtaattgtcataataatctgacaactgactgaatgatcaagataaaccctatacccaggaggaatggcacctatattaatggtgggatgtgtactatatattttcataatttaaatataaatttgatgtcttcaaaaacccggtgtacaagacagcaaaagagacactgatgtatagaacagtcttatgaactctgtgggagaaggagagggtaagaagatttgggagactgacattgaaacatgtaaaatatcatgtaagaaacgagttgccagtccaggtttgatgcacgatactggatgcttggggctagtgcactgggatgacccagagggatggtatggggagggaggagggaggagggttcaggatggggaacacatgtatacctgtggcggattcattttgatatttggcaaaactaatacaattatgtaaagtttaaaaataaaataaaatttaaaaaaaaagaaaaaaaaagtaagcaaaactgagaaagtaagcaaagagtatggtttctctggctttgtgctaaatatacaaagttagccattttgaaaattatttttgttatcttaaagtactctggaagtactttgatctgagtgagccaggattggctcactgcgatattcactaattattgacttcagatgtgttcttcaaccatgtcttcccagtatcttctgggcagagtgtaggtaagacttatgtacaaagccctaaggacctggcacaagtc

SEQ ID NO: 57644 - DNA, 943 bp, Bovine  19866880421397
gccaacataaagcagagctttaagctaatcaatgataactaatagagactaataagcatgacattgacagaaagagatgagaatgttctactcgtagcttgttactctgaaaattcaatggtattaatatttaataccaagcactaagttggctcgaaggcctgttaaaaagcagtccaggaagtgttccaatttcttggctcctggcctcttacagaagtgttaactgtaccagtttagttggcttgggtactcagagagcagaatgactctgaaagttgttctttttcaacagttttcatcaagatgctgagtgcctgttcaaacaaatattttggaatcttttcaatgcagattctttttaaaaatatacaactcagcatattttaactgaattattagaaacatatgctaaagcttcatctgagaaagcaaaaaatatgaattatatttctaaattgaacttttgttgaatttgaaaacacttttaaaatggaaactatacagagaatattcagaataaaacattttttgaaactttttcttttgaacagtttcacatgaatgctccctatcaatggtacttctcatttgaaatgcagctcaactgtgtcacactggaaagaaattataatatttcatgcacaagttatgtttatctcaccttaaaaatatttatggtcatgctacagaaaaaaaaaatgtttttaacattcagcaaaatttttaaaatatttaaaaatgtgactcaaaaccctgtattttcatttaatacacttataaacaaagaaaccttatttttacctaacaccttttctaggttccactccttaaattccttaaaaatttttggcttttaaatctgtctccacccttctactgaccagttacgcttctctgaaatttactaacaattccagactcttaagaaggttcattctca

SEQ ID NO: 57645 - DNA, 1452 bp, Bovine  19866880422594
cttcttaattttattatgctataatatatttgtttctgtgaagtctgtgttccctaccagaatgtaagttctttgtgggcggagatcacatccatgtctgtcttgttctgagttctatcctcaatgccatgcactaaccctaacacatggtagatatttcaattaacattccatgagtaagtaaatgaatccaaggttttaacaggaaatacctctctttggtgcaaaccaaaaaagatcctgggtagcaaatctgagtttaacctttagttttagctgtcttcctctgacacggctccagtgagaaaagaaaggctgccacctcattcctggcaagtggaggtggagtccaggtttcccacttaggcttcactgatgcctgagcaagggaccccttcattacactgggctggggagccagttctggcttcccacgagatccccactgaaacgtgtctgccttagagggttaggactgctcactattgatccccacatgccctctactgacacctcatgggcacgggccactcactacctctcagtgggaatgaagtcccagctccctactcagttttctctgtcaccactccaagtaggaggaacttgagaaaacttattatagactgggtagaagtctaagattcccacctggtttctgctggcatggcaagggacccagagtttttttgtggaggttgacttgagtagttttcttcccccccacaagctttccatctttctaggctgctcctttcctggccctttgactagagagagcaagcttttgttggggccttcttttgtccgcacacatgggtgtttgcaggttgccagctcactcagctaccagtctgggataataagggcagaaagaaaacctgaagaactcaccactgagttctttggatctccaggtcctaagcagtcttgtcttcttctctccaactttcagcgtctccttatgcttgtttcgtatataatatccaagaaggaataggataaagtacgtttactatgtcttcccagaagtggaattctggcattgcaccttttactccttttttctaacactgatgtgttaggcagtattttatcactatgacattgcacgtatcctcatctatttatttgctagatcgatgagaatttattgaattcttaccacatgttcaacactgaatcagtctctgaagttaaaaggaagaacaagatcacattttctcagtccactggaggacataatataaaatgaagcagactattttccagtagtcacatgtggatgtaagagttggaccataaagaaggctgagcactgaagaattgatacttttgaactgtggtgttagagaagagtcccttggactgcaaggagatcaaaccaatcttaaaggaaatcaaccctgaatattcattggaaggactgatgctgaagctgaagctccaata

SEQ ID NO: 57646 - DNA, 1074 bp, Bovine  19866880424033
tctcactgtttttgtaccacagcatgcagttactttaggctagtgttacccatgactatctgaatttaaggttatatcttgtgctcagttttacttctcatcaaaagaccccactaagtctaaaccacaagccactgtcttttcatctttccaaccacctggcttacatcaaactgagaatgacatgatcaacaggaaatgagcccacccaggtgacttgtggtccctatgaccacatagcttctgataaatgaaagagagcttcacaatgccacaccaagaagccagatagttactcatagactcagtgctaaccatgaaaacctgcagttgtgagaattacaaggttactagaaatatatacccaagcactgccaataatggttcaaaaaaatcaagtacaaactgttagttacaaaataaataaatcatgagactctaatgtacagcatgttgaaagttgcttaaaaagtagatcttaaaagttatcatcacaagaaaaaaattctgtcactatatctggtgacagttgtaaactagatttattgtggtgatcatttgtaatatatacaaatatatcattaatgttgtatacctgaagctaatataacattctgtttttttttttaaagtaatacccaaagaaccaacaaaaaacttctggaactaatgggtgattataaaaagatataagattaatatacaaaagtcaattactttcctatatactagcaacaagctactggaactttaaaagcacaataccatttacataagtccccccagattaaatacttaaatataaatccaacaaaatatgtacaaggtctgtataagggaaaactacaaaacattaatcaaaaaaaagctaaataaatgaaaaggtatttcatgtacatggataacaagactaaacattattaacattagctcatcccaccttgatttatagatacaatgctctacaagttaaaatcccagcaagttactgtgtaaacattgccaagctggttgtaaagtgtatgggaaaaaagtcaacacaataaggacctccactatcgactttaagactca

SEQ ID NO: 57647 - DNA, 1499 bp, Bovine  19866880511512
cactggaaaaaccatagccttgactagacagatctttgttggcaacgtaatatctctgcttttgaatatgctatctaggttggtcataactttcctttcaaggagtaagtgtcttttaatttcatggctgcaatcaccatctgctgtgattttggagcccagaaaatatgctacttggaggcaaaccattcaataaagtaattaacctctaattaaaataaataaattaaataataataataataatactagtgctatacaaagtgctacaggagacccaggagaagtcaattcattggaatggggtagagatgaaggtggagtaggttcagggaaggttccatagaggaagaagctattgaattagattaaagaatgagtaggagctttccaggtagataagaggaaaaagttgttacaggcaaaattaacagcatgaataaaggcacagaggcagaaagtggggaacaagtagctccttgaaggaggagcatgggatagaagaaaaaaagtgatgagtggaaaatagatgggagaaagatcatatatcatgtcacaaaaggccagagccacagtttttctcaagcaaaactcatgcaggctgtactacatggatggcaaaatacacttcctgttcagatgtggcagaactgagtctccttccatgcttggttgttatgaattaccctctttatccagccaaagcacatttctgtcagcagtttgtcagttccaggttccccaggcattgccacaatcatatcccaaagagagaggagccctgtgtgtctctcagccaattagtggtccacttgcgcctgccagcaatttgaagcctcagaaacattttcccatgaagtttatttatgttgctgctgccctaaaaactaaaatgatagaacaaaagatcaagaaagaaaataacaatattaaatggaaggaagaccttaaacaaaggctccaaacttaatcttattcctaatgggaggcctgcatataaaggaagtgggactgaaattgacgggctttggctggaacagcatgtttgtctgacaggctacaggagcggcagctgtaatcgaccggaggatttggccctttgatgacaatcaacaattctgttggggactctcatggacaggctgtcccctattgtggtgtgtttcatgatcctttgaccttaagctttagtagctctgttgtgtccaactctttgtgaccccatgcgctgtatcccagcaggctcctctgtccctgggattctccaggcaagaatactggagtgggttgccatttccttctccaggggatcttccccaacccagagattgaacccaggtctcttgcattggtagcagattctttaccatctgagccaccagggaagcccagagtgaagatataagttaagactcatggtgaccttaaggcaggaccacaaacttcattcctattaaattaagtttactacccatgctatgagggggcagaaaacagaa

SEQ ID NO: 57648 - DNA, 1892 bp, Bovine  19866880600000
ctaaaatatcatcctagtaactctcttatctcttttagatatcagcatgagatttcatttctaatataagggttcttatcaccagctgcatattaaaatcattggggaaacttataaaaagaacactttgtcctggttctcatcaaattaaataaaaatttctaaaagtgaggcatagacattggtcattttaaagagcctgttaagtctaatgggcagccatggttgaaaaccagtgggccagtattttggtcagtctataagctctgtcccctcgtttgttttaagaagctgtctcatagtgttgctgtatgttctcagtttggacataccatgtgtttatatgtatatgtttacatatgtatacatacacacacataagatttatattccaaaacgaactgatagaaatcaaaggaatctgttcatataatcttgatgtggctactgggctgatgactatccactatgttcagcatgctgaatgaacatcttggtttctctcccaaaggaaactttcagaccatgattcagcactcactccctagtatgagatggcagccaccataaccatgttgattgtacctacccaggctcaaggacgaggagaatcaagaaatcacctagctaacccaaggcttaaattcaaactactgagaaaagaggctgactttctctagctaagtgccttgttaatatcccctagaattgtaatttccatttcttgcctgctttgaaaaatactctaagacatttcctgtttctgcttctcccaatggactcaggttcttgtatataaatctgagaagcaggtgttggtgtggaacaatggcctgtgaagggcaaatatttccttttaatccaaatgctccagactggctgcttctgtttcttgcagaattgctgggcccttgactgtacttgttactagacagactgaccttagtgttcctcctgctgggcccagcccattgaatcagtgaagtgaataattcaagtcaaatttgcatgtcacttgtcacatggatgacacaggtgaccatggtcccttgatctgtcctttgcattatcccaaggtctctatattactctgttccactttgctggtggatatctgcctgctatatgttataggaggcaagtacagtgatagaagttgattttatttataatgaaattaagaaacgacagcactgggtgtatatctgaagaaaaccataattcaaaaagatatatgcatcccaatgttcattgcagcaccacttaacaataaccaggacgtggaagcaacctaaatgtccatcagaggaatggataataaagatgtggtacatatatacaatggaatattactcagccataaaaaagaacaaagtaatgtcatttgcagcaatatggatgtagattgtcatactgagtgaagtaagtcagacacagaaggtcaaatatcatatgatatcacatgtatgtggaatcgaaaaaaaagggtaaaatgaacttactgatgaaacaaaagtagagtcacagatgtagaaaacaaacttaaggttatcagggatggggggagtgatatattgagagattgggactgacatatacatactactatcaatttatttaaaataggtaactaataagaacctgctatatagcacagggaactctatttaatagtctgcaatggcttatataggaaaagaatctaaaaaaagagtggatatatgtgtaactctgattcactttgctgtacacctgaaactaatacaacattgtaaatcaactatacttcaagacaatttttttaaaaagtaacagcaaatgaaatacaagtatttaaactgcttgcttcatagtcttaactatccagttgaggtgtttctttgagagaagtg

SEQ ID NO: 57649 - DNA, 1934 bp, Bovine  19866880643795
cgcgagcccggggtggggtgcatcggtggggtgcgggcgtgtgtccgctgggaggtgactcgccgggaatcgcggacgggcgtggggggcgtgtgcctgacgcgcgagccttgcccggctagacgctggggcggcttccgcagcccggggaccctgcttcgcagcccgcatccccgcgtggccgctgctgtcagtctgcctttctattgcccgccggtgcgctgagcccaccctgcttggatgctgttcacgcctctgcgctccatcccttgctctcctgtcctctgtttcccgtttcactcccagcagagagggtggggtcctcccctcgctgatgtagggaagcttggtggtcactggctcatcaggtttggtgacaaaaccggagggttttgatgcactgggaattctcagtaactggcgccagtgccaggtttatcttccttgtgggaagcagttttaagttttcgtctataaaaggttagaacgctcctaattagaaggtgttaccggcttgtaaattgtcaggctgtaagtgggtgtgatgatgccaggtttctgcctataggtttgaagaagcttacttttgagggggatggggttggcgtggtgtgccccagacctgctgtttccttttctgcacagacctcgtcatcgtgtaggtttccatctcctgtgagagcccacaaggagcattggacgtttctttggctgcagcgaatttggcgttgtctttctgactgaagagttcagtcgtagggcttctggtcgccagttgctcttttgacgaaaaagaatcgaagtcatctgggtaaggtctaggcattggaaggagagattttcaccgtcttcatatgtattgtgtaaggcagtatctttgaactatttatacgttttggaaaaaaaatacttaccagaagacctgctcgatgttcgggtagtcctcatgtttgagtatcgaagtaatagtattggcgagctctcagcgttggagagctgtgactttagcatcctagacgcaggtctgcataatggcttttcggtgagaggaaacttcctccgcttttaatccagtaccgtctcccctgcctcaaacctgaccatttaggtgcttgtagtcttgccgaagttttataaattctgttacctgttttttgaggaaaagtcttgctcatgaaacatctttattgtttaccaggacatttcctatatagccccacagtgaattttagaaattccgtttaggaaagggaaacacgattttggaacactatttttataaaaacacaagtgatcctttcagatgcccagacatattcataattacattaattatattcagatttattggcaatgaaaagtttaccttggtaaatatgttatattttaaaatgtatttaaatttatactcagtgtttgtggagctttgttaaatttcatttatgtttcagtgaggggagaggaaaatgttgtcagaagtgatttttaaaattctaatatattggatattatcctattattgccacatactgtactgtcagagttatatataaagttcccatttttcctaccttatgcagttactaatttttgaaacaaatgcgttttctctttgggccaagcactgaagcaggatagatgaaacataatactgctcttaggtagatcaatgttattaaacacagagccatatactaaatctatgttttgtttattttaattcatgtatatttgagggaactattgcagtacaactttataaaattgtggggttttgtagtctgttttcaacatgctgcaagcatcccataactgtccaatagaattaagagtaattttattgctaacttggcctgacagctgcagaatttatgatgactctcaataaaagataaaattgttatttctgatttttaaaatcctttggttttggg

SEQ ID NO: 57650 - DNA, 969 bp, Bovine  19866880752712
ctgttcctttgtgttattgtcacaaattcacattttcatacattatgtacccatcaacagagatttataattatagctttatatagttgacttttaaatgagaaataaaaattaaaaaaaaatagatttgtactgtttttaaagtttagtttgctgttatcattactgttgctctttatgttttcatttttcttaataacaaataggtaataataaataaaacatcttaatctgtccttcatttctgaaagacagttgtgctggatataaggctctttatggacagtatttttcttttagcaccttgactaccacatccctgccttctgactccatcagctctgatgagaaactagctgttaatgttattaggatttcttgtacatgatggattacttctctctttctgctttcaagatgcttgttttgtctttagacagtttgattataatgtctgtagcctagatctctttgagtttatattcttcttggggttctttgagctttttgagtttgtagattagcatttttgaaattaagtttcagccattatttcttcaaatattctgcctccttttctttctcttctctttctgggacttcccttgtgtgcatgttgctgtttattgggatctcacaggtctctgaggctatgatcacttttcattttcccccttttctcctcaagactaggaattgacctactctcacactcactggttcttctgtctcctgagatctaacgttgagtccctctattcaagttactgtaatttccaaatacagaacttccatctgcttttaaaaatattatctctattctctctttagtgaggtatttttttaaaaactttaattctttagacatggttttctctagctccttgaacatgtttaaaataaatgatttagcttctttgtctagtgaacccaatgtctcagcttcttcaaggatcatttctattgatt

SEQ ID NO: 57651 - DNA, 1843 bp, Bovine  19866880756367
tgagcaaagatgtttaattcaaggaaatgctaattggtacagggtaggtgaacatggaatagacttttcaaatctattatagatttcactgtaaatgtattataatacaaaaataagacaaaattttacttaatcttggagttataaacatttggacatgatttgtattccttctaattccagagcatgacgtggcatctggagacggcaatgctgtgagagaagaacttgtgaaggagaatgatgccccatctcctgtaatgaagtggttaaatccacgctgatcctgggtgggatttctgagagaagaccctgttttaacaatcattcaacacacagccaacattttaggaattctctgtattatagtatatggacatatgatttttggagaccaagtgtgatttagggtgggtccacaaaaaaaaagtaggctactaacaatccataaaatgcatatgactgaactcttttagatatttgttaaatatttgaatgcatatagatttgttaaatatgtgtttttagtcatagtgaagaactaaagatgcaatttggataaccttaacttggagggaaatcagccaaagagaaggctagccaaagctgaagaccacagccagtctatggctctctgactcgatgtacattaatgtccagatatgggctggagagaattaagagcaagagaaggtgggggtgcaggctgggagggtatgatatttaggtcttcctttggtagcttcagtagaacttacttgtgcttttattttttttttttcactttggaaaaagtcaaaacaaaacaatccctgaaggaagtgggacttttgaagcttgtgggactttgagcagcagccttgaactgaggcaggtttcaaaggatggctaatgtagttcccagtttactgcgtctgagggatggttcttgggtacagggcaaatacacactccataaatggttttaaagaatgccacctctgattgagagtaaggaagtattttgcccacttaggagaagtgtgaaggtaaatatttatatatatattttaaacacttgttagtacaagtcatcctccatacccatgtttatcactctcttgagaaaataagcataatatcgttgtttaaaatggttagaataaaagtataattctctaagcttttcaaacatccaaggcatggtaaatttgttatcaataattatagtaatattaacattaagtataagagaaacctggaaaaatttagtccccatggatttataaaatgtcgaaacacatgagggaatttatttaaaagtaagtgcaatgatttagatgagctttaaatttaaagtagaaaatgctttttattaagtttggaaaagagtcaattttagcaggaaatgtcaactttaaaatatagttcattttaatgtatttttttctttaaacttgggtgataagtggaattatgagtacccttggaaggatcttagcacaaacaggactgttgtactagattttgttaggaaatatttgcagaagtattttatttggagtgaagaattatttaagattatttcactatttgcctgtattttattctcgaagtttgcctacagagttgtgaatgtgtgtgtgaggctcttttaatgtaagctgaataagctgtttggatttcttttaaaaagacaagtttacaattgatcaataaaaaaaaacaaaacagtcactcctgagtccattcatgacttcattgatcattaaaatatttaaacgattcattcaatgaataataactcattaatgcacattaaaggacaggcttctcatgtaaattttctcctacagataagcat

SEQ ID NO: 57652 - DNA, 1771 bp, Bovine  19866880860507
atatatatatacccatcctctttacccatttaactgtcaatgaacgcttaggttgcatccatgtcttggctactgtaaatagtgctgctatgaatgccgaagttcagatacctttcaaattagaattattgtcttttctggatatgtgcccaggagtagaattgctcggtcatacggtaactctcattttttgaggaagagttctttaaagaggctgcaccaatttacactcccaccaatagtgtagtagcgttcctttttctgtatactttctctagcagttattaattatagactttttaatgatggacattctgactggtgtgaggtaatacctcattgcagttttgatttgcattctctaataattagcagtgttgagcatcatgtgcctgttggccatctgtatatcttctttggagaaatgtctgtttatgttttctgcccatttttttatttttttttacattaagctgtatgagctgattgtatattttagaaattactcccttgccagtagcatcatttgcaaatattttctcccatttcataggttgtcttttccttttgtttttggtttcctaagctttttcatccaaaacttatgggactcaacaaaagcagttctaagcaggaagtttatactgatacaagcttacctcaggaaacaagaaaaatcccaaacaacatttgaacccaagaacctgtttctttgaaaggataagcaaaactaataaacttttagtcaggaagttcctttaaagaaagctgaatcagcaggaaggagtgtccttttccccttcctccttcctactgccgggattgtaaatgtgatgactagaactccagcaaaaatcctggtaccatgtggcaaacttgaatagagaccaagtgttggtgacagcggaacagagaggagcctctgtaccattcctgtactctttacctgagaacttcctttacatgaaagaaaacaacatttatattaatccactattatttggaactttctgttacatacatctttatgcgtgcgtgctcagtcttgtccaactctttgtgaccccatggactatagtccgccagtctcttctgtccatgggatttcccaggcaagaatactggagtgggttgccactttctcattcaggggatcttcctgacccagagatcaaactcatatctcctgtgtcttctgcattggcaggcagattctttgccactgagccaccgcggaagtccattatacatccttgaccaatcctaatagataaaatcagaaatctaacatttctgtccctggtatatgctccaaacagtgacaagcatgtgtctttatgcccttatgcccatatcctcaaaacttcctaatgattttaaccctattaaaataagaattgattcagaaaagtaacttttaaatgttataatcaataaatcacttccttcttgttgtttcatcctgtggcttaacatggaaaaaaaatgccctgacttatttgaaaagatatttttatcttaaccacatactgctgcatggcaaacattcttgttcctactataaaaataatacatggtactcagtctgtaacactattttctccttttgtgtatattttgtaagtagatcttgtagaattgctttttaagtgcgatgaaaataattttctctgacatttgagattattatttattttattatttcacaaccatttgaaataatatagcagcttttccatccgaactacaagagcaactccacggcttccag

SEQ ID NO: 57653 - DNA, 1499 bp, Bovine  19866880910303
cgggtctgtggactgacagaaacctctgctgaaagaaagaatagctggtcttgaatatggggctctttaccaggtttaaaaaaacatttcatctgtttttctcataggaaggaaataacaaatttatgtattattttggaattgggtattaacacagtactgtttaatgtgaccataaaatcagagaaaactaccttttccagctgaacatagaagtttcattacatggaaaacatggatttggattttagtttaacttttagtttgaaaggaaaagagaagttttaattacaagaatttagattgcctaatccttttctcagatccaagtagcttttcttatggggatttaacctctaccctgtcagttacttctgtggtggctcaagtggtagataatctgcctgcagagcaggagatccaggttcaatacctgggtcaggaagatgccttggagaagggaatggcaacccactccagtattcttgcctggagaattccaaagacagaggagcctggcaggctacagtccacggggttgcaaagagtcagacatgactgagtacctaacactttaacattgccaattacagaagtaagctgtgtgggggtggtctccttctggaggtcatactttaaacagaagtaatcctttcctgtgttgaagaaatcactttcaccccctgcaaagaatatacttttaaggaggtctcactccttctgactcctctctattcccttaacaccttatacatctctctcttccatgcttcttacactcttcctcattggtccagtcatcaaattctacgcaatcttcagggatccaaaaaaagcaaaagagcccactggatcttggagggcaaccatacgtgttcctatggaaactggggctggggaactagaactggatcagaaacaaagaggagtcagactgcaacaaattcccctagttcctttattttgtataagtttcacaaccatggggtctgtattaacattgtagatttttttttcctgttttaaaaacagatattaaggactcacataagaattctactaacactgatgtcatggacactttttaaaaaatgaggtatttggtttactgtccaaaacagtaaaggtttgggcaaactgaagaaatgatctagcaagtaataaaatgaaactgaatcactgaaacagaaatgggacctggcaatacagttgctgtgacaccctgagaacctttattgtagccaaaataaacctacccaccttacgtctctaaaagtaaaacctagcatgatttttcctagaggcatatgtttctacttggaaaagacagtgagaatgaagagatgagtgaatatgagaaaggtaaagagattaagaccactcttactgcccttttccccactctaataataattactgactaatggacccttatttccttgttatcaaatgaccttaggaaaatatttacagtcagagcaagaacagcattttcaagt

SEQ ID NO: 57654 - DNA, 1690 bp, Bovine  19866880990534
ttctatgctgcgtataggagactccttcagatgcaggacacacagtcttaaaaatgaaggaatggaaaaagatattccatgcaaaacagaaaccaaaagaaagtcttggtagctacacttacataaaacaaaattaactttaaaactgtaacaacatacaaagaaggacatgacataatgataaaggggccagcccaacaagacgatatagtatttatagacatttatgcacccaacacaagagcacctaaatgtacccagcaaatattaacagttctaaaatcccatttaaaaagaaagctactcactcagcgcaaacagtttttcctgctgatgtatgtgcagatactaaaacagactgattattatcaacacactgaatggcttctctttgaaaagcatcaagaatgaatggatattcctataaaaaaaaattaatatatgtatgaagataccttgccacatcagaacatacttaaaaccaagagatgctacccccagaagcgttatggaagcatttatgagtctacttgggaaacattctgtccactagagaaaattaggaagaattaaaaagaaaactttaatcagacagaatatgttatttctgctgtctaatctttcaattattatgcttacacatatactaattacaacatgattattaccatatattaagaacatgctttatgggaggcactgtggaacacatttcccacatattaatctccacagcaactcctaacataggtgtagttttctttcccagctgggaacactgagagtctgaaaagtcaagtcctcaatgaagttcactcatcagaggcagaataatatatctatcagactttaaaaattcaagtttaccgcacagtactgccatttttacttaaagaaaatgacttggaaaacctacactactcttttatagtctatcagtgattcaaaatacatttagtatcagcattagagtttaagtttcattagaagcttgttaggctccagaactgtatgcaaaacatattgtacatatgcatttttttctagagaaagattgatacttttcattagattctttgaaatggctgagaattatgcttaaaaatcttatcacatgatgcttggttttcagtatgggttgtttactgatttggttttcacccatatctgacttcaagtggaagcttcagagtgtgtatctacatacacatacacacaaacacacacagaaatataaaaatctcattttaaagtttacctttaagatttttaggaaaacagactcacacaactgtaccaactgtaccgctcaaggtacaaacctttgcagcttttccaactcgaggtttaagtggtagataatcttcatctgcaggaagtgcaacctgatgtttaaaaaaaaaaatttaccattcaagaattgatgtattcagcataccataattaaagatggtttgaaaaataaaggtgatgaactaaagtgttgctgacagtcttagacactacaaaattaaataaccatcttcaagaacaaggcaaatgcaaatgttacaacattccaaaaaagtgtttacctaatagttatataatcaaaagcatttaagtctacctcccaaaagaaactttattaagttctaggacttatctcagctatctttgtatattctgtatctaatgtacttctgacatt

SEQ ID NO: 57655 - DNA, 1657 bp, Bovine  19866881034605
tgtgtgacagtaataccccaagattgtcacccccaaatctctattttcatggccaaccaagcacaaagtactacagtttttgacctgcatggcagcaaaggcaaaggctgctctttagattcaaaacccagctccgtatctgaaaggccaggcttccttctctattaccttgtcactttccttgacggaacttttgttacatgttctgttgtcagagtgagtcctcaagaatctgtttattgggcaagtatttactaagtgttgggtatgtgcagagccccgtgttcaatcatatgacaatggggaaaaataataatagacaaggtagagtgctcaccaccaagacatttactctaatacattgcttttttctgtcagcctcaatagcaacttgatttcaaacccatgagcaccgaaatgaaattcttaattttaaaatttcttttatttcagtggattatttcaaatttccttgtctcccatttcttaatgaataaagctcaacaatcccagcgactgctaaaagacatatacatatacatagtcttcgagacagggacatggacaaagagaggcagagagacaaatggacagaaccattgttctggatggagagagagatacagagaacctgtacagctcaggggctgtagcaggcactctgcaggacacaaagaaaccaatgacccagattaataatcatttgatggttattaacagttgatggtccaaaaagttcaacgtcttcttgccaaatatctgcccgttttgttctttccagggtgactcagggggccccttggtctgcaaaggtgcctttcatgccttagtttctggaggtcccaaatgtggtgatgccaagaaacctggaatctacatcctactaacccggaaattccaagcttggatcaaaagcaacttggccccatctcatgcagactaagactacagatgattttcttggctctatcagctgcttgttttcatttttgtttcattaatgtgttctacaggctaacttatctgcacaggtacttgaatgtagttaaagtggagaacagtcaaggtccactcctgacctgttaggactgattttgttgaggaatcaagttctttttcacatgtaccactgatgtatttcttctatgctgcttttattctgaataaaatttagaatagacgagtgtctattcatcttatatggaaataagatacaaagaatgatatgtcctgcaactcaatctacaacccccacaaagtgcaaaaagatgattaaaaaagacagttgtggcatcaccttcaaccatgtttatgttgttatttctgctgtatcattcttaaagctgtatttttaaaattattggtgttgttcagttgctaagtcatgtctgaagaaacactaaattcaaacatcccagctcaagtgaaggaaaaaatcatcaaggtttatacaaatatttaaatagtgcttattagttttatatcacattttcttccaaacaggatttaaagcaacatataaaaatacctgcaattaaaaaaatgtgaaattgtaaacacttttcccttaaaaaaatagaaataccatgtgacccatcaatttcactttcaaatcttgaagaaaattaaaacactacctcaaaaagatacatgcacc

SEQ ID NO: 57656 - DNA, 1383 bp, Bovine  19866881050496
ctctatgctacttaaggtataaaaactactttggaaaataaagtgcgggccttgttcactgaaacttggtctccccatgtcgctctctctctcactctggctgagtctccatctggagcgtggaacccaccatgcttactaattatgcctgggcttctaagatccgaccggggaggcctcagtgtctcctctccttcgggagaacggaaggatgcctgcggcctacgtaagtggtgcaaacttcttgtcttgaagttttattggtttcccacgtaaaccaagctactcagcctcttttctccactgaatttcctcactgagctatcctcatcctattactctttatatctttgataaatatttaaataaataggtcgcctatgccgtctctcctttgaataccctggatcagccggggctggaccccggcaggtaggcattttcaactcagttcccaggggaagtcactgatattagtcttgctttgttgataaagacttgatgggaaagtacccgagctagcaggtggcagagtttgttcttaaacccttaggtgctggctccaggctgcatgtggctttcaacctgaccacatgcctgccgggctttgagaagttctgtggcttagatgctctaagaggcaagctggctgtgcaaagggaaaaaaggatttagctgtatacactgcaattagacatggtgaggtgtaatttaattgggaggacagtctcataactcttgtagctgaccaggaaaattctgtgaatcatgtcagtttatagtcaagagttacttggtttgggctttagaccgatgtgtgggtcagtgggatcatttattataccattcaggatcttggatttgagaacagtgggctgtgtaacatgatgagctctgagatctaatttatttctgggtgttggtttttgttctgttgagtctgctacggggagagcagtgtttgctttggatggattttgcagcagctgtgctgggctgagcaagtgcgaggcagtgctttgtgctggactcgctcacgggtcggtggccttgagcttcctcgctgtgttgtgttcagctgtccttattcgctgcttttggggatgctgattttgagcttggggtttttgttttcctccatccctcttctctcttgacccttctatgttttgagagactcatatagaacagctgtctagaaactccaaaggccacatgtggttctccccagtgggcttttatcacttcattagccactccctctaaagttttgtcactcaaagcatggccctcagacctgtgctggtctgtgacctgtttagtatccatcccaggcaagaagaaggcagaagttgagagtcagagtttagaagttgttacagc

SEQ ID NO: 57657 - DNA, 1407 bp, Bovine  19866881063893
ttggtctctccacccagcaatggacatttggctctcaagtccattcctggccgtagcattcagaacttcacccaggctcagatcaatgagggccagctagtgtttgtacacaacggtaggtaactgagcaaagcaatgtgaaactaaagtgcgtttcagtcaaaggttaacatgtagtcacacctaatagctgctgacggaaaaccacaagccatctaaaaaccttgcagactgtatagtttttttaaaaagtgacacattttagtaaggctagtacatttaagcttacatttgagtaaggccaataatagcaaacatcagagggtacctataactcatacttggcttactcacattctcatgtgaggtgaaatatgtacatttcagattcttttccgttatgggttattgcaatatgggttattgaatatagttccctatgccatatagtaagtccttattgtttatccattatatataaaatagataaatgtaaccttctcagagatctttttcctgaccgcccgctgaaatcacatctcttccatttatcgctatcacttattctggctaccttacgttctagtatagactgattcgttcatttgtgtgctgtctgtcttccccactagagtataagggctagaagaataggatctttcttttgtttgctcttacattctcagcacctaataacagtgactggaacgtagtaggtgcttaataaaaatttgttgtaagaatgaaatcctattgatacctattatgtgccgggtaatgttccaaatgctggaatacattggtgaacacaacaaatgcatttattaaattaatgaatataaggatgaatgaatggatataactgtaaatctaagagaccctgatattaaaaggctttgttttcttctctctggtcatcagtaaatcaataagccacatcaccactgtacatctgcaggaggggtgatctagctggcctctgtttcctggctgcccttgacagtggtcagagagggcaagctgcccattctcagccacaggaggaagtggggggaggaggagtgtgagcctggggtgcatgatggtaaagctaaaagctgtatctttccagccacttttaattaccttctttgaaaataaagaaaacaaagataaaaatctgctaaactcaaaggtagtaatttcctgattatctctgcagttaagtacaaagaattcccagataacctgaaaagcatttactatgtgactgctcttatctagtggttccaaacctgtagcctggggacctgttgggggttagttttattgcaataaaatcgtaaatctacccacatgtgtaaaagcgttgtttctagactgaatgatcttttccacatgtgttttattttttaattgtatgcagtt

SEQ ID NO: 57658 - DNA, 990 bp, Bovine  19866881157951
tccgcggaagttctttcccggtagcagcggctgaaccgggtatcggtgtacgaggatcccccagacgccgagacccctgcactgccaggtgagcacggtggtccctgctcgacccctcgagttccccaagtcgggtgggtggggcgcgcgaggctgaaaagaacctggggtttcggaatgtctggcggcgatgcccgcggctagcccttgcgggaggctcagggtccgcccggcgcgtgtctcgggttctcgccgcgcagcgctcaccaccatagacctgcaggacctcgctgactgctcctcgtttcttgggtccgacccgccgcctggtggtgactcagccgcctcacaggtacttcccctggtggaatgccccctgcctctcagcccaatgttctatttcccgagtttccttaaagagccgtttggggaggagagcacaggaacacctggttagcagggagagatgtcctgcaggaatccgaaccgcgagaataggaacttcctcctccctcctagtatgttaacggtggctccattctcagagctgttttgaccaactctgcacagggagggctcccctgccagacgggtctcccgttctcctccccatctatttcttggagctgcggtagagcaactcggaggttgcacaccgagagatcaggtgggtgggtgggagcacagttgcgctctgggcaccagatcagcgcgtgctctctgtccttccaacatgcctttccgggtcattcattaactattttcattccctggatgtctaaggagtgtggagattggagaataacttctccatcaagaccggaaaaaacgaagagaatttacatttggaggaagccagaagagtaacaaaggatttgaagaaatctgactgaaaacgttgttctctacagagatggcccttcagcagatgggcactttataaaagtccttttcaccctctgcaaaggctactgtcactcccatgaggga

SEQ ID NO: 57659 - DNA, 1115 bp, Bovine  19866881239114
cagagaaaatataccttctcttaagcaaaattagccctcttctgatactaacccttagtatccacttattaaatcaccagtcacttgttaaaatgaaagtgaaagttgctcagtcgcttccgactctttgcaatcccaaggactgtagcctgccaggctcctttgcccatggaattctccaggccagaacactggagtgggtagccattcctttctccaggggatctcccaacccagggatcaaacttaggtctcctgcattgcaggcggattatttaccatctgagccaccagggaagcccagtcacttgttaagaagcattgaattcatcatgacagaattgagactatgcagttatagtactgcatatgcgagaaaccttttcggactgatttaatactaaacaaggctttgccaaaatgtttcatttcatgttttatttgagccagcaccaaatgataggcattgtttccttttaattgaacccatatgcaaatcggtagaatactccagatcctctggaagaaatctttccaagctctatttgaattacttgatttatgactgagtcttgacatctggatctcacacagatgttcttattctagcaggcacactcacaaacaatatgaattatcattttaaagcagttgtgtgtgtcttattccaaaatggacaccaagtttgtttggagttgcagagttaacaggaaaaagaggagggaaatcaggcttttttgtttggtttggctggtagtcctagctccagagactttatggctgaagcaaggaagaggccaacatagtcatagagccaagtatgtccagctcttccacaaagaacaggtattttccttcccagtcaaaggagagcaaaggctcacttactgtatgcaaagatactccttggccttttctttctatgtacaaactcaagcacacattgccattctgcttctgctgagtgtctgactacttagaacagacctaagaacaatcctatgttgtacagtgatcaaaccaaccttggattatgactctcattcctccttttttctaaagggatcaagtacaaaaaacactgggaggtctatataaaattcaggaatccagaa

SEQ ID NO: 57660 - DNA, 752 bp, Bovine  19866881310550
aaatgtgtgttatcacacatcagtgatccaccctcaacatcaattcttattaatatccacatcatttatttttacaatggtaaattcttacatatcatagatcttgatttcactactctgtagcagcaataaagtgttagaaggcccatcagcatgatgacacacattccagtagtaaacccagcctgtttaaaaaaataaaaatatagaacaacatgtatcatgtcagaataaattaatatgcaaccatattaagttactctaaacaattatcataaatatctgatagctaatataaaactaaatataataatctatttctttaataattttatgtagacttatgaaaacttgtaaaactcacaatacaaagagaaaaaaattctaatacaaagtgtgctgaaaattatattacctgttttatgccccaaggaatacttagtatagatgttcccagcatggtattccaaatcataaaactgaaagcagagtaatagtagtaaaacataaagtttgactcttcaaatattttaattaagacaaaaattaaaataatcagtaatttttatttacacataatttaagttatgctccaaaaagtattttaactcacatggttactaaactggtgtttttaccatatccttcagtgtaacattgaagtttataagcagaacccagtgggctatatacgtagcactcttctggagcggaactacagatctggggcaatcggttaaaaaaaagaaaga

SEQ ID NO: 57661 - DNA, 758 bp, Bovine  19866881315330
caaatctttgaatgtagtacagtaccggatctgactccaatcaacagaacgctgagaaaaggtactgatttgtttccactcgccacctggcccttgctgctgaatttggccaaagcgaggcggataagtgataacataacgggtgtccacctcagggcgttcaccattaacctccaccgacaagttgctctgagtaatcagaactgaaccaccctgctgtacggccacaccggtccgattggccactgccaagtcccaaggaatagccatgacccgcaacaccaccgtactgctaaccagctctccatcatttgctctcagaaggatccgggagtttggatggcctctgtgcacacagaaaatgttgccatctcttaaatccccatatgagaaaccattaatggctctcccaggatcattgatgttttctaaaaacccagcatccgaattgaagttgccaagcactgagacactaagactcgaggaatctgtgtctgggtctgaaacatgtatgatatttggagtcagtcgtttcttagaattctcaaacacgagaagcaagtttccttcagggagcttaaggtttgggggatcatttactggaatgacaacaatgttaaacacataagaaacatgtccttgcagatacagtggcacttccctcttgctgttggaagagactgaaaatgtgaaataatccctaggttcttctgaaccgtcatggacataccaaacgttcccttgctccaaatccaaca

SEQ ID NO: 57662 - DNA, 801 bp, Bovine  19866881319453
tgtgtgtaatgccctaaggaagtacaccttccagtattaatgcctttctgtaacccccttccacgaagattttgaattggccacatgacttgcttcagccaatgtgacatcagcaacagtgatacaagcagaggcttgataaaaatttgtacactggtgtttactatcttgagatacttgctcttggaagccagatgtcaagtaagaagtctgaccattctaatatcaaaatgtaaggggaaacctaaactaatcatgtggagagagagatgccttgctagcaagatcccagctgaggctctagtcatgtgagtaaataaaccattttggatcttctagcctgaggagatacctcttggatcagacaaactgcctagctgagctcagtccaaactgcaaaatcataaggaataaaatgttggtttaagtcacttcattttcgggtggtttgttatgtagcaatagataactgaaatgacaatgctaatgaatttgccaaacccattagacattttcaatgagtaaaaacataacggcaacctaatacttatactcttatgaactgttacacatttcactcgattttatactttaaatgttgaattcttaaattaccatgatcttaggatcttcttcccgctttttggttttaggttgcaatggaggtgaaatagtggcttgcgtttgaggatactggaattttggcctacttttaagttgttgctcttcaaattcctgactgaatccttcaggaagcgcatcttaagagaaattgggataaaaataatgtacatgatacag

SEQ ID NO: 57663 - DNA, 1480 bp, Bovine  19866881371699
ctccacagctaccgagccttccctctagggcctgtgctccgcaagagaagccactgcaaagagaagctcctgcaaaaccccacatgcagcaagaaagccctagcacagtcaaaaacaaataaatatctttttaaacattaccatgtgtcgagggagggtaagcatattcacattaaaagaaacagaaccatcaatgtttcctttaggaaattttcagtagctatagtcaattaaaacttgacttttttagtctgcattaaaattattcaccaaaaccagaagcagggtatccccctattttactgaaaatgattcacctttgatgcaccagtgatagctgagaaaaggaaacacaggggtctcagtggggtttctttctaaggtcatgtgatttctgaaaaagcaagctctgagtttgaaagtctcagggtgttggggatggctggttaacagccaacaccctgatcaaacacattactatttatgtagtataatgaccacatcctcagctcagaaaaagagctaatgacatttctaatagaaagcataccgaatactcttccttcagagactgagactgatccttcttagagttgttctccaatatcggaacaaaatagcgatgtctgactcccattttcctttcttagctaaatccagaaagaaggtagggaggaaggaaaggaaggaggaagagaggaagggaaggagggagagaggagaaattcagatactctcacatgtctaaagtggtaaaatcaaaccgtcaggggaagcacaatcagaggacggcctggaaaaaaccagtgctccctaaccccaccagcctctgtccccacctgccaggttccagataggggcacaacaaattacctccacaaagtggagaaggaaaatccaggcaagagcttatgaataaataagattccctcctacatttccatttgtccttggccgattcattcttgcaaaatcctaggcaataactaaaaagacatttggctagtgaccaatttttaggtgactgattttaaatctctgattaaagactataaagggctttcatttatgatagggtaatggatagagaagataatgttggtgatgatgaaaactagaatgctcaaaatctcagctgaaacgtttgaggtctcttcttgtatactatcttctgatggcaacaaggccccatagtccctgcctccctctccccacagaggtcctcgccgaggggggcacacccactggtgaggagtggttactcaccattctcacttgtgaggtttctttccctaatgcctaactttgaaatgggaaagaaagaaaagaaaggaaaccacatcctttgtactctcagtatataaataagagctagtcaagaactgaaaacacatttcacattgattgatgtggggacaccagccacaatgaggaactcctctacctttctggcagccactctctcaattgtcgtttttct

SEQ ID NO: 57664 - DNA, 1754 bp, Bovine  19866881415534
tactttgtattactatgtgtatatcaccttatatttgaagttattaatttactgttatacataagcaaaaaatacctgtattgtagttgaaattggctagctcttaaaacaggcaaggcccttcctcattttacatgattataatataattaaagctatggttagtacctctgaaagtgagagtttggaaacattaaactttggtcatttttcttacgtagatggaaaaaagcacggcaggaaggaggctatcgttctgaaatagcatattgccggaagaactttcttaatagaacatcactgttaaccctagaggtaagtcttaatgcagctgtcttaatttagggtcatatggtggaccagtgggattatgttgggaaaagaaatgcctaggatagtgcttgacacatagtgtttaataaacatttgctaaattaataaatttgtgatttttttgttttgtttaccacaacaggtaacctgtattacatggttattcaaaatagtatttaacagggacttccttggctgttcagtggttcaaactttgcttccaaaatagtgtttaacaatcatattatattcaggaagtggtcaaagatgcaatatgatttcatagaaataactagtttgggaattaggatagttgtctattcaacagctcaagcttggagaaggttaatttagtctcagtttctcattttaaaaaaagaaattgaattggggatatgctacagtttttctcagctctgaaaatcagttgttactttgaattatcatggaaattttcaactatacataaacgtgacaatagtatagtgaactcctgtgtacttacttcacacttcatagttaccaacatgtgctcagtcttgttttacttatactccccttaatccactctctgccctctagatgatcttgaagcaaatcccagatgtcaggttgttatatatctctgaagtataggacttgtttttttctttagcattatcatgccttgaaaaataattcctttatatcgtcaactatacagtgtgtaaatatccctgatttttcatatttttttttttacagctagttcaaatcatgatccacacaaggtccacacgttaaaatcggttgatacgtctcaagtgtagtacagcatttaaagggaaatggtgtttagagcagacgtgctataaaagcattcagaaaataaacttaacctctcacataattcccctattctatgctcatattttaaaaggttgtctggcttgggttcaagatatggagagataagcaacgctcctttgtctgcactccacttcctccagaccttcaagttgccccccactcccttccttctatcagccttgtcttcacctcccctaggctacagggttttcagttctttaccagtctggtggtattacagcaactgtctgtctgatttttcttctcctggaattgaagtcccttaagtcccaaaccagaaaactcaaggaaatcctaaatgtaaacttcatcttttaatcacttgtatcctgtctactttaaaaatgctcatccttgcgagacagcaaaagagacacagatataaagaacagacttttggactctgtgggagaaggcaagggtgggatgatttgagagaatagcattgaaacatgtatattatcatatgtgaaatagatccgccagtccaggcttgatgcatgagacagggcgctcagggctggtacaccaggatgacccttaaggatggg

SEQ ID NO: 57665 - DNA, 1103 bp, Bovine  19866881417825
cttcccctctctttcctgtaatcttcaatctcttcttctgtttttcatcacctaaaagcaaactctaatcctaaaaatctctttcttgatattatgaccgcctcatcctgtaatctaatttcattcctactcttctaatcaaaccctttgaagtgctatctgcatgtgatgtctcctcttctttgtgtcccatccatacaggcttgaacaatttctgtctccctctgagctagtctcatcaaggtcagttttatggagaattccctagtggtccagtggttagcacttgacgctttcactgctggagccccaggttcaatccctggttggggaactaagatcctgcaacatgtgcagcatgccaaaagaaaaaaacattagctttatcccagtggtcaaaaccactgcatgacctttatccttcactgctctagatgcctttagcactgttgagccctcctgatgaacactgacgactccctcattctccatgaagcaagatgtcctggttctcttggtgactctgtgagactgctcacttgcagtctcctccacagtcagctgtcactagcccattacctggactaacaccatatgaagatacagaacatctggctgtttctacttcctgcgatggcaccagacacacggggtcaagggcaggtggacagagaaggggctcagaaaagctggtgatgctctttattcctgacttgaaaaccctcagtgctctggatctggaggagtcaagtggctgagggatctttttagcacttagtttttttcaagtctcacccaactgtggggtgaaggtgggaaggagtcggccacatgtgtaacttgtgcaagagggaggccaaacgcagcactcaattgttcttggggaagcagagttcaacaatttaaaatcaacttttgttctcagatagccaaaaatagtttcctgtggcttcttttatttctttcactagggttaccagaactcagctttgtgttagaaatgcaagtttagcagaaacatcttcccctaatgaggcctggtgccctgtcggtattatgtctgagtccctggggctgttcagtggggtgattttccagttgtt

SEQ ID NO: 57666 - DNA, 1134 bp, Bovine  19866881481295
gaaattaaccaggaaagtattttaaagaaagattttcagaactgtttgctttcactgaaattagaattgtcttttcataatacagtatttttggtaactttatatcataactttttatgtactgtgtttcttctaaaatgttctatagatgatacggcataagtgtaaaaacttattttttaaattaaaataaaaaaccaccaaagcaaacttctctgctagaatatttgcattatacagattcctaagatgaagtcctaagagaagggctgaagttataaaacagctcttattcatgctgtatcattcgagtggaataacttcacttggaaaggaaagccacattttaccccacaaatgcatccgtaagagccttgacagtgtttcaccatggtattgacggcccatacttgatcaaactgatgtcgagtatttattcaagagatcactaactttatgcactagctccccaggtggcgctagtgataaagaacccgcctgccaatgcaggagatgcaagagacgctgattcgatcagtcaggaagatcccctagaggagggcatggcaacccacttcagtattcttgcctgaagaatcccatggacagaggagtctggcagactacagtccatagagtcacacagtctaatacgactgaagcaatttagctcacatgcgcacaacttaatccacagcactctaagaaagaagaaagcttacaaatgtgaaaaaaattagcacaaatatctaacatgccctagaaggcccaacctcctttattcactgaaagcaaatcccaatagggaaagttccaacagtctctcccacaagggtcaggtccactaacatttaagttaagaaagaaaatcaatgagtgaatagatatttgctccacggctgcaggcagggcagctgacccgggtgttcactaggctgggagggtgggacgggtccctggctccatatctgtataccaaatgtgttgctgacacagttgggagggtggcggagaagcaagtagtaggcccaaggccactgtgaggatggaaatcttaggtttccaggaagagctggagcaatccacagtcctggaatcctggctattgcaaaacatgtcgcaccagcctctcaa

SEQ ID NO: 57667 - DNA, 1424 bp, Bovine  19866881560174
ctagatacacccactgtcatgagcagagagtcaaagcaatgcattaccacacctctgttaattaatacattacagtcattcttacacatctgtaggattttagttccaggaccatcccctccctatatcccccaccactgctgctaagtcacttcagtcgtatccgactctgtgcgaccccataaatggcagcctaccaggctcccccatccctgggattctccaggcaagaacactggagtgggttgccatttccttctccaatgcaggaaagtgaaaagtcaaagtgaagttgctcagttgtatgcaactcttagtgaccccatggactgcagcctaccaggctcctccacccatgggattttccaggcaagagtactggagtggggtgccattgccttctccgatcccccaccactgcagatactaaaatctaagaatgctcaagtcccatatataaaatggaattgtatttgcatataacctgcacatattcttctatatactttaaatcatttctagattacttacaatacttaatacaatataaatgccttataaatcatggccagtatgtaacacataacaattttgacttttggaactctatggaattttttttccaaatgtttttgatccatggttggttgaatctttgggtgtggaacccacggatatggaagaccatatttccaaatactgactgttgaaaatttctctgtaaattatatgatagtttatcctcagaacttttgacatggacagtcaagtactttggcagaacctacctgtaagttcagatattgtaatagatagcaggtcagaaaaagatgtgacctctaggaattcagggttgaatattttatctctagccttcccttcttggttatagtcactgttgttggaggaagggctgctcgcatggtattttcatggtaaacccatgaaaataatgagtttaggcagttgtatcaacaagatactgggttgggaccatctccatcaattgatataaaaaggaccttgatagtgttatgtgacagcctggatgggagggtagtttggaagagaatggatacgtgtatatgtatgattgagtttgctgtccaccggaaactatcacaacattgataattggctatactccaatataaaataaaaagcttttcaaaaaaaggacagtgataggtcacagacattaaggactttggttaaatcttgaaaactatctcaagcaagatgggaaaacttaaaaatcagtaggagttatacttgcaagagaatgatatacaccatatattaaaattcatgaattaatgatgattctcaagcaaataaaacaaaaccagtggtcagtgtttggagattggagccaagggactcattcttctgaaaatatattacaaggaaaagaataaaacact

SEQ ID NO: 57668 - DNA, 1671 bp, Bovine  19866881560550
agtgtctatgaggagatgctttggaacctctaaatatcctgtttctcatcataatttagctcactagtttcagcagtcattttaggattcttacctgaagcgtttattactagttggttgccagatggtgagttttcttttctcttttaaaacaatggtgcctgtaatttatttttggctgtgttggggcttcattgctgtgtgggctttctctagttgcggcaggcggggctactctccagttgtggagcacggacttctcactgcggtggcttcccttgctgcagcgcatgggctctaaggtgcgcaggcttcagtagctgggacgcttgggcttcatagttgggctcaagggctctagagcacaggctcagtagttgtggcgcacgggcttagttgttccgtagcatgtggaatgttccgggatcagggatggaacctgtgtctcctgcattggcaggcggattctttactactgagccaccagggaaaccctgacttttctgattttctatttttctttctatattgaaattatacaccattcagtttctaatgacataccagaaagattgtaaaagagaaaatatctgggctaatctaaatccataggaaccaaaaacacccctttcccctccccttaatcccagagcccaggtactttgctaagtggcttatctgtctatatttaacacagtggaaatatgcagagctgttggaagttgttcctaaggctgctttctatttgagataacaagtaattcctaatcttctctgagaaccttctctcctcaggttgaccctgcactttttctcataaggtcttgatcttattcttcctttcctggccctctctcagcatgcacacacacacaggcactctcacaaatacaccaactcacacacacacaccccttagaacctgacttttaaagctggtgaagccaaagttgttttctaaacatcacctcaaccctcttatcctctttcaaggcatgactggcaagttgacattccacaggtgccctcacttcctttgacttctagctcagccctttcagttacctgttctcgggtcttggaagctcacacactcaagatgaatctaattccattctctctctctctccagtgtaaaatgtcactttgttatctacaatttcttactcttaaaatgcgtttcaaaaacagaactcagaacagacctctcctacattaggcacctgaaatacggaactatgtttaagactctttgccagttacttctttcagaagatttctgaccttcatgtctattcttcccatttatgaaaaccattctttcattgggaaaatcattttccttacaatagacatcaaaagatcttagattattctaacaatttgttatatgttttttaggggagctgactttcactcataccaaagaaacagtggccatgaatgacccatatccacaaaaaccttcctcctggttaatagtctgttaattttcatattaagaaactggatcttgtttgccttataatattatacttctcaagcagaatggaaacatttcagaaaccatcctctgggtctaaaatccatggcacagtcacctacttctaggaggaggaatatattgataactaaccttttgtcataaatcttaaactaggaatagaaatg

SEQ ID NO: 57669 - DNA, 1300 bp, Bovine  19866881905464
aacaactactttcgcgaaagaaagtgtatacacgaatagttctacaaccatccgtgttctgagagtcttgttctctgaacacggatggtgtagcaccaggtggtcaaaaatgctccttcgcctttcctgcaggcctcaactccagacttcggacacgcaccgtgctactggactctccggcaggaagcagaaagaccccaaaggacagcttcaaacccctacccaccccaacggttcttcacttggcccgaagtccagctactactaggaaggccagagcgttgggatgactcctgtactgggaaaagagccggcggcctactcacctctccgcggcttgctctcccggggtcctcacaggcgctgacgcggcttaaacggctgcacgtgcaggacgcagactgcgtctggtgcgcttatccaacaacaaatggcaccaggcgacgaactccatcagccaatcagcgtcaggcagccatgtcgtcccgcccccatctcccgcctctcctaccctacgcgttcgcgttcgaggccgctgtcggctgacccattacgttctggacggagtggcccgttaggcctgggggtacaaggttgatcgtgggtcactttctctggatgcttgtgcggggtcctcaatctggagaggctatagaattttcctatgtaagcactgcaagtcaaagtttaaaatagaagaggaattaaaacgtcctcctacctacctctttaagttttctctcctttttttgcctactgcagtccctggcagttggcctctatttctgaggcgcttgcttcacatccagggggttcccaggtacctcaaagtatggctgaggccgggggtggtggtgtatttctttttcttcccagaccgaagttatgagactgtcacgctgatacctaggaggctgtgaagacagtaacttgtcttaaagagctagaggtcgaattcttttgggcaccctctgatccggaaaggaaaattaaattgtgctggtgaaggtcgttcattagatttgtgacccacctgtttatagccctacttactggccaaacctaagggtgtccgaaggtagttcagacttacactcatcaaccagttagtgttctggcccacaaaaagtcagagaaatctttccatattttcctatccttccaaaaggcataacaacacaccactggaaaaatgccatttttatttttggctttatattcatcattttccatgctctgaatcttttaataaattcctgaatagttcagaaatgtaagtcccaacacagtctgacactca

SEQ ID NO: 57670 - DNA, 1512 bp, Bovine  19866880476643
cctgggctacgtatcagggccaacaggcagatagatatatccttttagatattggaagcacctcccatgagctggcactcagtgcatctctgtgatggtaagttgttgtgacgatgactgtccccgacgtgcactgcaggtaccaaccagtctccagcttccagggacagcccaaatggactaggggtgccccggaggctgagaattggggatcctagggtgctttgaggaggacaacgatgggagaattgcaggttaaaccttaaacggcaagtcccccctccccccatttcggagtccagcactaggcaatgtgacctggtgatccttgccccctgggagggtggtttgcaagtggaataggcagctctggagttaccatggcaatggcatgtgtccacagcgagatggacacttctctcccagactctcaccccctctctcaacccgtacataagggatgctgggtaacagccaaggtccagagagggtgtgggtttgggaaaaaatacagagcatgttctggcctggtgggatctgagcttctgggaatggttattataattaatttaaaacattattagtcatgggaattatttaaattatcattatttttctttttgacttgtgagatcttagtttcccgatcagggattgagtctctgccctcagcagtaagagcccagtcctaaccactggaccatcagggaattccctaaaattattattaatataaaccatgctactgtttggggggcacgatgtcctaaggtttttcctgcatggatagatatttccctgcaagggaatctctctctgcaaggtgaggaagggtcaagctattctggtccattttacagatggggaaactgaggctcagaggggtgatgtcaagcctcagaagggatttagctcagcctgtcacagcctgggctctctccccctcacaggacccctgtcctctgccccgactcctcccaggtgcaaaggagaaatagaggaaagtactgggtttggttgatttccaagcagttcagggatcttggctcaaagatgggtgttcaagagatgggtctgctgagggttgggcccccgggaggctcctttcgcagcccaagccggccgcccctcaaccccgctccgcctcaacccccgccgtcttcctgcaggcccatggcggagagctccctctatcggcagcgactagaggtcatcgcggtaagtgacgccctaccagtgcgctgcgccctgagccctgggcacccctcgccataaccaggcctcttcctcacctctttcctatcacagggagcaggcctagcgctctgaacgtggggggagcaccctcagctccagccgtgcctggagcgccccaccaaaatcctcaggcccctctgctcctcagttcttctgtatgatcatcaacatccccagaatggagctctgcggactccgcactctcaaatcggcagcatctgtttcattcttgaaccctgtctcccaaacacacca

SEQ ID NO: 57671 - DNA, 1858 bp, Bovine  19866880533211
agccaaagtaaggcatcaaggagagatgggggctgtggaaaacccacagcttactgtggccaggtgcatcagttactggatctatggatactggataatgttcctggatctatggtatggacttcaaggacaacccagagagccagattttaagtaaagtcatcttagttttcaaagacccatatgttgtacagcatgtggattatatcttaatagaggcattaccaaaacaaaatcccaaacccctcaaatcatggagatgcctcaaattattagaccatctcatggggatccttttcccatttttggggctgaattctgagaacacatccccacattttcttatctttttttatttttggccaaactgtgcggcttgtgggatcattttagtaatcccaaccagggattgaacccagaccactatagtgaaagcaccaagtcctaaccgccagggaactcccagccccccagccccaaccctgccccacaacattttctgactactttcctcatttaggtcatattggcaatcaaatatcaaaatagggcttccctagtgctcagatgataaaaaatctgcctgcaatgcaggagaccccagttcaatccctggatcaggaagatcccctggagaaggaaatagcaactctagtattcttgcctggagaattccatgaacagaggagcttggcaggctacagtccatggggtcgcaatgagtcgaacacgactgagcgattaacacaacacgacaacatatcaaaacattccattgtgcctgcttccggtaccaagctatgatctcattgaccttctctcacgcctcttccagcggtgtgctattgttatatatccccattttagagatggggaaactgaggcttaggcatggaaagcaatttgcccaagaccacaagaggacccaggatctaaactgtgcttgggtacttctctggtggtccagtggttaagtacccgcatttccactgcaggaagcacaggtttgatccctggtcagggaattaagacagccacatggcagggtcacaaaaaaacacaacaactgtgcttggagaggtactgctttgagctctgctggtcacatcccctagttcctcacctgtcgtcgccaggtgggcctgcctgagggcttgtgctgggcacctgtggacgcactctgcagcagctgcagctgggattggagtctggggaagagaaggggctgctgggagcctggaccccaggctcaatgggctacccccaaccggaagtctcagcgaagtaggcagaggagactggcctagtcagagaggcaaagccaccaggcagggggccctactcacgtgaacaagctgtcttccaggttccggatgcgggcctgagcttggtcttcaggcgactgggggtcctgtgaggtgggatcctggggccgctctggctcctcagctgccccgtccattagccagcgttcccggagagacttcctctggccatgagaaggggcatgtggatggacagacattactgcctcaggctgggatacgtgccctaataatgccaggtgggaagccaccccgttcccagccgacagctttcccacgctggaagaaacacccatcaatctccccaacttttccagaatgggacagacacccccaaaggggaaataaacgtccctcttagcccctctctaccccaaagcggaacaaacacgttcccaagatcttcccaaaggtggaacaaacgtcccccattaccaccaaccactctttccaagctggggaagacgcccatccccgaagctggaaccaactcccccaaccccatgtctaaagagaggctcttggttcccaga

SEQ ID NO: 57672 - DNA, 2134 bp, Bovine  19866880556370
ctccatcccttcctcactccactccaagccacccttgacccttttgtatcccttgaacttgcctaattcattatagcctcagggctttgcactcgcctttcccctcttcctgggaaatccctttcccacctcttgactcaaggctggctcttctcacctttcaggccttttgggttcagtgtcaccacctccaagaggccctcctgcatcaatttttttttttttttttaatacttatttggctgcatcagatcttagttgcagcatgtgggatctagttccctgaccaggggtcgaaccggtgcccctgcgttgggagcatggagtcttagccactggaccaccagggaagtccccctcctgcattttatacctacaggaggcaccccatcacctcccaggcatttcttagccttttccccctgctattacagcccttctcacttcctgaattacagatttgtattttatgtttattacctgcttccttccactggaatttaagttctaatagcaaaagtcttaagtatcccttaagtgggatttcctaggtgactcagttgtaaagaatccgcctgctggtgcaggagatgtgtttgatccctgggttgggaagatcccctggagtaggaaatggcaacccgatctcatattcttgcctggaaaattccacgggcagaggagcctggcaggctgcagttcacggggtcacaaagagtcagacatgactgagcacgcatgcatgtcccttaagtaacctcagtagctagcagagtagatccccaatagagggagtggctgcatggacacaggattgactgggtacatacgatgtgcaaggcagtgcagcagagggagataagacaggtgaggaagactgatggtttggtccggaagtaatggggagccatcaggggagtttgagcagagtaggggtgctggcatgctggaggctggaagtgagatgtgggctgccctgaccttgtttctgccatccctgcagggtcaccgtcctctctcccagcccaacgtggagtcaggtcctgcaggtgggtgttttgaggtctggggattgcaagaggaagggcctgaatcttactctgttgccccatctctcctcttccctgactcccccaggccagaccgatctaaacaagagagcctccttaccagccggaccggtgggcgcatacccggagtccccctccgagcccagaactgaggctgccggggttccagcagccccgagggcgggtccctggggcagcagggacctcctcagaagccaatggcccctgccctggatccagcccccctctggagcaggagccgagtcagggggtgctaacacctgagggggcagtgaatgaggccaaaggaggaggcatggtgaaggtggtgtgggaggggctgaggcccacagaggactgtgccatcggggccacaggcctggagctggaggctaaggtggaggagatggtgctggaggccatcggggacagacaggaagccagccgtccagagctcccctcatgggtcaaggaggacagggccatcacggaggtggtctgggaggggatggggggcacagagggcagtgacttggaggccatggcggaggcaggcaggggcccagaggccgtgcagaccagctccctggggctccgggagggatcagggggaacagctcctggacaaggtgcccccaggagcagccctgatggtgatgggcagggggtctttggagaggaggggtccttcatctgggtggaaagagtgaccctcagtgaggaatgggaggagctggaggtggaggggttggaagggccaaaggcactgggaagggaggaagaggatgagagtccattgggggcggagggcagaggcgaggaggaaacgtgggaggcggagaggaggcgggtggagggacctgaaggtgcagagaagagaggcagtgaggggaaggcaggcacggagccagaaggagcagagacatcactggcgcttgagaagaaaggaagcccagactccatggagccagagagaagaggtgaggaacgcgtggaaacagagatggcaggaggtaacgaaccgttgtcagccgaaagaaaagaagttgagggacctctagggg

SEQ ID NO: 57673 - DNA, 1634 bp, Bovine  19866880714394
taagtcacttgccctcagtcacacagctggtaagagacactgtcagagacagtgtcttggcaacctgactccagggactctgctctgatttctaaactgtctctctgggtgagatgcagtcatcctggggaccaggaatgtatggaaagttcataaaccacagtggattctgggtggggttgtttcctcctatcctgtttcctctgattgtttggggattttcatttctttctctcatgagcactagctctcctggaaggtttggctctatcacatcctctgggggagacacaggaagctgggtaaaaggacagggagctttctcctccccagtcctcactcagaaagtttaattcatttggcataaacttgaccatctgggggcccaatccttccagtcctagcagacctccactgccttccccacctcctacaccttcatgtgggatccccaacccttcctctattgctgcctgtacgagctggtgatcaagtattacaggggagaaaattcccaaggccagagagcagagctctgagctgaggttttagaaatgtcctttcacctcttcacccagcctgcttcccttcctcttccagggcctgcgaggtcctcctgaagcccccagagaaccagaaccatgcccccacctgccctcagagattcccagggatacctagccgggcagggctcaggacacctccatgcaaacctcagtaactcctgccctgaccagttaactcagtacttactctacattaaataccaattgggccaatttactgctgtaattaaaacctcagcagatgtgttccctgctcatcagtgatgagtttattaacgtccagctctgaaggaatgtggggcagggagaaaaacagaatggggcttgctctgggactgggagagtggatgctgggagaggttgagtttgaaactgttcagtctcccttgtttggctccaggcagggggcaggcagccacgtttatgaaagtgtctgcatctctgggttttctgtttctaccgtggaaactcggaaatatctgccctgcccctcttatctgctgcaaacctgggcctgctgtatataacggatccttttttgaaaatcacattttcttgactactgacaaacagtgtgtctggaacctataaacacagccccttatagctcagcaatctgggcttgtttgttatgtagcataacctaggctgtcctgactactacatattatagctccacttacagacagtgaaactaaggtccagtttgcttactaatataggagagaccaagatagttcttgccaagggagcctggagacagacctctgagttggataagagaagcaggccaggctagtcctcagctctgctcaaggtgagtagttcatgactgctggtgggttggaagctcactgcttagtacactcatggcagctcaagcaatcggctccttctgatcatcagagaacacctgcacagtggagcatgattcagccccaagaagtcactctactttttttttttgtaattaggagattttattttttagagcagttttacatttataggacaactggatgaatagtgcagacagtttgcatatctctcctgccaatttctcctatt

SEQ ID NO: 57674 - DNA, 1250 bp, Bovine  19866880804189
aacctttgatttctcctcgcaggtgaccgcagatgtgctgggggagataagagcctcatgtgcttccatagctttcttcttttactccttaccctttcctttcagcgaccgaggcctccagtcaccgcctgagggggacgcccatctgatccttgaagcctccccacagcactggggacactgcccaccccctgtgggctggggcagcaggggaagggggacaggagttggggagcacagcacagtggaaaaatctagactgggttcgaggttcagccccggcccttgggttttctggctcggaaactggagcaaatgacttaaatttctctgggccgctgcagaagaaggcaagagtctgggaggtcatgtgtgcaaggcgcccagcccagggcccgccacagagcccagtcgtggtggcaaagtgctggatgtaaactccccccacagggcagagacctcatcttcaaccccctccccagcgcccagacccaagcctggttcgggatgtgctcagtaatggtttgggtgccctttcaatccagctgagcctacacctccctctgtgacgctgggaggggatcaaacacctctgagatgctgccaggactccggagaacgtgggtaaagagctctctgtgcacccccagcgggagatgtgaaggaaactgcacccgttctgtttacttcacttcattgaagtcgtgttgcttcacttcattgaacctgtttcctcatttatagacaggattctcgaaacgctgccagaggggtgcttagctcgcttcctggcgcctaataagcgctgagcacttagtagtcgttgcttttcttttgaccactcaccatgacttttaccaattattattgctattggtaatcaaaaataaaactaacaccagctgacaagcccagtttctcctgagaccaggcagataaaaagcagggggggggaaaatctcttggtccaagtggcgtgcaaaagcaagtgggaaaaaaaaacaaaaacaaatgagtggatactatgcaggtacagaagtagggaagaggtgtagagacttcctagagctgaacctccgagtgtgggtgggagggcatgacccacagagaccaggagggctcagggaatgggcagcccccagtctgatgggagagagctaccttgagccctgggagaggcagtggcacacgcgtcttgggtgcgcatgcacacacacacattctcacactcactgacacggaggatgtat

SEQ ID NO: 57675 - DNA, 2667 bp, Bovine  19866880884111
cctcacggggtgacacctaagttactgtgtttgttttgtttcatggtagttgagatactgtagattcagattcctcagctcagggggaacgagaacccaccggaaccccgagagaccacttccaaggatgatgcccatggacagccccaaggtggtggggtggggcgtcgggctcacctgaacctcccgatccgtcgcaggtgtgagaacatctccccaccgggcacgtactccatgaccatgtataaatttgagttgtcctgcgggaagcagcaagtgatcagggctctgctccccaagctccgggccccatctgcaggcctagtgccctggcccggcaggtgttcagaaagtgacaaccaccatcctggctcccaggcggagcgcgtcccacgtgccaggcgctgtgctcaccagttacctgtctcatttccttctgcccgagagaaactaggggcagccgtcatcctgctcacgggggcccaaagtgagggccggttaggggtacatgagggaactggccggcatcggggctgcagtcagaactccatggtggctcatgtctgtgactgtcctgagcaaggctcttggggccacggttttatcatctgtcaactgggaccaggatgggctacagaatttgtggggccccccaaataaaagtgtgaggccccttgttaaaaaacttgattacaaatttcaagaaggtggcagcagaggcttcaactaagtgcagggcccttgtgactgcaggggtcacagaccctgagtggcctttcccagctctcgcagtcaaggcttaggatgatgcccaaaacagctcacacagggcgctcatgctgtgctttgaattgttatggcagccccaagtggggactgccaccgatacccattatacagatgaagaaaccaaggctcaggggagtaaagtccctggccagggtcacacggccaggaagaacagggctggcactggaacccaggctgagtggcatggcttgtggccatgtgtcaggttcttgctataaacggagtgatgattttgagggacgttatccagactgagggactagccccagggtatcaagctagaggctggcaggcccagttgaacttggggctatcagagccccaggctgattttcacgcccccgccccatcagtggacagccactggtggtgatcagcctggctccggctctgggaacccagaggctgcactgcctggcagcggccccggtctgccgccactggaaccccaccttgaaggagaactcgagtttgacaaggaacggaaagttgaccgcctgcaggatgcgcttctcattcagggtgtgctcaatctgtttcagcttcaccacctgcaggagtgggaggggagagtggagaagacggggtgtgagcgagtcctttccctcctgaccacccaaaaaaaaggagaggtgccagggccgggccaggtccttcatctagaattgtatgagtggggacttccctggtgctcaagtggtgaagaatccgcctgccaatgcaggggacacgggtttgatccctggtctgggacaatgccacatgccatggggcagctaaacccatgcatcacaacaagtgagcctgtgagtcccaactactgaagctcacatgccctatagcccatgctccgcaacaagagaagccatggcaatgagaagcccgtacaccacatagcaactagagagaactcctactcgccgcaactggagaaagcctgtgtgcactgcacaacaaagacccagtgcagtcataaataaataaataagctttgacctaaaacacacacacacacacacacacacacacacacacacacacacacacacacacacgctgttttagtgcctggggactgtcaagccctgggccaggtgcctgtccccacatggcatgcagtcatgcaattcagggcaagaacacatgagtcaccaggccacaggggtcagagccgtggtgggggaagctgggggcctgtggatgcccagataaggcacccggtgaagtctgaggagtcagagaagacttcttggaggaaggggcagctgagctgaaacagaacatacaagcagaaggggcacccaaggggtggggggtttagaaataccttccttgcaactagagcgcacccctccccacaatccacctgaacccagggctaattcctcctccgccctcagccatccccagcagccgcctcacacactgacaggaatcctgaggaggatgcactgggaacatgcatgtctggaagtccagatgcagagaagggaagtgtggtgcccaaggtcacatgcagctagtcaacctcagaccagcttgtcacacgcacgcaatctggcccctcggtcagctctgagccccactgcaatggggcttcttctgctttgttcacgacatcctctgggtctatacctgcactgtccaggacagtccacgctagccacgtatgactgctgagtacttgaaacctggctggttgactgacagatggagtttaaaatgcaaagtatcttggggcttccctggtggctcagtggtaaagaatatgcctgccaatgtcggagatgtaggtttgatccctgatccgggaagatctcacctgcctcagagcaactaagctcacggccacaacta

SEQ ID NO: 57676 - DNA, 1805 bp, Bovine  19866880918808
ataaccgcaagggatggtcttcccttgtggctcagcggcaaagtctggtgggctacagtccatggggtccccaaagagccagacacgactgatcgagtaaacaacaataatggtgcttgtgaatttcatgaatccttcaggcaaatcatcaaagctgagagtggcctggggcacttctctaacttcacaccacccccacgcacagagcagggagggtgtattagggaatgtcctcatgttctggaagaaaccacagagcctgactttgctacttcccagctgacaggccaggtgggtcctttgggccagggttcctcccagtgtggccctgggcatatccacactgtgttcagagtgcagattctgagtgcccctagacccaggcctgctgatcccgaatctcgggggtgaaaccaggagcccccaaatgggtacacccacccgtgattcccatgcacactctcgtctggacagctgctgctggtgcctcaccaggcctgtttctggatctgtaaaatgggcaaaccacagcccagggatgtactgggaggcttctgtgctagaagatgttctggaaggaggtgctgtggacagcgagggcatcccagggagggggccctggctttcacttgggaaacttcctagggttgccatgacaatggaagaacttgccatgggagtgcctggctcttggaggggctacattgtcacatgtcagctcccttcctgtgcctttcagggactgcaagctgggactcaggagcccagtggttagggtttaaatcccagtgcagccactccctggctggtggcttcacgtagtcactgaccaccccagtgcccttacttcctattctagggagccaacaacgcctacctcacgggcctctgctgaggggtgcagaactggtccgcagtgagcagacaggcccctgattactactgtcaggaggatgattaaggcagctcgtctctgggggacagagcgggctcagcaccatccacgcctgccggggcagccaccttcttgcacactggtcccagccaggcctatgccaggggtccgagggaagcagggatacacagcagggtcccaagccaccaacatggagactgtcactggtggatggagagaaagtcccagtgtgcgttggcagcagagacagacggaccccctgtgttgcgatctagtccctctgatgccagctgggggcccaacagggttggcagccaggccctcggggttttttggggtgagttgagtcccacttggggaaaagttttacatgtgttcctccagcgccatctgctcccacatctaattttagtccttcctgggtctgggaaggaggctgggggtggagggctggctcagatgggtctgggggtggaagcagccccacccggccccactggggctgtagggcaggacctggacgggcagagaacacgggtgctgtgggattggagggtgccagctggccggagcagtgccaaggcctggtggcatggctgaatgacgccccctctacctttgaggctctctgtgagagggagcgctggtgagcagggctcaccaccagcagcctccagacagggctgggaagagtggggcagggggcacccccagggcgagggtgaagccggcaggcctcctctctctgcttctcatcccgcgctgcccttgcccccgcctgggcccaccgtagggacagtaattgagtaatcgggcgagggtgggcgggtaggctccgggcactaattgtggcgtgtgcgggatccagggccagcatagggccgagccg

SEQ ID NO: 57677 - DNA, 1366 bp, Bovine  19866880935972
attcatagggctgttgcaaagatccaatgtgatcagcagagcaccaagcactgagaagtgagaagtagaagttgctattatcattattcactcaacaagcatccatggggttggaggggaaaggagagagacgcaatcctcaagctcttagaaacaggcaccaagcagagattctgactctggtgttcatcagcctcacctggggagtcagttaaatgcagactcctaggcccactgacagagtctgggatgaccctggagtctgccgtttgagctagtcgccaggataattctggggcaggttgtacagggcactgagaagccctggcctggactttcccagccttaggaaggtggccccttgtggcccctcccaccataaaagggctttaaaacctccacgcttgccggtgctttctccccttcaaggtgcaaaccctgtaggcctccttgtctccactcgaggacagggggaggtggcatggacacaactgagctcaaaatggggaaggggagatgggtaaaacagctaagccagcttctctactggagaccttctcagcattgtcattgttagtctccaggaagaacgatacagaatgccaaatttcccataattatttcaccggggaacctccctttttattttttccaattgtggaaggctaggttgagcagagttcagtagggtgttccctggagaggaataagtcacaaatatctatacaggatgaggtgtgttctccatctatttgagcatgactcagcaaatctgttccttagcaatgaaactgccaaaaaatgcaccagtggctgcacctatcttcaaagccaacacctgttttttggagaatgtttgaatccattctttaggacggggctggcatatttctgtgaagggccagccagaagtcaagatttttgactccaaggacagacaagtctattccagtgactcagctctgccactggactgtgaaaacagccgtgacaatatgtaaacaagcagttgcgtggctgtgtgccaataaaagtttatttctagacactgagatttgaattttacataattttcacatatcacgatatattattcatgtcacaaaatgtccttaaaaatgtaaaaacattctcagatcacagacagtaaaaaacaggtgaaggtttagctgtaatggtttacatctgggacaaggccctcccaaggaaatgaaaagaaaacctcactttcctcacctgtagactggcttcaaaaacgaacttttgggggaatggggaaattaaatataacagtgtgagtttccctcatcctctatatccagtttgggttgttttttttttttttttttggtgtggtggggggggt

SEQ ID NO: 57678 - DNA, 958 bp, Bovine  19866880959492
tgggctgcagaccgtagtgatcctggtctattcggaatcaggctgcagagcaggaggtgagtggtgggccagcaaatgaagctttatctgtatttacagctgctctgcatcatttgcattaccgcctgagctccacctcctatcagatcagcggtggcattaatattctcataggagcgtgaacgctactgtgaactgtgcattcaaggggtctagattgcgcgctgcttatgagaaacatccgaaaacaatcgtccccataccccgtccatggaaaaaattgtcttccatgaaaccagtccctggtaccaaaaaggttggggaccgctgttctaagatactggggcttagggcttgatttcagcatctgaattggtggaggggggaagacctgatttaacccattaacagttcacacaggctatcctggcatggctccaggcccccaagtaaagacactcttctcacaaaggacactagaagggctcataggacacgtcccaggagccagactcttcttgggctgggctaatggccttactacacaagtgggcacaccgagaagcccatttcacagatgagtaaactgaggttcatacagcctgcaggccgatacagtcaagctggaggtggagcctcttcagtggggttctgtcccacccctcctgggcctggtggtgaccgactccctctctcttctccctgcaggcctgagccgggctgggctcccatttgggctgatgcgccgggagctggcatgtgaaggctaccccatcgagctgcggtgcccgggcagcgacgttatcatggtggagaatgccaactatgggcgcacagatgacaagatctgcgacgccgaccctttccagatggagaacgtgcagtgctacctgccggatgccttcaagatcatgtcccaaaaggtgaggggctccaggaggaaaggggtgacagcagt

SEQ ID NO: 57679 - DNA, 1358 bp, Bovine  19866880969786
atccctgcctgtggaggggcacatccgttaaaaaagagaaatagtcacatttgaaccaaggtttgaaggaggccagggagcagaggaagaggccgtgtgaataactggcaggcagaagattcacccagaggaagtgacaagtgccgaggccctggggcagggtctgggctgcttgaagaagagcaggaggcaagagtggggtcagggagcttaccgggctggttgataggctttcaactgtggggggaaaaacaaccagtcgtcagggctcttttgtgagattccaaactgtaaataagaggcttggaaagtatgagcttgtccctggtgttgagaccataggacagacgtgggggatgcgagtagaggacagaccaagggtttgcacactagaagtgaagtgagagtcactcagttgtgtcccactctttgcgaccccatggactctgcagtccatggaattctccaggccagaatactggagtgggtagtctttcccttctccagcggatcttcccaacccagggatcaaacctaggtctcccacattgtaggcggattctttaccaactgagctatcagggaatgagagccagataaaacatggggtgctggaacttgcctggtggtctagtgattaataatcagccttgcaattcagggggtgcagattcgatccctggccagggaactaagatcccgcatgccacaaagcaactacacccatgccacacaactactgagctggtgaaccacgactaagaactcagccaaataagtaaaagagaaactgttttttaaaaaagaaacatgggtgctgaccctcctcagagaaggtacatttctagcaagttgctgtccaggctggtgcccctgggccagggtcatacttgaagaaccggggtgtagatggagcaaaagaccaagggtggagatctgggtgtcccatcttaggagtatcgcaggggagacagaagcagtgagaagaggagaggctaggagggagaaaaagtggtcagaacccggctctgtgccctcgaagccgctgtgcccgggaaggacagactggggaagagggggctagcctgggagggcatacagctcccacccctcctccagcctccccagcccctccaggggctgcaccccacccctcaccccgcctgcccatctccagctcaccctgagggtccccccgagaggaaagaggggacttagttgtccctggtccctgatctgtggcgccagccagctggattctaattagcttccagagccagagagacaggaagccaaggggctgggggtggggccctggactcctgcccaagcccgcgaggctgcaggccggggccaag

SEQ ID NO: 57680 - DNA, 1317 bp, Bovine  19866881050891
ccctgatatacttggccctcctgccgagccctcagtcctgggaatttcctgtgtttgataggcggggtctcacggagcacttttccttttatctggccagaagagagccaggaatgggggtctcccaactggaggggatgccagagagttggggttcaggatggccttagggtgccacgtttgtggactgagtcgctgtcacccgaaggtccgagagcaggtgtgaccttggtgttggatctggaggacccggggactggccagctcccccagcgacctcatctccccctcctgccggctggctctccgaccagattgcaacccgccgtcctgccccagttgtcgagggatctactcagttcagtggcaccagtccctgtgtgtgaaagaggatgctgcctcctgtcccagctccctgctcttccctcctcagcatgtctctgagcctccatcacgtggccattaattcagcctctgccatacggttcaccctcaggctctgaggggcctgagttgccctggaggtgcatagtcaaggtcacctggccaagttaggcccacaggagaactttccccactggaaatagagcttcgtgcctgccctggtgaccagcaacacagtgcctggccctgggtgcccagtggatgtcgggtgttctttattaaaattaaaaaaaaaattttaatagattttattattcacagcaaccctcccaggttttccccattttacagatgcagaaattgaggcatggcgaggttaaagaatttctcaaggtcacaggacagaagcggggattcagaccttggcaggttacctgcagtagatgtcagatgtccttgagaattaaaatctaccaatgtattaaggactgatgcaaaactaccacgagaaggccctttcccagctttcttgctgttaaattatttctgttcctaacacccgtatccttgcagacctggagtggaagatcatttacgttggctcagctgagagcgaggagtttgatcaaatcctagactcagtactggttggccctgtcccagcaggaagacacatgttcgtcttccaggtaagaaagactcggccttggtccttgacacctagaaacatcctctctaaaaaaaaaaaaaaaagaaagaaagaaaagatagaaacatcctctctgacccaaaagcacacagatggttcattggtccgagttcaggttcagatcctggctccactctcaagcactgtctgacctctcaaaggtagttcagacatctcccatctctattacatcatagctgttaccatgagccaccaatttacag

SEQ ID NO: 57681 - DNA, 1022 bp, Bovine  19866881332368
ttgtgggatcttagttcccaaacctgggattgaatgagggccttccttccgcagtgaaatcatgaagtcctaaccaaggactgccagggaattccctccagttgcttttggaaaccagagacttgacaccactcacactttgagctcactcactcaaagcattggtgatacagaggaacccctacctccttcctgctgaaacaaggtctttgttttacagcacaccttctctcttttaatatctgtctggggtctgtaagggcttccctggtggctaagacagtaaagaatctgcgtgcaattttggagacctgggttccgtccctgggttgggaggcaactgactcagtattcttgcctggagaattacatggactgaggagcctggcgagctacagttcatgggatctcaaagagtcagaaacgactgagcagctaacacacacacgctggggtctgtaagcgtgtgaggtttacagttgctaggcagattataaatggccttacatgccctgctaaggagcttgaactaccaacaccacttttttttttttttttttgatagctattgtttatatgcccaggacgggaaccacctcttatcacttctgtctagccagcaccatgcgcggggcacgttgtttggcaccaataaaagttgacgaaatctagaaagggagggcatgagttcgtttgtcccaaagccgcagttcgcacccgcatcgctagggggcactaggaccccggcagggccgggggagaccagaggccacggaacccggcgacaaggggacattctgcattccggctggcgtctcccgtgtgtctcaggcctacctcgtctcgccgcgctcctgccccaccccaggagaagagaacccagaagaaaacagcctgcactgtccagaaagaaagggctttattggggagtaggcccagccgaggatccctgtcctctaacagacaaggccagaaggagaggctaaggcgcagaagggctgggcagttttactagcagggtg

SEQ ID NO: 57682 - DNA, 686 bp, Bovine  19866881413300
ctgacagggagaaaaggcctcagtattgtcacatgcctacctgagaacctgaaggcaccttttaatgagtttccactttacctctaaaatttaagccctcaaacagaagaacaagaaactactcactgctcacttttcattgctgccccttcccctcccagctacttcctatgctatagagatacatgggaagacacaggcaagagtcccgccaattcctgcccccagattcagaagctgtggtccatcggccgatggatgcccctaggaccagccgaggatgacctttattcatggtaggagcaagggcaatggtaaggtgggtgggatcggagggagggacagaaaccaaccagagaccatctgccttcctcaacactgttaccattgataataattaattttattgtgccctgaaaagcgtttatgcagactcatgtaacaacccactgaggtctatactactagccccattttacaaaggaaacaggtgttcagagaggttaagttacctgccgaaggacacacagctcgttgagcagtcagccaggtcagggataaaactgctcagcctcccagagccttaccctctaggtttctcatcaacaaggaaaccactttcccacccccagctgaaacaaagcctctttcagccacagcctttcgctcaaggggaggggctcccg

SEQ ID NO: 57683 - DNA, 798 bp, Bovine  19866880403952
ccagggcctggggtgctctgtgtttactctgaaggtgttggggagccgtggaaaggtcccaggcaggcaaggggcagggtcagttctggacccaagtggaggacggacaggaaaccaggaggccagggaggaagtcggggccaaaatccagggctttaaatcccacctccatactgatgatgccgccccagacgacccctctggtgtagacgggctcatcatcctggcttctggagaggggagcccggtggccacacccctcctggcgctcagccgctgctccctctaccctacaaggtcggcagctggagtccgtccgggccgaggtggccgagaagggtgatgtggggctggtggccgagagcagccgcagcacccagaggcttgtgctgcccccgcctgcgctcactgccgccggcgtcttcgccaagttccgggacatcgcgcagctggcaggcagcgctgtgagtgggcgggcggctggctctccccagaccttctcctcttggggacctggaaggctctggttcgactgctcagggcggtgtcacctgggtcctgcttttgggatcagagcttctcttctcctgctgctctcaagactgcgggactctcctcctgagaccctagccccgatgtagtgcgggccgtggggctccgtgaacacctgctgagcagagccggggtgggaggccggaaggacaagcttcttactgttctctgcgctccaggccgtggaaccggggagcaggggtgggaaggcgggcaggtctccaagggtggcagctccccaggcag

SEQ ID NO: 57684 - DNA, 1079 bp, Bovine  19866880408588
tgggtcttgtactacagagcctggccgcccccttctcgaaaactaaaacagaaatgcaagcggtctagaaattaaagcgacagccctggaatgacaacgtgataagagaaggaactcggggcgagccccagggtgcagcgcggcccctcccctgctgcccgcctccctctaggcccttccatggcagaaggatgagatgctgcctgcctgccacaccgcctctggggtatcttggggacagcagctctaacacggaagcgcgaactccacggggatgaggtgcggctcaggggagaggagggtgctctctgagcagggggccctgtgctggccaccccagggatggagggaggggagcctggtggcagccagcccggggcgaggctgtggatgggtggaggcgggcagggggtatttcatggaggcgagtacctgggctcagtctgcagtgctccgggagccgctccaggccgtgttccagaagcacggggacgatccgctccaggtcaggtacctcactggggcagggagcaagaacaaggcgggcgggggtgttcttctagaaccctgctcgctggctgcaagatccccactgcctgcctgtcaccccttcccagggtcggcttctgcctccctcgactcccctcatcaccccaactgtcgtcatccttcatgtttcttccaggccggcctccccctcccaatattccggcttaacaatggtctggggccagcctgaaagcaacagtctacaggtctccaagcaggggcagagttctctccatgaccgtcacgaccctcacagtgtgcccatcaccaggccccgtctgggtttctcatggcctttccacaggcacagtcctgcctggaactcagaagcctctgcctgcccctctccttggctgtcaggatcaccgcctctcccgtccctgtgtccctgacccctcgctgtcagacgcctccctgatctttgtcacctccccgtgcccagcgcctgtcttgtctggatccccacccagggctctgtcacctaggtctcaccagaaagtctgcttcaggatcatgccttgctcctccag

SEQ ID NO: 57685 - DNA, 1530 bp, Bovine  19866880483943
ccctcccagccctgccagccgcggcacctcccatcccggctgtcccacccagctgtgcctctcccctcccccagatgtgacccttcccgcccctccccactcacctacccgccccggagcggcgtccacctcccacaatgccccgcgccgcggcccggcccggcccttgctcccgggatgccccgcgcggcctcccgcctctcttcccgccgtgcctcgcgcggtggctcccaccagatctccgttttcccgccggtcactcctcaatccagagcaacagtggctcggggctgtttcccagcgtgctctgcgggagggctcgccccacttcatcccctttccagggagtctcacgaccgggagactacaactcccagcgtcctcctcgcgacggcggctcggacgtcgcccggccccgcccctggactcggccccgcccccgcccgccgaagtctgcgcgcgaagtcggtggcgcgaaattgggactgcggggtcgctccaggagagacgctcaggacagcggcgcgcgggcctggcgcgaggcaagtggcaccagccttgcggggcttcagggctgttcaacagagcgcatgtcggcaactcggggctccagctttcgccgaataggtcggctgcaaaggagaggacatgggggcaggctgatacggccgggagcgcgccgcggaggggagtgcgcgggctacgggccgctggagggggcgggacggcgtccgtcagaggttcaggatcaggtagaaggtagacgaagaccgaaaactgcacaagacaggatctgcagagacgcctggagggacgggactacctgaaaggggcgtggttatatagggatgagggggcggggaacggctctaggtgggcggggtcatccggaagttggaagggccggagaggcaggcccacctggaagggggtgggtctagggggaagtttaatagtgggcggggccggggaaaggttgaaggaaaagggtctactaaggggagagcccggggagctggaggtggggcggggcaagtcagtggtaagatctaggcctaaagcaaaggccttttgaaaggtcgagaaccttctgaacagggagcggtctggccttgtgtatgcctgatgagggggcggagtcaagggaagagacgtgaaggtgtggggtccaggggaggggagctgaaaggtctgggcttattgtgggcttctcaggtggcgctagtggtaaagaacctgcctgccaatacaggggacttgaaagacacaacttcgatccctgggtctggaagattgatgccctgttggagagcatagcaacccactccagtattcttgccaggaaaatccctacggcccatagggtcgcaaaaactctgaaacgatttagcacacaaagcactgcgcttattattgcccaggatggtggagggaggcctagaagagcttggggagggaagagacaaggatcttgagctggtctgattgggtctgagatgttggttaaatatccagatagagatatcagca

SEQ ID NO: 57686 - DNA, 849 bp, Bovine  19866880514463
caccccaggtcacctgccactctccttttctcccccagccacaaagttgcacgcctataagcacagcaatgatgccggccgctggcactggattatgagagcaatcatctcattctctctgctaagtattcgcttgcccagcctccctcgcaactagtgagggtgacatgacaattttggccaatgagagtgaagaagttttctagggtgcaggatgagggggctcctggaacagatctttcataataagtaaagaccccttccctccttcctatttggcatgctgggataagaatgtgatggccggagctgtggcagccatattgtaaaaggctgagagaactacattccaattgacaactctgtctctctgggacagggcaggattgggtggaagatgatggcaggtgctggagtggggcagaggctaccttgcgtttgcgggtggtgaggacttggaatggctggatctgcttcttttcccggtcccaagctacagcttctgtgtctaggatgaaggatgtgaccgatgggagtttaatctgaaaggtgaaagggggaaatgcaaagctcatgagaggtggtggatgaggccaaaagacagatggagagaaaccagtttattccccttctacatggagaagatccaatgacaaactgatgccagccttagagatacgcgtgaaaacagatgccttctggtccccactgagaggggaaaaaactaagttttctgaggacttactatgtggtcccacaagctggaaacccaggagcctttgtcatcttcctcttttgctcacttcacattcaattcagccatgaacttgcccattctctctgtgaaat

SEQ ID NO: 57687 - DNA, 2337 bp, Bovine  19866880578830
cctttgtgtcgtgttgggcagcaaggatggggccggctgtgtacctacctcctggggcagacagcgagaaagcaggcaggaccaggcgaggaggagggagggcgcaagagtggagtgcccccaagagccgcgggcgggggcagggagggatgcgcagcgggtgggacagagagagccggaaacagcagagagaaacacacagagagggagggagggagagagagggaagaaaaccagttacatccacatgagggggtaatggccagaccctgtccctccggggaggcccaggatgctgagttggccatgagcacctcccagcgtcagtgcctgactccagccccactcccaggatctatcccagccgggcaggctctctgttgccacggtgacgatggggcagtcatcaccaagaggcagaagaggaaacccccagtccgtgggccaaggtggccgtggggacccctgttagcaccagtaggacctatctgtgtgactttaggacaaccacttgccctctctggacccccatctggagatccacgcaggcccacaccttcctgctgcaaagtgacctacttctgggctccttgtggtcccggaagaagtcaacagcagcagtaaacacttttattaaccatctttttcactataaccgctaccagtaccactgattcccttttgtatttcactgtttaagaggtgccttttactagtatcttgtgctgcgctctggtcaaatctgggtccaatgccacctctgccctgtggctgcgggacagtgaccgagcctcagtttcctcatccaagaaatgggagggagtcctgcggctgcgggggaggtggggccgagcgcagtttggaagagaaccagtctctcaggaagctgcccttccggtttttctttcccgtccactcactgccaggggcatcatttgacctcccataaaggatctaaattcctctgggatcccccaggccagtctgcctcccttggagctgctgcaggaatccatctgccccggcaagttggctgaaaggagcgatccacatttcgtgtgcaccagggacctgcctctgtggcctgagaagagattcccccttctaagaacacaattccatgtgtacccctctgccaccccaccagagagtagatactgagacttgaaaggaggaaaggcctgccttgagcctgcacccaggctgaaagcttcctctggaccatacccctgtctgggctgcttccactgtaattcctcgccagattctatctccctggggcagccactcaccacttttccatgaaaatgccactgccaaccctccctaggcacctactatttaccaggcccagctctgagccagcagttctcaacctgtgccacacattgggaaccgcctggagagctttcaacatgaccaatggcctatcctgcccacagagaccctgatttcacgagcctgtggcctggcccctgtggtttccaggtgaatctcccaggcagccggggtggagaaccgctccagctctcagccagctgcccttgccggacctctgctaactgaaccagagtccgctggtgccacgtgttccaagggggactggcccctgtcccacccatcccaccgtggccagggctccccattctcctaagtcagccagggtgcttcctctccccacgtacgtgctaaatcacttcagtcttgtctgactctgtgatcccatggactgcagcctgccaggttcctctgtccatgggattctccaggcaagaatactggagtgggttgccatgccctcctccagggaatcttcccgactcagggatcaaactccctgtctctaaagtctcctgtgttggcaggagggttctttaccactagtgccacccaggaagctcttcccctccccaccaggaaccaatccgaccagctgagaagtgcatctgggcattccgggacccgtttctgcaggctctttactgcctacaggagacatctggggaacgaagacacttctagaacagccaccatgctacagggctgagcaggaggccacaggaggtggggataaaaatacaggagtctcagagtgggtctgccccagactccccgagagttcctgccaagcaaggtaaaaggcccagttccttgggttgttttgtttgctacagctgagagcagcctgagtcatgaacactctccccgcagggcctgtgctctttggttctcggctgtgtcctcagtccctacaccagggcccggcacgggggagggctttcataaacttgtgccccccaacagaaggggtgagacagcaccgattccaaggccagc

SEQ ID NO: 57688 - DNA, 717 bp, Bovine  19866880664813
attttgaaacaaattctcctcttacacagtaatcaaaaaatctctacgaacaacgaagatgaccgagtcaagtggcaggaaatgccgtggattccacgtgcaagaactcagacagagctgaaatcaaaggcgcggatggatcatcagaacgacctgcttcatttgcaggctgaaatgtacatgggcatgagcatctgtgaatacagtccacgtggggaggccttagagggagacatctcccttaggacaggagggacgcccatgaaagagaaacctcgtcattctcatcagtgtgaaaacaccttcctaaataactctctccctgccgggcagacgcaaccctacgaggcagagacaaataatgagaataatcaaagtgggaagacatttgtccctgttccaagttccgattcgcacaggagaacttcgatgggagggaagagctataagtgcagggaatgtgggaaggccttcgtgtatcagtcgttccttaagaaacacatggaaattcacacgggagagaagccctacacatgtgagaattgtgggaaaaccttcagatacatcttacaccttaataaacatttgagaaatcacaacctgaagacctttgaatgtccggaatgtgggaaaagtttcaacaagtcctcaaagcttaaggaacatattaggattcacactggagagaaaccctatagatgtcaggaatgtgggaaa

SEQ ID NO: 57689 - DNA, 1487 bp, Bovine  19866880687048
tgagcccaaggggcagtgtgtgcattggacttccctgacctcctctgctcccccaccccagcatctcccctggaaacatctggacccctctgtgggaagagctggcggcctcaacacctgaccccactgctacaatccgagagggcactctggcccaggtaggagtggggcccgggtcgaggtggtgttgggcgttggaggtcaggtgggggctcctcgtgactctcctttcccccttgtctctccccagcccctgggccgcatgggccagccagctgaggtggcggctgctgctgtgttcttggcctccgaagccaccttctgcacggggactgagctgctcgtgaccgggggtgcggagctggggtatgggcgcaaggcaggccaggccgccccggcggaggcccccaccaccccttcctgatctcccacatttccacctgggcctccttgatgagggttctcccaccccaaactctgtctcccaaatcccagtttccaccctctgcctctgaagtgcagcactccacccaccccagccccgactgtagacattcagaccactcaccaatgtgccaaaccaccccacagtttcccataaaagcactttgcaaccaggaggaggagggcatcactgcatttatttccgaccctttatgagtcctaccatgccaggaccgggtcccccgaccccgccccacccagctcccacgcattcccacgcgtggcttagacccgagggactacaactcccggcaggccttgcggcaggagactgcaacccagggctcctgggaaaagtattgcaggttggcttcaccggcgagctaattaaaaaggcccgcaagggagagtcaattaagctctaattaggagataatggagggggttaagcaaacaggcctccactttattcttggcccttaggggaaaggagctttgacttcgcttgcagcggagtaggaggctgcccagcaccaaaaataatgagggaagagaaagctaggcggttgacattcccgggtcagagggagaaagggctgggatctggactccagggtttgaggaggagggaactaggcggtgtggactccctggctgggagggagcggagtctggccgccccctccagatggggcgaggggccccatcgggggtaagtcccccgggtgcggaggtggggctgcatcgctgctgcgggattggccgaggcgggggtgtgtgcggcaatccttgattggccgcggcggaggcggggagccgcctgggcgccgcacccttgcggctccagcctaggtggtaggggagaaggactgggcaggtgggaagaaaaacaaggagacgtcctgcggggaaggactcagaatctgactgcccgggcctgtggcttttcgtactggggaaccagaaattgggaacaaaatgtctcagggttgaattacgcagacacagtgacctaaggagcggagtttgaggatacaacagga

SEQ ID NO: 57690 - DNA, 1263 bp, Bovine  19866880789987
ccctgttgctgctgctcttcgctgctttcatgggcctgcgggcccgccaaaggtacgtgacccccccaaccaagcctgccctttgatggtcagctagaagggtcaggccaccctgtcagtttgtttctttttttttgtggatgattcctgcttcgggttggcctttctttcccttccttattcactcaacacaaccttgggagggtttcttgatctccctgagcctcagttttctcatctggaaaatgggcttaataaatagcgagaccctcctaggagggctattgtgaggaagagatgagtgaatctgtaatgagcactgggtgcagggcttgcacatggccagtgtgacacaagtgttcacagccactcactgggcacttggtgatgtgaagggtgtgttttagaacaagactgcctgggtttgaatctatttctaccatcttctagctgtgtgacctattcttttagcgtgtgtgtatgagagagagagagagagagagaaccatgtcatgtggcatgtgggatcttcgttccccaagcagggatcgaacccatgccccctgcagtggaagtgcggagtcttaaccactggagtgccagcgaagtcctaagctatgtaaccttgaacaagctgcttaaacctctctgtgcatctcagaagcagagatgacagtgagttgtggtggtgattaaatgcattaatgcgctgaacatggaaaacagaggctggtgcacagtacagacgtgtcatatgagagttcaccgttacctttattcctattattactgactgggctcttgtccgctgagtctgggcttccccaccgccaagctctgggaccagggcctgtgttttgaacaagctgctttcctgatcctgctacgtgtgagtgcagggctgccccatccagttgtacaggttgttcatcatccaaggattcatggccgaagggacaggtgggcgctggaatccagcttgtgctttgcttgctgaacctcaagctctgccttgaggcggctaccttttactgattctccctggggttggcactggccccaagagtgcgaactggcgcgaattgtccattgtacctgatcattcacttgctggttcattgattttcaagctgttttcagccatcccaacgggctcttaggaagcctggtaataaatcccacagataataaccaggctgcgctggctgagcagggagcacttcctgctgaggaccaagggtccggggtgtcatttgagggaag

SEQ ID NO: 57691 - DNA, 1454 bp, Bovine  19866880802881
gacttaaaggaggtgctgctgataatacgccaggactgagccggcaagcaggggaggatgttgctctatgtggacatcatgtggccaaactaggatcctcagccaggcctgatcgatccttctggaataggaccctgggttcaattccagatattccccctgacccagatcaagtctcatcatctccctgggcctcagttcccaactctgccaaaggagcaccgtggaggctacacagtgtaaagcccagagtcacagctctaactcctcaagcactgaggtccagagaagggcagtgagcaggtcaaggtcacacagcaaagtcaggggctcaatgaggatttgcccccaggtgtctggactctttgggaatgtggtaatgatgaaacaaatgcaggtaaagtccttgcttggcaccgtgcctggcacacagagaccacccacccccctggcatcctaggtctgagaggtggaaaatgaatgggctgtattctcacagaccccagtttgagtccctgcctcttactgtgtgaccttagccaacactgtccattggaactttctgccatgatggaaatgttctagatcctcactgtccaatatgagagctgccagtcatgtgtggctattgggcacctgaaatgtggccactgtgactggggaattaaaaaattttttttctggctgcaccatgcagattgtgggatgttagttcctagaccagggaacgaactctggcctcctgcactggaagcacggagtcttaaccactggactgtcagggaagtccctgaatattttattttcattaatttagattagaatagccacatgtggcttatggttacccccctggacagcacagccttcaaaaaattatttaactttctctgatcctcagttttcttctctcaaaagtggggctcctgagcacccactttgcggggttctttcttcccaggagagttgataagtgctcagaatactgcagggcctatagttaagatgctcagtagagggtgacttcatttacaagttccttttggctttgttcccccaagctggcccttcctttcctcccaccaccctgtgcactgggtctgagagctgagaagccctatttcatgtcacccacagggcagctggcccacagaagggcctcacccctgcaaagatccgtgtgatcgcctttggcctcttgagaaactgcacggcttcactgtcggccaggtcctggaggctctccgggatgtgcatggcggctgctctgctgctcgggctctgggaagccagagcagggatgctgggttctgccggctgggcgctgctgtctgcaggttccaggcccacgctggggctcggctgttgcaagacaacaggaatggtggggggtggttagaatccaaggtgcagggtaaaggggctgccaggggtcccaggaggagggggtatgg

SEQ ID NO: 57692 - DNA, 1547 bp, Bovine  19866880853518
tggaggacgggggcccgcctgtccctctggccccgctccctcgccctagcactccctcgtgagctctgccttcaccctaccctttcccgggaagcccccaccccacactttgctattaaatccatgctttcccatggcaccttgcccttttcccaaccctgcctagtctccctgactttgcccttgttcctctacccatcccagtcctggtggactctccccggcaaggagtccctgaatctctggtacgactgcacatggaatagtgacaacaaaacgtgggcctgcagtaacgtcagtgagaacggtgaggcgtgaggggcgctggagatgggtctgcagaagggagggataaccccaagtctcctcctgggaccaaggattgggaaccccccaaggtttgagtgggcaggttatgggtccccatgctgagtgactgaagctgacgtatgatggcccacctttctggatgggacgcggaagtatgctcatgttctagagtgaagtgaagtgaaagtcgctcagtcgtgtccgactcttggcaaccccatggactatatagtccatggaattctccaggccataatactggagtgggtagcctttcccttttccaagggatcttcccaacccagggattgaacccaggtctcctgccctgcaggaagattatttacctgctgaggttaaaaaccccactcctgatgatttaggagtggaggccacaacgctataggtttaaggaattgggggaaagctttcaagattctgagaagacaagaacatgttcccaaagtcctaaagaggcaggacaggtgttctgaatggatggctgggaccacactatccaagttccaatggggtggaccacattgaggttctaaagaggtgagactgaatccttgcaaggttcaaaagaagtggggtcagatgcatctgagttctaaaggggcagagctgcatccgcttaaatttctaagtcaaagaaggtgaaagattaaatgctttttccctaagagcaaaggaagaatttctgctctcacaattcgataccacatcatactggaggtagccaatgcaacaaggcaagaaaaagaaataaaaggcataaaagatgggaaaagaagaagtaaaactgtctcgattcccagtgagcatgtttatatagaaaatcctaaagaatctgcaaatggcttctagaattcctcagggaatttaggaaagttatagggatcaaagttgatataagtgataactactgagtatctgaggttgaatgactctaaatggaagaacagttggtgggagcaatgatgagcaagcaggtggagctgaactctggacctgctgtaacttccacccctgtctccttattgcaggctggctgaaggcagtacaagtcctcatggtgctttccctcatcctctgctgtctgtccttcatcctgttcatgttccagctctacaccatgcggcgaggagggctattctatgccactggcttctgccagctttgcaccagtgagcacgggttcccagggaactgaa

SEQ ID NO: 57693 - DNA, 1575 bp, Bovine  19866881357271
tgtcacagtccagttgcaaggctgatctatcagggcctctcctcagcaaaagctgggtgcaaggggcagagaggagatgcccagcaggtgctgggtgcagggggcgcggttctcacctcttcccccaaggtagtccccaatggccgtcttgttcaggccctcgcccttgtacaggaagcgggctatctcctcaggtgtgttctgcaaaagttcgttctccaccaggaactggatccccctggtgggaagggctgagtctcagtgctggtgtgctcagaaagacaccccccagaaaccttagcctccaaacccacacccatcctcaacagagcagggcctgagtttcactttcaggctcttcccaggcccctaaacactgcctctccggtggcctagactttgcatctactgctccctctgcctttgcctggttaattccagtccccctggagcaggacctggcaaggaacaggagctctatgaatgtctgctaaatgactttacaaactaccattgcttctggcaagaagaataaagtgggaaactgttagaagacatcacacgaggagctgtgagggtcaagactcaggctggaggagggatttctcatgctctcttgatgtcttgaggaccatgaactgaggacccctaactttggatcctggtatctgagtctaggggctccctgagggcaaggcagcatcaaaccctacactgggtcctatgcattccctggcggagcagcaggccagagggaggcccgaggaaatggtgtaaaaagaatgaatgaatgaacgaacgaacatcttttctccacctggtaaacactaagtcatccttcacctgacccaaatatcctcctgagggaagccctccttgatgccaccaggctcactcctctgagtgtccacagcccagtacctctctttctctctgtcttggcacttctctgtccatattccctaccagactcaatcaagctcctcctggtgactcaagagtgacaagagaaatgggttctaaaatatgagcaaaaaggagaggaggaccactcaggcaggagttccagcatacacaaagatcaggaggctgaagcacttggttagtgttcagggaacaaatactgccaatatctggatccagggatcaggaccaactctgtcctgtctaaggcagacctttaaccacaacacttctggaacccggagatgccagaatcctatctggatgtcagcttggccgaccccagccctgtggccccaagcacctttttggggtccatattgaacttcttcctgcccattgccatcttccggttccgttgcaaggttttgctgcaggggcagagagcagagggtggaaggtcaatgcctgggtatccctggcccccgcctggccccatgacccctaggctccctgccctagccctcacctgccctcattggcctccagaccctccacctcgctcatggcttcgctgagctcctcccgcaggcgctggatctccaccagcagctcctgcttccgccgtcgaatgttctccagctccatccgctcctccggagtcaggtccgg

SEQ ID NO: 57694 - DNA, 981 bp, Bovine  19866881396772
ggcctgacccaagcagctcctcaggcaagtccccgccctcgttgatgccccggttcatggccacgaagcgctccagtcccggcttgtcccggacgttggggttgtggaggctggtgttcagcatgatcacagcgaaggacaatacgtagcacgtgtctgcaccagacagtcatggggtgatgactggggcatgcaagcctccgggacccaggagctcaagtcccccccactcccagctccctccttccccaggaccctagggcctgggcccctacctgtggactggaaaaccccagggttgcacaagcagtagcgctgggcaaaggcctccatcatgcggtcgatcttctgggcttctccagggaggcggaagctccagaggaactgcctgcggcagagacgagccaagggtagatgccaggactggcggggccaccccccacccactctcagtgcccatgggaggaactggccaatgagggcgccacacctgtggccaacctgaccactgagcgtcggccaggagactctagatgatgtatatggaaatgccctttctttctaccaaggttgctgcatggaacagatggttgcttggggcctctgctgtcatgtgggaggagggtctaccgtgagcagcacccaccctgtggcgaacacaatcaaaagctgtctttcccattccattcaagcgtctggatacggctatgcctgaaggaagctctactgtggactttggcaacactcacgtgcaatccatcccctaagttttgggttctgtttttgccttcaggagggggtgatcatcactggtaaagaaagccctgacaggtcccttcctgccctttcaatcccatccttctcacctgagggcctgcaccaggttgaggtcagtgaactcatgcagatccacgaaggcatgaagcactgccagattcagctcttccctgggaggacagggacaaggtcacgggcaggaag

SEQ ID NO: 57695 - DNA, 1372 bp, Bovine  19866881410362
tttatgaatcaggccctgttctgtaagttgttagggtgttgacacatcaagtccacactgaaagcgtgatacagatcatgataccctgttacccataaggaaactaggcacaggatcccagggtcccaaactgggaaggtgagctaaatctaccttgaatggtccggggacaaggtcttcccaagaacttatgacaaggatggtggggagagaacactgttctcctcagatgcagccagtggcagggtccctgccttgtggaggaagtctgctccagaatgaagtcaagacactgggccagagtcctgaagacaactctgaggtcctggatccagctataccagaagctgacactacctttagcctttcagtttaccaggatcaaaaatttccccatggaggcctgcgacattctgagccgagtttgttaacacttgcagccaacagagtcctgactgatgaacagattcaccacctcccagccccagaacatacttcggaggggactctgtttctctgatgctcttggctgtctccttctctggcttctttgctttgccctctttcttgggctggaaaaatgacctggaggagcagaagagggggaaaagaagtgaatgataacagtacccataacccctctaacacatgccacatccctcagcttccgatgcccgtccccatttctggcacacagcaaaagactttgaacaatccccttggatggatgaggaaacaggcttggacagaggaggcagcactatgtgcttttctgcctcagctcacctctcatgtgagagccaggatgcatcccagtttccctcctgcaagtattaactgcgcacttactgtgtggcaggccctgtcctgggaacccaggggcacaggagcggccccgacacatcaagtccctgccctcaaggggctgacgctccaggagcaggcagacattaagcaatgtgttcactgcttagttgtgtctggctctttgcaaccccatggactgcggcccaccaggctcctttgtccatgggattctccaggcaagaatactggagtgggttgtcatgccctcctccaggggatcttcccaacccagggtctgggtctcttgcattgcaggcagattctttactgtttgagccaccagggaagccaatagctaatatgaaatgtttggaagcgttatctgctctagaaaaggtcaagtaatgggctctcccttccacccaggcattaccggccctttaggctggatcacactttgttgtggggggctatctggggcactgtaggatgttaacagcctgccccacctttacccaccagattctaagggaagccccctctccctccaagggtacaaccaaga

SEQ ID NO: 57696 - DNA, 1444 bp, Bovine  19866881416476
ccccactgccggctgaggtggagctggggaccgaagccgggcagtgtgtggggtcgggggcgccgcacctgtaggatcctgagatgacccgctcgccgtccagcagcacaaacttttcccgcacgttgccgctcacctgccgacgccagcggctctggaaactgcagccccgcacgactcggatgtctaggttctgcggtgggagggcatgcccttgctcaggccgaccctcccctcccccctgacctccacccagtgccctccctccaggcagctcctacctgggcggcccatgggagggtctatcccagcttccccaggggtctcttgtggatagtcttaactttgacagctcaccccagctgccccacccccatgccatgggcatcagatctcaggggacactctcagccagcatccaccttgatgacccagcacctcctggaagggtctgccccccgctgcttcccccgccagtgccagggaattggggtgttaccctccagccacctggcccctacctcagtggcccagggattgacccccagctgctgggccagcgtcagaaaggcgggcagctgctgacggtccaggagcaggtagacgggcacccagcggcatgtggcagcctccaccaggtccgaaagcaggtctgggtcagtgaagacgtccatgaccacggccaccagctgaggggtggggagaggggctgtgggtggagcctggggcttggggggcacattctgggggtgaggttctccagggcgtttaatggtccaggctccgtgggacattcagggaagctgagggggataccctgagacacatactacagttcattcagcgcctatgtgtgaactgactcaagggacaggagtttgagcaaaccccaggagacagtggaggacaaaggagcctggcgtgccttagtccacggggtcgcagagttggacacaaccgagagactgaataacaacgatgtgtgaatgagaagcaaacaggctttctggagcccctccacctctaactgctagaaaactgtcattataaagcacacgtctgcagcagtaccccatgggctttgacactacgtggctgccaggctccagggcttggtgggctggaggcccttcactgtgggcagctgcacacctggtcctcgggtgggataacctgccaggccaccaaggtgagctctggggacagggaaatgctgaggagcctggagctggcaggcagaaaaaggtggtggtggtgaaccctgagtcactggccagaaggccttggttcaaagccccactcggccacttaaaagacaagggacaacctaccatgcctcactttccctgtctcctcaatgggtacatgaagcccaacctcataggaccctccttgggattagggggggttaacccataaaaaaacacttagcatggggagtaga

SEQ ID NO: 57697 - DNA, 1517 bp, Bovine  19866881540094
ctccctgccccctttctgcctctgatcacacccctctctttcctcacctttccttttttccccttagatcttgtttcacatttcccactcttctcagttttcatgcttgaaggctggcctctcagtcaacactgccagccagtcaaatccgtcttgttgttcaaggagatagactgattaaatcaccgcaggtaagataaaaatctttggttctttgactcttcttggctgcttggtgtggctctgcactccaggtttgaggtttctaaagggctgaatgtgatgactaacctccttgcaccttcagtcgtgtccacctctttgcaacatggccaggctcctctgtccatgggattttccaggcaagaatactggagtgggttgtcatttccttctccaggaacctccgtgcactgtagtaaagtctgactgttcagtttggttgagtctgtgctgaagacagagagtgagccagtgacctgtgtatagcttagaaaagcagagaggtgtgactctaaggacagtgagaaatcttgaaaagcgtatgtacaaaacttgtaaatttttatattttggaactttgcttctttggggttgaggcgcactggtcacccctctgcctgtgagagctctctacagtctgtgggctagcagtgtgctgatcttttaaagtttctttccctacccaatcccccttttttgatgaggtttcagtgaggtctgttaggtgtgcatcctgcagcttaattggcttaaaatgttctcacctttggtgtggtctctctagggaccaactaggagaaaaaaaaaccaatagtgtaactttttgatactgaaaattgataaatgtctttttgaaataaagaaccagtccctccaaaaaaataaataaatacacatttcttgtatcctctcagtctgtgcctccattcattttctgagattgtggatcatctttatcattgttgctttgaattcttttcaaggttgattgcctatattcactttacttggtggttcttctggggtttatcttgttccttcatctggaatatattttcctgcaatctcattttatctaactttctatgtctgtggtctgtgttcctcagaacttacagttccttgcagaactgtaatttttcttgtttctggtgtctgtctcctggtgggtaaacttggttcagggcttgtgcaggcttcctggtgggaaggacgagtacttgctattggtgggtggggctgtgttttgtcctgctggttgggagggccatgtcaagggatgtgtttataggcagttattggctcaggatgactttaggcaacacgtttgctgatgagtgggacttttcccaattattttccagtttgtttgttgcccaccttgtgggtatggggttatttgattttattgtgaaacaggcatcctagcactggagcctgcaggctgttgagtaaggccaggtcttggtgcccagatggcaacctccaggaggtctcacactgatgagcattcc

SEQ ID NO: 57698 - DNA, 935 bp, Bovine  19866881646860
tcccccagcccagcacccctgctctccccccaggtcaggcctgctgcactgcccgctctcctccggctctgcaggtgtctcggaggtccccgcccccaggctccccgggacccgctccccctacaccctgtggactccggtttcccagccgccatctttctggcctcgtggtttccccttgcatcctcctcgcccctcctgcttcctctcccagcctggcccttgccctacactggccttgccccctctccctccatctgtctgtctgcgcccctatctgtccctgtctctgttgctttgtcactgagtgttcatctgtctgtaactccgtctgccctgccttgctctccccccttatcccccttgtccttgctggaagtttccccatctgtcccccagccccgccctctccccagggccccctgcccctcaacactgactgatagcgctggggtgttaagctacggattagttcaggcaaaattctcgattttgcttgcgttctttcccctttggcttatgtaaacagtaattctccccagatggaactattttcctcgctcagaagcagccgggagaggtctggggcagggccaggggtggaatgccagggttcctcagggagcctggagagcggggtggaggctgacctcggggggcagcccgaggcccccagcctggccactcctctcctctgcaggtacttgcctctgctggaaccatgcccgtgacctttgccctctggctcctcctgagccaggccagcgcggacccatgttaccaccccgggggccgcccccgcttctgcctcccacccgtgacccagctggctggcatggccgcctcctgtccccaggcctgtggcccctccccgggcgtggatctcggcccacgggccccctgcaatggcagtctgaccctgggcctggggggcc

SEQ ID NO: 57699 - DNA, 1071 bp, Bovine  19866882110430
ataaaatttaaaaccaagacatgcaaaattccaaaccacattttatttcttaggcacaaaattattctctgagataacttgaaacactcactctctcagtttctgtacttacctcaccacggatcacagtttgttcaggggacaggtggtccgcacagcgcactctgagactaacgtggttaactgggcgtcatgacccactccataaattatgacaaacttttttttttaaaggaatggaatagactagaaaatatgtttgactgtattttctgtaatcagggtgagtatggttgtagggagcttctgttttagtcatatatacacccgacatcaagccagcacaccagtgtgttgttaaaacagtgcaccattgggacttccctggcaggccaggggttgagactctgcacttccacttccgggcatgtgggtttgatcccccgtcagggaactaagatcccatgtaccatgtggtaaggcaaaaaaaaaaaaatatatagtgaactatttctgaacagattggtaactcttagcaactgcccctagcctgcgccatgccagcccctaccccgggacctcccatgatccagcaagttaagggttaatgcctgacccagcaggggccttttctaattagggggtcttttctaattagaccatgatcaggccatactggggattaaatatttcaacataactcctgattgtgtatgcgcacgtgtatgtatacctacttgcgggcacgtgtactgataactgtgaacgtatgtgatgggtgaagagtagtgcttcctgctgggggtcacagtgagccagtgtgagaaccacttctggactggggcatctaccagtggcccccagaatggagaggctggttgaggacatccttgacccagatggcccctggtgggggcgctctaatatctccccattctgccccagttccagcggccccaggagcagtacccgcccctgaagtttgggacggtgcccaacgggtccacggagaagaacatccgcagcaactaccctgacatgcacagttacatcgtgcgctacaaccagccc

SEQ ID NO: 57700 - DNA, 901 bp, Bovine  19866880124554
ctttaaataagatgcaagtcttttgattaaaggatagtggtgatggttgacagggggaggacctgggctcaaccttggcctgaagagatgcctcagaactgtacagcagtgtggtccaaccttaagtcctactcagagcgcctatataattatgcattatctaccagccagtgtgaaattatttatttaatatgtttctttaaattgactcattttttccttaaataaatccagcatcatactatgtaatatagatttaatgtcctaagcatatttttctaattcatattaaaatacatccacaactattgaaatttaagatttatttttgatagcacttaaaattgtctctgaatggtctagtggttttccctactttcttcaatttcagtctgaatttggcaataaggagttcatggtctgagccacagtcagctcctggtcttgtttttgctgactgtatagagctcctccatctttggctgcaaagtatataatcaatctgatttcggtgttgaccatctggtgatgtccatgtatagagtcttctcttgtgttgttggaagagggtgtttgttataaccagtgcattttcttggcaaaactctattagtctttgccctacttcattccatgttccaaggccaaatttgcctgttactccaggtgtttcttgacttcctacttttgcattccagtcccctataatgaaaaggacatcttttttgcgtgttagttctaaaacgtcttgtaggtcttcatagaaccgttcaacttcagcttcttcagcgtgactggttggggcatagacttggattactgtgatactgagtggtttgccttggaaacgaacagagatcattctgtcgtttttgagatggcatccaagtactgcatttcg

SEQ ID NO: 57701 - DNA, 2274 bp, Bovine  19866881274165
tttaatattctacaagcagaatctgaaaaggaatatgtgtgtgtgtgtgtgtgtgtgtgtgtgtgtatgtgtgttagtctgtcatgtccaactctttgcgaccccatggactgtagcccaccaggttcctctgtccatgggattctcctggcaagaatactggagtgggttgccatttcctcctccacgggatcttcccgacccaaggatcaaacccaggtctcttgcattgcacgtggattctttactgtctgagccagcagggaagccccatttatataatatacacacacatatacataatatgtctgaatcactgtgctgtatacctgaaactaacacaatattgtaaatcaattataattccataacaacaccactcactacctttaaaaccactgcatctgatacctcctatacagctacttcaagtaagagccttagctctgtatatatttaaatagatgaaatttcatacaaaaattattttcttaagaatatgctacttttctaacattttaataggcaattgtaaggcttaaacctattgacaactatactaagcacttctacaaacatcaattaactcattagctataatgattctggaaaggaagacgttaaaactatataagtaagctgcaggcttttcatcaggtcttctgactctgttagtcctcttacatcaaaccacagttacttctctagtacaaacatatcagtacaaaataatcctcctatttcattcatggtatatacactaatggtaaagaaggtaaaatttagagagctcttcttagagaatcatgagattatttgcaataactttcattctctcttcatactgtttaaattagtaagatgggggaaatacaatgacaaacaatgatcactaaatgtacactatggcacatctatcactgttttcagaagttccttgcactgacacaggacactacacagagcagagggtcattttctctcaagtacaagaatgacttccaaagtatggtctctgaactgcctgtagtttcctccttacctttagtggaagtgataaactaacataatcatctatcaaggaagggcaatcacgaccaaatgccagaatagctactgttagtagcaagaggtttttttactttttttccttggtgggagggggacttttataagtttattctaaagaaacaactttttaaagtgtacaaaagtatttttacaactgatgtctcagtttttattaattgaaaaactgtaaatgatatgaaaaggccgttgatagggtactagttaaaaaaatgacagtggagccaagaacagactctgatttagccactgaaggtgatgacgtgcatggagtgactgacacgctcactccagagcacagggacttttggtcgggtaatgcagtcgtcggtggagcacacacagtcctggcctaaaccacaatcagggtcccggctctgcgagacagtcgcaaaaattttgagatcaattcctatggaaaatattaaaggcctctccttggatgaggccatggtgtgtccctacctgactgctgtagacaaatggatttgaattacaaatactactttcccaagctcttcctgagagcttttcgttgtgggagatctgctgctaggacctcagggatgggacccagtccgtgtttgagagggacattgggtgggggagtgaattcctctgctttgagatgccacttgggagctctgcagaatgaaggacaatcaacttcaagagtgtttggtttctaccaactgctggaaaaaatccacaggatgaattcctgtacctcttgaggatgccagttaaacacaccttccttgaggactctactgtgagggagaacccagctgggaaagtggagccagctctgagctgttcatggggcaggtggcctggaaggctgacgggcacagagggagggggtccacaaccctcagccacctgccagatggcaacagagaatttttagagtaaagcatgtcgccatcctcagaagcagtttcagatgattgagttaggttatcaaggtcattcacataattaatttgttctttgacctacacataaataatacgggttcacaaagtcctcaaaatatgtataaaatataccaagtgtacaaaggtgataaatatcttcatcaaagcaaaagcagagccttcttaaaagaacaggtttttatcaacaggataactttatcaacagagtttctaaattatgttttcaaagtaaatgtctcttcag

SEQ ID NO: 57702 - DNA, 1979 bp, Bovine  19866880512933
ttttatatatgtgtgtgtgattttcatcatcttggggataaagtggcactttttaaaacttgatagtaaaaataaaaaaacctgaaggaaacagattttactataaaacagctggaaaaaactatatgtaactgagagttatttgactgtatattaaataatcttaatacatgaatgggcttctctggtagctcagctggcaaaaaatctgcctgcattgcaggagaccctggtttgcttcctgggtcgggaagatcccctggagaagggataggccacccactccagcattcttgggcttccctggtgtctcagacagtaacgaatcctcctgaaatgtgggagacctgggtttgatctgtgggttaggatggtggactacagtccatggggttgctaaacacacataaaaaagatagactacatattaaaaattggaaaaatttatatgtaactgacagttatttgactatatgttaaataatcttaatatgtaaatagatcttagaaaccattgagaaagataaactttccaatggtccaaaggccatgaacaatttattcaaagagaaatgatatatcctccccttttgaattgacaagtattgataatttccatattggcaagactatggagatagtcatttatatacaatgttgatataagtagaaatgggtaaaatatttttgtagaaaagtattaccatacacataccaaaatttgtgtgtgtgtgtgttttttacttagtttatcttaggagaacttatctggaggaagtaatcaggcaagtgttgaaatatctacctacaacactgtgattcaaaatattgtttataacagtgaaaaaatgataggaacctaaatatccaacaatagaagatgtgagaacaaactctagtatattgaaatggtggaacaccctgtaaccattaaaacacattctgcagagatacgcttacgaactttgaaaagctaatagacttttaatagagaaaaatatgctaccaaatatcaggagcaatatgacaacacatatatttataaatatatatgtgtgtagcctgtatgtatgtatatcatcattttaataatcagtttgttagcagaggtggacaacccaaataatgtttctgctttcatggagtgtgtgttctgcaaaggaaaggctaacaacaaacgctgcatacaaattaacaaaataaattctaatttgatgattattctgaggcaaagaaaggaataattcctgcattagggaaaatgatggcactttaataagggaactctggaaagaggccttccaggtagtaatgtttgaatggagatttaaatgaaaagaaagagctaattatgagagatctgaggaacactgccttcttggaagaaggaacagctaggacgaggattctcagacggaataagcttgcagggagggctgcagcagaaaaaagccctccataataggggtccctgcaccccgagaagtgtgtgagagaaagtctgagatcctggcagtataatggccctactgggtcccgagtatttaaaagaaaaagtgtactttaatcttagtgcagtctatgaattttttatagttacaaaaacaatgaaacaattttatttttaaaatttccttgccttggcaagtaaaaattcacatagaatcttcagcattgccctcttaagacaacactgttttgtgttccccaacagtttaacaggggatcaggttcactgaatcgcagctaattgtaaagctttcaaaattagcagaaatcttccattaagggcccagtgattatgtgtactggtttttctggcctgaatggttactaggtaaaagatgccattacagtgtaatctcatacattttaaaagctgtgttattcctgatcatttgaagaagctgactgagtctcttatattagcagagattccctaaacagtaaatactaacaatccattttattttaaggca

SEQ ID NO: 57703 - DNA, 958 bp, Bovine  19866880557964
taaagtacctttactcattttcaaagatctaaaatgaaagtgtagtggtagccctctgtttaaagctgtcatataatgactacattttaatgcattttccttttacaataattaaattgtaaagtgcatggccagattagctcctgatgtgaacagtttgcactacagtgatatcacttaggaattgatttatcttagaaaactgacagtgtaatggatataacatcattaaccttgaaaccaagatctataattagccaaagttgaaaggaacaaaggtcaccatctgaaggttatcctcaatatcttgatctaatttctaaaggacaaactacttcatctaacacccattgtctaactgatcagaaaacaatcattgtaaattagtctaaactaaatcaccttgtccatctgtagatttcctttgtcccataataggtaaatgacaaaggaagggaatattggattactcttgttgatgtccacctggtgcctgccccataaacatatgcagcctattaagccctttggtgttttattaatcttggccagattggccagtgtggttgctcctttctaaaagatgttcttccttcatcaagtatagatttttctgaagtttttcaagaaaatgacatcattgcaaccctggagtcttgaatagttttctcacttgaataagtttaagcaatcttgaaatgcagccttcaatttacatggtaaatacatcattccagtaaaagacaagaaaataagtacaactattatttcagaaaatcttcatgtaatgtataacatgggtttataagataatataaaggaagatataaacgtaaatgggcttcccaggtggtgctaaagaacccgcctgtcaatgccagaaacataagagccacaggttccacccctgggtcaggaagatcccgtggaggagggcatggtgacccactctagtatt

SEQ ID NO: 57704 - DNA, 2106 bp, Bovine  19866880609384
ttcttgttaaactccaaggcttgtaaaaaaataaagatcctcatgttaaaaggtagtactccttttggagtgataattccatgggatttatgccttttattaacttaagctgttttataattatttaagtagtagagaattgaaaataatgcaagtatttccttttttattattttctttttttaaatttatttattttaattagaggctaatactttacaatattgtattggttttgccatacatcaacatgaatccgccacaggtgtacacatgttccctgggagaaatatctgtaacctcagatatgcagatgacaccactcttatggcagaaagtgaagaggaattaaagtgaaattggagagtgaaaaagttggcttaaaactcaacattcaaaaaacaagtatcaaggcatacagtcctatcacttcatggcaaatagatgaggaaacaatgaaaacagtcacagactttacattcttgggcttcaaaatcactgcagatggtgactgcaaccatgaaatcaagagacacttgctccttggaagaaaagctatgatcaacctagacagtgtattaaaaagcagaaacattactttgccaacaaaggtatatctaatcaaagctatagtttttccagtagtcacgtatggatgtgagatttggactataaagaaagttgactgctaaagaattgatgcttttgatctgtggtgttggaaacgtctcttgagagtcccttcgactgcatagagatccaaccagtccatcctaaaggaaatgagtcctgaacattcattgaaaggattgatgctgaagctgaagctccgatattttggccacctgatgcaaagaactgacacactgaaaaataccttgattctgggaaagactgaaggcaggaggtgaaggggacaacagaggatgagatgattggatggcatcatcgacttgatggacatgagtttgagcaagctctgggaattggtgatggacgtggaagcttggcgtgctgcagtccatggggttgcaaagagttagacatgactgagctgaactgtactgaattgacaggaagtaagggaagtgcccaaattcagcctcctctgtccttcatgttctacctaaacgtagggaaaagagaataaactgagaaacacttatgaaggccccagccttgggcaacaactcactaaaagactgagaccttatcataggattatagaaaaatttccctctttcccttccacctcttcaccactccatcaatagggctaccatataacatcaggggaataaaactggaagaacagaaagtctcatgatattgtttaagaagaagtctctagggaaacccaaagacaacggaggagataaaagtaggacaccaggggaagctttagcctttgacacccacagccacagcaaatagtaaacacagtctaacctttagcctgataaacataaaacctcatactaatggactgtttatatcagttccttttacttaatagaggatgcccaactttcaacaacaatagaaaagaatgagaaaagggaaaagcttgctaaaaagcaaagcacaccctctgaagagacagagcaagcatcagaaccagactcaaatatggcagattttggaattaatcaaccaggaagctaaaataactatgattaatacgttaacagctctaaaggaaaaagtggaccacatgtaagaacagatgggccgcgtaagcagagagatggaaactcttaagaaagaatcaaaaggaaatgctagaaatcaacaacacagtaaaagaaatgaagaatgcctttgatgggatcctcagtagactggacacagctaaggagagactcagtgatcttgaatatattccaccagaaacttcccaaatggaaagataaaatattaaaaaggaaaaaaaaaaaacaagaacagaataagcccagaactatggggagacaattacctaaagtataacatatgcatgatgagaatgccaggagaagaaacagagaaaggaacagaagacatacacctccacaaatacaaaacaacatatgaacatggccactcactgaagcactatatgtagca

SEQ ID NO: 57705 - DNA, 1719 bp, Bovine  19866880693090
aagaaccgttcctccgttgcacaaaacactgagtgcccgggtagtttccttcgtttagatcatatattcattgctgaactgatacctagatagccaaggggaggcccctgtcacagaccaagcgggggtcatgctcccacacctgcagttggaggatgggttcggttgtcccactataaccacaggaactgagaatagaggagaggaggttccccaagataaaagcagtatattgttaccagaagagatggtagatgctgcagaggcaccatcaggatacctgccacactaagggatagccagttattcttgatacgttttgagatccaagtttgtgaaagacagtttctaaacccataaatataaaagtgcttaaaaatataagcacttaaatgtatcttgtttatcacaatatagaagactgcaaattcttggtcattgatttcattgctgtagtgtaaatttccttctcctctgtccttaatataaataggaaaaataaccatacttctacagttgaaatagagtacttgacataatacatgacacataggtaactgctcaaaaatatcatggttgttattatgattattactattattaaatactcaacttgacacatattaatgtagagtctgttatatacaagatactactaggtttaggacgcaaagatgaataagaaagtgttctgtgttaaggaacacagagactagtgtagaggataaaatatgcacaaagctctaccaggcaggatgttacaagttttccataataggaatcagtgctatgcatatattatatgtttatgtttttatatattaagtccctacttaatctcttcttcaggcaatacaaaaacagaaaataaaggaatgcattttcaaacagctttttcttaaaagattagtcattctacacacttaacctttcagatataaattggatgtcacattaaccagcaactgaatagagtgaagaacaattgactttattgttactaatatattagatagaaagacttaaagatcacaacaagtaatctagtcagaatgttatttttcagcatttaatgttatagctcttcatgcatgacaaaagacctctgcatttttttcccctatacatgaagaaaatcatattatttgatttgtttgacagaaagctttgtgatttagaaaccacttttgaactaaatgaccagactgttgctaagcaactgtgtaaaacacttcttaagtacaaaagacacagctaaaatacagcattgtaaggtctatagtagtatgtctgacatttttgtacaatcagtctaatattttcaatattctctttcataaatcaattatatatgtgtgtgagtgtgtgtattcagagaaagtaaatagattgaatgtgaaattgaaagcaaaatctcaacccaattgtgtgaatttacaataataatttttcaggtctgtttggccctgttagcctgccacgacataaaatttttctaaatatttttagaaactcttgaagcttctacacagagtattattcagatgttctggatcaatgattgctctgcaaatagattttacatttcacagatcttatttctggaaaaataccaaaacaagaaagtattacctgacttgacaacatatattccaatttagaaataattatataattaatgtaattttattgtgagagtagttagtaaaaattcagcaa

SEQ ID NO: 57706 - DNA, 816 bp, Bovine  19866881172000
agttgtatattttttgaaatatactataacttattaagtgtacattttaggtgttaaaagcaattaaaaatctgtattcagtgtaacttgcatagtacagaaggctatgatcattcaacttatcttctatttcatcctcatattgccacttttaacttttagaatcattttcaatattgaaaacttcattgtatgacataattcctaataaactagagagagcatactaacaatttgctttgatatttgccttttcatcattcccttcccaaaatcaactggtacatgaattatgttatactcttcctaggtgttgatgccctggtcatttaattactgaaggtttcaagggctagttagagacattgtttatttttttgttgttaaaaaaaaaagaaaaatagctgttttaattatctcagtgctgaaatttagcttgaagaattttataccaggaaaaccaactcccttattcttagcacataaccttgactgtcttctaaatctctgatttcaaaataaaacttttgaatgcccactggagtcattacccaagggctttcaagatccagagtgtttcttagcaatatatgctattccaacagtatgtatccagatatgacagtactacaaaagcttttttttttttttctgtcaatgactcactttattcaaacagataattaggatttagagcctactggagacaaaaatctaattattctctgtagtcagtttcttctgcaaagatttagtctttagaacctacctatctccgcctcacttaatccacaaggaataattcgggaaagaaat

SEQ ID NO: 57707 - DNA, 2302 bp, Bovine  19866881419454
ttccgtacctcacagatagtacatgctcaataaatgttaaatgcagctattgatgttattattaccatagatattaccatcattatccttagccaatcttaatggcacaattttcctaggtaataatgaacaccagcacaaattgaacgcactaaaaaccctactctccacaatcattatcaaattttgtaagtttttgattgatcttattttaaaagaatcttaactgcattttctttaattgttttcccaatttcttcacttccttgatggccagtctcatgtctcttgattaagtcaaacaacagccttcctgttgtactaagaagatcacatctggattgagagctccttccttttcagtgagacttaatgccaccacaccacatacagaagggttttacccctcactcctgtcaaaaataaagatactattatctttttctatctctgattatggttattctatcttaaatgtgtttctctttcttccagttatttttcccccagccaaatgaaatggtatttaccctcagcccttattgcctgttatttatggccttttatttgtctttatttataactttttttgtgtgactgtgctgtgaggcatgcaggatcttagttccctgaccagggactgaacccatgcccactgcagtcgaaaggtggagacctaaccatcagactgccagggaagtccctctcttttcctttttagcgcttataatcaggcttctatcatcaccattctcctgaaaacacactcctgtgtgccaccgatgtgtgcacatttggcaaatccagtgatcctctttcattcttcatgttcatggcctctttgtgccaaaatgtgctattaattatctcatcttgaaattctcatgtccttaattcttcataaccattctcctcagagtctacaaggtgtggtgttctttagtactcactcttttcctacatattctcatatacttatttatatccatactcatctttatttacctatgttctccaaccttaagcactacccttcttgtttaatccttccctccaaatccccgatcccctcctttgtatctcttcctttgacttttttttttgtctcctgtatcttcaatttctccctctccttctcaactggctttttggtaacatattcaagtctattccttacaagtacagtgatggtaagtacaataacaacaaaaggcttccttaacaccatgtctccatttagctaccaatctcttttttcctttattccccaacttgtctattttcactgtctcagtgtcttcatcttctattcactttctgagcatctgcagttgggcttttcttctaaaaccttactaaaaattatgttaccagttaccaactgatgaatgtaggaggtttgttttattaaaattcactgcaaaatgtgacattgtgattaactgccttctcaaaaaatacctcccaaaataaacgaacaacaaaaaaaatttcactcttaactttcatgataccacattgtcttcattcctaaatctttcaaacttttttctcctaatacttttttctgtgagcaattcctcacttagccacttttaaaatactaaataataaatagaagatgactgacagtaatatctaacatttctgaacactccatctatgccaggtaatgtttcatttaagcatccagatattaaaatggggaggctgtctttctgtttgaggggaggctaaataagtgaggtgcaagactttattcgcaggaggtgctaagatataatccaactaattaatccaatattagcttaaactccattttaagactctacagaagttggtaaagctagaagagagacagagctgttttgcatggcagctggtctgctgtgcataatctaccacaccacgtatgaagcatggggtgatttctgttcaacttagtcaagtgagaagggcttcatgagcaatgttcagagagcttgatgtgcttcctccacaagttgaagaatatagaggctgaagtctagaagccacaggtgtggccggaaatgcccctttctctacagcaggttgaagagtcacctgtcagataaactgcaactcctccaatatcaacacaaaggttagttttttgaagagcaagaagttccctcgaaaggggatattacttagggtaatttctgtgtaaacccacaaagtagaatgttaaaaccccgagtttctaaatggtaagcaatgagagacaaattgggatactgacttcagagaagatactgagagcaagtcaataaaaccaaag

SEQ ID NO: 57708 - DNA, 1484 bp, Bovine  19866880154410
ctttattttccagggtccacttttatacacatagatgtaatacaaaagtcacgtggggtcagaagtcctgacttttatcaaaatcaggtgcttcatacagatgtatacaaaggtcttaggggtgttacatcatcttctggccagggggcctgctgacaatttatgaccctctccttgtgacagcggtcagtcaaccagaacacttatttctccaggagtgattattcttaaaacagacaccaccttccgaaggcaccagataaagttacattcctatagggtgaaggtgcagtgggttttaattaaggaaagaatctgcttagcctaaggtctaacatgattaatatcaaaggttaatacttatttcttctatatattcatcaatgtgtataagggcaggggatgtggagacttagcagcaaacattggctcaacaaatgaaaaacccttcaccaataaaatttttaatcagcccactatactacactaataatttcctaacttttcaaaagaatctgtttttagaaggtttaaagcatctcgtgcctctcatggttgggaggctgtgaacaatcacatgtggccgcacaaacctgtcaggcaggctagaaaaccttcagaggagtttgtagattgaaacactcctgtcatgcccaggaattactattaactggagctgtaagttaactctttgtcagagagaggtggtgggggacagcccccgtaaagtcagaggtgtaggtgagagcacaaagccgtaaaataggcagactctggttttgggggtagatgctcgagaatttccaggaggactcctgaggctcaatcccacctttgcgtgtgccgagcctcctttctcatgacctttgccacaggcggagttcctcatgctggctcctggcaaaaaagagcagtgaaaaggagctagaaaagtttgaccagttgtgtgtgcttcaaactttggggaagaaacccttggaaaagaatgggccaaagatgggaacagagaggagaggctgaaactgtcctcagaatcgcagggcacagtgagatccgactgatgaacacgctttccttctgagactgttgcctctgctctggatcaagttaaacatctattagtgcagaatgggaaaagtgctccagtttccaaggtcctgaacatgattcatcccaaaataagcagcctagtgtccttgacccaacaaatctctgcttttggtgatgactttcctgaagaaagacagatgattactcggcgcacagcaacatgtgtggtcctgtggacagactgaagtcgttctgggctcagggtctgctacaggtgtctgtgcatgctttcgttgtttcacttgatctacctacagaatttcaattagtttccatctgcaaaatacaaaatcgaatccttctgaatgccctgaactcgttctaagcaccaggctgtgttgccaaagtaacagtttgcatggaatctaggccat

SEQ ID NO: 57709 - DNA, 783 bp, Bovine  19866880388936
atggaaaagttgagggtgggccagtgaagcaggtctctcccgtgactgtttaagaagcatatttatcttttttctagttcgttctgagttgcaaaccaacttttgagggataaaagttagggaaactgacagtcattttccaagtcctgcctctaggttgattgctgcagaggttgttttttggctgcctatacttgcggctgcattatgtgtgggtcagtttcatcaccacccgtggtctcaccattgtctgtttatgcattatttctcagccctctgaggaacaggtaggactagttgaagaaggcagtggttctcaaactttagcttgatcatactgaattacaaacactaggagatagcacacacacacacacacacacacacacaccaagaaacaagttaaagctttacaactcatccttccccatttgtcttcacattttccctccaaggttattagtgctttgaaatttctcttactcattttctactatcagtttagtgactaacacatagagaattagtgcctgattagtatttacagttttgtctaggttcttttatctgtatcttcagattgactgtgactaatagaaaagatttggctccagagcctactctgttaattgttgaaagcagtgcggctcccactctgcagcagagacaaagcaaggaggaacgaggcattatgggtaatagggtgagggaactggaaagcataaaacaaagaaaggaccaaggggcccattgaacagctaaagtcagttgatgccgtcgagc

SEQ ID NO: 57710 - DNA, 1251 bp, Bovine  19866880472789
ttataacatggatattatcagatgtgaaatggatcaccagtccaggttcgatgcatgagacagggcgctcagggctggtgcactgggatgacccagagggatgggatggggagggaagtgggaggggagttcaggatggggaacacgtgtacacccgtggcggattcatgtcaatgtatggcaaaaccactgcaatattgtagagtaaatagcctccaattaaaataaataaatttatattaaaatatatcaaaaataaagaaaagaggtaacagtgaaaatcaaagaatggaagaaatattggattgtgagatatgaactaagagatacttagatacagttaaagtattcaggtttttccaggcaagttcaaatggcttaagtatttccagtttcagcttctcattgggttactgtgtaggttgacaggggagagctttctgaaaagcctatttgttgcaaaataaaggtattcttattcttacagctaataaatatggacttcctgtggtaaaactttattagtgaactgtgtgattaggaaaatgtccattaaaatacttatttcccaaatcccactcatttgaagaaaaacaagcttttaatgttacagtttagtgacaatcccttcaaaccacaaacacaaggtgcggcagtcaaagtactgagtaaattaattcagttaggatacagtactggatagagcagaaacgtaggtacaaattttttaaaaaatactaataaaataccttactcttcttcctttgaagtcaacttagaggattgatgttgtttgccaattttgcattagatgaattattttaagcatctaaaattgatcactccaagactgaataagtatactgtgcagagatcactttgctgttttcttctgttattataaagcataagaaatccctacctatggaatatttcttccccataccctgatcaaatgtaactacggagtctgaaaatctctaggactgttaatactttcattttcaaagggggtagaggttgaggaggatgtggaggacagagtgttatctgtacttgccgaagcaaagcctatttttttaaatatctcattttctagacttcttttggcagactgacctttctgtggagtagcttatcttgctgtgatgcactattcccaggcctcctggcattcacacagctatgaagaagtggagtcagaaaataaagggattgtaggaaaaaatgtatacaatcaaaataaagttt

SEQ ID NO: 57711 - DNA, 1516 bp, Bovine  19866880478605
ttggcactctgctttggtgttattcccatttttgtagcctctccttgatcattactttttgttaaatgagatgtcctgcataatgaacattttacaaagttacataaagattaagggtttcccaggcggctcaatggtaaagactgtgtttgccaaacaggaggtgctggtttgatccctgggtcaggaagactcctggaggaggaaagggaagacccccattacagtgttcttgcctgagaaatcctatgcacagaggagcgtggaggacttacagcccatggtgttgcaaagagtcagacatgactgagtgactaaacaacagtaaagctcattccaggctttggaggcctagaaattcatcatcgacctcaatctatatttataagagtatgctgaagaccacctaaacagacgtttctgttcctttggctcccatcacatatgccttgcataaccatctatgtttattgaaagaactcctggtctgtttttgttaaacactgaccttcaagtgtttgatttaataagctggggaattagaataaattgtattggcttgttccatcatctatattacaaagagctttaaggagtggctagaacaacataaaaactcagggctccaaacatctatcatagagatgaagagggaaagtcaagggaaaagattccagtcttagagatctgcatgtggaatgaagagaacagaagcccatgacttttaggatctttcccccgagtttaaaaaaaaaaaattgtcaaaggaaaaatcaacttagtacttgctttaaaagcaggcaatgtttcaaaacatgatgaagtatacttatgttaacaatttttataaataccacccaagaaagaaaagagcatttgtggcagtctttttccctctgctgctgctgaggctgctaagtcgcttcagtcacgtcggactctgtgcaaccccatagacggcagcccaacatgctcccccgtccctgggattctccaggcaggaacactggagtgggttgccatttccttctccaatgcatgaaagtggaaagtgaaagtgaagtcgctcagtcgtgtccgactctttgcgaccccatggactgcagcctactaggctcctccgtccatgggattttccaggcaagagtagtcgagtggggtgccatcgccttctccgtttttccctctaccaggtcatatagaaagctggatggaggataaagaccctatttcctgaaatgtcctgccctccaaagagactacagtgtactgaatatgggtatttccccaccccttctcatacacatgcctagaagtggacttggcacacagtaggtgcagacataatcattgacattgtttctgggagaaataattctcaccagccacattctcaaaccagtgtagcccatcttttgcttatatcatgatcagcaaggggcactatgactgagggctgttgtttacatatcctgttgcctccaaagaaacagagaatatgccatttcttgatata

SEQ ID NO: 57712 - DNA, 956 bp, Bovine  19866880567126
attccattgtaccctctgatatggttataagtagttaatttgggagagagtatgaaatctaagtaagattttaaaactaagaataaatcaactttagtgaattcaaaaatttaacttacctgcactaatcctcaagaagaaagctctactacacatgacacatgattttcccctaggtttacatttttccttattttgtcgggtggggaaataagatgaatgaaattaaaattcttagtgatttcagtgacaaatttaagtaactttaaaatatcttagtgagaataacgtaaatttcttttctatgtacatgaatcacccaagaatcctaaggacttttaaaagctaaggaaaaattctacttggagtgcacatgtatatgaatgacaaatctagccccaaaatagcacgtgtcattgctgatcattacaaatctactctctgcctgcgatgctatgaaaactatccattttcgtgtttctttcctcctgaagagatacagagatcttgaaaaagtgaaataaaagcttcaagcttaattgggtgacagtgaaaagagcagagaattattgtttaaagctgggttttcaataaagccagtgggatagctgggagaaatgacatcgtgtaccttcccccaagctgacatttagttattaatgaatgttcagaacacctcttagttgtttacttaaattcactgccaaatctgtagacactgacacggcagatctcacccacagccccctttcactaccagtaaacaagagctttgaccctcagacttaaaggagcagaagagcaaacacaccgagcttgcatccaaagcttaagagggctgaggttagaacaggcgccttttgccaagtttatcaaatgcctctttctgcactgtaaaatcagtgggctgtccctccagccaatcaatgttatctggtatcagcaacaaaaacggg

SEQ ID NO: 57713 - DNA, 751 bp, Bovine  19866880660246
gcctttttcccttaagtttctacaactggggaaatactcttaagattcccggattagaaaggtcaaggtagtatatttggagtaagtgcttttccagacatctatttgaatagaactaagtacatgagtgactttatatctcagtaaattcatggttattaatgacttggtaacagaaactctgtaatgaataaacaggagaatattgaagacctggcagcaatgagatatattggtgatgtgattccaaatttaaacaaattacaggggggaaatggataatgataaaataattagaaaccagaagcacctgaacaaacacccaaatcccacatctgtcttcactatattcagcaatccctaaatatcactggtgcattgaaggagaaattagcagagccttttaaacatcacctcagtgaaaagcagaattaactccttcctgttattgaaaatgttcacagagacagggggaatgacccgaatgccttcctttatgacaacaaaatttgcaaagctaaaatcttttagaaaatatatctccattacaaatttgtacataagctataggtccctaacaagattttagactaaaaatataatgatcagaatagtacactggcttcaatattgttatatatctctcctagaatacatcaatggtaaaatgaacgaatagcttagcactttattggtattttttaggtatattcaatgaagatgcagaatcagcaaagaaacttccgtagtt

SEQ ID NO: 57714 - DNA, 1770 bp, Bovine  19866880692590
taggatgtaatggaaagataggattttatattcagataattcttggcttactttcaattttctaatctataagtgagcttaacagtaataattatatcacaatattgaggtactagataaaaacccttaatatcttagatatattgattgttcagtaaaaggtatttggttatattatttcttatcctccttttctttcaaaagccttaggggatcccctcagttaactaaagagttgacattcatgtatatgatcaaaacttgccatagataatcctattctagctatcaaacacatatcctcctatcaaatcaaatccaaatcctatcaaacccataacctcctcccccatgtgccacatatcttcttatttaaaatctaggtccttgtatttcccaaaacccactttagtagcgtcattctattcttttctccttttccctcttagtcatctttcccctcctctgaagtcccatagcatttgaatggatcttttcttatagtggttgattataatttatgtttttctctcattatccaatttgagtaattttttttctgaatcttctttatggtagtttcttattaagtatttgattagtcaatgactgacagggccagctgttaatttggcattttgtaattttcattgccttttatatttaccatcccatttacttctcatcttaattctggggcatctgtaatgcaagtaaaagccctctcaatttggataaggtacagagaggttaagcaataggcctaaagtcacacagccaactagttacaaacctgaaataaatatatgatttttttcagattctttttccagtgtacatttcattatgtttttttgtcctatctggagacatgcttcaaacacaggaaactacaaagccctaggttgatagaagtcattatgagtttggatcagtatttaatataccaattctttctaccaatgaatacaaatatatttgtggcaaaacatatctgtctttaatagaatctaatgttgattagcactgtaaaaattacagcccttacaaaaaattattcctttgaagtgaaaactggttattttactatctgtattcattgaattaaacatagttaaaatcccaggcccacccaccaaagtaatattttaaaaatctagtaaaatctagctgacattgatgagaaattacaatttcaaatgcattacccttgtaagataaatcaaaggtaatggtaattaagataattgcaagatattttgggttctgtgtatttgcgcaagtgttgagaggtggaatataaatgtgagagtatttttgttcactttggtatcttgagcttgaaataattttttgactacaacattttttcttgctgaggtaaaatctgaaatttattgctgcaatctcatctatgcacatagtctaatattttcaaacaaaattctggttaaacttggtttgttgttattattcaccttgtataaaatatgaagttcaccaaatgcttttttaatattttctttttgtgtttgttagaaaaaattgtctcatttctattccatacacaataaacatgtaatccattattggttctgatattaagtcatcaagtcattattaaatctccaaatattacatgtcatttgattggaggagtttaagcatgaatgtttattagacataaacaatgaatgctctcttagtgaaaagtgaacccaaactatcccaagaagtggaggaatcatttggatataatgtgcacatatg

SEQ ID NO: 57715 - DNA, 1422 bp, Bovine  19866880729723
acagcagtttctacaatgggaagaagtccagggcagagataagaaagcagaagaactccagcagagattagaatgagtagctgacatggctgagatcagaagcgatacaggcaaacaactaccaagcctaccaactttgcggaaatcaagtagtgaaacagaggtctaagatgttgtagctttgttccctaaaaagtactggtatgcaatttagtcaaacacccaatgactactgattaaatatttagtatgtgccaggtatgatctacacactagattgcaacaaagaacaaaatgaacaggatcctttgaaagaagttcacatcccatatctttagacaattataaataaatatttaagatcatggtcatttctgtggagatgacgaccatatattctgtttgtcaggaaccgccttggtttgtgcccatattcctgctgtggattattaaggtcgcctccttttaccctccaaagtgcccctgttttggtcatcttgtctataaaagaaatttcaaaaaggtgatataaaagaaagtcattataggaggggttattttggattggatgatcaggaaatgattgaataagataatgtttgagctgagaaagtcatcacacaggtcttcagaatgtgtctgagcttgaggagagagaactgtatagtgaaagagagatgcagtttgggttcttccaaatctaattttctatcttagtcccaccacatcctggatttggctaggtttcccatgggatgctcaagtggtatcatttaagtccaataatgtgagtcagaaaggaacacattaaattatatggggaaagaaactgatacttatttataatatcctgccacaaatctatatttttgaacagatatgcaataaacactgtgtaagggtaaatgctagataattaaatatctttatgtcacttagaagactcaggtctacttgaaatacaactcccaacaccagaatctataaaataatacaaggttgatgagtaattaaatgacgaacaatggaggatagacaacttgtactgctgctgctgctaagtcacttcaagtcgtgtccgactctgtgcgaccccatagacggcaggcccaccaggctcccccgtccctgggattctccaggcaagaacactggagtgggttgccatttacttctccaatgtgtgaaagtgaaagtgaagtcgctcagtcgtgtctgactcttagcgaccccatggactgcagcccaccaggctcctccgtccatgggattttccaggcaagagtactggagtgggtggccaattccttctccaataacttgtacaatgagagctcaaaggggaatgaaatcagtgcatatcagagagtgaagacagatctaagagagtggaggagaaataggatgtgaacaggtgcttaa

SEQ ID NO: 57716 - DNA, 2256 bp, Bovine  19866880753172
acaaatttcttaagaggcagattaggtggtctggtattcccatctcttgaagaattttccacagtttcttgtgatccaccacagtcaaaggctttggcatagtcaataaagcagaaatagatgcttttctggaactctcttgctttttccatgatccagcggatgttggcaatttgatctctggttgctctgccttttctaaaaccagcttgaacatcaggaagttcacggttcacatattgctgaagcctggctaggagaattttaagcattactttactagcgtgtgagatgaatgcaattgtgcgggaccaattttctttgtaaatgtagttttactgatacagtagtccaaagatgttatgtagttcccttttctacaaaacaataaactaataacctcactagatgcattgaagagagccatatcctgttgggattacatattagtagaacttgaaagctatggcagaccatgcaatttaaggttgttttgaatttatgcatttctgtgtagtgcaacttgagtatatggccacataaattctcaaaaccttttctcttccatccctcttttctttccttcttttattttttctttccttccttaatatgggatgtttgtcaacagggccagcctcatggatatgcagtccttgtccaagcttagaagaggctagtacttgttttaatgtactgttgttgctgtctggaaattacaagtgctttttaaacatggttccctgcaatttcattctgtcatgggcccagcaagttctgtagctacttctgcttatcaaacaagtttgaaccctcctattgacaaacagctgtttacttggtagccattccttttctcccactccacccgtcagtgaaatacattagaacagggttttgtttctttccaagtagattgactacagttacttctcctttaactcatttggcacatggaacctgagcaaattcttaatatatatatatatattttttatcactttcatactcagaaaatctcagtaatattgagtttaaattttgcatgatcagcaaacagtaatctatctgttgctacattctgattaatcctttcttaattcctgctgctcttcctagttttatttctagtcagtggagcattatcaattcactaaaacatgaatatgttataaaatatcatacatttttataatttttaagaaatcaacttattaatttaatttgtcagttgtttaacaaatatttattaaacacacagactttgacaagtacttccctggtggccggtagagtctgcctgcaatacaggagacctgggttcaatccctaggtcagaaagatcccatggagaatggaaaggctacccactccagcattcttgcttggagaattccttggacagaagagcctggctggctatagtccatggggtctcaaagagtcagacactactgagtgaccaacatcatctaacattctagaaatggcagcaaagaaacagaggataaaacatccttggcccctatcctcatgtaattcacagtttagaacaggatagagatatttaataagtaattacctacttgttaaagaaatcttgacatgaaataattaggaattatggaagaaaattaaagggaacataattgccttctttccttcaatgattaaagtctcgtacatagttcaaaatccagataaatggctacttcttgcatgtagcttcttgttacttctctccctggcttactgtatgtacagtctgcttgtctagttcaatcccttttcattaatattttatttcttctttcctcaattagtgtgtggtttagattaagcctcatgtgcttcttggtccttcaagactcagaccagctattaccttctctggaacacttgcctagctttccttgccaccctgaatgctatatgtttgtgcattaattctactggagaccatttttagtctcattctcagtgctggcatagcactaaatccaacagctctgattggataaagagatgctcaacagcttctgcatggatgaaaaaatgattagttctattaagtcttctatgcttattatgaacttaaagtttaggaatattccaaattatgattgccaaattttgatatttcaggtatctggtactataacttacaaacaaaaagtaagagtatccccataagtataaaacatcatttttggctagatatttgacaatatttcctaggaactaggggagtttcaa

SEQ ID NO: 57717 - DNA, 1114 bp, Bovine  19866880974229
taaattttcagagagatgacagggcagaggaaagcagttttaggcttccaagagcagagacaaaggctagttagtaaaatgtgttttatacatacctctggtgcagtctcctggctggtagggtaaaaagttgtctccagtgattaacttttgttcttcctggtagagaaggacacttgaaaactgtatgtcctgcttttaggtaaataggaaaagggcagagatctttactgttgctgccgctgcttagtcgcttcagtcacgcccgaccctatacaaccctgtagactgcagccagccaggctcctctgtccatgggattctccaggcaagaatactggagtgggttgccattcccttctccagaggatcttcccagttcagggatcgagcccatgtgtcctgcattgcagacagattctttactgctgagccatcagggtaacctaagatcataactagtatctgcttattctcaactgccttcagctcaaaataatccttgtgccaaagtgggatatctgggggtagcatattctgctatcctcagctgcttctttgcagctcaatccaaaacttactagtttgaaaaatagaagaggatttctgtgtccctcaagaacacactatagcgctcttattcataaaggagcatgaagtaaaataaagtgctagtctcagaataaaactgaaagcaaaaattatgcatccccttcattggaaaatacataagacccaaaataaacaatgaggatgtcttatatttgtttaataacccttcaaaggcacttccaaatgcatgatttcatttatcctcaccaaaaacctggaaagtgtgggttgtgatgatcatcccaatgttttcaagatgaatattagccaggtcaaagagatgatggtcccatatctaatccttagctatgtaaggatcacttaacagtattgaggagtgggagaatacccagggcaagagaaatctacaaactcatcaaagtgacttagatgatagagaaaggtatgagcaagagggcagagaaaatgtcccagaaggaggacaagatgtatcctggcaagtgaatttggagataaatattggcagtttagggggttagag

SEQ ID NO: 57718 - DNA, 1357 bp, Bovine  19866881120168
aagctgctgggccccctctttacctttgtgacccatgacaagaaggtacactgaagctctcggaggatgacctatactctgttctcactgctttctcaattctgcgcaataaggagccttgtatgcttaggtagggacactccgggtagtatgtacaagttcactccataccctccacaaacaacacttggctattcttccaggctagaattacacatacttgtgtgcagtccatcattcagaagttagacttggtaaagtggttactgcaggccctgaaagctgacttgagccacttgggtaagagatgctgggaccctgggtacatagaatgtggaataaaagggcagaacatggagtacaagtggtcaggtctccttagccctgtggataagggcgtggctggaatagattcataataaacctctcaaaatcctattacccatgagtcttatgaaagtgggttctgactggactgttggcaggaaagaggaccatcgcgctaagtgggatcattccaagaatcgaagaaagagctataatcatcatttttatttttctctttggagttgctaattattcaccatttacaagacaacttcagcttactctactgtgattccaactgagaacagccaagttgcaatgcctcattaagaatgttatgattttttttctgcctgggtagacacacttctccagcttgctgaacctgagtaccagcccgagagctcctgcctctgcaaggcagactgctgccctgtccacacccttgctggctctcactctgtggggagtgggccctacttctacagggaagaaaggtaagtaatcatgcctcctcctaagaaccttatgtcagatagtctatccacgaatcaacctcatatatcatccttctgaatttccaaaagaatttttctatattttaataatgcaagtgagatgaagatagtaggagatgaaaaatggtgtactaatgtaaattttctaagatagatctcagtttttggtaggaaaaattatccaaagttcaatttcctgcaatatctggttctctttttcctattcttcacccctaacacccgctagatagaggaagatgttatttttctcatgaattaagtgaaggggaaacttgctttgtgctcatcctgtttgataagaggagaccataagaaatccttttgactctgactatcaccactcacttggttgggatacatttcattcttcgcattttttaaagtatctccatttttatgtaccttttctttagtggtccactggaaagaaaaaaagaagtgaattgaatctgaggaccctggattctctttcaactttatcattctcctga

SEQ ID NO: 57719 - DNA, 744 bp, Bovine  19866881132023
atgttcctgatttgggtgtgtaactctgactctttactaaatgactttttagtttgaacagggcccagaataagtgaaggttctgcaacaggtctgggcttctgcatagctgttctgacactcgggtcatatgataacatgatcaaaatattttcccctaaatgtaagtattagaaaagagacttctaagctgtatatgggtcttcacaaggattctgtcctggtttctaaaaaccaaaaaaatattggaagaactattgaacgctataatctttccatttcccagtatctccatgaactgaatctatgcaatgcaattaccatctacagagatccagggtcactatggattctagaatagtaaatacagaagcagaatgaacttctgcctgataaatcacaaatcaaatctaatattacttttggacaaaatggggttgacgaattctaatgggataaataaatatagaattcttatccaacccatgctatagaacatataatgagtaaactctgaaagatctaggcttatgggaagtgcagcttgttcaatgggaagggaggtatactgggagaagtgaggcctgggtttaagccaggtctgaacagcaaataaattatatgcttattagcaataagactgtccatttcttagccttcgttttcacatctgagagctgatgaggttgcagaacataaatccagtagagaatatccacattcaaagctgtacgtatacccaca

SEQ ID NO: 57720 - DNA, 1629 bp, Bovine  19866881180513
tcttcctatcatcatctcagcaagtaggtactatgtacccattttacagaggacaagacaatctctgagaactgtaattttatagatagcctataaataaattttatagtttactataaaatgcccagagtgatacacctcctaacttgaactctcatcttctgtctccaaagttgtaatcattctcgggcaggctcctgattctatttgctcttcaagagcaaattgattattctacacctctaaagtatgaatgtatctgcctattatagaacttaacattttgcaatagctctgatttactgcaggctgcagtactggaggcactacactgtgaaaaacttaaagacagtggatctgcctgcaatgcaggggactcgggtttgatcccctgggtcagaaagagctgcttgagaaaggaatggctacccacttcagtgttctttcctggagaatcccatggacggaggagccttgtgggctttagtccatgggattgcaaagagctggacttgactgagcaattaatacgttcactttcatactgggtaaagttctggttactgagtaggggattaattattgaatagataatgaatacaatcattcatagctttttaatctatgtatttgattaactcaatcaacagaaggagcctggccttgggacccaggccttatttggtttattttaggcacatgtcacctgaggttgttacttttcttcttgttggtgttcatgatctgagcaaatccagacagaagtaacaagcagagctgcaatcagaatttggactgtctgattacatgtcttatgttgcatgcaatacaggttaacatctaggatatgatcaaagcatatgtaaataataaatagattatcgtttttctacttgctctaaatcagtggtactgccctgtttaccatttgtttatcaagcactaaatttttggaaatctttttctacattgaaatatttaactggatattaatttacaatttttctcttgtttttttaaaatgtggaggacatcattatcccagttttagtttctgatgttggaaatgactatccaagcaataaatgtagaatggatggtacagcagaaatagttctaggctaggtgaaagtgggcaggagagttagtgacggagatcagaggttagaagactgagccccagctctgctgttactcaacatctatttaaccctactgtgtgctgggcatcctaccagctgatggttgcacaaagatgaatgaagtgagatcctaagcagctcacaatttactagaggaagccttgaggtcatcgtgcagtctaaaaattgtgtagttgaacatgaggctctcctccaaggaaggaggacactaaaggcccttagcagaggtgtcactcgtgtgattatgttgcttcctttgtcagtacgttgaattttatagccctttcaatcaaaagagaaaacagatttgtatattatcaatgtttttagtttaaataaacagtcaccattactactactgaatttcaccacagtgaacaagtggtaataatatagaaaatgtataaattcatatatacagagacagaagtaaaagcagagggataagcagaggaaaaaaagagag

SEQ ID NO: 57721 - DNA, 979 bp, Bovine  19866881193504
tttttttcttccaagtattcagtaaaaagggactcaatagtcagcagtttaattattctttgcaagcataataacttcctgagaaccaagagcactatcttgtgacaaagctggtttccacatttttttttaataaggaagggttcagagtggtgatttcttgatatccctgaaggttttttaggagcgatcttatccaagcagtacattttctaaagatataaagggagccgtaaactgttcagaaaggctgaagcatctcatttctttcttacatttcctttttctagggatagttctctgcaagaccacaggtagtcataaaagcatccagacaacctcctgctccaaatcccaggcctgttaagaaatattcatatctgcacaaaattgctgatgataataaaaataatgaaaataaattctacagacttggaaagtcccatgaaaattcctccctgtagttttagcactgtctttgcatattcagctttgaaacttccatctgcagtaatgctgagtgctctgcttgagtgaatacctaatccttccaataagttatagtcactaaaaagtgcctgtcccatgaagcagaaactgactattttgctgaattttattgctggttatcaggagcagtgtgcaggacaaaacaatttcatactgatctctctactgtatcaaatatatacaaatagatctgttccttatgatttttaaaagttagatttttacactgattagagactggaaagagacctttatgattttggctgatactcctataggatggagaatttaatctgtaattcagaattaattatttggttttaaaaagaaaaaaaaattatattcagggaacatcctaggagattctgatctagtagctactttatgctggggcttaaaaggctgtgtttctgtttttaatatcctcaggaaaaaaagaagcaatatatatctagcatatgttaaagta

SEQ ID NO: 57722 - DNA, 766 bp, Bovine  19866881215345
acagcattgctgctatcaattaatattttatcctcctgaattttactaccaaaaatcagttctactacttcaaagattggcaagttaaaaaacgttgtaacttctttttaatagtgatatatatatatacttacatatgtatatattatttttcattgaaataatatgctttgaatgatttaaaacctaattattgatgtcagttctacatccaagccattctttattctcaagtgaaaaaatggtgttcctgagacatttgctaataccttccggataaggataagatcttttactgccgagttatttatgcatattcacttctcatattgtgtgtaatgtgggaagatgatgaaaatatttaagcctgcctgtgtttctaatcttcctgacggagttcaggagcttagctaagatgacagcatcccaaactacatccggtatacaggttgttgctgttaatatgttaataatggtcagtgtatcttatctttagaaagtctttccttctacaagtgggtccattagattctactgtttagaccagtgtaagaacatcagaagttctcatgcaattttcatatcttttttttttttttaagtcttctcaatctgtaacaagttctgctcaggcacacataagaataatattgtaataggattaaataaaccctcagaaaatagaaatttctggtttttttttctcatattacacagtaattttatttaactgtgggaataattttatttaaccctcacatttctc

SEQ ID NO: 57723 - DNA, 625 bp, Bovine  19866881267550
aattccatgtctaatgctcttagtagtatgatccatgatggctcagtggttaaagaatctgcctgcaatgctggagacaaaggagatgtgggtttgatccctgggttgggaagatcccctggaagggcgtggcaacccactctagtattcttgcctaaagaatcccatggacagagaagcctggcaggctacagtccaaaagatagcagaaagtaggacacgactgaagcaactgagcacacatgcatgcagtgtgacctgaggtgaactactctctgtttggcatctcaagtatgccatctctgaattgggaacaatagttagaaaccttgcaagtttgttctgaaggttaagagaaatcattaacagattttaatttctttacacagtacacatcataaggcaaagtaatcacaaggaagtgttagttcttttgttcctttgagtctgatggactttttctgttaaaatgattccaatcatcagaattttcaaatctctcttatttgctggtatcttagtaattaccacagagggaggatatcttgatttatgaatcaattctgtttttcattcccagcatttcactatccctagatgtttccccacttccagcagcagccag

SEQ ID NO: 57724 - DNA, 1701 bp, Bovine  19866881267674
attatagacgtaaagtaatatcccagaatcaaatgactattaagaggtgaaacagtgattagaatccaagcaaaataattctatatcctctgagaaatctctgaacataataaatctcttcttctaatagtccctttgtagacattaatgtttttgaaatattaactataaaagatcctaaataagatcaaattgtctaagtattctctttattccactcctagataaaaaaattacttacactttctaatatctccataaatgattttatctttcttaaacatttcagtttagaaagacctttctgatagttcaaatacacacagctttaacattctattgcatttggagaagcaaaaatgctaagagaattttaaaagagtctgctttgtaaatttcaattaagctatttgagatagaaattataggtccttccctatcaagtcctcattaaagatcacagaatggtcacaaagtcagtagagttttccaactggcccaatttattgacagacccagcaaacctacacttctgtcaacaacaaaggaaaattaagaagttgggttctgaacattcatctttgagtatatggctaaagtcttgtttagctctcatgggaaagctgtattacagtatcatagatatctgctaaataaagtgagcaccagaagtgccaaagaaatcctagtgcatactctacaaagggcttagcagttggtttcctttttgtctttttatgaacaggattataaataaaagatactgtttttcaagtcatgtgtgttattgcacttttgtaaaattttgccttttatcaaggttagtagtaggaagaaggatgattctttcttaattcagtaactacttcaacatgatttaatacatatttgtgtgaaaagtggatattttcacagcccagtgttgcatacagagataatgaaatagctttgccattgaaattttgattcaatttctccttggaacctgttaacataaaaccactttcatttttatagctggaaaatagataatttactcttgtgaggttttaggaatattacagaccagcataactcttgagcttcccaaattcctcactatgtagagagaacctgtgaattcaaaaccctggccatgtgtgttatcctcaaaactttgctcaaggtaaaaatattatttgtatgcaccctgctcgtgctcgtgctcaattacttcagtcatgtccaattctttccaaccctatgcttgcatactcacctggtattaatatttctttttttaaaaaaagaaacactgaactttgaattgcaaaaaaaagaaaaagaaccggactatgaaacattaataaattataacatgatgtgtttatctgttgttgcaaacccatataagttttgagaaactctatcacaaggatgcctaaaatagcagccccaaatgtcaaattctaaagctacagggaaggacatttctctcttctcctgaaatgcaacgaaaatctccttgaggtttgatgaattagcccactatggaagagaaggaaagatgagccgagtagcagcactgtctgtcagtcccaaagtgggacattaatacccatttcctaagaaagaatacatgctatataaatgatcgaatctggattacctgacagacttatagaacttttgaaatggaaattcccgtgtagattatcaagt

SEQ ID NO: 57725 - DNA, 808 bp, Bovine  19866881314701
tccaggggatcttcctgacccagggatcgaacctgggtctcctaccattgcaggcagattctttaccacctgatccaccacagaagccctaggatatgttatagaatgctcatatactaataatctagtgaagaggggaaatgatgatgtaagagagaataggtacttcctggagagctaaggggatccacagaatgagtagaagagtagctctaagatctgagcctggttgtgttttatctgaaactaaagagaaccctgcacaagtggatgcaggggagagactggcaggtgggactatgtgtgcatttcattatgaaggttccattgcagggctaaaaacttttagaaacagcagtaaaagaagaggaagagagttttgtttctgtctccaacgagctttgttaggaaaccagcataagaaggtagtcagcccacctaccaggaggcgctggaggattgacaaggcctattagccatttactgctttggttttccctatgaacagaattccatgatgagatattcctgtttgatatgaccatatcatattcatgactatggtaataagaagagacagagcagtagatgagaatttgctgtgattcatttacttttcagggaagaaataaccacatgtgcttccattgaagaaatatgaatttgcaaccatgagaaaactatcttttttgaataactctgctttcttaaaaaatgtagccttcagatttggggaaactgaagtaaacccagagaattcatctagccagtgaacatgacgatgacgaatctttttttcctcctcatt

SEQ ID NO: 57726 - DNA, 811 bp, Bovine  19866881349939
aaatggggagagaatccagcattatattgctgagagctgcacatcaacacttccaactatttgctatgtgagttttaggacaaaacaatgtaacccaaatgtgaaggtgtgagtgcacaatgaatatgcaaagctgtaaactaagtgataatttttgccttgattgtgtgagctaactactaaggtcataattagggtgcatttcttatagtaccaacaagcatcttaatcaacctctatagcattaactccaattaccattagtaaactatgaggattctgttttaaattgcaatgagtcagtaaattccagatggcattttgggagtaaatgttaacaaaaccttatcattttcctgagcggtcctttaagacatgggtgggggctgcattgaggccgaagcaataatgggaggctgaagagttattcgatttcacaagtggtatttgtactctgatgtgaaacacacagttatccttaagaactgttaatgattattttatagatgaattttagctttatagctttaaagaaagacattttgtttagctgaacaaactaatagactaataaactcaaaataaagtctgataaacagggtcctttgaaactctcatcattaaattacaatatttgcataaatttgaacaaagatggatggctttaaatgactgtcagtaattaagagaccgaaacaaacaaaaaaaactaataaaacattatatacaaagacaggcacattagcatattctatccatatctccattgcagtgacatgaagacaaatattcctgattacacctgaagcaa

SEQ ID NO: 57727 - DNA, 1008 bp, Bovine  19866881413122
ttctctttgatattcttctgcatcttcttacatacagttctgaattctttgcccttcctttctttgaatttactgggtatcgtggctcttatcctctgttctttaatatatttcattaaagagatgctcatggaaagttgacaacaatctgcctcatccttcacatttccttacatctaatgaggttgttcttgtaagaagtaaacaccagaagcacattccattccatcttttacattgctttgatgctttgtttaaatttattctgtaaataatatcttaaatcaatgcctttcttttgaaggtctttgaatctatttggaatagcatgactatttttatctttgactccacttatatttcatgatccaatttagaagcagtatggtgtattataaagagctggatatactcagtctaaggttttgaatcctaggtcagccacttaactatgtgaccttgggtaacttgccttctagtttcttttgcattgcctttaaccctcacaggctgttgtgaggataaagaaaaatacctgacaaatggtataccctttgtaaacaatggttaaatgatgctgacatctgcttgaaagatactcagaaaattctgagtcattacccacagaattaatctgggggtaaattgatttaattgatgctctctttaacgtctttgcactatgctgctaatgatgatgtggcacgcttccctgaaagtaaaagcaagacctccttcataccatggctgatctctttctatttccataatagaatattgctgatagccttttccctattgagctcttctggataccttccctttaaagaaaagccattcataagagcctttaccactttgaaatatttgtgcaaatcattaaaatatatgctactaaggatgcattgtgatgcaagaagtggctactatgaagtcatttttacttaagttcattaggataaaacatgtttcaaaagggagataattgtactaagtaaaaaaggaagc

SEQ ID NO: 57728 - DNA, 852 bp, Bovine  19866881419661
tccttctaatgctgaaagcccctttctatccccctttccctttcaacctgcccccagaattaaataatttgtacctaggttttctcgtgaatggtgcccactctgatgcaggcaaggtgctgtttgagaaagaaaatgattgaagctcagaagtcaaggaagccaagaactgccaagaaggagacaatttccctctgtactctccttcctcaccccacactttcctcacatatcacactcccaggctgatttttcctttcagaggaaatgaagcaaaacacataaatggagtgaaatggtttattcctcagagtcgtaaaaccacagttccttgtaaaaggtgaagaaaatgagctcctcttatagataagtgaggcttttaggtaaaatgtcaatatcccaggcccttgataacttcctaacatatgactttctatagagacagatttttgtcaaccaccatggaaactgtttgacttgaagcagaaaaatgacttcaaattatgaaaatctgaccttcaagtatggagatgcttcctctgaatgattttattttgaagataaacaaacatagacctgctcaattttaaatatgtgttctggatcaaaaaaaagtttttcattttttaaattgataaatgactatgtttcaatgggtactgcattttctcctattggaaaaaatactgtgcatttcatattaatattcttttccttttaaaagtaacctctaagatgttgtataaacacatgccaaaaatggacaagttcaaaggagaaatgaaaaatgctggtgtttgttctccctgcacttctgtgtgtactttttaaaatgggatcatcattttgcat

SEQ ID NO: 57729 - DNA, 760 bp, Bovine  19866881641670
tatgtaatccagtgccatcattttacacagcagggcattgaaacctgaagcaactcactcaactctgggctttgagaaatccagaatgcctgctaactctcagtctggtgcttgtctcacaacctccctctcttgctgcatgagctctggagttaaacatggagcagggggtcagctgtggatggatctgaatatgaatttgcagcatgcattaaaaaggcttttagtgtgactactgcagtgaaaattgaatagtacagttactgtcctggagagtttgttacatgaaaactgcattaggtggttttcggttacagcgcacggttagtgtcacccattgtcatgcatttgttcccagactgattttcctgcagaaggtcagagtcctgtgttactctgacaccactgtgacaggatcctgaatatttaattgcgctgctctgatgagaggggggtctggcagcaagttccaggggagtctgtgcagtgtgattctcttctgactgctgtttggaaatgaatccgtggagcacactcaaggacattcaagaggcacagcagattctgaggcattcttttccttcagctagtcaaaactgaacttagaactgaagtcctaaagaaatcttttttagaaaatgttattttattgtggtaaaagtcacataatatcatccatctcctgaatttttcattgtcctaaactgatatcccatccccattaaacactaacttcctccccagtctccagccctctgcc

SEQ ID NO: 57730 - DNA, 1432 bp, Bovine  19866881735001
caatttaaaatgtacagctgttccactaacagttttggcaatgggaatcccaagagttctctgagccgagtccctacacctcagatcaagcataaatttccaaatgttttgaagccaaagctctcgacattaacactgggctgtcagtctgccaaatgggaagtggtttgtaattgcacagacgttccccttggtatttaggtaaacaggagcacatcaatagagtttgttttgcggaatataatatattgatcaattctctttagaagcagagaactgcaatacattcagacctaaacaaacaaaacaaagagtttgagggagaaaaacgaacaaacaaacttgctttgaacagcaggagacgacgttttggcagctgagcagggcaagagcttcatgagccgctctttaatgctgcgcttggtgctgttctgagtgtagaggaaacctagaagatatgggatgggttctgttaatgccagctgcagagagaaacctggggcatgctgctctgggtgtcagcagatgccatggcaggcaggatctgggtgcagccatatttgctcaggcaatcacaggcagagggttggcatcccagaggaaaaaaacaaaaacaaaaaaaacgaaactaactaaatcctggttttcccttttaggtttattttatgttgcattagatcatgattaccccatgagcaaagaatcatgcaaataaatcttttgagtagcaaaaataagatttgctgacttttggaggtcttaaattgggaatatagcaaatagtataaaaagagtgaactggatttgaagtttcaacattcaaagcagtgttaatgcccacgtgacattttctgcactcatcactcccgtctttgcttccaggggaggtgggtgctctgcataaatcattcacaccgcaatcacctgttagtacctttttgccttccctgaaagtgagaaaattgatgtccttgatttgcagcttcattagcataagctgatgtgcccagagatgggacatccttcaaatgtggacattaatggatggggcttattcaagcagagtgattctaaaagacacaaggagtattcacaaaatgttaacccaggagtagatggagcagcatctgtgacttcaagtagttagtgaggactcaaggaaaatcagtagtgacccaatgggccagctagcaagtgcttgaaaacctgctggtgccaggagccatatctgtccagcttagcatcaacttgcccattctgagtgaccagaagcctgaatcttcacgtcactatatagattaccgccccaaatcagtttggaaagtgtagaatacaaagcaaaagcaaaaggaccaatttaaatcaaagttagaccacccttaaaatatgaacttggcacatggaccccttgttgcttttctactttgtaatt

SEQ ID NO: 57731 - DNA, 617 bp, Bovine  19866881887434
agaaaaaaaaaaaaaacatacacacacacacacaaagaaaaaggagcctgatatgctagctccatttcagagctcaggaaactgaggtttagagaatatgagaaacttgctcaaggtctaataattagtaactgacagaactttgataaaaccagatccatgatgtcccattccactatcagaaacaaaaaacagcatttataaatcgatgtccaagtgaaaatgtgcattatctaaattgcctgagtttactttttaagagtaatatggtatcaatgatatcatcaggtgaagtacaaaggccctgttttaagtcatatgaaaatatatttgcttatctttgaagtgcacacatttttattaagtacattttaaataaagccttcttcttggaagtgaaaggaaactctaagctaatttaaaagttagggatccatggagttcttttgaagcacaggttttcagagccaaaattcattaacattaattcaatgggaaaatcaagtcaaataatttaatgctgaattttttcatggtgtgagacagatggttgccattcttaaatacaagtgaaatttctaatccagtggcaatggaaaaaacaaacaaatgcagta

SEQ ID NO: 57732 - DNA, 1471 bp, Bovine  19866880404959
tgcgcgagaggtgagcccgggcccacccgccccgccccgcccgcgccgcccgagcccgagtgtcctgtgcctctgccctttgcaggaacgcgctgatgttcaacaacgagctcatggccgacgtgcacttcgtcgtggggcccccgggcgcggcccggagggtgcctgcccacaaggttggtagaggttcggccctgtgcgctcccaaaggcgaccggccgccctcggaggatggacggtcgtcttctgggtgtggcagccgctgggggcagggagggcccagggctcagggccgcgctctgcctctctcgtccacagtatgtcttggccgtgggtagctctgtcttctatgccatgttttacggcgacctggcagaagtcaagtcagaaatccacatccccgacgtggaacctgcagcttttctcatcttgttgaagtaagtctaccgcatgagggtgggaggatggggcggttccttgctgtctggttcttccagccagctgcctggagcttcctgaaagtccacaaggacagatgggctcctctgctgggccctcggtgcccagagtgcccggtgctgcccatgactctgcccccatcctgcctaggtacatgtacagtgacgagattgacctggaagctgacacggtgctggctaccctctacgctgccaagaagtacattgtccccgccttagcaaaagcctgtgtcaactttctggagacgagtctggaagccaaaaatgcctgtgtcctgctatcgcagagccgactgtttgaggagcccgagctgacccagcgctgctgggaggtcatcgacgcgcaggctgagatggccctgaggtccgaaggcttctgtgagattgactggcagacgctggagatcatcgtcacacgggaggccctcaacaccaaggaggccgtggttttcgaagcggtcctgagctgggcggaggccgagtgcaagaggcagggcctgcccgccacccctcgcaacaagaggcatgtgctggggcccgccctctacctggtccgtattccgaccatgaccctggaggagtttgctaatggcgccgcccagtcagacatcctgacactggaagagacccacaacatcttcctgtggtacacagcagccaacaagcccctcctcgagttccccctgaccaagaggaagggcctcgcgccccagaggtgccaccgcttccagtcctctgcctaccgcagcaaccagtggcgctaccgcgggcgctgcgacagcatccagtttgccgtggacaggagagtctttgtcgctgggctgggcttatacggctctagctctgggaaagccgagtacagcgtgaagatcgaactcaagcggctggggggtggtcctagcgcagaacctgaccaagtttgtctctgacggctccagcaacaccttctcagtctggtttgaacaccccgtgcaggtggagcaggacacgtt

SEQ ID NO: 57733 - DNA, 673 bp, Bovine  19866880677804
tgcatctgagatgtgcctgcaggccggggctcacctgtggaacccatttgggagacacgaagctggtggcttctaccacagggagtcctgcttcggaaagcatgtctattagcttgattttcactggagtaggtacaatattctgtaatgcaaagagaaaacaccagaaaaagacaggctggccaagtgagtcacgaaatggtctcagaatgcagtcagttcaaagctttttctacagcacccgcttcactgtctccactgtcagacactaacctgaattcacatgtaatcctgccaataggtgcagtacaggcttgtcttccagttccacagagagcattttgcagtgaaagcagtttctcacttgaaaaggagttaatacttacaatggaaacagtatttgcccgtcatacgggcttttaaactaaagctctgttactttatgaccccatcaaaaacagattgagaccagtgagccatggcctgaaagggcggagatgactaaccctctggatcctatgagacatggcctccaacaggccacaccttcctccttccgtctcaggtggcacaggatctcatcctcacatgctccactacttctttctccccccgccacaccctgtctggctgctcaccagcctctgtggattcctatttccaaatctactat

SEQ ID NO: 57734 - DNA, 1500 bp, Bovine  19866880780616
aatctggtgaaatgaaattaatttcacagtaataagtagtactaagaacaatagaggaaagggagaaaaaaaccttgtattacttggtggtgaggaggggaagattttctatagaagactatgtacagggcagactttatacagaggcgactccaggccgttgttttaatatcttcaaatgctgaaggtttcatctcctctcagactcactccccttgtcaccacccaccctgtgatcataacagagcagagcctcttccatccctgccaccccacatagtccaagacgacttctctccacacttggcagttgtcctcctctggggcagctgtgccccgggtgtgtgtgctaagtcacttcagtcgtggccgactccgtgcgaccctgtggactgtagctcaccaggctcctctgtccacgggattctccaggcaagagtactggagtgggctgccgtttccttctccagcagattttcctgacccagggatcgaaccacgtcttttaggtctcctgcattgattggcagggttcttaaccacaggaagggttcagtaccacctgggaaggttcaagtcaaactaggctttaggagaaatcagttctgtttggggacttctaagtttgagaagtacaaataggtttgtttaaagaacagtctaaatgcccagttgccaggcggttggaaatgagtctggatttcaggggagttgcaaatggtccatactgcaagcatgaatctcttactctgttcttaagtgaaatgttctttttgttcttgattctaaaacagagcaaatatggattaaagggtgagaaatactgcttctagtctcagtattgaggatggatacattctttctgatttgtccccatggagaactgtgacactctcttcctgttactttttgttccctcttttaaaccacaggtcagcacctcatctgtgggtacgttcccaaagcaagtgaaaattgtggaagttggtcctcgagacggactacaaaatgaaaaggtaaacgtggaaatcaaccaaaagatatttcacaggtactgagcgctccatgtcacggatgccgagctgtgcctgactttgggcccgtctgggaggccaggcaggcacctgtgacagttcagccccaagtgttgtgatcctgggtccctctcaagggcctgtggggcggggtggatggtgagagctgcaggagtgagggggaaaggtgagggcgtgcctcatccagcagcgacacgtcaggggattcggccagaggaagttatgaaggtcacatgccaagatttagcttgggaatgtcccttacaaccctggtgtaagagcaggacagttgcaaataaccaacacgttcagtatgaggaaaagtagatcaaatacattaatgacttcataaaatgtaatactgtgaagctgttaatgatataggagtatattaagtgatgtaagcagattatacaatactgtatatataattacatacgtattt

SEQ ID NO: 57735 - DNA, 1715 bp, Bovine  19866881007698
ttaagcccctttggtaggaatccagcctccctgataatgtaaaacatgggtatcctgggatcttcaaaagcatggggctgaatccttgctggagctgatggactgtgggacatgagccctatgcttggcacatggtaagggaatttccccttcctcccacttgctctgtttattatttattatagggttcaggtggaagaggagacaaaggggctgaattgagggatggctgggaacaattcggggatttataaaacctttgtgtatatcttcctttttcttggagttggattagactggcacactgcctgcttccagtggtaccaccaaaaaggacttagcaagaccaacagaattctctgaagattctgcatgccaagtgatcccagcctcctctgtattccccaggtccctaggagacactgtgattgtggatggggattatcagggtgtcagagagggccactgccctaataataagatgctctgaactggagacttgtcagttacctttgcaagagggggatcgacatccttgatcctcatcgaattttagttcttggccctctgtgggaagggtgaccttcaggtagggcctttcatagctctagaaccaaggaggcccctaacagttaaacaggaagaagggctgtccagccatcccatctgatatcctgagatcccaggagaatgattcattcttcccagatctcctccaggtccctcattgctgagcgtgaaagctccacctggctcctggggtctctggagaattcaggcactaatctgttttattgggaaggttgttctgacctgcactgagcctgtcccaagccgcctgcctcctgcccaccttgccgcccctcacagggcctgactacccaatagactgtgatcaggtcatgcagacaggcatgaccaggctaccttccagggggtcagtaccaacactcagtggaaagggctaagtgtccaggcctctgggggctggttcaagtcagatgagaggaccaaggccactcttcctccttcggggagtgaaatgacttctgacttggctgatttcataatgtgaaagtgatcacatcagtgatcagagctcatcaggccaggatagctctctggaatctagcccgggggtggttttcacatcagcctctgtctcagtgactgaggacctggggatctctccttttccttctggcccaaggcccctcacgcacttcttccagcgggcgaggcggtgatgggcagaggaccggatctccccgctccgcagggcatagataatggggttgaccatggagttgacaaggcagagcaaggagcagaaggcaaagaccttcttgacctggtcgcttagcctggcacccaggctgtagaccatgagggccagtaccgggaaccagaatatgaagagcacagccaggagcatccccagggtcttagccaaccgcacatctagccgcatccgggctattccagacaggtgtctgtcccggtgctcagccaagctggctacgtgctgatgggccttccagaggacatgcgcgtaggtgtagatgatgccggcgaagagggcggcgataaacaggagccagcccagcagatagtcattgggggatcagggggaaaagctcagagcagggcctggggcagcaggtccatcccatgaggggcagggtaggacaccaatgcggcgagcacccacatga

SEQ ID NO: 57736 - DNA, 1878 bp, Bovine  19866881094634
ttggggtgcacgccccctcggcccacaagttttttttttttttagttaaaatttctttgcagtagaataacgggatcggggcgagggggagtgtggcgtagcgtttgctaccctttttgctgtgttatatttgtcccttttttattttttcttttggtattggagatgtttggagaaaagggatgttgagattagagataaaaataaaattctcccagcgagacggtacgaaatagtccttccccttttccgggaaatgcccatcaccctttgaaaacagaggtttaggaagcttctaccattagggcgttgatagctaaattggattaatctggaccgcccctttgttctcgccaattcccttaattgcatggagttgcggtcagaattttttggaagaaatgttaccagatttactgtttcacaagtaaccactctacacacacaccattttggtagccttgtgtgatttttctgtcttaacttttaagtagggaaagtaagcaatagtaatatactctagcttctaggaaattttcccctttatgtcatattgacatttattgagaaattttatatatttgttttttaattttcagaccgtatttacctgttattaagtgtgtaaccctttcgctaaaatttggggctaaaaaaagtgcttgatatttttcagaatactggagttgctttaaaacttttttttttaattaacaatacttatatacaatttaatgttaactactttttatgaaaagttatgaaggctgtggataaaagcagtgaagattaagttgtaatcaggtttccttaaatgtcttgttttcttattgatgtaaaacactagtaggttttattaccagctcgtttattatgttccaaaatcatggattctggctgtcctttctcaaaaagataaatgttgtgtatttttacagttggctctccctgtttgtttcaggtcacccaggaacatagcacagtccctttcattatttaaaatagtacagaaagaaacctatttcttacaaagaaactattaaaagagtgaacataaaaatttggcgtctttttatgatgtttttaggtctgaagatttacgtcgggaatttggtcgttatggtcctatagttgatgtgtatgttccacttgatttctacactcgccgtccaagaggatttgcatatgttcaatttgaggatgttcgtgatgctgaagatgctttacataatttggacagaaagtgcatttgtggacgccaaattgaaatacagtttgcacagggggatcgaaagactccaaatcagatgaaagccaaggaagggaggaatgtgtatagttcttcgcgctatgatgattatgacagatacagacgttctagaagccaaagttatgacagaagaagatccaggagtcgctcctttgattacaactatagaagatcttatagtcctagaaacagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctaggtcaaggtcttggactagtcctaagtccagtggccactgatagtataaaccatgatatttttaggcatgtatcattcatttactcatggtttggtttacttaaatta

SEQ ID NO: 57737 - DNA, 2092 bp, Bovine  19866880364917
ctcccccggcatgggacacaaactcctgatggcttccttcctgcccctcaacgcactcctgacactggagcacagatctcctcaaccccacttccccagtgcaggtgactctggtcctgtcaaggccttgggtcaggcggtattgcctgcaaagccttccctggccagcccacgacctcccaggtcagggacactgtggtccttggtctgcctctctctgagggttcctttccctagcctgcctctgtttccctgccccctgagtttctagggcccacactggggcctttccctctgcagatgcccgcaagaccatggcatctgacacaccaggttaatgctggctgggtgggataatgaagtttgtgagtgatcccttcttagcagcctcttagcagctctgggaaactatctggtaggggatcaatttatgattattggctatctggtgaatggagatgtcaagaatgattatattcgattttggtaacttgtgacaattagccttttctacatctgggactgaattttagagccaagaaacatcttagagattattttgctcaagtgagatgttgaagtcaagggcgccaaaactcaggcaagtgtctgtccagtgtcacacagcctggccctagtcccaacttgacgccttcctaccagcacggattgtcgcagagccagctggcagaaacctttgtggctgttggttcctggcatcattacaaatggatcaagcacctaaaggtccaggcacaaccttgcaggaggctggtgtgactaagagttccatgcctgagtaacagggtgctgaggaggggctctggttggtctctcccatgcctgccatgccccagcacagagccactgaaaggccaggctgcccagcgcagggtttacccagagaagccccaagcgcacacacacacactttctgctatcaactgcaatctcatccagcaggccttgcccatcatttgcacaagacaggtttgtcccaaaaaggcaaagaaaagggtgagaggagggagagggtgagtggggagagatggtgaagagggctgtgagttacagggagatggaaaagggggctgcagaggggagagaggaagggaggggacgggctttgagtcagtggagcaggtcaggattcagggcaggcagaaagcgccagctgtgccccaggcaaaggtccccaacaatgctcgcggatgcccggacatcccatctctggcccggctctccgacttacacggtggcctcatcccagacctagtcctggtcccctgcacctctcggccgtcgcggtccacacaccagcagtagccagtgctgctgtggcactgggtgggcacgtactgcccgtgctcatcacattcggggacaaagagtccagggggccggggccgcgaggagtccgccgtccccaggatgtgctcccgctcatgctggcatcgggttttctccactactgttagagagaggggcaaaaagagggtcgtcagttcaagcccctgcacccaactcggaacctggggagctgcctggtcattgccccgttttgttttattaattaaaaaaaaattttttgttcacctttattgaaggatgttggcttacaatattctattagtttcaggtacatgacaatgattcaaaatttttatagattatactccttttaaacctattataaaatactgattttattctctatgttgttgctattgttgttcagtcgctcagtcgtgtctgactctttgtgacaccatggactgtagccggacagggtcctctgtccatggcgtttcccaggcaagaatactggagtgggttgccatttcctcctccaggggatcttcctgacccagggatcgaacttgagtatccttcttggcaggcagattccttaccactgagccacctcaaaagctctatattccctatgtcatgcaatatatccttagagcttatttaaaatttttttaatttaatttttactttatattggagtacagttgatttacactgttgtgttagtttcaagtctacagctaagtgaattcccgttatacatatacatatatgtact

SEQ ID NO: 57738 - DNA, 2532 bp, Bovine  19866880451341
gcacccactccagtactcttgcctgggaaaatcccatggacggaggagcctggtgggctgcagtccatggggtcgctgagggtcggacacgactgagggacttccctttcacttttcactttcatgcattggagaaggaaatggcaacccactccagtgttcttgcctggagaatcccagggacgggggagcctggtgggctgccgtctatggggtcacacagagtcggacacgactgaaatgacttagcaagcaagcaagttacacatgtgtaatacagtatagcaactaaactgccatggtttaatggtctttagctcagtacaggccaattacttgagaactgacaatgcctcaaaattgtctgaggtgctttttttccaagtatactcagttggtcccattggagacacaccaaattagaatctctggggcttgagtctaaatctgcacatgccccaaaagtcattttcttgcaaactcttatttaagatctactattctaatatgtaaagaagaagttgatttttctttttaaaaaaagatggtgcatcttgtgttgctggaatgagaaaccagggacagttactgagttcttaccacatgccaggcctcgtggtaaaatctgggaagtcctgaggcttatctagagaggagcatatatgtaacaaggctatcctaatttctgtattgcaaaactgatgcccacatttggaattatactcaacaaaacaaaaagaaatctgtgaactacattttcaatgtgctcttgattcattcaacaaatatttatttgttttgttgctttatattatattgtgctacattttatgctatatattatgctgagtactcacattctatatattatagatacagctatatattaagcgaggtactcacactctccttaaggaactcaaagcttcttagttgtacaggcagcaccagctacctacagcttttatgctgcattagccctagtcagtgtgccaacaaggcatagattatgagaaacactggaaaaggatgtcaggatgtccagatctttatcccaaaaggacataatattatgttgagagtagaacaagaaaagagcagaacctcgttatatgaagttcccccgtataaaatccttgcagttgcaggattaaattattcttctcaggattgcttctgctccaacagtggtccctttctagcattagtagttctccatattgattttttagtatggggtatctagaaagttatttaaacattatctagttcacatttattattagaagaaaaagcatcacagaacataaatagaggaagcttaattatcattgtcttttataaaaatttcttaacagaaattttagttctaagtcaaataaatccctaccaaaataacacaggagaaaaagaatatagttccaaccttagaattctattagccttaaagaaatgaaactaacataaatcggtccatttatggctataaagatgattttgtactggaatgaccatgttctgctatgtgaacttcaggccttacaggccagaatggtctttaacctgccatttcagtgggctgtccaatgataactgatcagtggcaactaatacttttatttctctttcttgaggtgtgagaagcatgaacagtactgacattcagtggtcagccatcctgagctggggatatgctgataacatttttgaggttgaagagtaaacaaagtgagcctccaataaactttatacaaagttcacagcaatatcaggtaaacatttttatgaagtactttataataataattgaacataatgctttaaaagggagtcagactgatgacagctaggctttaatatcctgtagttagttgagaagctgatgacgctagacatatgccttgtttacagtgctgacagccttcctaactgctgctgtactgactgtgtccccagagtttgttctctaccccagcagtccccagcctttttggcaccagggattggctttacagaagactcttgtcccacagagcagggaatagggggatggtttcaggatgattctcctaaggagcccacaacctagatcccttgcatatgtagttcacagtagcattcgtgttcctatgagaatcaagtgccactgatctgacaggaggcggagctcaggcagtaatatgagtgatggggagtggatgtaaatacagatgaagcttcgctcacttgccagccactcacctgcttctgtgtggcccgcttcctaacaggccacggactgctactggtctgtggcccagaagtgggggacccctgctctccccatctcttgttgagactgtatcataatctcctactcagcattagctcacagcagtgttggaacaaaatcacaattgatttttttctcagtgttaatttgccttttgttactatgtcattttcaataaccagagcatcatctactgtacctggctttttttaaatggaccgggaattcaggcatcaccgcatggtagaaagagccttggg

SEQ ID NO: 57739 - DNA, 964 bp, Bovine  19866880467898
gaggcagaattattcttttagaaagcgttcccactgtttctgttaacctattctaggaacagtagaaaaatctgtgtactccacagcgaacttacacatgataaagacagaattcctgaaccctgcaatagtctgtttctatcaggatagtacttgggatgctgctttattggctttgaaaacactgtaaaataagctcagtaatgttaccatgagataaaaaaatatattcctggataagaataacttgcgtgtttgttatggaaatttaattcatatagtgtttacagaagtacttttgtaacttccagactttctaaaacattctgcttaaaaactgtataatatacaattccaaagtctctgctgtcaagataaacacgagaggaagcaagtggccacgtgtgctggtaaccttccgttgcattcataggtaagaacactccacggctacattcagatcatggtttgcacagaccagctattaattctgaggtccaattaggtgcagagatgaaattactcctattcacgttgaagtgatttgctttgtttaaaaaaaaatgcagctattgtctagcattcatttttctactgagaactttaaattagttccttattagaacagattgctactcagtctttttttttttaagctgaatttcatcatttatctgaagagaaaatatgcaaaataactggtcttgttaagagtgcaatattatatttttatgtaaaaataaaaaaataaattgggggggattatttattcagcatgaatttaatatgtatatgtttgaaacacgtcataatgtgcatgctgtagcaaatatttctgtaaattatcacaagctctgttacctttgtatacactgccacttcaaattgggaataaatttcataaaaatagatttaaggacctgttcttaacccaatttaaatattatgaccacatctcaaattg

SEQ ID NO: 57740 - DNA, 954 bp, Bovine  19866880525990
cagcagcccaccaggctcctccatccctgggactctccaggcaagaacactggagtgggttgccatttccttctccaatgcatgaaagtgaaaagtgaaaatgaagtcgctgagtcttgtccgactcttagcgaccccatggactgcagcccaccaggctcctccgtccatgggattttccaggcaagagtgctggggtggggtgccgtgagttgaacagaaaaatacatcctgcccatttgggggtgctgggttgtgactcagctatttcagagaaactaaataatacaatgtgtcctttgaggccaaaaatgaccaggagatcatttgagtctgggctacagtatccttgctcaagtgctgagcttgttttttctctcatgaacaaagttaataagagatgagtttagaaaacagtgttttgtggcaaaatttggctcattcccaaagtaaattaaactgttcttatcaaaatttctgaaggctgatcacaataagtcattctttcatcctcagatcttaattttgttaaaaaaaaaaaacctttagaataccatttcaagcattaagaaaaaagactactttttctgagatttttaggaaaaaaaaaaaagaattttcatacttgttgatataacctaaatacaaatggttacttagctaatttcatcttcatttcaagacttctgttttcttcttagaggattagttaattatctatgggctttctatagataatattgtacactcagggttttattacaaccaagtaaaatccactcatgtgtactctagttagataggagttagacatactggacacaaatatttataagaaattttgaagaaaaaagaaacttactagatttggaccagggtagaaggaaaccagggagaaggcaatggcaccccactccagtactcttgcctggaaaatcctatggacggaggagc

SEQ ID NO: 57741 - DNA, 2608 bp, Bovine  19866880593864
caaccgtttcaggaaaggcaggataaaagcttaattcttttccttagcggtcaaatcttaaaagtagagaactgttaccccatccaacagcaaccaatgagtttagttttgctttgttttgggggcctttaaagagtattattattaacttaagtattttctttttacttaaatgtgtttcaatcagttatggcctttatactttttgatgctgtgagagcatctttggcagtgagagccacttcaagttggctcctaagtcctttatttttctataattatagtaaaaacaacacacatcactgaacttagcatctagccaccctccagtacctagctcagtagtgttaactaattcacactgttgtgcaatagatctttaaagctttctcactttgtaaaactgaaactctacacctactggagcaacaactccgcaagtccccatccgctctccttccccaccccccaacaaacaccatttaactgagtctgactaccctaaacaaccgacgtaagtggaatcacatggtgtttgttatcttgtggctgacttattccatttagtacaatatccccaaagttcttccatgtgacaggacttccctccttcataatgttaaataatgttccatattacatatgtaccaaattttccacaactatttatccacagataggcacctgggctgcctccacctcttggctatgtgaatagagctgcagtgaacatgggtgtgcaaatatggctcccactcttttgacaagactatattaattttcttgctctctgatacaacaaaatgtcccaggctcatcttacgtgctttcttctaataaacgtacaagaaatgagaaaataggaaatcaccattcggtaacccccagtgaaatcacagactcaagaaataatcatcaatgaaacaaacaagttcaatgggaggctgaacccacggatcaacctgagcatccttaacagtgggatatcacatgcctcctgatagttcacaccaccacctctagagagttcttgcttaaaaaaaagttgaacctgaggctaagcaagcctttagaagtaatttccagtccctaggaacagtggctagaggaaaaaagctaaatgctaatgtggaacgggggacattctacaagataaatgaccttttttccttaaaaaaagccaatgttaggaataagaagaaaaatacatacataaaaataagggctgttctaagatttatgtctttagagacaaagcaaccaaaggtgatactgagcctgattcaaacaaatcaactataaaaagacatcttttatataatcaggggacatttaaaaataggctggctattagatgataccatgaaattaattgtttttattttctttgatatgataatggcactgaagttatgtaacaaaatgttttacttttttcttaagagatgtatactatagaacatacgagtgacataaatgtgtgtgatttgtcttaagaaaaaaaagatgatgcaagtttggcaaaaattttcataattattgagttggggtgataaccatatgggggtttattacacattcattctgttttttgcacgtttgaaaattttcatgagaagaactttaatgacataaattcagcacactgacaaagccaataggtgatgatgtcttcagttacctgtagactgatgggtcgctgaggtcaagggtctcactaacatagtctgccagtatgaacgggaacactggatactgcatgagatcattgaaagatcggccggcgtgtttgtttaggtgagtcaaatactcaaaattagtaatttgcccagtataccacaaatgtgtcagagcggtgatattgccatattccagaagattagggaggttatttgttagtatactgtggtatacatcattgcgaacctagaacagaaggagaaaaaaacagcccagattttcagtcttgacactttcctccaaagaatccatgatatcataggcatgttactaatctcaagtccttaaagaaaacactttttgcccaataacactgactggtggggaattaaggttcaactaggtcttcctctaaaggttgtgctatatatatttatttattgaagtacagttgatttactatattatattagcttcaggtgtacaacatagtgattcaatatttttataaattacactccatttaaatgttatgcaatactgactacagtccttgtgctgtacagtatatccttatggctcatttcctacatagtagtttgcactctgtaaccccctctgcctgctctcccccactcacaccactagtttagtcccctcctctttgaatctgtctctgctctgttgcactcatttacttttggctcttaaccactatgttttgcagctggagaaatcagtaagagactaagaagtctgttcagaaaaatcacttacatacagaccctaaaggaaaaaaatcaataaaagaaaatgaagagtcttcatctacatacatgaaacacgctgtagtagaaagagtagggttttctgaattagacagaccaggtcttttttcttgcttaaaccctttgtgctgtagttccca

SEQ ID NO: 57742 - DNA, 1096 bp, Bovine  19866880787421
cccatgaccttgaaagttcagtcattagctgcccatacaatggagccactgctttcaccttgttatttaatataattctttttttttaaatgacatatattacttcaaacaattttttaaaaaatattttaacacgtatttcaacagaattgatttccttgacaatcctatggattttatctcgcacatttaaaaacctaagagggagttttctaggctacaggagactgcccaaggagttcagggcggtggggatagcaaggggacaccctctgtgggtggagacttcaaggactcattctttttctgcaaagccgacaagctccacgtgggtgttgtcccgggcgcagtctgccgggatcagaccagcagagccatttcaggggcaggacaggctccagccgctgttggagctgttcccccgcccctcttctggaatgcacacagctttatatgaaatccacatggtgcgcggcagcgacaggaggcggcacgaaaggactttaccaagttgacagcgtccccgcgcccagccagtccggagaacgctccagagagccaaaggtccctccctgtccctctccccatctggctccccaccccccatggtgacaatggtcggctacaggaaattggatcaccgaggcactctgctttcccagccctgaactctggacacagagcagaatcattgccaagatgtatccggaatccgcacacacaaatgcaggggctgtcgactgcattcccggggccgagagctgggcttggcggtctttttctgccccggcacctacagtaatcccagggcccgcgagacggccgctacccagctctggccttcgtccggcgcctggtcccaagcggaccgggtcctgtcccccaaaagcaggggacaatggctagatgcggacagacttcccggcccactgccgcgggagaggaaactccgcccgggtcccggggtcccgggtcacagagtcccggagcctggcactgcgcgcgcggggcggcgcagacggggcgaactccccagaacccagtgaccctcctcgagcgaccgtgaccaggcggcggggaggcgtcggctggccgg

SEQ ID NO: 57743 - DNA, 1178 bp, Bovine  19866880789703
ctgtatgttcttctagaacattcatggttttatttttttagatctaaattttgattccttgtagtgtatcctggtataaagtgcaaattaagtatccaacctatttttcccccaagtgattacccagttattccagcaccatgcatcttttcctcactagtttgagatgctatgtgtaatcatatctaaaattctaggttctctattccattggtctgttactcctgtacctgtttcacattgttttaattactcagggcctcggttttaatagctattacagtggtcccctcagtctttccccacacccctttaaaataactttttaaagctgttcttatttgttccattaacgcttcaaagaaaaaaaaaatcctttaacatatgaatgatgctaaaactctgaccacctcaagtgtttggagggttgcacttttaaccacaatatgtcactgtcctttttatacttcacttgataaaaaatctactttttactacctgctgtggtaatcacatcagtattctatttgccagtgcccaaacaggtaaggacaaagagacagaacatgcagttgagactcagcttctaagaatgatttcagaatgatcttgctatacaatccttactttcttttttattccattatggattctttgtacaaaagttagatatctgtcaaagattcatgaaaaaacagggaggggcccttaaatgagtattaaacttataaaatctatatgcagtggataaaaatgcaagtgtaaaaagtcaccttaaaaaaccccaataacttgtcagaataacaggatctgagtatttgctcgctcttgtaggagctggacatatagcagtgaacaaaacaaatatccctgccttcaggtaacttaagaattccgtaacctcactgggttatatctagtttatcataagaatacacccagagaaagaatacagttgacccctgaacaacatgggttggaactgcatgagtccacttggaaacacgtgggttttcttcattatatacacaggggctacagcactgcctaatgtgcggttggctgaatctacagatttggaactacagctagagagctgattataaagttatacatggatttgactccctgggcctcagcccccactaaccttcataatgttcagtaatcaactgtat

SEQ ID NO: 57744 - DNA, 1605 bp, Bovine  19866880823203
tccccccgcgagcaccgccccggagacaaagcccgcgcgtgagccgcgccctcggcccgggtaagtgggcgcccgccggcgggtcggtcggggcgtgtcggtggggaacggatggcacagcccttgctcctgtgagctcgggacgagccggagacaaaagggaaactcgggctggaccgtctctgcaactggagagactggtctggtgcctgcgtcgtcctacagctgtcggaggaagctcgcgaaacgcacacctgtgataatcttggccgcgcacggcgagcctggccctcgcggcgccggcacaggtgggtatcagcggcccggcgggggctcctcaaatccgggaccctccgcaaagcccttgggaaacccgagcgcaggtttggacagacaactcggaacgttgaaggggtctcctggggatcgcggtcgccccatttgtccggcttgaagcagaggaagctcctggggagcctgtttccgtaagtaggtcatggcagggacgtcccccattgaagaagtggaagggctagtagtggcggaagagatggagtggctagttggtcattttattgggggaaatttctttgggcccgaagaagccctcttgattcctcgtcaccgggacacctgctttgggagcagttccggcggcgtcagtggaccatgggggccccttatggcgtctgtcctccagtctggtgctgaaatgggctgcgctcgccgcgcgcaaaccagcagcgttggggaggctttgatttactgttttaaattaccttaggaataataacaaaaagatgggatggggcggcgggcagaggtgtgactggagaagacttcgtaatttaaaaataaggaggacttgcttatttctgtgtgtcttgggctaggatgctcagaaatgcaaaaatgttaaagtttcatcaagtgataaagtggatcgtggacacgcgttctcccacgctctccccagctccccgccgacactggttttcttctctttctgtcgcctcccaggactgtaaaaggctggcacggggctggctggttcagtccgagcgaagggcctgctgggctgcgctggtgtttcccattaaaacgtgccagtcttatcatctgctcatgagccctcacgggtggtgcttccttctcatagaaaattcagtggcagacacctcagagaggcagggaagggactcgggctctttggctggcttcttgattctttggggaaatccttttcctgatttttgcatggggtgggggaagggaggcacccagcttctgatctggccctgttccctgcaggaggctactgtgggagcaaccgaggtgataaatggaaagtctgtttcagtcctgagaaacaagacagggtacattgtaaactggcaattatttttgaagtgtgaggttggctcagttatcagctgtgatgagacatggataccgcacgtcgtaactagttcatgtaaatacaaggtttattgtggtgcttccctagttaatgagtagcctcatgttgaggttattgggctgaaatgactatttaggacaaccagcttcctgttttctccatccacacatggctcaaatcctcag

SEQ ID NO: 57745 - DNA, 1210 bp, Bovine  19866880845784
aggaagatggtgacggtccccctgaggtgttttcgtttttatctttccgatgtttaagcggttccgagtgtggcgggagatgggacggggatgaaaacctctgcggctgttctgggatgagagcacgcagagaaaaggggaagccctcctcgcggggaactcaggggatgggtggggggcaggtggggagtagggttgcagacccagcggccctgcagaagccaagtcgatcgcgagggggacaagtctgaacttccttgacttttggactagagagtccctcgcctctctcaggaccgttgtatttttacccagcttgtactccgtctgctgagtggcgtcgccaggtgagctcaagtaccagaggggggcccgtgtctgaccttgtggctccctcagcagtgagtgatggccgataaattagagtttgggggttctttgtgaggcgtagcttacagaagggttctcaatacgctggttctcaatagcttcccagggtcttttgccttaataaaggcttctttttttttatacagtagaatttgaataggcttctgccaggtgctgtctagtctgcacctgctgcagagtggcaaaactactaagagctaaaaaaaacccaaaaaaacaagaaaaggtgtctcatgtggccagatgatgaggggagacatggtttgaagcaattagtgctgatggttaagtcaaattgaaggtaactcttgcctggaaaatcccatgggcagagcagcctgctagtttgcagtccacggggtcgctaagagtcggacacgactgagcgacttcccttttcacttttcactttcatgcattggagaaggaaacgacaacccactccagtgttcttacctggagaatcccagggacgggggagcctggtaggctgccgtctacggggtcgcacagagtcggacatgactgaagcgacttatcagcagcagcagcagcagcacatgctagtaaagtaatgctcaaaattctccaagccaggcttcagcaatacatgaaccgtgaacttccagatgttcgagctggttttagaaaaggcagaggaaccagaaatcaaattgccaacatccgttggatcatcaaaaaagcaagagagttccagaaaaacactatttctgcttcattgactatgccaaagcctttgactgcgtggatcacaataaactgtggaaaattctgaaag

SEQ ID NO: 57746 - DNA, 747 bp, Bovine  19866880859861
ttgcaggaatgctcaggaatgctcttattaggtctgtgttcctctaactggggccgtcctttccccctggaacagtcaccgtgttcgtgggctgagctttattcaccttcaagtagaattaacagattagactaatatggagaaattatatgtaataattatgctataaacaatttaaatctgagtcgtatattctctaaactcagcagtcgggagttattaacccatcactaaccaccctgtgaacaaggaaagccagtctacctaaaccctttgaaaggacaagattatccatattcacaaataaaagagcaaactgtcgatcgacattataaatgtccatttagtgtctgttttcaatacataaacaagaaaaggcaagtttttattctaaaataaagataacatttattatcacaagttgcataaagacacagcttttacaaaaatgtttgatagaaaaatatttttctgaatacatgtgatatctgtaggaacaccacactattgctgtacttccagctaaagcttcagaaaaactatttctcataatcagaatttccaatatttaccacagcccatctttggaaagaagttcatagtgttttctgaacgagccaaagcatgtcctcattcggttatgcccctgggcccagtggtcccctgcatgtgtgtgctgcacacacacacaccacagcgattagactgggagcacgtggggcagtagtctacacacctcactttaca

SEQ ID NO: 57747 - DNA, 771 bp, Bovine  19866880922592
cccaaattatgataacttaaaataggaatactgaatttaaaaacttgttactttgaagcattctacttcatcatcatttactcttatttttcataagaccatatatgaggtttagaaattttgtatttgtcttttctgcctgtcttttcttgcgtagaattaaatctttatacacacacacacacacacacacacacacactaattctctactaaagacattggttccatgtttaaattatagttattgtaccagataagaactaatttgataattatattgaatcaatgttctctatatatttttaagtatcagatgttaacttctttatacagcttgaagaaaattatttttacctaagaagaatagatcatcattttattgttagtttaatttacagtatgactcccccagttcctagcactaaggaaatattttaatgcctcctcttgaaacatttgcttccactgttttcactttgaaaacataacttaaaaatagcagttccgatgtatggcagaaaccaacacaatattgtaaagcaattatcctccaattaagaataaataaattttaaaaatcacagctcctttttacatggcattacttaaagtcacacacacagaatcacacacccataggtacaacgtacaatacttttttaaaaagagttaagtattcatccttgatattgccagaaaaaaattctctctaatggaaatactgcagaaaagaagaaaaaaaaataatgttaactagaatcattctatt

SEQ ID NO: 57748 - DNA, 2243 bp, Bovine  19866880929377
cccttaactgggtaagacctgcttttcctagtgcttggcaaggcaaagatttggattaaaaaacaatggggattcaaactgaacaacagggaagacatgctggtggtcagtctggaggttgctttggaagggtctcggtgtaagcctttgctgccagtctttgtagtcctcatgtcatatccctttccgatgagtttggatgaaagtctcaggtgaacttgaccatatgacaaggccagttcaggatgaagatggagttctgcagaatttattaactcagcagtcacacccacgtgggatatctgaatgacagaccttggctgctagccttgatttctgccagcaggtctaccctactggggactggtatctactggtgggcatgcgcaaacagcaaggctgtactgcatagcacaggaaactatattcaatactttgtgatgaactataatggaaaagaatacaaaaatgaatgtatatatatacacatatgtgtataactgagtcactttgctgtgcagcagaaattaacagaacattgtaaatcaactatatgtcaataaaattgaaaaaagaaaagaggccatcatgactctcagtctaggctatgccacaggcagggtgagggtcttgcagtgtgttccaggattccctaaggacacacgctgtcttaggaggctgagcctggaaaggtccaggactccgctaggatagccagtcagttccttccagcagttcaggtagtgattcgtagttcaagatctgcgcttagaatgtaacagagaagaacttttgtattctattacaaggtaatctctaaagggatgttgcctataagcttaaattatatacaattgcccatctctggccggagaaggcaatggcaacccactccagtgttcttgcctggaaaatcccatggatggaggagcctggtaggctgcagtccatggggtcgcacagagttggacacgactgaagcgacttagcagcagcagcccatctatgggaaccctgcttcccaggtaatgagcattaagataaaatacctttgtttatctcacaagaaacaacttgaccaagcccacctgtgaatgactacagggaggaagaaattaacacattccctccagagacagacaagaaccagaaaatgtttgactttactccctctccttttagtataaaaggagcctgaattctaacccaggcaagatggttctttgggatgagtctaccatcttctccatctgcatttatttctgaataaagttccttgccccaacaactcatctctcaatttatcagcctgtcatggggcgagcagtatgagcttggactcagtaacagaaggatgactttctcagcttcacagccccctcgtgagcccctgctggagtctcctactcagtgggaaggatgaagtggtccctgaagggatgatcaccctttagaagtcctcactgccctgaggctgttctgatgtaaaatgcactgtcccctcagattcctgttgtgatggctattttcttatttgagtttttggacaaatgacttcattgttctccaacctgtgactttcagtaaagcacccagtcttttattcggatcattaaaatcaaaatgaaaaatttagttttcatttaaaaatttaaatgaaatttcattgaatatggaaaagtattcatatttacttttgtaaaagttcagcacagttgtgagactgtagtcctgacttgcttcccccactgtactccccccatacataaccctgcctgaataccaccctggtgctccagtaatagaatctgtgccaggtcatgtctccagggctggagcttatggccaccccatcacatggtgtggcaactcatgcttcttaatcagagcatcagatgacttagtgcagtcgtgctcttattttgacaaagcttctctgcagccacgcctgctcttagatcgcgggcctttccttggcaccacttcaacaactcaactaatttcctgtgccaagggccctttctccaagatttcttctcacatgagtcaccccattagagcccagattgacttcagggcattcactggaggggaggggccattccattggtttggctgctgtgaacaaagagctgtggaattggagacagagtgaagactaggtttgacttctgcttttgccccttggtagctgtgtgactttaaaaaattacttaacttctctgggctccccatttctacat

SEQ ID NO: 57749 - DNA, 740 bp, Bovine  19866881120252
tggtatctagcttaaataggtattcagaagatgaaggatgcttttgtgaacatccattatgcccaagaaaccgggagaatttctgtgagtgacaagtaaattgtctccatctctaatgagaaaatgcaggatcacatgtcttctagctttggggttttggggcaattagtcaatgtcatggttcaccttttctgtttttattttaatgttgttttgcccagaacccagcacatgtttgctgaaggaagagtgttggctgattttcagaagtcaagtggggcaggagcaggtgggaagaagccatcgcctgtatttccacacctcaatggggcacagcagaagtgcaccctgggtctgtctctaccattttaagagctgtgtactttggcatctgtttcttctcacctcggtggccagaatggcttttctcctctaaggctctcacctggtccagtggagggatgagaagatgggcagcaaatccagttgttctgggcggcctcatggtaatggagtcactacattctgtctggcctcatacaggtcattcctctttcaattctgtgtctataaaatgcatgactcacctctcagatgccaagaaactcaaagactttgtgttcctgtcattaaagggtacaatttaaatttttaaaagctgctgtaggcatacgtaccagactatcattagacgaaagctcatgtcaaggccaaagccagacttgattttatttcaaagc

SEQ ID NO: 57750 - DNA, 1443 bp, Bovine  19866881229395
acatttatgttcacggcagcataattcacaatagccaaaatgtggaagcaacctaagtgtccatgacagatgaacagataaagaaaatgtggaaaacacatacaatggaatagtgtaagaaagaaaacagtcttgtcatatgttataacacagattatccttgaggacacaatgctaagtcaaataagccaatcacaaaaaggcaaactctgaatgatttcacttgtattaaatatctaatacaatcaaaccaaagaaacagaatgtagaatggtggctgccagggactcgggggaagggaaatggggagctgttgtccactgggtagtcaaaccaaatgaaaaagttctagagatctgccatatgacaaagtgtatatggttagtactgtacatgtaaaaattgctaagagggtaaattcataacaaacgctttttagccacataaagtacatgcctctgctttattccatatcttccagtctagcaatagttcctctaacagtttaacatcctggattatagcattagactctacatccaacttaagttctccattctcattgatatgaatgatatcttcaccacagcaaccttcaagaagggtctacagaaaaacagcattaatacaagatgcatcaataatcaatccaaaaattcaacagaaatattaagctttcaatcttagcagtcataacattaaattcaaaagaaaactactgaataactcagcaattcacaaggtatctttaccttgttttgtaaaacaattgaagtaataagaaaacccccaaatttcaaatatttataaatgactatttagtttcaaatatggagtaaaataaactataccctatatttaaaattcaatgaatctgttgaattttaaactttttctaagaagtattcatgccacaagtgtatggatcttgctcactttaagagttggagtctgggggcatgggaacaggcattggtcttttgccttaatactagaaccctcgggaagaaatactttcacaacgttaccaagtgcttttaattggaaaggtatttaaaaatgtgattacagctgaatcacagtaaaaagctaatacggctttaagataataactctacagcagcactgcctcttgagaacggcacagcactaggtgtctggagaactgggttcgcccccatacctgtggggtctgaagcaagcagcagtctatatgagtcactatcaccagtctacagaaggaggggccagcccaggaggtatcactggcttatcaagatctaaaaatcttaattttttcttatattcttctaaaatgttttaaaggaaatgaaaatgtaattatttaaatgacgaaaaacccagaagagccttcgtttgattaaacacatactatcaagtttccttaattttcttcagaaataactgaaacacgaaactcta

SEQ ID NO: 57751 - DNA, 1698 bp, Bovine  19866881259284
ctgtgtagcccagcagaatttggagtatgggaatgatgcctgtggtctggaatccactgaattgaatccactgaatgcctccaattaatggcagctttagtgtgctgatttagtgtgaaggttagctgatcatgctgcatttgcttcagagtgaaatttacgaatggtgttcactggaacgcatgaaaggatgaagaacagaaactaggcttacgggaacagcttgtacgattgttcagccagcttgctgatatctttgtctgtgtgacagaattcagtctgagacttgtttcccttgtaacataccactgtgtaggggacatagttcctactcacctctgatcttcagagtttcccagtatttccccagagagcccaccagtcttgaatggctgaattggctcaggccggtttagagcagcatgatcccgtgtgtgtgtgagcagagccctgccagacaacacatagagatggggcgaccccatttctctagcagaagcctccaactctgtagtctttatgcagcccagcttcagcttcctaagcaaattgaacagtaataaaacatggagccatcttctccaactgctaaagccatacgtgcatgaatgcttagtcgctctagacgtgtccaactctttgaaaccttatggactgtagcccaccaggctcctctgtccaagggagtctccaggcaggaatactggagtgggttgccatgcccgccttgctgaagccataaccttgggctaatccttctttggctggctgcttcatctcccaaggcacaaccagccatgctttatggattgatgtgttgctgtcctggaaacccttcttatgtcctcgcccacgaagacatgttcatgtgtacctggttttgccctatggttagccctcagcgtggcagatttgccccatggaatctacacgtgggtctgttcccagtcctgctactttttgttctgagtcacgagaataagcctcgtagtattaatgcattgagacaccaggctgttggtatgaaattgcattaagcagatcacttcacatattattttgacctggaaagtgcctcagaagagaagaatgaggatgagcctttgtcattcagcgtgtgtcgcattgatataatgatagatgacatccagaacaaggatggggttggttggatactgcaaggtgactgttcagggtaatttggagaagatttccagttgaatcagagctctggtgcctggtaggacggcttccctgtatttctcagttgggaggctgtaagagagagttttggacaatctctcattgagtaattttgagtgcactcaaggcatttaacaaatctgtcctgagacgagtctcctcccagagcctggcatttatgaggaggacacactggagaaactattatttgttggagtttttgaaaatatgtgaaaagtagccactcagaaaaaaagtcaaaacggaagcagtgattacaagaataattcaggatcttcctgttgggttagggaatggtttatttgagaggaaatctcttcctagagaaaatgttgtccagatattgaccagtaagaacagtaatgaacttccaggtgcttcagtggtaaggaacccgcctgccaatgcaggagacagaagagacgcagagtcaggaagatcccctggagtaggaaatggcaacccactccagtt

SEQ ID NO: 57752 - DNA, 689 bp, Bovine  19866881263015
cctggtgggctgccgtctatggggttgcacagagtcggacacgactgaagcaacttagcagcagactagatcagaaactgtgtctgaaaagattataaggttaggtaccaatgcccaataatttaaagtcagtcttcaattaaaaacaaatagcaacaaaaacacatattaatagttttatacaacatttttatttttctaatcttttatgtaatatttattttatagctcggtcatgagcactgacagtaactcattggcacgtgagtttctgactgatgtcaaccggctttgcaatgcagtggtccagagagtggaggccagggaggaagaagaggaggaaacccacatggcaaccctcggacaataccttgtccatggccgaggatttctgttacttacgaagctaaattctatcattgatcaggtaacattttcatatcaaatcattttttttaatcagtaaattttaattatagataagtaatttctaggttgcataatttctgatagtctttttgagataaagtcctgtctctcacatcactcagacaaggaaaagtaactccatttatgaacatactgtttatttgaatactttccaaaatgtctaaaatatcttacagttataaacaaccttttttctaaaatgctttcatatacactagctttttaattttaatatcagt

SEQ ID NO: 57753 - DNA, 1000 bp, Bovine  19866881310244
ggggaaaataggtattgccgagaaataatatatgcaagaaatccagctgttattactttcatacaagtgttaagagtacaaagaaggggtatcagtgattgcaaataacaccccagaagtctttactaggctctaagtaactgattttcaagccaggggttaccacagtataagctgactgcaatggaagcctttagcacccaccaaacctaatcaggagttcaagattgcaatggtttcctgactataaatacaaccaaagggttttactggggtcaccttggactcttcccctctgctgattatggaggtgaaggtcatttagtatggctggaagtggtaacaggaaggggaagagccaaggatgaagctaccctgccccagggacttggtatgaaaccagccctgcaacactgtgttctttcatcaatagcgaagcagtcccaaccctcagccccctccgtatcagctttcactaaactcctacgatgatcatgactatgaatgatggaaacatccaagcccccctgaaggactcccaccagagaaagcttattaagagttagaaacaattgtttctaattctaaacaaggtctttattattccaacccaaagcaaagatttataaagtataacaaactggttccaaatggggaaaggacaacatcaaggatgtatattgtcaccctgtttatttaaacttatatatgcagagaacatcatgagaaatgccgggctggatgaagcacaggctggaatcaagattgccaggagaaatagcaataacctgagatatgcagatgacaccacccttatggcagaaagcgaagaagaactaaagagcctcttaatgaaagaagagagtgaaaatgctggtttaaaactcaacattcagaaaacaaagatcatggcatctggtcccatcacttcatggcaagtagatgggggaaacaatggaaacagtgacagactttattttgtggggctccaaaatccctg

SEQ ID NO: 57754 - DNA, 714 bp, Bovine  19866881399839
tagctttcttgccttaggagaactgaccataaagttacttttagatcttacattcttgtcttctgtgttttcagaatgtctgtgctgttgattctccagaagagaaggcaggataaggcaagactgctgatctatttttttcatgtagaatagtaaattgattgaatgggatatattcttcctcttccatttctccttcttctctccctgaaactaaagaagtgaccagtaaacagaatgcatgtttggaacaattatagaattcaagtgacataatcaatcacttatatatacaagacaaaaggcacagtgttatatatgtaatagcaataaaatagaaggaaaacaatgagacagcagttcttctaaagactgagatctttttcagggctactggtttatatagatctatatttctctattctagagcattcagagacagcctggaaaagacaaagaactttagtatggaataaagtgacatttctaatgagagggggaaagatgagtataatgtatggtattgaaacaagagactgtccctttggaggaaaatgtctttccctgttttctttccctttaaatggtgtctttcagcctagtcctcaggcgtctggctaggaagcccagaaacacaggtggcacttggagtacatagtgttggcactcacccattcaccatcttgtactcctccttgtgaaccagtctcctgt

SEQ ID NO: 57755 - DNA, 1496 bp, Bovine  19866881420489
ggctgaagtccttaattagatataaccaggatttcagttgctttctaacaacttttacatccttcttcaaacactgcatatataattccagtagcatttgaaaacaacagattacatgtccctcaagtgaaacaaagcaattcagggaagaatatttttccgcaaatggcaaatttctctatataaattctccatgccccaatcacctccatatttgtgatggacactctgaaagcagggaggcctttgcatgcccattcatttggctacttggtggttcactcaggacttttgtttattttaaatctgtatgtcatcaagggaaagaaactaaactacagatctgaagtttttcagctctgtctcaggtaaaactcatgagtctggatcactggaatctgagaaataattttagtataaaccagctcagcaaagatccaggctgtccacaaacacgccacagagttataaaactttcagatcaaagacagttctatttaaacaatgtcagaatgtcaggattttttttaatggttgtgaaaataatgatcacagatatgttatactttactgtaagtttttaaaatggtatacgcattaatttcaaaggccaactacctatcagaagcaagcttcatttacaaaattattttttaagtatgaaagttgacaatcacaaaatctgcaaaactcactggtgggattcaaagtatcttaattttcttcattttgcttacctatattttctagtttttctacatacaggtaataaatgtaaatatggtattcaaaaaataataatttcattaatttcactgttttgataattatcatgcacatacacactttatgtactatatatatattttacatagctctaaataaatgggtgactttttattttttgtatgctacttataaaatattataagcattttctcatgtcccaatagatcctagctaacattatttttggctaataatattacatccagtaaatataattaatttaactttgcccctgctgttggggtatctgcgttttatccatttttttctcagatatagatttaaaactttacttttttttcagagaaattaaaatcaatggctctgtcctcttctctataaacaccccagtaaaacaaacaaataaataaatgttaaaaaaaaatccgacatgggatgggaaatttttttgttgttaaactaaaattaaatcctaggaaaaaataaataataaagatattcaaacatctttgaacatgatttttcaacaatgagaaaaagtatctacacacatatataacaaaccttgatttaagcagggtaggcagagtttttaaataaatctgaagtacttcctggggcaaacactggttatgatggctacatacatgagtctgagctgaagaaatgctaagctgctgacaatgatgtgctaattcaactcctctttgcagcacaggattaaatatgcagttatacagtttcca

SEQ ID NO: 57756 - DNA, 663 bp, Bovine  19866881485729
atgagtgtaaaataaaacagtggtgagaatgggttcctcaattattataactatgtactttatttgaaaggcaagaagaacattagttcataaaatgcattcattgttacgttttctgaatattcgttcattgaagtgcaaaaatcagtgtatcctggccaatggtaagaggaaattttgctggtgtgacttgtagggcagctgtttatatttgtcagctcactcttacactactttttgatatttacttatctgaacctttaatacactatgacttttcttttagtctattaaagattaaaatcctttgccattttctggatttcctattaacgatgattccaaagacagtaatgctgataactgttcctgcttttctctgttagctttatttaaaaattttggagtctatttctaaagtcatacattccatattactgaaatgtatttattttctctacatcttattttttttttaatagaatctctggttttgacaaaacctaatgatgcgcagtttaaagaaacatttagaatgtgtaattttaatcttaatcttgatgcttacagttactatatgactattcagttcagttcagttgctcagtcgtgtccagttctttgcgaccccatgaattgcagcacgccaggcctccctgtccg

SEQ ID NO: 57757 - DNA, 788 bp, Bovine  19866881717554
tcatgccagagatattacacttgattgttaagtgtacactatatattatttagacattaactttgccaacaagttaaacatgcgtaattttattttttaacaatttgcactcatacaaatatcactgtatttggctttatgatattttaaactgtgaatagtcaacaaatggatttggaaactattacattttaggtgatatttaaattcacatgctgaatcacatcatgtcgtttcccaaaagcataagatgaacatatgcaatgatgaaaatagcaaagcacattttaatgtaacattttaaattagtcaggagacagctgttacctgaccaaaagagaaaaatgaacagatgctctgcaagtaaaaggcctgaagagttggcaaataaagaggaatggtaaacgactagaatattttcatatgtgcatcttaaaggtaataatcttgatagaactctaaaaatatttcagtttagtattcggtgatattttaaaatcatcttgaaaaactatcagaaatgttttattttttcattctgaatgtccaaagaaacatgattttcctagacactgaagctgtttctaatagctcattttaacatcttctgatcaatcatttattgactgtagtttctgggactagaaaagttgtttttggagacatgcacacatagaaatcttatttcctgctctcaggaaactgatttaaggaattgaatttaaacacaaattcttagaaaataacaaaatgtgtaaaaataaaattttcaatgaagtttcttccag

SEQ ID NO: 57758 - DNA, 1720 bp, Bovine  19866880362865
catgttattgagctaactacttacatccactatcaaatcttcagccttcagttcagctttctagctctacatcactgggtttagcactggcgacctcatttggaaggtgttcatagttttcctggaaaagacaaggctcctcatgttagaactccagttcttcatcctacagtgtttgtgccaccaagagggttcttctctaaaaatggcactttaccaagacacatagatagagatttccccaacaaatatatacccatgctaccttttaatcaaatcacaatagtgtgattttcataacagaatttcacattgaaaaaaatgaggcattaacctattagtagaacaagaagaagtaaagtgtgacctaaggcagtattgtgaggcagggtgtggttatcagcatagcttgtgttacaggttttttgacaaagataagacccttcaacaagcaggagagagaactaatgactgaactaaggcaggcaggcaagcactgtctgggacaaagtgataaaccgtgaaagaaggaagtagttaaaaagcaggtccttagagtctcaaagaagctcctgcagaggccttattttgaggccccttttccattacattcattttctggtctttggatctaggtaaaacgaggccccctctcacttccgagttgagaaagtaaaggtttggagtaaatgagacttgactttgaatcctagcttactaagtgtgcttctgtaggcaagttatttaatctttcccaagcttcagtttgtctgcaagatacgtctcaagagattgatgtgaagattaaatgagaacgtattaattataaaggacttagaatacagctgtggtattgtgatgggtatggtttcctcttgtggggacagaggacctttcaacttacctttttaattctttgtatcatgggctgagtctcacccacaaacttgtatagattacgggattcaattttctttaaaatcattcgtgcatcattcaggttgggatcagtggagtataagatctccagaaaaatgttatctgccaatttgatgaaatttcagttatattagaatgaaaaaaaaacaaaaaaaaccaatatttaaagagactcatattgctgtacttctgaaatgatttcaagcagaggtttacatacatagacacactatgattataaagatgtgaaaaaacttttgtaaaaagtgctccaatcagtgtcttggatttgtttcaggataacctaatgagtgggaaaggggagagatgagataagactgcactggagatgatgacttgagactgagtttgggggtacaaaagggtatattagtttattgcttttttaaaaaaaagagaatgaaacttgaggaataacaaaattatgtctgagatctgcttcaaaatggctcagggtctgatggggtgaagggatgaaataaaactgcaatgctaattattgcagctaactcatgaaactaagtgatgtaaatttccttaataaaaagtttttaagggagttccctgaaggtacagtagttaggactcagtaatttcattgctggggcttgggttcgatccctggtaggggaactaagatcctgcaaagaaaggcacagtcaaaaaaaagaaaaagcttttaaaggtttcattccatgatgatagaaggtagcttaatttccttcttcctttttcttcaaactttttatttcagaaattt

SEQ ID NO: 57759 - DNA, 2312 bp, Bovine  19866880476791
acttaacaagaaaggtagtgccagtggctccccgaccctgggtcctgcacatttctacctcacgttctaggtcttgctgcatctgagctatgggcagggagatccagggccccaggattccaagcagatacctgactgtggctactgccctatcatatcccctagagctgcagcaatccagagcagcagggctggaaggaggaggcggtggcggagggaagagagggatggggtgacgcccagctcagctcaccagacaccccacgttgagccctagagcaaagcctgttcttctcattggtgtttcctccccatgaatagggatgtggttggccaggaacatctctgtgagcccttttccctgaggcgcatggctggaagtagatcctttcctcggctcttctgagaagtgggtgtgggtggaaccaggcaaggctctcccaacttacgacccaggaatcagctctcaaaggatctctctggagacgcttctgaaacccagttttggtctttctcccactcactgccttcccctgggaagtcagagatcaccacccagcagtcagcaggagaccccgctttacctggctgggaaagcgcttccatggcagagatgcagccctccagggcgagagatgcagggagcttgcgggccccaagcatcttctcctctccactggttccctttggctgtccagagacgggggctggtcgacatgaggagctctgctactctatcactcgctgggcggggctgcccgctcctccccaccccagccagactctgaagggtggagcctgcacttggatggagagtggcggatggcagagcgggatggccgggcgaagcaggaggcgagagactgggtgctgcagtcacacactgcatcctgtggggggagagagagaagtcaggaggagcctggaggcactgactgaccgcccaccccgggactgggtggccagccaggcaaggaatctggactcagctgtgccccaggaccagttcctaggagctgtagcccctctctgaaccaattttaaaaacgtattttcttccattagagcagtaatgaacgctcataaataaaacagtaatgagtgttcataaataacatttcagggacttccctggtggtccagtggttaagaatccaccttccaatgcaggggactcgggttcgacccctggccgaggaactaagatcctatatgccatggggcaactaagctgatgcactgcagctagagagacgcctgcacactgcaactagcaaaagcctgtgtgccgcaaaaaagacccagtacagacaaaaaagcaaaacaaaaaaacccaaacattccagaatataataaactctggaatatacataaataaattctggaacatacctttaccaaaatgatctcaactcctatagtttactttgtaatcgcaaagacatgaatacttttttgtcattatgtatgtccagatctctttctttttaatggccacacagtatcccactgagtggaaatagcttaatttattcatccaactcattttttatgtgttttaagtagtttctaattttttttactactaccaacacacagggataatggttaaaagtgctgctatacattatttacaattgccaagatatggaaacctaagtgtccatcaatagatgaatggatagaatgctactcaactattaaaaaaaaaaagtaattttgccatttgcattaccgtggatagactcggagggcatcacactaggtaaagttaagttagacaggggaagacaaatactgaatgacatcacttatatgtggaatctaaaaaatacaacaaacttgtgaatataacaaaaaagcatcagacccacagatatagggaacaaactcatggttaccaatggtgagagggaaggaagaagaggcaatatagaggtaggggattaagaggtacaaattattaggaataaaaataagctgctgctgctgctaagtcgcttcagtcgtgtccgactctgtgcgaccccatagacggcagccaaccaggctcccctgtccccgggattctccaggcaagaacactggagtgggttgccatttccttctccaatgcatgaaagtgaaaaatgaaagtgaagtcgctcagtcgtgtccgactcttcgagatcccatggactgcagcccaccaggctcctctgcccgtgggattttccaggcaagagtactggagtggggtgccattgccttctctgaaaaataagctactaggatatattttacagcacagggaatatagtcaatattaataa

SEQ ID NO: 57760 - DNA, 1498 bp, Bovine  19866880562961
cagggaagactcagggggaaaaaacttggccttaaggcataagaaagacttgaagagggttttgaatactcaacaggtacagttgggaggggggagttcctccagaaggactagggaaactaagctgggctggtaagacagaaagggggaaaagaatctctctccatatgggctactggcaagtcccttcccctctgatacgtggttcccactcatgggaaagtgaggaggctgggagagttccttccagactgatatcctacgatatgcctttactttgtctcatttaatattaaaggaggcaaggagggtccccagcttagcacatggccacagggctccacatctgtgcagactgtaatcaaatatttggaggtggcagaaaattcaggccaggatcttaggtacggccacccttgggcgacttccatccccctggggagaagcagatggccttctgtagagatgccctccctcaccttcttgttaataattaagtcattaccaaagacctcctttgtcactcttgaagttcagtttgtggagacttgctgtcttggcttgctttatcatgacgctccaggttgaaggctcacaggctacaacaatttaggtgttaagcctcatgcccaaattccagggctctgcagtggaaagagcccagggtggggggaaggagcactggggtggatccttgctagaccctgaaggttcggtggactctgggaggtcagaagctaagtctctagatggctctcctggtcactgtatccccaggcccagctcatcacctggcacacagcaggcacttaataaatatttgttgaagaagtgaacaacagctcagtcagtaaatcccagagtgaccttggtcaagtcactttctggaaaatgaggatgacaagaacagtagtgatctcctagggctggataagaatctgagataaggtgggtaagttctctgcaaatcaaaaacgggctacacaaacattaaggatccaaaactatgtgatgtgaacaaaataaaaagaatgaatatacctgagaatgatcacatttaccacaaagcacctggcaagtggtaaagcactgaccaaatgaatgactacaatcgaaagggacagcacaggggcgctctagttcactcctccaatgtctgcataatttctcaggcttctcaggctcagtctgttccaaaggagcacaaaaacccctcatcgaaactcttaccctgctttctgatatgaaaattgtgggagcagttacaattgtaccctgtaaaccccaaggctcagagagtacatgccaatgtattccctggtggctcagtgggaaagaattagcctgtaatacaggagccgtgggttcgacttggggggttggggaagatcccctggaggaggaaatggcaaacaactccagtgttcttgcctgaagaatcccatgggcagaggagcctggtgggctgcaacccatggggttgcaagagtcggataag

SEQ ID NO: 57761 - DNA, 1830 bp, Bovine  19866880641395
cagagcactgatatactggggagtgggggtggaatggggtagaaggctttgtttgagaatgacaccatctgaggagggcctactgccaatctacttctataaagcttggctggagcagggggaatgctcatgaatagtgatgggctaggagcacttcccagggagagagaggcatgagatggagtgtgggaagtgggtaggaacagcacgggcacatcaaagaagagctaccagatgttaggaagtgagacaatgcctggtatcttagactgctcaggctgcgtgaatggcttttacaacaaaaatttatcttctcacagttctggagcctggaagtccaagatcaaggttccagcagggttttgttttaggtgagagctcccttcttggcttgcagacggctgccatccatgtttcctcatctgtccaggggtggaggtagagggtgtatctctctctccctctccctcactcttcttataaggccatcaattctatcagattagggctctaccacatgacctcatttaaccttagtcacctccttaaagcccttatctccagtatagtcacataggaggctagtgcttcaacatatgaattttaggggagcagacataattctgttcatagcattcgggcacacatcagacacagccagggaatcactatagcctcagagatgaggacccaaacattaatccaacgcttttctgtggttacagttgccaaatctttcttttccagctgccttctctatgagacatccaggcaattaactcctggagttcttcatgtagctgcctcaggcatcctgtggacttccaaggtcaggaaacactcctcttcttacctgggccccaatcctcaaatgtctgagatccatcaggtcataggcttccaacgctggctagtcagaatcactttaggcatggttctcaatttttggatgcttttgtaaacgttcaccccagatcaattcaatcataatctctggaggtaagacctaggcatcagttatttttaaatctccccaagtaattgcaataagcagcgaaggctgaggaccactgatcatagagaggtgtgcgtgccctgtccccatcccctccgattccaatttagttgttctagagtggggacccaggaatctatatttttaaacaagttcctagctgactttggtgaccactcaggtttaggatatgtttctagttcctgaagctaaactgcctacccgcacctgccttgtaactattcatttctgtggctgtatgtaagcattacagatgtagattctacttccttcctcctcttcatggcccatcatttgggtacagcccttcatatgcaccaaaattcagtgcttaacagagagttttctgaaaacatgaagggaagcaacaaaagaaacaaaaaagggtttaaaaagtgtgcagcttgccaagggggagagcaagagatctggtgaaagataaaggaaggggtgggaataggggtagagatgaggtcacagggacaagaatggggttgaagggtttcaatagcaaattagtgaacacagtaagtcaatagccctagaagctgtaggtgaagggccctgccttgggcaaaaaaagattaacaaggcaacaggcatcttctggtatagcccccgttggcatcctgaccctacccaactttaccctttccatcaatacttccccaggaaaggatgccatgagctcatccacaccaagctagaagagtaatttaataggggacaatgacaatacatcaaaagaacagggcctaaaagaaggaatttcacacacttactgaatggagagg

SEQ ID NO: 57762 - DNA, 1583 bp, Bovine  19866880864919
gcaggaacacacatttaggtaatttcactcaggtgggtaagtctccagagaaatttggaaggggtttacaagacaaaaaaaatgatgaggaatatgctcaggaatataatttggatcatatatttaaaaatttgcttcctccttgcctcagtggtaaagaatctgcctgacaatgcatgagatacaggtttgatccctaggtcgagtagataccctggagaaggaaatggcaccccactccagtattcttgcctgggaaatcccatggacagaggagcctggtggactatagtccacggggttgcaaagagtcagacatgactcagcaactaagcaacaactacaacaaacattaaaggatttacgtggactggtgttcagttcagttcattctctgagtcatgtcgaactctttgtgactccgtggactgcagcatgccaggcttccctgtctatcaccatgtcctgaagcttgctcaaactcatgtccatcgactcagtgatgccatccaaccatctcatctgttgtccccttctcctcctcctatagtagtacagtaccagcatcagggtctcatgagttgactcttcgtatcgggtggacaaagtattggagtttcagcttcagcatcagtccttccaatgaatattcaggactgatttcctttagaatggactggttggatctcctttgcagtccaagggactctcaagagtcttctccaacaccacagttcaaaagcatcaattctttggtgcttagctttctgtatggtccaactctcatatccatacataactactggaaaaaccatagctttgactagatgaacctttgttggcaaagtaacgtctctgctttttaatatgctgtctaggttggtcatagcttttttcctaaggagcaaaagtctttaaataaatcattatttccttttaatttttctttaaaatttttagtgtatgttttcttattgcaaaggaaatacatgttcattgtgtggaaaatttagacaatacatgtatgtaagcactagaagacggagaaagcgatggcacctcactccagtactcttgcctggaaaatccaatggacagtggagcctggaaggctgcagtccatggggtcgctgagggtcggacactactgagcgacttcactttcacttttcactttcatgcattggagaaggaaatggcaacccactccagtgttcttgcctggagaatcccagggacaggggagcctggtgggctgccgtctatggggtcacacagagttggacacgactgaagcaacttagcagcaagcacctagaagaaaatcaaagtcacttaaaatcctcctgtcagagaaaaccaccgttaacttttttggtctatttccattcattcatttacactggtatgtttctgttttttgtccagatggaaccataatatacatattatctaatcattgcttattttatttagtaatattgcatcatcatttatctaagtcatttaaacattttcctacaatatttttcctggccaaatatatgattctacaatatggataaactctacttaactaattt

SEQ ID NO: 57763 - DNA, 1151 bp, Bovine  19866880865342
aatttcccttagtgttttttagtctttttttccttaaaacacacaaatctacttgtaaggtataagataaataggaggattttacagcaaatatcctatctccaaaaaacagagttcctaggaattccctggtgatccagtggctgggactctggcgctttcactgccaagggcccaggttccatccctggttggggaactaggatccccaggatcactcagcgcagccagaaaaaaaacacagagctccaagaattttcactcctgaatttaagcattagaatataagaaacattcttactagtttataaatagatcttaatattttaaaaaatcttttaaaccaagaaaacaagaaagcttgttggttatctaagtgtaatagaattaggatccttccaaaggcactaggtttagtattaacaggatatcatattttagcatttctagcatttctttcccttttctactaatttgggaattaagtgaaggaaaaaagagtagaaccttctcacttacctaacattcgcattcaaatatctgtttataattttcgggttaatacacttgctttgcttataaatagatttatctcctgttctataactttcagtgggttttcttctcttccagtggctctataaagggcgtcctaaagaaaaaagcttcctttatgagatagtggccaataaaagaaatggcattgatgtggacaaatgggattattttgccaggtatgcactgaacacttcagaaaaattgattagaaatcttgtatactttaaatagatacaatttttatttaagtaaataagcaagcaaaataaaaccgttatataaatttagtattgatatttaaggtatggtttcctttgctgaaaaatttcatctctctgcttgggaatctctccagggactgccatcatcttggaatccaaaatagctttgattacaagcgctttcttaagtttgcccgtgtctgtgaagtagataatatgaagcatattttgtactagagaaaaggtaagctatgtcagaggacaataaggaaggtgtgattcttagcttgaagtctagaaataccctttcagtaaattggaaaaatcactacctggtaaattatctatctctttacttcgtgcttagcattt

SEQ ID NO: 57764 - DNA, 900 bp, Bovine  19866880880239
tatttgcagagtacttgggaaaaaatcttttaaattaattatttatatagaaagcctatgcaaccgtctactgcctcccaaacagccctttgaatatttattgttataagtactatgaagatttatagtaaaaattgtgactactctgataacactggggcagtcagccacataaggcaaaagaaggtaaaactgaaacttactgtatttgcgctagtcactcagtcgtgtccaactctttacaaccccatgaactctaaccctccagactcctctgttcatgggattctcccggcaagtatactggagtgggttgccagttccctctcctacatgtatttagggacagactaaaaacctataagcctgaggctcccttagggcaacatgcaaataaaaattgccctgtacacttaagcgacatataccaattccactcttggggataaacagccttcttgacttaggacctttttctgcaaattttcagacacaagaggtggactagagacctctgagtggtcagtgatgaccagaagttgaatctaaagagaaggccagcgaaaagaaattgaagggcagaatgaaggaacagaagggcagcaggaaaacatcactctttgagtaatacaaaggaactgtggaaattcactgattctttcccagggcctactgtgagccaagcacttggggctgcaaagatgctccctgacctcaacgggctaatagtcctaagagtaagactgaagcctctaccctacctatctacctaacacacacacacacaagcgcgcatgcacgcatgtatgtgtgtgtatataattctaattgggaaaatcaagcaaggaaggtttcacagaaaaggtggtaagttaatggtgctttaagaacgcaggagaa

SEQ ID NO: 57765 - DNA, 3115 bp, Bovine  19866880911715
tgatacagtgaagatcctgtgcattgcaactgaaacctgatgcagccaagtcaataaataaatgaatttaacaacaacaacaaaaatctttaaaaaaatgaaagagcttcggggaaccactgaagtggaaggacactactgctttggcattttagaagtatcattccagttgcagtttgcagcctggattgcaggggtcttagagtgaacatagagagaccagggaggaggctggtatgattttccaggtgagcggtggaagtgacatagacagaggatacagagaggggatggcatccaaaaatataactgaggtggagtccctgggactgtcacagttggggttcctcagaagcatgaccaagataaggattcaggtgcaagtactttattggggaataggcggcacagtgtgggagcggggaggtaaggcagggaagggaggtggccaatgaagggagtgttatcaagcaagtgaccacccaactggagctcactgaggactgtagagcccactcctctgtagttccagccaaggggaaagagccagggtatttatacaccaaccacacagtcgtagctgagagctgcagccagaagatgcggtggggagggggttgttaattctcccgcagttcctgccagccacatgtgagcagagcgcactccagctgctagagaaagcccccgctccctccagcagggatgcaggtgctgacagttggaagtcagtctgttgggcatcacagcgagatacaggtggggtacccatagccactgccgtagtgaccaattggacatgagttcagtaacaggctcttattgaaagacacagaaacgcaactcagacttaagcaaaaaggctcttaacgctcatatctaagatgtcaggcaagatcttgacaaagaactgcaggttgacactcagatagcagcctgaggatgcctctttcccaagagttcagccataatcccagggctgactctcactggctaataaggatcctgtttctatctcagagccaatcagtactcggggatgcaggactccgattggccaggcctggatcacgtgtctacccctgcagctctggaataaggctgattccacctagaccacaggaaggaagtctgaatcattttttaggcacagtgggaactgtcattaggggaaagataagaaaagtcgggagagaagtgctcagggctgagaggacgagtgtagtgtgcacttctggggcaggactgcagctgtcttctgctcctggtgaccagcccactccacctctggtatttagagggagtcagacccctgctgagccagcgagcaagcggactatgtttgcaaactcttctgcattttcagtatcattggctttacttgagtgggcaccaaggacagattcctacacacacagttctccagctggagagccgaggaggctggcccctgagcccaaggacactgcagccctgaggagctgtaaggaagcttggccaggagcaagagggatccgggggtggttttgtgcccagagggagctgctgctggctggagtggaggaggatacttgattttctgggacactgatggggtggctgaagtctgagttacttacttcactttggctagaattgcttctcccagcctcagtttccccatctgtaaaatggagacaatggtcctccacctcatgtggctgctgtaatgaagataaagacgcacatcagcagaattcctctccaggctggggataaaggctctgacaagtcacctggtagaagcagagatgcttccgggagtgctgttcagtcacagcgaccatcattaaaatgctctggacttcagaagtggggtccctcaggcttctagaggcaaggagaggttctggcaaagaatggggagaattccacctggtggactctgagcaagtctcaggctgaggaaggcttgaggcaccgttggtcatgaaaatagccaggtccaaggatggcaggcctgcttccagggccagcacggatcttcccatggtggtctacactgccagtgggaccagccctagggatgaggggtggctgtttgaggggcatgtggagtgagcttgcatgtatggggctccttgtggtgaggaacagttatgccgccatggaatctggaggagaccctggtggctcagtgctaaagaatgcctgcaatgcaggagacctgggttcagtccctgggtagggaagatcccatggagaagggaatggctacccactccagtattcttgcctggagaattccatgaacagaggagcctgatgggctacagtccatggggtcacaaagagttggacacgaatgagtgactaacacacacaagaagtctgagtttgaacctgggtttccagtttattgtgaaaatatattcatcaaggtaggaaagtagaacatattttaacagtttgctagcctgagctgtcacttttatttacatacatggtgagtgggtctccattctactcttttatttttaatgctatcatttgtatttggaatttaaaaaatgatatgaatgaactttaaaaaattccttgtgtttccatataaattttagaataagcttgtcaatgaagaatatatataaattttttttttggctgtgttgggttttcattgtccattttactcttgatctcaacgcacaatgctaagggcaggccaggagtcttcagaaatcttcccaaccttgagatctgtggggcgtctgggctagccttctcctccaaatccagctgatgcctatctgtcttctctccccagatcagctgctgcccgggagaggcaacccgggcgccccgctagggcgacggcccctgccctgagggccgggatcatgaaaggcctcggtgacagccgcccccgccacctctctgacagcctggacccaccacacgagcccctgtttgccggccctgaccgcaacccctacctgctatcgcccacagaggcctttgcccgcgaggcccgcttccccgggcagaatgccctgccaggggacgggctcttcccactcaacaaccagctgccaccgccgagcagcaccttcccccgaatccactacaactccca

SEQ ID NO: 57766 - DNA, 1272 bp, Bovine  19866881046656
tccatggggtcgcaaagagttggacacgactgagcgactttcactttccaagaactctgtactttttctaattgttctagtaattgggaattgtgagtgcattccaattcaggaggtatccttctggatttcaggtaccagtacccaaccatggatgagctggccgaaatgctgcctcctgttctcacccacttaaagtgagttcattctgtagttcttccatgtggtttttgtttttcaaaaaaacacttttttttgctatgtgtctgatctgggtgctatgatggtaatcaaaacagtatggtcactacccttatggagtgtgaagcttacattttgatatggaaaataattaacaacagggaaacaaacaaatagtcacggcttacattgctgtagaagaaatcagtagggatgtgtgatagagaataaaagcaggctctaccaaatatggctaactgaggaatacctctctaaggagtcctttaggttaagacctggaggataaaaaggagttacctaaatagagagccaggacaagaggattccagatggaaggaatatgtccaaaaggcctgacccaagtgaacaagtgggagaaaagcataaggtgatatttgagaactaaaacaagaaccagattacacagatctgacagatcaggtgagacttcgggattttattcaaaaggcaaagaaaaacactgaagagttttatgcaggggagtgtatctgatttagtcttttaaaatgatcactctagatatgtaaactgcacatcaataaagctgtttgcatttttcttttaattactctaaagacttccctagcaatccagtggttaagattccatgcttccaacactaggggcatgggttcgatccctcgtcatgaaacttaagatcctgcgtgctgcatggcacagccaaagataaataaattaaacactgccaaaaggaacctttaaaaaaaaaaaaaaagattagctgtggagagaatctccacaggtttaaagaggggtaaaagagaaaaagcaggggaccagttaaactattacaacaatcaggcaagtgatgttgatagcttggcactagatgcctcccagaggatggaatggaggagaaggcagatggaaggactgtgaaggtgactataggacttgctgatgggttgggtgttgggaggtgataggagagtgagcctgtcaaggatgactcccatgttttagtcatacttcacataatctttaaaatcaacttaaaagtcatcatat

SEQ ID NO: 57767 - DNA, 631 bp, Bovine  19866881142579
ctgaggttgtgggaacttgagtctatgaaaccttgggagttactgttgtgaaatcagatggcaattctgaagaatcgagcctcagagaggaaaacctcttatagattggattccagatggattctgggaagctcatgatcatggttggcctaggataagccgttcttctgaaccctcttcctctggatttctaggcatctggctgagttgtggagaactctggaggtggagctgcccaaaacgacctggattctctggagactcctgaggaagctgcagaaatgccatgattctgactcccaggacaagatggcctatgtggctgttgctgtaagcccttgagctttgcccctccaactttagcccaccatggccctcctggataattggcccagcaccatctggagagtgttccttttggttcctctcaaagtttgtttccctcatccatttataaatccaccagtgtcaccaccaagggatggatgtggaggaggctgagatgagtgaaggagtcagtatggtttcatctgttttaagcattctttttctcatcttttaaaaaatgcatatcatcatagtcaagagagtacaaacatttcaaagaatatagaagaatataaaatagaaa

SEQ ID NO: 57768 - DNA, 1666 bp, Bovine  19866881211840
tgcctccatcctcatcccagccaccgtgacctctcaggggctggtccaacagctcccatgccccatcttctagcatcttcttgccatcagctagagtgatctatttaaaacacagattacatctcaccctggcttactccaaagtccccagtggcttgtcactgcatcaggaataaaggcctgcaagggctgctgtgactccctctgtccactccagctctgtccatcagccgtcaagtgctggtcacatggcccttctcactttcttgaacatctgtcagatgggttctctctgcctggaattctcttattctggatctctgaataactcactttaaatgtcacctccaaagagaggctgacctgactactctttttaaagcaggttcccctactaattcctctaactcttcttcagccagtggtttgtataagggacaaaaactttgggacttccctggtggcccggtggttaagacttcacaatttttaaaggttatactccatctatagttattgtaaaatagcagctatattccctgtgttgtacaataagtctttgtagcttatcattattattattatggggggtgtgctagggcatgggttccatcccttgttggggaactaagatcccatatgctgcatggtgtggccaaaaaataaaagcacttttaataaaggaataaaaatttcagtttttaaaaaatcacctcctcttgggagccttccaggatttagtctctattcagtttccatcatgttggtcagttcagctgcttgaatgggagaacataaattgtttttccactgggtgatcagcatcttcatttcttacaatctgatttatttcttataatcatttaattcttcatgacttctagagtagaactttatacagtgtgtgcctgagctgaacactacccagcagtgcagcacaacacggtcaaaagctagatggccctcggttcaaatctaccccagccctgccacttccaagttatatgaccttgaacaagcattccagttattcattgctgcataacaaactaccccaaaaattagtgtctcagaacaacaatatttattttgcagtttgggacagctcatttctgctctgcttagcatcagcgggcacagctccaaggctagaggctatatcatctgaaaattccttctcttacatgtccagggcttggtggggaccagagctggagttgttcattggaacaccttcatgtggcctctcccatgagggaggccttgcttcctcccaacgtggtggctgggatccaagggaaagtggattgagagagagagagactcagagacacagagacacagagagattgagttttcagtcatattgccttttaggacctagctttggaagtcacactgtcacctctgccattctctgttggttgaggcagtcacaaaagctgctcaggttctaggcgagggaatacaaacctcgtcactcaattggaagagggtcagtgccacactataaaaaagaataattgggggacttccctgatggtctagtggttgagaacccaccttgcaatgcagaggacgtgggttctagccctggtcggggaactaagaagccttgagccctgtacctcaccactagagcatctgtgtgctgcagccgaaagat

SEQ ID NO: 57769 - DNA, 730 bp, Bovine  19866881276940
ctggaaactggaaaggaggagagagctcagccgtttgctttctgttaagtcgacactgatggatctgcagagctctaacataaaatattaccacattcaaagagctggacatttatacagttagcaaagtaaaaaacaaaaaaaaaacctgaaaaattccctccctcttgatgcagcccaaattaaggtaaaaaaaacccaagaagtcttctctaatctgtcttcttacatctaatttgttcaagatcaccagagaatgaaatttacctatctgtgcatcctaagtttaaaaagttaaaagaaccttttatgtattaccttaaaatcttgtcttgctaaataaaacagatttaaaaaaataatttaacttctctttgtgttttatattcaccatttgaagaaaggagatgggaatatttcagaatttttgtgatagccattgtagtgtgctttaaatgagttcctctttacagatggggaaactgaagctcagaggggagacacttgtctgaagccagagacaataacattaatagtaagtttgttgaacacagactatctaacaggaattttattaaattctaaccgtcaccctcacttgaggcaagtgacttatcagcctaaccatttaacaaagcttaggtgctgggcaacttgcccaaggtcacacagtgcatcagcctgaactaaacaggcattttacataattatgccactgaatcctcagcta

SEQ ID NO: 57770 - DNA, 1479 bp, Bovine  19866881337886
cccacaactaagacccagtgcaaccaaaaaataaataaatatttaaaaagaaaaaagtagtaaaaacagtgctagaatgaacatctttaaacacaaaggatttttcaggttgcttacttaaattagaatttatcctatgtaatagcatctgctggatatattgtatctacacatgtagatagaacactggatagaacactggcccttctctcaagcaggaggttccagaattatttccacagttgaaatctgaggcaccaaatgcacatgcagtctaatggtatttttcttttgcttcctaatcagcttccagtgcaattccaaagacttggacacctggtggctctgatggctctgctgtgtggggacccactgaaagaggtggccgaggaggctgcggagggcatgcactacctgctgcacatcaccctgaggctgaagtgtaaggcactgctggaggcagtgaggccctgagtcagttctccagcacagcacaaaaagcaccaggcctccttgggcactcactgcccacattctagaaagacttttaccctggttcatagagagaagggtagcctgtccctaggcaaagatagagccacactgacttaataattagaaggataacactgggtcagacccatcagtgtcagccatgtgcatgcccatggagttggagcagaaaacatgtggccctgtggaaaagctggagtagttagtttagctgcaagtagaagaagttcttgccatcccttgggcctgcctttatgtgtttatcccagaaacgtttactaagtccttactcagatctaacagtaaccagaaaatatgtggtccgatccttatatgggcttcacagggggcgcagtggtaaagaatctgcctgccaatgtaggagatgcaagagacatgggtttgatctccaggttgggaagatcccttggagaaggaaatggcaacccactccagtatttccgcccagaaaatgccatggacagaggagcctggtgggctacggtctgtggggttgcaaagagtcggatacaactaagcgcacacacacacacaatccttagatgtaacacatgatctagtgggggcatcagagaatcagggggtcaacaaataactcttcttataaacacttgactgctatgaagggagattacagaggccatgagtaaggatcaaatctagttgtggggttcagaaacggcctctctgaagataacctaaaaaataacatttagtcaggtgaagtgataagaagagtgtattaggcagaaggaacagcgtgagcaaggacactcagcaaatatgaacgtggggaatttgaataacaaagagagggccatggtggtcaaggagtgaatcaccgatccccacagttggaagaaacttcagaagatatctaacccagacttccccagtgctgagtctgagtctgttctatccctacccagcagttgcccagcctgg

SEQ ID NO: 57771 - DNA, 763 bp, Bovine  19866881420550
ctgatgatactatagaactaaattttatagtaatattcattaaaatggtattctactgggaatttcctggcagtccagtggttagggtttggcgcttgcactgcaagggcctatgtttgatctctggtcaggtaactaagattctgcaaaccatgaagctcaccaaaaacaaacaaacaaaaaggtgttctatccttaaaatctggtagtattcagctgtgctctataatacatacgtattataaatcttatatctcattaaatatatttatcaaataatgatgcacctggattataaggttttgtagactggtaaaatatagacaaatttgacagatattttttaaatatctggaggactgtagttgaaaactaggtcattaacgtgcattagaactttatctctgaattaccagggagccaagagtaatttgaataatcaggggtccctgatggactagagtctgtaacaaaccatactgctgccttttcctagcatgaacagggctcagttatgatgtttgagcacctcatcaattctaacggactccaagatgtcatgaaatactatggtctcatccctgaagaagatattttgtttatcaaggaacaaattacaggaccacctgaatcacccatcaaagatgcttcaaaggtaaatttgtgtacaaccctaatttaaaccgactggttcttttcatctcgtcttcttcttggttccttcagatttgtatttgaaaggggtgacattttgctattttag

SEQ ID NO: 57772 - DNA, 1822 bp, Bovine  19866880459433
aatattcgggattgatttcctttaggattaactggtttgatctccttgcaatccaagggactctcaagagtcttctccaacatcacagtttaaaagcatcaattcttcagtgctcagacatctttatggtccacctctcacatccatacgtgactactggaaaaaccatatctttgactatatggacctttgttggcaaagtaatgtctctgctttttaacatgtgatctagatttgtcatagtttttcttccaaggagcaggtgtcttttaatttctcgcctgcagtcaccatccacagtgattttggagccagagaaaataaagtgtgtcactatttctattgtttctcaaaatataacgatcatattttgcatctatttggttaaataaaaatacttaaattaatttaactatttatatgtctttattccctggtgattcagacagtaaagcatctaccaacaatgcaggagacccgggtttgatccctgggttgggaagatcccctggagaaggaaatggcaacccactccaatactcttgcctagaaaattccatggatggaggaacctggtgggctacagtccatgggatcgcagagagtcagacacgattgagcaacttcacttcacttcacttcaatgtggctactagaaaattttaagtgacatatgtggctttctttagttttctgttggacaggactgaactaaaagtctcactgagttaggaaaatgtttcaagtggaagtattagaataggagaggacatatgggtcaaaaagggggaaacttgaaactcacatttaagagactgtacagttaccatcaacaacaaggcgatgggaaggccaagcaaaggggacattaaaaggttggatgatatctgtgtaaatgctgaaatcaccaaaaatgatgagaacagggtgggaataagatagtggctctttaggcactagagtctctaatgattgagaagaaagcagataaccactttcaggagaagcagctggcactataatctgatggcttcacttgaaagattctgggcatttttggaaagggaaaatgtttggggattggcaaaggggagccctggggttcatgagttaagagagaaaagcaacctaacttgggaagtattcccaggaggcttgcagaactctggcttaaggcaaggcaagaaacaaacaaaaaaaatgtttgggggagaacttgaaaatatagggatgcctcctggttacaaactggggattctagggagctcagaggaaatgtttggagagggaagtgatgggagagaggagaagctggtgcaatcagtatgaagaaagcagtgtgggtctatgatgctgggtgatggcagatgcccttgaagacttagagttctgagggtgagtgatgcaatcagggccctgctgtcagggctctggtcctgaggacatctgagaagcaagtggatgatcagctgaagctgtgtcctgaatacttagcctgacggtttagaagctaagtgacagtcgtcaggcaactgacaaccctcactggttctgagagatgttttaaaggaccagtaattagtactgataaaaaagaataattatcataatgagaggtaccagaaataattagaatttgcaatgatgctgttctgaagacaagttagaaagggcttttgattaaactagatcaatgagggaagatattggagacaatgagtgagagtgtctgcaaatgtatcagtggagacatgggtggaaaatgctgctgatggagaatttaagaacgcttacccaggaaaatgtgcctcacagagagatt

SEQ ID NO: 57773 - DNA, 1271 bp, Bovine  19866880571885
atggctggtgggctctctttggcagcgttctgcaagaactccgtggacggtctctggtactgcttcgacgacagtgacgtgcagcagctgtcggaagatgaggtctgcacgcagacggcgtacatcctcttctaccagaggcggacggctataccgtcgtggtcggccaacagctcggtggcgggtaaggccattccactccaggtgcggtttttctgagaacagaaggtggtgcttgatgatccagaggacttctccagaaggtcctctgattctgctggttggatcaggttaattgtcacatttgcatttaatctggaaggcagaatggttgcagtcaaggaaacggggctggaatgcgcaagcaactgtgataccaggagttggcatggaggtagagtggagcccagctcagagcacaatcgtgtgtttacttgtggagtcagtgagcgagggagctgaagagcaccaccaggcacttgcagagtagagggaccgcgtgatttggaagcagaaccagacttgactttgccaccccttgctcgggttatcgtggagcatgtcccatctaagccacgtatttgtcagccgtaacatgggtgtaataatgctacctgtctcatgaggtcgttgtgtccagcagatcaggtgaacttgggttaaagccctttgcaaagggtaaagcaccgttacaaattattctttttttccagtaaggctggcctgttctgttaggggaaggattgaaggctgtactaatcttagagggcttgggtttagtttgaggagatctactctgttgtgttaaacaaacacaagaacagtatccacacttgatgcagccacacagaatccagacggggagaaggcgtcttagtgccacgttgcagttgagagaataggacagagttgtgggacgtggccgtgtgtgagcagttattcatccctgcacccctcgaagcttgtgagggataagccggaagccgctcaaaggaagcatcgctgaggcagagagacccctggtgcatcacgccccacgcagtacagcactcagtctgtagctgctctcttcgttcacggaaggcgggaactccagggctctagtgccgtcccgcagtgctttccagagtttgagatgtgctcggacctgacacccccttgaggtgtcctcgagatagtcatgctgctgcacgctgtccatctcaggagtggcttctattgtcctaactcatatttaagggccttcctggaacagagaagacagaacggca

SEQ ID NO: 57774 - DNA, 881 bp, Bovine  19866880587993
ccatctctccttccttacttcctcttgactagattgatggttctcactggtatgcatgatggtaatatacaaggttatatgtccaccatcaactactctgttttaataatttaatgagtttaaggatgttttgacgctaagtcatcttcatcttcctcacagactctagagctgagctcctgtataagtcattttccaaaaggcagggtcagtgagaagagcacctgtcactcccaagactctagctgagctgcaggtgcgtgcaaggagcccagcacttagagcccctggtccctggagctgagagagcagccttccactactgacctggcatcgcaggacaccccgtcaaagaagcaagtgaccagcagctcgtcagcagagtagctcatgttgattttcttctcctgagacacctgggccatgatgttcatgtagtgcagcttgtaccactcctggatagcattgacccctgagctgaaggtgtagaccgcacagtccgatgtgtcattagaacactgtgaagaggaggagacaccaagataaagctacgggccctgccaggggcccttagaaggactgtgagcctaaggaactggactctagatactcaggggaacaggagagatacctgggcaaggatgggcttcttctcacttctgagaccagggactcaacatcctcaagcctcaaggaccaagaaggggctaagtgaggaaggacacagagcctcactctcatgagtctctcagtgagaaccaagaccagcttcctcagagtccccagatagccaggcttttaccaatcatggctactgagttccacccaaccctcaccatttcttatcagatcaacagtctaaaaattgagattctagccca

SEQ ID NO: 57775 - DNA, 1082 bp, Bovine  19866880595885
ttaatgaagcccattgtgctaataagaaattgttagtttggtctccttttaaagaggtacatacgcagatggtaaaataaatgacatcagcaccttttcctttcatttacttagcacaatctttcactcaaacgagacaagtggccgcgtacctggctaataaccacagccattgtacactgcagcttgaaatggcgacaaaatcaccgttttcccccaaggctgggggaagagaagggtgctgagttttggggttagaatgtcttcatttcagttccactcagccagtacttcctgaatacctactatgtgcagagatcacaggcatattcctgtacttggtacctctttcacctgtagccagttttacttgagataaagaatcgtcattatgccttgcatctttgccatttcatttttcccaaggacgttctgtttcatcccctcataatgctcacacagttctgtgtgggtgagggcatccaccaacaaggcaaagtgtcaagtacaaattttcaatcatctgacacctcgaacttcaattaatgggcctcacactgtgattcctagagagattccatgacaccaggtttctcttgggagttctacgtttattttttggaaatcaatgtgggaaaagatgcttctcatcagacctctagaggtttgtctactattctcacatattcaataaatactcgtcaatatcctgtctaggtaagcacagtgactcaggaaacatgaaaagctctgtggtcagaggaccagggcttgagttctgactctcccactgtgtgacgttgggcaccttactttaccagccggggccctggtttcatcatctctgaaatgagggtgatctcacacttacttcaaagggctgtggcaaggataaaattaatcctgtgtgagacacacatacagcatcctggcatcctaagagagcagccgctgggtaaatggcttccccaccccactcccatcccccagagcctcggtgctgctgatgtgaaaacacggctgccaccaaccggctcactaagttgttgtgaagacaaacctcggtctaggacttccctggt

SEQ ID NO: 57776 - DNA, 1548 bp, Bovine  19866880609698
tccagaaaggagactgggactcctaaaaaagaggctggagatgttcaaaggatgcaaggaaggggtgacctgggtttgcacctctaaatccccagaggcaagggcaggagtcttagtgcagagactcggatctcagagatggatagtatctttatcgcaaagccctctgctgtgatggcggtgccctttgcaggcattttttcctgttatgacaaagcaattccttcatgaaacagtctgaagttatttccaaatcctccaagctgtgtagccagggggactttattagacgtatttattctgtaacccagcttctcacaagacatccagggatttcctttaagctgcctctcctccctcccaggaagaatcctcatgctgcttctcagacattaaaaataagacgagaaagcctctgtcattcagatccaaaccagcttagctgactggctgctgccggccccccagccagctggtggacacacacaccttcctgtttgtgttaaatccccttgcggctgagggacttcacccaccatggccaaacccactcttggatcttcaaggctgaggagacagttgaaatgcaacagaaaacgacactatttatattttcatttctattaggcctttataatgatttcttattgaactgaagcttaaatggctcaagactgatagtactagaacatttaattgtttgcttgtctaactctctcagtcctaattaaatattgtttttcactgagcagcttacacagtagcgtttttctccccgtcactgaagggagcatgggctcgaggcagaattcagatgagccaggctccctctgtgctcacatcctattcattttttgtccaacaacaggaagcagagccctctggagggaaaatcactgagttcttaggaagagctttcggagataatctcacaccagtccttggagatgacctgggtggttaaaagatgagctatgacagctcacattgccttgtagggtttcctatagaaacagctggctcagggctttaaaagctggtgttggagccattgctggcacctttctcccacaacccttctcagcagcgttacctttagcatcaccaaaatccagccacatctcatcacctctaggccatcatccagatctaagccacattcacctcttgcccagattactgcagaaacctctttcttggcctcttctgtttatcctagccctgccaccatctgttcccaccagagcagctggagtccctcattcccctctccccatcccaggaccctgctgtggcccccagctcacacagaagaaagccagggttcagacaatggcctccaccctgcgaatcctattgactttgtctctaattcccctctgctcattcagctccagcctccctgacctcctagctacctccttggatactcttcacgtgcttcctcctccaggcttttcatttaccattcactcttcctggaatttgtctctccctgaaatctgcaggctcactccattattccttcatgtttttatccaaatgtca

SEQ ID NO: 57777 - DNA, 930 bp, Bovine  19866880619663
tcttcactgtgaggtcttgtggtgttagaacacctgccttgcctagaaaggagtctttgcctaggacaaaaacataaatatgggttcttcatttttaaaaatttaaaaatatttaaaaacttctcaattagaaaatgaagatacaccaagaggagaaaataaaaatcacccataattccactactcaggaaaaaaccaattattaacatttggtttatatttttgcagattttaatcaatacttataataagcattttaaattaaaattagaaaccaaaattaaaacacattattctgaaatctgcttttcattccctgcaattaatgtaatgtgaacatctttccaagacaagaaacatagatcagtggcatcttttatcaggcatcgttgtctcctctggtatggctgtacttgaatctcttcgagaaagtttaaattaaatcaaatttcaaatattaatatacactcatgggttaaaaattgaaaaggcacagcagagtttaccttgaaaagtctctctcctaacctgggtccttggccacccagttttgctccctataacaaccagtattacctgtctcttgtgtatacttctggaagtagccccagaatatacatgcaaatcatatacatttgttttctctctccaacacacacacattcaaatgttagcttaccttgctttttaaacttaatataccttggagtttgttctgtatcattacgtaaagaatgtccttattctattttatgactgcatcgtggtccatggaatgaatgtccctgggtatgtttttaaaattgttctgtattgactcagagaaacctttcctgtggttttgtccaagctccttgtccatatggcctggccaggggcagctaaaggaaggatgcccgttcagagattaggagggcccgcaggtccaga

SEQ ID NO: 57778 - DNA, 1880 bp, Bovine  19866880680242
tgcccaactcggatgggatttgaacccagccaaaacttagattgagacttgaacctgtgggctgggattaaaacccactatctctctctcttttttttttatttttaaatttgactgcaccaggtcttagttgcagcatgtggaatctagtccctgcctagggatcagactcaggccccttgcactgggagcatggagtcgtagctgccggaccaccaaagaagtccccactgttttaattaaaatcaggacttactgaagctcaggttctttttgttttgttttgttttaattttttaatttacacctaaaacattttgtattgaggtatacccaattaacaatgttgtgatagtctcaggtgaatagcaaagggactcagctatacatatacatgcgtccattctcccccaaaaccccactctcatccgagctgccacatgacattgtgaagctcaggttctttatgtctcagcacagaagggattcagcaagaggcagaatatacataagtagatttattaatacagaatgcttgtgagggttcaagtgggcaggcaagggggctctgtcctgagaactaagtgggaaaacagatttgtttgtagagagatacattccatagatagaatgtaggctgtctcagaagatgagagtggccctgaaatatggggtgttagtttttgtggcctcagtaatttcatagggtaacaagtgggaggattagtcctactattttatgaaagacggggtggagattcccaggaattgggccactattctctttttggcctttcatggtcaggcttgggactgtcatggctgtgtgtgtctttagctgatgtattgcagtgagtgtgtaatgaggttcaaggtctactagaaatcgaatcgcaccaccatcttgcacctatttggttctgactagtttctgttgtatcctcaacatctgtgtcattctttgaacgttatgacctctagccctttcttctgtctcactaaggcccttcagctcagtaattccctttcctttttatctttagtacctaggctcctggactacagaaaaagttaagggaagaatcattgaaatactcttcagttggacagtctggtttccagaggacatcaagatccgagatgcttatcagatgctaaagaaacaaggtctgactgcgctgccttcccttcccacagtgattgttccttcttgcttttctgtacagtttgtcatttttgggtgaaagctggagatcttgtgtccagtagacacagtaatcgaggctgaagcaagtaatttcagtccctgaaagtgggcagacctttccttctggttagcaggaatgggggcttccctgatagctcagttggtaaagaatcgaccttcagtgcaggagatcccagtttgattcctgggtcaggaaaatctgctggagaaggacagtctacccactccagtgtccttgggcttcccttgttgctcagctggtaaagaattcagcaggagttgagctgggtttgagatggttgttgctatagttacccttactataccaggtttcagattcctctggtgttggctcgtgtttgaggtgggggctgatggcctagagagtttctcgcagtatctactctgctctcagctttgggtcttcctcttgctctacatctcagaagagttcttattccactgcctgtcctgacagtagacctttattacttgttccctgatgcccttcgcctggcgctagtggtggttctgttctgattaagccttggtcttaggaaggcacgtgtccctggtcttggagggacctgtttgtgatcctgttccaccccatactcgggctggggccaggacacgtttgcacattgcaccc

SEQ ID NO: 57779 - DNA, 1908 bp, Bovine  19866880686674
ggcacacctaccaaataacccgtctcagacagagaacagagccacgaaaagaaaacccgagacgtccacctgggagaattcaggaggtgccagggaagaagaaagggcatccttggggctgaggggtggagggtggcttcaagccacaccctgtggagtgacagtgacctggaatcagtcatgggacccacaggaatacgtgggccagggagagggaatttatcaggcctttgcttcttccaggaagaccgacacagaagggaaacgtggggagatactgatcattcaaatatttgaaaatcatcttccaaattctaaggagacagtgatctttcaatactcgccttattatcaaaatgactacagcatctatgtattttacaacatgtgaacattttcagacataaagacgcctctcaaatgatcagtgtactacatggttacactctcccctacaacctaaagcgcaatcttaccagttaaaattaggtttatggtgctgtactttaggttttatggttcactcatccttggttaggaacagcctaaccctaaccctaaaccataatgctgtgccataggaaaataagatctgtcctgtggtctatatccaacaattgttaggaaaaataatggctggtggtacttatctaaattgaaacccctgtccacttacaatgctcctcaactcatatcgaataagcattcccacataggctatgaacctgaaggacggacttgtaaaacacctttgataatggtgatctctagtgcccccaagtggtcgtaagtgatgtgacatcctcaatagggagtcatcctgagaggtggcaaaatctttgccatcggggcatttttatcacaacaggatggctgaaaaagaaggtatcaagggcaagagggtccagaaaatatggttccttttataccgctgtcacctcctatcataaaatcttggtagaagagagaaaaaatacaaaagtttgaaagcccactggaattgagttaaaatgtgagtttttatctacttccatggcccaggaaaaactgcctcttgaaggaaacggctgcatttactcttggttatgaagattaaataagcatggatgtgatttttttttttttttgctttaaaatgttacttacaaaatgtatgtatccttctgtaacttgttttcacttaatactacaactttaaagcattttgtatacatcagcataatacaagtacctgtttaatttccaaagttagttaacaccaaaaaaaaaaaaaaaaagttaacaccaaaaatgtggaggttggcaaggggagaaagaggaatatggcttgaagagggcatcatgtaataaatttattatatttcattacatttttccacttttctcttaaattccaactgtatactatataatcaactgctgttccagaaataaaacattttaaacataaaaatataaattttgcttcttaaaagtgcatacactttgaataataaaacatacaaataaataacagaagtcagtgacacatctcatgcacttgttctaaaataatttaaaatgtatgatacactttgtttccagcctcaaggaaagacatcctgccttccatattactgtacaactaaaaaagaaaatcatacacaaatcactatgaatggtgcatgaccaccaccaaagcattttgttatacagtgatatgacatgcagcttttaagacaactatagaaattccactgtaaaaacttaagagttcaatcaagaaactgcttttgtaatggggcttgaattcaattttaaccagtggtgagaggcacagttggtgagcaaaaccaaagggaacataaatgcatatttgaaaggcctacaaagagaacttcagctccagaaacacagtaactgcttccc

SEQ ID NO: 57780 - DNA, 729 bp, Bovine  19866880740835
ttgttcttgaaaattccttcccattatggtgaaaagaacaagcctattgctagtactactacgtacaggggtcagtgtggtttattttctgattagagtgttttaccttgtttagataagagaaaggaaagttgtaaccccctccaaccccccacctttcttttttgagtgaatatttgatacacagttgtattgacccagaataatttggcctgtttgtgacttgacatacttttacatacctcttttactcaattcactgttaagagttttattggggtaaaaaattccctatttaatatttaccaaggaaagatgattcagtggctgaatggcttttcgctagataacttctgaatgctgctatgtaatcatgtaaataatgaaggtgttttgtattttggcctcctgtgacctcatctgggaagtattgcagtaaaacagataccaccagcagtgttgccctgatgcagcaagtatttcatattttcataggccaagtcctcgaagattgataaaatgttcgtgattttccttactttgaaatgctcgttcattctttctttttgttgtaaattcaagatgaggggagagagagagagggaggcttcggtgtgtgtctgaggctaatctggttgtatctttaaagcctccagtgctgtctagctctttttgcattgtttaagtgggtgatataattacagatttgttttgacctcagcttgctgg

SEQ ID NO: 57781 - DNA, 782 bp, Bovine  19866880886667
gctgaaggtgacctcagccttctagctcagaagctgggctcacaggtcctttaagtttgggtggaagggggctcaccaatgagaagccactggctagggagggccacgctgcccgaggggtatctgacagcagtgctaggtgagccctctcgctctcctgagacttgcagtgtcacctcctctgtggtggggccatcggtgggggccagggtcaggccacgaggctacggcagaagatggagagtcatgagtggtggcggggggcttctctcctgcttcatcccctctttccagcccctcagaggccctttctcaccactagggccaccccagtgtgaaccagtgctttagagacatagaagccagcttcatccttccccacatacagggtcatcctagtgggggagaggaaaggggagaagaatgagtgaaggtggcgggcagtttcagtcccatcgtactggtgtccttctattgttccagcccacacgtactctggcctgggtcatgtgacttgctttgaccaatgaaataatagcaaatgagacaatcagaggcttgagaaatgcttgtgcatggggacttgccttctcatgggggttctttggaaactgagaccaccacaagaggaaaacaaggttactgtgcaggggtatgagagaccttatttgataccccataggccaaaaaaatccactaactatgagataggtgagtgaagccattctagattgtccaggctcagccaagctgccagcggctgcccagaccagaagaccact

SEQ ID NO: 57782 - DNA, 1552 bp, Bovine  19866880956034
agctggtgaaggacagggaaccctgggcgtgctgcagtccatggggccacagagtcggacacaacttagcgagtgaacaacaaacagcagcagcagctattcagccagtgtttgggtgccaactgtagccctttgattgtgtttttccattgactcccattaaacgtagtttgtagagggattcagagttgtgccatgccttggcccagaagtgaggagacaaggctttctcctctaggggtcctgcttaaatgttgctaacagcgtcgtgctccttgtttccagctcgcccctgacgacgcctggcggtgcccgcactgtaagcagctgcaacaaggcagcattacattgagcctctggactctgcccgacgtgctgattatccatctgaagagatttcgacaggtaaggagagcctctggcccagggaagagcgctgtgaccaggtgtcttacgcctcctactggcgggctgttggggatggttctctggtgtccccgtgagagcccacgatcttgtgttgttacagacccacattttccctgtgtttggggccctgttttgttctttcccaaagcaaagttcaagtgtcctgtgacctttgaatcccaaccattttagttcatacggcagatattttactttgttcctgaggatttgctttagatttgtaaatgttgtgctcatgtaagtgtgccttgggattaaaaaaaaattgagctcctttctgggggcgggaagaattctttttctacctaaattaataacgggtgttgtcctgcttccaaggagctgttgtacagttggggagatgagtcatacatgtatacgaagaaaatctgctttgcattgtatggctttgtgagtcagttttcccaaaaaggctgtctgttcctgaggttagagctgtcctgggcggcccccttgtaagggaggtaaatgaaaggtagatgctggaggagtctctgagcctggctgcaagaacgtgtggatctgaaagatcagcaggaggcctgcagcaggtgagggaggggcacgcacatagtgcctggacacagcgggtgcagagcagggcagggggctgagagccgaggccagtgtggctggaggtccggggggtcagggagaaaggcgagagttgaagtagaagaggccggctgtggctggccatccaagcctggtaggcagagtggggttctgaaccactgaagcaacatgaccaaaggcgtgatttgaagagaggctacaaggatgcagacagggaggtctgaaggaggccgtttatccagggcaggcccggctgatggctggcattggagttgcggcagcggaggtggagagacccggatagattgggagatggctaagattcgctgatgaagtgaagatgttgggggcgcacacaaggtcgccggggcggggcttagtgcatggaggtttggagtccagcccctgtgctagtgaggagtgagcatttgccttgagtgtcccagctgcacgcctccattggggtactgcgggtggacggcctgttgagggtttgcccagccct

SEQ ID NO: 57783 - DNA, 1040 bp, Bovine  19866880979695
aaataatttgcagttggtttttctgggcctggccacacactatgctgattaattcatatattcttatccttttgtattaaagggcatgcctttggtgtaacttgctagagttaatgggcctgtaataataatcaaagtaatttgaatatataccttctgtctcattagcagtaaataaatgttctaagatttggggatccagacaacagaatgtataggagagaaataatacattgcttaaataaaggattagcaacacacttggatagttagctaaagaaaagagaggtttgtgtttcagctaatttgaaagctcaaacgtatgctattaaaataaccatcaagacaactgactatataaacactaagtcagaaaatacttacaaatcttttgtctccttgtcccattctactactaatttcacgtgagcagtaccgcctggtccacaagattttagtgccctataggatagagaagagagtcacacattactttctaaataaatgattttaattaaatattcaaaccgtctgaaatcagtgtgattgctgaaaatctttgtcattggttcccatcagaaaaggttttataacctcatatttaatgatttgactacaactggactgaaaaatccttaaattaaaatattcaacatggaaataaagatacggcaagaaatttagtaccacactataagggttatccatgtaactcttagagggtatgacctttccaatttttgtctaatttttcatcaaaccagagactagacaacaacctctttgagaaccaagtctgcctctctccacctccctccatacaccgtggctggtcccgggactgtgcccacacccgatgtaaactgtgccttcctgcaagggacccctcaagttttacctcatttattgcccctgagctccttggctcctcagtcatcttctgaaacactcagcattaacagtcaatattacttctcaagtactttttattttttgcaatgttttagatcattatataatctattaactctaatttctaa

SEQ ID NO: 57784 - DNA, 2920 bp, Bovine  19866881063716
acatctgtttcccctagagggatcaacaggaaaaaaaaaaaaaattcacttcagaagggctgaagccgctgttggcagaagcagcaaggaagtgggcagctggggggaccacatccgccccacagccaggctccctgggacataatgggtggtggcaacagggggagagggaaggagtctggtccctcggcccaactgaagaaggaaaaaggctctgagtcccatcccaggctgagatgcaacctggagtcgggtttagctggactcctgtgcctctgacagatctcagagagatctggcactaactgtgagaccctgggcagctgactcaagctctccggcttcagtttcctcatcagtgaaacagggatgtgaatggtctattcccagggaacaaagttaggactgcgggtggagattccccttaaaacagcttgtacctgctggctttgtgcttaccaggccacctcctctgccaccaagtcggacactatgagagcttgtctgcccacttcactgctgtgtctctaacacctacaaccacgtgtggcacacagtatgcactcaataaatattggttgaatcaataaataccaggtgctcaaaaatatttgttgaagaaaactacaggagatgtaagaaggaatgaaaggagataaacaaagagaggggaaggcagcacatgaacccccaggaaaattcctagcagtggaggtcaaccagttagccaaaccacttcttttgccattctctcctcaggaatattaaatgctttgtcatagtaaacagtacggctgataagtaggcaacggccaggcttactttctaatcagtctctgagcaaagacttcctttccttttcttttctaagaaagccccataggacagttctttctttcccctctgactttcaatctcattctcagcccccagcatccacccatagactctggaagagtataatcatctaatgtgcacagagtgcaaagtgcaagctctgtggcagagtgtatagctccaggccaaactcaagtgtatatgcctgaatcactgtcactagaacagctggctctattacgacaactccttgggtagccagtgaaaacccaatagatgtgactagacctggatctgaggaagcccatactatttacgagtgatctacaagggcctttccacatccacaaatctcttacagaagataggtggtggtttaaaatatgcactttggagccagattatttggactcaaatcctggttccttcacttaccagccatgtgaccttgggcaagttagttcacctcttcagtagtaaaaagagggttattaccatatagtaccacgctggtgtttaatcattaagtcatgtccgactcttcaaccccataaactgtagcccggcaggctcctctatccatgagatttcccaggcaagagtactggagtgggttgccatttccttccccaggggatcttcccatctcagggatctaaccaatgtctcttgcattggcaggcagattctttaccactgagccaccaaggaagccctcacaggtaagaatactggaatggattgccctcctccagaggatcttcctgacccagggatagaacttgagtctcttatgtcttctgcattggcaggtagattctttaccactagcaacaccttggaagcttagttatattatcatgaaagtggaagtcactcagttgactccaactctttgtgatcccatggactatacagcccatggaattctccaggccagaatactggagtgggtagcctttcccttctccaggggatcttcccaacccaggtataaaatccaggtcttctgcatcacaggcagattctttaccagttgagccacaaggaaagccctatactaccatattattaatacctcactgggctaccatgagacaatgcatattagagtgctctcgacagctaagattcttatttacaaacaacagaaacccactctaaccagtttaggcagaaagaccatttaatctctgggaggctaacagaatctgactagaggccccacagcccagaggaacatctaaaccatagcacagaacccatcctgagaggagtcactgccaccaccctagaatctaccccacggacactgtgactatccaacattcacgtgccacacatcctcctagaagcctttccacagccgcctgcctggtctggacatacctaccacctctctccatatcggattgccagtgtctgcttattctcatcactggaagctgattcaaagtccgaccaagatgcaaccaattggcagaccccaggtcatgtgtctctgctctagctgcaaggggggctgggaaagtggatttctgaattctacattcatggggcaggggtttataaggctgggaatctcccaacataaaaatgatgcttaagagtccagaaagcatgacatccgtcccctattagtttctggcacagctcctggcacatatacactcagtaattagtagccattccctggaaatgtggtttaggccccaaagcaaggacattcctgtgccctaacatttcccctttacctccaggtctacctgtcatctttccagaaagtctggattaaatccttatccttcctcctcctaagccctaactgtactcctccaaatgcctttggagaccctcctggaaactcacagcccagaaaaggagtccagttctccttatgacttagaggcagaatgcaccaaccagctgtaatcacagattcacagaacttcagaagccccaattggaaggtcactttgtcctactatcttattttgcaaatttagaaattaaatcctttttttttaaaaaaaaaaaaaaaagaagaagaagaagaaattaaatcctaaagaggaaaagggat

SEQ ID NO: 57785 - DNA, 1431 bp, Bovine  19866881080069
aggctccagtagcctgtggcctgacatgtgactgtacacacaaaaaggccctctgggtatttccctggtggcccagtggttaaaactccatgcttccaatacagggggtgcgtgttcaatccctggtcggggacctaaggatcccacgtgctgcatagcatggccaaaaatagggggggggcctattaatgattttactgagagagttcaatgtgaacttgaagacatcataagttcctagggaaaaaaatatgccaaaaataaaatgaacgtttgattcatctttgttgtttttaaaaagtacatattctaatttctatgtgctaactacagactaaaataaacttgaatcctataaagtcaaagttgatgaaaccagcaatgactggattcatgaaatactttggggatttttaagaataatgtctattataaggtttttaaaaagcaaagtgaactatattcaatatcctgtgtaaactataatggaaaagaatattttaaagagaatgtctacatgtgtgtagctgagtcactttgctgtacagcagagatttgcacaacattgtaaatcatctgtacttcaataaaaaataaaaattaaaaaagaaggcttaaaaacacgttttctaatctatgcaggaaaggggacagctggtttattcattataatcatcaatgctaggttttcatagtcagaaaattagtgcactggggtttttctagtgagtccatgggaagtttagattcttctcacaagaagggtgagaaaatataatctaagcaagctggctggctggggccagactcactgatgtcacctgaagtctgcaaagaaacatacctaagaagaaaacccacctaaatacatgaaagtcacaagtcatttaatgagttcccgtattaactctgtcccctgttgacacagttccctacagctaaagaagtaataattatcatctaacttagaattagcaacagtggatacttctcttgtaccacttcgttacttttcaccataaccctataaggtaggtactatcagcccatttcacagctgagcaaactgaggccacgacatatggaagacttgcccgattttacacagttgtaggtggcagagcatagattcaaacccaattctttctgactccaaccacatgctaggaattctaaatctctgcattttattgtctccctatttctaatgatgtcacttcctttaaaaaaattttttttttccttctctgccaaactgcaaaagcttcttggggtaagagtctagttccacccaaagccttgtcttaattacaactaaggcacaaatggcaggtctgcagctcctctaaagaatgctacagagacaagtctgccttgcttatctgagggatcctatttcttattcagaatttaggcagtgtcataatacag

SEQ ID NO: 57786 - DNA, 1376 bp, Bovine  19866881090321
gccttttgcagtagcgtcagctctttttaaaaagaaagtaagctgagctaagggtgcactttgctgtattgcagacatggtgggccaggtgaggcctctgtaggctcctgctttccatgacgagggccagggagacgcccttcgccactcagttgctggatctcagctggaaggggctgccttgcttcttcctctccctttcaccaggtgcctggaggaacggtccccgggcactcacacttggcccgcgctctttgccagaggcaggaccctgtgtgccaagggtggcttgctttccaccctgtcctctgagggcgcttctttctctcctggcctgttgtcttgggaaggatagtccttttgtcttcaggctttgtgatcaagtcatctccagttaggactggcacctgttcccttcttcgcggggcctggtggcctttctgaagtcgcaggtggtcaggagccctccagtgtgtgtcacatctggtcagttgacctgccaggctgggtggttctactgctttctgaatttctaagaatctctttttctttcctaacgagttctgctgatttatttgacaatgtacgtaagtaccatgttctccttgtggtgtacgctctgttctggtttttgtttttaatcaaatgcctgtttgggaggagatgaacgtatttagtctattagatttgcgctgctggaaaattttttttttttaagtgtaaccttgactagctgtcttattattgtttatcctgtaagattagtctatcaattaaagtttgataattaattgcgaaaaaaaaaaaaaaaacgatgttaaagctattcttcattttctccctttgagaaacagtgttgagatttcttgttacaatgcaaatgaatttcaaatccagtctcatgttcacatatagcatattccaaaagatgatgaatctctaaactgtggaagttcacgtggagttagatagtcatgttgcagcctagatgtcagtaaaacgacaagtcagctaaaggtgcatatgtttctgatgaatgtgaagatagatttgggagcccaggtggacctgtatttgccaggaaatttcaccagacacaatattcaccccttcctgcctgactgcctctccacagacctatcttgctgtaccatggcccttatccacaatggggccatggagacagttgttcaggttgctggattaaccagattagcatatgatggcaaagcagagaacgaagcagaggatgtcggggttagtctccttgttgtcctgtggggcaggccgttagagcactctatgcaaactgccttccttattgtacctgaggaggctgccaggtctgtgtggccagcttcccatttttgtcccaa

SEQ ID NO: 57787 - DNA, 793 bp, Bovine  19866881181489
caccagggaagctccctgaatcagtgtctttaatagcgctttaggcaaatagtacacaaagctcagatttattaaaatatttactgacatgattgttgcaggttcccatgaatggtaaaagcagatgaacagaaagtagtcacccccaaagatgaaataggaaaagttccagtagagttccttccacctatcgtttttcaccagttaatttccagttccttgttcattattgcttttaatttctgatctccttgaagatgagcaaaacctggtgaaagtcatggaactggtggatgctgtgtatggtccgtacaagccctaccagctgaagtatggagacatggaagagaagtaccttctcatccagttcagcgaggtgcctctggtaagggcacagcactgccggggccaactgggcatcactgtatctgccaggctagggtcagggtggctgggatgcttcagagaaggtgggagccagcatacagaatgcagagagtgggaacaggtgtgtaaaacatgggctttcagcgcttcctgggctcttgtaatccaaattaaaacgagaccacaggtctgctacctggtttttatttaaaatccccagtaaggacctcgcacccctcagaggcttaaatcttctcaagattaagttggttttctccctgagtcagtcatgattatgcagtcttttgttcaaggcagatatgcaaacagacactggagcggagcactcaaggatagtgctctcaggccaggttcaccaggtggacacaccagaggggaatttcca

SEQ ID NO: 57788 - DNA, 2382 bp, Bovine  19866881295850
ttccctccgctgagggctgcacctgcagatggatccagctgtgagctgatggccaccaacatttgtggcagcgggggatgaagttatctggaaagatctgggcagcccacgtggtgtctgctatgtgcccccagcacagcatttagcagaacctgctgtagcccacttatttatgtatgtctctccatctatcagctccaggaggcagaaaataagattcccccccaccctcgccttttttttggcatttccccatcatgttcaatacatagcatgtgtttagtgactggtgtttaaatttaatttagcagcaaaaaaaaccttggagctaagaatttcctttatgtttgagaaattcttaacgtaggctccacaaaaagagttaatggaaatgcttttggggttggagaggggaggctgtagccaggctctcagaaatgttagcacagagactaagtaaatcctccacttaaaaagctttaaagactctcagcccttgggtgttttcctttacttgaaaagcagagcgcagagtgagcactaggcactgtagatctggacactggccataagactcacatgacggagtggttttatgacagaaatttgttggaaaattcagtgtacttagctgcactcctttcagatgcaatatctagaatacgtaggctggaggaaggaaccagaaggaagaggaataactgagaaaaataatgggtttcagactagagttcaaccttctttagtaaaaaatttgatgtgtctttctaatgaatgaataattgaacagaatgagataggggacgccaaacagaaggcgcttgacaaggattatcaatttagggttgagtcatttcagatctatcctcacgtcaggctctccacccagctggaatggctcatgcctctctcacttcttgtttcgtagactcgcagctgttggggttttaccaggcctgtcccagctggatgagaccatgagcagtgccagggcagcgacagaaagggtcccattgatttaggaattggaggagcagctggaaaggaaagaggaaacaatccacttgggctgtggtaagatgctgtgactgtatcccttttggttctaggattaaacccagaaaagtcagagctcaggatggatcacaacacctttgaggttttgttaatgtcatgatgcttcttccatgtgacagtaagactatgctgtcaaaggagctatgtgtgtttaaagtatttcgttagtcaccgaccaattcagccgtccttcccatcatcttaataacctgccttccgtgtcaaggggtaggaggtgccctactcattaaaagagatagtttaaatgagtttcacatacatgatggctttggatggtttcttttttccatttttgagatcttagtgaataggacactcagcatatgctgactatagtggatagttgaccagaagcctccaggatttatttatttctcccagtaatctcaccattgttgttgttgccatttagtcactaagttgtgtccaactctttgcaaccccatggactgcaacacgccaggcttccctgtccttcactatctcttggagtttgttcaaatttatgtctattgtgtcagtgatgttatctaaacatctcatcctctgccaccctctttccctcttgccttcaatctttcccagcatcaggcatcaggcctaccatgaattaatcagacaaatactcaaactggagtctggcaagataatgaagattgataactgagggacttccctggtagctcagttcgtaaagaatctgtctgcaatgcaggaaacccaggttgggtgggtgggggtagggatggggagagagagagacaatgacagaccacttggaggagcacagaagtagaaaagaggaaggtggacaatctagaaactaaacttcatatggaattctattaaaagttgatggttttacaagggtggtatccttttcctatttgcttagatttccatgaactcctcaagggcagagaccaagcttggtttatctttgtattctcccttcctgattgagtgcagccacagaataagtgcacaaaaagaaagttcattgttgcatggattattataatggttattgcatgaataaattatttctgtattcatggccttggagaagagagggcttagtatgattgcttccttatccgtggggagggtgagcccccagggactgcctgcctcagcaggagaactgatacagtcttggagtgggggttttggaactcaatggaggtcaacctttgaacaacacttcacttcagaaatcaacaatgaacaggagggagaatagggcaggagagatttggatgagctgagtgaagccggtgtttg

SEQ ID NO: 57789 - DNA, 712 bp, Bovine  19866881386588
cccacagagacccaaacagaccttttggaactcaaaccagggcagagaaaacacataaaacagtaacagaacccatccagagatgaaagattaggcatgcagaatcacagggataaaagagagtgtgagaaagaggaggcaagagtcaacactcagactatttcaggtaccagtgggggctgggggagcggagagggaggggagagttggtaagcgtactacccacacccccttcaaggaagcccctataattaagttaatgctaagaggaaagagcccttttatttagctgtcatctgcatgagcagaggaggtgagtcaggcagcccctcaagcagagtggaaaagacccaggagctgccagctgacccagcttccacagtgatcgctgaatgggtggggatacacacaccagtgtctagtggtgtgagtctcagagctgggacaaataataatagtagtaaacactttcagagcatgtgatctgtgccaagccttattctaaattttatatacatgtgtgcatgtatgcgctagtcactcagtcgtgctgactctttgtgaccccatggactgcagcctgccaggctcctctgtccacaggattctccaggcaagaacactggagggttgcccttcccttatccaggggatcttcctgaccctgagatcgaacccagatctcccacactgcaggcagattcttttctat

SEQ ID NO: 57790 - DNA, 996 bp, Bovine  19866881412790
tacctttggtgtcagaaagaggggaaagaagaatatataagaatgctaagttgcttcagttgcgtccgactctgtgcgaccccatctatggggtccaggctcccccgtccctgggattctccaggcaagaacactggagtgggttgctgtttccttctccaatgcatgaaagtgaaaagtgaaagtgaagtcgctcagtcgtgtctgactcttagcgactgcagcttaccaggctcctctgtccatgagatttttcaggcaaaagtactggagttgggtgccattgccttctccggtatataagaatatgtattctcatttaaaaatatttagatgggtaaagttaataaagaaatatggaaagatgaacagaaagtaagaaaggaataaacctggttacttctaggggctggaaaaaatggctgaggtggatatatcattttggctttggcaaatgtgaacacattactaaaaatgagcataagcaaaaaatcattttccaattaaaatatcctatcactctattctagtctgctatctgaagaactcaggatggtaggaagaaaacatgcgaggttgatatcttactacttgttcataaaaacacttaaatctggaatgcactgatgaaaatcccaaaacagagaagatgtgcaagaaatatccccttcaccgaatagcttctcgggtgcttcctacatttggcactatgattgcttgctgaaatcttacctctccaggctgcactgcatccagaagcctgattttttatggatatgggtatttctgctcggccagccaaagattaagctgaccagccaagcatataaaagaattgccagacaaagaaagatgttatattaaagatttctttccgacctgcagggatcaggtggcctcatagagaaatgacaaaatctattttctcttcctagtatgttcttgctgttggcactctctctttatgggagaggctaagtaaagattgcttgcggg

SEQ ID NO: 57791 - DNA, 1221 bp, Bovine  19866881421207
cctgccctaggagatgtggttagcctgctctgcggtggctttggggtcaggagagctgtgccctggtgtcaccacggctcacagtcattcatacactggccttacttcagccattcctggtttgacaggttgcaggtcagaattgctgtcaggaaaagaagaaccccaccaccagcgcactgccagctggtggtgctcagagcccttctgcagaaaggaacttgctggacctcctctccccacagccgcctccgggatctctgtgagtcttgtgggcaggcagccgagaagtgttgctcctgtgtgccgttggccaggctgccgcttttccctgagggctgccctgtgtgccgcccctttaagtccccatccaccccgagtcaggaggacacacgccaaaggccaggacctctggaaagcggtttcaggagtaacatcagcggtagctgatgatgatgtttttggtctttataggttggttttctgttttcttgatttcactagtttgcagcgatgtttgatcgctagagaaatagatcatatagaaaatcctaaataccattccctaaacacgaggttgaatgcgccttctttgcttttatcctgcacatatagtaatatgtggcttgttttacacaagggaggttataatttacaggttgtgccatgctatgggttttttttaactttttaaaaataattttacgtttggctgtgctgggtcttggttgctgctctggtttttctctggttgcagccagcgcgggctcctctctagctgcggggcacaggcttcttgtggtggcctctcttattgcagagcaggggccatagggcgtgaaggcaggtagattctttaccactgagccacgagggaaaccccactgtggttttttatatcacacatctttgatacattttcatcattcatgtaaattggcttcattctgatagttgaataataattcatatacatataatgtatacttcgtcatttccctcttggggatatttacgtaacttgcagtgtggaggcacctgaagagtttctgtagtacagatttatataaatagagttgctataaggtatgaatgtaaacacattttcatagatcctgtccctttgcctctggcaaggctggagcactttgccctccccagacagctccctgagagcctgtgtccctggtggagacctccgaactgggttgagaggagctg

SEQ ID NO: 57792 - DNA, 1358 bp, Bovine  19866881763236
tctgcaaagtacatttcccaggcaccactgccactggctggctggtttccagctctgtgtgtgtgtgtgtgtgtgtgtgtgtgcacgctcagttgctcagtcttgtccaaccctctgcaactccatggactgtagcccaccaggctcctctgtccaccagattctccaggcaagaatactggagtgggttgccttttctttctccaggtgatctttcagacccagggactgaactcgtgtctcttctgtttcctgcattggccggaggattctttcactgcaccaccgggaagccctggtttccagctgctgctgctgctaagtcgcttcagtcgtgtccgactctgtgcgaccccatagacggcagcccaccaggctcccctgtccctgggattctccaggcaagaacactggagtgggttgccatttccttctccaatgcatgaaagtgaaaagtgaaagtgaagtcgctgagtcgtgtctgactcttagtgaccccatggactgcagcctaccaggctcctccatccatgggatttttccaggcgagagtactggagtgggtacgctaacctgagccaaaaactgacaggggatggcatggtgggctgaagggaggagccagagctccttcccaacctcagagagtgttttccaacagaggctacatctcctccatggtttagctcttcactgggcagcccctgctgtgactctagctcctcttggatggccccagagacggacacccctgccctccgtgtatcccagcagtgacagcagcttcctgccattgctcagccagggtggtttcaccatctcctcttatcggctcttaactcatttatggaatcaattccttgatgaagttccccctgtgtgaaatacctggagtggttttgattttttcttataaaacatacctggcccctgacctcaggacacgtactggttctttatctgcgtttacttgctttgtgactcttggcaaattactcaatctctctttactttgttctgtctccctgtcaggaaaataggatgaaaatggtatttccctcatattcctgttgtgaggatgaaatgcaatgatgcatatagggtggttagcccatttcctggaacctaacattaggtgttcaaaaatgtgacctattattctaggccacaggctacagactgtacccgacactcccctctcccctccactgaccaggggacatcaagtgatttcttcctctatgactccatagagatacagcttgtgttcactgagcacctactgtttctaaggtcttaactcatttactcttgataaatgtatctaagccataggtattgctcttctccctattttc

SEQ ID NO: 57793 - DNA, 826 bp, Bovine  19866881832672
ttgccactggaccagaggaccgcgcttggtgggccagtcatgtcctttaccactgtgcgttagaatcgcccatagacagaccctgcagggcagaggggaaagcagatcccaggccttatgcaggcctcaggttccatgggctgggcagcctgtctggacccttcctcaggaccctcatctccatcctcctcctctttctctgcaaccatttacccagaactctttgaaggtgacacaatgccagtcgttgtaagtcataactgacaggttcaccctggcctgtcgacttcacaatccacggtgaagaactgtgatgcaaatgagatacgaaaagagtttagcaatgattcaagtggtgactaaatctagaaagtcattgaataaatacctgtgtaacaaatatactttgtggagttttgagtaagtaggagatgcaatgcccgttgcatttggagatgataggctagaagggattgctcgtctgttgaagtgaggaagacttcctgaagaatgtggaaccttaagaactctttcagggaagagaagccctgaagatctgaatgaagctgaaagagacggatttttgttacatttttgtcatggtgtgaacagaaaattccaggcttgttacagttattccttagcacctactaggtgctaggcatttgtgcgtgttttccaagtcatgcttggcctgatgagtggagagagctaagcctggctgagatggcccaatgtaggatatgagatctgagcagctcacctgtctgggcaggattccacttcagaaactgcatggcttttgggggggctctttgtcacaaaa

SEQ ID NO: 57794 - DNA, 890 bp, Bovine  19866881921174
aaacatgatttttaatgactgtacaatatttcacatgtatttcacattttaatgactattcaatatttcacatagatcatgagtatcataatctatattttatttgttattatggaagatttaggttccttccgggtctttgttataacaacactaaaatcacattaatcaattttaatatattaatatttctttgtccctctgattttttccttagatttctaggacagaaaatgccaagttctaaggatgtaaaaagttttaaggcttttgatgcatattgctaattttccccccagaaaaaatataaatttagaaaaactttttctttgcacccttcccaaagatagctgttgtaatttttcagaagtttttccagtttgttaggaggaaaatggcacttctttgttttaatttgcttttgtttgaagactagtaatactgaacatgaagtgttgatgagccatgttctcttcattggagtgtcttaacataaatatcctctcttctggtcttcttgtaggacatagctgtgatttcagccaagctcacaggtatgcagaacagcctaatgatgctcgttgatacaccagactactcagaaaaatgtgtacacttggaggcgttgaagaaccggctggaggccttggccagcccccagatcgtagcagcattcacatctcagtctataggtgagtgctggctgctttcctgtctctctgtacacctctttatttttttatttttttttaaattttattttctttttaaactttacataattgtattagttttgccaaatatcaaaatgaatccattgtacacctctttaaacagataaggctttccatgtcttcagtcttggagaatgtcttaattttgattaagtt

SEQ ID NO: 57795 - DNA, 2564 bp, Bovine  19866880155799
ctgcttttgaattgctgtctaggttggtctaactttccttccaggagtaagcgtcttttaatttcatggctcaaatcaccatctgcagtgattttggagccccccaaaaaataaagtctgacactgtttccactgtttccccatctatttcccatgaagtgatgggactggatgccatgatcttcgttttctgaatgttgagctttaagccaactttttcactctccactttcactttcatcaagaggctttttagttcctcttcgctttctgccataagggtggtgtcatctgcatatctggggttattgatatttctcctggcaatcttgattccagcttgtgtttcttccagcccagcgtttctcatgatgtactctgcacataagttaaataagcagggtgacaatatacagccttgacctactccttttcctatttggaaccagtctgttgttccatgcccagttctaactgttgcttcctgacctgcatacagatttcttaagaggcaggtcaggtggtctggtattcccatctctttcagaattttccacagtttattatgatccacacagtcaaaggctttggcatagtcaataaagcagaaatagatgtttttctggaactctcttgctttttccatgcagctctctgtagctgcaggcaaatcacaggcagtagcccaaaagcagacattggataaagagtcacagagacacatcaaggacagagagagaggcaggagaagggacctgacaggatctggaggaggctctggctggggccactagacagtacttttaacatggtagaaccaggaagtccctatcccaagaaattatttgatcaatcaagaatgattaagaacagtgtgatcacatgaaggatgcagatgtgttttcttggacctgtgtggccttataaaaataaagacatctggggacttccctggtgttccagtggctaagactttgcactcccagtgcagggttctggggttcaattcctggtcagggaactaggtcccatatgttgcaacaaagagttcgcacgcccaagaaaaagacccctgcatgctgtaatgaagatcaaagattcttcatgcctcaattaagacctggagcagccaaataaataaataaatgtaaaaaaaaatttttttttaattaaagcaaggacatttgatagaaaaaaaaaagaacaatgtgaccatagatatgctacttacattctcttcatctcaaactcttcatgaaattaataaaagtgcccaactcaggattcttgtgagtattatgcaaaggaacacacacaacggattctaatcactacctatagtatcaaattaataattattaatttaatttttaaaactccttcatatttaatattataattttatattcttgggcagtgggcctctcttagtgacataatagtattataccagattcaaattatatgcagaagataagaataacaccaggcaatatgaagaatgtattttcagtaacatatcagaagattgctaaactgcataagaaaaggaagggaaacacagcttggctatacctaatgtaagcaaaaatacaactcattttgacactgaggtagaaaaaagagctagaagcttgaataccatctcagtttatcattttgcatcattttaaactctaaattcacctatgggtcaagaagatctcaatcctttgtaggaattgttatgagaaaaaaagcatcaaccaagtgtaatggaaagaaagagacagtaaacaaaaaagcaaaatatttaaacttaagagtaaggtgtgtgtgcacactcagtcctgtctaactctttgtgaccccatggactgtaacctgccagtttctccagtccatggaattttctaggcagtaatactggagtagattatcatttccttctccaggggatctttccaacccagggatcaaacccatgtctcctgcatcttctgcactggcaggcagattctttaccactgtgccacccaggaagccctggaagcaaaggaaacaaatgtaaatatgctgatgttcaagctgtttcctatgctgcgtgtgataacttcctgtctctgactcagggggttcatgttttctcacaatcatgaagcagcaacaagctaacttccgagctttagaatgtgtcttgtgtgctcagtcacatcagtcgtgtccaactccttgtgaccctgttgcagcaagggggaccccttccagggcctgaaactaggctcttatctaacggttggaaatgaattgtctgagaagacacatgtgctgacaaagcaagagattttattgggaaagggcacccaggtggagagcagtagggtaagggaacccagaacagctctgccacatggcttgcagtcttcgggttttatggtgataggatttagttgtctttagccaattattttgactcagagtccttcctggtggtgcaagccttgttcagccaagatggatgccagagagaaggattcttgggaggtggtcagaatgtggtatctccttttgacctttctggaact

SEQ ID NO: 57796 - DNA, 2382 bp, Bovine  19866880240016
agggttccccttttcttcacaccctctccagcatttattgttggtggactttttaatagcagccattctgaccagcgtgagatggtacctcattgtgattttgatttgcatttctctgataatgagtgatgttgagcatcttttcatgtgtttgttagctatctgtatgtcttctttggagaaatgtcagtttagttctttggcgcattttttgattgggtcatttatttttctggtattgagctgcaggagctgcttgtatattttgagattaattctttgtcagtgcttcatttgctattattttctcacattctgaaggctgtttttttcaccttgcttagtttccttcattgtgctaaagcttataagtttaattaggtcccatttatttattttttattttatttccattactctgggaggtgggtcatagaggatcctgctgtgattaatgtcagagagtgttttgcctatgttctcctctaggagttttatagtttctggtcttacatttggaactttaatccattttgagtttattttggtgtatggtgttagaaagtgttgtagtttcattcttttacaagtggttgaccagtttacccagcgccacttgttaacgagattgtcttttctccattgtatattcttgcctcctttgtcaaagataaggtgtccatcctgctgctgctgctgctgctgctgctaagtcgcttcagtcgtgtccgactctgtgcgaccccatagacggcggcccaccaggctccccggtccctgggattctccaggcaagaacactggagtgggttgcccatttccttctccaatgcgtgaaagtgaaaagtgaaagtgaagtcactcagtcgtgtccgactcttagcgaccccatggactgcaggcctaccaggctcctccatccatgggattttccaagcaagagtactcctagacctggtcattcttttgactatcgactcacatgatcaattccagttgacagcagagtgtcatcattttaatttatatttatattaatgtatatttataatttatattaatatattaatttgtagttacattttaatttctgtggaattatttgcactctctatcctgaaatgtcccttcctaacatcaagttacctagaggtgagtttaatcagaatgctgattgatgagcatagatgaaaattgctttgggaggaagttttatgtaaactttagtaaagctcaatgaaatatccatacttcaccactgaaaagatgatttgatgtccagatcatggaatctccaaatgtggtactctttcaccatcaaaagtatgagttctctcagtggagtagagaaagtggtaaggaacaaaattgataagctatatgtagcttatcagaatagtcccccccaaagatgtgcatccctggagcctgtaaatatgctttcttatatgacaaaaaggactttgcatctgtagctaagattatggacatggaattttctaagtgggtgggatgaaatcacataagcccttcaaagcagagaagttactttagttggagtcagagaaatgccgtagaactgaggcaggaaagggaatcagagaaacttggaatgtaaggagagtttgaagtgctgctgcttgttctgagtgtagaagccacttacaaggtctggagagaggtctttaggagtgaagggcagcccttgtctgacagccagtaagcaaatggggcctcagtcctacagccccaaggaacaagattatgacagcaacttgagtattcttggaagcaggttcttccctggagcctcccaaaaggaaattagctctgctcacaccttgatttgatctgtgaacctggagcagaggaaccagctgcccatacttctgatgcataaagttgtgagataataaatgttttgagtgttgttttaggccttaaaatttgtggttatttgttgctttagcagtagaaaaccaaaacactatgttagtatgttcaaattcaatctaagaaaaactagctgagaaaaatgacgcagttgtgcatgtgaacatacaccccaaaagagaattcaaaggacaagggcagggaaacctgaggtaggtcattcaaacaccaactgttatctgtaagataatgaaagctccccatctgtttctctgcataattgtgatcaaaggagcataatgtgttttgcacatatttggaagaaaacaaactacatcaggattttcatcaggggaggactgtacaggtgttgaactgcagtccaggacactcaacctatgttataatggcaaggaggtagatgtacagatttaggtgagtaagtgagcagtcatagagtgccagggaagatacataccccctcaatca

SEQ ID NO: 57797 - DNA, 1710 bp, Bovine  19866880342080
gatagcaagtaagacttgagaagatttgagaatgtacattcttacagttcacacagcccctgagtgtcaatccactcagaatttcatttctagatgcttattgaagacaagaaaattaaaatataacaattagatctgatacttcagggtctaaaatcccacgagattctgcttgactaaaaatggtccatgcagaaactttcaaaacatgaaattagtttgaatatattacaaactcttctcacacatactaataacatacaaatgaccttgataccagatcacagagacagtcgtagcaagcatgctaattcaatgttttgagtaataaactggaaacagccatgtgtcctaaccaccactctatgcacacgtacagtgcatagtgactgagtgttcatgagacttggaaatgtttaaaataagatccctgacatataaaggctcagggttcaatggggaagaaaaattcataagggttcaatttacacgtgaaatagaggggtcatgggtgattggaatacacagtttatgtagaataaagatcttaagctgaattcgctgttttgcaaaatatttaattatttggcttttaattcactagctacagattgaaaataacggttgatggaaatcaatttttagcaaaattgttgtgttgttcagtcgctaaattgtgtcttactctttgtgaccccatggactgcagcacaccaggctcccctgtccttcacttactatcccctaagtttgctcaaattcatgtgcattgagtcagtcatgctatgtaaccacctcatcctcttccatccggtctccttttgccttcaatctttcccagcatcagggtcttttccaatgagtcggctctttacatcaggtggccaaaggactggagcttcagcttcagcatcagtccttccactgactattcagggttgatttcctttaacattgactggtttaatttccttgctgtccaagggactctcaagagtcttcttcagcaccacaattccaaagcgtcaattctttggcacttagccttctttatggtccaactctcactcttgtatataactactggaaaaacctatacggatctttgttggcaaagtgatgtctctgcttttttaatacgctgtctaggtttgtcatagctttcctcccaacgagcaagaatctttaaatttcgtggctgtagtcaccatccacagtgattttggagtccaagaaaataaacctgtcaccggttctactttttctctatttgtttaaagtgatggcagtggataccataatcttagttttttgaatgttgagttttaaaccagctttttcactctcctctttcatcctcatcaaaaggctctttagttcctctttgccttctgctattagagtgttatcatctatcatctgtatatctgaggttgatgatatttctcctggcaatcttgattccagcttgtgtttcatccagcctggcatttcacatttagcaaaatagtaagccctaattctgaattcttccttttaaagatatccatctcttctgcctctaatgggaaattaaggtctcagtgctacatcattttgaaaaatctactgaaaaatagatttgaaaaataagtctgttgaaaaatataaattcagacaacctattgtttagttgttctcaactgcaccaaaataacaatttgagtgctg

SEQ ID NO: 57798 - DNA, 2340 bp, Bovine  19866880440310
tcagtcactcagtcgtgtccgactctttgcgacctcctagattgcagcatgccaggtttccctgcccatcaccaactcccagagtttacccaaactcatgtccattgagttggtaaagccatccaactatctcatcctctgtcatccccttctcctcctgccttcagtctttcccagcatcagggtcttttccagtaagtcaattcttcgcatcaggtggccaaagtattggagtttcagcttcagcatcagtccttccaatgaatattcaggactgatttcctttaggatggactggttggatctccttgcagtccaagggactctcaagagtcttctccaataccacagttcaaaaacatcaattctttggcgttcagctttctttatggtccaactcccattcatgactactggaacaatcatagctttgactgtgtagacttttgttggcaaagtaatgtctctgctttttaatatgctgtctaggttggtcatagcttttcttccaaagagcaagtgtcttttaatttcaaggctacagtcaccatcagcagtgattttggagcccaagaaaataaagtttctcactgtttccatggtttccccatctatttaccatgaagtgatgagaccagatgctgtgatctttgttttttcaatgttgagttttaagccagcttttttcactctcttctttcaccttcatcaagaggctctttaattcctcttcgctttctgccattagggtggtgtcatttgtgtatctgaagttactgctatttctccctgcaatcttgattctagattgtgcttcacccagtccagcatttcacatgatgtactctgcatataagttaaataatcaggggccctctgggaaatcccaaagttagttcaaggtcaaaaagacttcatttagaatttgatttttggtaagttttccaaactttttaagagattaaaaagaggcagcaagaatacacagagaaactgtacaaaaatgacccagataatcatgatggtgtggtcactcacctagagccagacatcctgtaatctgaagtcaagtgggtcttagaaagcattactacaaacaaggctagtgcactggaaaaggtcagttttcattccaatcccaaagaagggcagtgccaaagaacgtacaagctactatacagttgcactcatttcactggctagtaatattatgctcaaaatccttcaagctagacttcagcagcatgtgaaccgagaacttccagatgtgcaggctgagtttagaaaagggagaggaaccagagatcaaattgccaacatctgttggatcatagagaaagcaagggaatttctgaaaaacatctaattacgcatcattgactaactaaagcatttgattgtgtggatcacaacaaactgtgggaaattcttaacgagatgggactaccaggccaccttacctgcctctgagaaacctgtatgtaggtcaagaagcaacagttagatggaacaacagactggttccaaattggaaaaggagtatttcccaatacaaggctgcatttttaacttatatgcagagtacatcatgcaaaatgctgggctggatgaatcacaagccagaataaatattgctgagagaaatatcaccaatctcagataagcagatgaaaacacccttagggcagaaagtgaagataaattaaagagcctcttgatgaaggtaaaagaggagagtgaaatctggcttaaaacttaacattcaaaaagctaagatcatggcatctagccccatcatttcatggcaaatagattattctctcaggctccaaaatcactgcagacagcgactgaaagcacaaattaaaagacacttgctccttggaagaaaaggtatgacaagcctagacagtgtattaaaaaagagagacatattttttctgtcaaaggtcccgtatagtcaaggttatggtctttccagtaatcatgtatggatgtgagagttggaccatagagaagggtgagcactgaagaaatgaggctttcaaattgtggtgctggagaagactcttgaatgtccctcggagagcaaggaaatcaaacaagtcaatcctaaaggaaatcagtcctgaatattctctggaaggactgatgctgaagctgaagttccaatactttggccacctgatatgaagaactgactcattaggaaagaccctgatgctaggaaagattgaaggcaggaggagaagggtgtgacagaggataagattgttggatggcatcatcaactcaatgaatatgaatttgagaaagctctgggaattagtgaaggatagg

SEQ ID NO: 57799 - DNA, 4335 bp, Bovine  19866880448854
tagcctagacatgaataccaggctttcctggcagctcagatggtaaagaatccgtctgcaatgcaggagacctgggttcgatccctgagttgggaagatcccctggaggagagcatggcaacctgctccaggattcttgcctggagaatccccatagatggaggagcctggcgggctacagtctatggggtcgcaaaagtcggacacgactgagcaactaagcacatcacagcatacagcacagacatgagaataccaggctcagtggcctcaagacaaaactggaatcatctttgggtgtcctatttcctctgtagctttatttgccagcatgttaactgatacataaggccactctgctcaagccagggattatagaccctaaggagcacatggccacatgccaggagaacaagaagctgcaggataaacatgagacattttcctcaagtgccaataataggggaaattccttttttttaagagcattataaactagaatactatacaaacatggagtaaaatgcaaaattcatggacttttaaaataaaatgaatcaaaactataaataaattttgagcctgaagcaagagcttccaaatccttccccagatctccagggtctaaatgtttatctttctcctccattaggggcactttgatgggtatttgagaaaaactgtcttaagacacctctcctagagtcactgatattttaaaaagatactcttaatgaaaaataaaatctgttaccaaaaaaaaaaaaagagagagagaatgaattaagggaaaagaagtatttacagtacatatagcatatacttatggcactagtcctcgttgtatgaaggtggaatctgagattcagaaaggctgaataattcatctgatgccacactgagtggcaaagccaaggcaggcaatgaatgtagatcgtgagtaaggagatccttttctgaaacccctatatcattgcccatggggcagtcattcactccacctctggaaagagccctgggatcccctgcagttggtgtgtggctgcagcactgccattttgctctaggaaggattctacccacgtgcctaccagcaccacaacaccctgccagactcagagagagtgagcttacgtttatttcctcaggagatatttctcattttttcccaattttatcgaggtaaaattgacataaaacatatcctaaagaaaataaaccctgaatattcattggaaggactgatgctgaagctgaaactccaatactttggtcacctgatgtgaagagccaatcattggaaaagaccctgatgctgggaaagattgaaagcaggagaagagggcaacagaggatgagatggttagatagcatcactaactcaatggacatgaacttgagcaaactgggagatagtgttggacagggaagcctagcatgctgtaattcatggggtcgcaaagagtcggacacgacttagcaactgagcaatgaacaacattgtattagttaatcatattagtgtaccatgggacttcccaggtggctcagtggtaaagaatcctcctgccgatgcaagagatgcaggagacatgggttcaaactctgagtcagggaagatcccctagaggaggaaatggcaattcactccagtattcttgcctggaaaaccccatggacagaggagcttggcagggctacagtccatgggattccaaagagtcagacacaacttggcaacttgagcacatacacacacacacacacacacattagtgtacaatatgatatttgatatatgtgtatgtttcaaaatgctcattatagtaagtttaattaacatccatcacctcacacagtaacaattttttttcccatgatgagagtttttaagatctactctcttaaacaactttcaaatatatgatacagtattgttaactctaatcactatgctgtatgttttatccccagaacttgtttatcttacaagtagaagtttgttccttttgaccatcccatttcctccatgtcctattctccaccactgtttcagaaaacagtgtattctgttgctatgaattcagattttgcagactctacataaaagtaagatcatgcaacctttgtctttctctgtgtcacatttcatttagcataatgccctcaaggtccatccacattgttccaaatggcagaatttccttctttttatggctgaaatttataaatatcacatagttttactcattcatccaccgatggacacagattcaacccatgtcctggctattgtaagtactgccgcaatgaacatgggggttatcagaagatatttctgttgtcctctgtgtatccctccagccaagccagggatagttttgatgagacagacttgctatgcttggcagtgaaaaagaggtctttgaaggaatcacatgaaaatttaaaaatgaccaagctgaggatgcctgactattttggttcttcttctctctgtgcctctctctgagtctctaaaactgttcctttctcagtttccacttttctctgcctttttttttttcctttctatccattctctatgtcttcctcttctatccatttttctctttatttggtttgaaaaatttgcatcatttgcttgaagacctaaatgttaagactggatactataaaactcccagaggaaatcataggcagaacactctttgacataaatcaaaaccatatttttttggatccatctcctaaagtaaaggaaataaaagcaaatatcaacaaatgacacctgcttaaacttaaaggcttttggacagaaaaggaacccatcaataaaatgaaaagacaacatactgaatggggaaaaacaatttgcaaattatattcccaataaggagttaaatttatatattcccagaatatataaacagctcatatagatcaacaacatatacaagaaaagatgtttaacactgctaatcatcagggaaatgcaaatcaaaaccataaaaatatatcacctcacacctgtctgaatggctgtcatcaaaaagttgcaaataacaaacgttggcaaagatgtagagaaaagggaatatgcttacattgtcagtggtaacagaaattggtacagccactgtagaaaacaatatggagaattttcaaaaaaataaaaataaaagcaccatattacctaccaattcctatatatataactactagttatatatctgagaaaaacattaacttggaaagatacatgcatcccaatgttcatagcaccattatttacaattcccaagacatggcaacaacccaagtgtccgtcaacagatgaatggataaagaagatgcgttataaatatagaatggaatactactcattcataaaaaagaatgagatattgccattagcaaaaacatagatggacttagaaggcattgttaagtgaaaaaagtcagataaagacaaatactgcatgatatcatttatatgtggaatctttaaaaaatagatttttttttaagaaaaacaaactagtgaacataccaaaaaagaagcaaactcacagatacagagaattaactatggttccagtgggataggggagaattaggaggtacaaacccctgggtgtaagataacctcaaggatgtattgtacaacatggggaatacgtgaatattttgtaataactgtaaatggaaagtaacatttaaaaattatataaaaacttaaaaaaattttaaaaaggaaaaactgtgtcctttgcaaacaagcctgaggacataagcattacaattatgtaattaaaatatgtaaagcaactggcagccctagtacattgcttggagttttttgcatatttattaatttatttattaattataatttaatttgaaatattttagcctagactgagatattctgaatatgctagtttaagctcccactccaggggcagtcagctgccttaatggaaaacctatactcctggggtgcccagttagcatcacatttgagaggactgttctagaagcagctactgcaaatgattttgtcttctgtagtctcaatcagtacccaaggttttctaattagtgaagtaaattttagaaatatttaaaatggtgatttattaaataaatgaatggctttttagagtatcacagaagtttccacatatttgtaacatcactccttaaatattttattttacagaagtgaaacctgaggttcaaaaggttaaaaatgtgctttattggtaaaaattagatgtattcaagatgtatagactgaataaaatatttataaggccctctgcatccttg

SEQ ID NO: 57800 - DNA, 1824 bp, Bovine  19866880493544
accaagcaattcctggagatattatttatcaatggatattataaaaataaccaatgaatccaacactgtggaatgggaacaaacttcatgtacatatctgtatgcatgtatatgtacacacacattatattcaatccatgtgcatacatttaaataggattctgtgtgggcttagtgttcatttccaatcccttggggctctgctgcatcccatgcctcatgctatctgtgtggccaatggatctgcatcagagtcctgaatcctgctctttttgtatttttgccatgttggttttcaagctgctatacttttatattattatttgacagcaaacactacttttcctaatttgtcatggctaaatttctgaaaagtgtgctcccaatccactgcttcatcacatcatgtgagaattcttggaattgtactacttttataactataccactttattctgtatttttttttttaccatttttgtacttttttgtttacagttatttattgctgtattacttttttcactctgctagaacttctgcactaactgtagactcttaaatcactagtttaggaagggaaccaagaggtcaaagaggaaagaacagttatttgccaaactccacttgcagctggacaccaagaatatatcacagaacaggttgactgcctatgactttcataaaagcttgattttcattagatttcccctccaactttttcataatctaggcttcctgctctgtgttaattatatttctgacccaaaaccaacaaactaagaggctgcatgttgtgatggaaagcatgctggaccagacgccaaaaactgtgtggtttagggccaattctagagctaaccagctgtgtgaccttgcacaagtcacttcatctctcagaaccgttgttccctcgcctctttaatgaacagttaataaaattatgcctatgatttcttcccagtcaacgttatgttattctttgatgctgattgctcttcttctcacaattaatgtactatatataacaacaaaatcgacaattcttataaaccagactaagtttttattactacttccttcaaaacataaattactattcaggagctatataatactaaaaatgaacactatatgcaatttaaaaaacaattttgttaaatttatttcaggtatgattcagcaaatgaggtatttaacatactgctgtgaaagtaaaccttggttttaaatcccagcaaataaaaactggatctgaaaaactggagctaagattggctgggatccatcatctttatgagagtagagggagttagaatataccatttgcctaagaaccggacagataatctggaggaagagggcagagggtggtaaattggtgggaaaattaaagatacattttccccagctgtttgatttttcatgctattgagttttgaggttatagtacgtagctcatatatgaaacatcgctaagaggaagggaactcatttaaaattatgttagttgtagaattataactagatgtaaagcaaagaaagtagttatctattattcattccttctgaatagacatttcctgtctgtgaatacaaagcatgactagaattcacttgctgaaactcggagatgctatgagaaaacatttcttcctcgtttgatctgaccttgtgtatgataatggagcttctttaaaatactgtgacactagtctgttctccatatattgcacccctgagaattattccttcctctggtctcatggggtggaaattaacctcagagggttttagtgtcttgtccaaggtcatcccaaggct

SEQ ID NO: 57801 - DNA, 1647 bp, Bovine  19866880495383
ccttgccgtactcctttcccagttgttccatgtccagttctactgttgcttgttgacctgcatacagatttctcaggaggcaggtcaggtggtctggtattcccatcttttgaagaattttccacagtttgttgtgatccacacagtcaaacgttttggcatagtcaataaagcaatagatgtttttctggaactctcttgctttttcagtgatccaacggatgttggcaatttgatctctggttcctctgccttttctaaatccagcttgaccatctggaagatatggtaagtaaattagaaataaacttaaggaaaatagtatagaaataaaaaggcatttttgaaacacaaaataaagaaataaaaaggaaactttgaaatttaattcttaaaataactgaaccaagaattctgtcttaaagaatgacagcaggatacagaaacgcaaggaatgatttgtcctttgaaacacaataagagtatctcaagctattgtgttaaactaaatgattccattttatatacttcatacacctttggtctcctagtcaagtgtctatcaacacaaagaataccagtgtgaacctcactaatgagtaaaatctatgtgaaggatttatctttgttcctgtgtacaccattgtgttcatcaaagatttgaataaaatagtagagagcatacttcacaaatgtgtgtgacgtgataccaaaaggcataaataatatgtcaaaatagagtcttaaatctctaagatgctgcagtctggaatggtggggcaattaataaagactaaattttaaaagattaaatgtaaatcctgtaattataggcccaggttcacagtaaatagtgtggaaaggcctgagataatatagtcaactgtaagtttaataatagcccgcattgtgtcactgattatttaaagagcaatgtagtctcaggctacattacaagaaagagtatcatccaattactagctagctatttgttactctctactaggtgctgatcaaggaaagtaactatcacgactttgtacatgattaatttgccttgtgagtatttgtgttctgtttgaaggcctcctacatgggagattcaagctccttaacttcagaaagcaaaactacatataaagatctaatttataaagactgatttcagatcatttgaagggaattatttctcaaataatctgaaccatgttatcagtgaatatttgcccagaaatatgggcactaggtaaattatgttcaccagaaactatgataatttctccattaaaaaaaaaaaaacagagtcagaaaagaaattcaggctttcccctgctttcacctggattgtcaaagatgagaatgtgtgtctatgagctgttcaaacatggtggatgggccagaaaggaggaagggattggcagtgactggcaatacaggagaaaatggatgtcattactggtcataacaagcacaacactgtacatatagaaaatactgtctagagaagcttttggagaatgtttctttgttgtctgctatataaaatctcttagctgactctcttctgaaaagtccatcataaagatgtacttgaaattctaattacaatcaaagatgttaaagtcagactcttgttccacctgtgtg

SEQ ID NO: 57802 - DNA, 1574 bp, Bovine  19866880505811
actctaattttttcgaggctgccttcttcctgagctttatctttcccaaaatcttacagccactgatcgaagccctctgccacaactcgatattctttattttatagaagtatcaaaaaatttcaaagtccagcttaaattccatggtatccttaaggcactccatgattttcctaatgagaattaattattactcattcttcacttaagctatactttgaacttcagtttgagcacttaattccttctgatttgtattaattttgtgtactggtatcctgttttagatattataataaactctttaaaaacctacttctttataacctccaaccattttgcctactattttgtctatactgggtgttcaacatgtgtttattgaatgaatgaatgaataatctaatagtattttagtatttacagtgtcttccattaaagcaagaagtttgcactcacaggcttatttatatttctcctttaaattccccagtgcctatcactatgtctgatagagtcagcacccaaatagctgataaatgacaaagaagtgaatgaatctcttcctctgtttcacagacatgcacaaaatttttagaatttcaatccaagtctttcagaagcatgaactcattggaagcaaatacctcaaaacagctattgcattcttgcaaaaaaattattgtggaatctgtgagaacatccaattggcagatacacgaccaaccgcaacacatcaatggcatacaacaataagtgattcttactcattcctctgagatggttgatttggcaactctgctaatcttgactgagcttgactgagtggttcttttggtttcacttggataatttcacatgtatagggagatctattgttgtgtggggttctgttcagtttcagccaatatagtatgctcttggctggaatgactgggccaattcatctttgtctcaaatgtctctaatcatccaatgaactagtacagactttattaaagtgacaaagagggtaagaatgaagacaagcctgattgcacaactgctttcaacctttgcttatgttatgcttatcaacaactcattggccaaagcaagtctcatggctgggatcagagtcaacatgaaaaggaactttaaagtaatatagctaagagggatgagtggggcaattggaaccatttttgcaaacctaccacaaaagtaaagcctaaatatggctcacttaagtcttttgaccctagtacataatagtaggctcaacaaagacttgttgaacagaagcacggatcaatggatacatagatgaatagatgaattaatgaagctagtttatgaagctcttaacaaagattagtcatcaataattcatattaacttgatggcagcaagaaaacatttgtccagaggtttctacaagatccaatataatatcttacaaaaatagaaacaaggacacacttattggatccatcaagcaactctggggatgggctctcagaatccttctctaatgaacttgaaatactttccaaggcatctacccttctttgttatcttcccatgtaattaag

SEQ ID NO: 57803 - DNA, 993 bp, Bovine  19866880587847
actttctctcacttttttatgcttttccatcatttgaaggtggcaataaacaagaacaatttccctggaatgcccactggggtaagtggatgagtcaatttttaagtgtcatcaaattcctaaggtcaagttgaagtaaagtagtcagatgatattggacgttgattctaaaatgtgcagaaaaggaaagttactcagggatacaagaatggctcattcatatttgttcctatttatacgagtgaaaatactgtggttatgataacaggtttagttgtaatttctttctagggtacttcccaatatgcattcatctttcccccatttttttccaggaggttgcaaggcccatatggattcttgtggctttgtcaaatgttgagtttatgtctttgtaataaccccagcactttaaaatgaccactgtaagtactagctttacagaattgtcctgtctcttgggctactcatttccaaaggagactacactacaagtgacttgttttcaatttgctttacataccaaggcaataagaaaaaggtctaagcttttagcaatagtaagttcttcccctaagactccaattatgatggagtgtcaaaaaacaacataaaatctttacttcagcacaatagggggaccaaagggattcatagctcagaaagccagaggtctactgacaattaaggacttctgccaagaagaaaatatccataaaacgacaaataaggacatagacctatatgttgaaggcataaaacatctgacggtatgagcagggctcctgggataaggaactttcctttgacttatgcatatctaaggcatttaactctactttgttctaaatccctatacagttatgttcattcttccattatgttagtctctcaatcatgtccagctctttgagaccccatggactgtagcccgccaggtccctctgtccatggaattctctaggcaagagtactggagtgtgtagccattcc

SEQ ID NO: 57804 - DNA, 2737 bp, Bovine  19866880606905
ccaagaagaatcaggtttagcagattctatcccagctgagaggacaggctagcatacaatgttggcaaaaatgatatcttctcagccttggaagactttccttgagctactagaaatgccagagaggaaggtgatgactctttacaaacccctgtttctcaggccctctgatcacagtcattctcttcagttgatcacacaggcttctatcaagtcttagcaggcctcatgtgtattatttatttgattaaaaaaattgtgtcatttgcttttaaggagcctctgggaatgagcataattaagcatagattaaaatgtctgaaagactgaaaaccactataataatatggtgaaatgaacataagaagcttgaaaacatcctttacattgtcattccatcaaagcataccaattttgcaatgatacccttaaaactgattctcactggaaatgatcaaattgacatttcagctgcttgaacacaagcagtgattctacaaatttgggaagattaatttggaaaagagttcatctgtaccatcaaaggaagcataaagggcatcagtcagatttgatggaagagaagaaagagaaggaagaggagaaacaggaaaagaagaggaaggaggaggtgcaggaagaagaggagaaggacccactgagacaccttagcaaacaccgcaaaattagctggagattgcataccaatatctgaacactttctatgagctgggccatgttccaggtaacacttgctatgagctgggccatgttctaagtaagatggacagactgtagagtgtggagagattttgaacaaacaattcctacctacataggaaacacacaatatataggatgggaagttgagtgaagagaaaaatgcagccctgtgatgctctggggagagattttccctgcagaaaggagtagtgagggcaaaggccaggaaatgaggcagaatgcctgtgcgggccaggtcaccgcagtcctatctgattctttgcgactcaatggactgtagcccgccaggctcctctgtccatgggattctccagacaagaatactggagtgggttgccatgccctcctccagggaatctttcagacccagctattgaacccatatcttacatctcctgcattagcaggtgggttctttaccactagcgccacctggaaagaggcagagtggtggccaggttatctttcctggagtgtccttggggaggggagtagatgtgtgagtcagggtggacagtgaccaacactgagaacaggatgtccttcacaccctttctgaagggctgcttctaggtacctcgaatagtaggtgctttgggtggcaagtaatagaatccctaactattggtagatacaaatataaggcttaaagttttttttttttttttaatcaaacaatacatcagaaagttggcagcttaaggctggtgcagtggctcaatggcattttcaagttcctggcacttttcttcccttgtttctatcctccgtatgttagaggtgaattccctcatggctgcaagatagatgccacagcactaggctctgtgtcctcacgtagcagcagaaccagcaagaaggaggatgcaagcaaaaccattttcctgtggagagttctcctctctgagaagaaaatcttccccggaatccacccatagatttccccacacacttgccttaacaggactgactgggtgggcagcctagacttggaaggtgaagagggacaggaaggttgctagggtgctagagaggacaccgtgaccaagttatcctgagtgtaagatggagagccaggaaaagcatgatgagaggatggtgttagcagggcggaggtgcagagtccagactgggggtaacgggagcagattctttgggtccatgtcccaacatgaccactgactagccatggaccaccctctacctcaccatctgtaccattgggggggtgttacagtacctgtcttataggatcttgagatggacagacacttggtgtatgtaaattcacttagtgtattaaattcacagaacaatcccccatacaacgttcagtctctaaagatgacgtgattttattattgctctctacctcttgcctctccccatgttggattatccagcacttatttgcaaatcttcacatttgttttggcattccctgtggctcagaaggtaaagaatctgtctgcaatgtgagagacctgggtttgatcccttggtcaggaagatccttggagaaggggaatggctacccactccagtattcttgcctggagaattcagaggagcctagcagggtacagtccatggggttgcaaagagtctgacacaactgagcgactaacactttcacatttgatttacagatcacagagaaacttcacttgggcttcctccctggctcttgagttacactactctatctcttttttaaaaaatttattcatttattttaattgggaataatactttacaatactgtgatggttttttttttttttttttgccatcatcaatatgaatcggctctaaagatggctggatggcatcactgacttgatagatgtgagtttgagtgaactccgggagttggtgatggacagggaggcctggtgttctgcaattcatggggtcacaaagagtcggacatgactgagcgactgaactgaactgataggtattcatgtgtcccctccatcctgaaccccat

SEQ ID NO: 57805 - DNA, 1202 bp, Bovine  19866880607805
aagactcttgagagttccttggacagcaagggagatccaaccagtccatcctaaaggaaatcagtcctgaacattcattggaaggaatgatgctaaaggtgaaactccaatactttggctacctaatgcgaacaactgactcatttgaaaagaccctgatgctgggaaagattgaaggtgggaggagaaggggatgacagacaatgagatggttggaaggaatcatggagtcaacggacatgagtttgagtaaactccaggagttggtgatggacagggaggcctggtgtgctgcagtccatggggtcgcaaagaactagacacaactgagcaactgaactgaactgatacccatctttttgttcataatgtttttagccacctttccatttaaaaataaactatttccctaaatcctaattaaacttagagattgtgccacattatgattcattatgacctgcctcaaagcaggtatcagatactaagaaaattgcatggtcattttatcttttcacctaaaaagcatatctttacatctttcagtgcaaaacctagaatgttctatcaccacccatggattaggcaaaagcaactccagtctatggagagcccttgtccaagtagcagaagacaggacatggcctctgctccttcctctatgaccaacagtcaaagatttcactgctggcctttgtcctgactttaccaacatgactcatcttaatcgtgtaaatgtgaacatgattttatatgaattttcatattagagaagtctgctcacttaacataaagatccatttcaatcacaggctttttttccttctcagaaatgatcaagaagaaatgtggaaaattattttttgtttttttgaatagaaactaccaacattttaacaaattgatttttgctgaaaataaacataataaagtagtattttaaaacctcaaagtgagggatttccctgcaacaaaatttaggattatttagctgtctccaagaggacaaataaaactgtgaacataatggttgacttattgagaaagaaaaatatattatacaaagaccagaaaacagtggaagagaaaggtctgtaatggcttggctgctgaaggacatttctaccctcatgccagcactaagtgctcttcccaatgaataaaccatatgtccatttttatatgcttcctttcacttagat

SEQ ID NO: 57806 - DNA, 2084 bp, Bovine  19866880663474
cagagacgctaaataacctgagcttaagctcacatggttagcaagtggctgaggctgtggactgaatgcagagcccctgctctgcaaccgtgatgctctgctgcctcctcgtggaggcgactgagaacatgccttgaaaccaaaacaaatgatgaggctttataggagctgctcatgccagagcttctcttttcctggaggaaaaggcagatttgaaagctaggtttggacacaggaaattcagatctttccatggcttttagatgacactcaaaatcccatcttaggaaaagggtgttgtaggtttcctctaaataaaacaataaagaagtaaaacttgtgttattattaaagatggggaggagagaaggaagccagcaagtgggggccaggcaagtgggtgaccatcaccatggtgggtgaacacaggtgtaacaggggctagtgatgtggtgaaactgacgagctaggacaacccgggaactcaaaactggttaaaaaagggggtatgcgcagaaggggcaggagaagtgacataaaataggtctgatataaaataagtctgttgagctcactaagaactggaaatcaggttttcattttgctgagaaagtgaattgattttgcagagaattctgaggacacaatgaaatttcattcacagaaactcttcacaaataacacaagttgaaacaataaaacataccaatggccccaactgttggtaaccaggcaagctacaccaaagaaatatccacactacaatgaaaagtaaactctttttttaattgggcagtgggaaaacattaatatgattttctatattacaagtatatcataatcatttactcaataaacaagtattacatagcagttacactatatcctgtactgggccagacacagaattcgtttttgcggttacataaaatacaaatttaacattgatatatttttttcaaaatcattatgtataacataaagcatatattattatttttattttatcaaggactcttagaatgtgaatgacttgctcaggtcactcaaaaaaaaaaaaaaaagatagcaaaagcatagggccaaatatgccatattgctggttttagggttgtgtccctacctgctaagagtaagattaaacttcttcttagaaacacctctgtgtggcccatcttttgtcctagaaatctaaggcaatgtatagttctcatacatgcagacagctgagtcatctgggcatgaccatgagcttctccagaccacagtttctttgtaagcaagagaaggatgggtgaatcaaagtacgacttaggcttctcttagctgtaaccatctgagcttattagaaagtgcttgaatacgttataggtctgaccttaaacctgtgcttttggctctcagaaaaccacagctatagcatcaaggcttttactttgattgagtgtcataaagtcatcttagagcagaagtgttcatagatctggaggtagcaagaggagggcaagacttggcctcctaaagtcagagagaaagaccagagattgttcctaagctgagggtccaagtttagcaggatgtgtcacacttagactcctgaagagcatgtaattttgaaatgagattagggggaaataacggggttctttgtgagtaaaagcatcaacaacagaccagcttgttatccacactgtaccctttcttatgcctctgtcggcagtttcagagcatggaggagcgaagccaaggttagggtcaccatattgtcctaaggaaccaactgcaaccatgccgtaaagccaaataaagcagccagtaaagatggctcatcacatcatcttattaaaaaatacttcatgttatacacttcacgtctccctgagtatgcatgttgaataattttcaaagttgtgtaaaactttacaaaggccttggcttccctggtggctcagatggtaaagcgtctgcctgcaatgcgggagacccctggttcaattcctgggtcgggaagatcccctgaagaaggaaatagcaacccattccagtactgtagcctggaaaattccatggactgaggagcccgg

SEQ ID NO: 57807 - DNA, 708 bp, Bovine  19866880680214
tgtctgattagtatgaagttatgtaatgtgtccatatggctctggaatcaaatctggaagattaaataacttgttcaaaatcacgtggctaagtctagggtccttcatctgtgaaatgggcataataatatatacctcaaatttagaggctttaatttaattaacctttgagaaaaatgcgaagagacagtggctattattacacttgatatattatagttgtgggtctgggcttaaaatagtttccctgggagacttaccctatatgcattcccatgatgctgacattcttcaaaatatcagctgcctttcccttttggaactgcttccagagctagggtttacatcttagcagaaaattctctctttatgcctacatttgaccaaaaagattttaactcagttttatcaacctcattcaccaaagttagctgtgaggcatgtttaaccatttgtgaaaaccacagctaaatgcaaaggatgaaaatttgcagatttgccataactgaagatatttggaagaatttgcttcttctagtggaggggatagatatcctgtttgccagaccaggtccccaaaccttgggaaaatcataaaccatggcatcaaacagtgtttcagagttgagaaaatggaaagcaggggtgctgatcctcaaggtcagccctggggaagctagaattttctgaacttctaagagagaaata

SEQ ID NO: 57808 - DNA, 764 bp, Bovine  19866880739520
tttgcactgctgctgctaagtcgcttcagtcgtgtccgactctgtgcgaccccatagacggcagcccaccagggctcctctgtccctgggattctccaggcaagaacactggagtgggttgccatttccttctcccaatgcatgcatgcatgctaagttgcttcagtcatgtccgactctgtgcaaccccatagacggcagcccaccaggctcctctgtccatggcattctctagcaaagagtagtggagtgtgttgccatctcctttgcactagctggcacctgttctgaagatttcgatgcccatgtacattggcaaccccactgacaaccaacatttcaatggctgtcctgcttatggtgatcttgagacacctcctgatttcagaattgacaaatatgaaaaaatgtgtcttagaatcagtgaaatacagtaataacttgataacaacaatatctaattctcatcttgaagagaagaaccaactatatatttatgttcgcattagagaataagccacttacaagagatatgtgaaagatctgtcataaaattacaggacaagaattcttatccctatagataagcccatataccccctaaatgagtctgaaggggagtttttattgtttggtttgttctgatccttatcattctggcattaattttgtttccttaatttaacagttcactcacttttcaaatctttttctagtaagaaggtatctgatcaaaggagaaataagctaaatcatgtagacag

SEQ ID NO: 57809 - DNA, 1517 bp, Bovine  19866880771191
cttgacgttcgaaagcagagatctcctagagaccatcacgtgtcctgaatttcccagcttcgtttcgagacctattttgtctgtcgctgcttatacctctgctcaggctcatggtaaatggtctgcttctgtcaatgactttttcatctatgtcaggcaaaggcccattagacaaatccaatgggacaagttcagagagtttgtcagttcctgtcactttcaggtctggctgtgcagtgaagcacggacgcaaaacagacttgtcaagatgggcagcttcttctggaagaagtttatctcaatggagaggaacacgtgatggctggaaatcatcacaacacgagcgcctcagcctgggaacagcacagggggccggaagagctgactgtgaatgaattaagtatcagtctcctgtgcacaggagcagtggggagatgatgctatataccccagatatttgggggtgctgggtacgaggaagccatcacttcttatcatcaataattattttcaacttaacaatcaataattattgataaagataagtgagaagctagaggagaacttcccacataaccttactgccaagacggctaagcccccacatcctccctcaacctcatacacttgacaccccctgctttctgcaatgagcagaaggtcctggaagcagtcgaagcccaaatcctcttgtgcattggagtctcttgccttatcaactcgccaagcactcactcctagagttgtctgccttctgcattatcagttcctctccattggtcattgctttcagcttaaccatgctgtcataactgccactaaaaactttaaaatccttaaacaccttttaatcgccacccaaatttttctgtttgctttatagggaacttactttctttctcaactccctcctccttccctcagttcatttcagttcagttcagtcacgcagtcgtgtccgactctttgtgaccccatgaaccacagcacgccaggcctccctgtccaccaccagctcccagagttcacccaaaccaatgtctattgagtcagtgatgccatccaatcatctcatcctctgttgtctccttctcttcctgccctcaatctttcccagcatcagggtctttacaaatgagtcagctcttcacatcaggtggccaaagtattagactttcagcttcaacatcagtccttccaatgaacacccaggactgatctcctttaggatggactggttggatctccttgcagtccaagggactctcaagagtcttctccagcaccacagttcaaaagcatcaattcttcggcactcagctttctttatagtccaactctcacatccatacatgaccactggaaaaaccacagccttgactagatagacctttgttggcaaagtaatgtttctgcttttgaatatgctgtctaggttggtcataactttccttccaaggagtaagtgtcttttaatttcctggctgcaataccatctgcagtgatttttggagccc

SEQ ID NO: 57810 - DNA, 1879 bp, Bovine  19866880781068
ctgaaggctgagctgcgtcctgtggggcaggcagtagtatgctactttggatacaatccatgagcccacggtcataaatcccctctcaagagggagaacaggaagcactagctctcaggactctttgtcgaaaacacaaacgggctggagacccatctgcatctctcccctcagagggttacctgttcgaggacccccatgttggagccgcagcctggaagcctgcagcagtaggaagcccaagaaagtgttttgtttcactgtctgactcatcctcacaatgttttaaaagccaaggttacttagcagatgtgaggcttaattccagtagaaggagctcagcactttcacttagtatataagtttatgctaagcaccttcagtccttgctgctacctgctgaccctggaggcactggatgcagcagctctcataccagcatattggagagaaggggcgtttgtctcagtcctcttgtgtggggtcctccagctgtgtcctctctactgtctggctcctaagtttccatctctatgccatcttggactcctctgatgcacttgctgttcacctcctcggacctgcaataaccatacagagatgcttccacccttggggggaagggtgctcctgggaaggttaggtagcactctcagttctcctatcccagcttggactctgacccactgcataattccctgccacattagctgtagcagatcactgactctgccagagtgttgagaagatcacagaggatttcaaaagccagaagagaaacaccaaagttgagccctgatctctattccctgagtacatcagcacctactggttctctccttgttcaaggcccctcttgttgctcaggctctgctcctcttgggcaccttttctgtcctgccatctctctctctttcctccctgtgctagtttccagactccaatgttgggctgctactgagacgtcctcctcttcccttttgaatacccaccaaccgtcttttggcagagtaccctctttccctgggtacttttgtaattttttttcatttaagaaattgccttaatactttaataaattaaattgccttaataaagccattataactcttcattgagccaacgtctccttttaaaggagactcagactttccatatccactggactatctgaaatctttcttaaagtaaatggaatggggtggtattagtttagcatgaatcgacactcaggctttcaccccaatctgcatttgatgcactgtcacgattccatttaaccctcacaataccaaacacatcctgtaccatttataaagactgtcaagatttagtattaaaaaggaaatagagtaaaacctgtgacccaaaaagagctcttggcattttccacccagtgctcattcaaagctagggatatgatagctgccttagaggcagaatggtctcaaggctagacatctgcccacggatttcccttctgtttgctcctttaatcaagtgcaataattatcaaatttcagtgtggagagaaattagaacacaaggttgtatgtcttgtgggtgatataagggcttttcaagggtaatactaagtttatatgatgttcacgttaggtgttgattatagaacctaaaaatatcactgctaagatgtgactcttctgtcaaagcttccttcagtaagaattctgccttcagactagaatttctaaatggctgagaatttttaaatggtggttattattttttcctttttggtctcactacctttggaaagagaataccaccatccccccaccttggatctggagtatcctgttgaaaggcacccctgacccccacatcaccactaaatagcttctgtcaatctggtata

SEQ ID NO: 57811 - DNA, 1738 bp, Bovine  19866880784998
atccctcttggagcttgcattctaacagaaaaagatagacagcaaatacgatcatagctgatgtgaagagctgaatcactggaaaagaccctgatgctgagaaaatggaaagcaggaggagaaggggacaacagaggatgaggtggttggatgcatcagcagctcaatggacatgagtttgagtaaactctaggagatggtgaatgacagggaagcctggcatgatacagtccatggggttgcaaaagatggacttgtcttagtgactgaacaacaataatcaagtagattttataataaattagaagatgatttgaaaaactgtagaaaattcttaaagagatgggaataacagaccacctaaccttcatgctgagaattctatatgcaggtcaagaagcaacagttataactggacatggagcaacagatggttccaaattgggaaaatagtattacaaggctgtatattgtcaccctgctcatttaaattatgtacagagtacatcatgcaaaatgctgtgctggatgaagaacaagctggaatcaagattgccaggagaaatatcaataacctcagatataaaaataacaacacccttatgacagaaggcaaagaagaactaaagagcctcttgatgaaagtgaaagaggagagtgaaaaagttggcttaaaactcaacatgcagaaaactatgatcacggcctccggtcccatcacttcatggaaaataggtggggaaacaatggaaacagtgacagactttattttcttgggctccaaaattgctgcagatggtgactacagccatgaaattaaaagacgcttgcttcttggaagaaaatctatggccaacctagacagcatattaaaaagcagagaggttactttgcctaccaaggtccatatagtcaaagctatggtttttccagtattcatgtatggatgtgagagttgggctataaagagagctaaaaaccaaagaattgatgattttgaactgtggtgttggagaagactcttgagagtctcttggacttcaaggagatccaaccagtcaatcctaaaggaaatcagtcctgaatattcattggaaggactgatgctgaagctgaaatttcaatactttggccaccagattcgaagaactgactcattggaaaagaccgtgatgctaggaatgactgaaagagggaggaaaagtggacaacagaggatgaaatggttggatggcatcactgactcaatggacatgagtttgagtaagctctggaagttggtgatggacaaaggggcctggtgtgctgcagtccatggggttgcaaagagttggacacgactcagagactgaactgaactgaatggggcttccctggtagctcagatggtaaagaatctccttgcagtgcaagacacctgggttcaatccctgggttgggaaaatctcctggagaagggaattgctacccactccagtattcttgcctggagaattccatggaaagaggagcctggcaggctacagtccttcgggtccacaaagagttggaatgactgagcagctaacactttcgctttcactaaactgaatggtctggccaagcaaaaagcatccatggaccagattcaaccagtggcacaccagtatgcaaaccatgatttggaatcatctgtgacaagactgggttccgtcaatttgtctctaccattgtctctaccaattagcaaaagtaatta

SEQ ID NO: 57812 - DNA, 1806 bp, Bovine  19866880796288
caattttaagacttaaaggcctttaatatgctgagacacatggctgctaatgaagtttatccatgtgttgaggcagaaactcattaaacccctattatgggatggaaactagcgtaggggttaactgttcagttcacaaggtggagagagtttaataggagggtttggtagtttggatttagcatattcagggacttgggagaaagagtttgaaagaaggggtgtgaatgaggtggtggaaaacagttgatgagagaatcttagagctttaccatatgatgatttagcaatatgctaaatcttcatactatttatgaagataaatttaggtaaacgtatatcgagtcgaatggcttaaactcagcatatacacaacaaacacatttattttattattataatatggtaataaacataggctttgtaggatgcctattccagatgtccttttaaaggataatcggtagtcacaaagtgttaaaataagaattgaagagaaaggaagaaccacgaaataaatactgcaccatagacagtatttatggaacactcactgtactagacattattccttccccatctctgagaacctcattttttgatgcaaaagcctgaaatatggtttcatgaagtctaaatataatatttagaacctgatttcaaaagagagcatggattggggttgggaggtaggaaaagggaaaagaggaacctcattttagaaaaggctgtggaagtaatggaatgttataaattctaagatttaaaagttaggccagctctgtttgctctagaagaggaaaagagggtcacaagaagtctgtgccagtgacggcttggcattgggaaggccaacttaaagtgttccctttaataaataaataatgtatagaagttgtttctaatataataagagtattaataaccatgatcatcagggttatcctgtatatattacagtgagaggttggaagaaagttaaatagagcctttgtaaagaccgcaggtgaagagaatattgttaaaatccattggtggtaggcaatacttctgtctcctgaagctgaaacagtagtggagtgattctgtttgaatcaggaaaccaaggggagtttaagacagtcatgtgtaataaaaccaaaatccttttttcccttaaactttggaataacttttgaaaaaaattatttgagatacaagcacagatgaaaaaatatttgttaaatgatgtgtctttctttgaaaaatatacactttcaattctgtagaaattatagttgaagccccataaataaatcatgagaaaacaagcttttcatagaaagaagctaattctgggcagtaaatggagctctgggagtccaggctactttggttatatgtattcagttcagttcagttcagtcgctcagtcgtgtccgactctttgcgaccccatgaatcgcagcacaccaggcctccctgtccattgccaactccaggagtttactcaaactcatgtccatcgagtcagtgatgctatccagccatctcatcctctgtcgtccccttctcctcctgtccccaatccctcccagcatcagagtcttttccaatgagttaactctttgcatcaggtggccaaagtattggagtttcagctttagcatcagtccttccaaagaacacccagggctgatctcctttagaatggactggttggatctccttgcagtccaagggactctcaacagtcttctccaacaccacagttcaaaaccatcaattcttcggtgctcagctttcctcacagtccagctctcacat

SEQ ID NO: 57813 - DNA, 1726 bp, Bovine  19866880859966
gcttacttcactctgtataataggctccagtttcatccaccctccattagaactgattccaaatgtattctttttaatggctgagtaatactcccattgtgtatatgtaccactgctttcttatccattcatctgctgatggacatctagggtgcttccatgtcctggctattataaacagtgctgtgatgaacattggggtacactttcaattggtgtctctttcagttcctcagtgtgtatgcccagcagtgggattgctggatcataaggcagttctatttctagttttttaaggaatctccacactgaagactttaaagtcatatgaatttgtgaggaattactagggtgttctatacagaaactgaggaatcaactgtttctagttaggagtgtcagatactgtgtgggatcaacaattgaggaaaaacaatggaatttatcagagctggattggagttgagattctgctttcgaccttaggcgaagcactggttccttgtgagtctcagtttcttcctctcttatattggggtaatgacactcatcttgtctaaattccaggatagctgggaaggttatacttgataatgtttgcaaaaggactccaatgtcttaaaacattatttaagtgaaagcatttctaggaaaaaagacattttgatcatccacttacattctgaagtctctgctctgtccacaagatgatacattcaaagtcaatgaaataaattttatgtgccaaacccacagtctgtcggtacactctactggcaggtctttgttatacattagccttttttatttattcaacatccactgggaccaaggctctgcagttttgaataatccacgaagttgtcactaaaagctgatattctctatgttgataatgaagaaaaacaccaatgaacagccttattagtgtaaaaagtcacacactccaaagcctctatcccattaggaaaaaactcaacatatgtcacgtcacattaataaatactgcatgtgcaaagtgtgccttattctaacagtaaattcccccttggaaaattgatttgcttttaaattttaattgacttcttttctcttctatggaccctagttagtttccacccccctccttttctttcacaaatgatgtaagtttgcatgaaaaatacatcattctttaaacccaacagcaaaaaaaaaaaaaaaaaaagaaagaaaagaaaagaaacaaaatgcagaaaaaaagaggtaaggggaaataaaaggggaaaaataacaaattggtcattaaaagcgaaaagatgcatgagataaaagagagggaggcaagacgaacatctactatattgggcttcggtgcagatgtaagtataaaatgctccacaagtcctgtaattgagaaaatctatcaaatgtcctgacagctgctcgggcatttccagaagcgataaaacttgaatttatttcactcctagaaaaggggcagtatcaccttctggcggctttaatgaaatgccataaaattcgaggaaaaactgtgttgtaaagtcataaaaaggtagtcggaagtggattgttggaaatggggcgggaggggtttgccgtgtctgaagagttaccgaaggaggccagagggctctgggcttggcccgcgataaccagccaggccttcagtttcccaccgaccctgacccccgcagccccgcctccagggccaggggagggagta

SEQ ID NO: 57814 - DNA, 1038 bp, Bovine  19866880865099
gggattcttggagaagagttgagaagttttccttaagtgtgcatctgaagaaaccatgattgcagtccttcaagagaggatgaaacaaataaggagtttggggtcaaatgcctgaagtcctggagtctgcaggaaaggctgtaaataatagatttttctctttaaaataaaaattggaaagtaaaaagcagaaaaataaatgataaatttcagaacattttccaaaattatttacttctctttttctaaactttcttgccctggggcttattacctctgtggcaaagatctcagaaaagtgataaaaaataattggtctgactctataaacaataatgacaaacagctatcacataagttcagggaggatgggaggtcctagagcccatgctgaagctctgtcttgagtcccttgaccataccacagaacacagtggcagctactaggattttttccccactaggtggttctgtgatgggccattggcaaaactgatgtgttaaaaatctggccacctctggctgtgctccaggtcttggaatctcctctcttctgatggatacagcacaagcagtagagcaagagagcgacaccagagtgaattcaccagaaagactgagtttcctactttctgttgttatcaatggcttcttgaaggttgggggttagtttgcagaaaaagtggcacgttggctgtgaattaattactgatacaatttccgtctgtgtcttccatggacaggtggctcatatgtaagtcctaagaatcttcagcttcaaggtgccctggtggggttggcatgttgtgaaatgagctacacaccctctaataccatacttaccagcagctgtgataaagaaacatctgcccccatgaaaagtcaagggcagaggtcatctggcattccaagggaactctccacagcagggagccttctaattggctgatattgatcggtaaattgtgtctccactggattaattctagctgccccccaaacttccacagcaggagcggataggtcaagatttggggc

SEQ ID NO: 57815 - DNA, 1463 bp, Bovine  19866880884490
ctaaagaaataattaagtatgaacaaagaaggaatgaaaaaggatattcactgtaaggttgtttatcatactaaaaccccagaaacagcctaaatcctcatcagtaagagactgataaaacacattttggatcatctgtacagcaaaatattatgaaatctttagaagtaataatatagcttcatatttataggaagcccacaaaacattgtcaagtgaataaaacaaattaaatatagtatacataaacactttatcccatttttgtcaaaatgtgtatctatatgtatgtatgcatagaaaaaagtcttgaaaaatacataccaacatggtcatatgtttatctaaaagcagtaggattatgaatgattttctctttctttttaatacctttgtgttttaccatattctttcataataagtatgcataatttctatactcaaaaaatactaaagctacttaaaaaatttttttaatttatatgcaaaaaaaagccaactgatttaaaaaattaaaacccatatctatatggatcttatctcgttcatcctcaaacagaagggagacgtttcattattgctgtgtgtagcagggtttctcaatcttggcactattgacatttttggctggataattccttgtcatgggagattatcgggtgccttgtaagatgtttggcagcatcactgacctctactcttgtaatacacatcactcctttcccaccaagttatccaaaaatgtctccagatgtcaactaaaggctagactgccctggttgaaagtcactgctctaaggaaacaggagatctggaattaaaccccatgtttgacacttactagttgggtgatccaacctctctgggcttccatttcctcaagactacattatcttcaagatagctttggtcctgaaaaccatcttttgtgagtttgcggaaaatcagtggattcaaaagggtccaggcttccccagtggctgagttggtaagaacccacctgccaatgcaggatatgcaagaaacgtgggttcaacccctgggtcaggaagatcccctggagtaggaaatggcaacccacaccagtattcttgcctggaaaattccatggacagaggagcctggcagactataattcacagggtcgcaaagagttggacatgactaagcagctgagcatacaaagggaaagtggttggtccagagttaaaccaaaagccaaaagttcaaacagaaatgtggctaggtctcctaactgcaatcatgcatttattcactcatttgtgtaagaaatatttattttgagtgcctattatatcctgggcactattacagcactgggaaacagtaataaacaagaaaatgagatccttgctttcatggagtttaccttctatgaaagaagcaaatagtaatcatgtaggttaataaacaggagtattttaaataagtatattaatagg

SEQ ID NO: 57816 - DNA, 1756 bp, Bovine  19866880912288
gagggttcccatgcaaccagtggtaggacttagaactttaaattgaacatatttgcaagctttttgcctcctctccactcactactgagttttacattctctctctcttcctgaaagattatacatctgccctagttcctggttcctagttcctgttcctgtgtccagaactgaaatgatgggtaggaagggttaaataagtgcaaggaataaatctggttttaatcacttacactggaaagaagttgttgtttttgttattcaatcgctaaatcatatatgactctttgtgacccgccaggctcctctgtccatgggatttcccaggcaagaatactggagtggattgccatttccttctccaggggatctccctgacccggggattggacacttgtctccttcattgggcaggcaggttctttaccactgagccaccagagaagcctctggaaaggggtacaagagctgtctgcagaaagaagaggaaattataagaaggagaagagagtcagggaggggatttctggagagaaaaaatccattaaggaaatcagaaagaagagtagagagaaaggaaggattcagaatagttgccgtgtgtgagtgaaattaaaacacgcaccctggagaaagagttgctaaaatttagcagctcactcctttgtctagttctttgggagtctctagtagagatataaattgcttttaattattcttaattcccatgtgtatctgtatttctttgaatgaaactctgctaacttgtccatgtggggtcttaaccgttatttggtttgcatgaagcagctccaggctatattttctattcagataggttcttgcactcattttttatttcttgaaactcactccagatcaagattctttcttcttatggccaaacttaattttatatagttccctctccttaaatcctgcctattgggtgggaaagagtctttccagtttccttttctttcttgacaaaagaacttgtgatttctgcctcctttcaacactatactgcaaggccatagagagccaatttctctgctatccttcttctcagccttaaggttccttctagtcaaaataataaaaaatctctttgctagtagtgtgtaatttacattgttaaagacctcatgcatgcttaataacttctttcctgggcccagaaagtttcctataggcatatattcacgggcaagtactcaacaagattgattaaggccctggcatctgtgtgggaggatagagcttggaatgggatacaggggttgatgtggaaagagttcagatggaaagaatgtcagcatttgaaacattagacttcttatagctattctaatttccagagaagtttcgaatgaggctatatatagttctatttcccctacttagtgattgccaagttgtctatcacgcagtataatatttatcatgatttatacaaatttttcattttgtaaatacatagagattaattactagtctctggtggttgtaaatataccagaaatggaaaactcctgaaacagttggtgtgattctgtctttgtgtgctctatcaaagcttaccactgagaacctaaaaacactgctaactagcttcaatgagtttgacacatggtggtaacattttcagtctttttatggagaagtcttagtgatgaatgttatgctaacttttcaacacctgatactgtaagagacacagaattaagcaatcttgtcaattcaatttttcaat

SEQ ID NO: 57817 - DNA, 1796 bp, Bovine  19866880937609
tgagaagcctcctgtgtgtgtgtgtgtttgggtggtggggggtccactggcttctcccaaggagaagcgctgccatgcaccctcccccgacacactccacccctatcctgggaaacttaaccgagtgatgattctggacggcaggaacagctgagactctctctggagagtgtgccaggcggcagcttcccgccaccagctgcctgcacaggactgggaattgagacaacccccctctcagagatgaggctctaattacaatcagcatcaccttctagggaatttcttgggtgagtggctaccagcagacaagagctttctgctcactaccctcctggttagtaccgtagccagggattccagctgtggcctgggaagagaagaaacacctctttcaacagaacttgcccaaaccttggtaattcttccactttctcccccagtcaaggcattgagttcttttggatgaagggtgcttccttcctgactcttaggaccttttattttggacacattccaaatctctcgatccggctttgcctaatacatacctccttcttcttgcagttctcagaaatctttcagcagcagtaagaatgaccttgaactagtcatttcagaccacaccattggcaccaagaagtgcaagtttgccatatgctccttcattaaatacttttcactgtgcacttggatctgaaagaaatttgtagctaaagaccacaaacctccatgcctgccactcatagagtaacttcttgaaatttcttttgtaattaatgacttttgccccccctgtctgtgaaatgagaataggattgagaataataccatttatttataatggaactagtactgggctagatccaaagacacaaattccagttctacaagctattcatcttgtgattttaggccatttactgaaattcatcaccttcagattcctcagctgtgacatggggatagttagcattcagaacagagttgtaaagttgtaaccgaacgtaaatgaggttcgtgcaccaaagcacctttttcaggtctgggccaggaggaggcatagtccagagtttgctccctgccttccttgtttctgataatactgaagaaatttatgaaggaagcatttgaagacgttaaactggtagacgttaaactggttaaaacaataacaacaaaaacaaaacagaacagagaacagggtatgtcttgacatatagtcccacactgtccaatataatagctactagccacaagtggctatttaaattaattaaaataaaattaaaaatacagttcctcagtcacagtagaaataattcaagtgttcaatgtcccatgtggctggtggctatcatactggacaacacagataaagaacatttccattgcagaatgttctactggataacattgaaaggattctcacagaaattaccataatgacaagaacaagtttctcaagataaaacccagattccctttcgccatggagcacactatcttgtctcagtggcactgcatttaagacatacagtatttatttcaaaccataaccaagaaagcacactgtatgcccagatgtgcccacatcttcctcttagtcctgcacacgtgaacatgtgtctcttaaccagctcccgctcttcctgccaacctcatcaggggtgaaaggcctgtgcgtacaatttaggtgaaaattgagctctcacagaccttgctgccccacatggctttgtgcctggaaaatgatgggaagataacgccgaactctgtaatggactgtgggatgg

SEQ ID NO: 57818 - DNA, 1203 bp, Bovine  19866880984727
cttatttgtctttccttataggaaatgaacaaatgtggtgcaaagtaaccctagagtcagttttgtgattttttttttaagtgtaattactttcccatatcattgcatttcctgtctaagtagaggtttctatttcatcattattgaaatgctccctggaagtgtgggaaggaagattcttcagaagtgaagtgacgcttcaaggaggtttcactttaaatggttgagaaagtgtatgtaaattgaggtcccttgaagaggcaactttgtccccctgggaaggagctgttttattgagaaaactcagagcatgttgtgtgactgtgcacagaaatagttagcaaaggcaactcttacttggcgctaatggctggtactggcttcccatactaatgagatctaccctccactgttgaaagtgaagcaggagaagctctattctgagcagcaaccctgtcactagtagatcagaccagactctatagaatcatttctgctcaaattatccttaaaataggtagaaggcctcacacaaggatgatggagagaagagtgcagtgtttatagttcttagggcttcccccacggctcagcgggtaaagaatccacctccagtgcagcagatataggagatgcaggttcgatccgtaggtcaggaggatccctggaggagggcatggcaacccactccagtattcttacctgaagaatcctataaacagaggagcctggagggctgcagtccatgaggtcgcacagaattggacatgactaaagcagcgtagcgcacacacacacacacacaccaatacacataagcatacttcgggggttgagggaaggagatattccacaaagctatttcaaactttgcattctcctcaatcacaaaacaccccggctttgctaattctcatctgcataacagtattacttcctgtatgaggtgcatcagttgacagacctggagaagaggaatccgatggctgctagccaccctgcagggctgctagctgtcccagatcttgcttttgtgtgaatcagaaaaaggtgcccttctgtggagcaggtgcaacctgtacttgggtggcagagctagtgtcagccccgctccacccttcagctggacacccggtgcccactgcctcacatggctgcatcctcaccacaggagctgatccacttggccggccttccctaacc

SEQ ID NO: 57819 - DNA, 3546 bp, Bovine  19866881004910
tggcttttcttgaagacattcatttcaactttggccaagcggtggctttacttatgggcaatgggataatgtgatgattactgagcaaaatgttgaggctgagttggggttttggagctcagctgcctgagtttaaaacctgattctgctatgtggttgtataatcctgggcaagttactaattctccttatggctcattcttatgaagaaacaccttataagatttctgtaaagattaaatgagttaatacttaaatcacatataagaacaaagggtacacctgtaaaagttagctctcgttattttactaaaaaggtgagaccaatgtttttttccttgctatacaggcagcatctagagaattgtttggcatatagtaggtactcaagaaatatttattttataaataattaaattaagggatgcatacaggaattataagaggttatatcttgggagccaggtaagatttagattttgctagctcagtcctctatccagcttcatttagcaacaaatatgcaaagaataggagcatcagagtatttgggaggcaggggcctattataccactccttatacctcactgtgaatgaggagagtgagattccaagaagctaagtgatattatgtgaggtaactcatgatttgtcaaagctggtattagaatttatgcctcttagggacttcatcagcctgggtggagttatcccagaaatgatttgaacttggtcacttttaaaagaaactatctttttacagtttttttggaaggagggaaacattgtagaacatgaaggaccatctcctttattgacgctatgatctaacatggaatggtatcttcataaggcttataatgtaaatttgtatttcagcccttgttcctggctttcaatatggacatggattggaatcccaactctgtaatttgcaatctctgttaccttggggtaagttgcttaacctctctgagcctgagcatattttatccatgagattagttattacatagattcaaagggtcatcatgatgagtattaaggagctgatgagcacttaacacagggcctggcatagggcaagttctaattaagcagtagctgttattgtggagcacgttgtggaatgtctcacttaactctctcctttcatttgtgggattactagtgcagaccttggatctaccattgtttcaatatgacactttttcccctctttaagccttacttcctatggctgtcagctttgttgataattctcataaactgaccactggtcctgatttcctatttctacatcaaatctagaccttctgattctgcttttcaaaatcctcatcataaaacctcacttcacctctcacagctctactcacaactccttaaactgcatgcttttcctggcccatctctgctctgtccatggtactgacttcttagtttcacattctctactgccccactgtcttgctgctgctgctgctgctgctgctgctgcttaagtcgcttcagtcgtgtccaactctgtgtgaccccatagatggcagcccaccaggctcccctgtccctgggattctccaggcaagaacattggagtgggttgccatttccttctccaatgcatgaaagtgaaaagtgaaagtgaagtcgttcagttgtgtccgactcttagcaaccccatggactgcagcctaccaggctcctctgtccatgggattttccaggcaagagtactggagtgggttgccattgccctactgtcttaagctctccaaatcctccttatatttcaaagcagctgaagttccagctcttgaaaaagccttctatgattattccagtcctcactgagttactattctgagttctgacagtgtttctaaaacctgttaggatagtgcttggttttcacttctttggttacccatcagctgtgactgaaagaaaattgctgttaattataagtgcagtgttatatttggtgattgtatctgatgaagaacacatgtcatatattatcctaatatgaatttatcatattggcataataatgtcaataaattataaaaatgaagagtaaatatatatattgatttctataaaataggcacagatacatatttacagtaatttgctaaaaggatatcaaagtatttaaaaggatgtatttttcttattaaaatattcatgtaagtgggaaaagtgcacaaagatgtttttggtagggttacctaagttataaaaacattgaaaatactataaatatatgtcaataaagcttgagaagttatgatacatccatacatagaccatgtacttattgaaaagaacaaactggattctatatattgacaaggaatgctgtccttggacactatgtgcagaaagaagctacagagtagaacatatgactaaattttgtaaagcaaacacagatttcaaatatatttttatgttcctctatggatagaaaaaatctagatgttaattaaaccactgagaagttagatattggtaatggattggggtagctagaagagttattatgttttcaaaggatctatgcaacaaataaaaatcaaagtcctctatgttgtaagtttagaccaattataatatgtatttaaatttttatttaaaaaatgttatgcttgttttctaataatcttaagggttatgtaaaatatataaagtatgtgactgaaagaattgatatttttctcagtataaattttctctcagcaataagtgttatttgtatttccttcctttaatattgacattattcctctcaagaaccaatattcagtgtcttcaaattcataaaccaattaaggagttgggggatgttatttaaaagtctgtcatacccctactaacttttacactgactggttagaatgggtgctggctggtgtttcagatcaggcatcctggcagtccaccagccctggtctgaactgtgtgaattggcagaaggcagtctctgaaatctgttcttcacctttgttttcttgtgctcaatccctcccttttcccacccaacccagaatcaccagcctggaattatttgaaaaagactctttcacctagtgggcttccctgacggctcagcggtaaagaatccgtctgccaatacaggagatgcgggtttgatccctgggttgggaagatcccctagagtaggaaatgccaacctattccagtattcttgcctgggaaatcccatgaacagaggagcctggccacctagagtccatggggtcacaagttggacatgacttagcgactaaaccaccaccaccattcccataacggggtgcaagagacagtagctaaaaagaagatagaaaatgagaaagagatgttgaggagtgggaagagtgtgggatttagagcagacagatctgggtttgagttctgacttgttaattttctccttgtgtgacatggggcaagacaggtaatcgctctgtgcctctgttccttcctgtgtagaatgatgtcaatctctacttcacgaggcagttgtcaagggaaaa

SEQ ID NO: 57820 - DNA, 1279 bp, Bovine  19866881025441
aaaatgagagagctcaaagtgactgtattgcttgttttctttccccagcacactcaccagaggcttataatcattacccacaggatacatgtagttgtagagcagctgtctggcttgaggtgccagatgaaatgcaggaagaccagttaaatctgaatttcagatgaaaaacaagtaatgttttagtttaaatttgtcctaagcattgcatgggacattgttgatgttgtttagtcactaagctgttgttcaagtctttgcaaccccatggactgtatagcatgccagcctcctctgtccttggaattctctaggcaagaatactggaatgggttggcatttccttctccaggggttcttcctgactcagggattgaacctgcttctccagcttagcaggtgaattctttatgactgagccactggggttagcccaacctcagcttacccatgcataaaatggtagtagtcttaggtgttagagagaaaagaaaacaggtgatgtgatgagactgacttctgtagatatgataattggtcaaaacctcagtgaagctttttaactcaaatgattagaagaaggcagccccgtaaagactgtgcatacatgcatgtgtgtgtgtgtctgtgtgtgtgtgtgtgtttatatctgtgcaactacagataggacagaggagatgagggccagacaggatggcaagtaaaagtatttaatggggatagaggattccatactgacctgtttttttaacaaaaataaaagaaaccagattcagagtaaagtgaaagcctgacaattggggcaaagtaaaactaatctataaatcacataccgtgaagttgatttaagtggtgaacagaaatgtatgctaagtgaggaagaaaatacaaacactgagcttgaagttatgatcaaattaaaattataacaaatttcaccccattgatcccggtcattgtgtatctgaaggaggacagtgctatctcccccacctccaattcctatgttgaagtcttaactcccaatgcaataatatatttagagaaagaagctttaggtggtaattaaggtgaaatgaggtcatagagtggggtcctaatacaataggactggtagccttaatagaagagggagaaaaatctttctccctactggagtgtgctaaggaaaagccatgggaggacatggcaagaaggtgaccatctgccagccaggatgagaggctcaccagaacccaccccaggctggtgccctgatcctagacttctagcctccgga

SEQ ID NO: 57821 - DNA, 1845 bp, Bovine  19866881064512
atcactggaaacggtctttcctattaactcctgtaccttctcatggctagctctttataactgaagccagagggagtactgatctgaaccagtgtattttttacttttagttagcttgcaccttatccctagagaacacaattctggatttgtacagcctgccttttatccttgatcattttgatttgtacaacttcctgttgatccatggaacacttttatcctgtccaccacaccccactccaaagtccactgatttcttttgtgccttagatattattgaagaagttaaaaaaaaaaagatacttacataaaatatctgcactcgatccaactctataattggttccatgctttgctttcaatgcatttgctgccttctgtccaacttggatctgtaggtgggaaatgcagagacagatatctggtgttaaaaataaatctaacaatccagagtgtttgctattttgtccaaatccatcctctgagttccagactatctttctaacttcccactgaacacctatacctgggtcatctgctgatacttcagactcaacatactcaaatccagtttcatcatttcctccactaataaggctgttttgattttcatcattctgtcttatcacgtgccccatatgtaaattccgacaatcatctttgactcttctctcaaataatgaccaagttgcatttctaacatcatcactctatttcagttttattaactctgaaatggactgttgtcatcttctaataagttttccttcctcttaccaatccttaatcccagctgatcttctgacttcagggtgagcttttgtagagcaggactgtgatcatggtcctgctgaaaaccctcactgactcttggtttcccactgcgttagggtacactgctcagtgtagtatttaagattctctacaataaggacctaacccacctttccagcatcatattttcttgatcctaccctagattatagtcaaactccagttctcccacagttccccagatgtgccccatgttcttcagcctctctgccttttcttaagatatgccctctacctgggatgtctcatttctttgttgaaattctgcaccacctcaaaaccttctcaaatgccaagttctcttgagtaccgtgactagattatatctcctcacttttttttttcttacatagccctttcttcatactcctcttattgcttccctcttatttttctttaaaggtatttgatatttatctttcacaagctcatagattttcagaacaggaaatgacacccttctctgtacctatcaccatgtcacctgactgcactggaaacccttcagaactagatgatgtctaaggtctcagccttgctctctgaagaccctttcctgagatcagaaacactaactgaagtctaactgtattggctatgtttattgaccatgcaataaatctcctttcataccctatggacagtctaagtattccccaccctagattccctagtgctatattctagccacctgatgacttacaccactacttccccttgggttctacacaagacaccatgaaaatccccttagccaccacctgcctggatccaccattccttcaccccttagggcagccagactacactttcaggagcatcagttcccgacttcttcccttgatcagtgacagatcttattttagattctgtttttgtttttttttgtttttttttcctgctcctgtactgccccactgaatcctaatgtgtgacagtgtggtctttgggtagagtggatttaagcacagtgacattcaaaacgaaaagcaggagaggtaataagtg

SEQ ID NO: 57822 - DNA, 1071 bp, Bovine  19866881072527
ctaccagggaagagcaaatagtatacattcattcaataaatatttactaaaggctcgctgtttcaaagtaccacattctgaatacttctgactccattcacctaaaaacaataactgtgcacatcaaaaattattcttttttattttctttgtaaaaacaactttattaggaaaatttctgctaactttcttcaagttatacatttctataacttcttaagcttcacatccacacttctttacacaatgtggtataatttcaattttccctaactcagtcctccctaaaaataatctgaacaagtgaagcttcactataccaaaccagtatttctgttttcaattttggattgaaatatgcatatttttagatccagacctctcatccttcatatattcacccctggattgatcatcatgatccatgaaagtttatgaggtggaagtaaatataaacaaactgttggttacatttgctttagaaccaacattagcacttatttggggtgggaagtacacagatgtttgttagaatatcttctgtatttcttgcacaaatattaggaagctaccatgaagggtgctgattgagacgttgtcctgagctaaacaggaagatctggcagtaggcagtcaagaaaagcatgaataggtcacacatgcagaaaggaagtcggtgaaatatgtgggtgagggatctagcgctgtgaaggccaacattggccccatcttttagttgcatgtcatgatgagttggtagtatttttcatttgtggattggtgttttgttttgttctatggtctgttggcttttttatatctgctaaatacccagaaatcacccttcaactcagtcttaaatacattctctttaaaagaacagacatgctcataagtgatgagctttcaatatcaagctagaatccaattcttctactgccttacttctatttgtgttttcttaaacttctctgacaacagttcctaaactgtttaggttgttgcaaggaaaaaaaattaagatagaggtcagaatagaaatttttataatacccagggcaacaacaagca

SEQ ID NO: 57823 - DNA, 2360 bp, Bovine  19866881073263
tcttttaactgctttaagtagggcaggatcagtgtgtatatggatgtaaaacccaggtggagaagccttctgattgaatcctgtttagctgaaagggtggtatttctggtaggatccaagaaacacagggcaacagctctcgaaagaaatatttgtattgctatgaagatatgtttaatggtttttgaaactggatacagtaaaaagtatatatgcatatatgtggtgtgtgtatgtggtattatgtaacacttcttttgaagtaaacatttctaaaaatagaattactgggttaaacaatcatttacattttttatataaatgcccaaattgccctccagcaaggctttgccacttatttcctcagtcttggggaatatattaatattttccagattttttttttcaaagagtacaagaaagaatttacactttcttctgtaacattcaccccaaaatactaaagtctcttagattttcttttttaaacaagatccagtaagatccatgagaagtgtacgtgctggtatcagagatgagatatacttggctcggctacttgctctgtgaccttgtccaagacatttaatctctatgttcctcagtttccttatatgtgaaaaaggaatagcagtacttctcctgcagtttggttgtgagaataaatgaaataggctacactttactgatgaagcaataaataaaatgatagctgcaactgtgatgtgctatttatatctctcccaggactcagggcactgcatctgatccagtctcatcacagaaaagcatatagtacccatgtgatgagttgttaatctcttccctcagttaagtattattactgttataataatgcattttatccatagatattccatgctaaagatgaaagtcaattgagacacagaaatttgtctcagaattgagagaaaattgagacaaagtcaattaagacacagaaattcaaatagaatttgttatgccaaattaattattatcatttaccataattcttatcattcagataattctgctagacagaaattgaatgtggagggtatcatatgctgaggactgtcctaatatgtcttatcttggttaattgcttatttcattctcccttaaaggacccttaaaggactttatttcattctctccttaaagttattaacttggtcttgatttagaaatttcactgttctgcgaaggggtatacccagactcttctccaattttggatccatggacattaacaaaggatattttggggattcaaagaagatcccacaaaataagcttatcctgaaatttctggcatgattgagtgccacagcaaagtccagaagtctggtggctatctgaaaattgtgtgattggacaatgtttcgaaagtgttattctgcattgttgaacttgattattctcaatcatttatttgtgaagttcaacagggtgtcctagcctgggtggtagagtagatctttaaagaatatgggagaagggacaattataattcattggtttagtctttcatttgtgtgctaatgaacagccaagagctaagagttcagtatcttgatgaaagaaacaattatcttaattagaggcaagcaaaggatcttctaattgataacctcagccctccctggctgtttcagatctaccagtggatgagtgagataagggagaagtacacggaagtggtgacacagcatttcctaggaatgacctatgagagccggcccatgtattatttgaaggtgagcgagaaggctgagagttacagccttattcaaggatattggcttactattcaggggctgctcagaagtacggacaaggttaaagagacaggacacagagatgctgacttttccaccctaaactgggcttttaaaattaacaacttgtaaatgcttacatattaatcatctgggtggaatcttattcggaagtaaagagaacttcggaagtaaagagaacttggaatggctgggtgacaccacgggcctgcttgctcagtcgctcagttgtgtccaattctttgcagtcccatgggttgtagcccattgggctcctccgtccatgggatttcaggcaagaatactggagtgggttgccatttccttctctaggggatgctcctgacctagcaataaatctgcatttcttcagactccttcattggcgctaggattctttaccactgtactacctaaggcccagaagtaagaacttactgcttagttttcttcctgctgggcctcacttgtccctgctaaaaccgaggaacttacaatcacggatggtggttgaaaaggacttaagacgctctggcggagaggtttccagactgt

SEQ ID NO: 57824 - DNA, 1839 bp, Bovine  19866881126726
agttgactcattggaaaagactctgatgctgggagggattgggggcaggaggacaaggggacgacagaggatgagatggctggatggcatcactgactcgatggagagtcggacacgactgagtgactgaactgaactgaaaggaaatataacagtgacaatcaagatctagcaaagtgccgactgcttttataagattactttgagaatgcagccattagtttttcaactcattttccaaaacagaaaatatcaattactcactatactgtccactgctagtctgataaatcggagttggcaccgtgacagtggtgatggcaggtgctgaagtctcctcttcagatttctcttcttcaatccttggcactcctggtgcatcagaagataagtcattcaaaattttcctagaaaaatagagaattgtatcagttaaaataaaagtaacatttactggccaaatacaaagaagaggaaaagatcagaaaactgacagaaagttgagtgtttaggatagaatttaaaaatgttatagtttaaaatgtaaaaacttacaataataaacaataaaatatgcaacattaaactaaaaatcaatcagggcatctaaatgtcaaaaccatatgaggactagaaaaaacacagatgaatttctcctttcagtgaacataaaaaagacggtgattcaaaatccaggtgcaattaaagaagagatgaatagaaaaactgactataggaaaaacaacccttttgcatggcaaagaatgcttccctgctggctcagctggaaaagaatccacctgcaatatgggagacctgggctcaatcactggtttgggaagatcccctggagaagggaacagctacccactccagtagtctggcctggaaaatttcatggactttatagtccatggggtaaaacacttggatacaactgggcaactttcactttaatctagacactaggttatttttttcttttaaaccaatacaatcttatggtgtattggcttttttggcagccacatttaatcaatgataattaaagaacattatcttttttagatgaattcttaatccagaatcctgtatgggaataactgattttattttaaactcaagttcagaaattttaccattatcctcaacattttatcctatagtttagttcagttcagttcagtcactcagtcgtgtctgactctttgcgaccccatgaactgcagcacgccaggactccctgtccatcatcaacttccggagttcactcaaactcatgttcatagagtcagtgatgccatccagccatctcatcctctgtcgtccccttctcctcctgcccccaatccctcccagcatcagagtcttttccaatgagtcaactcttcgcatgaggtggccaaagtattggagtttcagctttagcatcattccttccaaagaaatcccagggctgatctccttcacaatggactggttggatctccttgcaggccaagggactctcaagagtcttctccaacaccacacttcaaaagcatcaattctttggcgctcagctttcttcacagtccaactctcacatccatacatgaccactggaaaaaccatggccttgaccagacagacctttgttggcaaagtaatgtctctacttttgaatatgctatctaggttggtcataactttccttccaaggagtaaagcgtcttttaatttcatggctgcagtcaccatctgcagtgatttgtagccccaaaaaataaagtgtgactattcgtttcactctatttcccttggctgctatgatctttcaagggttttattctaccatct

SEQ ID NO: 57825 - DNA, 2181 bp, Bovine  19866881171343
cgggcctgtgatattccccatgtgcaaaaggaactgatgtaaagacagagagaaaaaaaaaaggcacctggggagaaatagagcttcccatgtgcctcaggggtaaagaatccacttgtcaatgtaggagattcgagttaatttccctgagtcaggaagacctcctggaggaggaaatgtcaaaccactccaatattcttgcctggaaaattccatggacagaggaggttagtgagctacactccacaaggagtcagacactactgagtgactgagcatccatacagaagcaaataacctcatagtcacagaaaacctggcaatagcccccttggttctgatggattgtccagtccctgtttcattttttcctggagcctaagggttgttgagttctatgagatacacagggattctttcaacaagttttaattttctcatatctgagtctgtcacttgttccaaaaatctaactgaggtattgtgtatcatagtactgtgtatgatgattaagtggtcaagattattatccagctactctgtaccaatggtgtcctgtagggaaggatgagtttctcatgctccctccaagaaagcagggcttctgccagaaaaaagctacaacaatcgctttgttcaagttcacttgccgtgcagttctattttctcttccatgtatgtgcattctctccaactaaactggaagcatctttagggagatgattgtacttactcatctttcttttcatcccctgtagcacctggcccgtgatactattgaaattgctgatggtgttcatgcaaaaagaaaaaaaaaattaactttctacttcaacaattttccatttgggcaaaacttctcttacctcgacttaggaaataatcacatttctttctctttttttgttgtaactgatctctcttcttagctttgtgtcaatgaggagataggtttatttagccagtaatttccactgcagaaaatcttggtcccagattgccctgcaaaagcaatatgttctgttttatttttatattacattatatttattttaattgcattctccatctggtcaaagatagcattaggcatcatagacggagaaaagaaacaaagagatatctaaccatgataataactggaattattattttttaaaactatcctggggtactataacctctaggaatgaggcgaaaacaatagcccttttgttagagagctctagaatgattctgtagagggagagagaggcggaatgaaccaaatggactcctagtgtcccctgagtggccctgagtggactcttgcaatggtcccacacctggaaccagttccaggacagtgtggaccacggtatgaaatgatacgtacaagctctaagctatctcgagcacttttactatttcccaagtagtttcagcaggacactaatgcacagtttcaatcacatattttattaataaactttagaagagacccccaaaggggaggtcatttccttctcatttcagaagatgtttctgcaaaactctgctagcaacgtggaggtcttccaaatgaagctaatattatgtcaatggtttagcatactagaaataaatcctaaattggatgcctgcagtggatggctaggcacttggcttctgggtcacgatgccagttgaggggttatcagggatgctgaatcatttattcctgcatttaaatctgaaaatgatgggactggaggggaaggtttacacatgaaagtttgccaagaaactgtgagtggtaacattccttgatgagagtccactcccccagccactccctacaagctaccacttaggatatttatcttaaaaaaaaaaaaaaaaaactcatccaaaactggcataggcaaatgatggcatttgttggctcagagattgatgattcaggggcatatatcttctggtgaagtctgactcagagactcaccatatactacaagggtccattgatttgaaaaccttttgtcaatctttagtgtcagacttttcttcaggttggccccaggctcaggttccagaaatggtttcacggtttgaaacatccttttcccatggcagtcagaagagaaagtgcctttcccagcctttaatcatagtagggaagcatttcccccaaaatctcaaagaaaagactctgcacttgtt

SEQ ID NO: 57826 - DNA, 864 bp, Bovine  19866881246750
aatgctacataaacattcttttagtatatagtgccctatcctgtcagtggggtagcgtctaattagtggaattgttgaatcctagtcagcctgcccagttacccttcccagtgactacatcaatttatagccaataaattggtggttgtgttttttcattaacactagtattagtttgtccattacttggttcacaatccctgataataagtgttgaaaagatgttattcttaggtagaaaaacatgtttcactaaatcgtttttctcttcattttggctactcaaactctcagctaagtttgtttaattatacactttccttattttgtgatagaatcattatatacatctaaatacacgttagttacttgacttcttttctttcttgttttaatttagtttttttgagagcaatcttaaatccttttaaaatataacgtgtataaataaatattaagagaaaaacaatgtttgataggatcagacttcagttttcagagtactttcctatatacatggtctcatttgagttttataacaattatacttacgggctagaaccatatatttttatttttacagaagagataacagattcaaataatagtttagtgatggaacttggactagaacccagatctcctgattttttagtttgcttctttccttccactttgatttcattggtatatagtcaagaagaaagctctgtgtgttgaatacagtggaatttgctcattaactctaattgagaaattgtggtttgattctgttaaccttctgattctttcaagttacccagcagtgttaatctcagaatactttttacatatttcttttttcccctttgtctaacataagta

SEQ ID NO: 57827 - DNA, 1444 bp, Bovine  19866881261510
taattttcttataaaatgagatacctatttactactaggtttgttgtgaggtttaaatgagctagtacatatacggtgtgtagaagttaaacactctccacagttaaaaaatgttagctactactttgaactttattcagttaaataccctaatcatacatacagaggagggaagcacacaagtactttgatcaaattcattgaatgtgggattttagtgagaaacatttatgttttaaaataaatttattttgagataattgctgagacatacacatagtaagagataatatagagacatcctatttatgcttcatccaggttccctccatagtaatatcttgcataactatagtaaaataacaaccagagaattgacattggtagaatccacagagtttattcagatctgaccagttctgcatgcactcgtgtgtgtgtgtgtgtttgttctttgccaagcctgttctccagcagaagcatctggacagaaaattaggtcatcaattcaaaatttagatattaaagaagatagttgcacaaattcctgtagaccacatgcttgaatacgactaccaatgtattcaaagaaagggcctctattggaagtacagcacaactagatttgaattgcctcttctttccatttccctctacccctcctcactcccaaggctttactctgaagaactaagacacaagagtagagagattaaaaaaataaaattttcatcgtgcttcataccagactatcaagaaagaggtagaatgtttagtgtagtcagtacagattttgaaaacacgttttgtcatcaccttaaggggccttggaatctgggttccttttcacttcaggttggtcaaggtaatctgatcaacaagggcagagaaagccctgcacactctctcagctccacaatataggtccaggtttactgaagattgcaggtctgaaatcaacaaacaggaaagtcctgcagagaaagcacctgtaggtccttaaactgatcttaataaagttctagcacagagaagaactaaaattcatctctcttcagttcctggtggcaatgccctttctctaagctagcctgaaaatgagatgggtatcatttaccatgatcagttaccaattgagacaagttgtggttcttgaagagaattttcccataggttcaagcaaaattctgggtagccagaaatcccagtcttgagcagcgattttcacactctggtgtatgttgaaatcgcctttgtttgttgtgttagtggctcagtcatttctgactctttatgatcacatggactgtagcctgccagtctccctatccgtggaattctccaaacaagaatactggagttggttgccatttccttctccaggggatctttctgacccagggatgaagctgggtctcctgcactgcaggcagattcttaccat

SEQ ID NO: 57828 - DNA, 1415 bp, Bovine  19866881315658
agagcacctgtgcatgctaagttgcttcagttttgtctgactctttgcgacccaatggactgtagcccccagactcctctatccatgggattctccaggcaagaatactagaggggattggatggggctacacagattctttgtattcattttggtcattgttttggggtgcttgacattgttaatgaactagagtgctagacatttaatttgaatacactgcatggcttcaaagacatcaatcactgaattgtttatgcacaggcatatgagattatacttactaattacctgaattttgtttgaaagaatattttttaatattttgaactgagtgacgcaaaaaacaaaatgaagcaactggtaaataaagcattctactaacaaacaaaattaataaaagctctggaccccaagtaatcttattgaagtctttttatttcaatattcagtgttaccattaatgatatccaaactctaacaaaaaggcggtaagtataaattttttctccaattagtatattttctattgtattaaatattaagactgtaattgataacactttgctttgaaaaacaaactaaaaataaaaacagcattataagaaaagaacccataaaaatatttttcctcaagatgacaagacctgaataaggttcatcgcaaagaagtccaattagcaaatttatttgagttccagacacaatgctatttttatctctaattatgctcatctcgccaatcatttctgactattaaaactgatggttgaaaaccagtttgaatttcagctatgttagcaattcacttgcttttctagatccaaagaagtctcagtaagtgttttcactgaaggtttagggcctccttaaatgataaatcttatccgaagggttaatattagaagacatagctgcatctgaagattcaccaaatcgtgaaaatggcggaaacaagtctggggaaggaagtgagaaggggaaccagcctcagctttaacttgattagaagaatgagcacattaagagcggccattctttgactaccttttctagagggtcatgcttttacttctgtgctactttcactaatgtcttacattaatttcttaaaaagtatcacataaactcactatctgttatacatggttgaagagatgccattcttgcaaggcttgccccttactcctcctacaccctcggtactacaccagcggggctgccaagtttttctgatgctttgtgagccatctagtctctggtgctgtcaatcctgtcttcgtagaatgcaagcattggtagacaacatgtaaatacatgaacatggcagtgttccaataaaactttgcttgtggacactgaaatttgactccaagtcatttttcaagtgttagaaaacattattcttcatttga

SEQ ID NO: 57829 - DNA, 695 bp, Bovine  19866881357176
ttatattgtttgaggcttaagtgatttaaacaatatgattattgcttttaaggagatcataaatcttaataaaccagacatgtcaccaatttgtggcccctttgattcattttggagatactatttaattgtccaggattgaagaggaatgtttttaagcactttacagccagcatattttcttaacatttcctagaccaggctccttaaagagatagactttatgttgaactttgaatgaaaggataattagttggggagaaaatcaagtatatgggcatgagggaaagttaatgagaggaaaaataggtgaggaaaaccctttaggagagatggcaaaagtgcctggagatgtttgtagtcttccctggcaagtttcgtgtaaattatggtgagataaggactggttgaaaaagagctgtttggtaaccttggcatcatcttgcctgcatatgacaagtttcttgcatacttcttgatcctatgaaagtaactaccgcagggagattttggtgaactgaatttgtgctgcaagacttggattatcttgttttctatcaacttatgctttgggatcctatcatagaagttgcagatatggcagtaatagatttgcattttttttcttttttagagactaggtcttggattggggcttctttggtggctcagatggtaaagaatccacttgcaag

SEQ ID NO: 57830 - DNA, 1227 bp, Bovine  19866881413821
cgatacaatcacctatatctgttgcattaaatcctcattgtagtatcctagaagaatctggtagggcatgttaatccaatgaacaaatctagggcctgttagacgatcatttttgcaaggtttttaaaactgtacttatgtctcttggaattttaaagcagtccttttctggctaaatgtgaacatgcattacaggtggtacacttcacttgtgaatgactcccattgctactaataatacaaccggggaatacagatgaaccaacacaaaataattctaatggctgctccaccagtcagtttcaaaactgctaatgggacctgagacttttgagttttttgtatactcacaatattagaatgattatttacttccatttccctactatttccagagtggaaattcaaagcccttttgaattttcttgatgaaagtattcacacaattgtgttttaagatgatgtatttcactctactgagaggggacgtaagggagggagtagaaaaatatttatttcagagccccaaaccctgaatttgaatactttgggtctgccacttaccaattgtgtgaccttgtgtaggtattacacaagggctccaaaatcactgcagatggtgactgcagccatgaaattaaaagatgcttgatccttggaagaaaagctatgaccaacctagacagcatattaaaaagcagagacattacgttgctgacaaaggtccatcaagtcaaaagctatggtttttccagtagtcatgtatggatgtgagagttagaccataaagaaagctgagcactgaagaatgatgcttttgaactgtggtgttggagaagactcttgagagtccctgggactgcaaggagatccaaccagtcaatcctaaaggaaatcagtcccgaatattcattggaagaactgatgctgaagctgaagcttcaatactttggccactttgatgtgaagaattgactcactggaaaagatcctgatgttgggaaaggttgaaggtagggggagacagggaagacagaggatgagatggttggatggtatcactgacttgatgatgagtttgagcaagctccaggagttggtgatggacagggaagcctggcatgctgcagtccctggggttgcaaagagtcagacacgactgagcaactgaactgactgtgtaattgtttttctgtgcctcaatctgtaaatagagaaaaaaaaaaa

SEQ ID NO: 57831 - DNA, 681 bp, Bovine  19866881421948
tattaaagagactcttgtaacattctcaattcactcattaaaatgataaatgttagtactgtattcatatgaaataatataaacaagtgttatcacctacagggaaaactgaggaccaaaaatagtaaataccttaacccaggctatacaacctgccactaaattaaaatctgtcccattcccttcagcttgtattctatttagcattaatatagtttagtagtattcttactttgttcactcagccatcttacaatcaggtattaagtgcccatagatttcaggtgctgtgctatagaataacccagcagttaagataggaagggctgttcagataaggaaggctaaagaaagacagggcattaaatgagattagggctcctgtcagtggtcagaagcagcatggatgattctgagatacaaagtcacttttctcctctggaaaggctgttttttattgatgctgttcatcttttaaaattatgccaatgtgataatacattaatttatataaatagaagccctaattcaaggtcaggcatatcagcaggatgaaattaaatacctcagtctggaactgtagggggcccatcgaccactttcaacctcctcagctctatagataagaattctttgaatttatacaatagcaactgaaatagggcaattttaagacattaa

SEQ ID NO: 57832 - DNA, 1801 bp, Bovine  19866881587136
ctctagacagtgtctcatttttccactgtggatgtctcatgacttttgtgattcatttcatagcttttcccaatttttccttataacactcagtgtttttatggcctgttgaatgttgggacagataaaaaggttagatggaaaccaactaaaaagcctcacttcattaggaatttgattgagattaatttagctacaggtatcttcaagtaactacaggcaaggtgaagctcaaatctaagttttaactggagtagccctgacttttgtgatgcctgttcaaattttattagtaaagagatgaaacttctgatactggaaaggagttatcatcaagctggctatcctgggaaagaaggagaatatgcaccaagaagctcattcaagtctgcatatgagaagaaacatttgggaaggaattgggatgtctaaatttatagctcagttggtaaagaatctgcctgcgatgcaggagacctccattcgattcctgggttgggaagatccactggagaacggataggctacccactccagtgttcttgggtttcccttgtggctcaactggtaaagaatctgcctgcagtgtgggagactgtgttcgatccctgggttgggaagatcccctggagaagggaaaggctacccactccagtattctggcctggagaattccttggactgtatagtccatggggacgtaaagagttggacaggattgagcgactttcagtggtttgtgtaatgcctcatttcaacttcgtaacaaccctaaaaggcaatcactcttatccctgttttcccatgaagaaatgaaagttcagaagtacaaagggatttgcccaactaagggcagggatttgaaccaaaaccatctttgccaagatccacactctctcctatagtttaaggttgcagattaactttgttcttttattgtgtcttccagaaagcttcaaaactttatttttttttaatgaagctatagttttaccctgaaaaggaaaatttgattattactcaatgtggtctaaatttattctaggagatttagcaacaacttgaaatttcattttcggtcaccaaatttcactaacattttacaaattgctttccaaataactgatttttttccagatctatctctgacttccattttttattaagctgaaatatttgaggtgcaatcactttccacaggcattttgcaattgtaggacaaagatgctataaagtaccagaaacttggaacatacagttattaccacgatgatgctaaagttgagcatttggattgaggatttatgtattacagccttacttctgggaatgtgtgactagcagatcaagtacaaagatatggtacaggaagtgcagtctctcagccttctttggagagcctgtttattcccaatcctactgctaaactcaagagttactcttaaatctttcaagtacccaggccagaagaacaatttcaatttctcttctgaactttgttcatgagttttctgtagtaatacatgtgctgccaataatttggattcaaattgtgttatactttacatcttcacatcccttacactttcctgctgtacatagaagctgtgcaggatctcttcatgttgaaatggcacagcccagttagttagtctccctagagtgtaacatgaggtcaggggcaacctggccgcagtacatggatttctaaaattaatcatgataaaataagtatggcttcttggttgttgcaactatatatgaggtggacctagagattttcatgcttaaactaagtcag

SEQ ID NO: 57833 - DNA, 819 bp, Bovine  19866881998480
cttctctggcttctagattcaaagattttttttttaacataggaatcagttctactaatcatgcgtgaggttggctgtcttttttaccctgttatcgtcaggcaatcaaagatgtaaaaagggcacaagaggtgcaggaggggtggacaagggatacttgaagggctttgtaaggaagagcacagagaggagaaggaaatggtcagcatgaagttcattttggggggtctccgatatatttataaaacgcagctttgtcatggaatccaaacatctctttttctggacataatactcatcaaccaccaggcattaagctgggccaatgaaccatcagtggggcaggaggccagtagctaggagcagcattataatttcaggtttccacatctttgacttacagtcatgtggtaggagaaagaagcacaaattaaaataaaaaaaaaactgtcaatggcttcgaaacactctttttctatacattacactctgaaccctggataaagcgtgcttcggaggaccactacaagaaacaccatgacaggtttttcctttcaaattggagatatcctggaatgctggaagttaccaatttaaacgagacaatggtttaatatgtttcaactgtccactaaagcactgctttgaataacctgtcctcttggaagcaaactagcttcaggttatttcccagaaagcctgttcactccagcaggctccttccaaccatctctgccatttcagagaggatggatacttgataacatgcccaaatgactaccgctctccccaccccacaacagacaggacggttagcgt

SEQ ID NO: 57834 - DNA, 1661 bp, Bovine  19866880164375
gttcacgtattgctgaagcctggcttggagaattttgagcattactttactagcgtgtgagatgagtgcagttgtgcggtagtttgagcattcttttgcattgcctttctttgggattttaatgaaaactgaccttttccagtcctgtggccactgctgagttttccaaatttgctggcatattgagtgcagcactttcacagcatcatctttcaggatttgaaatagctcaactggaattctatcacctccactagctttgttcgtagtgatgctttctaaggcccacttgacttcacattccaggatgtctggctctaggtcagtgatcacaccatcatgattatctgggtcgtgaagatcttttttgtacagttctgtgtattcttgccacctcttcttaatatcttctgcttctgttaggtccctaccatttctgtcctttattaagcccatctttgcatgaaatgttcccttagtatctctaattttcttgaagaaatctctagtcttccccattctgttgttttcctctatttctttgcatgttgactctaattcccagaaggctaaaaaattgttgattctagaaagtcttgtcttgcccttctttgaaactcacacagcgtctagcatggtaccctgcatgcagttaaggattcaaaggtttaataaactaatttttacagattatgacaaaccaagaatgcagagaaattggaaccctcatacattgctggtagaaatatacaatggtgcagctgctgtgggaaacggtggttcctcaaagttaaacacagagttagcatacaatctatcatttctattcctaggtgtacagagacaagaaatgaaaacacgtgtccacacaacaagttgtaagtgaatgttcaccgcagttttattcacaaaagctacaagaagaaactcaaatgcccatcaaccgatagataagcaaaatgtggtatattcatacaacagaatattattcagctatgaaaatgaatgaagtactgatacatgctccaaggatgaactctgaaagcattatgctaaatgaaagatgccaaatatgcaaaacaacacatattacatgactccatttatatgaaatatccaatccagagagacagagaacaattagtggttaccaggggttggaggaggggatgtgactgcttaatgcatttgaggtttgggataatgaaaaggctctggacctgacagtgatgatggttggaaaacactgtgagtgtacttgctgccgtcaaactgtacactttaaaatgtttacaacagtgaatcttatatgtgttttgccccaatttaaaaaaaatagtattacagtgcagttgttaacagaaatcataatattaaatataaacagtgcactacatcattctttttaggttttatctaaataatttttagataaaatgctttcttcctgcacacgcatatcagaactgcctatttgaatacttgatccaaccattcattcacaaacatctgtcaaatattttagctttacaaatcctctgacttcctggctacttcccatatgcccagcaatctacaagatacttcataacatgatctaattttacaccttgtaataagttgctagagaaggatgtccctgccagggaccttatctcaat

SEQ ID NO: 57835 - DNA, 1913 bp, Bovine  19866880386278
tttaagccactttttactctcgtctttcactttcattaagaggctctttagttcttcttcactttctgccataagggtggtgtcatctgcacatctgaggttattgatatttctcccagcaatcttgattccagcttgtgcttcttccagcccagcatttctcatgatgtactctgcatagaagttaaataagcagggtgacaatatacagccttgacatactccttttcctatttggaaccagtctattgttccatgtccaattctaactgttgctttctgacctgcatacaggtttctcaagaggcaggtcaggtggtctggtattcccatctctttcagaattttccacagtttgttgtgatccacacaggcaaagactttgctttagccaagagtctgcttttacagaccaatctgttatcaaaccagtagtactggctggtggtatagttttaagctctcccaaagacagccccaccagcaccactcctccaattgagatcagctcctctcatctgaccaggttgacccgctgaactactgacaggaagagcgagctcctgaagactctgaaggatgaccggaatagggatttctcagagggcagagagtgtgagaagctgaaagatttggaggataatagcacacctgaaccaaaggaaaatgagaggaaggctgtcatcagaatggtctcgctctccctgtagaaaaggaaagggaggtcctctctcactcactggaagcagagcacaggttactgaaagcaatgggatggcaggagtatcctgaaaatgatgagaatttccttcccctcacaaaggatgacctcagagagtaccacatgaagacagagcagctgataagaaacggctttaggaagaatggcttcttgcagtcgaagttccaacctattctccccttggaggaccacttgcagagcagagtttgaggactcagacacagagacaagtagcagtgagacatctgatgacaatgcctggaagtaggcatataaatgctcacagttaaatctgacccagtaaactcagcttgtgtgtttagggattatacagaagaaattgttcttttccttttcttatgttattgttgaatatttcatgcacaggaaaaatagtcgtatcccaaagagagagcgaacagttggcttgtttagcttttggttgttgttctccctgttatctgcttaatagagagaactttgtgtggtgggaaatatttttaaaacacaccacacatacacacagtatatatggggcaatgcacaggatagagctggcagtgcagagaggaagacacactggtctgcagcagcagcttctactaccagcccttggggcactcacccctgtgctcaagcaatcactgtcaatgacaaagtgactattgaagttataattgtatcaaattaatgctaataatttggatattttattttatttctggctgctcaggtaaggttagcccttaaccaaacatatgtggtttctcccccctctttttttttctttctgggtacagctgtaaaatatttggatttgctgggctattcttgaagccttgatattcagggtggattgcaaaataaaaatttttgtgagatttcaaagattaagattactttgataacattatttacagatttaaaagatgtggttatcacaggtctgttggggggaaagctactgcataaaataactcacttgaaataaatagtttgcatcagtttggggggaaaaaagttttaattttaaaaagcaaattcagtgtatttcaaacttacaaaggctcaaagaatttcttataagtagaccctcgatcccaggtctcccacattgcaggtggattctttaccatatgagccaccagagaagcccacaagtggactcata

SEQ ID NO: 57836 - DNA, 1391 bp, Bovine  19866880488641
tggggcagcacttggtgttgtctgctcctggttgctccagaaaatgctttcaccacagacatggtggggactggcgagagcggcctgggagttgggagcagctctactcttgccccggagaaggcaatggcaccccactccagtacttttgcctggaaaatccatggacagaggagcctggtagactgcagtccatggggttgctaagagtcggacatgactgagcgactttactttcactttttactttcatgcgttggagaaggaaatggcaacccactccagtgttcttgcctgcagaatcccagggatggggaagcctggtgggctgccgtctatggggtcgctggagtcggacacgactgaagtgactaagcagcagcagcagcagcagctactcttgccctccattggtaaaccctgggaggaaagcaaagagtcactcagtcattccttggggcttttggagtgaagatttgtgggcagcttgactatgctactgatggacttgcccgtcacaggctcacttcattcgcttcttccattgccccttggggcttccctgatagctcagttggaaagaatctgcctgcagtgctagttctattcttgggtcgggaagatcccctggggaagggaatggctacccactccagtattctggcctggagaattccatggattgtatagtccacgggcaggcagagttggacaggactgagcgacttttacttttcactgctcctcaaattaggcaagttctttaacttcactaagctccagtgttctcacctgttacatcaggatgtaaacatgtattctaggattactatgaagatgatatatgataacacatgtgaagagtttagcacagtgctttacgcttaatgagattttaaatattagttgtcattgtggctaactctgtatcatccagacttcaccttccccaattctctctcttagacttctaagaaacctaagaaatccagctgtgagacccagagccaggagtgtttcctgtctccttttcggaaacctttgactcaactaacgaatcgaccaccctgtctggacagcagtcaacatgtaagcctgagctataacctgtcggtgtctgtgtgtgccctcttttgtttagggaggctccctgaatcctctctcagtagccatcagatgctttagtgggagatttgggcctggccacagctcccggggcctggaaaaggcctgacctcttttcttagagatttccttagtgtacctgacttggaattccccttgttatagctacttgggcaccaactctcaggtggctgggcaccggctgatgacaacaaggtgcagacagtgaagaccttcccatttagacagggtgtggaacccagcag

SEQ ID NO: 57837 - DNA, 970 bp, Bovine  19866880498646
gaatgcctttgctgggccccgtcaaggcctccaggacctcagtgcaagggaaaaaggaaaaaagagaaaaaagatagcagaaagagaaagacagaattggtgctgggagttgtgggcagcccatgcctcagcccctgcaagctgatggtactgagcatgggcctgtgaggcctgggcccatcacatggtgctgacataatctgcgaaggcttgcgatgagtcccacgagtcgctaaccacatggcaggtggcccggagccgccggatggcttccctggctgtgactgcatcctggtccagccagttctggaagaggcgcaggtgaccaaaggccccacggccccagcgctccagccgcttggcgaactccagaagcccatctggcttgatgcagttggaactggtaggggtgaggatcagaaacccaggaatcaatccctggtctgtgtccctgcagctttatcccttgtcattccccacccccacgggtacctgatatccagctgacagagagaggaggatgaatcttccgagaaaacatctgccagggccagtaggccagcattccctggggagatggggagaaatgctcatgacctttaccccagaataggaaacaaaggtatcccaacccaattctggctggagagaagcccagtctcctaaagccccagcacaactgtatcccaacccctgtcttcccagtggagaggtatgtgccttcacccactgagtttctaggtcagaggactggctccttccccctctccctcctcagggccctgtccccacccaggcggttccctggcagccggaggcccttcaatgtggagttgcccttcatagcagcaaccatctcgggcagaaattgggctgggcgcttctcaaacagacggcagaaggagaaggtaatctctgtaaagaaaaatggaacaagttctggggcagcctagaactggtgctgtcccac

SEQ ID NO: 57838 - DNA, 1201 bp, Bovine  19866880527382
tgtacatgttcccgtcgcccttgattttgctgcagaagcagcagctgtgacggttcagctccatgtctgcccagtggcacatcttcatctctgcctcttcagctgagcttagtggcacatctgtcttcagcagaactgaacccccgcaggaggagagggcaggtgagtcagaatgtttctccccaaggataggatctccttttcatcccacgaaggcccaggtctctctccagcccagggcagggccagcctggctgtcgcgcctcctcagcagagccttggctgtgtccttgagacggaaggagcccgtgtccttaataatgcaggtgaacccttggccaggtgccatcatgttgaggaacagcaccatggcctcatctatatgaggcacgtgcatgcctgctaagttgcttcactcgtgtcctactctttgtgaccccatggactgtagcccgccaggctcccctgcccatgggattctccaggtaagagagtgggttttcgtgccttcctccaggggaatcttcccaacctaggtaccgaactcaggtctccaatattgcaggcagattcttcactgtctgagccaccagggaagcccaggtcagtttctacttcccggtaagataccactccactttttccacacctcaaagggcttgatgagggggctgggcttccagttatccatgctgtattggggggcggaaggggcgggggtgcaggggtcgtcaccactgtcctgaccaacccatacctgcaggaatggctcagggagcccaggccccgctgaggcccacacagctctgcccatcacactgcagcgtccatctactccacgcccctggtggccccaccctggcccacacttgtttttaagaggccaaaaagcaggacaagtttaaattcttggcctccaaatcaaattttggaaagacttaacagcatcaaaattacattattgttagtcatgcctattcttctcctatcgttggggcccccaaatacccctaaatgctgtaggactccagctctagctgtgaagctgacacagttctgtgccctggcacgtggcaaggactctgagatcacaacctggtttcatgatgaggagataatgactgtaagtgatgaatggcaagggctttatgttctgtctgcaaatcatgatgggaatcttatggtacaagatataaaacaa

SEQ ID NO: 57839 - DNA, 1026 bp, Bovine  19866880594278
ctgacttatggccctaatgcctaattttagttaggagacagtatttgagctcttctgatggtgttaaatgcttaatgaaagatggcagaaataggcacattatacccattttatgaattgtttgaacccaagtgtgtagagctgtttatcagcagcctgtcctcgcaggcagttaacttgtatttgtcagtatgatgaaatgtggtgttggtatggctgcagactttaacatgatactggaaagtcaaataacatactgctcactcaaattctgtgcatgctggagctggctggagtgcggcatgctcattggtgaggaatggtgagggctgtgcttctttccacggctgtattgtgggaaagcatcttcttgagcatccttgcttcaaatggactgaagtaatttaacttttggtattttcttggccttattagtattaactgacagttggcttaaagaacccaggaatactggctgaggcctccaactgactctgagtagatgggagtttctagccagtgcatcaaagtcagtagttaatttcttttgatctgaactgtgcaggttgacttttagaagagaaacacagcctgttggtcattgaaggtctgaattatttaagattatgctaagtctggattagactcgagttagactgttaaccactgactttattatttatattcagttcaaatgttacccaatttggcttgaatctggcctgtcctaccccagaatataggtcatttgacatgtttattggaatctctgacttgtcctgtcatctttgtctgttatgtttagtattctcaatactgaagaatttttgcttgcagaaaccgagggctcagaagaggaggataaagaaaatgacaaggctgaagaaacactaaatgattcagctcttgaaaacaaggtgaattcttatttgccgagtattatctcctttcttattgtaggactgtggtttactagtgtaggcataattattatagatagtcatttctggttagggtttggggacc

SEQ ID NO: 57840 - DNA, 1189 bp, Bovine  19866880699997
ccccaatagataagcaacgtcctgcacaactcagcccggggccaggccagggctgctcaatcctgcctctccccacactggcacctttccaaggtctccctgacaaggcagctctaggctcagcttgaagctggagggatggtaaggtccctgcccaggaagctccaggccttcttcaggttctgccaaggcctgtcctccatcttccccagtggcctgtcccagggaggaacacagcactcagctgctctccctgcatctacccatgttcctgatcccaccacccacccccaaacccagtcactcacaagttctgtaggaaggtcgtgccaccgtcactgaacagcccacccgtgcccagggtctccagagcatgaggtatgttgcttggcaggaagggaaccagctgcagagatggaggcatgtaaggttcccagacctagaaacccttgggtcccacccccaaaaacacactgtcaaggcagccctcagccctcacggtgccctcactggagccacaaaggcacccttgttggcctgtgataactccccataagatgtgtatcctgagaggagtctggaaccacatataagcctgtctcagatgaacggccccaagcctgccatctcagggcgctgagaacccctggacagctgtgcaccactgtttgtggttgacgaagaaggaccactccatgcagctcccacatcccagctcagaggtgaggtcaccatcaagcatgtaccccaatacttctgatcagcccctttttactggtcccccagggatcgaatttgcgaccccaatctcagaacaatcagggtgcaagggtgccagggatgggtggcagccatgggtacctagaaggcttccctgaaggaggggcaatgccaggacctttgggttccctccccccgcccagcataccgtgtggccagcaacctcgagtctctccttggtctccagcagggcccgcttcatggccggcgtgggcatggtatagttgtcagtctcataataccctacacgcaggggctgagagctcctgtagatctgggggcagcatgcacgagtcagagtcaggtcaggagacggtggcccgaagcagggctcccagagctcagagccattactcagccccagacacagctttgaggctgctgcctagatccccaaaaactacctcca

SEQ ID NO: 57841 - DNA, 2749 bp, Bovine  19866880791790
gggcaggaggagaaggggacaacagaggatgagatggctggatggcatcactgactcaatggacgtgagtctgagtgaactccgggagatggtgatggacagggagacctggtgtgctgcgattgatggggtcgcaaagagtcggacatgactgagcgactgaccttgactgaactgaagagaaatgaaccaatctgaagaggctacataccgtatgattccaattacatgacattttggaaaaggcaaaactatggagacagtgaaaagattagtggatatcaggagctggggtacagagtgatgaacagatgggacacagaggattttagggcagtaaaactactctgcatgatactacaatgatagatacatgtcactatacatttgtcaaaactcatataaaaataaataaataaataaataaactcatataatgcacacgaagagtgaaccctaatgtaaactacgggttttgggtaataataatgtgacaatgcaggttcaacagttgtaacaaatgtactaatctggtgctggatattgatggtgctgaaggtggttacatgtgtggggatagggtatatgggaactctgtacaatccactcagttttaccatgaatctaaaactgctctaaaacaggtttattacttaaaagaaaaaaaaaatcacaatgaactagaaaggttccactcccagaatggctaagtgcctacttaattgaccttactatagttataatctagttatatatgctgttgttgttcagtttctaagtcatgtccaactgtttgtgaccccatgaactgtagcaagccagcttcactatgtccctgagtttggtcaaactcatgtcagtgatgccatccaaccatctcatcctcctggtcacatagtaaatatttaatattgaactaaactgtatgaaatgaacctactttcaaatcaacagaccccatactattcaacatattccagactttaaagtgaaaataaagagtcttagaatattctgtggatccaaatatcaggatgtataagattttagaattaatccaatatgaagtttgatctttctctacatttggttaaatgcagagtccacagtcatgaactgggcttttacatcagttcttcctcccggatctgaggcctacttagattttctgcagtatttaagagcgatgatgatgatagctaacatttatggagtactggggagcctggtcggctgccgtctatggagtcgcatagagtcggacacgactgaagcgacttagcagcagcagcaagcatgttatatgtattaacataaagctagagcccgcagacccagacaggctgaaaaggccaggtgatgttctcgatcaaagtctctgagtagggaaaaatctagtcctaaattctgtcagcaatctaaataaagagataatcatatcagagagaagctgcaagtagtgattactgcctggcattcacattatagttgtgatactatgttcaaggtttgcaagtgctaaattaatttctacatgatgaaaagtccaagtcagatatatgctgagtttttacaaagttcatggttagaatgcactatctgagctaacacctagcccagttcattctgagggaaaagtccctatgcacaatgagaaatctggctttaaaagccaagtaggtctagttccctgggtctccccgtgctcttgctggtgtcttctcatattagagttagtacagtatttgagaattctactgattcttggaagagggtcatgagcacactgaatagctgggtctgagtgagtctgataaagtgagacccttatctcaaggacacagatcagcttcagaatcactcgattcttagggtgctcaaacaactattcctcattcatcctcagagtcactctccaaagacacactaaactataagcaagtagacaaactcaaatggaacagacctgtcttatttggtttaatgctatactgtttcactactttggtacctttttattgcccaaagacaaggcttgtagattatcaaatccaggcagcaatggcttcctatggatccaagcctgctctatttccattatccctaggtctggaacttctactgtaaacagcatagcagtgaacagtgtagcagagcaacaactccttccacaaagctgagtcccctggtctgactcccctgggatttaagaatacatgtctagactaaaacatatggctaactccaatgaggtcttctgcctcataatttttatatattctttagtcagatgcaagtacatcaatccttatactgcctagaagagcccatattccagatgaatgcctgagatcagtgattccacatactggaactgaaataaatgtcaacatgaaacaaacagttctctcactactgttgacttctgttctaacagagggcaagttattaggagtcctatgaggcagaaaaccatctgtgtgagccctaattcttgggcaaggtaggacaaaatgttaatggaggcctcatcacatggtcccagatgaccggagtcataacacactctcaacacaccagaacaggggtggtggacccaagacatgcataagaccaaaaggaatattgacaggtcaaggcaagaaataactaagagtcaaaaacagactgaacatactctcccacagaaagcatgcccgtgagttctgtctgcttcagtcagccaagtaagaaaaaatatatcgtaaca

SEQ ID NO: 57842 - DNA, 1288 bp, Bovine  19866880814854
caaagggagttggcacctgcattgttcagtgtcaactgtactagggaactaatttttaaaatttagatgtcatttagagttctttagaaaagtggaaattcttttttaaagtgaaaaattaatatttttgcttataatttaaaaatatattgaaaaattttaccatcctattatatcttcatattttgtactcatctgagaaatatgctgaagccagctagagggataatatataggaaggtggagatttcttttgaatatatgtaattaaatacaagtagaatttcatcatggagaaggaaatggcaacccactccagtgttcttgcctgaagaatcccagggacaggggagcctggtgggctgccgtctatggggtcgcacagagtcggacacgactgaagcgacttagcagcagcagcagcagcagaatgtcatcaaatccaaacaggtagcagtaacaatacaggaaactaacgtcattttaaaacaggtgcttatgtgatccttaagtttttttcctatcttgtaaataagatattgtagttaaatattgtatttgtatagaaagctgtaccactactacacaaatgctgtgcgtctgtcaattatttttcatcatctgtgacatgtctattatatatgattaaaaaatagaaattcatatttaccatctgtctgtgtttagtctaatgatctcacttagtcttctttaggatttaacacattaagatggttaaattgttttttgggggaaaaaaataacctgcaaaatgaaaatttaaatagaagcaaaatttattatatatagtgaaataacattatttggtgtactcagacaaaaagttagttaaacaacttggtattattttagatgtaatctaacaacttaaactattaagaatgctttacttttattgacatatatgtttctctaggatattttagtcattgaacacaacatattgtctgttgcttgttaattgatgaatggtagtaaatttaccacattttcacggaagccaacctaaatactttgaatatccaaagcttaactttttggttttaattctgtggattaagttttagtctccatggtcattctgtgccaacattggtactgggtatgatattaatatctgagaatgatttttgaccacttacttttcttgagcctcttgcctaaactaacccactttgaatgtttctttttggctgagaaattaccactgactctgtttttctctgctgtggtacgtgtcagaatctctgctcttgccgaggatctg

SEQ ID NO: 57843 - DNA, 740 bp, Bovine  19866880882882
ggaaaattaagcataaatattttatcccaaaacacatacatctatcctaaatgtacatttcacttattcagaaccctatcctcaatacagtattaaaagtaatacccatacatacaatttaaagattatcttgtctttttttgtgtgtgggaagaaaactatttagaaaattttaaaggttctcctacacaggtttttaaatggtaatctttaaatgacaacttgtggggcattaaaaatatttttctaaactactaatctcaagaattattttttaaactccattcaactataatacttagtctaattaccttgaaatatccccccagtaccattctgcatcctgaagagaaacagaactgtcctttattccatttgtaatggctgaagtcattggcttaggtggctttggtggaagagctagaagagaaattaacattattattttgtaatgtaaattattatttactctctaatttcctcaaatacagttcattaaccaatgtacattaaggttccagatcattataaatcaaaatagggattattttatgttaaatgttaaacatttgccaatgaaagaatccttttagaactctaccaataattgcctgaaaaaatgaaatattcaagctatctgcatttttttccttcttataaaatactaactttttgttggatgcctttctcctaggccagggtcgggggtagagaacatctgtgccacccttctttcaagg

SEQ ID NO: 57844 - DNA, 1011 bp, Bovine  19866880939342
taaaatttaaattttagcagtgtacaaaaaaaggatctactatatttacatactacttaatttatattttaagaccatgtggttctgtgactcaagtttcttttatgtcctgccattttctttgagtcttctagtgttgttccttaaagtcctaaaccatctctgcagaagaaattttttgtcagtataaattcaaattggagaatattattgaaagattgtgaactgagtaaattatccccactctgatctgacccagctgccactgttgtttaaacttaatctttctaaacagctgctgtttttttctgacactctacaagttcatacctgcctacggaagccctaaaggcttaatggaaacaggtattccctacagacagttgaaacctggaagagtttaaaaatcaaatactcatcctgggattgcaaaacaccaaaaatcaaaacaaaagcatatctaggggaggaactaaatgacctctgacagcccccaggattctataatcttagaccccacctcccaattagtcttagtgataatatgtgaagaaaacaaccaacacttacattaaaaaaatttttttttcctataattcctttcttcagggaggaggtaaatgacaaattgcgggacatgccagatggtaccttcttggtcagagatgcctcaaccaaaatgcagggagattacactttgaccttgcggtgagtatttttcagcattttgtctagtgttctactagcatgatttatttctggtatacaaagattcctgtattttatttaaatctttatatacaaatttcttcatatttttatttaatttagatacataattttagttgtttggctaactatctttttcctacacatttaaatatttaaattaatactaaaaaggcaacaatttttatttttatgtagcagtaaaacaaaaagccttaaaatccctaaatatgagaagtaagatgtatactgttgaccttagaggaagtagaagtcagggca

SEQ ID NO: 57845 - DNA, 1904 bp, Bovine  19866880984777
acgcttactccttggcagaaaagttatgaccacctagatagcatattcaaaatcagagacattattttgccaacaaaggtctgtctagtcaaggctatggtttttccagtggtcatgtatggatgtcagaattggactgtgaagaaagctgagcaccgaagagttgatgcttttgaattgtggtgttggagaagactcttgagagtcccttggactgcaaggagatccaactagtccatcctagaggagatcagtcctgggtgttctttggaaggactgatgctgaagctgaaactccagtaccccgaagctgtaaaaaaaatatttggtattgtaggaaacaaattccaatgtttgatgatgagctttcattttttgattgttaaatgtatttcattttcatggaaataagtcttttcgatattgtttaaaagttgattaaaacatctttttcaacattactttaggaatatctgattttaatcttcgtgttgcattgcaaacacttttgaaagagtactgtgaggtgtgcaaatctcccaaagagaacaaattttgtagttttctgcagacatctaaggttcgacctcggaagaaagcaagaaagtacctgtatgcagtaggtgagaacccttttaaaaagtaatataaattatctttattttcaggatcaaaacctttaaaagttttgttattattaaaatgtgagaatatgcatgtatgtcaaataggcatatttaatttcacatacaggctgcagatttagaaattgcatttatatagtatagtggacacatctaagaataaagatatttatttgatgtctattatttggtgatttaaatctttgcgttcttagatacccaattattatcaaataattgcctaagatatgtggctttaaaaagtaatatttgaattctagtgagaaataggaaaataaatctcaaacatattaactattcacagcgtctgagatggtctttagggataacaggaactagtggtctccaaagtgtggagatgcaggacaatccaaaggaatattgtatggacattttgtattttattatagtgtagtatagtgtagtgtagttttttggccatgctgtacagcttgagggatcttagttctctgactaggaatttaacctgggccacctcagtgaaagcacagagtctgaaaccactggactgccagggaatttcctctattaaaaaaaatatttaaaatagaatttaaaatgttgatatatatcaacaacaaaattgtccagatttatatacataattaatttatatataagaactttatgtataacataatttatactatgtatgtcattgcatgtgtaattttatatatactgttatatataaattataatttttgagtattcattaaccttttttataatgggatgttcagttaaacaaggctttcaaccctcactattttttaattgaaaaagatattaatagggacttccctggtggttcagtggttaagaatccaccttgcagtacagggaagacaggttcggtctctgggtggggaagtaagagctcatatgctatggagcagctaagtctgcacactgcagctgcttagcccacaagctcgagagcccatgtgccacaagcactgacctctcaagctgcagatactgagcccaggctctacactagggtctgcatgtcacaatgaaagatctcttgtgacacaactaagactcagtgcatgaatagaaatcacaatgaaacttcctagataacaagttcctagatttacattttatctaacatttagttatgaccaggaccaggtggtagaatattgtggttgaattcattgcatttaagccatcatcttttaggacttggtacatttaagaataatggat

SEQ ID NO: 57846 - DNA, 1024 bp, Bovine  19866881035856
attcattgaagctacagtcgtccactgtttagtaactggatcataacattcagtacagtcaaaaatcattgaatctttttcacctgagtcaaataagagacacatatgagaagaattaataatgttattagcctaaaacccccaaacaatattcaatggcattctgtgttgtcagaattcaactattacgtctgattttatactcttcattaaaatttatttgcccaccatgtgttattttgaatcatagcactgtcatttattaatgtccacttaattaagcaaagtagactattacctgtttctaattccaccacccaaacaatccatgtaatttttggggataaaggttgcattttgaaacttctatattttcacagcttagacagcaggctctgctacaatttgagttttaatgcaatgcttatctaacaacaaacagaaaatgaaaaaaaaattttaaatagcacttaaaaatagaattttaaatataatatacctagaagaagttaatgcaatcaaagattgtatatggcttggcccaaaagtttgttcagctttttctgtaagatgttatggaaaaatccaaatgaacttttggccaacccaatataagacctttatggatataatttataaattttatttagataaatttttaaattagtagctcagacagtaaagtgtctggctgcaatgcaggagacttgggtttgatccctgggtcgggaagatcccctggagaaggaaatggcaacccacttcagtattcttgcctggagaattccatggactgtagccctaccaggctccaggctccagtccatgggatggcaaagagtcggacacgactgagtgacttcacttcacttcaaataaatgaagagatgtatcatgttgatgaattataagtgtcaatgtaaagatgattactcccaaaatgatttacagatttaaagaaattccaatatttaagaaacctctttttattgcattaaaatacacataacataaaatttatcat

SEQ ID NO: 57847 - DNA, 5008 bp, Bovine  19866881058946
acacttggatggcttctcatcacagtcaagtttttttctttattaaagcatatttgatatacaatattatataagttacagatgtacagaagagtgagtcacaacttttaaagggtacgctccatttatatttctcagtcaagttttaaaagcccaagttcttacaatgtcctatacagtcttccccaccatccacatcattacttgtcttttaaatctgactatatgatagtttcccctcactccacttcagccacactggcctccgacctgatccctgactgcctgacacacatgctcctgtgtgtcatctggtattccctctgccaggcatactggcatataaatcttacctcccatatatctacctgactagcaccctcacttccttcacatcaggcccttcctgtcctagtatctaaaatagtttccggcgggaatccatggtggtccagtggttagaactccactcttccaccgcaagagagcatgaatttgatccctgattggggaactaagatcctgcatgctgcatggcctgaatgaatgagtaaataaatatataatattgaaaacagcagctccctcacccagcactcatatttttgttctctgctttttcttcataacatttatcaccatcactatgtattccacttatgattttgtttattctttgttctctcccctcccttaaaaatgtatactccatgaataaagggagttttgctgttctgttgaatgctatacctgcctggcaatcaaatatttgctgaaaaacatgaattaattaatagacatgaacgaaaacatttttggatgcttaatatggtctgggcatcatgttagctgctttacagttgttaattcactggactctcaaaacaatcttattgaagtagggacaaccatcattgccgtttttaggcaaggaaaccaaaacacagaaaacataagtaaattgcccaatgatatatgctaggaagtggcagaagccaacatgaactctggcaatctgattccagaaccctctctcttcacagccccactatattgcctatgaatttctaactagttaatacaatctaattaaaagatatgatctatgagttactttaagtgtcctaatttttaaggtcagtcattcaaatcataaatcaagtcttaggcttaatttaccaaacttaatttactaaactttgaaatatggaatttataattttataaatgctttctcacactcatttatcagatgtactaatttactctattccaacacctacaagcctcaaataaggaaactgtcaaccagagatgttagcttcctcatcttctggaaagcaactgttaagacaggaaatggtctgtcatatttaactctcaatactatgtaaccctgtgaattccaatttataaaatgaaaatgggtttcataatacatcactgtactaactagattttagttttgaaaaagaaaaaaattaactcgctaattatctttatttccaaatacagagacaagaactttgaaaagagctatggttctccaaattacttttcagagtggccactgttgtttgccaacctagaattcatcccctcctcttccttcctaacagaatccttcccctgataatgcctcagaggaagtcaacaccactccagattccacaaacacggttatttcgatagtaatcactattgaaccactcatgactggttcaggaatagacatatgacccaattctggccaaaaagctgtgaaagaagcctgctacaggcttttagagaaagtttcctctctctgaatacagtggcacagaaagagacctcttccttctttcagaagttgtgtgtatagagacagtagccagttccagggagggcagcagaactgggcaaggcaaagaatatgggtttttactgacattgttgaatttctgtaatcaaccaacgctgaagcttattacatgagaagataaagtttcttatttcttaagccatgttgaaatgaggttctgctgcttacagatgaaaatatactaattatatacttttttatgaaacatatcccaggacgaccaggacaaatttcaggaaaagaagtctgtagttcattttacaaatccttgttagaagttcaatgtgaattataccatactgaatgactcttctgtacagttagaaagctaagaaggatacatgtgaaagaatgaactctaaagcagtattcctctaacacaatcattttgatatggccttctccaaaataatttatatacaaattttaaattttgactcatgatttatatttgcctaagtttaaaaaagaaaagaaactagggaattctctggtccagtggttaggactcagcactttcacttctgtggcctgggttcaatccctggtcagggaactgagtaacatctgcaagccgcctggtacagccaaaaagaaagaaagaaactacaacaataactacctaagatcatatagcctggacttgttgccctatacccttacacacaggtagacaactaaactggtccacaaacagaacatcagacaggaaatcgaaggcaggataatggtggatggtatgacatcatagtgttgactttggctttgtgttggctcatagtcacagggcacagggcagtttttacactgacatgggacatacaaaatggaatgatctagcaggctagacctagtctacttccccttttattaaaaaaataagataaccctctcacttcatatgaacttacaaataatgcacaaggagccaaaaaagataccatgggcgaacaatttgaaaattgatcttataaggctctacggttgaccttaccttgttatcccaagtcaacttctacacaatctaaatttaattggtatagtaacacactaaacaactacatttaacccaaactttcagaaacttactattcacttttactacttcaaaatttcaaatacggcttttatgcaaaaccataaaattttgctgataacactatgtattgcattttttcattattccttttgttacaataaattatccttagaactttaaagatcacatgttgataataaataataccaacattttgaaatgagtcacaaaataaaactggttgggtccacaggcctaagatttaactaaatatttagacactgggtgtttaagcttatcttgttggggaaataaattacatttgtgaaataattaatgccataacagaacgtgattttgtgtcaaaataagagaccagccctagatcattaaaggcgttcagtgctggaatttttagaggaagaaaaggaggaagaaggacttacaaaggatccggatttaaagatggggtaggatgagcataatctaacataagcagcagcataagcaaaaggctggagatggaaataagcaaggtatagtgaagtgataagcaaggaattgggcaagaaaaaaaatgagaatagaagattagtaattaagatggaaatgtaaattggtaccatattactaaagattacatatgtcaagtttaagagtatggcctctgcttaaaataaatggagagttgctaataatttctaaatagagccataaaacaatgaaaataacatttcagtaggattaatctggctgatgaattcaggatgaatttataggggaggggaaaaagaaattagaaacaaagaaccagttaggaggtaccagttaagaacctgggcgttggttaggcagacagacttgctctgctacttgctgacaactgaataagttagtaaacacatttgtgtcagtttcccgtctgtaaagtaggataaaagtcgtgcctattttataaagttgttgtgtggctaaacgaaataatacatatgaaagcatttaacatagtgccaggtctacaataactactcaacaaatgctggcaactattaccttattacaaataatttcaaatgtgaggtgatgagcaacaaaggcaatagaaactaaaaagaaaggatgatttgagtgatatttccatagactcatgagagtctagaaaagaccctagggagttcttccaaaaacaaaatagctccagtttaaatgtcaaggatgaagaaaagcatgcagcaagatatctcaaaaggttttgactacaagcgtatgcaaagagatagagttaactgaatattagcaatatgccaggatataagctacaatgaattgagtatattacatgtgccaaagggcttcccaggtggctcagtggtaaagaatctacctgccaatgcaggagcttcaggagatgtgggttcaatccctgggtcaggaagattccctggaggaggaaatggcaattcactccagtattcttgcctagaactcatggacaaaggagcctagctggccatagtccatggggtcacaaagtgtcagacacaactgagcaggcacacatgcagcacacaacatatgccaaacactgtacaagatattgatatagtacttctaatctccagaacaacttcgaacggtatgtattaattcaattctacagaagagaaaatggatgctcacagcaaagtaagaagcaaagctaggtttgggacccataccatctgtttccaaagcctgtgttctttctactacattcaggctgcatcctcctttaatatcaataaaaattatatcacatagacatatttgtcattatttttctatatactttgttaaacatggtgaccataaagatgtccaatattttctacattctaagaaaaatacaaagcatgaaaaaacaatgagaataaaccttaaaagcattaataagtgaagacttaccatacttctaatgaaacatacttagatatactataaactataatatattaaaatgaaagcaatgactaatctttttcgataagaagatgcagaaaaagttggcatggcttttttacatcatttgattatataaacattccttccttattacaatattattaaaa

SEQ ID NO: 57848 - DNA, 876 bp, Bovine  19866881076992
actggagtgggttgccattcccttccccaggtaatcttcctgacctaggaatcaaacctgggtctcctgcattgaaggcagattctttaccatctgagccaccagggaagcccatattatctaattaaccgggataacttaactccctacttacttccatatatggagagatagccattgacagtctggtatacagaatttcttgacccagccctaatatctgtgatcaagaaattagttcactgtttggtttttttttcccccaataggtgagaaatttattaataaaggaatcttttgatagacctgcaagggggcaggcaagggggctttgccaagttttttgtttttttttttaatctgtgttaggtcttagatgtgactccttgcggctggagagcctagttgcttttgcatgtgggatcttagttcctccacagggctcaaaccacgtcccctgcattgggagactgcagactctcaaccactggaccaccagggaagtccccaagtttttaaattaagcagcaactgtgggttttggattgtagacacttctgtttttctggttaatactaggactcatgtaaacatgacagatctgggttcatagtattctcattcagccacttactggttgcttacattttgtaaggtgggaataatagctagtttggtggttttgtgtgtttgtgtgtttttagtgcctgctttgtgttagggacagtgcccagctttttacatctattagcttatttaatttttatagcgaccctatgtagttattataagccttagatgagtgaactgcactataatcaggttaaataatttgtccaaaatcacataactaatacaggtagagccagaattcca

SEQ ID NO: 57849 - DNA, 1120 bp, Bovine  19866881172975
tgaagtactcttgcagctttccctcctcatttcatgcttgctttggctgctaaactgacttttttgttacttagaatgttatgaagtgtgaatgctttgtattgtatcattggtctaattatgattccatttcatcaagatgtataagcctctaattagcaactacataattggcacgtctgacttgagttgtactatcatttgaggattctgctgtgtctgtaagattgatctaacggtattaataaccacaggtatagtccaattaatcgttaatacttacatatatatacacacacacacatattatgtaattgactgctttgagttttcttacgtttgagatgttcaaagacccattatcaatatctgtagctaattctggttaacttccttctacctgtgtgcaagtccttgtactccagccagcacaagcatggtaaccagaagtgaattggctaaatggtagcaccactgggctgctcattgggcttgaggagagtgtatggaaaaagcacagaactgaactcagttttaaaaaaaacctctcatgtcttaatctttagagtttctcacatacattaaactttacttttgattccaaaatacagtactgtgtagtaggtagtatcactccagttatagtgatgaggaaatggagggttagaggttacgtgacttgtttgggatcaaacagtaaatcataggaccagaatatgaccctaggtctgatgtgaatgtgttcttcccagaatacctcacactgaggaagtcaactttaatcccttcctttaacccacttcttgtcagaaatgtatgtggtagcactagcctgcagaaatcttggaagaggttttctcttaaaaccctgtgaagaggtatttaagagtcattgtgctgctttgcacagctctcttgccaccttgttttgaagatgctctaagatgagagaagtggtgtctctaaaacgttgtttccctttctctgaaggatgacttacgacaaacaagattccattttcaaagaaacttagaaaataaacagatctcttaactgaggccttcagtgcatttctgttaatacctgggcacagattaccaggttaaaaatagggctttct

SEQ ID NO: 57850 - DNA, 1114 bp, Bovine  19866881191084
ttctggattcaagaaggaaagtcttcctcttcaaacttttccgccttatcttttttcttctctcccctaatatctgtaggtggcttttcctaaaaggcacattctttcttggagtggaagctgccattccagtggtgatggtttccagtgccaaccccactatgctggctcataccatcatgacctaatgcagagccatgccaactagataggttccctgtgattccagcatatgctcccttagagacaccagagtccacagaatcatggcggaacagggagggctggtgccaagaatctcctattatctgaagaggtccattgttgaaaatgccatcagaggaattatgtctacaacagcttactccaaatctaccatctccttgggataggtgccctccatgtttttcaaaagttgctgtaggtgacttagctgaatgtggtgttgagaattttagccaagcaggaacaaagtcatgctgcaccatttaaatccagtgtctcttttcaacaaggtgaggcctccaaccttatggccaggatcccagagtataatccctgtggtcctgcttcctgaacttctttgagctgccagctggatttccatgaggttctcttgttaagagggtacttaattaggctggccagcagaatgccttacgatgaagcacaaagaagccaggctctgtgtggatcaatctctcagtcccctcaactgcttatcttaaaccatctacttcttgacatatttcccaaaggggaaggaaaaaggggagagagagggggacataaaacgtatttgttccatttaaaaaatgggggaaagggaaagagctatatcaatgttcagctcattcaacttccttgagtgatgacactatgatgttgcttaaatagatgatacgtggacatctgcacagtgaatgcaaatgctgttcataacaaggtcatagcttagaaagacagaatgacttctgtttggtcaaataatgtcattgaagtgatagatcaaaaataaaacattgaagagctataaaagatcttctgagtagtcaactctagtagcaaaacatccatccacattacaaagccattaatttacaaatctcattat

SEQ ID NO: 57851 - DNA, 1662 bp, Bovine  19866881224367
ggaggcagtttttgagatagatctgaagggactgctcccaagggataagtaaggagccaggttatataggagtttttgcaacaaagactaggtagttaaaacatcaaagattactgctaattaaagaaaaccagatatctgaagttaatgaatttaatgcttttctatgcatgggaagcctcaagaggctgagctcactgaaatcattcctctgatatgcaccttaactctctagagagactattctcttctttctcatcctgagtcccctcagggtgtaccactggcttggctgcagtggctgagggcttggcagcaggcagcctatttatctccattctgagttctcacaggggttaccttcggggttgtctgcagtgatggctacaatatcgtttgtttactgagagggtgggtgacatttttcattcacacaggccagctaatcaatgtagaagaaataatagacaaaaatcattgttttttaaacatcatagcaataaattatataaataagaataatcaatggaataatcacataaaaaatgttggagaaaaggatatttgcatagtttcaaagtatctcctcagagacttctgcttccaaccataatttaccttctggcacacacaaaaaaatctaaaaatctgaacaaaatatttgaaacatttttcaaatgttggaaaacagacagaacaagagagttatccttgagagaaaggaagaaaacaagatgagctgtaaaatggccctgggatttccatggtggttcagtggctaagactctgtgcttccgaagtagagagccaggatttatttaattcctggtcagggaactagaaaccagaggctgcaactaagagtttatatactgcaactaaagatcttgcgtgctgcaactaaaacccggcacagccaagtaaataaatgagtattttaaaaaaataatgaaatcaaataaaattatcccagcttgcttcatggagtacatttcctgccacagttcagcattctccctgagttgcagagacaaagttgagaatttgaggaagccaaggaggacagaatttttaggataaagtaccagagaggatagagcagcacagaaaagagagaggtgaaaatggtgagcaatttggaaaccttcagaaggttctcctcacatcttcatctgggtactgatcagtacatctgtgtaagaaaactgagtcacggaaaaatcctcatctcacgtaggccagaaacattttatgtcccaaagagccagaatatgtcatcaggtagagtacaataagagtatgtcaaggctgtatattgtcaccctgcttatttaacttatatgcagagtacatcatgagaaatgccaggctggatatagcacaagctggaatcaagattgccgggagaaatatcaataacctcagatatgcagatgacaccacccttatggcagaaagtgaagaacaactaaagagcctcttgatgaaagtgaaagaggagagtgaaaaagttggcttgaggctcaacattcagaaaactaagatcatggcatctggtcccatcacttcatggcaaatagatggggagacagtggaaacagtgagagactttattttggggggtctccaaaatcactgcagatggtgattgcagcgatgaaa

SEQ ID NO: 57852 - DNA, 1038 bp, Bovine  19866881378519
gtgggattatctcacccttgaagatgtgcatgcctctgaaattcccactgcaaactaagtgtctgaagataagtggaccagagtttgaattagacttaggttagcgtctaaagatttctacttgtcaagtgagaagtctttctgttttcctttccagtagaatgaataatgcttgtaaccctgggagaaaaaagtaaattttgtgtttggtttttgtagccctcccaggcccaatacttcaaagcatcttacctctgctcaatatatattacttggagaggattgaggaaactgccctcaagaaaggtgagtgtttttctgtctctttctcagtgattgtaagcaaggcaccatgatgttcttcaggtaaatatgacacttgatacctgcatagaacttcatgcttttcaaaaagtaccctcacacctattttcttatctgatttctcaatgtcctgtgaaacacaaaacaagtatttaatccccattatactaataaaaatgaaaccacaagcacaccacaattaagagcaaagccaggtagaacacagatcttttgttttgggcatttttggtcttgcctcatggcttgaggatcttagtttcccaataagagattgaactcggcccctggcagtgaaagcacctagtcctaaccactccaccgccaaggagttcccaagcccagatcttttgaaattttagtttttctattttatcagactacctcctaagctcctcattaaatacatgttaacagctaacattcatccttgtctcaagcattgtcttaggcactctatctggagaaacttatttaatattttcatcaattttgcaaaatcactattattaactacattttgtagataatgaaactgaggtacagaaaaattaagtaacttgctcaaagtcacacagctagactgttctggtatttaaacctaaacagtctgtctttagagccagtgctctttaccagtctgccatattgctcctggaacctagaaaaggacattaaaaggctatgtacttcagt

SEQ ID NO: 57853 - DNA, 2246 bp, Bovine  19866881422001
ttttgtgaatgtttacctaaaattggaggttttcatatgctccatgcagctaataagaggttattaggcactgaaaatttacgaaacactcctttcctttagggaatgggagggggtggagatcactgaaagagattttaaatagaggggaaaatataatcagatctgcattttcagattattcaggaaaatagtgttgagtttggaagatggcacataaaattccatactggggacttccctgatggtccagtggttaggaatccacctgccaacgcaggggactcggtttgatcctggtccaggaagatccaacacgttgcggagcacctaagcttgggcgccacagttactaagcttgcatgccacagctactaaagcctgcatgcatagagcctgtgttcactaagagaagccactgcaatgggaagcctatgctctgtaactggagagtagcccctgctcactgcaactagggaaagccgaatgcagcaacaaagacctagctcagccataaatcaattaattaaaataagtaaacaaatgaaggtaccggtgttcctcccaaaaacttaatactggccgactttattctttctacaaacattcaggaacctactgaacagagcttgtactggaggatacaagaatggaaagattgcaatgggggtctatcgtcccgagtccagcctcgtggaagtgaccactattcaaacaaattacccaacgattaaatcacaattgtgttaagtcctgatgaagaatcaggagtggctctgagagatggcacggagatagaaaccgttcttagagaaaggtgagacatgaaggtgagagaggaaggagatgaaagatgattccagttttctggtttagagcctgaggttattgacagaaaaaggagggcggatttaagaggaagtgatttgccatcttttgataattaagtgctgtgctgtgctgtgcttagtcactcagtcgtgtcctttttttcgcgacctatagcccaccaggctcctctgtccatggggattttccaggcaagaatatcggagtgagttgccatgtcctccttcaggggctcttcccaacccagggattgaacccaggtctcccgcaatacaggtggattctttgctgtctgagccaccaaggaagccctgggtcagagattctctaggaccctttaaaactcaacccaaactaaataaaaggtcccctgatggtccaatccctgcccctcagtcacgactgaaactaacaatctcagcttcagccatactgcactatttgtagttcctcacacctgtgtgtgtctttgtatatcctgctcctcagcatgagagtcgcccacactggacttaagctctatagaccagagacgagaatacagtgcttggcagagagcacatgtcagtgaatgccaggccacttgctctgccatctactagatgtgtggattcttttgcttctgcttgggttcttgggtagagctcctcagtgattctttgatgtcaccaaagctttacaatgcccctgctggaccttgctgtcaatgttctttgcatctggggagagtcaggggttagagtaccaagcctgggtgcacacccacatgactagccatttgggatagattcagacatgctgtgtctgccttcatttatcttgagacccaagtgggagaccctaaacaagggactcgaagagtgggcatacttgtcaggcttgaggtcacggtgcacgatgccgtaattgtgtaagtactccagggctagcacagtttctgcaaagtacaggcgcaccatgtccacaggcagggccccgatgttcttcagcagcgtggcacagtctcctcctgcaacaagcccaggccaccatgaagcagggagccagtgccctgctccagatggtctcagaggccccagaggagatggcctcaccaaactccctggcgctagagacggtgattctagcacccctgctgctggggtgggtgggagacagactgtagactggagcaggagcaagaggagtcggccgggggcggtcaaggctgctgttcaggccaaagaaggaaggaacccaggcctctatgcctgtaagttgacttgttgggacaggaataagttatttttgggtgggaatcctgtttattgtaaacacgtctggctgatatttcagcatgtgttatttccttcccatggctgtcctttagttttagtaaagtaacatgtaaactccca

SEQ ID NO: 57854 - DNA, 1052 bp, Bovine  19866881536501
ctgatcggtcccacacgcttgactttagttgactgtaacacccttactactaacaggaccactctcctaaattcttacagtcccgctggccaggtctcaattacaaatctcttcttctacctctaatgtctctcgtgcagcaggatcaggtggtgccagggtgtcctccccacaggcccagaatactcacacaaggtgctgatctcgggatcttgcgcagctggatcaggtcaggtttgatactattcatttttttatctatttctcggttatccaaagcttgtttcttcaaatcctgttcaagacgcattttgctatcatgaatctcacccagacgtgatttcagcttgtcataattcatcataattctgtgaaaatatttgacatattaaggttaaaacagaaaccaagcagaagcgttctacagcatgcacacggtctaacaccctcaatgcggtggacatctgctgtttttgcctggcacatctttattctcacccctctgggaagagcactgtcatgttccctgtagcgaagggctcctgttcccatctcagattcattggtgaacatcacacaacccctcctggccaagaaaagtgttctcttccatcctatcccagcctcaggccacaatgacttgttcagaaatcagaataatacacaaagtaatccaatgacagtcaaatctacggctcttgctagcaatattgtagacagattctctgtttccactgagattgttaagttgttaacatgtgattcttagtctcccaacagtttatactactgccttgaagggaaagcctgcctgaggatgaagccaacacagaagaaaactgagccaacagacagagaatgaggagaatccggacgacattgtttgggccctggccccagccatgactgaacgagtaaagctgggttactatgtgaactaaatgtgctcacaacatgtaaaaggaccagtgtctgggacatcttggtaaagcactcagtagaggatggccctaagcttttccaccacacaaagtttttgccgtgctctgaac

SEQ ID NO: 57855 - DNA, 726 bp, Bovine  19866881905823
ctggcctgagtccacgtttactcctatcttccccagtttaataaatgacaagccaatatttttttcagtttctcaggccaaaagctcagaatgatacttgaatattttctttctcacacatttcacatccattccactagcaaattctatgctagccgagttaagataatgttataattatctgggagagaggtgatgatgacaagtactaagaaagtgatagtcctgatgaaagaaagtgaatgaattttagagagactcagaaagcagaaacaataggaactgttgattcatctgggtagagacaaagaaagaatatttgagaataatttccaagattctggcttggacaactgatatagggaacaataaagaagtttgaaggagattatgattgatcacttagatgtatttgctgttaagtaccaatgagatatctatggaaggatgtacagtgaactattgattaaattggtttagagcccagaagtgagagctaccagtatttagatgtataacaaatacaaactgttcaataatcttggggttatacatgtgatgacattcttttctgttttctagttagtcactcaggcccctcatgtcaagttatcaggaagtctagtatctcctccttaattatttaagaactccaaagttcctacatattctaaaggtaaggatggtagttgtctattgctatataataaaccatctcaaaatgtg

SEQ ID NO: 57856 - DNA, 1335 bp, Bovine  19866881948651
tgggactgggacatgtttatgcggatgccagaacaacgctgaggccgagagtgcattatccctgacgtgtcctgatcctaccgctttggcatcattggcctcaacatgaatggctacttccatgaggcctacttcaagaagcacaagttcagcatggttccaggtgtccagctcaggaacgtggacggtctaaagaaggacgcttatgaagtagaagttcacaggcttctcagtgaagcggaggttctggaccacagcaagaacccttgtgaagactctttcctgccagacacagagggccacacctacatggcatttatccggatggagaaggacaatgacttcaccacctggactcagcttgccaagtgtctccgaatctgggacctggatgtgtgtgacaaccaccggggcctgtggagactgtttcagaagaagaaccacttcctggtggtgggggtcccagcctccccatactcgatgaagaagccaccatcaatcaccccaattttcttggagtcacccacaaaggaggagggaggcccgggagctgcagaacagacatgagacctcctccaggaacctgcagggctgcgtactgtgtagccccaggcaggctagccctttatccaatcctgtaggattttgtagacactggcaggggctaggtgtggttttttttaacatgaaacttaattactaactcccaggggagggttcctctgctccaacacccctgttcctgagttggaggtctatttatttaccttcttgttgggaaagggcaggagagtacctgggaatcactgggatccctgggcagcccattctgccctttgcatactccttcctcccaggcctgactgagaatctaaggtatttattgactgtcctgagggtcttggaaacagctgaagcctggagggccttgattcttttttttttttttttcttggactggggtgctgccctgagggtggggcaggctcttactcaggaaactgctgtgcccaacccatggacaggcccacctggggcccacctgctgatgcagactcactcagagaccctcagacactgaaccaggcctcttctcagcctcctctttgtccagatttccaaagctggataaggtggtcattgattaaaaaaggagaaaagctctggggatgtgtctcgtgactgtgtgtgtatgagagagagacacacacacacacacggatgggtgggagagagaatggtgatgatagatggtgagttttctttactatcctccacagggttattttccacttgggcttccctgggactcagcggtaaagaatccacctccaa

SEQ ID NO: 57857 - DNA, 1620 bp, Bovine  19866880426853
ttgcctttgaagagccctttgctcttcccctagtcctgcccacttatcgtcataataacaaagtaattttcagggaagagcaatgttgttcagtgtcccttcttgcatagagtatatttttgccttttcatactgtaaaaacgttgctgacaaaggtctgtatattcaaagctatgatttctacagtagtcatgtatggatgtgagagctggaccataaagaaggctgagagctgaagaattgttgctttcaaattgtggggctggagaagactcttgagagtcccttggacggcatgcaatatcaaatcaatccatcctaaaggaaatcaactcaatatactttggaaggactgatgctgaagcggtggctctaatattttggccacctgatgtgaagagctgactcattagaaaagaccctgatgctgggaaagattgagagaaggagcatagaggatgagatggctggatggcatcactgactcaatggacgtgaatttgaacagacttcatgagacagtgaagaacagggaagcctggtgtcctgcagtccatggggttgcaaagaattggacatgacttagcaactgaataacaacaatacagtcaggtcccttacgagctctcctgtgataatctgagccgggactcttagcagatcttcaaatctactcttcttgaaagtcactccttctgtcatgggagaaagagagtacatgttaaactagctgacatgtgaaaacgaaggccaggatgtcgttcatttttttttcagaaaccagcataatgtttggctcacatagaattcactaaatggcgaattaatggtgattttttaatagagctttggacacagctccttcatttccttgagaaagctaggaaataggtatttctgagtcctaagtagtttatacagaggtttagaatgaatggctaagagtatatggtgtttcctaaaactttagtatcttatgaagatgtagctggagagttgggctatttcaggcctgagttccttaaaagtgagacagacaggaagaaagcagccagctgcttttatgcatgttgcaatgacagaatgagcacatcatctaggaaagcaaataactgcaaatattttcctgaataagcaggaatggaagatgggaaaaactactgagaacattttacattgggatttttttcacagctttcccaatcttggcagttgtaagagaattgttttatgtggttttggtctgtgcttgcaacatacggcagcctattcccgaacacaaagaggtatttcaggatgtctggtgagtgaccagtggtttgcctttttaactcttcaaaatataaaaattaaatggattacttaaaaccatttttgttttcaggggttaataataacctattccttagcactagcttctctggtttttatgctatcttatgttccagtgaggctctctgagaagtcaagaatgatattcttcttattattattattttttaccaaatccaaaaggcttctctcaatctttgttttctataatctatgtgacctccacttggtatcaccgaccacctgctccttcttgaaaactcctctgttcttatttctaagacatca

SEQ ID NO: 57858 - DNA, 1040 bp, Bovine  19866880448543
actagcaaggctttagaccagttaattgtatcctggttagtaacacagctaaatacaagtatgttggtcttgcacacaaaatttttttcaagtcagaaattgtcctactcacttctcaagcactttattccatgtctttaaaaatggagtgaattgaattgattgccatcacctagatgttaactggaacattgaggatcccattttgtcattcatctttatgataagaacactaatgcaataataataatatgatgtaagtttcatatattatgggtttaccatgtgtaagatcatgcactcagcaccataattattatgatctcatttatggctttcaagaaccccgggatataggtactattatcaaccctatttaacataggttgaaaaactctcctaagagcccaagctagtaagtagtggagctaaatttcaaacccagttctgtatgatttcaagtcagtgttttttctcaccatgctctatagtctcccttgattacacggcaaggcttcagaaactgaggatgaaaagatgactgactgttccccaaagatatatcagctcaataactgcatacagttagtagagaattgcttcaggaaaaaaaaggtgtgcgtagtctagtaatttcaaatgtaccatttaaaacgttcctagggacctgacctttcctggctgatggcaatagctcccacgaccagtaattcagaaacccagataatccatcacccacagcacggcttttttgtattgccatcaaagtggcacttcagagtatctgctgccacgcttaatgacacagagtgagagctcttcaacttagggaagcctattgctctgctctagccacagccagggctctgctgctgaagctcagataaggtttggatatggacctggatagtttaaaactaatggactcagctggaaacaggcaatggacagagacagttggtactgcaaaagagagaaagatctaaaaaggtcatcacaatagtgtttttagctccatttagaaggccaggaaaaatata

SEQ ID NO: 57859 - DNA, 1187 bp, Bovine  19866880473443
ttaaaacagtatcagaattaaaaatagtatttcgtttttcatcacctatagatttaggctgtaacatgctcatatgttaccagaaccaaagcttttccataccaaaatgaattcatgtgaaattatgagtaacaactcactaatatagtaattgatttcaattattgtgttttgttaaataaataaattgtattcctatatgtatttggttatttttataagaaaaactacaaccaaagatgcaaagaaagctgtacaatgccaagattatccattgaaaggtaaaatgtttatccatcagttattttatttcatctgatatatgtaaataaactgtccaaaggtctgttatttttactaacttcacctcctttggaattctgacaagatgttttggtaatctcagacatgacttcagaaatgttcatcgcatgcaggtttcataaagtaatactaagagtacctgtctttaaagatcagtgtttctccgcggagactggttatggcatcaagggataaggaagggtcacatttgtctggcgtttttggatgtttagagtaggggtcttcatctcctggacctgcagtcatgaaatgagttaaggaagtgactgaggatgacctgctcctaccatggagagcaggaagggcttcatccagggagggcagtgggtcctgccacctcctacataatacgccaaagaacccgtaatccctcctccttcctccagggctaccacggccttgcctgtgggacttccccttctgttttcaacttttaaaacccttgagaatcatctaagcttcaaattcagctttcttgaggttggtgatagaaacgggctgggggagcaagagactttggggaaactatccccatgctttgcacaacctattcacagactgctcctgagaaacacattgctctcacagacatttctggaggcacgtcatctctgtgggagccctcctttgggctctttctcaagcctacttgaccagctgccaacatcagctcaccttgctttagagtttatcactgtgtatctgcatctcagtgaaaagccggccttcgaccactctggtatgacttgtaacgtgttggtaactttccaaccagctcacgtgagtgcaaaagggttgcaggacataaaatcattctaaacttctttttcactacctatgtc

SEQ ID NO: 57860 - DNA, 2994 bp, Bovine  19866880627800
ttaagcaggtccccaaggccataacttgagaaacgttaggctggaggaagcacaagctggaatcaagattgctgggagaaatatcaatccctcagatatgcagatgacaccacccttatggcagaaaatgaagaagaactaaagagcttcttgataaaagtgaaagaggagagtgaaaaagttggcttaaagctcaacattcagaaaatgaagatcatggcatccggtcccatcacttcatgggaaatacatggggaaacagtggaaacaatggctgactttatttttttggctccaaaatcactgcagatggtggctgcagccatgaaattaaaaaacgcttactccttggaagaaaagttatgaccaacctagacagcatattcaaaagcagagacattactttgccaacaaaagtctgtctggtcaaggctatggtttttccagtggtcatgtatggatgtgagaattggacagtaaagaaaactgagcactgaagaattgaggcttttgaactgtgatgttgaagaagactctggagagtcccttggactgcaagaagatccaaccagtccattctaaaggagatcagtcctgggtgttcattggaaggactgatgctaaagctgaatctccagtactttggccacctcatgcaaagaactgactcattggaaaagactctgatgctgggagggattgggggcaggaggaaaaagggacgacagaggatgagatggctggatggcatcactgactcaatggacatgagtctgagagaactctgggagttggtgatggacagggaggcctatagtgctgcgattcatggggtcgcaaagagtcagacacgactgagcacagaactgaactgaaatgaactgaaggctttaacaggacacctaatctgaaacaaaaccttaacaagttgactatcagccaagacacataagacttgttcgtagtgagtttacaaagcaagggaaatacagattctgggtaaagctcactgctcagctgaatccatgcctcatttgaatcctacattcaactaaaattttaaattttgtttgaattatgtttaagcaactaaaaaaccattatgtggatgtacaaatgccatgtgtttataaggtaatgtgcacttgctttcaaagaagttgaggtatttgcaagtgttggacaatattattaggaatatctaggtgtagcagtttttgtaagtgaagtttaactcaaagtagactttagatttaattaggctaggaacaaaaagatgtttgttgttttcccaaaacacacacactatgaataagtgtcaggggagcagtgggtgttcctggtggggtgaaggcttgataagtgtcctgctataagtttcagaagaatcattctctctcctgacacatatttaagagaaatacttctctccaaaccacttgactccaataaccttggtggcagtcttaccggttctgatggaacaagaggccatgacactcgatgccacagctttgcttgttatctccaccagttactgggctgcacaaatctgtcatgcactaatttgcttggagtgtcaaggaaagcagagctgaattcttgacatatgaatctcctgtccccaaagctctctcctgggctctgctgagtgcagaaagagctggcagctgagtggagttttgattaactgcgctggtgtgtatccactcaagcttcagcgagattgtgcattgtcagtcagctgtctcctgggtgctgaattttcattaaagcttttgtatttaatggaagttctctcacactctagagtttcaaatgaagttcaaatcagatgtaatttacaattttataacggtcatgtaatattttctgtctctgtaagtagctcggaaacaaaattgcctttagtgattataacttctcattctcaaatttgcattaatttgagctccctaacaagctaaaaacatttctccactaaatacatccatatggggggttatgctttatgcatattagtgttcccagtatacctgccacattttagctgctttgacttgacttctattgttttaagggcaatttgaatgcatgggattcttgaaacacagacgcactctccttatcctttgaaacaatcagcagttagattacaacaggctgtgatttatgtggggcttgcgtggaaatacatgccaacatgtgcctaattgtttagcaacaaacatagaccccatatgatgctctgaaagttaaagttctctttaaaagcaaaatcaagtattgcattctggtcctatagaacacaggtgtctaagtctacaggtactagtgtttccctatagaataacagtgctgttttaacataagatttttggtgaaggtgtgcagattttagcaaagtctttaaaaagtttgtagtgctgccagccttaagcatacactggaatgtagtaccaataccacttaatcaagaataaagtttccaactgggtagaacaatttctgtaggaaacgcatgctaacagaatactaaaatctgaactaggtaggagcaagacagtacttacatcctgttttttaactgttttgaacatggctcaagatataagtttctgactttgacgttctgacttcctgtccttaaaagaacaactggcctttcctgatatcccctgaaagtcaatacaaccctaataaaagggttcctgcttatacaactgctaatattagaggtcaaataagtctcacaagaaatttaagaacaatcagtcagagttcactcaggaaaaagagaaaccatacctgttactgtagtaaacatttaaacaggtactggagaacaaaccagcaaaaaggagaagactaaggtaacacagaggtaattaccaaaggcagctaaccatttcatagggtcagggggaagtaagggaagaagctgggctcatcagacctgttagttccaaccagggcttcgtgggtagacttatg

SEQ ID NO: 57861 - DNA, 1137 bp, Bovine  19866880654555
cggcctctgtgcaatgctgagctttgtttcttttacttggtgcagatttgatgagaagacacaatccatggagccaggttttcccaagcaaatagtggaagattttccaggggttgaaccagaggtggatgctgtttttgaagtatttgataagaggacactccttttgttggcagtggggcacttgaaacattctgtagtaccagaagaaagaggaaagctgaagtatttaataaagttttctttaaccagattcctcctcccaatcctaaatttcagcttacaaatttcatatcaattgtatgactacttcgtataataagctgtataaaaaccccctcaagtggtgtggccaagttcaacagtggccagctggcttctccatcccacctctaattctcatggagagtttctctgtctttcctgagtagtcagtcagctgccaatatttaactttccatgagcccaaagttaaaaaaaaaaaaaaggattttctcctgcctcagggatagatgggtggagggatagatgatctttattgaaaggtaacctgagcaccaggatggcagagtcagaaaggatcgtctggttctgaaagagtccctgagattctctgaggccagagaatcaggcttctttgtcagcaaaggggaggaggagtattcggaaggaaaagtgtaaagatacatggtttctgaagatgcagagaattttatctgattttaagtggaataacctaataacccagagcctggttctgctgtcagagagagctggagtggggtgctgttcccatcctttccttattgagtgaccttgggcaggcatttaaatttgtttgaatctcaacttcctatctgtaaaatggagttagatatatgtgcctcataggacttttacagaaagaaatgaaaataaaagtcatgcaaaatgcttaccatagttcctgctgctcctgctgctaagtcgcttcagtcgtgtccgactctgtgcgaccccatagaaggcagcctgccaggctcccctgtccctgggattctccagccaagaacactggagtgggtttccatttccttctccaaggcatagttcctggcacatagtaaatttctacaaacactttctacttttaggtat

SEQ ID NO: 57862 - DNA, 2549 bp, Bovine  19866880664433
ctaggtttgcctgtttttataaaattgaaaatcataacatcatgactctttaatattaagattctttcagctaatgttgtatttgagagattcatccatatggttacatatcaattatagtccatttattctcaatgctatatagtatgccattctgagaatctatgtcttctgtcaggtataatatatttctgtcatgtatgtattagcagtagataggatattaatttatttgttccccgttgttagttaatgccaaatagtattccaggtgattttcttgcttatttaaatttttttgaattatacatcagaaaagtacacattaatgtacagttcaatagattttcaaaaagtgaacctttgtaactagtccaaaatcaataaatagaatgttaccagcattctggaagcatctccctcattcttttctacacatgatgcagcatttccccattttgtgctaaggggcaattaattttattacttgagttgttttaaagtttattttaaaacatatttttgaggatatttactagtattttatcttgcttagaaacttggtaattttccaaaaggcttttgaacatttatttatttttattatatcactatgaggcatatattattagtatccttttaagatgaggaaaccaaagcatagagaaagtgaatgatttgtttatcatcatgtttccagcttatgatggattaattaatgacatcatatgatttatatatatatattataccaatgaaattattgtaaaagtaagatgctttaaaattacattgaatcttatgataaaagtctttgctatataatcttatagttacaaaatttcctgatattaagggacttccacatctggagaattaaatgtaaaaatggggaaaagttcattgaattttatagtaatgaaatagaactaagctagtaatactatcagtgatcttaagtaggtagattaaaatagtttttctgcatttactgctgtcatggaggaagaaattttcctctacccttataggttcttctggctggtcaaagaattacattgacataaaatgaattaataagggaagatggtggctcaggtggtaaagaatctgcctgtaatgcagatttgatccctgggttgggaagatcccctggagaagggcatgacagaccactccagtattcttgcctggagaatcccatggacagagaagcctggtgggctactgtccatggggttgcagagagtcagacatgactgagtgagtaagcacagcacaacaaatatacaaaaaaagatattaataatgtgtttatatgtgagagatcctagaaaactaagtaacctgctataatggctgaagctcttaataccatcttcaactaaagacaaaaaagtagtgaagtggggatagtggctttagccttcaaaaggaggaaggcagtttatgtggagatgcaaaaaagcaaatgtttggaaggaaatcgctgggttatgcaaagacagtgggaaacagagaggaaatttgaaagactttgccaggttccttcctgaccaccatatctagttcatactgtacttatctatggtgataactcccttcctggaattggtcctctatgattatattaataatattaatgaacattaatgttaatttaaaggctggaaaatgaaagttgctcagtcatgtccgactccttgcgaccgtggggactatacagtctatggaattctccagaccagaatattggagtgggtagccatttccttctccagctgatgttcccttctccagaagatcttcccaacccagagattgaacccaggtctcccatattgcaggtggattctttaccagctgagccacaagggaagcccaagaatactgtagtgggtagcctgtcccttctccaggagatcttcccaacccaggaattgaacccaggtctccctcattgcaggcagattctttaccagctgaggctaccaggggaagccctaatattgatgagcattaatgttaatatcaagccttaaggaataatttaaatgctttaaatatgtattattatagtctataaatatagctagagcctgaaatttgtttaatattttagaatatttttagaaaatttctaatatcttagaaatgaaacaaaatttttttttaaattataggttccaaagatgtacagtgggaatttgtacatggtttgcttgaaaatgctatttatggaggacgcatagataactactttgaccttagagttcttcgatcatacctgaaagcaattttttaattcttcaataattgatgtattaagtgaaaggaacaagaaaatgtgtttttccatactccatatctctgccaaaatcctgcacgcattttggtaggtaacattaattgttttcagtttattaccagattgaaacttgcataatttcttacattgttaaaatatgttgttgcttcttttcacaagtacaagcagtcatcacaaatacggattattatttattatgccaatatgcagcccgattctc

SEQ ID NO: 57863 - DNA, 2169 bp, Bovine  19866880739368
ctctaagcacacctgaacctcagacaaacctggcctggcccccagcaaagtgccttggttctataattgggtttctcattccattaaaaaaaaattatttcctcatccagttctggttacggcctggagccctgcctttgtctgggtgacctcgtcctctgtggctgtgcttctcatgtcattttccttactcaccctgcaaatgtcacctgccaccccttctggcagcccagcacctgtcactcaggaaggaggacaaagggcctggacctgcctccccctagtgtagcttctctgggccaagccatgaccattaagctttgctcttaatggtgtagtcaaaaggaactgcatttctatgatgcatttttatttatgaacaaatataggatctattgattcggatgagcaaagaaacgtatgtccagagagatttaagaatgagacactcaggaacattccttttagagacaatctatgcaagctaagtgtaggttccaaattttctgagaattatagtgcataaaaaaatgaaattaaaactctatgaagtctaaattgcctattaaatacaattgtattgtcgctaatgactcaagaggtgctttgtgattttaaagtgaccattgcttatcatcattaatttataagtgaaatatttagctcaatcagacctaaccattacaaattagagagcattagatatttttctatgcgatttctaggccctctgtctcataattgggtaggtctcctttcaggttctttagatctgggcttactgcttatgtaatgtattaacagaactatgggtctagtggccattttaataaatctctaaaataattttttttagtttttatggtgttctaaccatgtaatcatcaatgtgatgtgggagatctctctctctctcacacacacacacacacacgcgcacgcacagcttacggtgtttgccctcaccattctaactcgggatctacttgtccagatacacgtttaaaccattaatccgccaccactcattgcagagtcaaatggaataaaatgagtcatttaaaagacagaaaaatcaatagaactgatcatgtgagggattaatgaaagggttgaatcaaagatgaaattaaagtttcaaagctaagtttaagaaacatttacagtgaggggtgtttgagtctgaggcaagaagctggagaaagatacgcttatctcaatgaacctgtaacatactgttccacaacagtggcacaatatggacattatgtggctagaaagattagatattaagcttgataatttgaaaactgtaaacaatctttagaaccttaaaattttatgtattcaagcttcctccttgacaatcccagatgtctacatgtgtttctctcccagagagttctaatttccttttctggtaaaaatataataatgccttcaagtcatgacagctacctcagagatcccaagtgtaaaaaaagaagttaataggaggtgggtctcatgatcactcccaggatagctctcgcctgaaatgcagcagatttactcatcaagacaaggaaagccactttctggtttaaaaatgagagccaccgaataaggctcaggtgttattttttgaggctgaaaacgatgtggagtgtggccatgtccacagtagcagctgtactagcagggggactgatcacatgcttgaagaagaacttctagtgcaaataaatgattgctatcatcttcaagttgtctagtctttggatttgtagacagtttctgaaaaaaaaattgttcatatctgccaatgttggagtattaggattctctagagaaacagaaccaataagatgtataatatgcagaaagaaatttattattaagaattggctcatacaattagtgaagtaaacaagtctcaagagccaggaaagttgatgcttcatttaaagtccaaaaacaggatacactgatgtctcagctcaaaaagaaggaaattcctcaaatatgaagaaagagtcaacctttgttctatttaggcctccaactaattggataaggcacaatcaccttagggaaggcaatctgttttacttagcctgtcaacttttaaatgttcaactcattccaaaactccctcacaaaatagtgtccgaccagatatctgacatg

SEQ ID NO: 57864 - DNA, 1464 bp, Bovine  19866880764933
catagaactagcagtcattaagttaagctcttatttattgtaagcatattaatttttgcttgctgactgtgtaagtagtcacaataagtaatgccttaattatgcaaggttttcattagtgaatctaagttctaactgaggggctacagaagctgtccactaagatcagtgaaatagttaccatttttctggtagacagcatctactttatcaccaattcctgggaagacctcttcaatgagtctcgggtagtctttatccatcacatggttagtgtcatcatagctatataataagaaaaagaaactcttaagtgggttgtaggtaaattactttagaaataatacagtggatataatggcaactttcaaaattgacaaagttcccaatttttaagtccatttaaaacacctggtagtttttttaaattaagaattataatactgagtatatagtagatacctggtgactactttgacttgcctaaaggccgtgtttataaagatggttataaactcatttccacttcaaaatttgtacatctattataaaactatgttattaggaaagcatttttagagccaaatacatatgtttctggattgaacaattgtctattgatctctcagtatgtgtaagacaacttgttaagggcagtcgtggatactaaactatttaaggctcagtttctgcacaaggaagttacagaggcaaatggtagtaataaagcgagggtggggagcatagatttctcctcccataactatatattccacactcctcttccccagcacaaactcacactctagccaaccaaacacattctgaaatcagcctaggagaacaacctcccatgatgcactcttcctactgttactgatgagagttttttatattcttgaggtacagtccaataagtaaaagctaagaatcattgcaccatcaagaaggctaagacatatacagatggcattgtaacactaggcaataggggctaaacatcatgagagaatatacaggagatgtcacaggaattacatgagaagggagatagcctttgaatgggatgatcaagaaagactgtgcataaaatggtatttcaaattaactttaaacatcggatagaatgtcaagaggataaatgtagggaaagacctctggcaaagaaaattgtataagggaaggttatgcagagataaaagcacaaagcttttgagatatggtaagcagtccaccttgaccaaaccacagacctcatataggataaagggacagaaatactagaccaggtagaacctagatagtaatgtgtaatagtattgtatttaattgaattgcatttaaagttgtgagtgtcattatcagaaataagtcaaaaagtaaagataatatgtacagaagtgtgtgtgtgtgtacacatgcacacatgagtgtacgtgtgtagaggaagtaaagctaccattt

SEQ ID NO: 57865 - DNA, 1032 bp, Bovine  19866880927850
cctggagaattcccatgggctgtatagtctatggggtctcaaagagtaggacacgactgagtgattttcactatggtaacaatatgtttaaatttttgaggaatagaaaaaaatttctaaagtagctatacaattttagtttcctgccagtagtaaatgacattttctctttttacacatagttacaacatttattattattcatctttttaattgtagccatcttaataggtatgatatggtttcttattgtgattttgattagatatctctttctttatttttgtgactaactaccatgagaaagttagcttctatagtttttatatataatctaagaactgaatattagatgctgatatgttaaatgatgcaatttcttacagctgtttttataatatgtaacattttatcagttagcttcactattcattttgcctcttttgtcagaaataattgtggaggtgtctcatatgtttaactagaaagaatgaagtgtacagagtagtatatttgtaatatccaatcaaacataaggtctctttgtgggaagttttcactttggtttgtcttgcttgacctttattgttagaataatcttggccttttttttttttttataaagcttttggcattaactattcaacatgagaaacctgatttagaggaacagaaaacaaaactattacaacaggaagaagataagaaaattcagttagctaagcttgaagaatctcttttagaggtaaaatttagttattcaggatgttgatcatattacatattttgattaaaatcaaatgctgtttttttaaaggttataataccttcagcatgtttttggttgtatcagaagaatatcaatatatatattaaaataaaaattcaaacagaagaagggtagatatcttggaatatgaaacttgggagtaatgtttaagacaagtgatttttaactaatactgtctttacactgtatttcattaatgtttaattatatgctcagaataacattcaaaagaagcatgagat

SEQ ID NO: 57866 - DNA, 1716 bp, Bovine  19866880978875
gggtgtgacattgctccgagttgaaaggctttctcaatggcttggtcccatctgctcttgacaggtctggggtgtaattttcaatccttcaagtggaataaaacacagacacatcagatttcatttctcatggctctgatgggaaagagggttcccactctggtgctcaatctgattacctgtaggtcaggtttgtgttctcccaacgaggatttcctggagtaagaacaaacggagccacgtcgggcaccccacatctgggctgcttcatcacattcagggtttcagcatctggtttcccagtcactctcagcccaaagaatttttgcatttgctttagcttttcagttatgaggccaccgtttctctgcctttcaactttcttcccattactgttcaggttgtagtagttttccaggtatttctgatgaaagataaaattatcgaaacactgaatgggaaatcctccaattttactaaatactgatggtttatactgtcatacctgaaacaaaaaactacttttaaaggttccacttaggttgcatggtccttattatccttattgttggtggaagctcattttggagtagaactcttcctaccactatttactatgaagtcagaattacaattttatagagacatatttgtatattattcctttagttccctatcacttttaactggaaatgagagtctatgcacagctagatacattttgggggagaataccctttctggaaaaaatctctctttataggaaatgcatccttaaataaactctattatactattactgggggcttccctcatagctcagacagtaaagaatccacctgcaatgcaggaatctgcccaccatgcaggagtccacctgcaatgcaggagacctgggtttgattcctgggtcaggaatatcccctggggaagagaatggcaacccatgtcagtatcctcactgggggaagcccatggacagaggagcctggtgggctccagtccatggggtcacaaagagttggacacgacttagttactaaatcaccaccagaactgcatactgatactattctgttatattgtggaaaaacacaaatgaggcttttgggtcttaggcatgtgaagttgagcatttaccttcaccgtctccacatcttgttcttgtgtttctgaagttgctgctgggaagccgtgggaccccgtgccccagagtagcagcagcagcagaggcagtctgggcatgttggtctctgtcttccttctcagcttaaggaatctgatagctcctacctctctgctgctccagtgtctcaactaggaagctccctctttatatacaggttctggaacttccaggaagccggcggctgtctgactcacatttcataacatcctttgattagctatgagcaatcatcacgaatggtgactccaagcagaatatctggggtcgtttggtgttgcaatcttcattactatcgaacaggacgtgggcaaaggagacatatccaccacataaacaattgttttctccaattcatttctatcctgtttgagagagaacttcttatatacacagatcacagagtacgccacggacttaaaaaaaaaaaatagcaggctttgctacttgattctgctggtcataaagtgctctgggtacacacacaccttgctttccaagcaaagggcaaagctgttacatgtatgccc

SEQ ID NO: 57867 - DNA, 1233 bp, Bovine  19866881125131
atagcttgaaagaattcaggaggtgcacaaaggagtaggtaggagatgccagccccgtcagcctcccagaagccctcacactggaatccatcttggttgagagaggtgcatatcactaggaaagaccctgagccagaccaaatttggcagcaagcaaggtgattggccaaagacagcctggaaagctaaccccattaccgtgaaacctgagactgcaaggcacatggcagagttctctcctgggctcccttaccttatttgctctctgccaaggtgccccttcccaaaagtcttttgctttgtcagtacgtgtgaattcacaattcatttctaagtattagacaagaacttagccttgtgctctcgaagaaagtgatggcaccccactccagtactcttgcctggaaaatcccatggatggaggagcctggtaggctgcagtccatggggtcactaagagtcagacacgactgagtgacttcactttcacttttcactttcatgcattggagaaggaaatggcaacccactccagtgttctggcctggagaatcccagggacagaggagcctagtgggctgccgtctatggggttgcacagagtcggacacgactgaagcgacttagcagcaggcaggcagcataccttattacactgaaaggcaaaattaaaagctctgtatttattagacaagtaattatcacataatttggtatatatgcaacaggcttcattaagacagcattctgtaaaacagctttacaagctcacacacctacagggtaaagtaggctatgtaaattaaactggtctgggtgtgagactatggggtggctgagtacacaccctatctgcagtttggatgagttagcttagcacagagcaacagagaattcaataactcagttgtttaaaacacttgctctcatgagttggtcaagggtcagctggggaccctgttctttgtcattagaacaaatctatccaaatttgacatatccatcaaaagtcatgaatgtcatcaaatgtctagaacattattggttactatggcagaggaaaaagaagacatattttattttgcttagtccaagcaacattttttttcttaatttgaaagatgttagaatgtatgatagtcattagaactcttttcagataaatttttagagcctcaagttttctttctcctcaataccaataagatatattgtcaattaaaacaattgtga

SEQ ID NO: 57868 - DNA, 2607 bp, Bovine  19866881175024
agaaagagaaagccaagagaagcatgcagactggttgctctaattgtaattctgacttctaactgaaattctgtagacctagcaatagcatagtttctaccactgcactgacatttctgtatcaacggtaagcataaaaagggctatgaaattcagacagaaattcattgcagaagcagatttttttttcccctcttgacactaaacctttaaggtaaaagaactattctgtcactacagtgaaatgctgggaattttcagagaaataagaaagatttcatatcttctgtttgaattttttttatttatcagaaatacctacaaaactattacggcttaggggttggaaccagctgattcgaaaggcagagaaaccacagtacaatgattgaaaaattaaagcaaatgcaggaattctttgggctaaaggtgacgggaaagatagatgctgataccctggatattatgaggcagtctaggtgtggagtgcctgacgtttcaccccagtatggactcactccagggaaccctccttggcagagcacacacctaactactacgggtaattagacggagccccagagtggggacactgtttcccaccagagccgtgagaaatgagctctgacatgtctgtgaagggttgaaaattacaccccagacctgtcgagagcagacatagagcaggctgttgagaaggcctttcagctctggagcagtgcctcacccctgtccttcaccaaggtctctgaggggcaagtggacataatgatatcctttgtctggggaggtgagctcttttctccccaaaccattctgaacctcgcctcacacttctttcagacacactgagcttccggtcagattttccccttatttgagggtgctgattttacgggctgaagaagggacccctcacaggtgaacaatgctttttggctccttgtccctacgctctcgtctctggtagggaagtctaaatagaaaaggagatttatctttgctgccctttgtccctcacagatcattgtgacaactctccctttcatggacctgggggcatattcgctcatgcgttccaaccaggaataggtattggagatgttcatcttgatgaagaagaaatatggaccaaagttttgaatagtgagtcaaggaattctccctttctatttttattttcccttttcatggcttactgcaatatgttctgttttgtataaaagaataaaccaatattatgatgatagttaaatgctttaataaagatatgctttttaatggtggttcagaaagatattgcaacactatagttacagttagtgataatgtccgaggatattgtttctaccaatggctgcatcttaagggtaaaatatgtttttgaaattttaaaataagattacaaatgatattttgtatgtgtacaaatatgtaccaaaattaaataatggtaactcttggtggggttgctttggagaatatgtgttttggtacatggttatccaaatttttattttgaatctgtattagtttatttagaatttatattagatcagagtaataagcattaatagaatgctgttgtttctctatgtaatcttttttccaatttatttatagctggacttactaatcaatattaaaattttgcatgtcagctaattttttcccttacattttatcagttcaattataaaaatttagacttgaaggctttttagtgttaattaattcttctcttgtgattatacacacacacacatctcagaccatgtcataaaccaaaccacaggggaattcttgtgcggtttggagatacatttgctctttgaggcctgaatactgtactgccatctgctaaagactgactgattctgttgccctttagattacaacttgtactgggttttggcacatgaattgggccgttcctttggactttctcattctactaacatcggggctttgatgtaccccaactacatctacactggtgaagtttatctgtctcaggatgacatcagtggcatccaggccatctatggtaagtgaagctgggtgaaccagacacatgcttgtgagctatatgtgtgcttcaaaaatagtggcaatgacctggtccttgaaagactcttcatcatatatatattttgggtcaatgtagtatgtaaaacttcattaacttcaggatctttgtttattttttaagggccatctaataaaccacagctggtcccagtgccacaaatcccacagccctgtgataactgggctgtctctgactgtctggctggaatcagctctctacactctgctgagcgttgaacagcccagagtccagacagggaaggcctccctttctgtgtgtgagtgtgataacaggataacatttgatgctgttaccaaaattcttggggaattgctcttcttcaaagacaggtacaagttataattaatcctgacgtatgtttataatgattatacatgtgtgcgtattttttttcttttcttattcttcaatattatattcatacataataataaaaatccataaaataaaagctctcctaagtccactcccaccaccctctgtacacagatata

SEQ ID NO: 57869 - DNA, 823 bp, Bovine  19866881185064
gaaggactgatgccgaagctgaagcttcaatactttggctgctgctgctaagtcgcttcagtcgtgtccaactctgtgggaccccatagacagcagcccaccaggccctgccatccctgggattctccaggcaagaacactggagtggattgccatttcctcctccaatgcatgaaagtgaaaagtgaaagtgaagtcgctcagtcgtgtctgactcttagcaaccccgtggactgcagcctaccaggctcctccatccatgggattttccaggcaagagtactggagagggttgccattggctacttaacgcaaaaagccaactcattttcaagatcctaatgttgagaaagattgaaggcaaaaggagaagggggtggcaaaggatgagacatatgctacagacagcatcaccaactcaatggacatgaatgtgagcaagctctgggggaaaaaaagagttcttgtcatgcttcagtccaaggagtcacaaagagtcagacacaactaattgtttactcctcatgactcaaatcctcaaaataagctttgtctttagaaatatcaacagatataattttgaatatatttattatagaagaaagagttctaaacacttggatttaaaacatatagccttagatcaatggctatggtaagctcaggagtatactaaaaaccaacaaataagaaacactttacatgtaaaatctaattataataatataaaaagtccatttaccttaattatctgttcaaacgctaaggcagattgtaacatcattggtctctgactttgaatcatctgttgatcaatagaatt

SEQ ID NO: 57870 - DNA, 1076 bp, Bovine  19866881190411
tccagatgctgtattcaaactgtatgggtccattgaaaaaatagatataacctataagaaaaagaccaaaaagatttcaaagtttgaaaataaagtcttactctagctaccattaaaatctcaatctgttagattcacttttttaaacatttcaatgcctgcattataaacacaactaatgctttaacttattgcttataatttaaagaaggggaaatgtataaaggtttctagctctcctaaaatgtcacctcaaattaattgctgtgttggcatgagttccagttttgaggtttgaattttttttttccctttggccatgcccagctatgaaagtacagtctagacctctggggaatgaccccaaatgcttgagttattaatattggttatttgttgcaaattggagataatgtccttttccataattaaagcaaaaaacattttatatttatgatgttatttgtcttcacatataaaatactccccattcatccctgattttaattatagtaatactttttgcatcttgtgtgttgtgcttagtctctcagtcgtgtccgactctttgcgaccccattgactgtagccagccaggcactttggtccacggggattctccaggcaagaatactggagtgggttgccataccctcctccaggggatcttcccaacccagggattgaacccaggtctcctgcattgcaggcagatcctttaccatctgagccaccagggaagcacctttgctttttcaaggggtcatttccacctgctgtaacacccccagctacaaggggtcttacaggggcagcaaacatgtatgaagtaaccaacctgaggaagaggattctccattattggagagcaaaaatgggagcaagctaggagagaaacttagataactgacaaagggaaaactaaaccaggtctcaaggaaacagaaagtataagtggcctaaagtctacctctgggttctggcctatgtaaaaaattactgttccaaacaatttgagccaggacagtttctcaaatttaacaggagcaaaaggaatttactatcctaactttcaa

SEQ ID NO: 57871 - DNA, 1865 bp, Bovine  19866881264412
attggaaacgttgggagaaattagtaaagtaggttgtatcatcctactttggattcagatgttttggaaatggtcctgttgccatttggaagaaagcaatcatgagtcaaactgcgggtgatctaaacaaacactgtcaccttataaaaatcggactctagaccgaggacctagtagaagatagacagagagcaagccattaagaccacatcaagctgagaaaagtcagtggaaatgagaaaccttccgattctgctattgctatgtgtggcggtgtgctcagcctatccactggacagggctgcaagggacaaggaagacaccatggagcttgttcaggtaactaagggggcggtcctcacatccctgatggcccggtggggaaactagctctgctttctatttataaagctcacacagaattgttggaactgaccgtgtatgaagtgcaaaggcagagttatatgtgttgcacatggaaagggtctcagtatcactcacctgggcttctctttttatactggaaggaacaaaagccagagatattaggtactaagatcaaaaccaccttagtagcagcattgtttaaggtacgtgaataacaagcagagagtatatgaaatgtgtcttgttttgaaacttctgtaggtattttaatccaatataatgttagctggatatttttattgctgctgtcatgtttagacatagagattttttttaagtttttttcttaagccagctccttatgagaagtataaagtggaaaattgaataaatgtagctgaaatcgacaaatacacacaaggaagtttgattgtttgtttatctcctttaagttccctagatatttaccttgattttccagttcatggcaattttcattgctctggtagtaaaataagctgcacagattattctgctacaaagataaagcaaaagtgaagaagagtctgtaactgaagaattaaacatgacattgacttttatttcagtaagctaggagactatttcaaatagataaagtgagcaactgcacaaattttctgtaaaccactaaaaatcataagaataacctaaaactatacttattttccattagcaatatctagaaaactactacaaccttgcaaaggatacgaaacagtttgttagaagaaaggacagtagtccagtagtccaaaagattcaagagatgcagaagtttctggggttggaggtgacaggaaagctggactctgacactctggaggtgatacgcaagccccgatgtgggattcctgacgttggtttcttcagcacctttcctgggtcgcccaagtggaggaaaactcacctcacgtacaggtaatgggtccaaagagatttttacatactatgagattttataaattactattacaggagaaaatagtatctttattattactttttttcatacagaattgtgaattacacaaaggatttacccagagatgctgttgattctgccattgaaaaagctctgacggtctggggaggaggtgactccacttaccttctccaggatctatgaaggagaagctgacataatgatcatatttgcagttagaggtaaaaaaaacagaaacaagggggaaaaaacccacacaaaattttatctggtgttgtttcattagaaaaagattgcaaagagatcctaattattgatcatccaataattttttctctctctctcttagaacatggggactttttgccttttgatggacctggaaaagttttggctcatgcctacccacctggatcagggttttatggagatgctcactttgatgatgatgaacaaggacaaaggatacatcaggttagcgacacatctctca

SEQ ID NO: 57872 - DNA, 1019 bp, Bovine  19866881422266
aagaaataaaagcatacaggcaaattggaagttatgactgtttaggaacttaccgatgagagcagatcgtaagactcaaaccaccacctgagataataaacctgtctccaaccctctagattctagtttacccaattcttctggcaaatacttcccagctataacagctacaacttattataaaaaacttttacttttttaaataaactaaaaaacaaataatgtaaaccatcacattttgacaagaagaatataacaagagtatggaaacagaatttaaggtatctgttaaaattacctttggatcaaaagatcctttatttttaaaaagaagttcttcaacactctctcttatttcctttggaatatttcgtgcatcaaaggttgctatgtcttctcgcacccctctctttgcaaggaagctagaaataaagcatattattaattcaaatgaggctaaatatagtttgctatttttaacaaaaatatcaatttaacagagtggtatatacaatactttcaatctattagttaaccacagaacagagtaattttaaagtacttaagtttctaaagtaacattatttcatcagtttttatagacaaggagctccagaaagatgcacaacagtttttctaaggttctgtgaatacactgaagcaatacaatgaaggaattataacactgaactccatccacatccctttatgtgaactcctgagtaattaatacattataggatatgcaagaaaatattctgactcctttataagaaagatattttacgtgctctctcaatttaaatctcctcccccatttcagactgaaaaagaactctactatcagaatgaataccagcacaaactataatgccattgctatactgtgaaatctaaagctccacattatatactgagttaacagtcagccttttctcctctggtttacatcccttttatattttcatggggctctcactttttctctgggtctctctgcctctgccaagagtgaaaaa

SEQ ID NO: 57873 - DNA, 1088 bp, Bovine  19866881434740
ttatgattaaagaccggtaagaagctttctttgttaaaatgagaacagttttttccctcatttacaatttcttgtctttatttcattatagctcacatttataagaattttatattattgatggaattgatctccctcagcacttctatgtaataagatattttgtataagtgatgatcatgtcacagaatttaccttcatttatgccatagcaagaatatatgtgacagtattatcagactttcttatgaatggtttgttacctactgtgtgaggtgtcttataagagtccaggctggaagctgtgcgcatttattgtgctcatatcctactgaccagaacctagtgttctggtggtgagctgcatgggagactgggagatgcccttctttattaagcagctgtataatcaggtagaacaactggatgtcactgaggaaacttttttcatcgtattaattttgttgatagttatcacagatgctgttagtcatgtgaatggttttgtaatgttgatgtttgcagtatatcttttgttattgtaaatttagtgtctaatttatttttgagtaaattcattgcacttgaaataaataatgaataagaatctttagaaaagttgatattgatgttttttgacctttaaatagaaaatattggaagtaaaaatgtgaatataaagtagaaatttacattgagttaaattatgtatactctgttgacttatagattgaagtgatgaaaggaaacgtcaaatcacgtcttcagatttattatcaagaactggaaaaatttaaagctcgttgggaccaactaaagcctggtgaatgatgttattgaaacaggccagctgagtactcttgatcaaagtgcaaagtcaataaaagagaagaaagttgaatttgatgatcttgaagtcataagaaaaaagctgctgtatgtttattctttaaaactgatagtgctcattttggaaaaaaagttttatgtttatatattaagctaataatgtacctgtatctgttatattaatgtctttttataagcttcagcagtttaaaaaataccagtattaagtgctcatgcta

SEQ ID NO: 57874 - DNA, 1346 bp, Bovine  19866881712853
atgcaaagctgaatatatatagccacagtctatactgttaaattctgtaaaaacagaagaaatacactctagaataaaattgaaagggaaattcactttttgagcctttgatctgaaatacctaaatctgattcaaactttgatttaaaagcaggcagttagtccaggtaagactctatctgataactttccgcttttgtcttcctatttagcatgcttctccatgactaatcagacaggatagcacaagatccttgctacctccaaccaatacaatcattcttctagctattcacttgtttctcaagtgtcacagttttaaatgtttcagaataaataaattaagactgtagatttgaagataacatttaaaggagaaatatagaaaaaagtgaccaaattagctgggaaggatgaaaataggaaaaaaagagtataatctactagaggagatgatcgctgcatagctaattttataagaagtaaataaattgtataggaattatgaagaaggaaagatattttcttgagagaaagcctagggtaaagccacaaatgagtgaagactgaagtagtttggatgcagaggaaaatccaggaacaggataaacaaccaacaaactcaagaaagtttagtgtctctgaaaaaatggcaaagggctgactttttattgaagtaaaaagtgtgtgaacatgagtagtgaaaaacgaaaaatgaagttgtggaaagataggttggagcctctttgtggaatggcattagtgactaagatgtttgtttatttagtttatttcagatgtttacttgattttgttgttgatggaaatccatgtttctatgaaatattttcaattaaagtttttatatttcaataaaattttgtatttttactatagaaaattttaaatacataaaaatgtagaggaaattaaattatttatggtcaagctactaggagaaaaaatactattagcactttacagtacttttttctgatttttaataattgtgtattctgttttatatcatgctcattcgtggacaatttataaaattttatctattttttctatgaatttgaatgtcatcagccaaaaggaagtactaataaggcgaagtatttcttcttcaccgtgtaaaaataaaacatgttgcttacagattttttaaaatatacattttccatagttgaaatcagatcatatatattatttttcacgtctaatttccatagaaacattcaaacatattggttgaaaggtgaactagagcaaaaaaggaagttgggaacagatattatctgcaagtggggtgactatctttttcatttataaaagcctaatga

SEQ ID NO: 57875 - DNA, 1073 bp, Bovine  19866881883096
acagttgaaatttagaatctggaacccatatcaataaacatttcatactcagttacattaaaacccattggttatcttgcactctgaatggatattttgcctgtacataactgtaacttcatgtattgatcatttggaaaacatttgagctatgtagatcttccaaatgtggatacatttcattatacaatatcataaaatcacattccttaataaaccactgataccagaagaaaaagtctgtgtatggtgaggttgtcaagcttacagtagtagagaatttaagttttccaaaattctactttttcatgaaagcctgaatttcatcattggcaacaaatattgttcattttttccttgaaatgatagacttatttaattcatttttgagggaaaaaaatgtctgccaaatacccaagtcttaagagtaatagtttgtcatctattcaagtaaaaattttcttcagtgataaaagctgatactgctaagtcacttcagtcatgtccgactctgtgtgaccccatagacggcagcccaccaggccctgccatccctgggattctccaggcaagaacactggagtgggttgccatttccttctccaatgcatgaaagtgaaaagtgaaagtgaagttccccagtcgtgtcggaccctcagcaaccccatggactgcagccttcagctcctccgtccacgggattttccaggcaggagtcatggagtggggtgccattgccttctccgataaaagctgctagttttgatcacaactcaaacagtaacacaagttcctggttgtttttttgtttgtttgtttgtttcttttccttaaggcaaccactgtacttcagtattcagcgtaagtgcttttggtgtttcatccatcagaacactaaactgacttgaactcaagatttgagatttgactaaattatttactctatcattgaagacattcttaaatgaaactggtatcttttcctttgagtacatggaggagaagaaaggatgtctactagaacatttcagtgtcccagccttgatttgtgcaaagatgccagcagttagcca

SEQ ID NO: 57876 - DNA, 836 bp, Bovine  19866881901410
cccaaatgctactttgctcactatcaaataccaaaaatatcactaaaattattgctcccagatttcaaaaatccacatagaagttcaacctaatggtctcaatgcaggactggtagttgggaaaacgtaaatctttacagtgattctgctgatttgcataaaaattctgtatgtgtataatttgaaaatgaactttacaaagtatattttgatacccagtgaatcaatatttcagaatattatatattaggagttgtttatttaccatctaccaaacttaaacattttaaagataaaagataatataggacttaaaggtataattagattccacagattaaaaagaaagaaaaaaaaaaaaaaaaactctaatagatcataccagttcaaataattgggccaaagcagtttaatcccaggatctatctttttcataaaattattaaaatttagaaagttcgtaagtggcctctaagatttaacgaatagagaaacttttctcaagctcagttatactaccacagtgacaggaatgctctaacttctgcaactatgtaatagtttttgaataatgtaatataacataagggtgccaaattaaaattttaagttgacagagcaaagtatcacctgagtgctaagaatactaacagctcagccgttttaatgtgcttaattcaaataattttaatacgttatacatttaagattgctacaagttaaagtaaaaggaattaatttgcatgcgtcatacaaatatgagctagtggagtatatgtcaaattctagtatgagttattaagaggtataagaatacagcagtatctttcacagta

SEQ ID NO: 57877 - DNA, 3097 bp, Bovine  19866880347769
tttctcctcattacaaagttgatcttgtaatgtgttgtatttacttgccaacacatgctgcaggaaagcacacagctatctttgtggctgatgactagtaagactaaagcttgtagcagcatcttttttcaagaaattaatacaacttctggctccatcttacttttctctttttatttgttttcttggcctcatgtttcttatctggttttaacaaatgcttatttgtaagtccccttaaatccctttttgaaaaagtctgaataaaactaaatgctctcaatttgactaccacagttttaaaaataagaactaccaaacagtaaatgaaaactaagaggcaaataaaaacctgaccaaaatatacaagacatataaaaaaaggtgaaaagtcttgattgtgaagaatattggaagtcaacaagagaaaactatgtgaactgcaagtaaaaaactggggaaaggtccaaaaaagatacaagaagagaaaaaaatgcaatgggcagataacaatgtggaaaaaacccaacctcagttttagttcaggaaatgcaagtcaaaacttgatgagaaactcccataaacaatgggaaaataaattggtttccttggaattgtcaacttaaaaaaatttgtacaatgtgagagttgtgggtcattttatttgggaaaaaaatgaggacaatagaaagcctgggatacaacacctcagatagctctgagaaactgctccaaagaggtactggggaggtcagtatacatgtgaatctggtgaagaaggaatacatgcaatcaagcacatgtttttttccagaaggtttctgctagtcacaagaagcagatgtcactatgaaggattttagtgcttttctagatatgaagagatacaagaattgggctcataaaatcagctcctgcaaatatctaactctcttctctgaagacctgttctgcaagttttccccctgagcaaagagtgcttcatttctgctttctaccctgaaactcctttcagggggggggttgaaaatcagcagctgtagcagcacatgatttaatccttatagaggtagatgaagtgaaactgttagtcgctcagtcacgtctgactctttgcaatcccatggactgtagcccaccagggtcctatgtcctggggattctccaggcaagaatactggaatgggttgccattcccttctccagggaatctttctgacccacgggtcgaacccaggtctcctgaactgcaggcagatactttactggctgagccacctgggaagtcctgtagaggtagatggtaagtgccaatttgtagttgacagaattcacctaccttgttccctgacctcaaggaggggaacagacatgcagataagcatgtataggatagagtggctgtgacagagtatatgtgtgtttacaaggaaacaccagagggaagataaaatacaggctcatggttggagagatcccagaagaatctggaaagaagagctgggatcattagatgtgagtttttgaaggcagggactgcctaagtggcattcctcaagtgcacaatctctggcatacagaaggcacttgataagtctttttttagataaaaagagtgagaagggacatttctgccgggaagcaaaggcccagaaaaaaatccatcaaatgaacaaatgggtccatgaatgaatgagctgtttgtcagggacatactaatgcatctttgaaagaattaaatgaccagcctccaaaggacaaaactaacagcctccaaaggactttttccccctcctatggatcattaccatacatcttattacttgaaaggagaattccaaaccattcaacagttcctttggattcacttacatcctgatttttctaactgcatttcatcccaaccaccaggattaaatactcccaactcagaaatattcccagtcaagactctgaaaaagcccatctgagctaaaccttaggacatatgggtagttgccataaatctcgatacttttcagctgaaggtttttttttttttcttggttattagggaagacagatgtgctataggaaaaacatttaaaagctaacattggttgtttctcagtagaggatttctgagtaacttttattttccactttgtacatttcggtattttgcaaatcctctccatcagttctgaatcgcttttataatgacaagaagagaaatcaggtcaagaaatgcatgtgaatcttgttgtggagaattaaattagaaaagttgtggaatacttagaaatcaactgagttttcacattgtggacaatttaaagggagggttcagggtgattagcccttgggcagaatatggttttagacatgttctattctaagctattaaatacaaaatgtataaatgttatcttaaatatcaaatattaccaaaggcaatttaatagcaattaattttgtgtcgtctcaaaagctccagttgaaaacgtctttgttgtaataaaattcctacacttcttaacccagcattttaagtaatgaatttaattatgaagaaaactgctgtcattaaacccttcttcttaatcatgcctgtgtttatgacaaaaaaaaaaaatctgttgccatggaaattttagtgtcaaagttgcaactcataaagctttacagaagtataaagtaaaaataggaaatgatctttagcaaggtgaaacttcttccttaatatatttttaaaaacacttaaattatggacagcaggtagattttacaagtgaacctaattttgtataactaagcaatcatgaaaagtttggcatttatctcattttggaaaatcaaataaagtataattagggaacttataaaagataagaattgcactggtaatccacctcaatttaattaaacatttattggggctctactatcttataaaaattaatattttcatgggctgacttttctaaaagtgggcacttatatagtttgacattagtttttaaattatttttagctgtcattaaaaccccaaataatggaactagatgtgaacaatgcagctatagttatacaatgagaccagagtcataacttacat

SEQ ID NO: 57878 - DNA, 769 bp, Bovine  19866880398002
ttttctttccctgattaaaatacagatgttcttcaaccagcaatcaaagaagtcttcatgtgcaggcgttgcatgaacttggaaatcttctcatcttcgcacagaagaaaaggtagcttataggagtcagtaaaacagggagaactctgttcacctgaaaaatgtttaactattgtgaaaaaaagcaccatcttttataaattttagttcttggataatattccattgctgtgttttagtcatcaaatgctaccggagagaaatggttatgagcaataaatggcacagatccattctctaacattttgatgaaaatgtttattcaatacattttctttcctttttgaaagatagatttaacaacacagatctcatgctgcctgatgccccgtttctgtttcagggctgcttttaagtgttggagtcaagctctggatgaaattttcagaaaagaagatgtgctccatacatggaaggagattggcagctcactcaccagtgccactgatggctggtcacctccaggttccaaagactacagtgaggagctcctgtccaaaggcggcatctgggggtgtttgcaggggagcggtgatatcagcaaagatagcacagtgagtatgacgctgggagccgtttgcgtaggacctggggccttccttcatgggctacccacccgggccatggtagggtgcctcacacacactgggttcttgggcagctccattcatatcctataggcttattatacactttacttggtttgggg

SEQ ID NO: 57879 - DNA, 1618 bp, Bovine  19866880480927
attaatacttagtgaaacagaatgctatttctgagcaaaaaaaaaaatgaaaactacatgtgtctggctagatgcattaaccatcacctagctgtatgaaccactcacctatctgcaattccattaacaatgatcaccataccaaccttccacattaacactttctagtggaacaaatagttggtactcttaagattttttttaatgacttgaaaaaatatacttaaatgctcataggacatcaaaaacttaaaacccaatcattcaattattgacaagaacaaacttaatgagatgggcaatctggtcctctctttgtaaaaagtagtgggaaagtcagaggaattgtttatgaaaatgctatatgaaaatattcctttagctaaccctgcaggggaaatcatagtgcaatacataaaagtatcaaatcaatgcagttgtgcacctcacatttacacaacaatatgtgttgattacattccagtaaaaaaactgaaaaagaaaagaaaagaaaaccttccaaacactggttgagaggccatctcagactggggcaagggtctaagtaaaagcagtactgaacaggtggcccattagaaaatcctttacttatgatcaaagctactaggtaactaagataaatattagatgtttggcgtggctagataagacactgaagatgcatgtataactgaaaaattgaggagcaataattgatgcttgttgtatctgaaaagcagatcagtttgggtccaactgtaccgctggcttcagtatttggaggtaaaacccctttactagaatagaagaatatattcacagcagtgctcaaaaacaaagattatacacaccaaatagatggaaatgactcaaaaattatccacactaaatagccaaggtttataaaatgttatccttacctgcagattctctttactaataagaggttttcccgagtcaaatgattgaaatagctgtcaatatacaaaatgttaacattagaaacaagagtactgagtggccctttagatgaaaacgttaatgtgttctaaagctattttaaaataccatttttactataaaagtaatacatgctctagtcagaaaaggcaagtatagtataaagaagaaagcaaaaaatctttaggttgttaatgttaatatcttggtgtctttactaccaacttccttctgatgtattttaaagctttatacatggatttgtgttccttttcactaaatgttacatcataattattttctcaagccattaagttatttgtaaacctcatccaacagctcaatgacactctagcctacgaatgtactggtgttggccaaaagtttgtttgggtttttctgtaacatcccatggaaaaacctgagagaacattttggccaatcgcagtagcataataacttatcctcttgcctattgtgaggcaaagaggaccacttccaccttcaccccaccattcagccctgtactaaataatattggtgatgagtatttctgattagcacctttgaatagattcctggaagcagaagtgctgggtcataagaataagaggcttccctggtggctgagacagtaaagaatctgcctgaagtgcag

SEQ ID NO: 57880 - DNA, 1024 bp, Bovine  19866880499750
tgtagagtttatttgtaaatggaataacacaatcttatggacaggaaaagaaattccaacatgacatagataactaatatggcactcctgacagtttaatcacttgaaggattctattctttcacagggtgatacgaaattctcttccagtatggcaacaagtggaatcatgtgtagtgttgtagaagagggaataaaaatcaatgacattactcttttttgttcttgggcatttttaaatgttattgatcaaagcatcacagcataactctaaaaaatagaaaagcaagttgtggctgaaatattgtattactgtattgtctgcttcaactttcttaacattgttaactttcagtacactggctcacattactaatgttgagaatgttttctcagtaatgaatgttcaatggacaaaagaatgaaacaaattgacaactggagaagctatgttgtataaatggaacatggactgtaactgaaaggcattttataagcaaatttggcataacaaagaatcagtaaggatagccaaaggaaatgcaattaaaggaagaagtatgaaatttagatacttagaatttgtttcagataaatgtagttttttttgcataagtatgcaatatttttttaagttaatgttcttaaacacaggagcttccctggtggctcagtggtaaagaatcatccagccaatgcagaggacgcaggtttgatcactggtcttggaagatcccctggagaaggaaatggcaacccactccagtactcttgcctgggaaatcccatggacagagaagcctagtgggctacaccctacggggccacaaaaagtcagacatgacttttagcaactacacaacaacatattcataagcaattagaaagaattaaaatttagctgagtgtcctttttctagtttgctcaatcttgtaaccataaaggagggacaattcttgttttttaatttcccagaacttaaattgctgttttaaaaatagcaaccagttctgctttatagat

SEQ ID NO: 57881 - DNA, 1810 bp, Bovine  19866880528816
tttgcttgctatttggggaatggatggtggatgaggttgagtataaatagcgagaccagggagaagggctttgcaaatgagctgagtgagacatgacagtggttagaggtaaacggggtggaaggaaagaaatgtggtgaagttctagatgtgtagctaaggcagagctgacagcatttgctgatgctggttgagatataggaggtaagagaaagaagttaagcatgaccacacagcttcaacatgagcagctggtaggaaagtgttttcattgactgaaatggggagtcctgctgctctgaggcagggtggagcatgttaagtatgagattcctaatagacaaacaggtggagaggctgcctgtgtaggtgcagagagtatatgattcagaggagggctgcaggtaaatttgggagcattaacagagagttaaaaaatcatgggactggatgaaatcagctggggaccaaggcagagtgaaaagtagaagtcagaggactggatgttgggatcctccacacttagggtccagaagacaagaaggaaagggaagtcagctgggtagaatgggaagcaagagaaagttttcagtagtcactggtatcaccaaagcaaataaacaagcagcctgaaactcacgtgctcagtcacttcagttgtgtccaactctttgtgacatatggactatatagcccgccaatccaaactgaaacttatgtatacagataaattccaaacttcatttttttaatcaactcatttgcgtaagacaaaagtgggggcaaattgtctcctgatggactgtgacttcatattttttattctcaaagttattgtgcagctttccagcttcagttgggaatttagaaagcgtaattaaaagaggaagtgcattcagggtttataattaaaataggtgccaatgttattaggctgcaggctagttatttaaagaaaggattaatgaattagatttcagtgtaaaagcagttactgaaaaaaaaatcttacagattatgattggacttttcacaggcttttaaaaaattctatttttaaacatactcatattgagtttctgttctcatcaccaaatctaaagtcctgtcattaaacttctttaaattatatcaccagaagtctcaccatggatttgcttactcacttttcaatgtattcaaggaaataaagactatcttaaaaaaaaaaaaaagaaatgtctttaaacgcttaccaacactttcttccctttagagctatgtgtgatgtcttgatttagaggtccctcaaaagcagatcctgaaataaagatttgggaacacgtagtgtggtcaggggacttcccttatggttcaggtggtaaaaaatgcacctgcaatgtgggaaacctaggtttgatccctgagttgggaagatctcctggagaagggaaagcctacccactccagtattctggcctggagaattccatggactatataaatatagtccatgaggtcacaagagtctgacacgactgatcaactttcactttcacagtgtgtttgggcggtgactccaggaagaactgtgagtaagggggaaagtcagacagcgaaataaggaaaaccactccaaagagtgttaatgagatcactgccatggcagtcggggccacggagagacagtccctcacccctcatgggtagtggctgctccttacgtgtccagcctctcctgaaactctcttatggccgaagaccaccctcaggtagagaggtccaggtggttgaagtaggataccatatccacatatgagtgacctattca

SEQ ID NO: 57882 - DNA, 1572 bp, Bovine  19866880585524
cagaacagaaggtgacataagacttgggctaactgacacagcccagaacatgagagcacttgggtatgggctcttattatgaaaagtgatgagaatatttagaagtctgttttttccaccccttcctccccaggctcacaagtatttgttgctgacggttgcctggtaacctgacaaacgctgtctgtgtccagcggggctgagtgactctcccaagcgcggtttcagagcaacagttgcacacatctgcttccctccacgtgtaggggaccagcctccacttgtaacttcccatcaaatgtgcattctgtgtgaggttacaggcggcaaagacgggaccagcttcagcaaagaggaaaagcgacattcatccagtacaccccaagaggcagttccagcagaagtagaagctcaggtctccaaaccactcccttcatcgccactgcccagtgggtgttttaagactgtaggagcctacagggcaagcagtccatctgggtcagcaccatggtcgccttgtgcaaagaaatccttccagaagcaccagccacccctggtcctgtgagagcctccctaggttacttcaccctaacaacatggatgatgctgagagagtaagtcccatttccacttccctcagcactgcctgctgccctgacaggttccaggcttacttacacaaataggtgtgtccatgggtgtgttcaaatatgtaccctcatgcccaactctgcctgctcctcccactgaagaagaaggaatttgtgtaaataatcccctagagtggagaactcagacgtatgtttattaagttccataattttttaaaaaattacagggtaataaagagatgtttgtggaagtttaccttcttcattttgatgttatgaaggataatattaagttcattacacatttattgaatgaatgactctcactgtggatagaacaaacccaggcaggaagccgaatgacaggaaccccatgacagacacaattttctgtagctaatccccaggctggttaaagctccgtatgaagcattgcatatatgtactggcatgtgctttttgctggcattttttattggaaaactcccagacagacactgggagctataagcaaggccccacaacttcataccttcagtgagagtttgctgtttagtcgctaagtcatgtctgactctgtgatccatggattgtagcctgccaggctcctctgtacatgggagttcccgggcaagaatactagagtgggctgccatttccttccccaggggatcttcccagaccagggattgaacctgagtctcctgcactgcaggcagattctttaccactgagccaccctgttaagagcttactaaactgtaattctccttatctaagtccccagcaaatacctgctgcgtgtgtgggctctggcttggcaccccaattctgacatagagtcatgcgtggggctttccagcactcagacttcttacccagctcacattcctttccagcactgcccttcccccaggaggagccggtccagctctgagctccccatcagcagggcggagct

SEQ ID NO: 57883 - DNA, 3605 bp, Bovine  19866880615441
catcttttaatttatggctgcagtcaccatctgcagtgattttggagcccaaaaaaataaagtctgacactgttttcactgtttccccatctgtttgccatgaagtgatgggaccagatgccatgatcttcattttctgaatgttgagctttaagccaaatttttcactctcttctttcactttcatcaagaggatcttcagttcttcttcactttctggcataagggtggtgtcatctgcatatctgaagttattgatatttctcctggcaatcttgattccagcttgtgcgtcatccagcccagcatttctcatgatgtcctctgcatataagttaaataagcagggtgacaatatacagccttaatatactccttttcctatttggaatcagtctgtttttccatgtccagttctaactgttgcttcctgatctgcatatagatttctcaagaggcaggtcaggtggtctggtattcccatctatttcagaatttcccacagtgtattgtgatccacacagtcaaaggctttggcatagtcaataaagcagaaagagatgcttttctggaactctcttgctttttgatgatccaatggatgttggcaatttgatctctggtaaagcaagtatccttcaaaaaaaaatttaaaaatgaagaaaggccagataaggagactgagtacataaaacagctttacttattacagtctaccagtggaggtcagtgtagtcaggctacacaacaaagatatcagcatcattatccaggagagatcggaatataaatttccatgatctagcatcctcaccagtgatgcacaatgctggatggtaatatccaggtgtcttttaagtctctgatggggaaacaatggaagcagtgagagactttattttgaggggctccaaaatcactgcagatggtgactgcagccatgaaattaaaagatgcttgctccttggaagaaaatctatgataaacccagatagtatattaaaaagcagagacattactttgccaataaatgtccatctagtcaaagctatggtttttccaatagtcatgtatggatgtgagatttgggctataaagaaagctgagtgctgaagaattgatgcttttgaagtgtggtgttggagaagacttttgagagtcccttggactgcaaggagatccaaccagtccaccctaaaggaaatcagtcctgaatactcattggaaggactgatgccgaagctgtatctccaatattatgaccacctgatgcgaagatctgactcatttgaaaagactctaatgctgaggaagattgaaggcaggaggagaaggggatgacagaggatgagagggttggatggcatcaccaactcaatggacatgagtttgagtaagctttgggagttggtggtggacagggaagcctggcatgctgcagtctatgtggtcacaaagagtcggacatgactgagagactaaactgactgactaagtctctgatgcttgaagaaatgtctgcagttcctctggagtgcagtgttgcttcaatttaatcatacagtttcagatacctccacttggctcttctaccaaactctaatgccacaggttaggaatcccatgttagggttctgctagatactaagtctcaccttcaatcagaggttttgagttttgaacggcctgagatctggaaactagatgaggaagcacgattttccattgcagtaactaatatcagacttttgcttaccatttcttaacttttctgattatacatatcaagcagcaaatttgttgccttctcatccatctatcttgaccctgtaacaccatgattcattagtcaacactgcatatccctataggtagagacaccttggttgtcactctggcctgggctgtccattatggtaatgacatctcatgctggcctttgttaactgttactacctggctttgccattctggaattacatcatccccactaatattatagggttccccagtggctgagcagtaaagaatctgcctgcaatgtatgaggcgtaggagacatgggttcaagcccatgtctctggtcaggaagatcccctggaggaggtcatgggaaacccactccagtattcttggctggagaatcccatgaacagaggagcctggtgggctacagtcctcagggtcacaaagaatcagtcatgactgagagactgagcaccactaatatgatgaaactaaagttcatggcagaatcccttactgcccacagccctggcccacagacagaaaacttccaaaacttctccaaagttgctgttactcaccttgttacattccttgcattctcagtggagtcgtcctctgaccaactaggggaacatggccaaaaggtaggttctttaggacatatgtaataaatccattctaacatttctctctctctgagctttctggccctgtcttcaaaatcatgtcaaggaagtgctgcatcttcatttcatttaatgtagaacattatcagatccacacttccagaaactaccttgttatgtgattaggaattctgaatcatggctgagcccctcatattgggtttccttggtagctcattggtaaagaatctgcctgctgatacagaagaagtgggttcgatcccctgagttgagaaaatcccctggataagtaaatgtcaactccctccagtattcgtacctgggaaattccatggacagaggagcttagtgggcttagagtccatggggttgcaatagagtcagacacaacttagcaactgaacagcaataacaacccccatattaatgaattctaccccatccagctttgtctttctggtcttagtgtactcaaaataccctctgaacacatgttacccccagtttcagctaatccctgtaagccagatcctgcaattcctttggcatgtgggctatttcttcccagaacacagcttgtgttttcctgttcaggctgtgctgaaatgtgtttgatttttagccaggaggtaatgaaggatgttgggggcatatctagagggaacaagaatcatcttgaaaggcacctgcttcagattaggtcattgcacgttcctccaggcaaaaaaaaaaaaaaagactctttttctctggcaggtggttagaggatgtttctgcaaccctggagggttcagaggaattcaagagctcaaaattagacttgtctacctaaaaatctccattttatatctctgaatcccattattttcttggaacctctgctacataatcagatgtgggcccaagttttagcagtctacactgtcattactctgagctgcaatagaggcaatctgacttttagagaatgcttgaagaacttccagtgcctcaaaggaatccatcctacaatccctttcattaatattgccccatactgactaactacaatagctatttgacctccctataccttgctctctacctacacctcatcacaatgaaaccatgggtgaaatcactgcatgccaacccaacttatgaccacagtcggctccctattgctttcagacaggaagattcaaccctaaatcccatccggggagtcca

SEQ ID NO: 57884 - DNA, 1112 bp, Bovine  19866880652099
agtggaaatgtctctttttctatttcagaatatacaacttgctagaaagaactctgattggtcaagacagccgggatcatgagcctacccttaaggcaaggggaagatactgagaatggttactccaccaaaatcatgtgatttgaggaaggaggaatagatccaaaagaaagaggaggaaaatatgctgttcccagaatctagggtaggaatggagggtaactaaaaacaacagatgtctacaatctgttgaatgatgctggtggaagccagtttgcagttgaaatccagtcagcttttcagactcagctgtcacagatatttattcaaaaactaagacacattctcatagactgcgcttcattttgaaaatgcttgcctattaattgaacatatggattaagatatatgtattccctaaaagtcacacataagagaggcaggcttttcactcctttatggtaattgaagttttggcatgagagaagattataaggttacaggatttaaaagtaaataaataaaaacactagaaagtttttcaaggtgttccctttgggagtctgtacatttatcttagcagtgatgttactgcacaagacagttttgaaaattctcttttgaatttgcctctggcttgaaggggtaaaaatccatgtcttttaagggctaatttgaattttgaaaaaacctaatttgtcatttggaataaaatctggtgaaaagggcaggttagaggcatacagcacaatcatgtaatccaataatgagatagattgatttttctctccaagaccctaatgacctcctctcctctttatccttctctctctccctcctccagtagctcttacacattcatccagactaatctttctgaagcataactccaataatatcactacctttttcgaaatctatcaatgacttgaactactgatttgaaaatatccaagctctttggtctgaaagtcaagacaatttgtagtctcactgaagtttgttatttgttctccctttcagcaccctcaaactgaacccttgaatagtttttgttaaatctctgaattcttaacttgttgttttctatccatgaccagtttctatctcac

SEQ ID NO: 57885 - DNA, 793 bp, Bovine  19866880669961
cttggagcggctttcctgtacatgctgtccatagtctctcaggcagaatgctctcaccacctggtatctcagaacacaggaaacagtcaccccagaaaatctgcaaaccatttgaggcttaggttcagagagttacatcatgttctgagagaggaaagaccacctttggagagtacgccatccaaaatcctggaggaatggatcccaggaactgtcagagccaagaacatcacctggcatcagttgatctcagctgttccctgagcagtgagggctgggcatccttcctgaaatggagggtctttggcaacttgcttctggatagtgatgtgtttacggtcatatccaccaattgccggaagtgtggggtggaaactgattctgaatgcacagtctccttgaataccaacaacctgcttcattatttgtttctgaaaacctttaccagtttgtgctcctttcagaacaatttgggatcatgatgaacaggactacctgggcttcttctctcctcacttccctggggctgttgaaccccaaggggtcccagggccgagttcagctggcaggtaagggccttacattccagtcccagtaaatcctctgctaggcacttgagatcttccaggattgctatagggggggcttcccagagcctgtctccccagttgtcttgattatcatcagtttgaaaggaattctagtctagtgaccataagcatcaacagcctgctgccagactgttgagatttgcatcttagatctaccaccaaggactgtgcaaatgacctta

SEQ ID NO: 57886 - DNA, 2122 bp, Bovine  19866880700652
ttataagaataacaaaaatatttaaatgttaatttaaaagtaggtacgtaactaggacattactatacaaagcattgttatttaagaaccactgaaaaatggaaagataaacaggatatagaattcatcagtgtcagagaccaggtagagtaacactgtttaagaatggaacattccagtaagcaagcgaaagttactgaactagggaaggaggcaaagaaataaacaaaaggaagcttattaggaacttaccaggaaagtaaacgtacataggatttataaagcaaatcaagggagaggcatctgtccttcccaccccactcacccaaatatttaccattatctttgctgctgttttcttcaatagtcatttgctcagccaattcagataacgattcatcaatagtctggcttcctcgaagcgtgagggatagccttctcttaaattttttcatcctatcaactgaatgtgacttgaaaaatcctgaaagagaatagaatgaacacaagagtaaagctatgaatatcttactgctcaagaacaatgtttttctgcgtttactgggaatcttcaaaataagtataaagtaagaattctcacgtgcctcaaacatcacaaaatctagcctcttccttaaaaagatccattcattttgattaatgccatatgtatatagcatcatcagaagagcaagaattctacaaaactaaagattgacattttaagcatcacaattaaacttagaaggattagaaattttcctaaaatgaactctctaaaagccacttcagtgaaaatatattattattttgatgtgtcagttccatcattatatcaatcatcgtattgcaatcagtggtatctttagatacaactgaggagataagacaggtgaaagcaatgaagcagggagagaataaagaatgaagtctgacaatttattaaacagcaccaggagaaattttcttttttaagttcttatttagccaatatattggggttctgttcccccaccccatcccatcagttgtcaggagtctcttcctattatcataacaatgccaaattttagaaagaaaaaaaataaagtctaattaacaggtttcaaaatgcctactccgtaaaactattcttatctcttaattcatttagccttcctaattctaaagagtagactatactatcccaatatcacaaataagcaaacaggcccaaagaagttccttgactgaaagcaaacaattgatgacgtaagtgagatttaaaactaagattatcatttctgaaatcaagatgtatcacaattaatgcaatgtcaattacaactgatagctttctcttttctgagttgtacatataccaatggtacaattcatagtggagtcttagatatgattaaacaaggtactggttgccaaaatcaagtcctcaattatttacccataacttcttttctaatttacagtcttaactgttgggagaaggaaatggcaacccactccagtattcttgcctggagaatcccatggacagaggagcctggcaggctacagtccacagggtcacaagagtcagccacgacttagcaactaaaccaatttaccagattaccaagcatattacaaccattagcccaactaaaagtaagaatgttctaacactactatgttaaaatacctgtttaaccacctagcgctggatatctattttgaattggcaagtattttgcttactttttcattccagggctttactccaagtagctgagtgtgctaaacaagctacataagatatttataatgaataatttttgtctgctcaaaggctggggggagggtatcaaatacaaatttgtaagtaatattatgttttaccaattctgttttacattcttaaagataaattactgttgctgaatattttctactatcttccagttgactaatcctcttttcagctgtgtctaaactacagttaaactgatctattgggatcttaatttcagttactctattttcagtcctttattcttaattgattcctttctatagattcaagttctccagtgaacttcaccatgctgtcaattttcatgagtaggttagttacagtattttaaag

SEQ ID NO: 57887 - DNA, 1316 bp, Bovine  19866880704475
atttgctgatttgcttatctgctaaaagttacttgtaacctccaaatcaaaacccttggctctttggtggtcctttggggacctgcacagagcatagaagaattggatttttctgacatgcacattctcagccaagttgaacaacacgatggtgactttttgtttctactctcatactataaacaagtatcccttttcatggtatatttattgccaaacttttcacatttttgtgggggttttgtcatttcattatttgaaatggcccctaagcataaagctgaagtgctgtctagtaatcctaagttcaagaaggctgtgatgagccttttggagaacatgtgtatgttagacaagcttcagtcaggcatgacttatagagctcctggctgtgagttcagggataatgaatctacattatatattcaattatatgtctttaaacatagacacacattaaacaagattacatattgatcagctgacaaaaaatggtgtgaccagaggcttgtaggaacctatccctgtatttcccctaggagtaatgcttcagcattcactgactcactgttggcaggaactttctagaacacagcttctgtgaataagcaagtatgggcatcagctgtgtgtgcagtaaagggccactgtcctgcaccttattcctgccattactgcccttttcattctctgctaacttttcctgttcactgagctctcttctctgatgcttttgttcagatttcctttttgctcttccattcattgttactttttagtacgtaaaaaatgcttgctgagtaaggatgagacatggtttgtattatgtctggacttgggtaactgcgtggtattctttctttagtcaattttactgacagaagctgaagacagactcaacacccttctgtcggagatggaccatctaagccataaggacctctctcagtgttctgctggcgaactggagattgtagtggaggtcagactgcagctggctgccattgccctgcagagacaccgggcagcatacaggcgagtatctgcacacatgatttcttcctcaccctgatttgttcaatatatctcaattttatgtaagcttcaaaaattcctagattaatagagcagacttaggattcagggttttttttttcacatgttactacacttaaaactatagtcctcaacaaatgagttggtttattaaagcacatagcttcggatgttttatgtcaaacattagcaaattcacagatctctccttttcagaattaatctatttttttaaaaggcagaatctaaattccttatag

SEQ ID NO: 57888 - DNA, 3709 bp, Bovine  19866880717016
attaatacatgttttgcctcttgagatggagaaaacttcccatcctggaaaaaatgtgatttgtctttcctgttctgccttgtccctggctcagagatatgggtcagtgccaactgaaaactgggatatcattcctctactgctatcctattttctattcctccgagacacaaatttcccatactggtggggagctagaaggacacattatatcttcaaatcccaaataattataccacgtacaggtgagaatggagataaattattcatgctagaaatactgattatatacatgcatgcatgtgtgtgctcacgtgctgcaccaattcagattgtcaacaattcagacaatgagggtacaatgagaattatcctcagtgaagcagaggccccaagtcagtgtaaccaggcggtccttgctgaaggtggtggaaaccattgcaaagggatgcttctcaatgcagggtataagggacgctccctccaaaatattcttctaaagataaacttacagatagcacagataatacgtggacaaattttggcctcatttatggattgtaaagacaaaataattgtaaacagaaaaagcaaactttctacgaaagaacaaaaactaaactggtcttattttttctctgtgacattaaagactacataatattggccacataaatgtagaggttcttttttgcttttaatttagctcagttttttgcataggtcatttattttcaagaatcacaattcaaaattcatagaagggtatggaaagagttgtctcccttccatcttctctgcaagtgactcagttctcttccccagaggcaaacagtgttgtcagaatgcgtgtgtgtatgctaggttgcttcagtagtgtccaactcttggcagctatatggactgtagcccaccaggctcctctgtccatgggattctccaggcaagaaaactggagtgggttgtcaggccttcctgtaggggatattcccaacccaggaattgaaccatggggtctcctgcattgcaggtggattctttaccaactgatctaccagggaaccactagtaccatatcaatgctctattcctcctataacaaatagccacaaattcagtggcttaaagcaacacaatgtattctcttacagtgctggtgttctgaagcccaatataggacttattgggctaaaattaaggtgtcagcaggctactttcctctggaggcattaagggagaatgtttccttacttacttagagtctcagattatggtcaagcgctaactatggcaaaaatccaaaagttatcaaagaaaaggttaatagtttatactacttagaaatgaaaagtttcttcatggcacacaattaccataaagagggttaaataacatgtgataattgaaaagatgtatttgcaaataatatcacagttaaagggtttatttctataataaagagcttctgtgtatgtgtgtgtgcttagtcgttcagtcgtgtctgactctttgcgaccccatggactgtagtcagccaagctcctctgtccatagaattctccaggcaagaatattggagtgggttgccatctcctcctccatgagctcttcctgaccccaggatcaaactcctgtctcctacattgcaggtggattctttaccactgagccacttgggaagcccaataaagagcttctgcaagtatttaaggaaaaggcatggacccttttactagttaatggaaatctattcggaatatgtaaaaaataacaaatggatacaattttagttttcccaaatggctatcctatttctgtacttttttctaatttctattgatctgtctattcaggattcaataccacactattttaattattatagccttataatataattagtatctattagagtaaatcctcacttattactctttcttttcaaaattgtatttcttttatggctctttttttctactttggaaacaacttgtctagtttaagaaagttctctcataattttattaaagttgcattacctttatattttatcctagaaataacatgtttttattctgttgagtcatcttaaccaagaatattgtatgtcttatatttttagttcattttcatgcctttttttcaaaaaaaatcagtcccttaggagtgttttaacattttctttaagtagatcgtatatgcttcttgttagacttacttctcagatttttatcttattagtagtattgcagaattttttcattagctttctattggttgctgtttttgtgtatggaggctattgatagctctgtattacttaattatctttagatatttttcctcactttatccttcatgagcaaagtctaggcagcacatatcttctgtaaagggccaaatagtaatattttatgttttgtgatctctgttgcaactgttcagctttgctgtgttaatgtgaaggaaccatagacaaaatgtaaatgagcatggctgtattccattcttaaggacactgacatttgaatttcatataactttcacatatcacaaaatattaattttttaaaaccctttaaagtataaaaaccattcttagcttatgggtcttacataaacatgcattgacctaatttggctcatagactagagtttctccttatagatctaattaattctaattagtgccattaaattaatccttatatttgttcaagtttccttttttttttttttttgtaacacaaacagtggtgccatgagtatcttgtgcaggactcttggtacatgtctctgagtatctgcatttaaaattttattagcctctgcccaggaatttgctctcccaagtagtatatgagaattatggtatcttcacatttattgctttcagattttagtttctgttaattgctgaggaatgtgaaatggtatttcatcttaatttatctgattttttatgatgctaaaaattttggccatttggttttccttttctacaagttacctgttgaaattctttgcccatgtttctgttggactatctgactttttcttattgattacatagtagagagaagataatttatgattttttaaacatgttttctcagtccatggtttgttatttatgattggtgtcttttgtgatacaattttttttaattgaatgcaatcctaagtgtcaatatttcctttataagttgtgctttacttttttcacatatggttattttacaaggaaaacataatatttgtattctaatttttttttttttacactttcagataactaccaagttgtcttccagactggttgtacattttcttacgttagtgaagagatacatgaagatgtagattctcagaaaaaaaacccaattaaagtggatattacatggattcttctgctgcgctactatattcacctacaaagaattaataatatgagcaaattgctaggtaggcctttgaaagaatatattcctttccagtcattaagtcatgtttcttacttagaactataaaatatgtttaacatctttctgagtgaactctcatcagaagatggaaatttcagggggttctttgcctgatatacagggacctttgaaaagaacagtatttcaatgtatttaaaaacatccttagaaggaggcatccagaaacttcccccaaaactactgaagtgctatgtgactcaaaa

SEQ ID NO: 57889 - DNA, 892 bp, Bovine  19866880770237
cgatgccgccacttcctgaaatgtgtaatccttctgtcttgaattccaaagaggttggcaggaggaaggcactaaagatagttcaggaactaatatttaaatcagtttttaattcacctttcaacatgaatagtaaaaccggaacaaaagcttacccttattaggactccaaatctttatgtctatgaggctaaatattcagcaacaatagctccacacagaaatggtcaacaattacaggcctgaaatgattacccctcaagagcaataattttgccccagcagtcacatcaattgcttttccagaaacgcattacagctcactccgactgtccaggctttggaaactatgttgtgttatcattaatagagcactctgacttatttccgggacttaaacatgagaatggttttgcttttaattagggaggtttcccatgaagtcgcgatccctgagtaccaagcattattctaagttttccacatgtgtctgcttgtttagttctgcacagagtcctgagcccacactatttgagccccattttataaatgaggacagcaggcacccaaatgttaaatagcttgccccaggtaccatcccctccccaccctggaaaagcctgtttgagtgattcacaaaccagaccggataaacagactttctcaattgtcacattcattctgtcactctacctgtgacggaggccacagaacctccctgcacctaatttctgttgtgagcaaatttttgcagcaaccaccaaagaaaatgcagaggcaacaaaatttgacccacggtcacacctaaagggtggacctccctggtggctaagtgataaagaactcgcctgccaatgcaggagatgcaggttcaatccctgggtcggaaagg

SEQ ID NO: 57890 - DNA, 2721 bp, Bovine  19866880773184
tccacgtctctgcgctaatcttgaccttgatccgggataactgcctggttttccgggttctcacagctctcaccacagaagcctgccctccccagttcccaggccagggtgtgtgcagttttcatctcttccacttcactggggtgtcaggctcaatgccagcaaccttttcttgtcatgggcacatcagtcacacacctagatgttccctaacttctatgaccgcaactccaccacacctcatcttccctaagacagagcgagttgctgacaaaaccgagtcctcaggtcataccgtaagtagcataaagtggtggtcatacctgggatgagtcaaggtactatactaacagaaccaggttgggccagtggctggcctggattccctcttatcaatgtggaattccttcttcactctctttcctcccatgtggctggtatggtcagatcatccatcctagactaagcatatgttccacttcactagggggagggtagaagggtggctcccagaccctaaggaaaggattcgcctataatccaggggtaaggtccaaagggccacagaatgagcctgtgggcaagtaccaatagctgaggttttacactagagaaaaaaaggtgcaggccaaccagataattcttcaataataaagttttctgatcatgcctatgctgaaaagatgaacacacacacacaaaaacataaagtggaaggaacatctctggcttatgtcacatacttagcacatggtttcttttcatctttgcactttcccctgcccatccctgcttcacagaggtgaaggattaattaaggtagataaagtgttctacaggtctcagatgaacgttcttataaaactgcaagaatgcgtaccattactgaccctaattagcctgaagtcaagtgagtattaactagatttaaaggtaaaggaatattggtatatgtttcaaagttcctactacccaaggggaagacatgccccatgaaagaagatttttcatggtgaaattataaaagtattcagagtgaaaaaaaaaggaaagaggcaaacatcaaacatcaagggattatgggtgaccatgaaagcaaactagttaacaagaacaaagtaggtccttcaccaaggtgacagcataactgatttttatataagatttttcaggtcaagtctattaaagaatctgtcagctccatgaactttcattgtggtaccatttctctgcattgaatgctggctgaaattaatggggcatgggttaggggtggaaagcttttaataaaacacagaaatgtttgtggtaaattatggtagctaggagtttgtggttgggggaggggaatgttctagaacatttcttacagcaattgccctagcagtcatacactacctgatttctcatctttggtgagtgcagtcatttaacctttttgtgcctcaatttcctcatttctagaaaggggaaaatgttgaccttataaagttggtgtgaggaaaaatgaattaatagataaaaagcactggtatggaaaataatactaaaggagttactactattattacgattatcattgctgtgattgtactctgcccttggacagagaatctattggagactgaaataggtcttataaaggccccaaagaaggcctaagaacccagggaagaaaaaatggagaaggaaagattcaaagtgaaaggactgtagatctgctatgaagatttgcttggataagttttcacctattccaatggctttttcatgctattctgcctcattttaagccattatcaaaatagtatttggcctatagaagcaaattgtttccaagcatagtcaaggcctgtttggagcccagtattttgaagtaacattggacacaacagcattatttgacccttctctctcagttgtcatgagattatctgaaaaggatattttagataatggaaatgagacaggctggaacctggggcccttgctgcagtgctgcaaagctcacatgtagacacacttctccttgagctacaaaatacaaagaaactgtaggagactaaaaatcactgagtgcatgcacagttggggcaaattctgggccaaaagatacaaaaaaaccaaaaaactcaacaaccatttctgaagagctgggagcaaaaactgggtgtcgggagcaaaatcagggtactgcacataccattacctaaagggagggcaaactgcctaagccacccctccagcctaatgcctggacagacttccacttgctcccaacctggagtggggtgcagaaagcctgttacttgttttcattccctcctgcagctggtgcagaagccccaataaagccttacctaaatttcttgtctggcctctagtcaatttctattgagtggagaagggcaaggactctggttggtatcagaaaggagatgggtagtaataacatttgtcgattatttccaacccttctgctgggcacatgataggattatacgtctggtcccctttggggcattggatgggatcaacgggctagttcctgccaatgagttgtgagaagcagtgaggtgtgtcccttccaggctgaagtacttaatagccaatgcagcacccaccaatcctctccttctctctggcttgaaagccggcagcttttggaggctgtgactattcatcagcctcatttcttcatgactgatcaatgatgagcag

SEQ ID NO: 57891 - DNA, 1667 bp, Bovine  19866880791852
atgattgctaacataaaaatgaatgctttttattacacatgtaaaacaaaggtacagaaattgggtatagattgagaaagtctcagtttaatttccttatagggtattatattgaaatttgtataacttcttggcaaaatgactctgagagaagttgtgatgtgtaggaatacagaaaagtctgggacattttgaaggcttataagagcagcaaaacagaacatatgaaaacagaaaaccagcatgtctggttggtttttctctgtggtaaaagtttcctcaggtaaaacctctgaggaaactaaaaacctttgtgtcagtatggaggttaatgtgcttctttcagaaataaaaggatgattaagtcttccaaaaaatgtataattatataatgttttaaacattaccttgcttgctgaatcatataagactttttctagaacaggtggatgttccatgacttgaaatagttcttttggaaattcatcaatacaagaagaagaatatagctgtaagaatcttttaaggaaaaaatgcatttctttttggcgcaaaatcaatccagagttaaaaagagaagtgagaagagtgtcatctggcaaagacatcccagatcctggcttcagagatgcttaaaggaaaaacaaaaactactatagaatcatgttagataacagaatggtctcaatattgctgtcctttgcttgctaatctcattcctgcacattcccacctcacccagtggctgcccatgaccttcctccatttttcaagcttgtacactaacagaattgcttctggtcacaggaaggaaagaacacctcaaaactctgtgatcctacttctggtttcaagcgtatcaaagcaaaacattcaatctagctgtcttatttgtcttatccccagccaaaaaaaaataataataataaagcaaaaattcaggttcaggtaatttatttgaaaactgatctgaagtgagagaatgggaaatgtgtgacagaaaagaaaagagtcaatgacaacaagttaggaaagggctccagctatggacaaggagagctcagtcctgctgagggcctcctaagaaaaagcatggaaatctgttccatcagggggctggcatgctggaatacctatcaaccagttccctccctcagcagttgtgggttactcctgaatgtgtgcagtccctggtacttccaggctatcctgcctatatgctgggcctcagtcatttctaagaaagcccagggcagaaagaagcaaaatgtgcacgattgacatgggagataccagcaggtgaatccagggggagctgaatccataacaggagggcatcactggggcccactgtgctggattatatccacttccttcgctactgaactggccctatcacgatgcaccttttacccaccacctttcccagtgcttgcctctcccgtcactaactctgataaccaggctgagccgctctgtgacttagcctctttgccctgctgatttccccatcactgggtgctgctttagtcaagctgtctttcccaattgtttgccctcataagcaacactggctcaccaatttcatggggcacagataaatacatcatcacaaaaccacaagaggagagaatgtgacttagattacaacagtttttttggctatt

SEQ ID NO: 57892 - DNA, 1054 bp, Bovine  19866880862895
cttcaatcaaagctttcataaaatttaattttatttaggtaacagaggttttattgggatgtattttattataccattaaccattttataacttcttaagcttgatctgtttccagaattttaaaaattgagatattaaatgaggataataattttcagcagtcccttgtatcactgaaaatggcatatatgttactgatgtatgcattgcaggcaacgagatttcagagtcatctaggaaggcagcctggtgcaggggtccagagagcagtttctggagccaccctaccttgagttcaaatactctatccaccacttccttgctgtgtaatcttggccaaatcacttaattccccctatgccccagttttctcctctgtaaaatagaaatagggtacttacttcataggattatttccagaataaataggttaaatttctaaggttcttagattacaacctggcacatacaaatattagtgctggcagaggttaatagttatctgtgtgtgaacctatctatttacccatctctacccatctcccaaattaaattatttcatgcaatatcattattactttggcagcgtttgaatactctaaagtacttcccctcaaattatgtttattttcaatatttcatgtagttttgttttccatctttgcatcttccttttcttctattttatacaatattcctgtgataaactttgaggattttatgcttatacagtttcttcctttcttggtgcattttaagtaactgcatttgtttattttagaaaacgatataacagattacgtgagccttatcaatgaagtgtgtgtggaggcaaaagctgcaggtgacagggagctacaggctgaattcttgatgcaagctgtaattatcggcctacaagaaaagcatttaaaggcagacatcataaaaagccttcaggtaggaaggcagtctcattcacattgatatttaccaaaggattctggttagaataaaaggagagagtttaaatttccattagttactgcttgttggcagtcaatatggccagct

SEQ ID NO: 57893 - DNA, 1494 bp, Bovine  19866880864783
catcctatttacagaggagatgagtgaggctcagtgaggttaagtaacatgtccagagttgcacagttttaaatattagaatgaggatctgaacctagtttttacaggataccatagactctgctttttcttctacaccattatgtactgcacacacactgagaatctatcacgtgtaaggtgctgtgccaggtctgggaacacagggcataaaagatttcactctgtccagatggaacgtatggtgtagtaggagaaagtgaaagtgaagtcgctcagttgtgtccgactctttacgaccccttggactgtagcccaccaggctcctccatccatgggatttcccaggcaagaatactggagtgggttgccatttccttctccaggggatcttccctaaccagggatcgaacccaggtctcctgcattgcaggagccaccagggaagcccatagtaggagaccagagatctaaataagttataactcagggtgaaaacgccgatgagaacacatgggaggggatcagagctgaagattctaacccacatctgggaaatcagagtgggcttcctgaaggaagtgatgtcaaaactgagactgcaggtcagcaaggaaagacccagggaataataacactgagttccagtttcttgtctgctcaaccaggttgtcagtgggcactccctacccctgagaaacctggttctaagattcatggcctttgagattcacggcctttgatggtcccttcccaagatggcccctgagtcctctgtcctgaggtgttctctgcctctacctcgctcatcctgaaatgctatcatgattttgccccacagctctccagagataagactcagccccttctctattttcctcattacttacttcagtatcgcatgaattggtgaacctgacttaagattttggtggagggaggcaggcatcgtggggagggtccctttcggagcacagggtttccgccctctcctggccccccacttcctccctggagctgcaagcaaaatcctctctttgtcttgctgggagcggcccgcctacctccgtccccaaggatctcggtttttacttctagcaaaggattttctcaacaaacacagctctaccttcctaagaggaattctgatgaataaaacgctcttctctttacacgtgcattgtctcatctgatcctcctagcaaatctccaacagagccatcattgtgcccattttacagatggggaaactgagtagccaggtggtggcactgagagtaaagagtaggactgtctgaatccaaaatctccattctcagctactctatcctgctttccagtaccacttggattggatctgaggaagagaggggttgggagggaggacaaggaagatgattagatatcagaagctgggtccatagaaaaatatgaatttcaccagcgatgctagtctgcagtacttacatctccacaaccttagggcaattattt

SEQ ID NO: 57894 - DNA, 1203 bp, Bovine  19866880899856
atgtgtctttctcccttgccgtggccctgtagaacagaacagccaatgtgaataactttgtaggaaattagagtgtgattggaccttctcagaattcttgttgaaagtatacactccccaaattcaagtaatgcctaagagaatgtgctttctgttgcaggtcgcctatcagactggtaactatgatctggctaagaaagttttctcaccagtctgggattattttgttgcttcaccacctcagggtgaccaatccattatttgtttaagcaatataatgactattacacagagaaggtaattagaaatgttcttttaaaatattattttgcttattgaaaagataggtattagctgtgaagcctggagttaatttattttcaagttcatgttgagatggtatatgtaaaactacttccaacaagtaaagtgtagatattctgaaggtttgggtccttcttagaacttgctttgttagaatcagaaaaaacactggaaacatataggtacattctgaatataagctaatgaggttatgagggaaaaaaccccaaatactaaccaaggtagtgtcagttttactagaagacacaaatacgtattgggaacctttatcacagagaaagatcaggttgagattaaggttagggtctggtgggtgagctcttagggtaagaaggcttttcctttgcttgaagaggcacccaggattaggccatcaactgcaaataggtctatagaagccatagaaagctacaggctatcctttgccattttttctttaagaaaccaaagtttaagggcagcatcagaaatgagcattggtataatttcagcctgtctcaacatattcagtaagaacagtctccttaaaaaaaaaaaaaaaaaaaagaacagtctcctttacctgcttgataatgcctaaaattcccttaataaggcaaaactcttcactcctcaaaggtaacgagtttaaaaatgcaaatgctgaatgaggcaagacattggtaacacttattcatgtaaatgtataattccattcaattaaacaaacataaacttagtgtttaccatgtatgaggatgctcagtgctgtggggggatggattcaagaggcattaaagaagaggaagagatagatcttggcagattttatgtgacttgtggggataagacagaggaaggaggggaagctgactggga

SEQ ID NO: 57895 - DNA, 725 bp, Bovine  19866880917782
cgtgttctgggcaatcgttgcaattttgggggtaggagagagtgactgtattgacaagtgggctttcctttggtggtctcagtatctctctatccctcaaggcccagggaaatgatgtcctggtttgcctaggatggtcacaggttacatttcttatcctggaataattattaatagcacttgcttttactcaaaagtgtcccagtttagacaacagatttcattttcatccttctcatgacagatggaagttagctgagatactgtcccatttctctctttggccccggcacccaccttgggagaatctggcagcctatataccagttaatttagggagcagaattcatggctttaacctggggacaagtggtacagcagccccttgcagaataaaagactgatatagctacttcacatccctgtaattatccaactggctgccttcttctgcccttattacttaacatcttagatttctttttcaggggtcatcagagctgttatctttcaccttaataggattatatgttgtgtgtgtgtgtgtgtatgtgtgtgtgtgtgtgtgtgttttttaatccctggtgggtgttatcatccatgactaacagacccatctgttttaatattcagtattaaacctacaataacaataattatgggcttcccaggtggctcaatgataaagaatctgcctgccaatgcaggagatgtgattttgatcc

SEQ ID NO: 57896 - DNA, 768 bp, Bovine  19866880929942
ttagcagagggtgtggtaggcgcccaacaggaaatgctgagcatcatgttcctacctcatacaaaggagcccagacaccacttcctgttgtttttcacatggctgaccttgcccacagcccttgcagggccttgctgctgtgttgcttgcttccaggtgccttgtttcaatgaccttcagctccttctcaacactttgccatatgtaattgcagcagtcattccatacaggccccagttcttactcagtgttgtattccaactgagttcctgccttatttctagttccattatcaatgcccgggtcttggattgctgcggactcatggatttggtttgataagaccacactgaggctgggttttcagttaatgaaaatgtgaatttttccccataacctctggcttgggcccaaattattccaagttaaatatgatatctttggcacgtgtattaataggctccttggaccaagtgttattttatacaaagtgattttaggccagacatgggaggtattctgtctgttaccaagccaggtctgttttcctgacatgaagcgagccaagtactgagccgctgagatttgcagcagagaaacagtttattcacaaggcaaccaggcgaggaaaaagtctcagatctgcctctggaaagcgagggagttgggatatttatgagatatcaacagtgtgatcttaggctcagggaaaggtgattggaggtagggggaaaggtgagggaggagtggagttctgcacagggcacc

SEQ ID NO: 57897 - DNA, 2095 bp, Bovine  19866880936915
tgtaattgaaaatgaaatttaggaaaataatgaaataaaagtccttttgtgttctacaatgcattggggagtaattctataattatggaaagattgcttcattggattctgggttgcatttaggagcttgagccttcaagagagactaattgatgactaatgatactgtggtggactggcaagtatggccacaatatgtgggatttagtgtatacctgtaggaagaatttaaaaggaattagacacagtctgcaaagagtttagtcaattctgtgatcccaggaattttccaaatcagcattcttagaaggaatgtttagacttcaggctagagaatgagattccaaggcagtacatggtacttcaaatacagaaaacagaaaaggagaagttgaattagaagcaggcttggggcgggggcaggcagagacctaagaggaggagaccaagcatcagagtgctgctaagtcacttcagtcgtgtccgactctgtgcaaccccacagacggcagcccaccaggctcccccatccctgggattctccaggcaagaacactggagtgggttgccatttcctcctccaatgcatgaaagtgaaaagtcaaagtgaagtcgctcagtcgagtccaactcagcgaccccatggactgcagcctaccaggctcctccatccatgggattttccaggcaagagtactggagtggggtgccatcagctttaccaagtacatagataagatttaggtttgaaaagagtagaactaactgagcaggagagaggaagaagggaacattgtcagccgacaactgtgtgaaaggtatagaggtgagaaagtgttgatttgttttagggggctgagggggcttggttagactggagtgggggtcttgagtaggcagtttggagaagatgacatgaggacaccagaggcccaggatgtggaggagaccgtgggtccagtcttgaactctaagctgagacgtaacgtggagggtgagcagtgagagagatgaggaggtgtggagtcagagtagggtgacaattttatcctggtgtcactaggagacaagaagcattgcaggttgcagtgatcatcagtagcatgtcagaaggagatcagaaaggcattgaaagaatctggaacaaagtttttgattaagtgactattttttattggattgttagcactcagcaactctttttgtatgagagtagcttaaaagtcagtgagaactatggagagtctcctgtagtcttgtgctgagagggggaattcatgacacagttttgatcaggagaaggacgagatcagatgtatctggtaggagtgttaggagtagagtgagatgagagtaggatcttactggcatagcatgactggaaactcaactacagcattgccagaatccatgaaaaggggcaattgttgcatcatacagaagaaagaatgacagcccctgtgagtaatttgtctgaccttcccgaactaaacttggggtcagtgagtgggaaaagagaaaagtcacagtcagaaaacaataaacagtgatgctttctgacaaatcaaacagcagtaaatcacactgttaagtctctaccagtgctctaatgtctttcagggaaagctttaaggcctctttatgatcaacttgtctggcttcctaaaagatgtattactctcaaaacatccagcattcctgggaagggtaccaatagttctgtatttgtatgatggaatagttgatttatgggtggttcttttttccacctggcttatgttcacaatgtttctgaaaatacatgtctattattatcaccatggctttttcaagtggtcagattcatttaataaactgaacgagaggtagcctgaacagttacaagtggtccacgtatagcaatctcacattcaagaccagaggagactgacctcacatagatatggggaaatgtttcctctaaggagcagagagttcagtcgactccctaatgcctgctttggtattatatgacaccagggagattagagcccaaagtgttttagggaagagccaaagtgggcaagtcaataggcaagccattttctcttcatta

SEQ ID NO: 57898 - DNA, 1515 bp, Bovine  19866880944030
gagtgaggaaggaagagaagggaaggaagggttggggttgttttaggtggtgaagtttaggattaagaaatgacttgagttggtgggattgtgaatgactgcagtggaaagaggtgaaaagtgagatttgatcatctgggagggagccttgcagggtggcagaggcatgcactccatcaagcagctcttccaaataaggggcagaaacatctccattgatcctgtgatcctgttgaggtcagaggttcagcctttctcaggagctcctagaaatgccaatgctgctggtctgtgggccacacctgagtacccaggattcagacagggagattttctttcttttttaaaaacattaatgtatttattttaattggaggctgattacagtattgtactgggttttgccatacatcgacatgattcagtagcaggtgcaaatgtgttccccatccagaacccccttcccgcctccctccccatcccagcccccagggtcatcccagtgcaccagccctgagcaccccagagagggagattttttaggcaggaagttgggtggggaactttgtgttaattttttttttttgaaaacttgatttttatttttcaaaaaataccatctaattgtttattctttagatttcagtaggctttatatatttcattctcattaaataatcctctgacccaccaaaaaatctctccagaaaattttgatgtaaaatctctaatctttgagacaacataaacatgatttaaattctgtagacaaataggctttcagtcagttggaacaacttaaatggttgctgccttaggtgggtaacagctattttttttttcatcaaaataattacatagaaaacttacttttgtgatatgatacacatctttacatccaataagagaaaacagaaatctttgtttccatggcagtttgcaatgcaaattaataagatgctaggatagaaaatatatcaccttttgggccttctctagggagctgtttataattaggagcttaaacaaataagatttgaatgaaagaatagtataactccagtgactgaacagcaacaacaaacacaatatgagcattattttctgtatatcttgacatggcataaatattttagcaagacatacaattattagacacacagaaaacagtcaaaaacaacaaaaattcatctaggcatattcagaccattgaaatgaaaatttaaaatatgtcctagtaaagacaattgctatataaatgctgaaaagaaaacattattgtttcacttacatggagagtctggagtatagtgaccgtcaccctggtttgggttggaatcctatcttcatgacacagcagtgggagcaaagcctttctaacccaagtttcctcatctgtgaaatgaaggtgaggatgcttaccccttagagtagctaggaaaattaagtaaaataaaagactcggcacataataaatacccaaaagaaaacccaaaaagaggtgaggggactatc

SEQ ID NO: 57899 - DNA, 862 bp, Bovine  19866880947671
atgaatactgtgaggtcaagatggcttcaaaactaccctcagtattaaagatgatgggtaagatccacagactcttgcagccagacttcatgggctgtggtactttactgagttatccaggtactaactctcagtgctgaacacctgaagccatcacctcattcagagataagatcagaccctgggagaactgatttcatactccccagactcagacaagtcagatttgtcccagaaagcttctttatgaatatgtagtagcaagaagacctccatctgctctccagaacaccttttccctacattaatggtatatgtgtattaatatactacctagattttttttcttagtaagttaagttagttatcaaaatttgatttgatacccaaaaagatgatttgggtatatggattcagagaaagaagggcttgtgatccataggctgatatttcctgtctatgttagtgctaagtcacttgagtcgtgttctactctttgtgaccccttggactgtagccaggggacaagaatactagactgggttgcaatgctctcctccagggatcttctcgacctagggatagaactgcatctcttatgtctcctgcattggcaggcaggttctttaccagtagcatcacctgtgatagggtctcatgaattccctttggttccatgtgtctgtcagaaatgatcgacagcaagcaactaaaactgaccctggttacacagagcaagaaagaagggttatttggaggatcgtgggcagctcatggaggttttccctgaccatcctatctgtagtgacctcttctgttgatctctaatacaccaacaccctatctctttcataggacttgt

SEQ ID NO: 57900 - DNA, 1057 bp, Bovine  19866880953255
ttaaggtagtaaaaatgcacttgtgtgtaagatatctcctaacaggacaggaagaaaaaggcctggtaatttactgaagacataatgaagaatgtcggaacacatgggccaaatggggttaaaaaaaaaaaaatttctgaagaaggaaagaaaatgcagatttaacatatcccaaaatgagtcaatcatctgctgccctgtctaatcaatgattctggactcagagcaccagaaaataaatctgattactttgtcttctttccccccaaagtgaatttattataaggatatccagaaacaatggcatgaaggcagctggcctctgggagggaatagaatctggaccagaaaactctcattaacgtaggcaatactctgtctccaggttctgcctttgcttttcaaagacgtcttgcttttctctctcgagacaactttctctgtttttccaagctcttggaagacttgaccactcttacaagcagttttactatgcgcagcagaatctcagtttcagattcccaggagaaatccctggcctcactatcaagttttactgattcttcactcctggctttgcctttcagttttttcaactacagccttgactcaacaccattcggattgatccttgtggtttaacagaatcatgggtaaggagttagagattgactaattttggaagtagaaccagggtatcaaagggcctgaaaattcagggaaaactgtttattcttgaaatatggacatacaaaatggaattccaggtaagatgattgagtactcatcagtgagcctttggagtaaaaatacattacttcagtagacctatgatgtaatttggagtgcagagttttaggaactctaagatcatggcatctgctcccatcacttcataggaaatagatggggaaacagtggaaacagtgtcagactttatttttatgggctccaaaatcactgcagatggtgactgcagccatgaaactaaaagacgcctactccttggaaggaaagttatgaccaacctagatagcataatcaaatgcagagacat

SEQ ID NO: 57901 - DNA, 961 bp, Bovine  19866880982411
actggcctccccacaaggcattgtaccttgggattcctaagggcagggactatttataatttacctttttagacccacagaacctagtacaaaacctgaaggagcataatactagatagatgttatttgaaccaaaaaaaaaaaatgaacaaccagaattccctcattgacaaagctcataatactgcatggtgtttttttctaaaaagaggttctgctgctgctgctgctaagttgcttcagtcgtgtccgactctgtgcgaccccatagacagaagcccaccaggctcccccgtccctgggattctccaggcaagaacactggagtgggttgccatttccttctccaatgcatgaaagtgaaaaatgaaagtgaagtcgctcagtcgtgtccaactcttagcgaccccatggactgcagcctaccaggctcttccatccatgggattctccaggaaagagtactggagtggggtgccattgccttctccaaggagagttctagcagtcattatttcaatgtttgcaaattgtgatgctcactaacacctgtgttgccccactccatttccaactattctttaaattgacttgatactgcatttttttgacaattcagtgacagccacaaattacttcactgttaccgtggtaactaagggacctccaaagagagaaaaaaataagattaaaataaaagggggaaggaataatctaaattggcattattgaaacgttgtccaagtgtagacgggtatcagttggtcaagctttggggagtttttcccagtaaggaccccctgaatcagtcagccagcagggggaggttgctcctttgaacaagaatgcttgtttcctgcaagaagcaatggttcaaagttatggaaccttctactctcccttacttatgcatctcttttatttggatcatctcctttgtttttcatctcctcctgctttt

SEQ ID NO: 57902 - DNA, 1211 bp, Bovine  19866881019678
aggagttaaaggatcttttacatcaaagttaaacctgtgattttttatgaactttggtgtgcctaattaagcgattagtaacaagcaggagtttccaaatgtcaagtgtataattatgaaataaacaagagctggtttttccaataaacttctgtactgtgctctattacctcttgctggggaccaaacaatgtcttctggtgaagagtacgaaattaggatggatttccattgccgaaggcgagaaatcttatctgctgaaacataaccacaagatacttaggataagagtaagttttaacctagtaaatctatggatggatattaattccacctctcaaaccatatattataaagaaattccattttattcctttttgcatttttattttgcatgctttggactctcttgctcttaagctttaccaccagtatttctctctcatttcaaaattcaaaatagttattttttttaactgaaaggtgaattaaatttggtgtggatgaggagctgggagttacatgataagttaaacatattactgtttaactgagtagaaagtcctctgtgttatttcagatgaaggatataatttttaaagcccatccccaacatttactcttggtgtttctgtacagatagtcagtgtttgactgattcccataggttttagccaaccaaatattaaggtctattgttatatgctagggagagtggcagagacaaagaaaatacaagtttttatgtctgtgtttgggaagtttaaaagataattgaagaggcagagtatatgttaagtagaatgagtaatacttatcatgaaatatttttgtcatttgttataaaagtaatacatacattaattaaaaatataatgcacatatggcttatttttctctcagagaggtaggtagatcggtcaatctagttcttttaaccacccacttttattcattcatttctttcatactaggcatttataatgtgttccagcttagttgcagtcaatagagaagcctgaataacagggttcaactaaaggagaaattcatttctctctcatgagaaagaaggccagagaggcagcatagggatcctccctcgtgctggtagatacccaggttcttgccagcttactgcccaggcatgtctttgctttctggctcaatatagctgctggaacataagaagcacagctgaactccagtcg

SEQ ID NO: 57903 - DNA, 771 bp, Bovine  19866881036580
attttaatgacaatatgctcaactctgtcatggggctagttaagtctgagtgaacacagttaaggaaaaccatcttcatgtcttaaaaaggaaatttactttcatgagaaaactaatgttttggctgtgtttcattacgacttgcttataatccatttttaacaactctgaatcaaagtaattcagattgggcctaatgacaattggcccaatgccatcattggatggcattttccagcttaagtccaataagactaatgacccacatagaagtgctactgatttcttaagagtcatagcaacatgctcagtgttaaaagaaataaattaaaacaggtaaataagacatacgcctcccttcaaggatttctgatctaattacaataagaccagaattttaggcttaaaaagcaatagtcccttcctcaactcctaattcactccagtctccaaacctggataaaaataaaagggatggaaggacacactctagaatttctcttactttcaggtaaagcatgtattctcggtcccagacttcgaaagtacacatgtttcatggcctcttctgctgaaacccttttcttagattcatactgtgaaaaaccaaaaaagcagcttcattaatttttttctctaaataatggaaaaagcatgtgtgaggggtaggggacacacacacaaattagcatttaaatgtttagagctaccgttagcttgattacttaataaaaattacttatttttaagaaccaatttactatgctctaa

SEQ ID NO: 57904 - DNA, 1033 bp, Bovine  19866881148357
ctccttcgagtctcccaactaacttcactgccagcattcctcattccatccagcctccccagcatcagaggaatagtcgtcataatcaccattgcatcagatgaaagtgaaagttaagtcgctcagtcgtgtctgactctttgcgaccccatggactgtagcctatcaggctcctccgtccatgggattttccaggcaagagtgctggagtggactgcgatttccttctccatgggatcttcccaacccaggaatcaaacccgtgtctcctgcattgcgggcagacgctttaccgtctgagccaccagatgactcgtcgttaaaaatgtgaaatcctttgctcctatctagaatcacatctaacatttctagcttgacattcaaagacttgtcacatcgggtcccagcagtctttcttgtgttctctccattaacctctttcccaaacccacagtttcctcctcttgcaacaccggccacgctctgtcatgttccgctctgtctgacttgaatttgtacctccctgctgattctgttctgctcagatcaatccccagttcccccaaatccttcctgattaccccggttggaagggaatccttcttcccttttttcacaaatgacacctaaaattccttttactgctaaattttgcatgtgtgaccgttcctagtagcttataaactttttgaggacatgggatatttctttcttacatacttttatattcaacactgtattaaacatagcaggcattcaatcaacaaatgtttttaagtaaacaaatgaattttaacaaatcatttttttctgttagtttctacattaatacttttccaatgctatgcctttatgcccattttaatttctaatattttgagctagtacttacattctggagcatctgtgctaaaaattcattcacttgatgggaagagaagtcttttaggtctgctgagctgaatgaatttaaatcatcatctttggcctgaaataaatgttgcctgattatttacattcatgtagaactcaa

SEQ ID NO: 57905 - DNA, 2475 bp, Bovine  19866881179286
ctaaaaatctgtgatgtggaatcttttatactaaatctgagaccacaccccaaatattatgtgaacaactggtaactgtagctagttttattttgaagtatgaagttttgaataccaggaatcctgagacctttgaaagccacgtggatataaagggggaaaaatttgtacatgatttaatcccacgccccgcaaaacacaactatatgaatgcaaaaatccacaataggatttctttacagcagataatgtgaaactcaagaattttggtaattgttaactccgttttagttcacagtgtggcaaaattagcaaacaacgacagaaacaattaaagcagcaataaagcaaccccaggttgacttaatagagacatagggaccagaaccagagagtgagagtttcattttactgtgctctagtcatatactgtacagggacattggccacctcaaataataccatggtaagagagggaagctctgtcctgggaggatagaagtgcttggggatcttagtcctggagagtgctgggggagcggcagcctgcatagatgctttcagattcttggaaggctgtataattctcaagttgagtcttgagtggtcttgtgctgttctagaaggcataactagaatgaatgcactggaggtgtatcaaagtgattgcatttcaggttaaagaagatcatgtttagaagtgtcttcttatgccacgtggcacattccttgttgattgtgggcagagaaggtgagggacatcaggtggtggtgctggtgatgttgagggaatgaaattagattctcagccccttgatgctatgattactagaaatatgtagcatcaggaactgaaacttttcaatgaaggtctgttgtcgatcaatcaacagaaatttgttgctaataacaattgcattgttgcaattagctccttgggcttcccttgtggctcagctggtaaagaatcctcctacaatgcaggagaccctggtttgattcctgggtcaggaagatcccctggagaagggataggctatccactccagtacttttgggcttgccttgtgtagctcagctggtaaagaatctgcttgtagtgtgggagacctgggttcaatccctgtgttgggaagatcccctggagaagggaaaggctacctactccagtattttggcctggagaatttcatggactgtatagtccatggggtcacaaagagtcaaacacgactgagtcactttcactttcatgcctttcataattagctcctcgactagtgttgacatttggtaagtgttaagaagaataagctgagttcataggactctaggagctaggcaggaagacatcgtaaaatggctaacttgagattttgagttcttgaaattcttctttaacttttaaatgcttattttttagttgactcattatttgtgtatttttagcgtcagtgacttgtgctcaccattcttcgtttgattatattgaataaaaattggcattattcccttaaaatgaaaagacactcaatcgtgccctttctgatttaggccttggaatacctcctgtgggccagtatatgtatggagtcttcagtgcctctcctgtccatcaggtacttgacgtggagagctactctttacacagctgtctgccagtgctactatgactgccaagctggtgttcatggagaggtaggctactttttgggcttcccaggtggcactagtggtaaagaacctgcctgacaatgcagaagatgtaagagatgtggcttcaatccctgggttgggaaaatcccctggaggaggatgtggcaactcactccagtatcctagcctggagaatcccatggacagaagagcctgttgggctatagtccatagggttgcaaagagtcaaacacactgaagtgacttagcgtgcatgcgtgcaggccactttttaattatgaggatgctaatacttaaaaatacaacatatttagcattttcttcattagataagtggcaagaaaacaagcaaaccaacaaaagccaaagaattgggatgaagcagggatacaagtcccaggctttatttgcagacatttgcctggcttctccattctgtgaatctcttgcttttactttctgcttccccgtttattctctgttcacttccaccatctttgcttcttttctgaataagatctctgatatcttcccttccgctttatattcttgtatgcaagccactttccttccctgtttagtttttgtgttccaagctgtctactatctgttttgtttttctctgcttccagccaccatttatttagtatactctatttcttatttttcctcttttcctgtatatatttttgatgaaatatttgaaatgtagcttaactggttggagcttctattgacctctgccacatctctgtgcaaatgaaatccggtaccctcactatagtatgtagtactctg

SEQ ID NO: 57906 - DNA, 970 bp, Bovine  19866881231882
tatgaaattgtaggtactctggtccttcttcttgatggaattgatcattatgacagatggatgtggaagcaaagaaacgctctacctgttaggtgaatggatatgtctagatggtgttaaaagagacttttctttctccctcctgtcttcctagtgtttactttcaaggtttgccacaagatcaaaatgtcaagaccttaaccgcattgtccaagctgtgtttctcagaaaactggcgtcccattagactttaataattaaccaaaagaaagtgggttttgtgttgaaataagtataagaatttgaacaggtttcttcagagccttcagaaagctaatgttcctggtgactctcccagacaggcatgtaacatgccatggctctcaaatttacttcactaaagagccttttttgacagggttcttaacaacttctcattgggtgctactgttgctcaggaatcattgtttaaccttgcttcatgctccaactgaaatgtgagggtggggcatacattaaaaggggaaattagatttttttatccacagatctacttttgctacttgaaaagaactgaaaaaatgtgagacatttttacttttaaaagaacgtatctaagaacaatgctgcaattgtaatgacttcttaatgacttgatttatgagtcagggaaacagctgtttcttttttccctctctctcccaggctatccactgtagagctattcttccttgccaggacactccttccgtgaaattaacctacagcgcagaggtaactattactgaaattattagctgaattgttctgtatgagtatttttatagggactacattaaatctatagattgctttgggtagtttgggatgttttagcaatattaattcttccaatccatgaacacagattgtgtttccaaaatgaatcaaataagtcaataatgataagcagagataataatgttttttt

SEQ ID NO: 57907 - DNA, 1538 bp, Bovine  19866881289918
ggccaaatcgagaggtggtcctcatttggaaaactgatggagttgttctgccagaggagacctaggtcgttctgccagagtggacctaggggagctgtggaggacttcacgtaggtagtgatactcagtatggaagtgactacagtcttctttctcaccagccaaaacccctcacacagcccctgttggccacaagtatgtttggccaattgcactaagggaggagagtgggacatacatatgcctgtgggttcttctgccctttctcccttctgtctttttccctctcccactgtcttccctttggccattcagagtctcagtgttccttaaatcccagctctatatatcttcgcagtgccctgtgactgttgtggatagctgtaaactctcttctatgagcttctgtgtaaggattgaaaatgaaagtggaggggaagaatatgaacactttctgacagaagagatgtagaatctcagaacctggaagggattttggaaatcatttggtcagtccttttctattacagatgggaaaaataaatcccagagtatttaagccagctgctggcaacccttgaaccagaacccaggtctctagcccagggtattctaaataatccaatgactgctgttctctttcctcatttctttttataaacatttgagagggcttctcttttcttttaaatgaattcaaatactaaatgaaaatattatttggacacagtaacttttcattgctacttagtgtccgtggtatattgactggtgagcccagacatacagttcatacatccttttaaattgtaccccttactgactcatggtgtctaactggtcaagggtggtaacctgccaaattgtagataatccattggatgagctgctgagtagcctgcatctggtatcattaagtagttatgctatagtgttcgttagagagcaggggtcatattttgcagaatgttctgctttatgcttatgaaatcattttattatgtttctacaaaagaaaatgatttcaatatgcattaaatctattttataaaaaatttctgagtttgtaggtcaattgttaatttgcagtaaatcattttgactcaaaggattgtttgtaggactattaattcagacttctgataattgaccatttagtgattcattcaataaatattttaaagtaacttctctgtgaacaaaatatgtagaggttacattctagtggagaaattacagaataaataagtaaattaaagcctgtgataagaattaagaaggaaataatggtggtgactaaatgagttacatgtaacacccctagaatgttcctggcaaatggtagagccttagtagtattagctgttactgttatttatttttcattcattcatttagtaaccatgtgtcaaaggcctactgtggtccaagagtggtggcacatattaatagaaaagatgggagtcactttttctgtcttttttgaatgacttgaaataagaagcaggattgacggacagggagaacaggaaaaacat

SEQ ID NO: 57908 - DNA, 879 bp, Bovine  19866881293359
cattaattccagttgccgtaactcatcaattttagctaaagcacgccgaagcaaatgcctacatgcaattaaaataaatttaattcataagacgttagagtacagtgattaaaaatgtatcaagagagtatgttttactctcccagacatttgatttaatttgtgaattaaactaggctgatgctgactttttcagaacatagtggctgacccatcaatcatttcctagaagcaccactaatttctgtaaatctaaagtcaatgaaatgttggctatactaactttagaatgcagaaaagtaaagaaattcaaaaaagtaaggaaattcaaattctgggttacagagtagcttcttatagatgatcacttctccggtattgcacatgcatgcacacacacacacacacacacccctcctcggtgctcttctcaaattctaacttttccaccaaaaccagctgtattatctattcaactgtacacattgtcaactaaattgttaggtccttaaagggccttgtttttatatttccagtacccaacatatagaaagtgtttattaatatctgaggaaaggaagaaggtgggcttgcttatttaatcagatcaccattattataattctctattgctatgatagagataatagcaaaatgagtttcattcctgtcatttattttagcagttctttcaagtattttatttataatttatgatttttcatgaagatgtttctagaacataatagtaacataaagggttacacttttcaataagaaaaaaattgcaataggaatcaaatggttaaaactatgcaaacatgtctatccctgataaatttaacagctacagcaatatgccaccactagtacactaag

SEQ ID NO: 57909 - DNA, 982 bp, Bovine  19866881328139
tcctcgcagaaaaaaggggagtgtgaacagccccaaagcacagcttttgcagaaagagctcttactgccatctaaccaaacagatgtcccttgaatgtgctttcaaggtgaagtcaggaggcctggccctacttccaagccttcccctgccatccagaacctgcatgcacctctgttttcttcatcttggtaatcccactgcccaggctccctcatagatggggcaggaatcaaatgtgaccgcacatgggaaagtgctttgggaattacaaagtcttaggcaaatgtaacccaaccccgctgacagtggggaaaggtgataaaggagactgaaacagtccctgcacaactgaacaggccaaaagggtctggatgtgtggatggtgagagcagacgataccaaggggaagtgaaactctgagggcagggtgtgtgtaggggttgggggagaagaaacagctttttaaagatgcacaaggaaaccgccatctcaactaatgaagtaaacccagatttgtcaaggtccacgccagcaggggattctccactggggtttccttctttaccacctcagtgaaacagtgtgggttttacttaaagaagactgcagcattcttataagatgagatctgcaacgtgttcaaagggagaggatgaccccagtaattacaaatcaccaaccatcgagagaagaggctgtattagatgatggaagaacagagccattatatcctgcctgatctgggttcaaatacatcccttggtaggtgagtggtacttcattcttaattcagttcagttcagtcagtcatgactgactctttgcaaccccgtggactgccgcaacccagactttcctgtccaccaccaactcctggagcttgctcaaactcatgtccactgagtcagtgatgccatccaaccatctcatcctctgtcgtccccttctcctcctgccttcgatttttcccagcatcagggt

SEQ ID NO: 57910 - DNA, 985 bp, Bovine  19866881364123
atgaaactggaagttgataagaaaaggtgcctccacttcctctccatcctcaacaccttcaaaactgacaccgagtggtcaaaaggcttctgtggtcttactcagaaggcagtaaatttgaacctttcccaggcttttcttcagcttcttgccctttaacattacaaaactaggattatgtgaaggtacaaaagctctgaggaaaggatgaaacaagaccatgtccaaattaggaagacattcttctatttgcagggattgggggcaggatttttttacctggaggataagaatgttctttacaatgtttgttggtttctgctgtacaacaaggtgaatcagcttttatacatacatccccaccctcttgagcctccctccaacccagcccccatcccatccctctaggtcatcacagatacggggcaggatttaatattgagtggtgaaagtgttagttgtaggcctgtttgcaaccccattgactgtagcccactaggctcctctgtccatgggattttccaagtaaagagtactggagtgggtagccatttccttttccaagggatcttcctgactcagggatcaaacttgggtctcctgcattgcaggcagattctactccatctgagccaccagggaagaataatgatcaagcattaaggacacagaggtataacataaacactgtagaaatagtctgagacacagaagatattctgagacttacagtttgtgcttcctttatgttaactcttatctttggtctaaagaaacttttgttttttcttctagattcaaatactcctcttttgaagatcatgactgccatctgcctcaaaaagaagaattacttatgaagcatcaatgggatacacttctcaactactgatattaagtacttcatcatctgtagagtacagtggatttatctcatgaaatttttatacctttattggggcctctctataatattctctggatt

SEQ ID NO: 57911 - DNA, 1617 bp, Bovine  19866881407804
gtatattctgacacattctatttgaaaatattcagaattcctttaaaaatgtctttctctaccatattactgcacatagcatagttaacaggcagtctataaatactgtaggaatcccatttgagcctatcagaatctgtccacattttaatgataaaagaattcacagtggcagctagctgccacactctcaagtcctctgttaactgccccacggaaacgtgcctttccctagctgatagaaaataaactcggcacttaaagagtcacaaaactcatcatgtcttctacgtttttacagatcctagaacctaggctaaagtagtcaccaccaccattactcataggtacggttttacacctaacaataaaagctagtcaaagtctagatagaaagagtaatttcccaattacctaaagtcatccagagtttcctgtatcatgttctgaataaaacggatctgaacagatgacaacggtgcatttggccgactatttccaatggtatcaacgattttttctgatagtgaaccagcaactccagcagtgacagaggatgctatctttggatctgaaataaaaatttgagaaaatattaatagtcagcttggactaagagacatcaaatatgattcagcatgagaaagcctgaaaaactggcaacaccccctccccaccaaaaaaaaaaaaaccagtgctcccatgacatttagaaaaattcactgtctggaacacaagtcttagaaactttctatgatgtcatttctataagtcattcatatatatatataaattgccactgtctaatgtactaacatctgacagaggaattaagtcttaaaggatcgctgaaccattatctcttacaaaaaatgaatgtgacgagctgctggataaaccaagactattagaaacaaacagaagggacataggagtaaagtagttctcaggcaaagccctagagtttaagctaatgcaatatatccacagaaacctcaaaatacaggtatttatataaaagagctccttctatacaaagagttcttttgtatagataactcctatcgctaaacctaatattgctttaaatgtgaccaagtttttagggtctctaccatgaactctatatagacactttaatatggaaaaagaaaaagacattttcaggtagttaatgaccctatattacattcctatctgtaccacagtagacaagacacttacatattggattgaaaatgaaattcatacccaaagaataccaaattaatgtggttgaatttaacctttcgttttattgtcttctagtaagagagtccagagaaggcaatggcaccccactccagtacttttgcctagaaaatcccatggacggaggagcctggtaggctgcatgcagtcagtccatggggtcgctagagtcggacacgactgagcgacttcactttcacttttcatcttcacgcattggagaaggaaatggcaacctactccagtgttcttgcctggagaatcccagggacagggggagcctggtgagctaccatatatggggttgcacagagtcagacacgactgaagtgacttagcagtagcagtaagagagtcacgcactag

SEQ ID NO: 57912 - DNA, 1617 bp, Bovine  19866881422328
aggcagcaaaggatgagatggttatatagcatcactgactcaatggacataaatttgagcaaactacaggagacagtggaagacaggagagtctggcataatacagtccgtgaggtcttaaagaattggacatggcttggtgaccgaacaacaacaatgaagcctgcgtaaaaacccaaaaggatggtgtttgggaagtttccaagatgatgaacacatggaggtgctgggagtggggtgcccacaggggccatggaagcactacgccctttccccatgccttgttctatgtatctcttccctctagttcctgagttacattatgtccgtttataataaacctgtaatctaataactaaaacgttttcacaagtgccatgagccactacagcaaattattgaacccaaggatgggtggtaggaacctctgaggtaacaactggagcttgcaactggcatctgaagtgagtatgggatgtggtggaatggggagtggtcttgtaagactgaacccttaacctgtggaatctgactccatctcctcgtagagtcagaatcgagttgagctgtaggacaatcagctagtgttccaagaattatttcttggtatcaggatccctacccctcccctccatattaagcactaactcacattgcccagtattctcattcatgcacttgtgtcacaggcaaactaaatgtgccttcaaacatgcttcagcatttctgcttattaaaccacatgttgttttcaagacctagaacaatcattaagtttggaataacacagcctcggattcagatgaattagggttcaaacaccaactgtgtctattgcttaaaacaactaggttttttactctccaaaaagcctcagtttcttatctgtaaaagaggcataatcgtacccatctcttaggactgcaatgaggctgcaagataacagttcatataaagcatttagaagactacctagcacatgataactgctcaaccagtgactcatcggtagcaattaacataataatgctggtatactagaaaaaagcatatttttttttcatatcaaaagatctatgtttcctctccagagtcactagttattatactgtgtgattagctttctttttctctcttatacaatagggataataacagtatctaactcatagagttattgtaaggagccaatgttttccaaagtactttgaagaataaaagcattctaccaatattagttataataataataaaactgcctactggatgaataagcgattatagtgacgaaatctccaaagcatctttacaaaagttaataagtgcactttctcatccagcacagaaaatatttattaagcaacttatagtacacaggtaaataccacgctaggcaaatgaaagacactgagaagctgtcagctaaaggacagactgttgcatagctaatataaacggtagctattttagctaccactttcatcttactgtatgtgctgcagttttgtctccaaagccttttgggaaaaagacagttttgaattgattcacgtctgctttattctcatcaaagctgatgctgaactccgaagatatctgccatagcacgtaaaaggg

SEQ ID NO: 57913 - DNA, 1211 bp, Bovine  19866881512784
ctttttgtgatggaggccttagaggattgctttcctactttaaaaagagctccctgtgtccttgttctctggtttggttcacctcagagacatgaaaattattttactggctcttaggagcacttggatgtgggtttttatttgcagacccctgccatttttatcttccaatgagaatatgtttctgtatgttagaaattggtttcatcattttcttggggaaatagaaaaaaatagtaaattatagcttgtagaaataatagatacttttaattaaccttaagtatcagcttacaagtcaataacacaaatattgtgcttatacagatgattttgtagttctttagactttatctttgtgctaataacgaaggttattttacagcactataattatttgtcaaattatttgtctaattattactatacagttaagttttgagaatagggtaattttagcaggtatagtggggaaggaaatggcaacccactccagtgttcttgcctggagaatcccacggatgggggagcctggtgggctgccgactgtggggtagcacagagtcggacacgactgaagccacttagcagcagcagcagcaggtatagtatatttcagcatttttttttttttattaaagcttgcaatgaatttttggtacataattgtccctaagcgggagctattttatctcataatatacttactcttcagaaatgattctttcctttcctcattctttctttctatttgaacccttcaatttttttttatagttgtaggcattaaaaattatttgcagaaattaaaattaaatttttttgaaataagtaatgtgattatggggcttcccaggtggtgcttgtggtaaaaaacctgcttgccaatgcaggttagacgtaacagatgtggtttctatccctgcgttgggaagatcccctggaggggagggcaccacaataccaccactctagtattcttgcctggagtatccccatggacagaggagcccggcaggctgcagttgtagggtggtacagagtcagaaacaactgaagcgtcttacttagcatgcacccaatgtgattataaacctagaagtatgtatagagacacacaaaagttttgtttcctcttttgctttcttcttgtttttcctcacacgccttttataggcaaacatttcttttagtatcctgcttatttttca

SEQ ID NO: 57914 - DNA, 1309 bp, Bovine  19866880419016
tttacagtctctttcttctgtcctcttgtggtcagctggtaagtagaagtgaggtttgcagaatctcagcttcagcatcacaaagcaagtagagaaaggtgtttggagctgagagacaattacttagtaagtgacacaatcatctgcagaacattcttcttaaataactgaaaattgactcatgattacaatcacactgtggttaacaatgtaactacttataaaggttggtagcttagtaggaaaccatataactcaacataacttcacagttttaacagtagagagagaaataatgcaaactccaacccatgtttattatgtgatagaagaagatgaactacgcatctgcatatctctttctgatgcttgtttgaagaacactgatgcactctatgacttccaagagtaaaaattgtaacataaatctgacacttgccaaccatgaaaaggaaaaactgagaagttcctgttttttaaaccagaccaaataaagctaatttcaaatgatgtttgttgaaaatacactcactcccatccctctcctaaaacacaacataaactaaataacaactagaatttcttgcttctgcctatgtcaaaaaaatcaaaacctggttttgattagtgtgtgaaaatatatgttgttatatcctgttggtgagactttctttcacacttctgtgcaggggtgccatttggctgttatgcatgacaatcctctaaagcaatcatctgcagcttttttggcagcaaggacagttttggagaagacagtttttccatggacaggggtggggttgtttggggatgattcaagcacattacatttattgtgcacttgatttctattattatttgatcagctccacctcagatcatcaggcagtagattccagaggttggggactccctgctataagtgaagaagtgaagtggctcagccctatctgactctttgcgatcccatggactgtagcctaccaggctccttcatccgtgaaattttccaggcaagaatagtggagtagttttccatttccttctccagggaatcttcccaacccagggatcaaacccaggtctcccacattgcaggcagatgcgttactgtctgagccaccagggaagcctaaaatctgctttattcttttcaacagaaaactcatttctaaaactttactccaaggagataatcacatgggtataaaatagagtcatccaaagatttctcttattaatgtcatttaaagaaaaatagaactgatgataaacttaaacattcatccatgaagaatgttgctgttca

SEQ ID NO: 57915 - DNA, 1213 bp, Bovine  19866880485783
actagaactcagttcctcctccaagctcttcctctgaccttttctcacccaagcatttgagaattgttagacagaggaggctggtgggctacagtccacggggtcgcaaagagtcagacatgactgagcagctaacagaaagcacagggactctttccagatgactcagcagtaaagaatccacctgtcaatgcaggagatgcaggatcgatgcctgggttgggacgattccctggagaaggaaatggcaatccactccagtattcttccctggagaatcccatggacagaggagcctggcgggccacagtccatggggtcacaaagagttgaacatggctgagcaactaaacaagggactctgccagcagagacagagtatgtctctttaatgtacaaaatggtgcctgcagcctgaaagaatcatttatttgtgttcactcgtaaacagaatagagctgtggtggcaggggattgagctcattgctatgcgtgcatagactgtgaggaataatggtttactagtgtgggaaaaacacaaaacaagcactctccaacctccctaaatcttatttcttcatcgctcaggtggggataatgaatcctgcttgcttatttcccagcgtggctgtgaaattttaagaagagccagtggagtgtacagtatattcttatttaacaacagtcaagcacttattttagaacttcctctagacctagtaataattaaaatattaaagaaccaaaactgcttgagtttcaaccactctggatggaatccagctgtaaattctgatctagctgtaccatcagcctctcctgggtgaacactagacttaccttcagggtaaagaccacttcccaaatcctccacacatgtagtttcatggatataacattgactagaatgtgtttatcttatttatttttttaattggagaaaaattgctctacaatgttggttgttttctgccatgctgctgctgctaagtctcttcagtcgtgttcgactctttgcgaccccatagacagcaggccaccaggttcccccgtccctgggattctccaggcaagaacactggagtgggttgccatttccttctccagtgcatgaaagtgaaaagtgaaagtgaagtcgctttctcgacctcatggactgcagcctatcaggcttctccgtccatgggatttgccaggcaagagtgctggagtg

SEQ ID NO: 57916 - DNA, 1116 bp, Bovine  19866880578489
ttttggaaggttgtgttttattttattctctcaaaatattttttactttttcttgtggttttcttcacccactgattactcaagaacatgttttcaacagagcctgtgaggacaatgctgttggctccacgtcaactcttgggataaaaaaggataagttccatcaggagggtttccaggaaattgccagacaggtcaaataatgacagtcctctgagagcgaggtttttgggagctcagaacctgtcttcttgctccagtgactgcgtggatgctggttttcactttgattgacgagctggtggttttcagagaggtggagtgggagtgagaggaagaggtcaagtttaaaaggcacaacatttgctgcttattatttatttatttatttggctgcggctgtgtcgggtcttagttgcaacacataggagcttcgttaggtcatgcagaatcttcccttgcgaagcatggacgctccagttgtggcacgtgggcttagctgctgcacagcatgtgggatcttagttccctgaccagggaccaaccaaacccaagtctcctgccttgcaaggtggattcttaaccactggaccactagggaagtccccattcgctgttcttattaagagtcaggatttttttttttcttgaataaacactcctcagattaccacgagcctttgattgattttcagagttctgaagaaattgattttgacagtttttgccagtgttcttgcttttatggcgaatggattttccgaagctcttactttataagaactttacaagtgcctcttgcactttcagttgttcttttaacgaggcctgattttgtattttcatgcattgataattggggaaataatggttttgcattttgcagttcttccaatcattgctgtattttattataaaacatccctccgaattgcattagttaatatcaccactgatgtcatcagaaaatctttaggtttggggaagctaacaagcttactgtagcaggtataagttttttaaaaattattgttttctcttgagagttcattttttattattgataactaataccatccattgttttccttgaggtgacaggttcacctcattaat

SEQ ID NO: 57917 - DNA, 1568 bp, Bovine  19866880668582
tgggagcttcagtacttgccaaaaaaattaactaaaaacatttttattaagagataatatatgctatggcacagaactcatatttaaaaagtacattaaaaaaaatctgttttctgcatcttttgctcctcagctatcatttctcctctctcaagggagccaaccatggttctttccaatgttcctcttgtatttcaaagtgttctatgtatttaccatcatacacacacatttgcaaagattcttaaaaataacttgtgtggagattttgtgtccctgcttgacctgttaattaacattctatctgctagattaaacccttattaattaatttgatgggccattttattctatagcttaaaagaaagtgtacgccttctattgcagataactatgagctcaccaaggatctgcatatcaaaaatatttggaagatgaaatgtgttaaattaaactatccaagccctgtcccttctaggaaagactattagcttaatgtctatctagagtcttgcttaatcttcaaaaaccttcctcaaacagtctcttggcatagtaagaaatctgcttatgtaatatattgtctgctaaaaggcctctatcttcactcaaaaatgagtgaaattctaagaaatttgttttaattttgctttaaaattagagaaaatgtttttgacctttatgtaatgattagttgtggcaattcctgatatgaaaacaatccagtttctattttcacctcatgtactcttctgcagtgaaaactttatggtaataattcctggaagagcagaatatatgatgctttcataaataaatattagtgcattagtcttcttccagcccaagccagattttcctggctgcttatttccccaggtggccagagaacacaatccttggtttaaaaaaaaaaaaaaaatgcctgcttcacatacatatctgatcagaagaaatgtgctcacttgcataatgttcttgcacttctgttgatgatatatggtgtagtgattatctaataggcattatgaaataacctcatatatgattaaaaccactgtatcttaatttgtggttgcattttacttacaaagaagccttccttaataaatacttgctttaaggaacacgtctttaaattcataaaaatttagtctaaaaatgattatgattataccatgctcaaattctgacatgttcttattatgatttgcagtcctagaggcctagaagcacattgagagaattaaagagaatatatattcctaaaaatattaagtacagaattgtcaaattatactctttcctccaataaccagctggctagcatactctaaaatgccataactttcttatatttcaagctgaaatactccaatttactgagtagtcaagtaatgttaatgacattttgcaaaatcattctgtttttaatatgttgggcctgaagttatattattaaactatacatattttgctgaattatttaatagaatcctctgtaccagttctctagaatatgtttatctgttttattaactactactgtatccccatcttagaacata

SEQ ID NO: 57918 - DNA, 718 bp, Bovine  19866880808401
tgatgtatgattaccaatccgattgattttattatggcaaaaccatgcttttgccacttttctgttacagtattactttgcttttatcttttcttgatctacagctttccattcagtctggatcctccgtgactatagccatttaagtgttcagcactgtgtacaatacataatatttggtagcttgtaaatgaaattaaagaataaagttttatttatggctacctatgtgtttgtaagcagatatattatatattagtgtatttttttagttatataaatgaattttttcctggggattgtttatgggtgattaacagattaatccagacttttaattttgctgtaatgttaggacattagaaatttactgagtatttgatacttaaatattatatctatatttttgactaagttgttaaacttagtatggcacctaaacctgtgttgaattcaaatcaggttttaactgaagtgagcagctgatatttaagtcaacgacactgaaacttttaaccttttcttagattaacctttaatttttttaatgtatttacatataatatagcaaggtgattattccaagagatagcagaaaacaaaaagtacttgaataagggctatttaatagtgaaacttatgagaactatgaatatgtatatattatatatatatatacacacacacacacacacatacatacacacatacacacaca

SEQ ID NO: 57919 - DNA, 2156 bp, Bovine  19866880859873
agggaatataacaaatgtaaatgatggggaaaagctggcaagtcctgtcagataggaatattagtggggaatatgtcttagtttgacttagtaaaaataaaatgtattaagtctgtaaatttagatactcttgtgagaaacagaaaagatgaaaagcagactgtatagaatttaatattgtgatgctacaaaatataagtgaaccaagaataaccgggttggagcctggccaatgaatgctgctaggactcaactattcaatttgcatgaaaacaagttacaagtctggaaagatttgtgcatgcctatacatcagtcaccacaacatactgtagtcttacagatctctcattcaaagaataaacccatctaaagttcaaaggagaatgctaaaatttatctaggtaaaggtgcctaggaatctgtctgtaaagacaaaattaaacaaacaccgagaacactttcttaataaaaacaaaacacacaaaccttacaaaaaagggtgattcaaaatgatccactaagagtaaattaaaaaaaaaaaaaaaagggagagacaaataagtttaaggaaaagatctaatttatctcttctcatttccctaaccactaaacagaaatagtaccttcctacaaaatgtcatcttaaattatattcacaacttaatcatatgatgaatcttaaaaaaaccattggacattgtattttcaaatgtgtaagaatgtattttatttttgcaatccttaatattttattgatttcaccagctaataattatagaattgttaaaatatttatatttttatatacgtctcatttgttttatagattgcatagattttcttcacttggaatatattaaaaatttagttgctgctaatttgtcttttacgaatctgaaaagaatcaaataaatactctacattaactaatactatttaccagtagtgttattttgcttaaatatgaaattattagagtgcattcccttgaaagctttagtgaattggcggtttcacagtttttctaggtatcttgccaggaaaagtcaatcaaagtaggcaacatgcatagatggagagttagcagaatcatctcattcagcttaaaaatggtatatacgtatatatagtgttctctagcactatctactaaaggggtaaactaaattgttgccttttgtctctgagtgatggaatttcagattttttaaactggaatcttcctactctaggataaagttttttgctcttgcttttacaatggccgtattttatttttacaataattatccataaatatgaaattgataaaatgcaataaaaatggactaacctgttgtcacagaagactcggactctctcaatttctgagatgctagaagtttttcctgcaaggctttctgagcaagttgtgcatcccattcttctagttctttctcaaatcgctggttgtcttcctcaacaaaatctcttaagtcagggggtagtgtttctattccaacaagggcctgcccagtttctttattaaactcctctgcaaatcatatttcaaaaactattataaaattaaggattaaaagaaaaatgcaaagttcaaaacagaaggtatttcaagtgttaaggtccaaattattaccatctagcaaatcaagattactatatattaaaagaaaactcaaacaaatgctcagaaaagcaagatgcaaatatgtgatcacccattacaggtaatgttctcagcttttatttttattctgaagagtaaaaaaaataaaacaagacataaagccaaaattgttgctactcaaacactgacatagtactactttttctactataaaataccagatacttgattattcatgaagtaaaacttaccacaaaatgagaagtaacacaaaacctcaaagctcaaaacagaactaaaattcttttccatctgaagcaattatttcaatatatttatatacaatttgaaatctaatcaatatagcaaagttttttttaaaaatcacatatatagaatctaaaaaggttactcaacctctaccacacacacataaattaaattttaggttttcagtcataaatccagcaagttttgctggaatgggttaaatacaaaagggaaagttgatttctatcagtctcaa

SEQ ID NO: 57920 - DNA, 925 bp, Bovine  19866880930420
ttaggtcttaaaaaaggtcactttttaaaagaagaacttcgattcataattaggaatgaataaactggctttaactacagagtaaatataatacttacctggatgtgccttataaaagaagtaatttccatatggtgtttagcagattgtgtctcagtagtcaattatacacaaacaactttactgttatggtagaataccataaaatgctgaagatactttataattgctttgatgatacacgtgaagtttctaaactttcaacatgacttgaaaatcgatgcagaatactaattctgctaagtagagaatttaaaatctaaaccaaagcacattctgatggctataatatacaaaatttaactttacaaagaaatagcaatttatcattaataccttagcagtacattgatatctttataaggagtattatataacagcttaatattttcttcttcttcttccatccagatcttttatgagaggcacttatacaaagcactagttttggtgacgctgtaacaaacatacacatagtataatgatatattttactatgctgacaaagtatcatttataaagaaatttttataaattcaaaaataggttgttggtagcatgattacctttaaagcattggatttcattcacaatattacttcattaatcttaaatagcagttccacctataaaatgttctacagtttttttcctttttgaaaaggaagtaaataaatgcagggaagatactcatataatttctagttcaacaatatcaacttccatttcacagcattgattagtagagaacatttgcaattaaagtagtatacaatttacaaaaatagaatgattatataatgcaaacaccatcctccattatgaagaatgtgtgtgtgtatgtgtgtatgtatgtgtgtgtgtg

SEQ ID NO: 57921 - DNA, 1460 bp, Bovine  19866880931587
gaattttctttatgagcggatctcaaactgaacttgaagtcacttcagaaaaaagtaggtttgtggacaaaggaatccagaatgaaataaatattttgtatgactatttttacaaagacctccggttatttcagagtcaagaaaattctagatattttggtgaaaagttttcctgatggttcagtaataaagaatttaccttacaactcctgccagttcagcagattcaggttctgtccctgggtcgggaagattccctggagaagaaaataactacccactccagtattcttgtctggggaagttccatggacagaggagcctgacaggctacagtccatggttcacaaagagttggacatgacttagcgactgaacaccaccaccaccctgattagagttacctttctggagatccattaatcacaagaaaatgaacagagattgaatagtatggcagaagtctttcctacaccctgaaatattcatttgaaagtttttctagttatttaatggaatgacagaaagctaacctgaaattcacacttcgcctttgttgtatgtaagcagatgttgtgcaactccttactcaccaggaattattcctgttgactcttagtcacttgggggcacactccactctggagaagaacagagaaaagatggaagaaacacaacagctgactcttcagttcaagtgactagaattctttctcaacttttgtgttcagtgagaaatgttatcttaatctcaactgacaagaatgttcttaaaacaaaactcagaggtagaaggctagaggaatgctttaaagccatccaagaagaacaaactgaataggatctgcacagaaattacatttagcaactgaaatttgctactcacaattttagctactacatggaaagacaaattgttcctttctattttggggtgaagattataatagatcatcatagtggcttttcacattaaataatgtttttccatttctgtaaaaaatgccataatgtcaaaaaggaaggaaaatcacttagtcacactagtacatgctcagtcactcagccatgtccaactcttcgcgacctcatggactgtagccctccaggctcctctgcccatgggattctccaggcaagaataatggagtgggtttccatttccttcactaggtgatcttcctggcccagggactgaacctgtgtctcctgcattggcaggtggattctttatcactgagccaccagggaatccagtcacacgatgggaaaaaacaaatctatgtagcagcaataattcatgtgttcttctgtccagggatttctaaacacttattgtatacctggttttagtctaagcaaagagataattatcataaggatccctacagagaatctcttttaacttttggtggcacttgcaaacgacaaacagggatgagggaggacctctcagaaga

SEQ ID NO: 57922 - DNA, 662 bp, Bovine  19866880980487
ggaggtgactgtagctgccagtaaactgaaagtgagagagcattcagaccctgcatgaaccccagagaacagaatggaactgcggagccaactccagggttcatactccaaggggtcacggcaactagagagcattcttttaccatcagaaatgatctgagttctttccttttcccatgtataatcttcccatgctatcagcaagaggaaagtggttcttcttttaaacaataacaattgtgcttaacttcggctagttagttacctgtcttattgaaacgcttactttataaacaggattccctctcctcctccccaatagtactagttgcttctttttgttttcattttgtacccagagactcattttaggcaaggtctcactgtgtatcaaagaatgccaatttctgacttctttgccaaaaaaaattcttgccaaatggagatcagttttgaaaaaccaaagataaatgtacacatcttaaagatttaattgtattatttccctctttatactttgattactttgacagatgggaccttcacaatatactcattgttcagctggaaaccccatgaagctgtaacctgaatcctttgtcctgaggccactcgaaggcggctccatccaagggtgtctgtggaccccagcagagagaggg

SEQ ID NO: 57923 - DNA, 1686 bp, Bovine  19866880994827
ccagtttgtctttatcttaaaaaaaaagaaaattattcaaagtccagctttctgaccaccttttttgggctatatttctctttttccttttatgagcaattttgtttccatggtagttgtctctatttccttcttgcccagtcttccttaatatgctgaaactagtctttcatctccactggaactgattcagaaactaatcttggcaaatacaacagtgacttgcttattgctaaatccaataggctctcaactgtaagctggccagaggtgctaaattctggtaagtgaccagtaaacagcaaatattcagtaaatgggagttgttactattatggttgggctgaattaatttttaaaattgttattgctaatttttttaataagagggattatcgcaacaaattctcattttgtctggttatttcctttcttagtgaatgtgtgtctctaattacctaccatcaaaacaattagtgaattcagcaggaaaaaaaaatatttcacacacagtcacttagcatcctatgaaaggaataaaaatataaaccctataaaaattatttgactagaattttcaactttcaactagttatttgtttctttacaaagagagcttcaaaataagaaagctgccttcggggaatgataggcaaaagtatcttcctcaaaattttcttccttctaatgttttcttgcagtagccacaaatagctagtaatctttagtaagaaacagagatgaggaataagggtcatttactaaggggtgtgtttgatttacagtccagtagttgcaaagaattagtggtgtgtttatgtttcagtagctcacagcataaaaggcagagttagagtgatgagcagacttttaaatcatatctttgcctcagtgtaaaagggaatatgctttaatagaacagtgtgacctcatctttcagtctttttcagaggaaggaacacaatctacaaatgagatgtgataccttatttttttttttccagtttgcactttaaagagcagttctttatttgtaggcactttgaatgtgaaagctaagatttgacatgtatgtgtttgtaatcatatatgctcagatttaatcctcattcacagctgataaacctcatgctctgaagcaggaaaaccccaaggcaatcttgaagttgttagtaaactggtattttctgtaatgtaacactggaggttggactgtgtgagcatattcagggatcatttctagataaacataacacaatttttttaaattggaagattatattggctataataatcagtctcatttacattccacatgaaaccttaaagatgataaaatcccatgaaagaaggactttaggtatgactttataaatgcttaataaaaacaaatgatgttttaatttaatgaataaggagataggagaccaatatcatgtggtggctcagatgttaagaatctgcctgcagtgtgggagacctgggttctcccacagggaagatgccctgaagaagagcacagcaacccactttagtattcttacctggagaatccccacggacagaggagccctggtgggccacagtccatgggggtcttaaagagttggacatgactgagcaactgagcacacaaaacaacctctctttcatcacatggagaagctctaaagaaaataaaatgca

SEQ ID NO: 57924 - DNA, 727 bp, Bovine  19866881205319
taaatagtgctgcaatgagttgttctaagttaaaaataaaataaacctaaaaaaaagaaaaccagaacctcagaatctcagccccctcccaaatctactgagttagagtctgccttttaactagatctccgtgtgatttgtttactcattaaagtttgagaaggattgcttcagaatactattcatgtccaatgtaggaagctctatttgaataattaaaagcattaaattgtgtgattattttgttaaagttcattaaatattaatatgctgctctttcaataagtggctatttaacattgagttgtaagagtcaacttagaagagtttggcaaatcaaaattttaaaagtcctatttttcaagtttttcttctcctttcccttcaaaaaatacttcacttttacatccctatttaaaatgaatagtgaaatatatacaaacatattttaatgccttcctggtagaggaataatattatttctggagtcatacattaagtagtgtatttgtggtagaaataaaaatgtcgtaaatatgataagaggccttgagcatgagagggctctttttcatacattttagggatagacagctattttgtgaagcaaagtttgttagtgttctctttgatttggaaaagtaaaattccagagcttgggctggagcagattttgagtcagaagaattaagaagtttcacatcaaaatgaatctgaattttgctat

SEQ ID NO: 57925 - DNA, 2126 bp, Bovine  19866881340994
ggctgggcttgaccttctttcagcctcacccctgatacttccactttaggcttttgctgtagttataacagactttgaactctgcctgagctttgcccagaactttgctcttgaccagcttattacccctttcaagtcattattcactatttcaccttttcaaagagacctactctgacctttaccaaatattttaattccctatatcctgccccagccttcagacttcaccatcacttatcttcttatctactaaatatggccttattatttgttacttttatggtttatctttcaccattagactataagctccatgagatccatgagacctttgatttgttcactgttgtatctcagtcacctagaccattaccaggcacacagtaggtgctcagcaaatattcattgcactaaattgtgaacaatttgatttgccattttaactctcaaaatatggatgagattaacaaaggattaataataagtaaaaatgctgaacagttttactactggataaagaaaaacactctagcttcaaagtccttgttttccctcaaaacaagaacctgatagggcatattaagaaatggacacatgatttattcattaccatttgtagcatcttgactgagaaaattaaattgttttgtagatccttgatacaccctgggacctcttcaatttcttcactgttcttcccttgttaatttttcttgttttctttaaaggactacaggcaagtaagcaatattctgctcctttggcaaataattgatcacttggcctcttgaactcctctgcagaatgtgtctccacaggtttacttagcatcctgaatgacattatggaattggagagtgatttcttactggaaaccatgcaaaagaaataggggtgtaatgcttcttattttggccacagtgcaagatgaaacagatgaccagcaaaagacactttccaatatcactttttaaaaatgtattttactgatcttccttgtctcagcggggaaagatgctcatgaactcacccttcctgttgatattcatatcagcattagcatcaaatcacagatttgaagttgaaaggcacattagtagattttttaaattattgagctataatttatgtataacactatgttagttttaagtgtacaatataatgattatacatatgtgtatataatgtgaaatgattactacaataagcaaattcactgctaaatatgtctttttttttaacctctgtgctttttgtgcttcatcttggaattcttaacagtgtagttagatttcacattataatgaaaattgtacttaagtaccatcttatgttgaaatatttcccgtctacatattgcttttcatcatatttttcattaaacaaaattctaagtattgaacctatacaggttggcctttggagatctcataataagttatagtagcataagccatgatgataatgaaaaaaaagaagaaaagacacattagtctctaatttttaaatggcaaagtagtttataaagcacaaaatcaaattctcttgtacttaatattaggtaagccctattgaaacatccttttctaaaatatctttataataaaaagttgtgtataaaaaaatatttccaaactgtagtttgtgatctaataactttaaatagcaatatctaatacaacgagattctagaccaagaggtagcaaaatttgttgcctctttttgttaataaaaatttggggagcatatgtgtgttcatttttttgtgtgttatctgttaactgcttttgtgctacaatagctgagtttaatagctatgacagggattatagggcctgcaaacctaaaatatatactttctggccctttatagaaaaaaaaaaaaaaatgctgaccccctgttctagacaaataaaaaattgggggcagttctttataattcattacacctgaagttaaccctcatgttctcgtctatcatttaagagggagggagaacttggaaaaatttcagagctttctggctgtgagttggttagtataaatgaccagggaaagacagaatattggctccattggctgctcaggctggccacacacatatcctcatattattcct

SEQ ID NO: 57926 - DNA, 868 bp, Bovine  19866881361750
tatactttttaggttgagataaatatacatttatttactttttagaagctaaaaggccatattgaggaatatgaatttctcctctcttataggtaaaaaatttgaaaatactgaaatgtttggtcagtacccacttcaggtcaatggatttaaagatctacatgaatgcctagaagctgctatgattgaaggagaaattgagtctttacattcagaaaattcaggaaaatctggtcaagaggtgagtttagcatcttcattccccttccctataagtgtcttctacagtgttgtgaagttaaggctctaactgtatagctacctaataattgagagaataatcagaaaatgtttttgaatttaattatggtaatttagacattttggggaaaattgcagagtcaatacagtctataatctacgttaacttttcgtttaaagtgttctctcaaaattttatgttaaaatcgtcatttaggacattgttcagtcttttaagactttttcagtcaaggtaccagccattacagcatgctagtgctggtagtaaggaaggaaaacactgatgttagagtggaattctgtatagagatatgttagaatatcaaatatcaaatttgatatatcaaatatgttggaatgtgtcaggcccaaggaggcaacaccacactccttttcttgtaaaattactgtgtaattgcctgaaagacagatggaaaaacttgcttcctcaagaaagagaattaaaatagatattacacacctatttatctgtctccactggcctctgtcttgtaatctatgttcatctctcgattcatctctctagctccgtctgtatatcctttcatccatatgttcatccaga

SEQ ID NO: 57927 - DNA, 1198 bp, Bovine  19866881423031
ttgtatccaaactctttgtgaccccatggactgtggcctgccaggctcctctgtccatggaattctccaggcaagaacactggagtggtttgtcattcccttatccaggggttcttcttgactcagggatcgaacctaggtctcctgcattgcaggcggaatctttactgtctgagccacaaaggaagcccagtcagaatttacagctggatttcattcagagtggttgaaacccaaggcagttttggttaatattttagtcgctactaggactaaaggaaattctaaaataagtgtctgactgttgttaaacaatatactatacagtccattcaaggaattatcatcatgctgtccttcctgtaaaaaaagtgatgctaatgaccagctgacagtagggcctacgtagtgacttgttttttcaagggtgctgggttctgctactctctcctgacctctcagtgagagcaatgaaagaagttaagaggccagagtgcagctacagagagaatatgcattgctctggcctcattaacaccgaaactcaaaccaagtgagtcaaacaatttggagaaacagttcccttttcaactcccaggtaaggtgaacctgtgaaaattgcctatggacctggtgccaagttaggtaaacaataaaaacagagagctggttcctcatccctgaaagatgaaaagtctcaaattgagggggaaggaggaaatccaatttttaaaaagtaatctccaaattgaaatgtataaaaattgagtgaatgtgatattgaatatgtaggtaatattgctgtaaccatcagtaaaatttttcagctctaaaaattgtatgatttaaaaaagtctatgcaaagatatattttctttctgaaacctgtagtcctcccctttacatagaaaagaagtttcctttctctttagacataggtattaatctttcattcattcattccccagacatttatggagcaggacatagctagtgtgtgaaaataagtgaattgtagctgttctcttgtcctcaaggaacttaccagggaaacaagaacgggtcgttgattaactcatcaatatgccttatgcaaagtttaacaaatggacacgcattctctagtttatcaacacaccagcatgaaatgtcacaaagagttgtaagcctcaggctcagtcttcatctccagcacaga

SEQ ID NO: 57928 - DNA, 1727 bp, Bovine  19866881436322
cccccgtccatgggattttccaggcaagagtactggagtggggtgccattgccttctccggacttaccaactaaacaacagcaataaggggctactttcagctaatgaaagaaaaatactccatgggtaacaaacctaagatacttcactacaagagctggtaaggtggtaaggatatgtaactatcctggaagactgttttgactttttaaatatgtggaccaatgagtttttttaaagttaaaattatggaatatattcccaatatttcaattgagttagtgaagatttcctaaaacacaaccctttgtgtcactcccaaagacataatgatgctttttcatctcacacaaaaactgtgagctatgaactgactaagctggtactgcttctgcccaaatcatcattgaactttcatcctgataagctaatgctaaggggaaagttaattttgtttaacagaaagtatcatggcacccaacattttaaccaacagtgaatctgtttggtaatcactttctgagcaaggagtcactttcccacaaaagaagatttcaagcaccctttccataccactccagagataagaatactaatcttacagctgccaaataaagtacgtgtagcactgagtattcatcttagccccaaccagaagttcctaagaagtactgaagaaaaaaaaattctcagtaaaaatcaagtgcacgcttgctaagtcacttcagttgtgtctgactctttgcaaccctatggactgtagccttccaggctcctctgtccatgggatctccagaatactgcagtgggttgccatgcaattgttacatctcctgccttggcagtcgggttctttaccgctagcgccacgttgaagccagagatacatgcttaaaaaccgtatttggaataagggtgtaagaagcataatttagattaataataagatctttaaagaaagatacacaaatctcaagactgactttgtgaggcaaagggtaatagaaaaaaatactatttgtttaaccatgctcttaaaatttatcaccaacttcttaccccacaggaaatagactgccaaactccaatgcccatatttgacatttttataaagtttctcatgtctaaggaggcctgatcaactcaatatagttcttactattgatcttcaggtcagtcactatcagcaaatccatttgtccacttcataaagtcctgcattatggacagatatctagaacaataggctcaatgagtatttgctgaataaatgaatcctggacttagtaggtgttccatggttagagtcataattctggtgttctaaaaagaggaaaacaggtcagaggtaatcctcaaagacttctcttgcaatggggcttatttttgtctggatgtgctacaaactatgctatgttcttcacattcaagatgaaatacagtccattgggtaaatgttctaacaaacttcaccttgctggccttgaccttttaagtgtattttggttctggtcttggcttttggacaagagtctatatagagctcatctctcatggccagtttagtctggctgaacataatgtccagcagagggctcccagggagactgatttggcttagttgtccttttggcccattctattggcagggctaatgagctctgataggtccactctgatcttttcaactatcccagacctcctgtgtccatgaaagtagtcttttt

SEQ ID NO: 57929 - DNA, 1164 bp, Bovine  19866881531143
cccctgcccgctttgggggcgtcgcgcccagttccgggctgcgtgtggaaagtggggtgtagttagcgggtttcagtccacttccttcttgccaattgttttcctgtaaccgacggtgctgggtatttgttgagcgcgatctcacattcctacactcctctgtatgacttcctaattaaactttatcttcctcgtccttttttttttttttttttttaagaagaaatagccggttgtcatcccttgtgaacccagttttctttccaagacaggagccttccaggtctgctattttgcaaaagcctctccaccggaattgagttgccaggtacaggaaccaggtggactcaatgtagaagtagaggatttggttggttcctttttctttttttcctttttttaaaaaatatagaaactgtcccttaagaaggagacctttttggccatgcttatttcaggtatattttgtcccctaagtttgaccttgttccatcctcaccctttactcttgcctgggtcacacattaaaaaggttgttcccttaaagaaatctgggtttgtgaagcttcaaatcttttctgttaagtatacttatgtgagagatgctactttccccccctcgattttgctttcagaatctcaagtgcacaatcaggggttgcaccatatcctggagagtcgttggctatggcttaatttttttgggagggggttattggtgtgaaaaacatttggggcaaaaggaaaaccattactcgtcttgaaattatggtggtgaccagggtttactgtgaaaagctgctaaaactcttcgatttttctgggagagtagtgtgaatgccccaccctgtggtgttgatatcagtagtttttttgcatcattatatcctacctgtgcttgattttagaataaggcctacctactgtcgtaaaatggactgtgtatactcacagcctgcgaagtttttgctttgagatatttttagaattttatggtagtacttgaagtaattgaagatgctcaagaattttggaaagtgagcatattgcattattattttaggcactttggggaacttgtcttggaactcttgtgtgttagttaattgttattggttaatttgggcatcccaggtggctcagtggtaaagaatctgtctgcaa

SEQ ID NO: 57930 - DNA, 1334 bp, Bovine  19866881725866
tctctaaaggtcctaaaactccttgctcgctgccagcattgcaaagaaaggtatcccatcaggtcatgcttctctgggtcttgtaagaaatgttgcagctcacctctctctcctcccagctcatcaactcgcatcgctcttagaaattaaatgagctctctctccccggtactcatttggtcaccgaaaagtagagactcacttgaaccacaagagggcgctgtcttccttgaaaaggaagatggccatctaacttgtatactcaaaccgtaaacttggaatggcacaagaaaaagccaagcgggacctcaaattaaccattgcagttttcaaaaatgttttagtgtctgcagaggggccctgcccctggggagtctgacctttccaagatcctgagagagatgtggcagatatggcctctgtcacataaatatgctttgaactacccgagtggacttcagtgatggcttgaagaaagaaagcttcaggctgaagaaagcacagtgacagttcagatcctgaaggccaattgccacaagctcccgtggaatttgtaactcctgctttatggttattctggagaacttcacattttgacattttaaacctttagatgtttagaaaagacccttgatgctggaaaagatcgaaggcaggagaagaggacgacagaggaagagatgactggatggcaccactgactcaatggacatgagtttgagcaaggtccgggagttggtgatggacaggaaattctgcagtccatggcattcttcagtccgtgggttcacaaagagtcggacaggactgaacaactgaagcaagatgtttgaaaagaatgagcatgaagtgacatggacacatacacaaacacattcatatacacacagacacatcgtcatttaattctcatgatttatgaaggaggtgtttgtgttctcatcttacatacatagaatcatacttgggtaaattaattcatttcttcaactactaagtaaaaaaagccaagagttttactcagttcaggtgctttttcttttacttaagtatcctatggaaatacccagaattttggaagaaagtgtcctattttaagtagctgatagctcagaaatacaatacaggagagagccatatcatacaaactttgtaaaaacagatgtaaggaagttcagagaaaaaattagtagttttatatggagagattgcaaaggggaggtctctgggaaaggctagaagattcacagaagggaaattttgcaaaaatactcacaacattgcaatgagggaaaaagagagacacaccagtgatttagaaagttctctagaaa

SEQ ID NO: 57931 - DNA, 825 bp, Bovine  19866880362348
ttgactaaagtctaaagtcgacttgtatgatttcgatatgatgcagatcattgaggcaaagagtttttcaggaaatcttttcctcaattatcttgaataacaaaatttcaaggtagtgtattatccatacaattttcaaacattttactttacaatgaaaaggaagacataactcaagtagaagtgtttcctacttttttctttttttcaccactctcacatttcttttctacccagaggaggctgagactgtgtaaaaggaggcatcttacaatatcacatgaacaccagctgttgcatataggtctgaagcactatttcattttagactatatattttaaaaagaactattgtttaaccattaaaaaaaaaaaaaaaaccctgctgaaataagctgcaagttttagccttggggaaaataaccaagtaaaaacccattgagttctttatcctctaaactttaagatgctttagagaggtgttcataaaataagttatgtgcattttacccaacttggacgggctctcactttgctatactgagtgataaaaatccttcctctctcatattcacatttctcaagaaatgagtcaatgcatactcagcttccatgaccaacaaactggaaaccaaattcttctcatttgaaagggagaaaggtgtccagagtgactagttttatgagctgcacctctgtgataaattattcccagatgctgatgtggataaaaatagccttctttcctctgaatacctatgtaagcaggtggatttcaagcagacagctttaaataccacatatcctgcttgggggaatgccatg

SEQ ID NO: 57932 - DNA, 1334 bp, Bovine  19866880585836
ccattaagaaataaccagatcaactattttacagtctggttattccagttgtcttaatgactgaattggactgggttgcccagtgaccctggcaattgcttcatgattggcctgcaggtgattgagacagccagtcatccttggccagtgtaatctcactgataaagtggagctgtctcttcatatgctgcagaagcactaagaggcttgttttcactataagctgtggccccatctgacacaaggacattttctgacaattacgcagctgtatgtgcatttgaccagccgcccagcgcttggaacaactctaccaccttggtatgggaactgcagcgtgactgaagatgcaaatctgattaagtaaattgtagttggaaaccaggcatgttgatcaatagttggaaacttttatgaacatcgtgatgactgctatttaatgtaaatctctttatttttcctgccttcaaaagaaataaatgaccagttttttcattggctgacatgtttgatcaaagcataaaagaatactggagaagtagtgcttctgaaagcaatctagtcatgctcggactataaaaccttaattacaaccctagattttcctggcagatgtgtctgttaaatgaagctcttctctattcagcagatatgggccttggtttgcaaatatgatttgcttcccacagacatgaacacacacacacacacgacacacacgtgcatgcatttcatgaagagctcacctgctgttatcttacactttcctctctctttagtcagctctatttgcagagggcagattttaaagcagtcattagagatattttatagttcacatttgctttgtcattagcagtactctttcaaatatttatccatgttgtttctaaataaaacacccaagcaaacatttatgagtcatttgcgaatatatttaggagaaaagtgattgtctgtgggtcataagccattctcactataatagattttaactcagcattttatttgagggtgtgagagtggaaactaccatgctgactggttcatgacccaccggagcatcatagaacagaaattagagtaatttagcatgtacgtggagaaggcaatggcaccccactccagtactcttgcctggaaaatcccatggacggaggagcctggtgggctgcagaccatggggtcgcgaagagtcagacatgactgagcgacttcactttcacttttccctttcatgcattggagaaggaaatggcaacccactccattgttcttgcctggagaatcccagggacgggggagcctggtgggctgcagatcatggggtcgca

SEQ ID NO: 57933 - DNA, 4075 bp, Bovine  19866880760975
aaccatagccttgactagacagacatttgttggcaaagtaatgtctctgcttttcaatatgctatctaggttggttgtaactttccttccaaggagtaaacgtcttttaatttcatggctgcaatcaccatctgcagtgattttggagcccaaaaaaataaagtctgacactgtgttagtgatgccatttggtatttctctttctctatctgacttacttcacatgacaacctctagatccatccatttggctgcaaatggcattaattcattcttttagtggctgagtagtattctactgtatatatgtaccatatctttttatccattcacctgccaatagacatttaagttgcttccgtgtcttggctattgtaaatagtgctgccatgaatattggggtgcatgtatgtttctgagttatatgaaacatcttttccagatatgtgctcaggagtgggatcgctgaatcacataataaactctatttttggtttttgaaagaatctctattattctccatagtggttgcacaaatttatattctcaccaacagtgtaggaggattcctttttctgcacactctcttcagtattcatcatctgtagactttttgatgatggcccttctgaccagtgtaagatgatacctcatcctagttttcatttgcatttctctaatgccttagtgatgctgagcatctctgcatgtgcctattggccatttgaacgtcttctttggagaaatgtccatttaagtctgcccattttctgattgagttgtttgttttcttgacattgagctgtatgagctatttgtctattttggaaatgagttccttctcggtttcattgtttgcaaatattttcccctagtccataggatgtcttttcattttgtttatggttgccttcactgtgcgaaagcttttaagtttaattaggtcccatttgtttatttttgcttttatttccattatgctgggaaatggatcaaaaaaattattgctgcaatttatgtcaaagaggactcttcctatgttttgctctaggacaggggtcttcaacccccagggctatggaccagtaccagtctgtggcctgttagggatcaggccacacggcaggaggtgagtggtgggcagaaccgaaaccatgctccccctgcttccatctgtggaaaaattgtgttccgtgacaccagtccttggtgccagaagcactgggccctgctgctctgtgagttttatccaggcttgtatttaggtatttaattcactttgagtttacttttctatatggtattacagagtgtgctcatttcattcttctgcatttaactgtccggttttcccagcaccacttattgaagagattgtcttttttccattgtatattcttgcctcctttgtcatagattaattgagtgtaagtgtgtgggtttatttctgggcgttttctcttgttccattgatctgtgtgtctgtttttgggccagtaccatactgttctgattactctagctttacagtataggctgaagtcagggagtctgattcctgcagctcttttcttctttatcaggatttttttggctcttcagggtcttttgggtttccatacaaatttaaaaaaatatttattctagttctgtgaaaaatatcattgataatttgataggggttgtactgagtctgtagatgacactgggtagtatggtcactttaacaatatgtattcttccagtccagaaacactgaagtaccttcatccttaacagatgtaaagagtagttcttatttgcatatacacataatattattttacatctatcaatactatcgttaaatattccaaaattagcctcctctcaaacagtgggtataattgttaacatttggtgacacattcattagatctgccctcttctctaagatattaaatcatgctaaattataattttcatgaagataaaatcatggtatctccataatacacatacagtcaggaatactgaatatacccatacataaacacacacacacacataattcaggaatattgacatttgaaagactggttaatatcatatagggcaataaaatgtattctttcttattgaccaaacagaatgcatttgcactgctatgaacaagtctctttttcattattataagtattctaaaaggtaactctacctgtaaaatagtctagttgtagaaagtcaaagaggtaacaccttatagaatcaaataatctgcagttctctgcctgcaaacactagaccttccaagactctcagcagtttctccttaactcaggaaatctgctggactgtgcactgtggtctggaaagcctctctaggtggtcagcggggacaaccacagggctcacctcatttccttactctcaggcatcactgacaccagattgtaatattaattggtgcttttattttccatgacaatggagaaatgttagcatactttaatttacctcatctcaataagtgccattattgcaatatattttaactctcagtctatcttaacccccacagtatgttattcttattataattatcattgatttgtacatcactgttcatttagacttatccaataattgccatttaccttgtttataattccttccatcatctttgaccatctgggatcaatatccttccacttgaagaatacagaaaggccattagataacaagactaacacatgcaggtctcatctatacattgagtgactggataactagggattataataacagggatgtgtaaaaatgttcactgacactttgttgtaaagaccaaaatattgtcaacccatttttttagcatataaccttaaaattaggtattagctgctgtatctgctttcaaagatcacagaagttcaatatctatttccataaacagctttttatataacaaatagccactgactattatatcatatatatagggtaaaatatttattatacctggatttagacttaaccacttgactcaatcagatgaaagaaattctgtaccctattgattgtacaaaaggtatgtccattctgatttggatttaaaacttggtgctacttttctttctgttttagaaggaaactcagtttcttttcattgctttttatacatcaggtgccttcatttcagtgcagtatgtaaagaacaggtggtgtaaggagtactttgaatgttaattatttctttcatttatttcactgtgaggatttacctttcaatgtgtttttataatcaagatggaaacagttagggagcttgctgcttgactgtttcactacatttattttatggcatctgcttcaaatatttgtttaaaaaaaaaaaaaagaagaaagggagtaagcattttaacaatagcaaagggtttgagttgatggtatgttatcactttatttcactctgaatcttcaaaggaaaggttgagataaatcagtcatgtttctaaccaagaaatatcatctcatagttacagcttacattttttatatagaaacatgtcttttcgtttttcagaaatgtcataatttattagtctcagattttaattgaaaagaatagaaaaaagcgacaaagaaagaagaatggaagagtaaaaactggatatttcatcttaaagatatattttaaaggagaatgtttactttccattcattgtatttagtttatttcttaaatatacacaacttttaattcttatgtccttcatttttcttataatattgaacatagttcataaaataatattaaggatcaagaggtgtgaagttcatgatatattaagacacagacatataattccaacagaaaggaacacttttcaaaattaatatagtcatttcatgctattacattactcgtttttcccattaacaaaatattatagacaaccttaatcagaaaacaaaacttgcataaaatgtagtaattatacataattaggaggataataatagacaagatattgataaactcatatacgtgtgtataaggaggagagacagacagacagacagaaccagcaag

SEQ ID NO: 57934 - DNA, 1923 bp, Bovine  19866880764909
tagtgtggcaggggtagtcggagaggctcccattaaaatatggcatatgttgaaaagctgcttcagatgttgaatatatgcagcagagagcatctagcccccttcttctgctttaacctttctccaaatgagcatccatagtacctcaacactgaaacggggtgagcaggagggctgggcagtagatacaagacacccaggcagacagcagtgataatgtggagacactaatgaaaaatacattgcagataagagagtttattctctctctgcaaatctgcatcactggaggaaaaaataaaagtcaagtttcccagttctaaatattagccatgttttctttcctctttttttttttttttgagagaatgtaccctcaagaaatgtttcttctttgatttcaggcctacaaattgccttcggatactatttcatcttccatccttcctatcaaggaggtcacggcagctctgggagcttcctggaatgtctagatttggctctaggctggaacttccaattgcccttcaaaattatgggcaagaagccctgggatcactgccaaaggacttaggactctgatgctcactcagcacatagctctgaggggctgaaagtgaagggtcaggagcaggtgacaggccatctctcctcactggcccaaaactactctccttcattccggtcgagatatcaagcctggaagaatcccttgtacacagtgtggtgggcactcaggaaataattgttgaactctgaataaatggactattaatattaaataaatattatcagtgtcaatcagggtgtcgcatttagtgggcgtgtattgaataaatgatgcatttttaaacagcttatcccctttatctctcccgaagcatttagtgttcctaagtttagtgtcactctctgattcaatgctaaacactatgcaagaacctcgtctttaacaggtatgctcacctaggatgtatctcagttccaagtccacattttcatcactgataatgacttctggtttatatcacagcagcttcaggaaagtcaaggttaccttccctagagaatgcaaacatcttcctgagtctgaccacaaaaaatgaggctaaggtctaatgattactgggaactttcttttttaaaaagagggcagagtacatttcctttttatgagttcttatatgatttatctcaatgctgtggtcatccttgatccacaagggaatggtttctgaaaacatgtggattcattattatccaaaatgtctttggaaatgctcaaagcagtttgaaaccaagccttgtgtggcaggattcagcagttatagcccaaattttcttctactagtggaaataattggaaaaatgtaactcaagattagggtttaggaaacagaactaaataatgcctgccatttattatggaagggttctctgtgagtcaaatatggtactgagcacttatccatgttttttcatttaatgtgcaaagcatttctgttgggttaaattatattatctccattttacagaggagggggaaccacagctcatagagataaaataattagagcgagagatagtatgtaaattctagtgagtgtgggtgctcagtcatgtccaactctttgcaacaccatggactgtagcccaccaggctcctctgtccatggaattttgcaagcaagaatactggatggggttgccatttcctactccagggggtcttcccaacccagagattgaacttgcatgtctcttgcatgaacttcaaaggcccaaatcatcacactacatccggcgcctcccagggacctgacacttactaacattgtgaaaagtgtatcttcaaatggccaaataacttagagtatcagccatatgacagggaaaggacaaaggagagatttccacagccaa

SEQ ID NO: 57935 - DNA, 847 bp, Bovine  19866880767329
aataattatgggtaatatttaaatatctatctatataatctgtttaactatataaatactaaggaatttatctaattactttgtattaagtgattaatactaaatctatacaaagtgacaatcaattaagcaaaagtaaatttctttcaatcatggtatcagtttaataaagtgaagacttctttttccatgcaaaagtaagaacttacttttttttttttcaatcagttctctgttatctggaaaatgtactaaaagacagcagttaatggtatagcaacttaaagttccatccctgtattttataaatttttgctaataaatgtaacttaagttatgacttcaaggatcatgtagttaactataacttttccataaattatccatgcaagatttaaaggaaaatccaatatttagatacatcaaacatcatttggcttagagaatattattatagtttatattaatacattagaaactcatcaaattgtatatctcatcaaattgtagatctgttgtctgataatgtacatgtcataaagatgcagggacagactcaaggattcaaggtggattattttccctagctggatcttgatttaatttgtatcactatcttggccaactgacttgacctacctatttctaatttcctgattcttaaagttcgttctgatgtttttgatgattaataaggctactcattttgcaatgcttcttaactaaaagcaacaaagcaatcaaacaataattatttggcagaatttcaatgtgcttcacgtgctttcttcctacatcttagatcgcatgctcgaaatattctacagttcatgttctgaaatcacat

SEQ ID NO: 57936 - DNA, 1004 bp, Bovine  19866880786559
atatatatatatagatatatatatagatatatatagatctctctcaaagtgacctcagaaatcaactggaggagtggagaagggggaggggtagactttggagagtttaatattcagctttctaaatttatgtgtaattgaaatatatatgaatatatacgtatatatgtaaatagaaagatttacttcatcttgataaaaaaagcattttcattaaaaactaaagagactttaggcttctaaaattcagtagaaagctcagaacagtaattttcttcatacgttcatctccagagccttcagtgatttttggtactgaatgttattgttccatcatattttttacactagcactttgactcttgctgcacaattgcctcaacatagaatattcagcaaacctgcatgtgatgcccattcttcaggagcccaagccctggcaatgctaaatcaagcagcccgatactgcactttaaaatattaatgatctctcttgtcagatgaaattagatgtggaaacattttgcaaactaggaagtacttgacaagttttgaaggatctaatgttgctattagaagcattattattgtttttactaaaataaagttttctgaatatgtgacccatgggtggaatgcactttgtattccctgagaggcagcattttctctctgccctcttattttctctgcatatgaaaagatcatgtgacaaactgttttgtgagtggctggacagaacaaacattctctctttcaggatgccacgaagcacttcatgcattatattcataagcatgatctttaatttaatttttttgacaagtgcactgaagggtaaaatcaggcagtcataattttgactttgccattgctcaaacgagctcaatgattgaccagattttaaaactaaaataagaaagaaaaaagcaggaatgaggaaaagcaactttctcatgaaggaaagctttgttttttatcctctagaccttaaaatactacga

SEQ ID NO: 57937 - DNA, 1912 bp, Bovine  19866880804174
tctgttcagatgatcctagaagcttgagaagggatgaggcccgcctatgactagaagaggaagctcttccttcctgaagggggatcctgtggaccaagacagcacccactgttctgttgcttttgctggtcttttttcttgttccttgtcttttctctttttttaatgactcccttggcatctccctttatactattcaaatatgtgttttttgcttgttgttttatgtttgttttttgggtattttgtgctcggctttctttacaccacgtgggcttcttctatctgttgtgtggggggggcttctctggcggtgcacaggcttagtcgctctgcggcatgtggggtcttagttccccaactgggaatcgagccccatcctctgtatctccctgtgtctcctacatctcccacattggcaagcagattctttactaccgagccacctgaaaagccctcccaatcattcagcctgtgataaaaaaaatttttaatgtcttgaagtagaataggagagttttaggaaacaagagaaatagtctaatttaagtgcttcaaactgagatacttcctgtggagttgtttggtttggagatgtcacacctttacagaaacacaccgtgatgtttcttcatgcttttaggatctcacaccattaattgctcatgccaggatcagtttctcagaacacttttacatgtttctttttttacacgaaacttttaatggtggtaactccagtgagttctgaaatgtatcacaaatgccagttcctaataagaccgaatgtgaagtttgggggattcttttactgaaattgttaatatccattaacccctatatctaaggaaaagaattttgaagtgcacatttacatgtgatccagtttccattaaaattagaatatacaggttatgatttttaccttttttctgaaatagcaggtatttatggaagaccactattttaactgattatcattccaatgcttagactaagcgtctattgcttatagaactgcaagtgttggaaatattacatagtttagcttgattgatagagacatggcttagaatgaaaaaaaagaaatgaatttgccattgagatcctccaagattgaggtcgtgatgaggttaaaaggcattcatatgtgttgagaattcatttcaaatactcaccgtcatgttacatgcagaaatatatctccttggtgatttctgggctatttatgatctctgcagctataacactgcttataaaaatgcttattacactctccagtttaagtgccgagcattttgctgaccataggttctcaaggagcccctgctcttgtctttgtttctaggctttgcttctaacccagcatcttcttcttaggtcttggaatcaccaatattatggactggcctttttttttagtatcctttccaatataattctcagaaattttgagcctcgtcagttatttttagcttggcttattggttggctggctttatatttgttataattttggctcccacaggaacctcaatgtcttagagtgcaaggactaaaaataaacaaaaaactgagcaggctaatgtcacttggtttggaagatgccggggaccagccccggctgatccagggaattcgaagcggggacggcgtcggcgaagatcaggaaacaattgcttaattaaacgttaattaaggatataaagagtaatagaatgaggatagctcagtaggaaaattcagtggagaaaagaggctgaaataaggatagctcagtgaggaaattcagtgtagaaaagaggctgaataattcagccagaaggtaagagaaagaacgacatggtgagaccaagtttcggtgaacaaggcccgcactttattttccaaagtgtttttataccttaagtta

SEQ ID NO: 57938 - DNA, 1272 bp, Bovine  19866880819325
tttctttttttggggcagcaccctgtggcctgtgggatcttagttcctcaccagggactggaacccatgtctcctgcagtggaagtgtggcgtctcaaaccactggacaccagggaagtccctaactttgtttctcttagaaaacatattccatattccaaacagtacacctgggtaaaccagcttgttccaagactggaggtgataattcttccacaacttgtttttgcaaatataagcaaataagagaactgatcatgagtggatgggcactagtctcggggtgtgattccagatgtacaactagaaactccattcactttatataatctcagtttcagcatcttaggacctgagggtgtctaggcagataatcccagagaaggcaatggcaccctactccagtactcttgcctggaaaatcccatggacggagaagccttgtgggctgtggtccatggggtcgctaggagtcggacatgactgagtgacttcactttcacttttcactttcatgcgttggagaaggcaagggcaacccactccagtgttcttgcctggagaatcccagggacgggggagcctggtgggctgctgtttatggggtcacacagagtcggacatgactgaagtgacttagcagcagtagcagcaggcagataatccatcttaaacattttataatgctaatctgctgaattgttcaaattatctcttccttccagacaactctgtaaacctttctactcttcacttgctatctgcctacttgaggttttacgtagatttcccctattgataaagtaaaggttaacagtgggggaagtggtgctgtgtgacatcaatgacacgctggctgtctttcattctgcgactccacaaaggagcatcacaacgtgaaacagaacagctggatatgaaaccgggttggaccatgatgggaaaagaaatgcttaattaccctttccatcaagttaatttttcccctttggcgatgtaaacaaaggcaaatctgctcttgtttggttgtctgtgacctgctatccttgacctccatcctccgatgcctttctgttcttgcctccctctcccttgctaagccttgcactgcaggctctctttattaaaaaagaaagaaagaaaactttgaccagggcacaagcatgaaaagcagctatggctccaaacacagactgacttgcaattctattaaaatgttcactgagggacttccctggtggtccagtggctaaaaatccaagctgccaatgg

SEQ ID NO: 57939 - DNA, 2130 bp, Bovine  19866880839173
ttgtactcagtcatgtccaactctttgtacccccatggactatagcccaccaggcttctcagtccatagtattctccaggcaagaactctggagtgggttgcctttccttagtccatcaaagctatttttattgttttgaacaagaaagaaatttcacctgccttgaagcattattgctgtgaaattattttatttcaaatcagtggatttgttttctacaaaagtgtaagcaaaggtgtgccgaacacagattgttttattaaaccatgtttttcagagtgatgtttaggataatgatttataaattatatttctgcaaaacataaagaggaataatagtctgtacaatggatactgggtagaatataagtaacgaaataacatgtgatgacgtttatctttgaaattatatggcttttagttctactatctgtttttgttatgttccttctaaaatcctcagcattgttaataataaaaatgtggctgacatataaatttcaattctacaacttaacctttttccagtactagtaagtggttaaaggaatagtaagtaaagtaagttgcatttgtcatctttcatgaggatatggggttctaaatcagggtaaatgacagactaattgtctcaaatatagtaggacttttcctttggatggctgtttcttgaaagccattttcttcttcagaagctattgatattttcaaaagctactctcttcctgatggatataatctttataggaaactttgcaaaacttttcaaagataagaagaaaaacaatggcggtgtttcagagaatgtcagttgacctcagaataatttttcaaggatattcatgatttatgctctatttccaaaaagagagtttagatcttttcaataaatattaaagaagattatcatattgaggatattctttaaaaaggaggatcattaaatatctcagatacctttttctatgacatacctaagaaagcaaatattctgtacaatgttagccttcataggaaacaagacaaaaacagcaagaagtgcttcaaaccccccttaagaaatggtcttaagttgtcctaatggtctgtctggtagcattatccgctgcaaaggaagagaaaaactgccgtgtttatccacgtacctttaaaagaaagaagtagtaatttccattgctcattgtgttttccttttctgcttgtggggatggggttgagttggggaagggaagaagtatggagattaattaatggaatcagtcagccaggaaagtgatcagcacataataaactctcagctgcatatttgtggatgttctgactacctttcattctaatcaggactcaaggctacactaagtagattgtacatccaagaatggatatgcaggctctgaagtgtgcacttcacagtggtgggtggagcaagctcatctgcctgaatgactgacagttgctgggccctggaggagtcttccggggggcttctcagagggattccagctgagtggtccttctacacccatgcatgcatgcatgctaagtcgcttcagttgcgtctgactctttgtgacgctatggactgtagcccaccaggctcctctgtccatggaattttccaggcaagaatacaggttgccatttcctcctccaggggatattcctaacctagattcatgtctcctgtgtctcctgcatttgcaggtggattctccatcactgagccagctgggaagtccatgttatatgcacctgcattaaataaaatacacacaaatctagacacagcacaccaggtattatttataattgttgttcttaattccttaccagaagttaaagattgtgactgaggtcaagcatcacaaatttagtccctctaaaataaaagtttatcttcgtatattgaatctcagtaagatcatgtatgaaagaagttgagagccattgaagaaattaaatatgcacttcttttaataaacaatgtccaggtgtgatatttatatttctttgtcattagggatgctgctgctgctaagtcgcttcagtcgtgtccgactctgtgcgaccccacagatggcagcccaccaggctcccccgtccctgggattctccaggcaagaacactg

SEQ ID NO: 57940 - DNA, 1010 bp, Bovine  19866880852319
taatgaaaataaaactctatatccaaaagtccacagtataaaacatgcaaataattttagaaaatgtttgatttttaaaatttgatgtttaatgtttagttaaatatttaaagttaaacacttaaatatttgtaatattcagtcactcaaagctgtaatgatggccacatttcttccttcaacaaaatgagttctaatttccagaagagggaaagggaaaaagattagagacactgctgcttccagaaaggaaaaaaaagagattctgacattaacaaactgcatggtcttgggcaagataaagaaccatttgcagtctattttaaaaacagttttgtagagagagaaaacgtgaccatatgcgctcaagattcttcttctggatcaaaatacagctattatggttttaaacgctagaaaatccaggtgaatttgtattctaactccactctgcatggccctgtctttatactacaaggtgagccaaggtgattagtagtacctgtcagggttggaagcagagcagggaacccaaaggtaggagagaagtgagaagtcaagcgatggggaggacagctgagtgatctctaagagaaaataccaggagcacatgtcacaaagagaggagccaacgagagcaagtttgaggaacattcctgacctattctattgtgcaagagatcactaggatggttatggaaagaaatctcaaataatttatctcaggagaagggcaggaagagaagggagtgacagagaataagatggttggatagcatcattgactcaatggtcatgagttggagcaaactccaggagatagtgaaggacagggaacccttggcgtgctgcagtccatggggtcgcaaagagcagaacatgactgagcgactgaaaaacaataggagtaatgatagtatttttgagaaaaaaaatcagtagaagcatttttctgcacatagaatggaggaattccagataataatgaatgcatatgtgtacaaatgatt

SEQ ID NO: 57941 - DNA, 1805 bp, Bovine  19866880911437
cagatggtaaagaatccgcctgcaatgtgggagaccctgggctcaatccctgggttgggaagatcccctagaagagggcatggcaacccactccagtattcttgcctggagaatccccatggacagaggagcctggtgggctacagtccatggggtcgcagagtcagacacaactgagcgactaagcacagcacagcatgtggatggtatttaaagccatgggctggaaaaagcacatagagaatcctttcattttagaaaaaaataatttgtgagtttagctttcttaacactgtgtacccagctctttcccctgtatgatgcctccctacattggtggaatgttctgtacacagaaatgaaacaactatagtctttgccttctaagaactcaaaatccaaaatggccctgatggtatgaccaaggtagattccgtttctcctcttgtccctgagcctttgtaataataactcgtacaagtattacagtctccagggactttatattcattatcccattttgcttttttgtccttgtaacaatccatgaagtgtgaaggacgtgcaccgtctcccgtttgatggactgagcaactctttaaacagatattctcattcctccttttaacagaagagaatgtgggccacgaaaggttaattaagcaatttctctggatgaggtcacggaagtaacaagtgagattggcagaagaaagatacttctgactccaagggtctaaggcatctagttttagatggaaatttcctgaatatagcaacttttttaaagaaatagagccgccattgagagcaagagctctggagtctaacagagttcaatgaaatctgtgctctccacttgaccttggaagtagcatgctttcaatgcattgacttcctaatctgtagagtgaggatgctaatatctacctgtcaggttgttggtgaattcatgcatccgtgtaatttacccagccttccactaaccaatgaattcattcaccaaccaaacacaaaagctcctactatgtgctagcctccatattagacattggaaaagcattatattgcagaaaataaagctactgcccttctgagagtgccatctttggtgggaagcagtcaaggaccaatcagcaaagtgttacagagtgtacagatggtggcaagagccgtgtataaaggagagcagtgttgaggatcatgacaagtcagggaaggcttctttggcagggagctggacaaggatgaaatgagacagcacacagaaacatgtttagcacgggactagacacccgcttcaagccatgccatcctgagaaaaggagagtcagaaagcaggcatgggtggtacccaggatcacgggccccttgcccagcctggggagagcctctgccttgggaatcatttcatccactgactgagctacgagatagtctctggctgctctagctgatgccactgaatgcatgatgaatccaactgctctttttctgaatctgttcaccaaacgcattctaatcatgatttaacctcccatgtaaacctgcccacctggagggattttctgatcacatagacctccagtgctcatcttccattcgtagctcttctcattatgctttgagacacaggcactctaattatgatttggcttcctgtgtagcttggccacatggagtgcctacgctcatcacacggactttgattattctagctcctgttgcagctctcgctcattgtaagtttagcagccggcattctgactgaacacgttcgcctccgaacttgggtaacatcagcg

SEQ ID NO: 57942 - DNA, 1341 bp, Bovine  19866880917403
acattgtgtcatgataatgtatcctgtcatgtcatttttctccaattatctgagtagttgcagggattctaggcttgtgagataaaagttgaagatggttcaaagaaatgaatttaggagtgttctctgtatagctaatcattttctctgaaaactcagggaagctcagtgcctcattttacaagggacagtcttgaatttttgtgtgtgtgtgcttttaaaaaaaatcaggggggaaaaaatccagcagaggaaataaagatattatgaaaactctctttttaaaaatgtttagggcttccctgaaggctcagtggtaaagaatccacttgccaatgaagaatacacaagtttgatccctgagccaggaagatactacacgctgtggggtaactaagctgaagtatcacaactcctaagcctgtgctctagagcctgggggtcacagctactgagcccacctacctcaactactggagtcacccaccctagagcctgtgctgcacgacaaatggagccattgcttcgagaagctcactcaccacgggggctagagagtagccccagcttgaacaactggagaaaagccagtgtagcaacagagacccagcaaagtcaaaaaaaaaaaaaaaaaaagtttatatcagggataaatagatgggaagaaacctcatgagatgagtcttctaggaaaatgtctttcaaaacttaagacctgctctgttaagttataacaagcaaactggaactaataaggcaaaccatgtaaatatacagtaagtgggcttgaggatgggctaaatacatgggtaggtctttatttctaagaaacatctatttaatgcttgtacaccctccttcagttttgttacacttcattggattaagagttaacttagcaggcgagctaattttgaaatcacaagcacgtgttccgtaatggtagacacagccttcagaagtattgtttgctgttcacaaactcatattatgcaaattacagaagaatgcctaatattaccttctagtcaacagttttaaaagacattagatctataccacctcacctcctccggctcctccccctcggtatttcttgtgtgattcacactagactgtcccccacttctgagctcttaggatcataatattaatcacttaatcctctcagcacacgcctgaaacaagtcaaaggtgaactcagcattatgtattaactcataggcatatcatttaaataatctgttgtcaaaacccttaccagtcttacaatgagagcaccttgtcacaacaggaactaattcctctgataaattccaagcctcaatttctctctgtcat

SEQ ID NO: 57943 - DNA, 727 bp, Bovine  19866880963356
gccgccaggttactatcttttcatgggaggggtacctctttcttggggccaacgaacatcctttagccaggggcttgggtgtctgttccccatgccactgtctccaccctagacacagccatactcattggttagcaaggaattatttacatgtcatgtgcttcagacacaataaggaaaaagttttttccaccataggcatgagcacgcaagcttcaacctgttcagttcttttgtttgcttgtttagttgtttttggtttgatgatttttccaaattcagcagaggggtccaaagtgcttgatgtgttatgggttggaacataaggtccctgtagaaatactttatctttcaatagtatatacagtgttaaaaaaggcaacatgttgtagaatgcaactcattctaagatgtggcagtatactaaatataaatctttgtatagcagcatgtttctaaaacacctaaagcattgcatatgaggaatgtataaagactaaggatatgtaagttacccattttcaaataactgaagggctgccatgtgatagagagtaccaacttattccatgtaacacttaagagtaagattttggcaagaagtagctgagagagaatttcctgggggtccagtggctaagactccacactcccaaagcaggggacccaagcctgggttcaatcccggtcagggaagtggatcccacgcatctcaattaggagttcc

SEQ ID NO: 57944 - DNA, 2939 bp, Bovine  19866881003115
acagcatattatacagcagagacagtactttgccaacaaggtccgactagtcaaagctatggtttttccagtagtcatgtatggatgtgagagttggaccataaaggaagctgagcaccaaagaactgacgcttttgaactgtggtgttggagaagattcttgagagtcccttggactgcaaggagatcaaaatagtccatcccaaaggaaatcagtcctgaatattcattggaaggactgattctgaagctaaagctcctataatactctggccacctggtgcaaagaactgtctcattggaaaataccctgatgctgggaaagattgaaggtaggaggagaaggggacagcagagggtgagatggttggatggcgtcaccaactcgatggacatgagtttgagcaagctctgggagttgatgatgggcagggaagcctggtgtgctgcagtccatgcagtcgcaaagagttggacacaactgagtgactgaactgactgacccagcctacaaaggctgatgtaacatagctcagcttctgactcagttaaggtatagagctcctgcccacactttgctgtcactcgcgtggtacactcagtacccttccagcaagaagacagcaccaggaataggtcttttgactcgaggttcttcacagtatagtccatgacatgaaattacccttccaatgatggagctattgtgcatcaggcactcacgtggtgcccttgtcaaccctgctaagccagctgcaatcccctattgtatatttcatacttcaacttctaagaacattctgtttctgttcccttttatttgatgaagaacatctgcagatgtggttcagctacaaaagttaataagtactcttttttgtgtgtgtcaccataattaaaaatttcaaggaagaacttgtcattcattgtagcttattgaggttgcccatggtgcagataatgctttaggaagcccacaaatcatgaccttaaaaaaagccatcatcaggagaaacaaaacctcgcctcaaaacagggatgctatgccaagccatgaggtggctctgaagcctgctcacatgtccagcgatgtgggggccacccgagagccttgcacatcattgtcactgcattctcattttcctgaggtttccatccgtatctggcagtcctgtggatgccagttatggttcaaaggaagctcattcacacagcatcccccaaagagcattttgtgaggacaaaagctgtttttctcaagctggtgtccctcccattcccgccagaaaggatctttttgttcaaaagacaaataccaagggggacaatcactctcaattaattttccatacgttcatgtctcatacaataagaaagagcaaaccaaagagcttctaaagtgtccccagagggctggggggtggtagcagttgggtgcgtgggtggcatttgtgtggtctgtggagtgtatagaagacaagggcgggaaagagcgttctgtttacatctctcctcccagccagcctcggacctctctttatctcctccatcagacactgtctgctctgaaccatggattgttagtttctatttatatagatatatttatctgttttataatggctattatacatattatacatttataataatgtttatattatatattacatatatagatatatgtttatatttatttatatatactttattgacatatagttgctgtacaatgttatttaagttacagatgaataatatagtgattacaggtgtataatacagtgattcctagtttttaaagattatactccatttatacttactataaaatactggctatatttcctttgttgtacactatatcctcagagcttactttgtatgtaatagcttgcacctcttaatcccctgcccctactttgcccctctcctctccccactggaaaccactagtctgttctctacacctgtgcgtctgcttctttctttgtttcaacttccaatgactctcttgaaatgtcagatgaaggaacgtgtgtccaaccacaatgtaaatccctgggggagacacaccttttactttagtcctgtttccatctagcgagcgatggagccaactgcagggttgagaaaaaggccctcagtcatactgcttcctggacaaggaggctctggacggcctgatgaccaagctcactgactacgggaccccaaaagaagggccatttgaggaaaaaggacggccctgactcccttccctctcccctctgtggttcatccacatccacgccatccttctcaaccacatcaccgtcatcccgacagtttgaaataaagttgatttccactttgtattctgaaaatcaaatacagcttttggctgtttatctattaaggttttttcagatgtctatcagagaatgccctcaaggggttaagtctctctcagggactcaacatggcaaaacacctcctgcaaaatgttatttaattttgagttttgccacatggtcttttgtttaatggactgcataaaaagctcacgctggtaggcatacagaaacagtgtttctcctcccagtgtttatagatcctcagatcctcaaggaagacgggctccgccttacaggagtttcaagtcctacctggcactgttgcacacactccataggggctggactccactcctgccagaaaagtatgactgcctgacatagagccagtgtgcctggtatactgccacatgtgcatgagagagagagactggtatacataaagatatttgaacttccagaagcatttgcctttagtactacagtgttaagctatactccagtcttctaaattctacattttaaaaccaaatccatcatgaatatcaaatcttctcagggaaacagaagagaaaggactaatagttactgaacatttctctg

SEQ ID NO: 57945 - DNA, 1930 bp, Bovine  19866881027027
ctttcttgttaattagtataaaaaataatatttggagtaactccttaagatagacccataaaaagtatattcctagccaatctgaataaatcaagagcatctgctaaaaaagaaaaaaaaaaaaaaggaatacggagaaatggaactcatatatttctggcaggagtgtaaaatagttcagccacattgggaaagtctgacagtttgttaaaaaggtgaacataaaactcagcctttgcaaaacccctaggttcttcaaaccccatctgaatgcagagttccaatagcaaggagagatgagagagccttcctcagtgatcaatgcaaagaaatagagggaaacaacagaatgggaaagactagagatctcctcaagaaaattagagataccaagggaatatttcatgcaaagatgggcacaataaaggacagaaacggtatggacctaacagaagcagaagatattaagaagaggtggcaagaatacacagaagaactatacaaaaaagatcttcacgacccagataatcatgatggtgtgatcactcacctagagccagacatcctggaatgtgaaggcaagtgggccttaggaagcatctctacgaacaaagctagtggaggtgatggaattccagttgagctatttcaaatcctaaaagatgttgctgttaaagcgctgcactcaatatgccagcaaaattagaaaactcagcagtggccacagtactggaaaatatcagtttccattccaatcccaaagaaagacaatgccaaagaatgttcaaactaccaaacaattgcactcatctcacactccagcaaagtaatgctcaaaattctccaagccaagctttaatagtacctgaaccatgaacttccagatgttcaagctggatttagaaaaggcagaggaaccagagatcaaattgccaacatccactggatcattgaaaaagcaagagctccagaaaaacataaatttctgctttattgattacaccaaagcctttgactgtgaggatcacaacatactgtggaaaattcttcaagagatagaaataccagaccacttttcctgcctcttgagaaatctgtatgcaggtcaagaagcaacagttagaaccaaacaaggaacaacagactggttccaaattgggaaaggagtatgtcaaagctatatattgtcaccctgcttatttaacttacatacagagtactcacgcaaaatgccatgctggatgaagcacaagctggaatcaagattgccaggagaaacagcaataacctcagatacgcagatgaaaccacactttatggcagaaggtgaagaggaactaaagagcctcttgatgaaagtgaaagaagagagtgaaaaagctggcttaaaactcaacattcaaaaacctaagatcttggcatccagtctcatcacttcatggcaaatagatggggaaacaatggaaacggtggcagactttcttttcttgggctccaaaaatcactgcagatattaactgcagccatgaaattaaaagatgtttgttccttggaagaaaagctatgaccaacctagatagcatattaaaaagcagagacattactttgcccacaaaggtccatctagtcaaagctatgatttttccagtagtcatgtatgtatgtgagagttggactgtaaagaaagctgagcaccaaagaattgatccttttgaactgtggtgttggagaagactcttgagagtcccttggacagcaaggagatcaaaccagtcaatcctaaaggaaattagtcttgagtattcattggaaggactgattctgaagctgaaaaactccaatactttggccacctgatgcaaagaactgactgacggaaaagaccctgatgctggggaagatgaaggcaggaggagaagggggcaacaga

SEQ ID NO: 57946 - DNA, 697 bp, Bovine  19866881082803
aaaaattttacttatcttttaaaatttttattggcatatagttgatttataatgcatttctgccgtacagcaaagcgaatcagttttgcatatgcatatatctgacaactcattaaaactggcagcttagatttgcatattcctcttagagatctcaaaaatcattatgaaataatttcacaatgcattttacaagtatccacccttcttacatgttaacaattcatgtgaatttttaagtcacgaccctttaggaaatagaatgaagaaatgatagactgtggatgtaattttagcagcaaaaggtctttgttttattcccagatgttccttcaagtgatttttgaccttagaaactaaaaggcaaatgttgcgtgattttccccctcattgcagtacatgtgccttttcagatccttcccagttctcttaaatctttccacttcttttctcatctaccagcatggcaacacacgtgtagtgcacgacccgtgctctttcatttcctttgaatcaggagaaaatgtgcctgggtggaagaaaagtcgtgggtccttctctctttgagcatactttcttctgctgtcttggggcatcattctttgtaatatagttttttttttttttttggtttcccatatttgccagagaaagatgcaaaatgaaaagacaatattattctttttcttctgggggg

SEQ ID NO: 57947 - DNA, 951 bp, Bovine  19866881089563
ttgccgagtacctttcatatttcagtcactgttttgtatgtctcatatatgacctcacttaaacctttcacaatcctcattttactcataaaggagctgaggcccagagaagtcaggccctttcccccagttcacatagctatgaaatggcagggataagaatccgaattcaagtttttgacgcattcatctatattctgaaccctaaacccatcacataccaccgactgaaataatcagtgagtctgtagttgttatattgcaaatgagcgaaagtgataaagtaagaacctaaagcatatgttaacctgggtttgcagtttggctatttttctaacaccattgtctctgaggcaaagacaggaaagtaatgtataattgtgtgtgtgtgcacctgtgtgtgcttgtatgtgtgtgcacatacaatgagtgtgtgcatgtgtgtgtgtgcatgggcctgcatgcatgtgtgtgtgtagaccagtaaatcaatcctaatttatttgcaccctttcttctgctgtttctaactcccaattttgaaactatttctcaaaaatcattatctagggacacagctactcacagaacaagatagttagggtcatttaaattctctcaggcagagagcatttaagttttctcgtctctggctcccagttacaaatcttcattaaatcttaaacacagaataaacaaagcatgaacagattgtgaatgcttcctaattcaacaatatgagattacccttttgtagctactgttaaatgttggaatagatcccaaggaagtgattttaaggaccacagtattttcatgggttttggcctctttaagtcagattcccctgtaggagtcgacattgccaaaaaagtatgcattttatggttgtctggacaaacatgtgtgcttcctcagctgtcttcattatcactcatgcaagtcagtcaa

SEQ ID NO: 57948 - DNA, 764 bp, Bovine  19866881114466
gggtgacagtgaatggagtcataaagaactggagataacttagagattgaaaaacagcaaccaatatatacatcctctgcatatatatatatatggatttaaaaataaaaagcatgctgcttggcctgactaaaagaaaaagtacctaaaatcccactagtatgggctcgtcctccaggccttacgcactcttccatccttcagcatttctaacgttttatcttactcacagacgatgctctgcatggcagttgggatacctgacagagaggaagatggtcacagataagtgagagcaaagaactatggccttttacacgggatgtgtactcggggagcaggaatgcaagaaaagcagtggacaggtggaaaagaggaggaggccaagtttgtggaatctatcacaaactgcccctcatgatcaggtgaccctccctgctctgtgactgcacagccctgagcctctcctttcatgtctacaggctgtgtttttggagcccacctgctctcatagattatgccataatacatcctaagtaatttgaagcaaggtacagatcactagtcaaccgtgaaatcatcatagcactcagaatggaacaactttgggatattggtttcatttgtagttaagatgccaacaaggctaaacaccaatttcttcccactgacttaaatcaatagcttctctctctccccttctaattgaatgaaagtatggggaaaagattctgttaacatcttcaacactcccttagtccagg

SEQ ID NO: 57949 - DNA, 1219 bp, Bovine  19866881116505
tgtcatctgcatatctgaggttattgatatttatctcagcagtcttgattccatcttgtgctttatccagcccagcattttgcatgatgtactctgcatataggttaaataagcagggtaacaatatacagccttgatgtgctcctttccctatttggaaccagtttgttgttccatgtctggttctaactattgcctcctgacctgcatacagacttctcaggaggcaggtaaggtggtctggtattcccatcccttttagaattttccagagtttgttgtgatccacacagtcaaaggctttggaatagtcaataaagcagactatttccgagtttcttgctaaaacatcactggcatttgtaggataaatgagcaatacctatatagtgctttattctttttctggcatataatatggtttctatatatatttgctaaaagaatgatcactttgatgagtgaatgaatgtgaaaagtagttgaaccctaagtctctgtggagaaagatgctttttttgtcctaccctcccccattcatctttggggcagccaactctcatccccacccaaagcccaattttaatctaacaagggtgagtacatccagaaatactttcagaacacaaactgcctttcccctaagacaccacgtggtcaactgtggttagtcaacaggctctttttaacggaagtacaggtatgtgaaaacactatacttccatctctgaaatgctagattttcaaattagatacttgggatttgttcctagcctgcccacccctaacatctgtaataaagcactgcctaacacacaattatattcttagggaaaaatgaaaaacttgttcgaagaactcaacccttattagcaccatttttttcgagtaacagtaaccattaaatacttatgtatttaacctctgtagtctttaagcctgctagaatgtctaattagttaattaggaaattaattatgtgctaaaaagggaaatttgaaaattgtctatggatatataaaactctgtttaaaataaacttctattttgaggctttagtgctgtctcattgtattaacattttgtgattctttgcattcattatttttttttttttcacagaaacattgggaaagtttcccaaagttctcccttccgacctcctggtgtatattaaatagagtattggatctatctagtcaaatcatacttggacttg

SEQ ID NO: 57950 - DNA, 868 bp, Bovine  19866881182772
tcttaaaatgtcagcatgttctcctcacagtattgggcaattccacttcagcccctctacaatttcatggtatgaacttgaaaacactacacagaaaaagagatgggtttccacgggcacctttaaagtcaattctatgtgcaaacacctgactccctttcctacgtatgagagttaggtgagattatcttgacagttgcttggggcctaacccacagtgtggtttgtaaagaataaggactttaaataaaatgagttatgattacgcagcttgagtcaatatgtaaaggtaatacattcttctttccttagtcacaaaggaagacattaatcaagcctaatgcacactttatatttaacaagggaattaattaggggataatgactaagaaagaggtgtctacagaacacactctataggaatgactaaagaaaaagaaagcaagaaaggaaaagaaaaaaggaaattgactgtagtcatattccccaagtttaggaattgatactcatggcctgaaaatggctgtgctttttggaccatcaataacagtgaagacttttatcagctagagtctatgatggaaatgagcaaaaataataggacaaggagcagccagtctgcagggagatgtctggatacttaggccccaggaggtgagttatttgtagacatttcctggtgatcactgcattaatccaactagaattatctgagaacaaggaaggaagcaggcgagatgtctgacaacttaggccccaggaggtgggttatttgtagacatttcctggtgatcaccgcattaatccaaccagaattatctgagaacaaggaaggaagcaggcacctggccttccattgtgcacgtga

SEQ ID NO: 57951 - DNA, 1478 bp, Bovine  19866881228246
gcttcccttttatgatcttgttttatgcacaaaacattccttttgaaatctccgcggccacataaacattaaagaaacagcacagtgttttcctagcacatgtgcgcctgtcactgatgcttttggcagaatctgtcccatagcaatcattgggtaagtggtttctaagctgccggcggtttgaccttcggagggacttcaaggacagtgatacattgatccacggagaccattttgggggcaccagctttttgccaacacaaggcaaagttttcttttcctgtagttattttactcatctttgtcatttccttccgtactcttttctagaaacagaattaaattgtattgggaattacgaggagggaaaagaattcactcatattttattgttttaatatcttgcatttgtatccctggtaatttatgtttcctaatcctttgtccctctggtttatatttaccatgtctatcaagggtgttgaatgagttagaaccagtaaatagacttttgggagagaatgcggggagggaagggaatggggagaggtgaatgaggtttgttttctcgttggtctttcatttggctttgcaaagcaggggatgctgtttgcaggttctgatgagttacagggagtacaagaaggcccagttgttacacgttgtatattactttaattgctgagatacatgagaaagtaaaaacggtgctgggcatacatggaaacctggacatttaacaatgatgcacttctcagtatattgagaaccatgtttctttctgcctagacccactcagtcctgactgccatgttagctattttcatttctctctgattggccctgagtggtagctgactatcctgggcagaaagaacctccatttgctctgagcccttcattgggtgtagtgatcccctcatatctcatcgtgtatacagtgggcacccggcttagggaaactgagtgtgcttttcctcacactgaatttgcctttgtgctttagtttcacaggaaaacaaggtacatatcagaatatttattcttagatgctgacatacactagtctttctgcacacactttgaatcccctcctcacaaccagctggaatcagtctctgctttcgcatgatataattcttgccaggaaggtttccattttgctagatccttgtgccattactgattcaataatctgtcctataaaaatgatggccctggtgcataaagatgtgtgtacaaggatatttactgtaactttaagtgatttggtaaagcccaggaaaccacttgaatgtccctcataggaaatagtagaactgtggtaaggtatggcataatagatgagaaggactgaggaaaatagataaattatagctagatggagtgatgtaattgtaaaacaaatgacaaactctgcttggggtgtatatgggaacaggaaaacgtggagggtaatatagaaagaaataaaccaa

SEQ ID NO: 57952 - DNA, 859 bp, Bovine  19866881244040
tggcccccagaagactggggacccttgacataaatggctgctcataactaacatgcatctatgcccactggtgaccccaggagtgccctacagcttcttcaaaaaggaagcaccagtgcatttacagtttataaatagctcaaaatgtggacacagagatgtctttttaaatctcacccattccccaagaactcccatttaggtgggtaatcatgaattcataatttaattctcaagtcactttctggaaatgctggtttggagctgaattcccagcactggaaactctcctcttggtcccagttgcacacaatgcatttcggcacaagggagggtgagaggcctctcccagggatattgcaagtggtgctctgctcattttatgaatccttttgaacccagcatctgtgctcagtgagctgtttcaagcatctcatttctgtttttgctgaacccgttctgaaaggtcaatatctacccacacctggtgacagaaatttgggagagttgctaatgtagtcattggcgacatttttcaccctggtcgtggtaatgaccttggatgtgactgccttgcaaccacagaaggcctaacctagtgcccaaacccctttatagtccataatgccaaagtttttaatagcacatctatcaaatgcatttttctgttctgttctttttataataaatgggaaaagaaaaatgagtcaccataactctattgtatagagtcctggcataggtaatagttgctaagagagtgagaattaggcacaaaccccattatgtcttggtctcaaagaaaggcctgggttataaggatataaaaaagaatttaaataaattctccaggcactgc

SEQ ID NO: 57953 - DNA, 1798 bp, Bovine  19866881268932
tgtctttctctttctctaatttctttctctttttcactctaactctgactccttccaacttcatatcacataaaagaaaacagagaccaatggaagtaaatgatccatctagttagtgctgggattaagacagaaatctgatttcttgtctcctagttcaatactttaatagatgtgagaattctttgatcatttttaagaataaaaccaagtaactttaacaaacattcactatttttcctaaaagctccagattttcgttcaaggatcccagagtaaccactatctaaaaagctgaccagccatgcatttagactatgaggcagatccactgtagcatctgtcatgtcatcaaactctaatattgagttctgtgatctatttggtttgatgagctatcccctcttcccatccaatctacataacacctgaaaatatgactttaacagacagatcaaggcaggtacaggagtagccacacttccattcattttctttttatcaatgtacaaaaaaaaatatatatatatatatatatatatatatagagagagagagagagagagagagagagagagaaagagagaaatggggttggaagctgcagtctaaattagctcctgaagtttcagttatcttggtatgtatagtttaagtgagattcttctaaaatgaattaggtgatagcataaaattcatattatattccaaatacaaatccagactcactgatgaaaatctaagtgtaattcccaatccttccctttttccttttcatctccaagtgccagcctttctcccacttcagagaccccttacctctaatgtttctttccttctttttttttttttaactttcttttttttccttgtcctcttcctcttgatactcctcaatctgtatgctctgtacaagtgggaaagccagacttagaaggtgtgggtaaggcagagatgagaagaggtaatgaccaattttgtatgtacagttctgggtcactggagggaccagaagaagctctcatatgccccaggcctggggacaaaacaagcactactcctgttagaagacattaatagagcaatcagggggtggattgctcagatggagcagcagcagggaccaatctgcctaagatctgagtcttggtttgttttgtgtagaaacttttggtatgtgtacttccagagagcatcagccttgtcaactagactcacataggactgatttctaaatctctgtgcctgtttactcaactgcaatgtgactgatctagttttgcagccacaatggtcctatctgtttgttcaccctttcttggcccaagatgtggaattagtgactagaaaattggaaaccatagaaaaaggattggaattcttagtatgttatttaatctgacctgtaatggaacctagaaaattattcccatccctccatgatgattctgttatatttttttaaatttctttatttggccgtgctgggtcttggagttgtcacacaggatctttggtcttcactggggcatgtgggatctttacttgcatcatgtgggctctaccagggatcaaccccagggctcctgcattgggagtgtggagtcttagccactggaccaccgggggaagttctgatcctgttataattaactgtgtgtctgttcattcattcagtatgtatttagtgtacttcttcaatgtttcagtcactgtcctaggttcttgtatttatcaatgagcacagtaggcgaagatcccttccttaattttctacatccttcagaacatgctttaa

SEQ ID NO: 57954 - DNA, 963 bp, Bovine  19866881423228
catagaaaacagataccgcacactcagtaatcttggagtgagactgctagtctgtgagaacgaaaaaccggtctcttcggaattatggggtcacctttaaaatctcttcttttccttctttcttttcattttgactgtatatagtattggaagcaaatcatgttttcttgtattttctgaaacatttgtgaccagagggcaaagctttgtactcaagggatagagagtttatagatctgcttggaaatgcattttgccatttttttaaactcaattttataaatccctggatttatcacacttcaggaaaaaatctaagtggcattgcacaccacaaagggacaaggcagaataaaaatccctccgcctcgaagactatgaagcggatggcccaagtatggaagagtgaaaaccttgacatggcaacatattcagatttgctccaccccatcaagtctttctggagaaggaaatggcagcccactccagtatttttgtctggagaattccatggagcctggcaggctacatgactgagcaactattactcattcatcaagtctttgaccgcacgtctcttccttatttttgaactgcattcttagtggaaaggcctttttctgaccgtggacacacatcagagtagcttatacatcttgaatttcaattatgtgccaggccctctataagtggttaaatttagaagtttcaacatttttgaagttcttctcaaaacctcaggaagttacccatcatatttgcattgcagaaatgaggaaacactctcaaacttccatagctattaagtgttagagcctggataatcagctttgtagcttggtttcaagggattgccacacttaacctaaaattgagaatggattaacaatgaagttgttttatcctgcacgcctgcaggaaacctccaaagaataaagaaaagaattcagattcacttaaaag

SEQ ID NO: 57955 - DNA, 1882 bp, Bovine  19866881581919
catcacatctggttaatgatgtaattaaggactctacaagacggaaaccataagcacattgtgtagaaagaaaagaaatggtgaagatcagtattaggatgaaagcaacactctttatctgtaggataatttctctgaaacttaagaccatcgggtcacttttgtattcatagtttgctgttttccttattagaaagggattctaaatgttaaaaggaaaggattgaatgtatcatggctccatagaaacgataagcttgatactctgctcaaaaactttccatccttgacaggaaaattaacctacacagatcgctggggtatttaatgaaatgttacatagcagttactctcatactttttagtctgacaaatttatgaggctagagtgagatattactgggtgctacaaaactcaacaactgatggcccaaaagactctgatggatttgggatagctgatcattttcagtttgtattgtaggtccaaggagaaggatttggatttgagaagccaagaggttgtttatgggcttggaggttcacaaaaattacacaggattcaaattacctatgggctaaacgggggtttaagaccaacaaccaggatgtaaggacctactgcctttatacatcatcagagatagaccagagatagatcaagaggaatgtaaagtgtctcaggtcagaagcagctcagaaaccaaatcataagttagtaaaattgttttatcaatgacttgaagaaaactagtttccagaaattcaaggaaggtagaaaagaaagactgaacctggagtgggtagcctaccccttctccagagatcttcccaacccaggaattgaactggagtgcagaacacagcaaatcagagaaacagatcaatagatctggtgtccagaggacaggcacgagtccatgcatcacacagggtctgcttgcaagagacctggaggaattcctgggatgacaagaggagccccttcagaggaggatcagagtctgcacaactgcaggcagtggctcacggacaaagctgaggggccagcccaccctgacacaaaggaacagggctctattcaagatcttctgtgccccatgactacagactttctccctctgttagaagaccagattactcaagcaagtaccacaggacatatcacaatgaatattacatttctgaaaaggcttctgtggttaaacaagttgggaaacactggatgtttttatctgtttaaacatttaaaagggtgtctttaatgtcttggttctccttcgtgttacatacagccctgtccatgaaaatctacagtcttagtaacatcaagagaaacacatagaccaagtgcatgtatgtgtgggtgcagacagcctgcattttgcagaaaacaaaccaaaaacagataacctcatgaactgaagccaaaaccccttaatctttgattcaagaatagacagtgaagttttattctggttttcatttagcaaggcaatcctcacaggcagtatctctctagtatacaatcagaccttatacagagaaatagcttgtggtctacttgctaagcttctgcccaattagaccaatatttcttccttgaaaactcctgattttcccataacattgcattgccattctgagtgcacagctcaagctcagccagatcacattaaagtggcaaaatcctgcagccattctcatgtcaaagttactattggatggtcattccctttcattgcatcatttattctcttcaagcaatttgtaaagcaaacaagaggagcattgcaagttacaataaaattacagaaactattttaaagctaaagcttatattcagggaatgaatgttttttgcccaaccacacactgctaa

SEQ ID NO: 57956 - DNA, 1377 bp, Bovine  19866881603578
ctgagccttacactttatgcctatcttggaataaacattcttaaggttgtcaagaatgtatacaaaggtaaatttgcatgtatttgaattttgcccaaggggaatttatggttggaggaaaataactgaatatttgaagtaatttggaaggaataaggtccttccacataccacatctaggaagcatgaaagatagtcagatttttcacgtgaaactctttatggtaagactgaaatgaaaatcatgtttaaagcctaaatttaaacattctttcatattaataaagctgcgctcattaataattcatagaagagacctgccactgtaaaatgaaccattagatttattcattaatttatttttattcttttacaacctaaagcaaacatgtgggtacatattgaaaaagagctgtatattggaaaaaaaaaaaaaaagaatggatagaggagagaaatttcagaaaattttatccctcaattaacaacaggaatattagagaattcttggcagtccagaggttaagactctgtgcttccactgtagcggacatgcatgcaatccctgatgggggaactaaataaataaaaggaatactgttctttcacagcaaaaaaaattgtatccacaaatgtaatattaaccacgtaactaacttatttctagactgtgttaagtaactatcacttttccttccattctgtttaaaagttcctcctttaagcaaaactgaaaggcaggtccagttcttggtgcctcactttgctgtctgtttcttccaatctccctccagaccccctttgaattctctgctttcaggctgaggagtttagtacttttatcatcctctaatttatccttccaaaatgaaaagtaatttgatacatttcctcaaattaaggtactaggaaattaattatctgctaatctcattaattatctgctaatctcatgcaattttaaaggaaaattgcagagaaagaaaaatgcctgaccatcctaaactactcattaattatggaatctcaggttttgtgagaagatattttaaagtgatgagaaagttacagaatactctcaaattgtacaatggacatggtgaccgggcctatttattttcctggattgtcagaagattgagacaaattatacatattgagacaaacactacatcctgtaggtcttcagttccagtcagttgctcagtcgtgtctgactctttgcgaccccatgaatcacagcacaccaggcctccctgtccatcaccaactcccagagttcactcagactcacgtccatcgagtcagtgatgccatccagccatctcatcctctgtcgtccccttctcctcctgcccccaatacctcccagcatca

SEQ ID NO: 57957 - DNA, 1137 bp, Bovine  19866881873914
actatagattgacttttaaaaagaagatagccagcttttattaaattatcccttctttttccccctaatccctggatggtctctttttactttggccaaaacttgggagtaagatccattcttggggcaagaccagggctattatgtttaattaatttccgtagctatattttctaagtcttgggaaatgagttagccagtcgggagcaactgcatgctctggggctgggctgcatttagtccacagcgggcatcataggaaaccccctcctgttccctcttgctctggcactgagccttggctggggacctcttgccggctggtcttcatttatgctaaacctctccccttattggatacatacaaaaggtgcctgcagtgccagctctggggtttggcccaaacgattctaattgtccccttatccaatattcaaagataaggctcagccattaggcccttgtaaagcaatatacaaacattggcttccggacaaggttagtaataagatactttgtatgtcatacttgagggatgcaaaaacgatagcgggcccccattcctgttctcacacattttgtagctcgtatatgtttatatttcctgcttcaaatgtgccaggcggagctgcagcaattcaagaccctggaattgatacaacctgaccatctgaaatttacttcaggaactagttagccttcttatcaaaaggagaaaccttctgcttctgacagccttctcagttaaaattaggaaatggatcatgatagatcaatattgcaaccccagcaccactgtgcattaaagcttcaccatcatccctcacctcccacgacccccctcaacaaaacctctacaccttgctctagagagaccgaagtgtatagaattaaaacagtaagagagttaggtcagccacagggttacccttaacagaagatgattcgagaggtttcttttaaaatggagttgatgccttaaagatagcttattaacatcccccatttatcactgctgctaagctgctaggtcacttcagtcgtgtccgactctatgtgatcccatagacggcagcccaccagggtcccctgtccctgggattctccaggcaagaacactaaatgatggtaaatatt

SEQ ID NO: 57958 - DNA, 1015 bp, Bovine  19866881938694
cctctgccgtccccttctccttccgccttcaatcattcccagcatcagagtgtttttcaaatgaggcaattcttcatatcaggtgaccaaagcattggaatttccgcttcagcattccttcccaatgaatattcaggactgatttcctttaggatggactgtttggatctccttgctgtccacaggactctcaagagtcttctcctacaccacagttcaaaagcatcagttcttcggtgctcagctgtctttatagtccaactctcacatccatacatgactactagaaaaaccatagctttgactttgttggcaaagtgatatctctgctttttaatatgctgtctaggttggtcataacttttcttccaaggagcaagcatcttttaatttcatggctgcagtcaccatctgcagtgattttggagcccagaaaaataaagtctgtcactggttccattgtttccccatttatttgccatgaaatgatgggaccagatgccatggtcttagttttaagaatatttataacactactgaattgtacccttaaaaatggttaagaagggaaactatatgttgcatgtaatttgtcacaatttgaaaaaaaaatggattttgcaattagttgaggaaataaatgtaagaaaacttataaaaactaaatacaaataagttgtctagaaagtaatttagcactatatcaggagacttaagaatgtccataccctctttaggtatatcttaagaaaataatcagaaatatggtcaggaatcatttaatgctcttcactgaagcattatttatgattttaaaaaggcatacttagtcctcaaccagaggttgagttaaatgaaggttggtatgtccataggaaggaaaatgcagctttttaaaacttgttttgaaatatacttaatgatgtgaggaatattaaaaattctgttatagaaaaagcatacatagtatacaaagctgcaagttcaatatattccacttctttaaaacgtaagg

SEQ ID NO: 57959 - DNA, 1609 bp, Bovine  19866880828520
cagactttaaaagtggtccacattaaaaaaaaaaaaaaaaaatttaaaaacatgcaagagaaagaaaaggaaaccaaatggcccagaccattaggacagttctccaaatccaaatagcagtatgtgaaataaccctatccctgagactcaagcagagattagaccttcacaaggctacaaatcacctttacaagcttttgaactcttccgccactattggctcaccctaaacaatctgtcaccacatagcaagtatggcccggctgtttccagaagggcacattgtatgagtcatacatgacttagtgaataaacaaacaaaaaataaagtcatcagtccaccaggcctgatagatgggattgttaaggacaatggcatgttctatgaggtatcctaacttactaccaaagaatagatgttattagcagttaatattgtctattcttttcccagctgaatttttaaagactgtggaaagtgatgtaaacctcaatgttattgcagaatcaagaagcaactacctccctagttccataacaaatgctgatcaaatacatgtgaattggaaaggcatatttaatttgcaggtttctgtctacatggtctgcttctattttctttgataagattagtgaacaaagtttagaggactttttttagttcaaacattttcccataatggcaaatcagtctgcttgggcaaagagaacatcaaaacattaaccatcaggagctaacatgggaagttgatctgatttacacataaaaacacctgctaaaacttaaatgaaactttatagaggaagaaaactggataaaggattttttgcatcttttcaagcagtgactacaataattgcaagagtatggacaaatggtaccaagtctaattaatcttgtatatcttctgcgctgttgcaaaatacatttcataccagggtagagtaagtacacagcaggcaaaatgtggtagctgaagtcaagcatagctaatatgctgcttagaacaggtgagatctacagaattccctgatccatcctgattggctctggtatagagaactgattcctagcatgctttttttctatgacttttctgtccatgatatatataggctgcttggatctaaacagatacaggagatggtagcagtatgtgagcagaaagcctactctattttacatggcagtattatgtatgatagtaaggcaatttgtcatgccaagactggtaggtgggagccagcagcaggtctcagactctcccaccagagttaacaacagcttagagaaatgggccagggcaggggcaggatgatagcatggagaagaacaaaatggtaacctgacacccactgagccagcaacaccacaagatgtaacaaagtctcagagataaaggaggccagtcatcagaatgggcttctcagatggctccatggtaaagaatccacctgcaaatacaggagatgtgtgtttgatcccttggtcgggaaggtccctggagaaggaaatggcaacccactccaggattcttgcctgggacatcccatggacagaagagcttggaaagctacagtccatgggatagtaaagagtcagacatga

SEQ ID NO: 57960 - DNA, 787 bp, Bovine  19866881233146
gtcctgtcttcagttctctctcccagttgctataacattttattataatgagtataaataagagatctctttattaaaaatggatagaatctcaattctcaactatgtccataccttgaaacattttattctcatgtgaggcattttgaagagagaggtcctttcatggcctctcttccaaagcatgaaacattaattgaccttgactgtggatgcccaccatttccactgcaggtgaaggcagtgggcagcatggttagcctgattgaactgtgcaatgccaagctgctcatgtgacctcttctaatgagactgtgtgtgtgtggagccctcaagtaaagaatgaaacattcattgaaatttggccagggtagtggtgggggatggtggtggtggtagaatataaattagagttggaaaagtcttacaaatgattaaattaggtcaaagcggtttatatatattatgataaagctggaattagttttctgcttctttactgaattgataaaatctgtcaactatttttgcattattatagacaaagtcttggtgtttcttttggttggtgatgtttttgtaaaggccaagttatttccataatttataatcacctgagatttggtacagatagcaattgttcaccaccgtctgtcttttgaaagacatttttgcattatttccaaggccttcagaattcatgtaaaataatacacagaaggcctgaaatacctcattggcttttcaggatatccttaggacagattacacttgccagaaacaggtt

SEQ ID NO: 57961 - DNA, 927 bp, Bovine  19866881423476
agggggtatggcttgctctgttttcccatttcttgatgagcagactaatgcacactgcagtgatgtgttccccagtacaattatagccaggacttcaaccagagagccatgtctgggtctagccttgctagcatatatggctttgataacgcaggactaaagagtctcactctttggcattcattgttcctaggaaaattccagctggaatctccacactatgtactttaatagcacagggaataccacatcaggaaactaataatttctccccgccgaaatgacctcttctttctaaacaggggcccagtaattctccttggaaaattatagttctgttactagagtgtctcttcatctggaaggaaaactgcccattcatacggccaggcaaggatgaataaaacatgctggtggagaaatacactaggcgtgaggtcccattcattccattctactgtgtcagcacattctgcagaggtaagtttcctagactgccacaacattttgctatttcttacttaaaatagaggcggagggtagcatgtggcttcctatcatgttaaagcagacttgtatccaagaatagtgtgcaaaagtagaagtgttcctgtttatcaaagatatgtaagaggttgacacttcgaaaataatgcctctgcttagaagcctctggagcatcaatacaaatctgaagatctcaaagttatccagcttcttctaactaatcagtgacatcccgcagagacagtcttcatacaaagtggaattagtatttgcaaatcttgaaggtagtgttcggtccagtaagacaatgaatgactacaatggtccttaattgaggacataaggattaagaaagcagaagaactcattaccctatcatggcaactggataattatcatcaatagtgctatgcatattta

SEQ ID NO: 57962 - DNA, 1506 bp, Bovine  19866881866935
aaactgagttactttgctgtacagcagagattggctcaacattgtaaatcaattctatttcaatttttaacaaagaagaaacacttcatatatataaaagaacctagataaagtatgtttgcctgtgtatgtgtgtgtatgctctctaaactaataatcctctaaggacaaaaaaaccatgactttgaacaagtatataccttaaatgaaaataaaggatcaaaacatattggggagaataagaagaaaaagctttgtatttataactactataatggagtgagtccctggtaggaaaagtggaagctttcataggaaaacatatcgtttctgaaacatggaaacactgtcacactaactaaaacacagtctctgaacataataggaattatcccactttgtttaatgaaaggacaaacttgactctattttagtgagctcagactgtcagctactttcaagcacataagctctatttccttagttatttatgtaatttatgaataaatactagaattagagtttatttgcaagataaattgcaaaattggaaaggataaaaaattccatttacatagtagaaaaacccataataaatttggagctatacctaataaaatgtatgtcttttaaggaaatattatgagcttttattgaattccataaacaatgaacaaaatttaaataatagaagatatataccttttaaattgtttggaagattcaatatcatacataaatcaattctccacaaattaacttgcagttcagtgcaatttcaatcaaacgctccaacagtttttttttttcccctagaacttggcaaacttgccctaaaatctatgtggaaagagggtaaagattagtcaagagtctctacagcagaaaaacaatatgagactagctctataagatattaagaattgttattcacttatattaacaaaaatgtgatattagtacaaggacagacaagtgtaccaatagaacaaaattgaaattccagaagcaaactcgtacatatatgaggacttggtttatgacagaggagacattacaaaccaatagaatagtcctgggaaaattggctatgtagatggtaaaaaaaaattcctaccctatactatacagaaatgtaaactcaagatggatttaagatataaaagttaaaagcaagaattatttgatcctgaaaacgacaaagactaccttaatgatctcaaagtagggaaaggtttcttaaaagcacaaaatggaaattatacaagatagatacatttgccttcattaaatgtaaagactagttgatgaagtatgcaccacaaagaaaattttaaataatgagccacaggttggtgggagctatttttagctcttacaaataaagaaggattaacatctagaagggagaggggacattaatatctagaggagaaggggacgccacatgatgatatggttggatgggatcaccaactcgatggacatgagtttgagtgagctctg

SEQ ID NO: 57963 - DNA, 945 bp, Bovine  19866880421121
ccagagtgatggtagcccaagggcacaaagaattcccacccaggtgttctttctttcctagatgacactgacatctgatctaaagtcaaagcttctcatcctaaattagactcacaatccccccagctcctccttctcctttgcatcttctccctctggataaaaatgcccagtttacactttgctgtcctgagccatgctgggcacaacctctagtacctctaagtgctggacagacaatagatatttggtaaattatatttataataaaagacaatagaaatggagctctaagatttttctctcattaccctaagtttcttaaagtacagatcaaaagcaaggtttaccacatatccacaagtctgaaataacagcttgtaaggcacaccagcttttatgttccgaaaagaaaggaaaaccccatcaattaaaacatgacactgctgctgctgctaagtcgcttcagttgtgtccgactgtgtgcgaccccatagacggcagcccaccaggctgccccgtccctgggattctccaggcaagaacactggagtgggttgccatttccttctccaatgcatgaaagtgaaaagtgaaagtgaagtcactcagtcgtgtccgacttagcagccccatggactgcagcctaccaggctcctccgtccatgggattttccaggcaagagtactggagtgggatgccattgccttctccgtaaaacatgacacagtgcttccttattgtgtcgggtataagccacaacttgatttcataggtgttaaaatatgaaagaaatatgcatcttagaagagatgaaatgaagtctatttaccccttcccaaaagtacagatttctccttttgattctgatgaattcttaggttagcccacttcaaactgtctcagttttagccccagctccactccttacattgcatttatgt

SEQ ID NO: 57964 - DNA, 1128 bp, Bovine  19866880520727
gatgctggtggggaacagtacagtctgggagagtcctaggtgctttcccggggtctgacatgaaaatagctctgagttctgcaacatttctttagtgtcaatgtactgacatcctgtgtgtgttaactagctcctgccctacttcaaggatcatgagttctgagctgtctttctcccataagagggaccctgtggagggctggtgctttgtggggtaagacacttgtttccttataaagctgagactctgatcttaaattcctgctgcctcaggttcagaatgaccagtgccagcccaatgcagatgactcgaggtggatgaaaaccacagagaaaggatgggaatttcacagtgtgagtatcagagcagccctctccctagagaccccagaaaagggaccaaggaacaaaggcctcttcctcccagtctgggcctccacccttctctccttggagggcaggagcctgacaacatgaggatgctgtagtttctctcgtgagttgacataatatggatgtgaactgactcgatcctctggcttgatcccaaggaccagagctctgcaggtttaaagggcccagttcctggggctgggcatggataaacagaaccagagaagaaaaaggagggagattccgccttgctgttgtcagtatcttcaggtcccttcattggtctcaccgcagaaatgctcatgatatatgtgattgagggagacaagggagaggacattgagagagttggaggaggaggcttcggaggagcgaggaactgagccaagggggcagaagggcaatgctgaggaggcggagggagaggagcagaagaggagctgccatgcaggctgcaacaggaggggtccctccaggaggctgatgcaatggaccagcagcatctgtctctgtgagtgaactctttcctgtttgtggtttttaggtcgagctaaatcgaggcaataacgttctctactggagaaccacagccttctcagtgtggtccaaagtctccaagcccgtgctggtgagaaacattgccataacaggtatggattgtagacagtggggttgggtctggggtctgatgctgacttctgcagggagggtgggggttagtccccacagccctca

SEQ ID NO: 57965 - DNA, 1065 bp, Bovine  19866880798104
cagccttgaccctcagtcattgccaagtgtcaccaacagagactctggcccaggcttctgccatcactgggcaaactggagatgggtgagtggagaatcagctctagaatgtctgttctgctctggtcaaccgaatcctaaaggcaaacagaggcctggctcttgctgaagcagacttggctgtagcccagagccaagatccggggccaggagtgcctggaaatgtgcttgggcaggtggtggctttttttatataagattttttttttaatgtggaccatttttaaagtttttattgaatttgttacaatactgtttctgttttacattttggttttttggccacaaggcatgtggggtcttagctccttaatcagggagcaaaccttcaccccctgcattggaaggcgaagtcctaagcactggaccacaaaagaagcccttgggcaggtggttttagaaaagactcctggcagttgaccaagtttctgcacccacagactccagtccctctcacataaagctggaatcaagtcacccctgctgctgctgctgtgtcacttcagtcgtgtccgactctgtgcaaccccatagacagcagccgaccaggctccaccatccctgggattctccaggcaagaacactggagtgggttgccatttccttctccaatgcgtgaaagtgaaaagtgaaagggaagtcgctcagtcatgtctgactcttagtgactccatggactgcagcctaccaggctcctctgtccatgggattttccaggcaagagtactggagtgggttgccatttccttctccacatttctgtgtgacaatccctaaataactgtgttttgcctgcaacagacactccacaggtattttagaaaatgtcatattgttgtaaattgaagcaaagtctgctaatccaaactccaagctggtagagacatctctgattgacctgagagatggttagagcagttggttaacagagattcgaaagatctagaggcagaggtatgtactcttcaaattatttagcagacattggatctatactaaaatca

SEQ ID NO: 57966 - DNA, 1034 bp, Bovine  19866881610790
ttgcaaaatctgatgatctgaagattcttcctccatgacttcctccagatacctctgctgttaaaatcacctggtcagggagaaggaagttcagaaccagggtataatactataaaagtacatgaagttcctccaccattttcaccagacatttgttcaaaaattttagttccaaaagtaagaagagttataaaaatagattagttgatacactctcttcctgaagtattagtcttacgaaaaaaaatactgtcctgagacagtgcattgtatctatgaagataagcttgatcagtctgagattagccagtttccccaaagactagaatgttgtctttagacgtatacctcgtaacactaaacaaccaccgcataattatgaagagttttgatgcatcttagacaaggtccaaagaaaacaacttgtgtgcaaaatgccaatcttttgtaatcagtattaaattgtttcattttattatattgtaaatattgtaatagtaaactaaacatattgctgtgtatcactggaccattcaaatatcaacatctgacggccttgcacatggtattatgcacagttttgtacacgtatggtatagtctcaccttcccagagttctcaggaccaagtagccatgccaaattcagtccgaatgaatgtgttattgatgagatttgtgatatccttaaagttctttccatcagtcctcactgagagggaaaaaaaggacaaatttagaatgcagaggtcatgggcactgttgggtttgtacctagcctccctcactctccggcactcaccctcctgattctacccctccccgcggtggtgggcctaattagtggaaggaagttccaatccctcatgggtgacagggtcaggaatgaggaaaggacctagactgagccagtaagaaaaaagtgggagaacctgggatcaattaggaaacacacttaagacaatcacttaatgaaatggtctgtcttccttaaggattcagtggttcttaaccagggtatttttgccccatgccc

SEQ ID NO: 57967 - DNA, 3092 bp, Bovine  19866880408109
ccttgatgtactcctttcctgatttggaattagtctgttgttccatgtccagttctacctgttgcttcttgacctgcatacagatttctcaggaggcaggtcaggtggtctggtattcccatctctttaagaatttttcatagtttgttggattccacataatcaaagcctttggcatagtcaataaagcagaaatagatgtttttctggaactctcttgctttttcgatgatccaatggatgttggcaatttaatttctggatcctctgccttttctaaatacagtttgaacatctggaagttcactgtttacatactgttgaagcctggcttcaagaattttgagcattactttgctagtgtgtgagatgagtgcaattgtgtggtagtttgagctttctttggcattggctttctttgggactggaatgaaaactgaccttttccagtcctgtggtcactgctgagttttccaaatttgctttcatattgagtgtagcactttcacagcatcagcttttaggatttgaaatagctcaactggaattccatcacctccactagctttgtttttagtgatacttcttctctaatcatctctaaatatggtttctggacatctctgattgctttgtagaacagacatcagagaaattcctgcctacttctagttgttttctggaacttgctctgcttgtcttccagctccagtcacatagttactgtgggacctgacatgtgacatgagtgtaactctacccaagactctagctctaggggtgagcaaggcatgtacttgaactctgggctgatgagtaaggattacttacttactttgggatttttagaaagagttctttcacctgtcttattatctgaagctccaagatgtatgactctggagctcttaagggctatggttttgctttgtgtaaatcatgggcttccagtaaaagagaagaatgaaggtgtacacaaagagaaacagagacaggataatatcccagcagtattgtagtctctggttccaatagttcctgggctccaactatatccaacatttgcctagccttggagctgtgagatacctatggctgcatgttaaatggcttcagtcatgtccgactcttagagaacctatggactgtggcccaccaggccttctctgtccatgagattcaccagggaaaaatactggagtgggttgccatgccctcctcccaggagatctttccgacctgggaatctaacacatgtctcttgtgcctcctgcatggacagaaggtttctttacactagcaccacctgggaagatacttccaataattctctcgctttgtcaccaagaatataaactaataaatacatcttgatctcttttgagagctccctgagatgggatttattgcttgaattcaggacaaccagggtagagaaagttaaactgcaatgaagcatctcagattttaacatatagtttctaaaatatgtttatctgaagtctccactgggagagagcacaatataatgggaagattatgtgctttggagtcagacttggatttgaggccaactctatgtttcctagtagaaattgttactctagacagttgactgcactactctgagcctcgtcaaatggagataatattacccacattaaagagttattatcacatggtgtaatgaataatggattaaaggacttggcatagaatctggttcagcataggcacttggcattacacatttcactgagttaaagatgatatcagatgaattaggtatcatgatttgggatatcactgaaaaaggaaaacccaattaatctgtgacatgccattgatgatataaggcattctgattttaaaacttttaaattaaaaaaaaaaaagtgcgtcttagaattgatgaaatgcagtatatttattgggcacagatgatatgagcaataatgttaggcactagtgatataattgaacaagactaatatagcccctcaagatgctggggtctaataattaatacaattcagattttcaaaaggactcacaataaccttacatggtaaattcctggctttcaaaactgcctaggaccaagaagtaaagcaggagagaaatactagactttaatcctcttatatgctgttagatcctatagcagttatattttcatgctctgtatacaatccaaaacaaattgtctgcttacaattaaaatcctgctgagtttccaagagcccggcccccagggagctatttgaacaccatgtcttatccacaatgacgcaattctacttttaagggacaattaaggggtttccttgtaagtcaggccagactttccccaaaatacatgaaggaagtgcctagaaaagaaaatgtttgaggcttgttttcatactgtcatttaagaaaaacaatttccaaaaagaactggattaaaaaaaaaaattaaatttggaaggcttgtacttttatagccctttgcagccttttagtagaacagaacagtgtcccttaggaaacttaatgtaacagtaaccaaatgtccttgttaagcagccatttattggtctattaaatctgatctgaactgtgatattttgcggtaaatctcttcaacataaattgcttaagatgggcttatttaggcatctaccccactagagacggcttcagcatcatcccagcaacgacaaatgtgtttgcatcttcctggagagctcttccaatatgggagatctaaaaagaacattttctttgtctcttttgcttaggaagagttaaaaatggttttagagatcattcagcccaattttactgatgagatggagaccaacaattattcattataggctaggtgctatcttagaccctgaggttggagagataaataagatattttctctgccctcaaggcactcgccatccagtggggatacaagatcagtaaatagagccatgcaaccaagtgagccacccaaataagggcaggcagttgggagaggagaggaaaataaggagccaggattcattcagagagtttaaatgtagagactgtaatgaatagtcttagagaggacaag

SEQ ID NO: 57968 - DNA, 1140 bp, Bovine  19866880416880
attctccaggcaagaatactggagtgggttgccatttccttctctagatcacacagctagtaggtaccaatactgagactagaattgatgattttccaagtgtaaaggcatgtgctcctgtgataccacgctgccttccccaatcctgtaaagactagcttctatctaagtacctcttctctgatcccagagcctactgctgtccctgcccgttggttggtggcctggaatcatgcctgacttttctcagctcctttccctggggactgggttctggagtctgtccttgctggttggtacctcctgcatgtggacagatcttccccaaaggtggcaaattcctacctggttccagagaatgcaaactggagttccctctccagacacatccacctttgagaatgaatgtaaatgggttagaagcaaactaacccactcccgtggcttccctgtttggtcttctaggttgccttgctcctgagctggcttgagtggggccgagaggtcaatccccccatcttgccttctcccagtttcatctccccgttcactcagtcatgctgctactgctgctgctgctgctaagtcgcttcagtcatgtccgactctgtgcgaccccatagacggcagcccaccaggctcccccgtccctgggattctccaggcaagaaccattggagtgggtactcagtcatgctaggtatccataatgccttgtactccagcctgacccatgacaactgtgagctgttgtttttcattatgtcactcaactccaattataaaagcaacagtctcattgtgccatttcccactcttatgacaaaccattcctctccacagcaaatgctgcagaagcatcaagggaggagttacacttaaagttttataacctacgtaagtactaattaaaactcctccaaggtgttcaaaggatgctaccaccggatcaatttgcaacagattcaacagaggaaaagcagattaagaaatagaatatttaaaccctgcaaatcatttccttggaaaagctctctgtatcttgtcagagaagcgagtcatcttcctgcgtgaagtgttcctactcacttccggtgagtaatgagaggggcattcaggtctggacacagccgctgtgca

SEQ ID NO: 57969 - DNA, 2480 bp, Bovine  19866880486110
accctgatgctgagaaagactgcaggcaaaaagagaaggggaaggcagaggatgagatggttagatagcataactgactcaatggacatgaattcgagcaagctctgggaaatagtgaaggacagaggagcctggtgtgctgccgtccatggggtcacagagcgtcagacaagacttagtgactgaacaacaacaatgctgtcacccatctctctttttatgaagaacatcaagagcaccttaaatgcctgtgaactggcagatttcaaaagaatcacttttatgatgttatagtggcccaatatttgttcttgtccaatattaaatgagttgatattaagcaaaactcatcctctactttgtggaattcactagaaggtgggaaggactgctgtcaatcaagagctcatcaagaaggcttttccaacagcagagccaaggaggagagtctaccgtgaaccacactattgaagaatgagatttcacagaaacccctccctctctatgctctcagggttcccacttagaatcccagctctcttgcaccatcttagaatcaaatccaaaatccttatgcttactaagttctttaattagtgttcttaagtctatgacacccacttttaataataaatatttaaaatatctctttaaaaatcctgaaatggaaaccatactacccacccacccataaagctcaaaaacaaccacaaagaaaaaataaaaggaagatacttataataaaacaatatgtattttaaaaaagagatccttaaatatatctgcatttaactatttaactattaatagctctcattgtgatgaaggaccagtttgttttttaaacttttattcactgaatataataaaactatagctgtaacgtgcaactgctgtagtggttcccaaacaattatgttcactttttgtatgtacctgaccaaggactggtaatagttgatagatgagctctggtccgtggatcccattttgagtagaactgtattagatcaatgaatgttcttaacagctctaccaggtttgtattatgctgagtctccatattatagagaagaaaactgaggccctgagaagttaagtaacttgtctagaacttttctcagattcagatccaggtttattggcacatggccaacacaggactctcagtcctgaatctaagattaggacccctggggtgcacacagtctattggaagaaactgacagataagtaatgggttaattgtgtttttttttaatcttaaagtttttattatcaagtaaaaaactaggggcaaaactctcaccccactgaaattgccttcagcttcaaagtccttctccagtcagtttctcaggaattcacccatcttacctccaaatgaataacataaaccttggaacgatccgaatctctcattcctcattctgactctttgaccagccctcactttgtaaaggactgcgaggtgggggggtgactgttctcatgtccaagttcgacatctttttgagcaacatttgtgcccctcctgaaggagtgtggaggggacatgacaagaaattaattggtgcatctgttctcatgtctgctcatgagcagcctgtgatcacaaacaactcatttgggggcacgtcaatctctccctcagaggtaccacccccacaccatttgcggaccgcacactctggcgtgtgaatcacctcccaggatgagcgactattgactcacagcttcagagagcttcctattgaaacagcagttgccctaaagccttggaaagagagccaaacaacttttgaaggaaatgaacaccatccctttgtcaactgtgaggctgttacagctggaaatgggccccgcttcctatcagcaacagtatccaagtgtctgcaggctcccaaggcccagacctaccacagcctgatgggtggcttcttgagtcatgccagcagtgctcctcaaagggctctgagacctatctatttaggagaggcattaaatgagaacttactatgcgctgggcactatgcaaaataatctacaaacactactgcatttattctcaaaaaaacactaatataaggtagatgctattgtgatttccattttacaattgattgaaactgaggcacagagtggttaagaatgtatccaaagttagagtgttggaaggcaaaagagccaaggcaatttggccccaggatgctctcaagtgctgaactgtagtgaacattttgcctcagaggaggtgtctcatcatctgtgggagcattctttgacacttatggaacatctgctttggcctcagttatgctgcagaatgatgcaaagaacatggcatcacacctggtgagttcctcagcttttccatagcatctgtattctcatcttgtgatggggattcaatttctccttatagagtccgggggtagatccaaggagataatgtatcaaaagcgcattatacacaacgg

SEQ ID NO: 57970 - DNA, 1590 bp, Bovine  19866880496705
ctagagtcggacacgactgagcgacttcacttttcacttttcactttcatgcattggagaaggaaatggcaacccactccagtgttcttgcctggagaatcccagggatggcggagcctggtgggctgccatctatggggttgcgcagagtcagacacgactgaagcgacttagcagcagcagcagcagcagcagcagtatcatcaaatagctagtcattgttttaatttctgtttatctcagggcttccctagtagctcagctggtaaagaatccgcctgcaatgcaggagaccctggttcaattcctgggttgggaagatcccctggagaagggataggctacccactccagtattcttgggcttccctggtggctcagatggtaaagaatctgcctgcaatgtggaataccttgggttccatccctgggttgggaagatcccttggaggagagcatggcaacccactccagtattcttgcctggaggatcccaggtaactagtcattgttgtaatttctggttatctcataaatgtcatataaatatgaatagaaatatacatgcaaatatttatatacactgtttagtcagatccaaataaagggctgcaacccttttgaaagtgaaagaagatgttctcaatcattaatagatatcactgaggacttttgatttaatcaggggtgaataattacttcagtttattctgttttttcactattacagttatctgaacaagtgtttggcaaaatataaaggaagcctggctcttattattggttctacctcgctcctatttccctaggtctctctgttccctggtgtgcaaatggacatactctgcagagaaaggctgggacgacagtttctggaagatggttggtttggaagacttggttacagataattacagcaaaataggtaaaaaataatatacatttttctgattatgtgtatgtatacatgaagatattggtgtttgctttttgtttgtttttgtctaaattaaaatataggaacacatccctatttttcaaagagaagctagtaagctatgatgggtagtccatgactaataggcctttgtattggggcttacagtaattgagctatggtaatctcttagacatgccactagactggggaagatttttgcatggagcagctggaaataacataatcaaagttatttatggatcattccagtcagaccttggaaaatgtgttgtgatttaggttcaaggaaccaggtaaggccatgaacaggaaaaaaaaaaaaaataattgaagagatcaaaattggaaggatcaagaacaaagcataaactggaatgtgagccagttgttcctgactaaagccttaggacccctgacttccagttttatgtggcactaactaggtagtaaaggagtggatgactagtaggaatttacctgtaaaataattcagatactaggtatatataatggtagctgatatgttaaagtttcaagataaagttcatattcatgtcacagaaagatgcttatttcatatagttactacctacctttctagtaagctgtcttcaggtaagatattacac

SEQ ID NO: 57971 - DNA, 1849 bp, Bovine  19866880523131
cagtattcttacctggaaaactccacgggcagaggagctatagttcatggggtttccaagagtcgggcatgatttagtgactaaagaacaaacaagtttgggggtacacaggtgtacctacaaattctcggagggggttcaagctggtgtgtggaaccattagaccatgagagagtgtggtacagcagcaggttatagtctctacttaaaaagccaataacagggcttggaacttagtagatccttcataaataactgttaatgggtctgtctactccgtgacttcagaagggggttacactgacaagtacatgggtctatggatatggagatactaggaagttagaagcttaggaggcactaggaagactgttacagtgatcagtttcaggtaggattctgcaataattgaatcccaatcagtatttctgctcagggccctgggattcaagacagcgactatccaggggagcaagcacaagaaaggtcaggattgcagaatcaggggccaaggccaaacaagggcacttcatttatttactcatctacacatcctgcccttcatctgttcatccatccaatcctccacccatctttttctatatgaaatctttccataaaacttagcatttgatttccgcctcacttccttctttctcctgccacaaatattttgcgagaagtgattgttagtaagacaggataaagataaaaaggttgtgtctgcacaaaaatacattgaaggtttactaagaaagtcaaaatgctggtttggctttgaatgccgctattccactcagaagaactgaaagatcctaaagctttatagatttactgctgccctttggattgaacctgagattctgggcaggggaggaggacatataggcaggaagcaagtgtagaaaaagaagggaatcgaaaagggaggaacaaagtccctggatcccaaatgtgtatgtcagttggactctggcatgggagatggcaaagtgagaaaataaacattccagatcatctttacatgtgctcagaagtaaaaagcattttcattttgatgatgagaaataaccaaaagctctttctgatattttgttcaaatgaggaccaaccattcttaagtgctgggcacaccaacacagattaagatacagccctgctctggagtacctcacattctaagggagatggcagacatgaagcaaagcaatgtgatggaggagagttgtattgataagatgggccatcgcactcagacttggactttcaagaagaattcccagaagaagtattatggctgaaagctgagttttgaaagaaaggctggagttatccaaacaaagaagtaacaagtgttgtagggagtaggagaagaaccagggcatggaacagtggtggtggtttgtgcggttagagaaaaggtataagcaagaaggagataggtgttaagggcaagaattaggtcatgaagggtcttgtatgcccggatataagacttcaaactttattctgactgctactgagagccatttgaggagtattccacagaactaggatcttaagtcactgagatggaactactggaatttcttggatgcctccaaccatttacctctgggtcctaggctctgatgtctggcctgaaactcacgcagcctctggcttcctcttgtgccttgggagcaagtactgacacccctggcccagaggatgggctcctttccatggtgctgggccacttgggtggagcctcgctaggcagggccttccagaaatgagttgcatgcacatgatgtcagaggggtggcgcatggggaatggagtggggtgtaacctctgctatcactgt

SEQ ID NO: 57972 - DNA, 759 bp, Bovine  19866880569730
cattgtctgtcggacatttttctggacagacagacgtgggtctgggtaccagttctgccactttctagctaggtgacctttgtgtagattccttcatctctctgagctttgctgtcctcatctgtaaaatggggataatgatacccatctctaaaatatgttctgagaagtagattagataaatagagattatacatattaagtatttagtgccctcaatgtcaattaacattgttattaattatattgttattacgaatgactaataatgacactcaggattattactaatgctactataagtaaaaaaaaaagcccaattaaaattttttactgagggaaatatcaacagttttatgagaggtaaataaagaagagtaacactgggtaagaaagtatatgcacgtggcctcatttaatattcaagcagcttcacaaggcaggccttattatccccattatacagatggggaagttgaggctcctggaagttgcctccaacacacactgagttagtacctggtgtcctgacctcctttcttcaaagtgtctcttaagctccagctactccacacctgccagcctcagcagagatgcctgtatctattagggaatgccttttcttcccctaggctcaccgaattacaggaaaatgggagagctctagaaagtggataaaggttacctcctccaggcagtttccttattctctgcctcctccccttgtagaacaaaccctccctctttgttcttccggtg

SEQ ID NO: 57973 - DNA, 2704 bp, Bovine  19866880609290
tagctcaactggaattccatcacctcccactagctttgttcatagtgatgttttctaaggcccacttgacttctcattccaggatgtctggctctagatcagtgatcacaccatcatgattatctgggttgtgaagatcttttttgtacagttcttctctgtattcttgccacctcttcttcatatcttctgcttctgttaggtccataccatttctgtcctttatcaagcccatctttgcatgaaatgtccgcttggtatctctgattttcttgaagagctctctagtctttcccattctgttgttttcctctatttctgtgcattgatcactgaagaaggctttcttatctcttcttgctattctttggaacgctgcattcagatgtttatatctttccttttctcctttggtttttgcttctcttcttttcacagctatttgtaaggcctccccagacagccatcttgcttttttgcatttcttttccatggggatggtcttgatgttttactgccctaaaaatcccctgtgttccacctattcacctctcctttcttgcccctgaaccctggcaaacatcgatcttttaccatcaaatacccttttgatttgctagaaaattcattaaaagtcttgcctaaagacaagagtgttttttcaataatgaaactgatagagaggttacatgacttgttcaaagtcaccaaactaataagtacaggtttctaactcaggtctagctccaaatctctgttctcttcagggtgaccaagtcttttttttaactagaaggagatatttgagcttctgaactgcaggagaggttcagagttcttggtaactattacccctatggatagtgtgtgcatgtagtggtatgggggttaggcagagagatagaaaccatctgacctgcagaggtccccaagaattcctaatatgtgctacagtgggagctgtagctgaatctccccacgccaactgcttctgcacctcagtcaagccagttattaatacgatttacaaatgggaacttagaaatgctaatggccctgattgggctcactaattactccttaatcagctgctaatgagtattagctgccagcctggggtggccgatagggcttatacgcctccagctggccaaagttaaagggaagctggttgtcagtgtcactggccttgaaaataggagaaagccatgggtgagtgaaaagtgtcctcttttcaccttcttctctgtctttttgtctggatgtttgggcccagtcatgcagggatgggaagcaaaggttatttggaggacgtgaggaaccaggaagagcaaggagtgagcagctagcaagcagaggtcagaagacagtcaacaaccaactgttgaatgtggccaacgtcagggattgtgctgagtgctttcctcctgatgctgtcaaggtcatggtttcagagggacagaaaggaagtgaggaaaagttgaatgtgtaggaaagtgaggggaacatgaaggacagaagtcaagaatcagaggtatctgaaggttggcgagaaaaaaaacaaagagaaactaacatttacagaacatgttttaaaaatacttgttagtcatctgaaatcgaccactctctgtgggagatattttaacaataacacctgccatgaattgtgacattcccagcatgtgctgttccccacaatgactatcttcaatagagatttactgtacctattctacagatgtagaaattaggattcacagaggttaagagtcatacctgtgctcgcattgctattatgtagctctgtggtatttctgattgcaatttttaatagctttactgagatagtattgtcatatataaagtatatatgtatttaagatgtacaacttggtattttggtgtgtgtatatattgtggaatgatcaccacaaaacagctaacatatttattatttctacaaagttaccacttgtgtgtaagaagatttaagatttattgatttatccttttagcaattttaagtacatactgcagtgttagattttattttcctggactccaaaatcaatgtggatggtgactgcagccacaaagttaaaagatgcttgctccttggaagaatagctatgacaaacctagacagtgtattaaaaagcagagacatcactttgccaacaaaggtctctctagtcaaagctatggtttttccagtagtcatgtatggatatgagagttggatcataaagaaaactgagtgctgaagaattgatgtttttgaactgtggtgctggggaagactcttgagtcccttggacagcaaggagatcaaaccagttaatcctaaaggaaatcagtcctaaatattcattggaaggactgatgctgaagctgaagggccaattctttggccacctgatgcattgagctgactcattggaaaagactgatgctgggaaagattgagggcaagaggagaaggaggtgacagaggatgagatggttggatggcatcactgactcaatggacatgagtttcagcaaacttggggagatggtgaaggacaggggagcctggcgtgctgcagttcatggggttgcaaagagtcggacgtgacttaactgaagagcaacaacagtgctgatcactgtcatcaccatgtgtgcatcagatctctagacttatcttagctaactgaaa

SEQ ID NO: 57974 - DNA, 1612 bp, Bovine  19866880615311
tacagtaatgttcataacacacttggtgaccagcatactgtaaattgggtgctttactgtttgcatctctcagtatgtgagaaggaaagagattcagaacagttagtgatttctctagtctccaaagcaggtaagcaataacaactcaattttgaaatcaggtctacctctgcagcccagtacctttctccaatcttttatgccctctttgtattagaattataccctttccatatgacttcccatgaaagtgggcaagtatacttcccctacccagccatactgagttttatcatggacaaaggaatggtgggcagaaggaggaaatgacagtatggcagtttgggactgacatacgaagagatatcagctgttacatcacattcttgtctgcttacttgctcatttaccatgagaatagtgaccagagcctacctttcagcttggcccacagaatgagacaaatggaacagacccacccctgacccacgcatcactgaaacttgtagccagaacccaggccacccagccacccctcaagcccatgagttagaaaaaaaatgcttgcagttgtaagtgactgagtcttgggaaatctgttaccttgcattattgtggcaatatcttactaatacacctccatgaatgaatacagacaaacctggtcagttctgcaagtatttcttgagtacctactaggtgtgatgggaagtaaaaaggaatttaaaaccatctctgacctcaaagacagtcttattgctcccttcatctcctttaccaaatgcagtaatggcaaagaaatcacaaatcgttgctttacaaaaattaaaatgcatgcgtgcctgtgtatatactgttaaaaagcatagctccattaaatgatacctaggaatatcaaggcatataggaactcagtagtaggtattaaattagcctttctgggacatgaaataactcagctagggagtggacagggggttccagacaagtcacatagcagaactttaatgttcagctttctctactggggttgggaggaatcagaaactaggattcaaaccctcaggctgctgctttctggctgagtgaccttgggcaagtcatgtgtctctggccttcagatgagcttctagaactctttcctttgcctgaaatggccccgccacctttgtctgcctgtgaggacctttgtagaccacctatctaccaagaagtaagacctcccctctgttgggttccagctacgcttcactgaaagatgttggccccgtggatactctggggtcttgtacacatatctttttcttacaatggatgacgagctgcttcaggacagggcaataccttccacacccttagaccccagcaccaagtacagcgcctggcacaaaataggttttcagtaaatactggctgacttttaactaaactagatggaattgcccctgatatcatccagggcttaaagtattttaaagtacactttctacattgtttttaaaaagggtctcagggctaaatacataaataaaaaagagacgtgcttgaaaaacatgtctacataaacacatatgtatgcaaacaaacttatgccaaacacaacgggagtttt

SEQ ID NO: 57975 - DNA, 1986 bp, Bovine  19866880642913
tgggttgccatttccctctccaatgcatgaaagtgaaaagtgaaagtgaagtggctcagtcgtgtccaactcctagtgaccctatggactgcagcctaccaggctcctccgtccatgggattttccaggcaagaacactggagtggggtgccatttccttctccaatgcatgaaggtgaaaagtgaaagtgaagtggctcagtcgtgtccgactcttatcgaccccatggactgtagcccaccaggctcctctgtccatgggattttccaggcaagagtactggagtggggtgtcattgccttctcctgtataaggctacatacatataaaaatatatgtacatatacaaatgtgagtctggaaagattttaattcagtattgccagaggcatagaggacgagatggatggatggcctcaccgactccatggacgtgagtttgggtaaactctgagagttggtgatggacagggaggcctggcgtgctgcagtccacggggtcgcagaaagtcagacgtgactgggcaactgaactgaaccgagatgatttaagagttcaacatgtcaagagtagaaaagagagggtaaggaattcgagaggaagggtcagcatgaggggaagcctggggaaaactctagggtgccccaagcgtgacgggaaggcctatctccttggattcgggtgagcagaggagaggagtgagcagtgagattggtgctgaccagtttatacttttgtcctctccaatgctctttctccccttcagtttcactttattttcaccactaccctgcatgcatcattgttagtaactgtttcacaggaacagaagctgaggctcccagtgagttttaagagtttctgatgaggctcctcatccagtgactgacagggccatgattaggtccccagccatcaagaaccatatcgttctcctctgttgttccacaaaccagatggcctggtgatcccaggacaccttgattctacagtaaggaccctcaggaactgaattagtcatcagaaggttctttgatgtgcacagcatctgagcaaaggtaatcagatagtctcctgggatatttcatccatgctagtaacgcctaatgaactctcctcgccctgatgcaaacccatccactctggagggaccagaaccctgacaatttcttgctatacaaacttccttcatgtacatccactaaaagacattgcctgatggttgcttcatcattccttcaaaaaactgggttaccagatcactgagttactgccttcttgggctataaatattcactagctacttggacagaacctgggtgtttcccaggcctccttgggactttctgtacattagcttctgctaatagcagatctcttccagggtgtatttgattcatcctgtattcatgcttgtaggaaggaatatcctgaccttatggcaaatcttgaaaaaagataagcaggcacctggaccattatataatcaatcacgctaccagttaggatgcttacacaggccagtaacagaaggcacaatttaaacaaggtcccaggcgaatatagcagctcagcaacatcatcatgggctttcatcttttcctttcaccatcctcagggtgtgagagatgctccttgtgtggactcaagacagcaccaacagggacttcccaggtagtccagtgattaagaatctgccttctagtgcaagggatgggggcttgatccctggttgggaactaagctcccacatgccttgggacaagctccatgtactacagctactaagcctacattccacaaggaaagatcctgtgtgctgaagctaagacctgatgcagccagataaataatgattttttaccaaataagtaaaaatcaaggctctgatagtaagaaataactgagttggaggatggcttttggcactggtagatagtcattattgctctccaccaggtatttccagttttcctcttgggta

SEQ ID NO: 57976 - DNA, 1276 bp, Bovine  19866880662773
attcctgcccttctccctccctgtctgtgtaactcatccctttaggtctggctgggcctctgccctctgcgatttcctctctcaactgaagggccaaatgcttgttgcctgagccactgacaaccccagcccccagggccctgggcacgtcacgtcagtcctttccagatcccacaaaaagaaggaggttcaggggggttcatgtaggcgtgtgatgggattctaggtccaaaatgaaatacctttttttttctcttccataccttttgacttagtaatagacacatgatcactggagaattctgaataatgagtttattaggacctattgtcataaagcagtaggaaattcaagcattattctaatattgtacatggaccagttggttaatttgctccaaaaacaatcactgctcttacagttagtaaaacattaacttggttttggaaggctcattattcattcataatggactcttccaatgacatatgaaacccacatacgaaattgtgggtgaactctagcttttcaatttccttggcatgtttgttgattttaaactgctccttttcaaaactttccttgttaattaaataagccagtcagccatattccctgcttctaattccgcactcaaatgtaagcttagttctggagtcggctttctaaccttggcttaagggacattagtcactgggagcaaaattcggcatgtgaacagctgtttcaagctttcagagtccagggcctacaggtttggagaaggtcggggaaaggaatcagtatttacttactaaatacctatcatgtgctgggcacctttataaagtatagctctttcaattctctaaacagcccattaatatgtgtgtgtgtgtgtgtgtgtgtacaggtttgagatatatcttcttgaggcacagcaaggttaagaacttgtcaaaaatcacatggcttatgagtggtggagctgggactcaaaagcaaatcaattctagagcttaaactcttgaaaactgtccaatgggttccatgtttaactttcccaaccccgagacattattattgacaattattatcagacctgtcttccagatgagaaactagaagctcagaaaagtaattttcccaaaataaactaaattcacacccatctgaactctgtggtccagggcaagtcacttcatccatccatccatccatcacctttccactgattaattgaacagacttaatggcaagtgcttattctgtcccagagattgtctagtccataga

SEQ ID NO: 57977 - DNA, 3434 bp, Bovine  19866880673779
ccgctgtgcacgtgggggaggccgcagcactccagcttccttttcggaaagcagaggtgctgccgccagggccccattgctcctggcttttctccaggcttcaaaacagccagagcttccgaggggcatctgctggtggcatctgccagctctccatccagtgcatcgtggtgtctgtgactgaaagcaagttcccaccagaagccattgccctgggtctctgtgcagggtctgctggctgaaattcatgccagccccaggaaagctctgtgatgctggcaggcagcaatcgcgagcaaaggagagctgcaaggacccaaccttagcttgggccgcagtggcacttaagggaaaaaatacaaaccgacacaaatggattcatgtgatgaatgggtcagtctattcagtaagctggaaaacacatcccacagatctggtggagaatgcaaatgcatgccacccacacagagaaggctgtatgttatctaggtcaagcacggtatttccaaggagataaggaaggaagagaacccattgctcggaacagtagatgaagcaggacaacgggagacatgatgtattagaaactcccattctacttctaatttaggttaatcataaaaccttcaaatgaccccacagaaacagcctgggagggcagttttgtcccctccattttacacagcctgaggctcgaagatccaccagtagtcagtggtctggcagcacaggaacccacatctctcagactcccgggctctgagttacttcaaaactcattttgtctgatagatttttattgaaaaccacctgtatgcagtacccaagcttggagcagacatcctcatgagatgttgagtgaaagaaaaaaagaaagggagagaagaagatgtcccaccatttttgctttccaagtgtgtgaccttgaaagtgaaagtcactcagtcatgtctgactctttgcaaccccacagactatacagtccaaggaattctccaggctggaatattggagtgacccactccatgcctttcccttctccaggggatcttcccaatccagggatcgaacccaggtctcctgcattgcaggcggattctttaccacctgagccaccagggaagcccaagaatactggagtgtgtagcctatcccttcttcagcagatcttcctgatccaggaatcaaataggggtctcctgcattgcaggtgaattctttaccaactgagctatcaggaaagatcttgagcaagttgcaaataacctgccaccactctcgggtatcctgtgaagcacagggaaccacggggagggtggaaccagatcttgacctgactccatcagcaaccagaagggggagggacatccagggggtcaccagccccctctggcctccagttattcatttgtaaaacagtggacttatccataaggactcttgcacctctgacatggttttatgattgagaggttgaaattagattattgtaaaaatctaatttttgttgtaagatccctatcatctcagatttttttcataggtgtggtgatagactaaagatcttacctttatataagagattgcccccttagcacgtaacacttcacagctgggcaggattgccacctctccctccttttctgctttgtaatttcatgaagtcctgggttgtgtctcctccaactgggttaacacacaaaacaactctcacctggaccactctgattgcttccatttttgaatcaaggcccatctctgatctttaaggaattacagcaatatacgcagggaattctatgggaataaagtctttgtctgtttgttatccagctcctagcctgtgtgtagcaaatgctactactgctgctgctgctactactactaatagtagtagtaatactactattactggcccagtgcacggcaaagctgctactaatactattgctgctatactcctgtaactgctgctgctgccgccactactggtactacccgttcagcacatggcaaggactactgctattaacttctactgctgttactactgctactgttgacccggtgtatggcaaatactgctactactagtagtaataataataacaataacaacagcatcagcaacagcagatttagagttcaaagcacattttagggcttcccaggtagcgctcgtggtaaagaacccacctcctaatgcaggagacataagaaacacaagttcaatccctgggtgggaagatcccctggaggaggccatggtaatccactccagtattctgcctggagaattccatggacagaaaagcctggagggttatagtccataagatcacaaagagtcagacacgacggaagcaacttagcatacacgcgtgaccactagcatacaagcacatactaaacgccagcctttatgctacttgctttatacgcatcatctcacatattttccttcaacaactcttggagggaggtaccattatcatccctgctttacagatgaaggaatagaggtgtaaaaaggttaaaatacctgctcagagttacacagcatcaggtggcagagttgagattcaaacccagagagcctgactcccaagcttgtccacctagcctccaaagacactgagctgcattttgaataaacaagtgaatgtgggcaaggacgggggaagggtaggacacggcttagaaggcactcagtcctggggtttgaacgtcagccctgttacttactgctgctgctgctaagtcacttcagtcgtgtccaactctgtgcaaccccatagacggcctcccaccaggctcctctgtccctgggattctccaggcaagaacactggagtgggttgccatttccttctccaatgcatgaaagtgaaaagtgaaagtgaagtcgctcagtcgtgtccaactcttagcgaccccatggactgcaccccaccaggctcctccatccatgggattttccaggcaagagtactggagtggggtgccattgccttctctgagatgaacaatacaataactgaaatgaaaaatacactgaagtagtcaatagcagaataactgaggcagaagaatggataagtgaactggaagacagaatggtggaaatcactttcatgggataaagaaaaaagaatgaaaagaaatgaagacactctaagagacctctgggacaacactaaatatgtcaatatttgcattataggggttccagaaggagagaagagagaaggaaaggacctgggggaatatttgaatattcaaaaaatttgaatagctgaaatattcaaaaatatttgcaatattcaaaaatatttgaatagctgaaaacttccataacatgggaaatgaaacagtcacccgagttcagaaagtgcagagaatcccaggcaagataaacccaaggagatacacgt

SEQ ID NO: 57978 - DNA, 2453 bp, Bovine  19866880710152
tggctctctgggaatagaaaagtcaatggatgtaagagggtcagtggaagcagcccctcccattccgggtgtgagcctgggctgtgggtttacagagaggggcccttggtgcttgcaaggataagggcactgcctaagggttcccttaatgagcgaaccaagcctaggttctggagctcagtgtgcttccctagggtcctgcttccctgtctccactcatcgtgcagcaatcagagataagattaaatgaaactggccaccagggccagcctggcttccaggatgtgtgaattccggtagaacgctctgtgtgttgataccctgtgtgtgtggtgtgggcttattcgccattggcctagcaatctgagaatctggctctcacctgagggacagatgtcagggtaaggagtcagagctatttttccacttcactggcaggctgtcggagggtggtgactgagcacacagccatggtgggaagagacactcctcaaccctccacaatggcctctgggggatacagagaggggagcgctggttaatggggtctggggctggtgagactccttcctcaaggccaaatagtgccataaaggagaggatttcggttgagccagatagggagttaaaacttgtgtggtgagttattaaagtgaaaagtgttagtagctcagtcgtgtctgactctgtgaccccctggctctgtgatgaccaggctcctctgtccatggaattttctaggcaagaatactggaataggtagccattcccttttctaggggatcttcctgacccaggaatcaaacccaggaatcaaactccctcattgcacgcaggttctttaccaagttatcagactctggtgaatcctggtttctttcatgtcagtgacagacaagagtatttaccttccagaaggttcaggaatattacaggcaacagagagaaaaccctgacatggtgcctgcacacagtaaataatcaacaagcgatagctgattatttaacttcctgaaccaggaaatgttaagccaggcaacgtttgatctacatttttctgagtgaagagagcagactggcctggttaatcctgctcaggtgcaaataactgagatgccggcagagggtgtgaatggctggagatacagtagggtttgggtggaaggaatgtgggtctcatttgtttttagccagaccgggaggatggcttggatctcaagttgtgtccctaatgggttgatggtaaaaaaaaaaaaaaacccaactaatgtttacacttgaggcatttctgttaattgaggctctgcactcatctgtgaagagcttccgcagctgccttctagagctggggctatgagctgtgactgcatgcaaagcacctcgtgtggtttctgacacccagcaggtccctaagacgggggaagagaggagggcccaggcaacacctggggcctctgtggaatcaagattctctagaacagagacacttcacacactgcttcagcaaacatttaattgagcacctactctgtgtcaggccctggagaaataaagatgaaaagaagtctgtctttgtcctagtctgcagtgtcgtcatgatgtccaacagccaaccccccagtggcaagagactctgataaacttttcaataaaggcataagttcttagcataataatggcttggctagagtgtagactagatagtaataataacaaaaatcatacaaatgttgaattggcacaaggtgtgagcaaaagactgtgttagtggctttatctgcactatctcatgtaataattattacaggcctgtaagatagctatctgtattcccatttttacagatgaaggaactgacgctcagcagggttatataacttgcccaacgtcaggccgccatggaggaggacaagaaaatattaaatgtcagacctatgagtggacagcaggcagaggtcggatgatgaaagccttttcacgacatgctgaagagtagagatttttttttcttgcagacaataggggaaatatattcccagtttctgttttggttactttgcagctggaagtccacaaacccactgcttcccccatctcaagcacatattcgggattaccagaggccaaacttgcatagtggttcagtttggtttgttttgattcacaactgaatgcataatgaatgataattgtctgttatgtggcccgaaagttcctgtggtcacagcctacgtaagtgtccacacagagcccgaccttccccggcctcaggagtctccaagctctggatcggcctcctggtgcataaggatgtgtggtttcttctactttgctaagtcaacagttctaggcagggtaacaggcgttgcctcaaatacatctccccagaaagtccttcatctcatttaatccatctactcttcccaaactgtgccctttaccaccttctgcca

SEQ ID NO: 57979 - DNA, 1072 bp, Bovine  19866880752228
attgctacaggcagagtaatgtaccatattcctgggacaggaaaatggcacaggcaggaatggcaggtaaaaaggcaacttctctgtgatatctactttagcaaaaatgagacaagaaaccttttggtccaagaggtaaagcaaacagatgaacaacttacacatggtagttgataaatatttaatgtcacttggtacagtggttcttcaaaaatgtctttcagctctgaaggcccttccataaatccacatttcagcagtgtggccaaggctcagaaaaaatacattttgaataaggactgtgccaacgtgaaaggttgaaaatggaatataagacccacaggggacctcacactctagggagacagggtcctaatgtgaaaaaggaaataaaaagaggccagaaacatatatatatatatatatatatatttatattctagggagatacacacacacacacacacacacacatatatacacatatacaaattctagaaaaatacatacatctatatatatattcttggagaaggaaatggcaacccactccagtattcttgcctggagaattccatggacagaggggtccatggggtcgcaaagagtcgaatgtaactgagcgactaccacacacacatatatatatattctagggaatgaggccctgttagaactctgtcagaataattagaacggattttttttccttccctcagtggatgatctagtcaggttaaggggcatcatattccagacaaacacgctcaggtcacaaggcactgactactctccaaccgccgacggcatctcagctgcttaacctgtgcatgcggagtccagcaccacatcctcagcacacacggccctcaggctgaggactctctccacccctcactcctgtctcagtctctctcatacggtgttgggcccttgctactagtctctctctctctttttttttggtcttgttttggtgtttgaatctgatgctttacccaggggatagggaagattagggacagcaggaagccgctcccactcgtgggcggaaaggacaaaaggaggaggt

SEQ ID NO: 57980 - DNA, 2175 bp, Bovine  19866880760178
tggtgtgaaacccaaccttctctggctaccgcatgtccagagcagacaagtgattatggccctctgtcctgccatttctggagcaggcatccagggtgcttctgaagagtcactgccatcaaatgcagtgacgtgccctgaaacgtctctgtcatctgatgggggcgggggcactttcacatatattccaagatgctgggatggcctgtgctgtatgtgattctgatgggaaagggagctgagctttagagatactaactcaagttcccagcttccaaaaggcagaatcaggatttagactcagatgggatgtaagagtccctaacttttctgagacattgttttagaggaaaaaggttgtaagaacacaggagacagagagccctctcttccatatttggtctggagcaagcctggtgccttctggacctcgaatggaatatgtaacttgcaaattcaacaggcatgatgagattttcctatactggggagagaaagagaaaaaagagaacccacatattccagagtatttttttcctcctctctatgcacgcagagttctcagttgtgttgactctttgcagccccacaggactgtagcccgccaggctcctctgtccttgggattctcaaggcaaggatgctagagtgggttgccatttcctcctccaggggatcttccccacccagggattgaacctgcatgtccagtgtctcctgcattgcaggcgggctctttactactgagccaccagggaagcctccgatctatactcaatagaaattctttaagaatattaagggagtttcatgtttagataaaaataacttacttaataaattactttcctatttaaatgagatcttataaaagagaaatggcttgtaccacagaggcaaggggactaaagaagaaaggatgctgaatgctcagaggggaagttgattgagggggtgtgccctctgcctgtactcttatagaagaccacgctaatataggcaatatgtaaacactgcagaacaatcagaaacaaatgaaaggagggctgcagagtaacaaagttcagctgtgggcgatggccgggaggcagcttttgttatgcacagatcatctgcatgtgaggaaaggcctgatttcaactaggctataggctagttagtgtatgagaatggatcagggcccatctggatttccttaggaaaaaagcatgggggagtgggtagaaaaagagaaaaaagcaggtatctgcaaaatataaaataaatgacctgatgtaggtcagggttacagttctggaagagtggtttaaataaagtttctgtgttatagatcagtcatgtatttagcctgtgctaagtcgtgtctgactctttgtgaccccatggactgtagtcctccaggctcctctgtccatgggattttccaagcaaagaatattggctgctgctgctgctaagtcgcttcagtcgtgcccgactctgtggagtgggttgctatttccttcttcaggggatcttccttacccagggatagaacctgtgtctcctggattggcaggtggaatctttaccactgagctacctggaaagcattatttagctcacaatgaaacaaatgacaattactgggtttgccaaggagtttgttctggtttttccattacatcttatggaaaaatgaaattattggccaactcaatacaatggtttatatatttatatatttaaaggcactgcaaataaacacaggggagaagggaagggaagacagctaacatttgccaaacagttactatgtctgatggtttttacatatttataggttttcttcgatttacagagggcctccctggtgtctcagacagtaaaagcatctgcctacaatgcgggagaccagggtttgatccctgggtaggtaaggtcccctggagaaggaaatggcaacccactccagttctcttgcctggaaaagcccacggattgaggaacctggtaggttacagtccatggggttgcaaagagtacaacacgactgaacaacttcactttgttttacagatgaagaaaccatagctcacaaaattcaaagccctgttcatggccacacaggtaccaagggacagaaaggggattggtctgggtctgtctgactccaaaagccatgctcttcctata

SEQ ID NO: 57981 - DNA, 2221 bp, Bovine  19866880795228
gcaagagtactggagtggggtgccattgcagtaatgtgtactcagtaacaaatgtgtagaataataagtgtccagacaatgatctccttgcagctggaggtatgcacacagcaggtggaatcatctctttataaatgtgtttcaggggaggtttgagcatcaaatcacagttgactggatgacttttaaggtttttttccttcaggggagtctctgagattctgtgagtctgtgattctagggtccccactcatggtagaaaaccctgactacttgcgtgactcacctatggcccaggtctcgggtctcctggctccaaggacacaacccctctcaagaggcagctaactccaggctcctctggcagcctggtactcacatcaagcacagggagaagctatattggaaaccttgggagcagctgcctgggggctttagtgattggaccctctgtggctcctttaagacgttttacaaggttaaggtttgctctaaaaataagctcacaaggctttttaaaaagcttctaaaaccatatgtccacaacagccattttttgaagggccagtgaacctttaaaagcttcaaaaatcactacttggcctgcctcccacagtggagaaagttcaatatgcagtgtgcttaaaaacagacctgcttttaagtcttctagaatctccacctgaaacactctgctccctatcaaaggggttcaaaatggagatcagtttgtgtgtggcttgttaccccagaggctaggttctttccacagtgatcaagtgccccaaataaccacaacatttccattagttgcctatagagagattagttcagggttttctttcctgttccttctttcctcctataggtctcttcatattatggggtgctgtggattattctgttaagtgcatacacacagattcacaggaaccatggtgtgtccaagaaaatgttcacccagattgggtgtctatgagatgactggtagcaaacgagaaagggcacttatttgttaaattgttcttaagttcaatatgtggtacataataggtaggcagttatgtatttatagacatagaatacctatatttcaggtaagaaggcaggagttagagatgagtggaaagcaatagaaacgatatctcaatgaatcataaatacgttcttctctagcatgaagattcctcaaaaaacgaaaaatctacttgctataagatccagcaacgacacttctgggcatgtatctggacaaaactctagcagctcttttcgcaatagctgaaacatgggaacaacctacatgtctatcaacagatgactggataaagaagatgcggtccgtatatacaatgaaaaattactcagctgcccccaaaagaaagaatgaagtaatgtcatttgtagcaacatggacggacttagagattatcatactaaacgaagtaagtcagaaagagaaattcaaatgccgtatgatatcacttatatatggaatctcacacaaatgaacttatctgcaaaacagtaactcacagacagagaacaagcttttggttgataaggggatggggtgggggagggctggattgggagcttgggactagcagatgcacacgcatatatagaacagacagacaaggtcctactgtagagcacagggagctatattcaatatcctgtgctaaaccattatggaaaacagtatgaaaaagagcatatatgtatctctttgctgtatagcagaaactaacacagcattcaagagcagttatacttcaacaaaaaaaggaaaagaaaaataatatgttctcctcaaagacattttataatttgcagggaggactagagagaatcatgtgatacgatgaaccgtatttcaagctcctcgaatccttcaagcctcagtaaggaattccctattgacccctctacataatgaaaaaatggaggcccagagaggttacgatgatcccacaggactgccaccctctgcacccaggctcctcatattggtgtaaaagggtaatgtgatggctctagacacagagtactgaggtttgactcccgacttcactacttcctaactgtaaattttggggcaattttctccacctcacagaacttcagttcctttatctataaaacaaagataatatctaccatgtcatggcctactcttttgggaccccatggactgtagcccaccaggctcctctgt

SEQ ID NO: 57982 - DNA, 2406 bp, Bovine  19866880817863
ccatgactgaaatgaaaacattttccattaagattcaacgaggtctcctaggacctgcttcttggtcatataagggctggcaggtcctctctgcgggctggagaaaagttttgtttccccagctgcactcacaggggaatactctgcaggcacggcgttgggaacctgtttggcttggctcagaggcctgtcagcacattcaggaagtgaagtcagaagaggcaggatttcaaacagccagctgcacatgaatgcccgagcggtgaaatgccttatccaagcagggtgcctctcagcctgggttgccctgagagctgtcaaatgagcctctgaggatggctctggaccaggaaaggaagaagcgattggtggcacgcagagaagggccatgacttcacagcaaagcagccagaagggctgtgtggcatcatctcagccatctcttctctctcaggttgctgagagaagagttagcttcatccccagtctccacgtgatagtgcccagctgctcccactctctgcccataggaataagtgagatggaggtagcagttcctcatgtgctcccaggatggtgtttcattgatctgactgggcctcatatccattcctggaccaatcagatacaggacatactgttatagtactaggttggctgagatatgtaggtcaattgcccacctctaaaacctaagtattgatgggagttccattaaaccacatggccagagaagagaataagggagaagatcttcaaaggacaatcagaacctacaaaaaagtaggttctggaggtcaaacagattattattatctgttgttattattatcaaacccataccaggatgaaggggcatctacttcacttccaaaatcaggttggcactcacgatccacagttttacctcttttaatgaattgatgagtccagatataaatcaagaacatgcttccttggatggaaaatgctcaggagggatgtattcaatgatataaacacataaaaatattctgtgaaaaaattattaatcttagttgcggttatgatattcactgtaaaaacttgacataagccaattaaaagagagaattgaatatcctccaagcaagattttgaaacatcaagaagccctccaggtatatctctggtctgtgtttttctctacttaccctacccactgaactgtatcagtatcagtttctacaccaggatttgcacaattcaatcattaaggtagtagaagtagaaaaaagtctgagatcaattatcatcatgaccgaaccctgaaaaaggagaatccaatataaaatgaaatatactttttccctccctacaacaaatcaaagatctttactcccaagaaccagaatgtgagaaggatctttgaaaatccttagaactgactataaacataagtgaatgataaatccagtgttgcaagtaggaaatgccaagaaaggttgatgagtatctactgtgtggcttaaaacgttgctgggcggtaatatagtaaccagttcttgacataaatagtcttaaaatctttccacctgaggatagcattatgagacttaatgattgtcactctctcagaaggtcacgtgctctattcattcaccccgtgcttattgaattcattcatctcctctgtccaggtacctgctaagcactgcaggtgagaatttatgtaaaacctggatcctgctatcaaagtcaggtggcttcaatacataattgtcacgacagagacaaatacagggtacttcaggaataagaacccaacctaagggaattcagcaatggcttcactgaggagcctatttagaattgtatcttaaaagagatgagtaggcgtttgataggaaaatggggagatagtgccccagggagatgggacattggggactaaggtaagtgtcaactattcacagacaaaatggagggagttcctacccacatattgtcaggtaagaaaaagagagagaccaaataaattattaaagatattatcacaattactttatccagcccagacctttacagagtgctgcagaaaatgtgtacagcagtgcctgcagagactgggaagccacaacccaagccttcactgagggatgaggaggggctggcctcagtccaggaaattagggaggcctcctggaggaagcctgaaggaattagttaggcacatggggtgagtggggacagcactgctgtcttaggctagagcatatgttagaagtaacaagaaggggctcccctggaagctcagtggtaaagaatccacctgccaatacaggagacacagggtttgatccctgatctggggaagattccacatgccttggagcaactaagcctgtgagccacaactactgagcctgggctctggagcctgggcat

SEQ ID NO: 57983 - DNA, 1692 bp, Bovine  19866880822382
aaaccttgggggtttataaggaatggagtttagagaagagttccatctctagtcttcagctccaagatgttccaactacaagggcgatgttaatgaagcttcagcctcagtgcccctcacttgcacaggaaccctcttagagggaccctagaatgtttttgcaggtcagatactagacaattttcagaagtgtgatattttaacttcagtgggtgaagactactgcctccttgcacccacctccatctcctccatcacccctgctgggtgagtcggagtagctatgggcgttttcaatttgtaattttctatttcttttttgagaaagctccccaaattgtatatgtttcaggccctgtaaaacctagctctgctcttgctgtgctacactcacagggggcagtgcccttccatacatgccatgggcagttggccttgcagtgccctagagcccacaactcttcctgttcagccttttgactttttactctcagagcctctgcccctttgggagggggaagagtgctatataagagtgggatataagtccctccttctggaagcagcagctactacagtttattttgccatcttggaaaacccctgccagggtcaggccattccccttttgaactagccttgcccacccctgcccgcccagaatgatatatccctatttcaccaggaagtaagggagaggatgtatagggctgcttagatcctcctaaagacaagagtgtcctccatgcttgtgagaaaaggtattccacagtattcaaggaagcagaccaagcgatagatgtattgttgttgtttttttgtctctcaccaggatgtgtagactgaaggggagagggcttcctggaagaagtgacatttgaactgggctgtacaaaacagaagggtttctgcggggaaaatgggtggggaagccacgattggaaagggtccagaaacccagatgctttataaacacagagtcagagtcagaaaacagaggaaaggccagcagtgagacagcaggcatggagcatgcggttgtttttattctcttaaataaagttcaaagcaaaggtctctgatatcccctgaagagaggacatccaggttgttttcctgcccagagcaaagtaaacaggattatgggaaccttcagtggcctcagcaggacacggctgcccggctggcccgggagagagggcagtgtggaaaaggctgagattaggcaccgcctgggcctctggacttggttcctaaggaaacgcctctgttgggacaacctgtttcagccgcttggaatctatatttcaggtcagaaaaaatgcacagcctttgacccagtaattctacttttagagatgcaacagaagagatagttgctgatgtgtgtaaagatacatgtgcatggatgttcaatgcaatgctgtttatagtagagaaaactggcagtaagtatctagcaatgggggtaagttaggagacttagagtacatctacgtgatgaaaaatattaatttatatttactgacatggaatattcaggatattttgccaaattaaaagctggctataaagcagtactataggctctcagttatgtaatatatattacactggcatttactgaacacttactgtgtgccaagcaggctcgaggcatttaaaatacattaatatctttaatcatacaac

SEQ ID NO: 57984 - DNA, 1672 bp, Bovine  19866880848740
aatctaaaataggagaaggaagcaaaagaggggcggggggaagccattatgtagaacagaatgatgtaattccaagaaacatgctgtgggattgtagaggaaagactgattaattatgatctacccaggaaaggctctttggaggtggccttaggctaggtgagggcaaaatagggcatcagcaattatctagagaattaggtcactgtgggtgtcaaagtggatgatttcaagctaaaaaactgcactttatgctctgaatagtttagaattggccgcctacactgctggaatccactggaattttgccaactctcctgttctccctgtgacttagaccctggcttaggtgagcttcctgctccagttggggttggggcaggatggagaagtggaggaagcctgcctctggttgggagccctagggttcattccagactctactaccacagagagtgaccccagggaacccaccttcctcccagattctgtaagaggaatataccaaagttgatggtccctaatggccatttgaagtcttgagtctctgtctttggaatttgcctaggagagaaaatggatcagcatgctcagatttcatgttcctggacatgacccacttgggagcctcttgtaaatgaagcttcctcctgttatatccatgacagtcagtatattcttgagatcatcctctctggctctgtatctcccacgtcggaatctatgtggtatagtaggaagatctccgactttggaatctaagaatcctggattgaaacccagaccatgtccctcatcagatagatgagtttcaacaaattatgtaacctttctgttgtgtttatttctgcaattgtaacatagtgattctgggcttccctggtgactcagatagtaaagaagggaaaggcaaagatatacccatctgaatgcaagagttccaaaaaataacaaggagagataggaaagccttcttaactgagcaatgcaaagaaatagaagaaaacagtagaatggataagactagagatctcataaaggaaattggagatatcaagggaacatgtcatgcaaggatgggcatgctaaagtacagaaatggtaaggacctaacagaagcagaagagattaagaggaggtggcaagaatacacaggagaactatataaaaaagatcttcatgacctggataaccatgatgatgtggtcactcacctagagtcagatatcctagattgtgaagtcaagtaggccttaggaaacatcactatgaacaaaaatagtgaaggtgatggaattccagctgagctatttcaaatcctaaaagatgatgctgttaaagtgctgcgctcaatatgccaacagatttgagaaaactcagcagtggccacaggactggaaaaggtcagttttcattccaatcccaaagaatgttcaaattaccatacaattgtgctcatttctcatgctagcaaggtatgatgaaaacccttcaagctagacttcaatggtatatgaactgagaacttccagatggtataagttggatttagaaaagtcagaggaaccagagatcaaattgccaatattcattgtatcataaggaaagcaagggattttcagaaaaatatctactactgcttcattgactacactaaagcctttgactatgt

SEQ ID NO: 57985 - DNA, 1575 bp, Bovine  19866880866594
agctcttggctttgtaaagcactctagagcgtgacctttgggaaccaagctcatacacctaagtcaccagatgagcacaaggactctttgtagctgcatggtttctatcttcatgaagttgagaaaaggcagaggagaggggaggggtccaagaggttctcttaagaaaactctctatttgcttttgtgtttttcaagctgacaggtgtttattttttctcctgtctacccaggaaaccaagtgctgcctcctggagcttctcttggaagtgggctcacaccagaggcagcaaaggaccttggccttcctcccggaattgcagtggcagcctcactaattgatgctcatgcaggaggactaggtaatttctttccccgtgtcaccactagcactgtgttcagtcactctctaggatcgaacacactgcttttctatttttaaagcaaagattgagagctagtgattctagttagagaagaaagccttttcatacttaagcatatgtatagaattatagaacttttcatcaactgtagaattcatttataattttatcagtttacccatacaaactaatagaaaaatgatataaataaatacctggatggctctttggtttactgaaaacttgataaagatatgttaacttccaaactagcatgtatgacaatggtgtacttacctatactactttttctacacatactccaaagcccttgcaagtctaattttattttcataatatatttggcttatatcccatgtccagttacttgggtatattcctgatttaatcttttaagtaaatctacaacctggcatgcttgtattcatttattcattcatcaaagaaccattgaacacttggtgtgtcccaagcatggtgctaggaaacaatgaattaaaaaaaaacaaacacaaggtttcatcccccagtgggaggcagaccgtgaggcaaagtttactgtaaagtgtgatgactctatcctcttcttcattctcattgctgttttgtttttttttttgggggggtggatttttcatattctcaatatttcttacttcaactatagacaaacttttttttttcccctagcctttctttctaagtgtttctttttaaattatggttcaaacttcttgagatcaatttaggagatcatgaccattatattttcagaacagaatggactgaccagaagagcacttttttgtagaacatacatttccactgcaattgtatgtatctgcatgtgtatactgctccataatgaaagtgaatttcttactatggattaccatcaaaaactttgaaaaatattttagtccatacttcatattacagtcaaaagttatctatcaaatgcttacatcaaactctactcacagacctctgtctttgcatttttatttccatgtctttgcacatgtgtttctctgcatggggataactcatcctccactttgccactagctaacttctactctaagttgaagacgatcttggatgctttatcctctgtgtagccttccatggacaactcttccatttatatctaaattctctaagctgt

SEQ ID NO: 57986 - DNA, 1864 bp, Bovine  19866880911635
tcttttcaatgagtcgctcttcgtgtcggtggccaaagtattggagtttcagcttcaacaccagtccttcagttcttccagtttcaccaagctcatatttcctcatcacatgatgggagcaaggctaatgctacaccacaaagttttggagaggctcaaaagagaatatttcagtgttgttgacagggccttgggaaaggctggaagaagctacagtaaaatgatcagtatacctcagtgaagctgtttttctatataaaacagatgtaactgtgttgtgagataatcctttttttcactatactttttctgtattccagtttccctaccatcaacacaaacatccacaaaggctattaataaatatgttggtgtgttagtcattcagtcctgttcaactctgtgatcgcaaggactatagcctgccaagctcctctgttcatgggattctccaagcaagaacattaaagtgggcagccattcccttctccaggggatgttcccaacccagggactgaacccaggtctcccactttgaaggcagattctttaccatctcagccaccagggaagcctagatatgttggtaccagcctccaaattattattgttggctaatattgtgctctctgccttactgaggtgtggaaattagcagccacagcagcactgacttgactgtggaccatcttgtgtcatatcttgtgatgtggccatagcctcgtttctcagttctcgtctcgtggaagcctctgggatcccccagtgcttctcctggaggccaaggctgttcccagcagttagcacattgtgttacaattccttcctctactagcctgggaccttctttaggtcatgctactatgttttattcatctccttatcaccagccttgtctcctgtttgtcaatgctgccttcattcctgttgcccaggttcccctacacctctgcagggagttctcaggctcacatactgtagcttctacaatggagaacaacaagttccaaaatcccagggaagaattttgattattttcatatgagtcaggtccaccctctttattgattaaactatacccatgggcgtgaggtgttataatggtctcagctttaggcaagtgtccattcccaggggaatctgtcatggccagtggcatggggtctatacaatcatatcaactcttacttaaatccatgggttgcagtagaggaggatgaatcaattaggaatgcattcagcttcataacactaagaagctctcatttaaatcagtgagttgcagtgaggaagaagcatggatcaggaatatatctgcaagagtgcaaacattggtttttggaggatgaaaaaatctcaggcattaaaatggtttgtggtcttctaaaactcagctgtacctgacattgtaaacagatatacaggtgttaaaacttgataggggcagggatatccccaaggaatgtctgaaaattctctttagtggggttgatggtgaaaaactggttgagaaacactgagttctaatgacaacaataatacctaacagttatgcagtacttagcaagtgctaggaatttttttggatgttatattaaattaacttgtttaacaatatacccatcaaaataccattttacagtggcttaaacaagtaggcttgatttcctactctacttgatttttctgctcctaaatgaaagtccaaaggtggtttgaccatttcaaaaccagcatatctttagttctgtagacttttccttcatgctaattatctcatggttaggggataattactgtagctctagacattacatctacctttaatggtagaagaatggggaagaaatgaagaaagcagtgt

SEQ ID NO: 57987 - DNA, 782 bp, Bovine  19866880922934
tgattgcacaccagattaaacattttttaaagcaactaatcctcacaaccatttacctagcacctactatgtgtcaagcaaattcacttactccttcctgcttaatcttctcaacaagcctagaagcaccccctcttacaatgagagaatggaggctcagaaatgtcatgaacttctcaagatcatacagtgagcaaaggctgtcaccaatatgggacctcagttttctgtctgattccaaccttctaggttttaaaatctgggttagaagaatctggaaagtgttctaaaaggcccacgagaacaacccagtggaaaaagaacataatggcatttacagaccatccagttctttctccacccactttagttccactcctaaagctgaaataacttgttttctgtcactccagtatccagagctgacactaacagttgggagttaggctcaagagagttcaacttggaatgaaccttttagcccattcagtctagccccaacattttgaactgtaacccaaagagcttaagaagatcacccatttaatcaggcagagtcagccttgtttctaccaaatcctaagctttttacctgaaagggggcaataacacgtgtatattaaactgtgactatgaagaccaagtgagataatgtcttcaaagtgctccgcctggtggctcagcaggaaagaatccacctttcaatcaggagacacgggtttgacccctgggtcaggaagattctctgaaagaggaaatgggcaacccaggaatattgccaa

SEQ ID NO: 57988 - DNA, 1059 bp, Bovine  19866880924242
gatttttcggccttaatttggacctggcataaaaggagctggagatgttggaaggctctgatgcctggggggcaatggttacacctcattagtcccagagcaggggctccttttcccccttgcccttgtggtctgcaccttccctcctggcccagggagtagactgcgcatgccctgggaagactgaagcgcttcccaggagagtacaaacagacacacacccgccctcaaactcctgctgcagggatttcatctttatttttattttgtctgctcatggcttgtcctaacttcagagcttaggtggattctctgaatggaaaaggtgatgtttgccagaaagaacagtgaatgagggagtgaaaagtgaacaggcgggaattctggctttgcatttattggtgtagtgcatttgaaaagtccttgtcctctctgggtgtctgtttcatcatctgtaatggtgggtaaggatccctaccttggagggctattggaaggatgaaatgatacgcaacaaaatgaaataaagataatggaagaggaaaggcttagtccagggtatgacacttaacaaatgttatgctgcctcaggcaacggttgttcttggcgatggctgtgctgcaaacacacggtgtctggttttgaccataacatctgctgtaggtctgtgttcaaaacagttgctccttcacatggatactagcttgcttgtgagggtgcagttgagaatgtgaccagggaccagggctttggtgcctgcccgaggaggagatctgtgtgattcctggtcatcacggccctttgctatcagctgcagcttaagatgactatcacaatctgtactatatctgagatcatatggccctgtccacgtcctgcctggctaaatgagtaggacagacagactctaaagctgtttctaaagctatcgaatgatttaaacacaaaatctggggtctgatgattccccttcagattgcgcaagcaagaaggcttaaaattacacaagaatgatttaagggagaaaacgcactcgtttctgttctggcaaacacaag

SEQ ID NO: 57989 - DNA, 628 bp, Bovine  19866880993731
ttcaatccctgggttggaaagatcccctggaggagggcatggaagaatactactccagtagtcttgcctggagaatcccgtggacagatgtgcctgatggactcagtccatggggtcgcaaagagtcggacacaactgagcgagaacgcacagcacattcactgaattatgctgaacccattccgccgtcactgctccctggaatgtaggtttctgggttgtggtggcagggtacagatgcgggcatgaaggaagacaccccccctcctcacctccgctacccgaggacactggtgtgatgcacagaccttgggatgtggcaccagaacgaacttggatctcagcccatattcaaccgctcactgccagctgtgtagccaggagggagttatttgcaacccaagcctcagtttcctcatttaaaaattggggttgatgataaactcccttctctcgggagagctctgtgagactccattgagccaagagatcaagtgctctgtaaactgtgaaaggtcagtcctgggcaagggattaagcctggatcaaggcagcagcacgctgggaatgccccagctccagggctatttaaaggccaccctgaatcctgggaagatgcctggattgg

SEQ ID NO: 57990 - DNA, 1639 bp, Bovine  19866881078786
caccacagtttgaaagtatcaattcttcagcactcagtcttccttagggtccaactgtcacatccgtgacctagtactggacctagtagtctagtcaaaccatagctttgactagatgaacttttgttgcaaagtgatatctctgctttttaatatgctgtctagcttcatcatagcttttcttccaaggagcaagcatcttgtaatttcatggctgcagtcactgtctgtggtgatgtcaaatacattatcttactttaaagagactagagtctcctctctctctcacttttcccaccccaccagttgtgacattctttcatcttcaaccctctctccctttaaaaatatttattttcttactatatagagatcagggcatggggcacacagccacacacctgagcaaacagaggggctaactgatttgctggtataatgaaaaacattgtttttcagctcattactgtgattccacaatgggcaccaaatcccatttgggatccacccgggaagccttcaaagggacactgttccaggtctgtacctggcaaacgtgccgactctcagagtctttgcaaaggaataacccatgtttggagacccaggcctgtcagatcaaaaccagacctggcctccagaccttcagacaagtcacaacagtgaactcaactcatccattttcaaaatgcggcctgttctcttcacagaatggagcagagcctctcagattggcgctggctgctatatttgatatattagggagaatcctgactccttccagatttctgccggtctgttttaaatccaaatagcttggctgagtgtggtttttagttattttttcatttgaaatggaattcaaaacagcaggggcataaagcccagatacgaatgggaaagaaaataaaagggtccctggagtttccccttcaccttccacattaaggaaaaggaatatcattgcaaaccaactttctgtcaaagtaccaggcagggagggtgatattgctgagctgttggaattttacaatatttctaatgcttttggttttctttagaggtggtttgatggagggatcaggggctcagctttggagccaaatctgggactgcctcttacagtcccagggccttggcccttttctgtaaccacccagtctcagtttcctcacctgggagcaagcttgccatagttacctgatagggcgattgtgaggttgaaacaaggtaatacagaaggcatttagcatgggcctgggcacatcacaagagcttcgtaaacagttaatgttatggtcagtctctcatagccagaaattggagcttctgccctgagaatgaagagtgtgactttcagacaaagactgggcagaggtttgttctaaattttcaatagttacatcacttgctttctaaggataaaacaatgacagttcactaaactcctgacgtatctttataatatcagcagagagaagtcatgaatattagttgacttgattgaaatcaagacatattcaccaacacccaagaaaaagtataagaaatgcttcctggaaaaatcatataattaatttatgtccatgtttactaaatgattagcctctgttttgtaaaccacagaaatcacagttct

SEQ ID NO: 57991 - DNA, 808 bp, Bovine  19866881125996
acaaaggtccatctagtcaaagcaatggtttttcccagcggtcatgtatggatgtaagagttggactataaagaaagctgagcaccgaagaattgatgcttttgaactgtggtgttggagaagactcttgagaatcccttggactgcaaggagatccaaccagtccatcctaaaggaaatcagtcctgaatattcattggaaggactgataagctgaaattccaatactttggccacctaatgcaaagagccactttattagaaaagatcctgatgttgggaaagattgagggcaggaggagaaggggacaacagaggaagagatggttggatggtatcatcgactcaatggacatgagtttgagcaatctccgggagatggtgaaggacagggaagcctggcatgctgcagtccatggagtcacaaagagttctacaccactgagtgactgaacaacctgtctctggggacttctatctactctgggagccagccacataaataacccaaaatcagaagtgtgtagaaatgctagggaaagtcagcagtaagactggccatctcactatgttcatcaaggcagtgtctccaagacccagtggcaatattttttcatctcctggtaaactcactctatgtaactgaaagaaatgttagcattttaaagcagtttaaaactatccccaaacatttaattgtgttaattgggggggcatgtttattatagcagaagacacaccaggggttgaaactgagcctatggctttcatcttctcaaggacattgtcatctgtccctctccggcag

SEQ ID NO: 57992 - DNA, 1184 bp, Bovine  19866881139270
gctctacctatcgccgcagtaggaccctcattgtctgccggatgcccattgagttagcccccactgagacaaggggtcaggtctttgtaactctgcattggatgtgaactgcccctagacagtaggggcaaaatgtgatccaggtagctcctttgttgaggggcagttccaggggagaggttcaggtgggggccaccagcagcttccagaagccagggaaatgaataccttggtcctgatgtgggccacacaatacaacattctctacaatactgtgaaattataggaacattcttaccaccaccattcacactgccagagaatgtgaaatgccatcttacgagtgaggcctctcccctagcacatgctgttcctctcactctgtttcatttttttccactgggctaatttccatctgaaactcttgtttatcatttatctcttaccatcagaccatatactccagacttagggtacccattacccagaagaggacctggcacaaggcaggctcccaacaaatataaatgaaattccaaatatgtatatgaacctactctgtgcatctcactggaatttctgtgaggactaaaatctcctacatgtaagaatagagctcacagtatacacttaagccaaaaaagtatacaaaaatataaatgttgggaaagaaatgtttgtgtgtgtgtgtgtgtgtatgtgtgtgtgtatgtgtgtatgtatatatatatgtatatatatatatatatatatatatatatatatggcattgggataaggaaatggaccttttttcttttcttttaaaattttctggccataccattcagcacatggatcttaggtcccaatcagggactgaacccatgccccctgcattggaagcatggggttttataaccactagggaagtccttggaccttttttcttataggaaagacaccacaatttgagcaattcagcagcagggaacagagacagaacttcttatccagggcttaagggcaagcctttgactctctataaggtagggagacttaagactagcatttatttcttccagcaccagcatttaattccagacttaacagggactgagacctataaaagattcaccttgtttctctgaatgtgtacattatttaccatacagtttataaaatatttacccttttatcaaccg

SEQ ID NO: 57993 - DNA, 1912 bp, Bovine  19866881163951
ctttctcccaagatctcaaaaggcctgggtccatttatctagatactcaaattctcaacagcggcgttagatagatgctgagagggaaatgctgttttggaaagaatgaaaccattcttgcagtgtttatattcgattccggagacctggttagaaaaatatttttaacaaacggaaggaagagtaactatgcactcacaaaatgtgggctgctcatcgcggtgaacctttgccctgggagtctattcccagggcagggcatgtgcagccccaaatggccgttagaagatgaaagggaatctttcaccatttcctcccattgtctgagctttctccctgctttgtcaccataacattcttttttggaattccattaacatgaagtttttccctcccccagaaacaattaaaaagaggagttggcaaagccagccaggaaagacctgtggctcactcctaagtgagtaactgtcatgtgtcttggaaaggtttgctgcttccagtcgaagaggttggagcttgaagaggaaaacacagaagtatcctctctactgactgcaagatgttctttagactctacagtgaggcgctgggagggctgaacatgatccggggaccagaagacctaggcccagtctaaataggaagctttaagcactggcaactccatttaactaataaggtaactaacaatttcaattggctactacatttgtatatgtgtatgtatgaagcagtcatttgtaagtaaaagaaaaggatacttgattgaggctatctgttcaataatgtggttttcatcattgatctgagtactaatcaggatgagatatatatatatatatatatgactatatagaatatatatgtatattttctgtgcaaaataagtctatcatttataaagtacttgttgtatcctggatactttgtgaatattatcttggttaaaccttataaccatattatgtagtaggaatttttatccaaaggtcgatataaggaattaaggctaagagatctagtcagtagtggagttagaatatttttttaagagcagttttagatttacaacaaaattgacaggaagatacagaggttgctaataatagccctgccccgacacatgcacagccccctgccaacatcactcatcagaatggtacattttttaccaaggacaaacctacatggactcatcattatcacccaaagtccataatttaccttagagttcactcctggtgttgtaccttttatgggtttgggcaaatgtataatgattatgtctttcattataatttcatacagactattttcaggaccctaaaaatcctccatgctctgtctattccatctcctcttcctcctcacccttgcctactccggcaactagtaatcttttactagtctccgtagttttaccttttgtagaatatcatagagttgtaatcatagtgtgtagccttttcagattgatttctttcacttagtaatacgcatttaagtttcattcatgtctttgcatggccttgatagctcatttccttttagcacctgagtaatattccattgtctggatgtaccacagtgtatgtatccactcacctactgaagacatctcagttgcctccagatttttttgcagttatgaataaagctgctatgagtatccatccatgtgcaggtttttgtgtgaacataagttgtcagctcctttggttaaataccaaggagtgtgatcgctggaccattcagtaacagtatgttttgtttttataagaaactatccaactatcttccaaagtgactgtaccattttgtattcccaccagcaatgaatgagaattcctgttgctccacatcctcactagcatttagtattgtcagcattcttgatagcacacccatt

SEQ ID NO: 57994 - DNA, 1164 bp, Bovine  19866881213466
aaaacttttgcacctgaagattccctaacctacgtgtcatcaaggccaggaggttggttcagtctaagtgagtctcttttggctctaatgacccttgctttctgccctttaaaggtaaatgaaggactcaaagaagcaatggtagcctaaaatcaggaagaaatacagaacaggaacaaacacagaacctgtagagcctgactgctttgtgtttttataaccttgtgtatattatgtatgctgtttcatgggcttcccaggtggctcagtggtaatctacctgccagtgcaggggacacaggagatgtgggttcaatccctgggtcaggaagatcctctgaaggagaaaatggcaaccctctccagtgttcttgcctagaaaaatcccatggacagaggagcctggtgggccacagtccacaggattgcaaagagtcggacatgaccgagcaactgagcatgagcatgtatgctgtttaagagtctctgcctcagtttacatatctgaacaataggagtaatgacagaatcttccccttagggttattgtggggatcaagtgatttaattcctgcagtgtgcttagaatagggtctttaataagtacccagtcaattgtagtggttgctgttgccaatagcacattattgctggaaagtcagtgtcctgtatgacacccgttactagtggagtaaaatgtgctccttcccgttgagtcccagagcagccttcaggccaagatagccatcagcagggaaagggctttcacaaaatttttctgaagtatttaggtttactgcagaggattaaagtacacataaatacacgaatgtgcactcagtctaaacaaactcttacttgttttctcccagagtttgggagtaattggaggtgctctggggagcatatttctgtatctgtttccttgctgtagtcaggatgtccagtgagaagcgtgtgcccttccaaatgagtgaacacaagcaggaatcaacgcagagcattctggacagtcagacagagcctttactgccatttctgagcagcagagtccagtctgccagtggagtttggcaaaaactgatacagaaacatctttaaatcatggggtttgaggtgcagggacagttggggggtgggggcgggagtaagcaaaatcctcct

SEQ ID NO: 57995 - DNA, 1701 bp, Bovine  19866881223101
tgctatgcgacaagtatgtgccatatctttatgcacattatcttttgttcaatgagtgaaaaaaatctcagttaatccatctaggcctggttatccccattttatagagaagaacactcaggctgagaaaaattccccaactttttcagtatctctgtactgaaagagcattcctcgttaggtctgcttggttccccaaatggaaaaaaaatattccagtgttttccactccacaaaaccaaccaagtgaggaaaaagcacttaaattaactaattttaattaaagtgactagaggcagtgagactataagcagataatagccattatgtagatgcatatgataattatacctgaaattatatgtcctgatttccaggaggcataccttaaaaaactgaagtatcatttaggcttatttcattggttctttgcttgagtatatgtccagaaaagtttttcttagatataagggataggagaggggaaaagttgagagaatgaatggcaatactgtataattaatcagtgaatcttgactaggattttgtgtagacatttaaccttgaaactatattcaaagagtacatctcttgaagggagatccgaggttcgggtgggatgtactagtcggtgctggtggtgttccctgttgatgtgtgaaactatagaagcgattgtgaagatttctgcccttgggaatccacaaacacccccttgaattagaatgacaaggatgtacctgtgtcctcactttccttgtttttgctaggggattcccgtcgaaacatcatcatgtggctggatcaccgggcggtcagtcaggtccaccggatcaacgagaccaagcacagcgtcctgcagtacgttgggggtgtaatgtctgtggagatgcaggccccgaagcttctgtggctaaaagaggtgagtgcacaggcttggggagagattgctcataatagcagaggattccttccagggaatctgtctgtaccaggcaccctgctcgagtctgctgtgttggatttttccagcaactcccagaaggttgatcccattttattgattcagtagcagttaagtcattctgcataactcatgcaaggcactgtgataagtttttgacagagattatctctttgaatcctaacagcaaccctataaagtaggttttttttctttttttgtgtgtgttttgtaaaaactaaagctaatagagattcatcagctcaccctaagcaacttaatcttagcagcaaccctctagttttctttttcttttttatgtgttttgtaaaagctaaaactaatagagatttgtcagctcactctaagtgactcagaagcatgcaacagagccagaatctgaacctaaaactgactctgaaattgatttttcataacacccactactctactgcagttcacagaggttaattaccattccagttagaaagtggcagagctgggattcaagtcctgattttctaacgggaacattctctgcatacttttagcccccaatgattaatgtttgaccttggtggcattttatggaatgcctttctcatctcacctgaacctgagtttccatgtccttgtgtgataaggtgatctctggacaaagcacttgcaggtggttcccatttccagatgttaggatcatttatgaagtgcggagaatggtgatgtcaacttaatgg

SEQ ID NO: 57996 - DNA, 1115 bp, Bovine  19866881247266
tagggaatggtttttaaaatgatggtatattcatagaaaggaatggaaagatgcccagattctaaaaaatgaacacctgtctccccaggagccctcgatcttctaattacaactctcttctgatttgtccctgggggtgtcacaccagatacataattaaggaacagggatgggaaggggatgagactccccctcccccatttatatctgtggtttcctttcttcccttcttccttccttcattctatcctatcttttattctttcttccttaagtctaataaacatgcatttttgttatcaagattactttatctttttttttttttacaagatgctggtacccagcaaggcaaagccagacttgtgaacaggtttagttcagtaataaaagtatggacaaaaccccatgctaatacagaagagaatgtaaaacaaacacctttccaaaaacacaggagaagatgcacagaagaggaggctcggggagttaacctgagctcggcttgggcatctcttaggaagagatgctctccaggggaagacaatgaaggcaaagcttcctaggcagaggaacgcaagaacccaggcctagggcctgaaacagggtgggctgtgctgtgtttgcagctggaatgtgaccctcagtgctcagatgctgtatttagtcctgaaacaaggcaccagaagaagcacaggctgaggagtggcctgaatttagttctagtttggaggagcagccacggaggaagaaggcaagagagatgggtgaacgatttgcacatagttttcatctgacctgctgtggaatgtggctcataattcatctacatgggcagctagctactggaatggacaaaggaaacccagccagtggaaattcctgggaaactgtcatggggcccaaataggaaatgccactcaagagattttactggtgccaggcttggataccagtgtcagaaccatgctcctccaagaaccatttcttcctgtcagccaagagagagacacttcggctgatacatatgtggataataagcagggtcccatccacattattcttttcagccatattacattcaccatctaacttgatacttcaagaactgctga

SEQ ID NO: 57997 - DNA, 929 bp, Bovine  19866881310096
tgcaatcattacaactcacctagcaggcacgtcaacatgcctgttgacatgtgctcacaaatactaaaaatgcatgcaatgcgatgcagccagataaaatgcgtggcacccttccacatacattcagtgaaatagtagagcagaatggaaagagcagacgctttggagctgggtgaatgtgggttccgacttgtttctgtcttttaatagtggtatgatcttgagcacgtctctaggcgtctcagtccccctcatctgaaacactatattcacaattcttagcttttggtcttgttttgaggattgtataagacaatgtatgtaaaagaatggtctgatatgcaacagatgcttaaaggtatttattgcagaaatgccaagaatctgaaaagggaggagagagggagagtccagtgctggactcaccttctttatggtgttttaccttttttctgtttctcagctccttaggagctttttgcctcttgacagtaagatcttgaccttaattgattttactgttatgctcctgtttccattttacctcatcaaatgagccaggagacgatctgagtgtgaatgctgtttcccttccacatctccccacctcccacccacgatcccaaatgcccggcagagctagagacagcaggtcctcagtgaaggctgagaaacgagcattggatttatctttatcctcaaacttcttgccatggtcctaatcccctccttcttccctctgcctctttgagcctagttgggtgagagggactatagtcagcaagaagggtgaagataaagaagggcacaggatttacagtccagatctggaatacatattttggaatgggaaacaaacaaacaaacaaaaaaagtgctccaaaaagagtaactctccccctatccccctcctcatttatctgaaacat

SEQ ID NO: 57998 - DNA, 1677 bp, Bovine  19866881374863
gagtacttactaaccagcaccttaagtacgaaatgtccctttatctttgatttttattcccatcaagtccttcctcctctttttccagaactggaaaaagcaggagttgagtggcacttgcttctttgatctttatcctcctgttcccaggcttccccggagactgagagtccaggaggctttctccaaagcagaatgttgactccttctgccagtcagaatttgggatctgcagcaggtcacaccaggtcagcacttgaaggaaccgtaattgtttggggcttgtgtgaggcctggatgacatccaattccaaagccagatccttaacctgactcttggcaatctctcagcatggagttcatctaatcagatcttgaggttgtttctgacctcaacctaaacagaatcttaaagtaggaaaccctgcattcaatgaaagaggtttggggaaggaaatatagggtagagattcaaggaatcagatgacatccagaagcctgggtggggttcttctccgactgcctatgcaaagggaagataattctcctggatattaactaagagaacttcccttaataaggctcctactttgtgtcaggcactgtgattccagagtgagaaaaatcaaaggaagatagctcattactgcatgcctgcgatgtgccagatgctaagccagatgctccacttatgtacatcctaacatatctatgaggagagtattgctatctcctactgcctgaggggaaattcagaagtatgaagaggtatgatatttgacccaaggtacacaggtagagagaatataaacatttaaatccagatcttcaaactccatgttcagagccctgattacagtatcacaatacatctcaggggatggctgtctcacaccaataccgttaagtcacaaacatgcaggccaggcgagaacaactgaaagctttgggacataggctgcctggttcactgctgtaatctccagcacctggaccagcactcagttgtgtccaactctttgggaccccatggactgcagcccaacaggctcctctatccgtggaattctttaggcacgaatacaggagtgcatcaccacttccttctccagtaagcaccaggtttgcaagctttcaatatatatccttactaactacatgcttggatgggtgaatgactttttaagacacttgagcctctcttctcctcccatcctgaaaggagcataggcaggctgggaaacaagagggaatatttgctcccaggcttcctttctttccaagacattccaactctaaactggctatgagatgaagaggagagatggaggtagaagaaggataaaacttggtcaaaactgctaaatagattaacttcctaggccctccttagccacttctggcttctacatttaaccctttaagaatccaaggtcctgtcctctctttctgcttaaaaaacttacttttggaaaagaaagggggaaacattaacgtaagtgcatttatgttttaaaagcaacaaaaacatctgggccaaagcttctaaataaatagctgagaaaagaacagaaggtaaagccaaagtttagacacatttgaatgcagagttccaaagaatagcaagcagagataagaatgccttcctcagtgatcaatacaaagaaatagaaatag

SEQ ID NO: 57999 - DNA, 769 bp, Bovine  19866881397431
catgtctcctttctgtttttattttattttattttgttgccccacggtttggatttctgtaatgctacttattagtctcacttacatcacagtaattcatgggctcattttctctccttcattggactgaggactgagactcatgttttatctccatgctcctgacacctccccacagaatttgcacttcatagccactcaatatattttattaaattgcaatttgaaaagaagcctgtgtgcttttatttaaataagcccataaattcagcacaaccgtcttcatgaattcaaaattctcagaaacgttattcttcaggattgttcttttgttgagatccaagaggttggctttacagtaaataaaatgaatcacagaatctcgggaccagaataacaacagcaataaggatggaaactagaagtcatctatgtgatccattcccttctcttcagacagttcctcagtcacctgaaactgttatggctgtccttttgcaaagatcccctttaacggagaatgtcatctcataccagctcatcatggcttctagtcttgtaagttaggcagtgttctctcagttaatctgaatcctcccttactgaaatttatgctcattgctttcatagaaatggaaaccagctgctttcaactgaaaatatttccctttccaaagatggttattccatcattccacatccttctcttcccctggtgtaattctcccttccatctgacattcctttccgttctccatttcccaactat

SEQ ID NO: 58000 - DNA, 1247 bp, Bovine  19866881423787
gcactggtgacctaaggcttcctcctcctcgttctaacaaatgccactcccctggggcctgcggagacaaataaacagttcacatctcagcagctggccctggctgtaagtctgcacgatttaccttggctctcactggcattgtgaatgaggtcatagagggaggggacaatggagaagacctctaggagggcagcagtaaaacacgccatcggaaggcgggagaggacacttgagtcatggggtccttggcagctgtctttgagaggtaaataacttcaaaaagtccttgactggaagataaaatgtgtgcttttatgcttactaaaggccatctctagacttttctctcatttatttttatgaaatcaatttccttaaggcccaagagtatggtatggtaaaacgaacgagacctggagtggtgagaagagagatagatttccagcaccatacaggggtctgtggtggatgaggaaatctagtccatgcttacctctctgggactctcctcctcactccccatgtgccagttgtactggaattttcccatcagttttcctgagatgcgtaccctctgagtccttctggaaatctctcctcatcactcttcctttggctgattcctgtatagtcttcaaatttttgacattctacaaagaatgtcaaagaatgacaaatatgtcattcttcagggtcctttcctatttcacttcttcttttttccttttatccttcatgatatctgaaatgcaggtgtgattactgagatttgagcagccattttggaccatgaggtaaaggttaaagctgtacatggcagaactgcaagatagaaagagtgtgaatccctgaagttgtcataaagatgcataccagttttaaatttccacctctggatttatttttttccaattgaggtaaaatttatgtaacataattggccattaaccattttaaagtgtacaattcagcggcatttagtatatttaccaggttatgaaataatcgtctctgtttagttccaagatctattaatcacccccagaaagaagcatcatacgcattatgcagtcactatccattccctcctttcctcagtcattagaaactatgagtctgctctcagtttctatggatttgcctattacggacatctcatatacatggaatcgtagtatctgtgaccatttgtgtctggcttctttcattcagcataatgtttttgagattcatgcacatcagat

SEQ ID NO: 58001 - DNA, 1413 bp, Bovine  19866881494387
atatttagtaggcattcagtgttgattctcttcccttctagtttccttctgttaccttgcaaaggaaaatgtctctatttatcagatctataaatagactgtatcaggactatagcactcactatacttcggatcttagaaccaaataaggatagttgttattatgtgaagttggttatttggaagggacaacaaatcccttggaatgaaaaactgtatgcctcttttggtgtgacttggggctctctgaaaacagtaatgcaggtcacccctatctcagagcttagcatcagcaaatcctatttgaaaccatagagacaaatgttgataaacagacttagtattttatactctccatgtactgtactcctagagttcatcctgaagaggactgttttatgagcttatcaagtgtgtaaacagtaactagatgtaccaatgcatgtaaatgacaacccagagtctctttctatgtggggccaaatatccacatattttactgctttgccagagatcactttccattgattataacttcagctcttttcctctagtctgcctattattttcttacttctcttaaagactctttaccagtgtttcagaatgaggttatggtgatggcaggatttgatgggaagataataatccacaagtactggattcaaggtcgacagcagagccaaggttaaaatttgggtcctcagactgtctgctaattgtcttatgaacacttatggtataacagtgaacaagaaataaataagtccctgttttcatggaaattatggtcatgcacatacacatacatacatgtatgtgcgtatctgcagagagagagagagaacacatactccaggaattggtcagcattataaaggaaaaattggagaaggcaatggcaccccactccagtactcttgcttggaaaatcccatggatggaggagcctggtaggctgcagtccatggggtggctaagagtcaggcacgactgagcgacttcactttcacttttcactttcatgcattggagaaggaaatggcaacccactccagtattcttgcctgaagaatcccagggacgggggagcctgatgggctgccgtctatggggtcgcacagagtcggacatgactgaagtaacttagcagcagcagcagcataaaggaaaaatagagatgagtaaggagacatagaatgagaggtgttaaggtgatggatgggagctatttcaggtgggggagccatccttcattaggttgcattcaaagaggactctgaataaggagagggaacgagccatgattatgcaaagaagatccctttggatgaaaaaaacaagtcccacggcctggaggcagaagccagcttggcaaactcagtagacattgtaaaggtcactatggctgga

SEQ ID NO: 58002 - DNA, 1648 bp, Bovine  19866881545052
cggcaaacaggaggtgcagggaaggggttaagagcattccggcagaggatgaggcctggagggataacacactctggaactccaggtgatcaagtcagtttcaagtgtggtccctgagctaaggcatggtgagataccaaacagagaggcaagcagggtgtttaaacaaaagacaccacacatgaagggagccagccagtcagacctgagttcaggtgctgaccatgtcactagcaattcattcttctctgggctctacttcccaggaaggaattgaccaggaggtgaggggagtgagcagctctcactggggtgggtagaggtgaagagctagaaccagaagctctgaagaggcttattaggtttaaaaacaaaatattgaagatgggatttccctggtagttcagtgttttaagactctgcgcttccaaagcagggggctgtgggcacaggttcgatctctggtaggggaactaagatcccagatgccacaggacatggctgcaaagcaaaagaaccaacaaaaaacctgaaaatgtgaaaatgctgtcgctttgctttgttttgaatcataatatttattttgaatttgaaactcattcagaaaaggcttttgcatttatctacagtgacctggatttcataaagaggcagagaaaccctggttgagggcaacttaaagtcccctctgattcttgcctccaggtctaagatgactgacagccaggcatatggaaaaaagaagagaggtgcagtgaattagctgctgaatttacgattagaccaaaattgcaactcagattatagtacttactccctgatgagacaggcaagttaatgaactttttggagtgtcaatttcttcctctatacatgatgttttcctcacaagttcattttgcaattaatttgaaataatggacttataagcatctagcacatagtaggcattcaataaaaatcagttgactggaaaatcttcagtggtctctctgcgtcccagtccctaatcataaaggcttcccttgagtgtctaccatttgctgaaccctctccacagctatctcatgttcaaggagaaactcacaatttaatgctttgtcatcagttgagctcattgcattgtctaaaggtggtttaactctcagaatacagcattgctggatgatgggaatttagggcatgctgcttggaaccagaccaggattcaaatcttctgaaatttaaagcttttttttattattattactctggaaacctatccactgcatgcctttatttccaaccgttaagcacttttcccccttactttccacatttaagtcaaggcttcatatgcaaaaggcaagcttgaaacgatcataacatttaagcaatgaatataacgacagcttacacttgcatcgcaggaagatctacattctatatttaatagctttagtcatttacagcaagagttatcacaggcgccccaaagagggagggctggagagggagaattctgcacctttgattaaagatgtcgtagtcataagctgttttggaaatgattaagtgataaatacagtaagttcatcctcagttctgggaaccccacagcacagacagtaattttcagaggcagaagccatcattattatttaaaggt

SEQ ID NO: 58003 - DNA, 1214 bp, Bovine  19866881555165
gtctttctaactccgagtctatacgctttctcttgcttgccctgcaagaatatttatgtctgtctagattatatctatgactttacttacattagcctgcagttacacaaacatatgtctatatgtaaagcagaagatagagtttctataatatttaacattcttccaggtaggtgtgtttctaaatccattttatggatgagagttgaggcacagagtggagaagggacttaataaaatataattaagccagcacagatttctggggatctcccagttgtggggaattaagaccaggcttaatgatcaggctggctattttttgactgaatgctggagagatcagtaatactaaagttgataagatttcattgattatttttttgattaatactgaaatggatattgacactaaacttaacttgtgtagtgccttgctgttctaaccaccatcatggtatttttacctccatgaatggttgaacaaatagactccagcaggtaaaggaattttcttagggacacagggtgaaggattgtattcaagactatgatactgatctctctctccccttgactttttgtctactttggtgaagatttttcatcaaacaatggagcaagtgcttcctcctaaatagagcagaatgttttaactcagtgtgagttcctgggcccggaggccctgatttcaagtaaacctgtgaccaactcatcagcttcagaaacttatctggtatccagagggaatttttaaccaggaggctctacttattctcttctgtattaatatgtgactgaaaacatgagctgttgttttcggttgctgaacttgggaacaaaaacaaagacacagaataacccggtcctaggttctgacacctccaccacctgttaggaggacttcccactccaagttcaaaaggtagaaggctgctggaaaagtgtttgtttgggggcctgagttctaagattgcacttgcgtcactgactgtgtgagtaggcttaccctacgggcccactgtttttcatggcacaggaactcaacacatgatgcttcacatccatataatatccccaagtgctaatgtttactttggggctcgcacatccgcagctgttggtgggaaaatgaacatctccagttattgctcagtggcggcagcctcacatctgaactgctggctgcttccttatcatctctccacgggcct

SEQ ID NO: 58004 - DNA, 930 bp, Bovine  19866881556971
gagaacagagtatttgaatagcatatagttatatctatatagcatgaataaataaaagtactttgcttaagtaggtatatttatgaaaaataaactatgactcagaattcagggaactgattctcctttcctttagtctccaactccctttccagagcagagcaactaagcctcactggattattgttattttggagttcctaccagctctgagatcctgaaagccatgactcactcccttcaaatgcactttctaacatgcacatacatgcaatctttcatgttatttcagggtttagagccctcctgtagctcactcacagatcacctctagacaatgagtccttagacagtgatgcttgaccttctaaaaacttgttttcatttctggttgatcttcagtttaggagttcctaacactgaattctcccctttctccttccctaaccatccaatgctttcgtttaagcacctatttataaaaacaaacattttcatgttccaaggaagcttactatttaaaggaaccccggactggatgcttttgtaaagtgaacaatatcacatattttataaatctggacattcttaatgccagctcttcttaatgcacaagaacatggcatctgcttgcttgcttctatttaattgaacttagaagacaaagtagataaatggtaggtaagatgttctaagattttaactccttccagttctcagctatgtgaagctattagtaaagtagataaagatcttcagaatttccttctggacaagcatctatttttggcaagctccctagaatctctgtcacaacagcatatgatgtatcctgggggatatgcagtctcaactttatcaatagacctaaatctctttaaaaatggcattcaagtgtcttacagcaatagctgaactgggccaggtaga

SEQ ID NO: 58005 - DNA, 1600 bp, Bovine  19866881613808
tacccaggattccctccatctgtgtcatgatctctgggtctgatgagttgagaaggaatcacaggatcttgacatttcaatcagggctcaaattcccaccagcagccagacacctgcagctcccaccatagccaggctcggcaatctttcttcaagatggtttgcttatcacttccgccagtcacttgccctgcactgttacagatccaaaccagggcaaggtcatggtgtttccataacaccctgtgcttttctcactcaaagctcttgctacactagatgtgatgtgtctgttttctgtctgccttcttccacagaccctgagctctctgggggcaagaatcatgttttcatttctgtatcttcaatactacccaaagtggggtatgagaagaggtactcaagactcttaagtaaatatttgaaaactaagatctggcccttgccaacttctcttatttcttaccatcatccagtagttggatacacatagaagtcacttttcctggtatgacaacagcagttaacttaagaaaaaaatcattttaacataaatgctccaaataatatggcaccccacctatatcctccttttttctaccctgtctagatcttggccacattcatgtgctgtcaagtctaggataatctctactcctcctccccatacttaccagttatgtcggcgtgcatttgcacaaaaaggggattcttgctgaggccaccacacaggaaaagggtgctgatcgagtgccctgctgactccatggcctctataatgaggcgcgtcccgaacttaaaaggaaaaatagaagaaagcatcagcatggtagcaaagggaaatgatatagaacatttgctaagtgtttacccagcagtagaacctgcacttggagcctgacatatatatactctcttagaaagtcaggactcaaggagattacattgctcgtgataatgccattatattaagttgcagagtgggaattccaacctgggtctgcctgattccaaaaccttctgaattattataccatttgcttctatcagtagtcatacgttgacaaaacaagttgacagtgttaacacagttcattcaactacacagatttgatgagtatccactatggtccagatcctctacgataaactttttggcaccaggggctagttttgtggaagacaattcttccacagactggcgtggggttggtggtttctggatgactctcataaggaacgtgcaacctagatcccttacatgtgcagttcacagcaggattcgtgatcctataagaatctaatgctgtggctgatctgacaggaaggagagctcagttggtaacatgagtgatggggagcaactgtaaatacagatgaagcttcgctagctcacctgccactcacctcctgctgtgcaacctggcaggctggggacctctgctctataagttatggggaatggagtgactggcagctctgctccaaaaaactctgtttcaaaagatcgctgctggagatctctaagtcagttttccttccttaaagaggaactaaagaagttagttccttggaaatggcgccaacaaacttagcagca

SEQ ID NO: 58006 - DNA, 1788 bp, Bovine  19866881619369
accaaaagagcaaggtccagatgagacatttaccccaaacccccgctcctcgttgatggtaacaagatgacggtgactaattgcacgttctggggtcaagttcagaccactcctccagagccctctccccagagaaaggtgagtacctgaggtttgccaaggccatttttatatgcatgtgaatcccctctactctagcatttcacgaagaggaggggagagtaatcaacaaaatgaataaagtgcttgtgaaatgcatcttctactttctggaagcccctgctgctgaatgaactactagactcccatcaactctccactagttaagtccaaatcacacaaaatgggacaaacggaaagagcacagggaaaacgaaactccccgtcccagcttctcattagttaaataaaaagaaaaatggagaagatttaaaagagaggaatttaagatacacctaaatatatacactgaagcaggtttatccgtcctttgggagatgatcttctttcttatatgcaattatgagtcattttcaagataagaagacccctgcccttgtgcatcccctgaaatttgaggtcaagatgacaacaggtttgcatgcactgagagttcatgtcctatctgtccaaatatatgcacatctgtgcacacatccactctgtttactgcagcagctacaatcacacttgagtatttttttaaattgtcaggtgtgtgccagatagcacatgacttatgtataacattcaaaatttattaagaaatactattgatatcaacatacatacctttatcctctgggatgattcaggtacattgatacaaaaagcaaaatagcttcattaacacaccaatctagttaaagttaaaatcagcttccttaaaaaaacgtatctcttgccttaattttaggggcctaaatgtttcttttcttcatcatgtaaaaaagtggctttggaaaaatagtcacatttcacaatggactattcacatctcctttaaatgtgtccaattttaatgaatggtcttcaccttggatacacacattccaggcctcataaaaacaatggtgtttgggcatgtgcagtggaggtggaagatggattcaagatgtttcaagtatgcaaaatcacatgcagatgtacaaatagtacatcgagtcaaagcgcgttaagaaagcaatatatatacagacacccaggaatggatgaacgcaaataaaatccaacttgtaattaacataccgtgctgtgacacctgttgccttccacgataagaagtctgggagatcaaagaaatgtcccgccttatcccagcaagtctctctcaagttctgccaaattaaatatatattagaatcaattacaggctattttttctcctcctctcctctctcaataatgtttcaaaattttcaaaacaaaagtacagccaacaatgcccaagaaaacatctgtgcaggggctgggaagtggtggtggggaggggagtataaaagcagtacacaggaaagaaaaattggcaattattgatccttccaaaaatgactataatttcccttttattcttctttgccaacctggtgtgggaagaagtacactttgcaaggggatgcaatccatcttgcaaggggatatatttcaagacatataaaaagacttcaaagctgaacagctgggaactggggagaaaaatcacactaggaaactacctgatgaaatgtgatgtgtcctgccatgaaaacgtctccccacgctaacaggttccaaaaacaacaggaatga

SEQ ID NO: 58007 - DNA, 725 bp, Bovine  19866881859403
cccccgcccctcttttgcttccttctcctattttagattctaaccaccttgagggcagagctcttttggtttagcagagcactcggaaggtcaggtgaggaggtggggaggcttgggtgaggatcctggctttaccaatcacagggcttgtgacctgggcaagtgattcaatttccctgctgcaatatcctcatttttaaaaaggctacaatcatgctattgaatatttttctcccaaagtggttgtgagactcacacaaggtgatacatataaaaggactttaggattctgtctaccacatgggaaatgtttaataaatgtagatgtcatggttcttgtgactctgtattgctggtgtataggtactgcctggaacacagtggttactcagttcattctggctgattataaagctgaggagagagcctcaatgttagggcatgtggagatatatgctttggggtttatgagaacaaaccagagaaactgtgaaaatctgttaaaatattcacagtaatggagttcagttttccagcacaaaaaagtgtctccccacggctgtgtctccatggtatgtctccagagtgaaatgttttaaaagcgctgaaaggtgttcccctcagagttattttaaggaccaaatgtcttgcttcaaaaggaaaaattatgattttgtcagtgaaacgcttgactgttaagcatgaccaatgattttaaaacccag

SEQ ID NO: 58008 - DNA, 1417 bp, Bovine  19866880488702
gcatgggccggagactgttccctccctgtgcccacggcccagctggcagagtctgcagtggatgggaggccctgagcagcggggaggctgggcctgagcccaggggctgggaggtggaggctgagtcctgcctgagtgtccctttaatagctgctggcttggccctgcttggcgcctgcttcagctccctgttcagctgtggctgcagctgctgtgctgactcacgcagcctggccgccagcaggagctgggaacatgggctccccaggcaccggggtgggctgggggcttctggattacaaaacggagaagtatgtgatgacccggaactggcgggtgggcgccctgcagaggctgctgcagctgggggtcgtggtctacgtggtggggtaagagaagagctcccgggtgtgctggccggaggggttatggctgggctgaggggcgagaggctgagtcttcagggtctgggctggtggtcggcgtgcagggcaggaggtggggagaaggaaggctctccgtccgtctagaggctgggggagtgtcagagcaggtcctgtgctcaggtgcctctctgcatccttccctgggccttcttcccagccccgtgctggactccggcacccagcagaatgggcccctgccccacaccgggggcccttggccaggcaggaggtggtccctgaccacctgagagctgagagctggagcactaaggaccccggtagagaccaccctttcaagctgggtcgggggcgtctttgaggaggaagcggatctagacagggcaggggaggctgttggctggtgaaggaggtgatggcgggcgtccccaagctcacaggtgcctggcaagggccctggccctctgacccatggccggagctccggcctgggcaaggggtttggtgtgggagaccaggtggagagaaggcggggtccctgagccccgggctgggagccaggagggtgcgggggagaggtggccccgggggcacaccgcgctgcctgtccgtcccctctaggtgggccctcctcaccaaaaaaggctaccaggagcaggacctggacccccaaggtctctgtcatcaccaagctcaagggggtctccgtgacccggatcgaggagctggggaaccggctgtgggacgtggccgacttcgtgaagccgccacaggtgggtgacctgccactgctgccgggcgctggcccctctgacacaccccctactgtgagtgtgtgcaggggcgacggggtgccagctctggcccaaggccatgcttggggcggggcctcgcagagcagtggccttccagtggaggaggagatggtcaggaagccaggccggagggacgcgttcagcaagcctgcatccggagcgggtagagaagacgcggtgggcacggcggaatgccgc

SEQ ID NO: 58009 - DNA, 1299 bp, Bovine  19866880533551
tcctgtgaggtggagacgagggtggtggtgggcagccacggggaagcagaggcgcgcgtttctgtgaggctgggaggcccgggagccgcggaggggcccggccggcccgcaccgccctcctgcccggcggggcactacctgccggcagtcgtcccccactttgaagatggccgcctgccaggagatcttctggccgtcggcctcctgcatgctgccctcctcctcggggtctgagcggcaccgcaggcctgtggggagaggccctgtgggggtctgggggcgccctggtcacgtgcctgaaggaaccccaagaaccttagggatcacgcctgcaaagcccaaggggggctaatgggggcctggcagacacccgggtcagcgggtggggccacagggccgtgtttcttcctgagaacagctgaagacagagcgctctctcgccggagcgaggactgggggccctgtcagggctgggccccgtgaggggtgcccagcaggagccggggccacaccctggctggtgtcctctcaagcccacaccacggggactgcagagtgtgactacgacacttggtggagtcagcgtggccctgaccagcggtcgtgccttcccagagacggaagagcggggactcgggccgaggcagaggccgcactgacagtccacggccgaggaccaaccaggccccgtgctgggaggaggcgcaggaccctgccaggagggagcggagcctcccgacactccaggctcagcaccaggagacggtcgactcctgccatggaagccggcctgcctgtgggtgctcacactgaggccaagcagacccgccctcccgggcccgttactgcatgtgtgcccactgaccccggccgaggggccacactgatccaccagtgttcacaaggaccccagaatacaggggacaaggcactgaccttccttctcaagctcactaaccccgcaacgtttcaccttgaacttcgccagatacggggccttggcggcactagaagacgagagagggggcgcaggtgatgggggaggggacgcgggtgacgggggagggggcgtgagggacgggggagggggcctgcgaggggcagctgggggtcgcacctctgcatgggcgtcccagacttgtagtcgatgtccagcacgatggcctcggggttgctgggcaggtagcagcctgcaagggacggagggacgtcacgggcgtgggagggacatcacaggcgtgggcgggacgcaggaggacatgccgccatccagcacgcaggccggccccgggcagacag

SEQ ID NO: 58010 - DNA, 839 bp, Bovine  19866880567312
ccttcacagcatctactggtaccagcagaggcccggccaccgcccgagattcctgctgagatatttctccccctccgacaagaggcagggccacaaggtcccccctcgcttctccggctccaaagacctggccaagaacaccgggtatttgagcatcgctgagctgcaagccgaggacgaggctgtctatttctgtgctgtggggaccccggtcatggggcggaggcggaagatacagagagagagggcagaaagggagctggccaccctgggctccccgggcccccgggccacactccccttgcattaaaggccggaggccgcatccctctggggtggggtgggggtgtggacaaggaggctgggcggtgggctgcccagggccagaagacactcctgtgaacccccttggaggctggatttggggattaaaactgcttgcatcttgggaagttgttctgccgagtggtctgaattggttcggaggaggcccaggatgctttgtgaacagtcagaatgagtggaacgcacctgagaaccagccagggtgaaggtcccaggagactggctggccatggtctgcttggccggagcccctgggctgtgggtcttccgggacggggggctgacatggccccttggaggtgcccctgccaaggacagaacctgctgttgtacctgactgtgggcatggagtaagcagtttagaaaacacctttgctggccctctggggagaagagcgatgcccagggatgggtgtggactcggtcccccgctgggccagacggttctgtgccatgggggacggcctgtgcactccagggggtccagcggcatc

SEQ ID NO: 58011 - DNA, 808 bp, Bovine  19866880587904
cgctcctggtaaatgtacccgggacagcaacgctcgcctctcgctgccccacgggcctccactggacagctccgtgcatggaggcgaagccacggctctcggggccgacactcaggtgtggttctggtctgacgggggagtccagcacccgctccggcccgagggtgcaagcccttcctggcgcttgactgggacacaggccaccctctaggaagaaccaaagaacccaacttgtgacttctgggctgtgtcatcagagtctgacagaacaccgcagacctgtgatctgaggagcatgtcagaactgatgctctgccgtgtggaggaaaaaacccctccacaacgctgtctacatggccttacacaaacccaggtgttcgggcagcgcccagcagggagcgggcccgctgggcttcctggtctaagcacagcctgacctgactgttggttcggaccccacgatccagaggaaatcgacactgaatcttaatgtgagcaggagatagaggacgcccgtttattttcaggaatgacaagcgcatttccgtttgtgttagcaggcagtctttatataacccactctccactgctatcaaaatccaaacaagaaagaaaggacagctgagaaatgaaaagctgagaactgaggaacttttcctaagtgatctgctggagagcattttccgtggaacacaactcagaggtaacaacagagtctcgtttcaaccacaggtgcgtggcacgtggactcatctccgcacagaagctgtaacagtcatgcgaggggacagtgacggctggacaggca

SEQ ID NO: 58012 - DNA, 1224 bp, Bovine  19866880590727
acagtccttcactggcatcctccttgggccctgggatgctctgtgccttggggtccctgcccgggaggggtccccgtcacagcgtctctggggcctgtggccccagggcagaccgctcactctgaggctcactcacatcgggtgcccaccctctactggtcaccactgcccaagcccagggctctcccctgcaacctctgtggtcttctactcccggtccacactctgctcctccactgtcctgggctcggaggctggggctcctgtcctcagctgtcctggggcctggcttcctccatcgcacgtgtggtcctgtggggtcgcttctttgtgtcccaggcaaacatcttcttgagggtcctggacatctcgtacaatggctgtggggattctggagcctccgcggtgggggaggcgctcaagaccaacaacgtgctggaggagctctacatgaggtgagagcagggggcccccgtccccgtccccaggccccccgccacccagggactggggctcctcctgctgctgttcaccctcagggctggaacctgtcacagtcccagggcatgccgctctgtccccctcactcaagttcatccttgctacgtgaaagtgttagtccctcaatcgtgtccgatgctttgtgaccctctggactgtagtctgccaggctcctctgtccatgggattctccaggccagaatactggagtgggttgccatgccctcctccaggggatcttcccaacccagggactgaacctgggtctcctgcattgcaggcagatcctttaccgtctgagccactagggaagcccatccttcgtacctggggactcgtaattcctaccgcgtggctggggggtgggaggtgtagcatgtaaccctcttcagcagagctggtgcgggcgtggtgctccacgtgcgtgctcctccctttcaggagggtttgtgctctgtccagcacgtggctgctgggggcctgccgtggctgggctgctcctccaagcccaggcagggtcccaggcttcctgggaacaccagagggaagggaggaggtgggggtcagacaggtcatgggctgtccgccgttggcacaggcatctgctccatcctacccgttttcccctcccggtgggggaagctggggtctgagaagatagagggaagtggggctggcctggagacaaagtagccaagagcagtgaggggccctgagcaggag

SEQ ID NO: 58013 - DNA, 995 bp, Bovine  19866880643503
cgcccggccccccagacgtcagccggctgcggcgatgcaggaagcggtacgtgctgtcccactgcgtatagccccgagggcccagccttcagggtgctggccagcagccttcctgggcggggctgggagcctgtggagtggcttcagggatgggggttaggggagctgtgaagtgggtcagggcaccctgcgcctggcccggcgtgtcagtctgtctgtctcttcccagctgctctgagggccgagggcccaccactccgttttccccgcctccacctgccgacctcacctgctttcctgtggaagaggcctcggcacctgctgctttgtctgcctccccagccgggaggctggagcctggcctcagcagccccttctccgacctcctggggcccctgggcgcccaggcagatgaagcgggctgcagcgcccagccctccccggagcaccagccgtcccccttggagccgaggcctgtctcgccctcggcctacatgctgcgcctcccaccgcccgccggcgcctacatccagaacgagcacagctaccaggtgggcagcgccctgctctggaagcggcgggccgaggccgccctcgacgccctggacaaggcccagcgccagctgcaggcctgcaagcggcgggagcagcggctgcggctgcggctgaccaagctgcagcaggagcgggcgcgggagaagcgggcccaggccgacgcccggcagaccctgaaggagcatgtgcaggactttgccatgcagctgagcagcagcatggcctgaggggcccgtccagcagcacttggcctgcggatccacctggagagggagctgcccctagctgtgtccgccacaataaaggggatcccagaaagccctgctctctggctcagctgagggctggggccccgccccctgggtaccatgtccatctcccctgactggctgtagcccccagagggctcggccctgcagtcacggtgattcccaagcccc

SEQ ID NO: 58014 - DNA, 1575 bp, Bovine  19866880646423
taaccacagatttttgccaccaacaaaaggctgtgatccaggagctccagttgggaaactgcactctagaagattccactggtggtgccccttcgggtaaatggaatattaatttgtctccaagatcaagttcatgacgctgtacatctcttagtgtgatttgaatgacaagagtcctaatggcagtggagggggtctgagtctccctgtggagccaagcctcattgccaacagcatgggcagagaggggtccccttagagagatggacacaccgaggagagctgggaggagacacgtggccacggaccaccggacaggagacgggcccagagcctccctccccatggggaccctgacctgtcccagcccctccctgcctctcctgccactaagcgctgagccctctgagcacaagggcagattttggtagcacttcccccatgggctacatcactgtggcattgtaactaccagttcccagaccacagtaatagtcggcttctacctcggactgggcctccgagatggtgagggtggatttgtttccagagatggagccagagaagtgagcagggaccccagaatatcggctgcttgtgctgtagataagcagtcggggagcctggcctggggtctgctggtaccagctgggcagttactggtagtgactgacccagagctcagtccacaggtgagggtgaccgtccctcctggacacactgacagcgctggctcctggaccacagtctgagcatccacccctaaaaggaacaagagagagacaggggttgttatggagacaagggccctcagaccctgcttggaggtgccccaaggatacagagtcccggcccctgacctgagccgtaagtgaggagcccgagcagaggcaccgttcaggccatggtggggaccctcccaggatgcagcctcctcagcctcctgggctgcaggtggagtcctgggccttttcatgcctccagcccgtcaggagatgcaggggcctcatgcagatcacttcctcctctccctgcccacatcacctgatgtccccttgggtgggcgttcttgaaggaggcagatgctggacctcacgcagagtggggacagttcggggaggagcccctgagtgatggggtgacgtctgccagcaaatgtgctcctgtgaccttggtgaccttggtcctctgtctcctccccgagtgtctgaggctgaaggaggagtttgcaagtcttcctctgctgctgctaagtcacttcagtcttgtccgtctctgtgcgatcccacagatggcagcccacaaggctcctccatccctgggactctccaggcaagaacgatggagtgggttgccatttccttctccattgtatacacgcatgcatgctaagtcacttcagtcgtgcccgactctgtgtgaccccatggacaagctcctctgtccacaggattctctaggcaggaatactggggtgggttgccatttccttctcctaagtcttcctctcttgccccaataatccagcccttcccacacctgagcctgtctttagaatacactctgtcttctcag

SEQ ID NO: 58015 - DNA, 1777 bp, Bovine  19866880697174
tacgtctgggggccctggctcccctgcggggactggctactcttggccgtgctctcgggggccgctgcctccaagctgcgtcttcctgcgctcctcggcgatctgtgggggccgggcggaggcgggctcgagtgctggcccaggcggggctccggggacagaaccgggccggccgcgggcacagccggtccccccaggcctctcctcacctgagcatcggcctcttcgtaggggtccacgaacacgatggtagaatcaatccggatctcctcctggcggggaggtgggcatgagcaggccccccacctgccgccgcccacccagctccaagcccaaggggagggccctctgctctgaggcacataccttagggcggtcagttttggggtcactctccacgttctccatggccgtcagtgtgtcaaagcccccaacaaccctgcagcagggcaacggggcacctgagaacgtgcccggcacgagcacccctgaacgcgaggcacccctgcagactggggcacagactgtgagcaggtgggccggctgccagcacagactgacaggacccaaccacacacacgtctgcagaggactcggcgctaagggtgaacaccgagtcctggacaaaaggtggagagacaggacatggcccagctttgagctttgggactgcaaagggagagcctgcggggggcaggtcttgggtctaagggtcacccctgcaacctgcgcacagaccggacaagggggcacaggcctggcctgggggaggcggccacccacccccaacacagaccctgtccagagccttaccgcccgaagatggtgtgcttcttgtccaggtaagcgcaggagcggaaggtgatgaagctggggaaggacggggtggtcagggagagcccatgcctccctacccgcctgcctcagtgcccccaggccaagctcccacatgggccagtgcactgtccacagtctcagctgggacagacacacggacacggcagagaggctgacccctcagggttgcacccacagcctacaggaggaaaacacacgaccccagggacagatgtcccaggaacacacaaactccgaaacctcgcctggaaaagcaggcccgggagccgaatcaggtgacaacgctgctcaccggccccgcacagcccatccggagggacccgagtccacccacccctcaagctgagaacacaagtgtccacaaagccttgactctctcagataaggacccggatagacgccactcagcaactgcgccccccgtgacctagatggacccggtagtttcctctacgtgagcgaccaccaccccagaatgaggaaagagaagctccatttccaagctgtcccaaaccacaaaaaccctccaggagcagctgtccgcaggaaggcagggcacccgtgggcaggaactgtgaagtcacattaaaaagatacaagacgtccttggaaagccgaggcacgtccccacctggaggctctcacgctgcctgatcctctaaaacacgccacacggctccgactggaatcacgtccacgtcggaggataagcaactcagcaaagcagacaggaaacagcacggggaccgccctcggggaacgctgtaggccccacagacgctggcgtcgagggtggcccgaaggccctcctcgtggtcggcgggaggtccctcttctgtgggccgctccccaggggccccgctgaggtaggtccagggaaaaccactggacaagtcccccgggttggtcgccacccttc

SEQ ID NO: 58016 - DNA, 1762 bp, Bovine  19866880707643
tcggttctgcagcgagtgaatctgttttacggagtgttcatcctgtacctcctgtctccccgtccaccgctcccagtctcccattggctgcttctggaagtcacaccctgtattctggtttgcttcttatttgaacggactcctctctacccacctccccagacacagcctgaaagcctctgcctcaggtcatctcagcttttacgtgtattttgtctggtgttccggctccaccgtccaacttatacacgtggagggctcctccagctctcgttgcttcctcaccgctgcacagaaccagcctgcggtggtgagcggggcgtgctgcctgctgccaggcgggtgcgtgccgctgtcctctgcccactggctttcttgcctgcccgttacttgtgcagagaagggtgttgcgagtctccagctctgttagtctatttctcccctgaattctgtcaagttttccttcagaagcacacgtgcgcgtgctgatggggaatctctcctcccctcctttcgcatcaggtctgtgactatttaagagcatctcttgtcgacgtaatcgggcctcacgtttcatccacgtgtagaactcctgcctcccagtgggcgggctcagcccgtggacacgtgcctggtccgtgtggctgctccgcccgtgatggcctcccttcctggttagccccacgcctggcagagcccctgcctccccacccgctgcctctgtcttcctgtagctgagcgcatcctgtgccagctctggggtcccagcccgctccccgtttctttatgcctctccaggtgcatgtcctctcctccacgcgccttcccttcacctctgtctcacatgctatgtaccagcctttcgggcgactcatttctaggtgttttatcgtttctttagtttcaggtctttggagggtcgtgggggtgggatgggagccgtgggggcagggggtcagtgtgggaggacagtgtggttgcagagcagagcgacccgaagatgctggagacggacacggcggaggcaaggccaggaagggacggccgctggccccacgccggcagggagagcccatgtgctttggctccgcgggcgccgtgctgccgtctctgtgcactcacagtcgggatgccgggggcggccctgagccccttgctgcccacccccagctaaacgtgcacttaggacccagagtaaaccaggttccagcacagcggtgcttttgtttttattttgctcacgttggttaaataccactgttctgatttttgtgcctaagaacgtgctccctgtacctctgagacaggacgggtggggggaaatgtgtccagtgcagaagagcccgtgcccacacagagaccggctctgattgtccttctggccacacgggcggcacccgggaccgtgcgtctccggcttggcaggggcacctccagcccatttgtcctcggatgaagcggcggcctgctcgcctgcggagcttgattgcggccgccccgccctcagtaggggatgtcgttctgatagtactggatcatgtcgtaggtccggctcctgtgggcacagggcaaggggtgctgtgaggggccgacccctctgagctgccctggaggctcagggcccaaccgcggacctctgccccaccagcacctcgcccgctgggacccgtgctccctccctggcagactatgggactcttccccatctcctcgactcgtgggtgcctaacgtgggcttgggtagacgcctttcctcagctgg

SEQ ID NO: 58017 - DNA, 1464 bp, Bovine  19866880735669
cagcgagtccccgtgggaggaggcctgccccaggcctctctgcagagagaaggggaaccctcagagatgtccgcgggcggccaagcaaggcctggtgctgggctcccggctggggtcagccccgcacccccccaccgggtccgcagcccctgacctcacccctcggttctccagctgcagcagccgtttgaggctcttctccagcaggagttggtccgtcacgggtggcagtcggcccaggccctgggagcccaggtcgctgtcccggctgtggcagcccggccagtcggcggctgtgcagctgctgcgggagtcggacatggagctagagcgggaggggtaattgttggggcgccccacgcagaggccgggccgggcgcggtgccggcggagggtgctgaggctgggccgggcccgcgcccggcgcccgcccctcggcacctccacggggtcctgcacctccaccagcggcactcccgcctcggtcttcacggtggccatgcgctccgttgcctcctccaccaccgtctgcaggctttccagcacctgaccctcgacaaggaaatccaggaagctcctaaagggtcgagggccctgacggtttctgcagcggcctgaactgccagaggggtcatgcgaggaaggcgggtgtggcctgtggcccggcttggaggcgtggcccatttccgagaacagagacttcttaggtggctgcacctgagcagacaggcatgtcagggtgggcaaggatgccccatggcgggggaaggtgttcccgggggtcctcctagggcaccaggagctgggtggggactgggcagtaaaatgaacggggttttggagccaggcagctcaggctctggaccctggctctgccagcttcaggcacgatgccctctcttgaggtccctctcttgcagaatgggggtccgttcagggtggccctgaagcttccctgacgtgtacgcttcacatacacaagatgtggctgggcagtctgaaagcccgcttgtgccctcacccagggcatgactgggcaaccacaaaacctctcggcactgccccactgccggtctcctcagaccacctgcggtcctgagccctgtgcgccccatagcggctgctgcatctccagccagaggccctcaggagactctgttctcactctggggtcctcccaggcccctgggggtcgggggggggtgggcacagggaaagagactgacagaggtgaccaggacccagcagggcggcggcggagtgctgaagacaacaggtcactatgcggcccagagaggacatccgtgggggatgagaaacgggggcggggggagcgggggggctgtgggctactggggaacacggtgggttccccacttacccgggccacgtaggtagggtggccggcctcatcgtccgccaggtagcccgaatggtggcggcagctggccatggtgccgatgg

SEQ ID NO: 58018 - DNA, 716 bp, Bovine  19866880816583
tgccccacccccgcctcccacgccctcccaggcccagcacccactggccattctccaggtccttgacgtggcagacagcggcctccacgcagtcctgggcgccggggtaggggtgggcggtgggaaggcgctcgtccgcgtggaagtggcgggcggcgccgttgccctggtaggcccgggggctgcccctgctgccggtggacagctcctccttgccccggtccttctcgggcagcaccacctcgatcttgagctccactgtgggcaggcggggtgcgtgtgagcctccagcccagcccacccctcacctacccctccagtgctgggcagagcggaggtactgggggggccctgggcaagctcaacgtgatgtctcatgcatttttttcctcactaacaaaatgagccaggggcaccagcagcgcacattcgccccagatgcggccccttctccaggaacccacgtgcgggtgagaatttggggctggaaccctgctgaccccaagggcgcggccaccatggaggatgggggcggcctgaggacacagcccgggtcacggtccctgagtgaatctgggtaacggaggtctgcagaggtttgaaactttttcaaaattaaaagaaaaaagtgtatatgctatgtaatttcaactggagatagctgctctggccagctggagaacccctcattatttgccaggtgctgagtgcagggg

SEQ ID NO: 58019 - DNA, 2279 bp, Bovine  19866880831954
ttccgtgctaggtggaccacggccccacccccggccttttctgagccgctacgtgccttctttctgtggaagcgtacacacacctcaacctgttgttctgcgccaagaacgttctttccgcctccggggatggctctcaggtgcggccctgagcaggcggcccctctgctccccggaggtggacacgccggccgagccccgcccccggcagcagctggcccgttcccggtgttgagctttgcgaccctgcttcggcctctggtctgacataggccagcttgggcccctcccgccgcctcccccttgtatcttaggggccaggtgtcttctccgtggggggagccttggccaggcccaggggcagccccgtcttagcagggctgtaaccacctagcactgggcactgagtgatcttgattaccaatctgtttgagtctttttgagttgaaatcagcttactttggaacaacttttatgtttacacaagagttgcaaaggtagtccagcccgtcccagcctgcgctctacccagcgtgcccactgccgcccagcgtgggcctgtgtgcttgccaaaattaaaaactggtaaaagtacatgcctttataaagctctttatgtccagagcctttgatccctccctgccttgtcagggcccgccaggatcctggggcggggggcgaggtggatgcccacgaggacttgctgcgcgggagtctcttcctccctgaaaaactgatgagggaaggtagtttcaaatatgaagaagcagtggaagttctcctcctcatctctgacactttatccagagtcgtttggttttaactttttagaaaggggttagattggctgatcagcaaaacctgcaggagtggggagagtgtggagagaggggaggacggagcaagcgctggacgccgggtccctggaggctgaggctccagggaggacagtggggagggtttggtccagttgggcgctgggtgacacccctgcggtgactgcaacactgggcctgtcgctggccatggagtcaggccgtgtccacacccaggcggcctcaggaccagggatccccgtgggcgctgttaggcatggacacagcccttggccaccgcgcagcctacctgacgcccggagctattctcggggcgcctgggcccattttacaggtcgggtagcaatttggcttgaggccccccagcttcccctcatgtggctttgttcagtcttggtccgtctgagtccccccacccccaaccctcagctgcacagcctctgctgagcaccagccccgttctggctcctctctgcgtctctggttttcccatcccttcctcgacaaaaggggtgcttggtgtttcaatgagcacgaggctcctaaaatggccaagcgtcccagcgtctttcctcctctccctcttggagctgaagagaggcatccctgcctgtgtcttcccttctgagcagcaagtgggcgacttctgctaggaggcacccaaggactcttagttactagggggagaaattaaaacattgtatcagaggctcttagaaaagaaaggctgggtgccagcgcactgctcagcaggcaggtgggcagggcggggccggcagcactcacaaacccacgatgggccagaggggccggagcccacaccctcccgggagtcagccgctcgcttggggttctggttctcaggtttgtcttccgaatggtgaagcaccatatggacatgggcctgattcacgttctcaaaataaatatccatgcttattttaggaggaaaacttctggaatccagaatgttatttttgctctaaaaacttaccccacactagcatcttaggaggatggtggctgctccccaaacccagggacacagcagccacagcagtgaggccggtggtgtgtttgctcttcaagtgctaagatgggtcctgacctgtcagcaggtctcctcgaagagcgcgctgtactggtggctggagaagtgggcctcggggatgcccagcccaaaatcccagttaaatcacaacacgcttctctgtgaccaagatccaggctgggcccctgctccgctgggttccccaggggtcagcgaggagggagggcaggacagatggcagaacacgtgggctggaggcacgccggcctttgaagggtgaccgtgggcaccgaggatggacggggcctggcgctccaggggaaggggcctccggggggcggcagtatgcgggaggcgatctacaccgggagaaattcaaagaaacagaaaag

SEQ ID NO: 58020 - DNA, 1224 bp, Bovine  19866881042546
gttgacactgagcattaagcatccctttttcatttgcttatttgccttaatattttgctcgaggctgcttttgtgtaaattatgcaaaacttgagctaaagaggtggcctaggattttaaaaataaaaggtatttgtttttttaagtgtctgcttaaaaaggacagggtgctaatacacatttttttcagggtgagatgtttctgactttagagatttgctgaccagatagtagtctcagctctgaacattagaagctgtcatattaaaggagtacgccctggatgcttctgtggactagaggtagagagcaaataaagccctcatgctgtaatgactaggagattaactgctgaactaaacggactttaaaagctgggagaaagggattataaatcagatactgtataacaaagacccagacaccacgaatctgattggcgaagcctccaggtccccgaagagcctggtagctagagtcagctttcagcacgacgtgattccagtgtaagaggccggaggggctctcagcacccgcagcatcgagacttcaaatgcatttgcctctcccagcgctcctctcaggcactggctgagcctcgccgcgccgggcacctcagtgcagctgtgagggagcgactcgagccccttcttggtggagagaaaggggtgcagccttggcttcccagtacccacagacgcgacccccagcttccccttcgtgctccttcccagatgcttgtcctcaccccctcccgctgcttccggggagcccgccctacacacccactcacacccctggacctttgctcgggccccacccgcccctcacctgggcagcgcctccctgctgttcgaggcctttccctgacactgcccccgcctcgggtcagctttgcttgtttctcctcccctgtgccctctgccctgggcgtcctgctgccgttgagtttttccttttccctggtgtctccgagggctgtcactgcgccggttgaattagatcctggcaggatttaccttgttacactgaatctgggttgcctctccctgagccagaaatccacggatttggggtgatgtatttattactcacctagtatagaagacaaggctgggccagctttggccaaatgcagaaatcaggccacgtgctttcacgccccaggcagggtggatgaagggttaggctctttaggcctcagagctagctcctaagccagag

SEQ ID NO: 58021 - DNA, 1448 bp, Bovine  19866881117747
acagcgggcatggatggagccctcagctcttgagtcacttggtccgtgtggggtgcagtttcctccgcactcagtgtgagccgggtctcccccaggcacgactcggggcatgcggcacgcaggccgctgcaggagcaacgagcaggcagcatggcggcacgttcgggcccgcggcaggcaggccgctgcgggagcaacgagcaggcagcgtggctgctctaacggcagaagccagccctgctgacttgggcaggaagcccactgggaggcccctggccccagcctggtctgccaaggccatgcctgggcgtcagcaccactgcccccacggacacccagccacacgcacgcccctcatgctactcgagagcgccacgaggctgagctgtagcctcagggcaccgggaagcgataacgcctgccctcgccccagcctggccctgggcacttgggtgctgcagacccagagatggcaggtgtctgccttgacctcccgttggtccagcggctaagggaagaggagaccccggagcagcaggccgagaagttgtggtctggaggggaggggagactcggacgtgcctggtccccagaggccgagagagaccagggaccctccgtggagtcaggaggccaccctggggtcaacagtcagggagtgtctggggcatttctggggagggtctgaaagaggcaggactcaaattccagagtgaacacagaagtgtggagaacagccctcgagcggtctccgagcactgtggggcggcccagcctcggggaagctgcgtcaggcctggcctgcctgtgcccctccgcaggcagcatgtcctcgcgcaaagggctgaacgggacctgctcggtgcacgagtacagcggggccttcgaggggcagccggcccgcttcaagatgacgtccgtctgcggccacgtgatgacgctggacttcctgggtgagtgccgccgccacccacgcccattccaccgaggagccccgccccgcgccgccgcggccggaggaagcccggggtgggctcggggcagagaggtttgtccagaaccggtgagtctgaggccagcaggctgtggggggctgccctgcagtccccgccccagcagtggccctcgtggaggcggtggcccgcatctgagcgggagcctggcccgtgcgggtgttctggcacaggccgccgcctgccaggggtgcccattgtcttcggtcacttggaggttggcatcggaagtccagcgccggtgacccgtgggctggctccagggccgcggttgctgtgggtccgactgggactctgggcctcgctgcttgtctagtcctcactgtggaggggctgaggacagagccgtcgcctgccaggatcgtccaggcctcctgcaccccgagcctcaagtagagaagcggggggcagtgcacgggacaaggggcctgagga

SEQ ID NO: 58022 - DNA, 1247 bp, Bovine  19866881377397
ccccgcgctcccttgccctccgtgctcacaccctctcctcacagcggcttccaccctccatcaggaggtgctactgcccaggacgcaagagatcccggccgctatgcccaccttctcaaggggagcatggggaggggggcggcatctgggagaccctccagcaataggaggaaagagagacgggagagaaagcaaggcagcaggcgggtagcagcagcagctccaggtcacagcccggcgggcctagggtcccggagcccagacttgctcagagtctgcgggccacgcagcttcctcacaggggacgacagtgtccaccccacatggagggcccaggggaggcgcaggggcagggccaggagagggccccgagcaccagcggggtcacagcccgaggggctcctgcagagggaggcctgggagtggcacccgccctgggggtggcagacgtggggcaggcatcatggtggagcacagagctggcaggggtggggagaggggcgaaggggtatgacagggcactcagccgccaaggcagaagtcccggcacgggcccgggcccgacgctcagaacccacgctccgctccgggcagccctccgccagggtaaatcctgccccagcacttcctcacaagctgcccgctggcgatgggatgctcctgccccaggcagagcccctgtaccatcagcatccacgggatctccagagctggggccctggcccccatcgcggcagcccgcggggtgcaggccggccggctgcgcgggccccagcccctcacctcgaagcagatgttctcgccctccttgtcgcagtccagccacagcacgatgcagtcgcagcccctgccctccacctgtacagagacacggggtgtgcactgcccggcccactcgtcgctgcctggcacagagtgtgcagccccaagccccccagactgccctcaagaggcctggagcccagggcagtagtcaccaagtggagtcactggccggcttggcctctcagcaaagagtgtagttcagaactgctagtttttagaccaaaaaacacaataaacgccatgagatcttaatccccaaaactgaatcaaaaaaaaaaaaaatactgaactggaatgactaaacattaaggccgttgtcttagatggtgagattacagagacatttgtttcttcctccttactcgtcttttctaacttttatcatggttttgagttatttttatcattcttcatttcttagt

SEQ ID NO: 58023 - DNA, 975 bp, Bovine  19866881414196
gccccctcccttggttccccgtttccgcgtgagcccccctatcccgtggcctccaagctttcctcggccctgggcagcagggtgggcctggggtgtggggggtctctgcaggtcagctgagcccacaggatgagtcccagtggtgccatgctaggatgaagttacaggagtaatggctgctgcctggtgtccctcagaccccaaacaaccaccccaggactctgccagggcctccccaggagcaatgcgaatcacatttttccatggctgtgttctaggcagtggggtgtccagggccctgtgactgccctggcagtgggtcttgacccttccctgcagcactggccccgccctggacacggccttcttcccttctacccacaaaagcacaaacaagcagcccgctcccaaaccacaacccttgtcccacgtgacaccgtagccctgggagcttcaagctggttgatggggggacagggagagccccgggaggctgtgggggcagcttgaaccaaggcctccgggacatctgctccctccccggggcctccagcacccacgctcactccacttcccgcttccggatggtgcggccggaggccagaacctcagccaccttagacacgataggatcgtagttcatgctggccacagagatcacctcgtcgcccctgcagggagaggtggccgagcctaaggactgccagcagcagcccctgtccttggagacccggatgcagctgggcccagggaggctcccactcggaaccaagggaatgctctgaccacctggcacccccttggcccagcacagcttctggtcccgtgggaccccgtgaggctcctgcccagtggggttgaaggccgacacctgtcctgggaccccgccctctacctgtgtcactgtcctcggtgtaaaagtaggccgtcaacccccatctccaagagctgacctcagattaagtgtccgcctcc

SEQ ID NO: 58024 - DNA, 925 bp, Bovine  19866881424573
tggtccctccttaaccaaggcactccatccttcacatacagctcagagcctacttcctctgagaagacccccatgaatttccatggtgctgaaatgcatgtttttctacagcttcatggaggtataatttacataccacacaattcacccattataagcagtgaggattttcagtgaatgcattcagatgctcagccagtgccacaatgcagtcttagaacatctccatcacccccaagcaacactgccctcccagccaatccccacttccatccccaaccctgggcaaccacgaatctgctcgctctccctataattaggccttttctggaagaatcatataaatggaactgtacaatatgtgtccttttgtatctggcatctttcactcagcacagtgtttctgagccagctgggtatttttaaacgtacatggggatttggtatttaaaggaatgctggctgaatccagccataagcaaatgaatcacttctcaatgtgactcctcctccccctcacatctttatcttgtaagtatggtgtttgcatcttggtcctctccagccaggcttgctttagaggtgccctgactccccaactcctatacatgtgaaaggtttggcttgactctaccataccgcattttttttgtatttttttgtagattttttttccctataagtcagatgccataaacactcaaataacccaccttataaaaagtatgtttacaatgtcagaagaattcaaatgaaatgtaaacccttctatttacaatttttatacacataaaccaaatcacaaataccacaaataaatgtgggcttccctggtggctcagatggtaaggaacttgcatacagtgcaggagacttgggttccatccctgggtcaggaagatagatcccttggagaaggaaatgg

SEQ ID NO: 58025 - DNA, 1142 bp, Bovine  19866882202574
tcaaagactctcctcacacactcagtgctgttaccaggcacccagccctcatccctgccgttctcacaccaggtcttaaggggaggaaaacacacaccccaaactcggctctggcctccgaaaggggggaaaggaggaactcgcagttgctctccctgcggggggctcgcagtgtggggccctagcgtgccgctcttctgctgcgcgggcgcccagggcaggggagcccgggtctctggttctccgctgctgccctattgccacagggaggcggcctccactgctcctgggggagctaacggatccgtgcgcgctccccctccgcccaggcaggcagcccctgccggactcttacctcatcgctcgggtcgtagtactgctctaggtaaggatgggccagagcctgctccacctcgatcctcttgtgagggttgaacgtcaacattttgtccagtagatccagagctacagagagaaaggttttgcagagatgagaagccaaaggagcagtcaccgaacagactgcgcactccctgtttaagtcaagacccactagacgggggagctgagggagccatgcgctcaggggagcctgcttcacctgagtgtctgatggtagagaccagactcaggaaggcggcgtgctctgcagaggctgcacagggagccaggattcaggcccaagtctgcccgtaaaacccgggcctggtccgaaagcatggccccactctgcagggtcacgagcagaggctgcgcgtattacagctcttgggtcagctccaagcttgctgtggccctggttacttcctgccctgtggctgcagccccctccttccaggttccggctgacaggtgtgtgtgaagcgcagggccctggaaacatgttccctgctgggctctgcccctgctccccaccttcatccaagcagtaaaccacgttggacgtgaagagaaactccacacaatgaagggcgtttttcatgtccataaagcgaagtgtgaaaagcagcaggatcttttttaagtcctaaccctaactctaatttctaccaacagcacatttcccggaatagcgacaggggagcgtgggacgcctgctgagccccagcagccccggggcctgcccccgcccctccctatag

SEQ ID NO: 58026 - DNA, 1279 bp, Bovine  19866880352023
aaaatcccatggactgaggagcctggtaggctgcagtccatggggtcactatgagtcggacacgactgagcgacttcactttcacctttcactttcatgcaatggagaaggaaatggcaacccactccagtgttcttgcctggagaatcccagggacgggggagcctggtgggaggccgtctctgggaccgcacagagtcggacacgactgaagcgacttagcagcagcagcaacacgaagtcagagctgcaatttggtcacagactgatgatgatgtgagtttgccaccatcctgggattataaatgggaaccccaaactgcagtctttgaagtctcacccacagagccgaccgctacctacgaccctttcccaactggtactctagatgtgctgtaacacgggacttcccagcgctgtttaagtctggatgttggtcaaaacccaatttggtgatgtattctctggtctatttctctttcttttaatgttagtatgttgaaaataagttagacaattctctaataaatatccgtattacttatttgtatataacgagtggcttattttgttaacaaatcctgtgaacctgagatgaaagtgaaaacttttgcaaccagtaagtaactctattaacctgagtcccagtttccgcatctgtaaacagggacgataggggcaccgacctcacaggaccatatgaagattaaatgaggtaacacggggcacttcagccaaggaagctgataaggggtcccacccgcctctgactcacagtgtcatttgaagtgagggcagacaaagaatatcactcctggaggcaggcaagctaggttcaattgctatgtgacctaggctatgttcatacccaatctgagcctctttttcctcatccgtaacatgaagataacaatttctattttatagattcagggaaagggaaaatgctttgacaactcaggaaaatgtgggtgattaggcttccagaagcccacatctcctgccatgctcacctcctagccatgccccagccactccctacttctccaagcctgggagacacgacgcaggctttgggtacccctggcactgcttcagcaggcaacagctggcagggcagggcacagctgccaggtgagaccagcccacagcaggaagtttgcttagagggcagagggtgcagtagccctcacaccatctcacctagccagctgggcccacccagccccaggtcaccacagtcatggtcctgaaagccagaaacttgggaaacatgaag

SEQ ID NO: 58027 - DNA, 1632 bp, Bovine  19866880402820
ctgccccatagtagaggagccagaagccaagctgggaggtctgtatggccaccagagcctgcacgttgaacccttgcactgcagttaggcagtttcacctcgggacagtactaggttcaaacaccaactgccctggcttttctggctgtgtgaccttgggcaagttatgtatccgtgtcttcatttataaagtagggatagtagtgcccgccttacagggttccctaaatgagttaatacatatcacatgtttaaaatagagccctgcatgcaggcaccattcgtaactagtggccaggtgggcccatgaccttgaagagtctaaaattcttcaggattctaaaatgccagcctgtgggatcctggaatcccccagtggcattctgaggcctttgggctgcagtagttacctgcttcccctggctggatggtgcaggctgcctgtccatccagctcagccccacacagggaaatgaggtgatgtcaaagcctgggctggggctcagccctggaacctccccttccctccgtctccctcactcggattcccacacgctccagagggccagagcggaggtgagaggggtgaaggtgggggcacacggccacctgtgcgtaactcctccagcctggagcacggggtgtgcctggtggctgggctgggcctgcagggagcctgcctccctcttggcttaagtcctgatcggcagcgatcccagagcgtcactcctcaagtgtgagtgcgtgtgtaggtagctggctggtttgctggcacccctctgcaggtggctcacaggccaggcctggccaggcagccatgacagatgagaagaccttccgcatcggcttcatcgtgctggggctcttcctgctggcccttggcacgttcctcatgagccacgaccggccccaggtctacggcaccttctacgccatgggaggcgtcatggtgatcgggggcgtcatctggagcatgtgccaatgctaccccaaggtaggtgggaacagtgggaacaggtgggctgggggccagggcccaggagggtctggggctgtgcctctattccaggcatcagtcccccatccttcaatcatcttgtcatcctctcccctttaccatttcttttcttatctccactctcctgagcctccatccatccatccatctatccatcccttagcataaagattaataagaagtcccctgaatctggagccctgaactaggtaccatgcgggagacacaatccaggttcttgaaaccagagttcctgagggcttgctgcctgccaggcacacctgtgtccctggtgaagttcagcatccatcctgagctttttggtacctttgaagttctattttatagtggagaagcctgaggctcagaaagtgaggttccttcagctcctgggtatccgggttgggatcagagctcagatgtgtggtgcctaaagcataaccttcctcaggaggacggtccctgtgtcccagagctgctgagagatctgagtgagtcagctggaacctcatggcttgggcagtgctctctctttttggagttttaatgagtgacttaatgatgggaagagcactggtttgagagtctgagttctagttctagctctgttccaa

SEQ ID NO: 58028 - DNA, 891 bp, Bovine  19866880513226
aatacactcaggtagcttttaatgatatggaatatcattaaatataatgtcaattgaaaaaagagggcacaaaaatcatatagacaataaaatcccaattatgttaaaatatacacacagaaaataaaaaggaaacgtgagagaatattcatgctgatcatcataaatggtgagattctgcattttttttattcatttaaaaaatgagtctatactatttttatgattaggaaaacaattaaggttattaaaagaagcaaagcgcctgggagcagaagaaatgctttcctaggtctcaactgcaggctcgcaggctaccacaggtgttcacgaggtcctaccttaatgaaatgcagcatggtgaaggagaaatgctcgttacagaaacagcagtacaccaccatctcgatgagcgccagcagtgagcccgtcagctctcgcagagcaaacattacctagtgagggtagaagaggagtctttcttttgtcacagttccctgttaaaacgctgtttccgactttcactgaaatctactcagatgaaggaccatcaacactgcctcaaaatagtttgagtctgtctgagagttaacacaatttgtgcaaatgtgtacctttttctcacttttatcagacttttaaaaggggatctcccccattaaaataaccactgataggtccaaaaaatacatgacgttaagcttaaaaaaaaagagatatagcacagcactgttgatgtaaataaaaactagtatgattatgttcaccaagtcatgcatataaaagtcaagttacagaacaaggattggaagattacattcttaaggtgcagtagctctgggtggaagggagagggacctcaacaggaggttgtgaagagctcacttctat

SEQ ID NO: 58029 - DNA, 2764 bp, Bovine  19866880513898
agtcttttaatttcatggctgccgtcaccatctgcagtgaatttgaagcccccaaaatagtctgtcactgtttccattgtttccccatctatttgccatgaagtgatgagaccagatgccataatcttagttttctgaatgttgagttttaagccaaccttttcactctcctctttcactttcattaagaggttctttagttcttcttcgctttctgccataagggtggtgtcatctgccataagggtggactcagtctagtcatttgcaaaacaagaatttcttttcctgcccggccatctgcctctgttgtggtcagatgagatgccaggtgtgaagggggactgtcaagtgtcaatatataggtgaggggttactgttaccgatttgctggggtttttttttcttccagcttttccttctgacagcctctccttgctgtctttggagagagtgtagtgaggttctttttctcccccagagaaaatgccttgagctggagacaggaggcacttgccccactgacagattcacaggaagagaaccaaaggtaatttacaaatggcttgtttctacatgcttctggtggcctggaggctcataaagattggggtccactcctcgagcacctcatttcatgtatacattttatctttcttgctcacatgtgtacatacaaacacatacacactatttaaaaaaatttattttttaattgaaagataattgctttacagaattttgctgttttctgtcaaacctcaacatgaatcagccataggtatacatatatcccctcccttttgaaactcccctcccatctccctccccatcccaccgctctgggttgatacagagcccctgtttgagtttcctgagccatacagcaaattcctgttggctatctattttacacatggtaatgtaagtttccgtgtcactctttccatacatctcatcctctcctcccctctccccatgtccataagtctattgtcttatgtctgtttctccattgttgccctgtaaataaattcttcagtaccatttttctagattctgtatatatgcatacacacgtttttaaacacatctggaaatatgcccttttgaaatctaaagtctcacctactagatcttgaacactttgccatgctcttcagctccctgcgcgcgctttcctggtggctcagaggttagagcgtctgcctgcaatgtgggagacctgggttcgatctctgggtcaggaagatcccctggagaaggaaatggcaacccactccagtactcttgcctggagaatcccatggatggaggagcctggtgggcggggtcgctaagagtcggacacgactgagtgagttcactttcagctccctgaggactgtgtctctgaatgactgcacagcagggcgttgtgcagttgtaccctgttaggctgggcaagccccatttggaaggctgaccattagtcttcctgaggtctacgagtccctggccctctccttccctggctcaacctgtggaagaggagagggggactctgtatagatgaggagacaggtcaggcgcagttgggaggcttatcccaggacatggctggtgagctgcagagtagggaccaaaaccagactccaaggctgggtgctgcagcagctggcgtcctgtattccctcccctctcccaatccctcccagctacgagaggggcatttcacccaacaaggtttattcagcaacactgtttctcatttaggagaatttctttaacacctgtttatggagcagctactatgtgttaagcactgggggatagagctgtaaacaaggctgatacagaccctgccctcagggaacttgctgtctggtgaggacaagacgcaaagagaagtcaaacagacagataacagtttggtcaatgaaggcccagggaactctgagtttaaagtgtcccatttgaaggcttcttgggtgagagtcaagctgagcgtggagaggacattgatgatagcaagttaccagggagagggaacagtgtgtacaatgacctggatgttggttttggagaaatcccttcccgtctgtataatctggagccagggttcctcccaagtgtttttttccaccccctgggcattttgtttttcctcactgagataatactgtgtgcttaatttggcacctaagttggaaaaagtcagatatcataagaatttccccctgttgttaaatatctgtgctgagcttgatttttttttttttttaaatcagtcatggaatataccatctagattttatgccatgctttattcaccctttccctatagttggacatttaggctctttccaaattatgaccattaaaaataagctcacaaaaaccatctttttgcatgaaattttgttttgtgttgtgaatctcagctccaggcttctcaatgccctttccccactggcgccggtacctgccctgggtttcagtgtcttcctcggtcagatggagatttgttgtagttgttgtttagtcactaagtcacgtccgattcttttgaaactccatggactgtagcccacccggctcctctgtccatggaatttcccaggcaagaatactggaatgggttgccatttccttctccagggaatcttcccaacccagggattgaacccaggtctcctgcattgcaggcaaattctttatcaacttagccaccagggaagcctatcaaatggagataagagcatcaccctttcgagattgtgac

SEQ ID NO: 58030 - DNA, 819 bp, Bovine  19866880587361
cagtgaagaaagtggggggggggagctataatctgtaattgtatttgataaaatgataaattgaaaagataagtaactttaaatgtttagacgttacctataacctattaatcacttttatttatcttctgataaaaatttcactacaaggatagctaattaaaaaaaagcagttattctgataggcaaattctgaacaacctgataaaacgataatttttactgtttgtatgccttagatcacttttgaaataagtgcaaaatggtttatcttacctgtaccactgaggaattgaggtactctgcacatacccctaagggctgcactagtgctgagactgcctgaaaaaaagacagcaaatttgagaaataaatgtgagcaagttctttcctttcaacattaaacaaatccttttttatatgtcagagaacattttatactcttgggcaggaaaagctgatataaagatgtcagttcatttaaattattgtagaaatttaatgtaacttaaatcatactatgccaataaaacttctttcaaggcttggatgagatgattctaaagttcacattgtagaataataaaaatttttatttgaaaaacgagagaatagtgggggaaggaatgaaatgtgcctttaatgtgcctttaacaaagaaaacatttaagactttcattaagaaatctataaaactttacagaaatacataaatggtccaaataaatgaggaaagatcatgttcttgaagggaaaggactagtactatagacatgtcaattctccacacatgatcttggggcactttctgcaggagat

SEQ ID NO: 58031 - DNA, 3533 bp, Bovine  19866880597579
tgttcctttatactctctccccaagtgaactcatctgcatacgtgcttcagtgatcatctatgtaataataatactcagatgcatattttagctcaatcctttttcccgagcctcagatcaatacatgttgacatttccgttggaatgcctcaaaggtattacaacttcagtttatttaataccaaactcatggtgtcgtgtgtcaaaactgacctttttttaaaaaaaaaaaaacaatatctgttctggcaaataactctactatctatccagaaatgtagcatcattctcaatatcttctctgcagtctccccaaacaccaagtcctgtggatttttactcatagctctctccagtctgatcacctctctccttctccagtgcaatcgtcacttccccctggaaccatggtgatggactgctaatttgtttgcatatgttcactgtcatctcgtctccagttcattttccacagagcagccacagctatctttgcaaactagagcatgccccatgtccctcctttgctttggatctttcactggctgcttgttgctctgagcaaaatccttaacaaggccctaaatgccccagctccatcctcccacatcttagcccagcccttttcactctatcccttgctctgacacactgactttctttagtggttcctacttctgtgcttctgttcaggacctgtggagtgctaatccttcctagaattctccctccccttttgtcaccaaatgaccttaatcgattttagatctcacttcaaatgctgccttctcagggaactcttcctgaattctacactagatacgaaccttcagtcacatgctgtcacaacagcttgcttatgcttttctttctttgtgtacgcttgcatgattatttgattcctacctgtcttcccctctatactgtgctgctcatggtatctgagtccacttctgttttctctctatgggactcatagtgcttaatgcagtgtcaggcacatagtaggtactcaataaatatgttctggaagaaaggagactttgtaatctggaagggctcagggggagagtgactgagggtaagtggtttatgacatttggaatgacttgggtaaaatgtggggaaagcttcccaagtagccctagtgataacccacctgccaacacaggagtcataagaggtgcgggttcaatccctgggttgggaagctcccctggggtagggtatagttacccactccagtattcttgcttggagaatcccatggacagaggagcctggtgggcttcagtccatatggttgcaaagagtcagacatgactgaggtgacttcatgcatgggaaagaggtagaccatggaaacctctgggcaggagagaactgaaagggcctgttggggacagaaggcatgtctgcagatgcactctgagcctctgaaaggctgtgctatgtgcccaaactgtgtcaggagacagagtttttaaggcctggatttgatgcttttaaggcctggatttgatgcttttaaggcctggatttgatgctaactagctgtgtgtttttccctctcattcttaatttaatttgtaaaataacagtgctacattattacagcagtcagagttcttagttgcaaagaacaaatattgcctctgggcaatttaaacagaaacttaactgattgaagggctatcagccagctcacaggattcccaggaagccggaagaaccagatagagagaactggtaagaacagggaagattgtatgggcaaagcctgggccagcacctcactgaggagccaggctcccttgaagccagcacagctacaataccactcagttgtagcatcacagcttgtgtccctgccaggagtgggcacgggctacccctgttggcaccactgtctgtgctgcccttgggaactggatcttgctgcctttgcttgctaccctcggaaggaatgctctgctctctttcctttgcgtcattagcttctgattcaaaaacctgagcagatgcatctgccatgcctggtgtgtgggggcaggtgtggggatgagggtgggggactgggaagacagcttcctagagatggaggcaggctccgttgaccatcaaccctcctaaaagggggactttcccaggggaggaatcagaagattcagatcctgagagccagtcaacatctaatgttcagtcttaacgatcctgccaatgttaacaatccatgtgtgcgtcagcaaaataagaatggatccagtcatcaccccaccccacctttccattaacctcagcaacttataaaagctactatatcatcactttgcctagaaaactttctccaggactacaagcccttacttccaggtactttagagactaatctgcatgtccttgcattatgtgtttatttgagctgctgaagccagccagtgtttcctggctccacagccctaaaaatagggcattattgagtagcctaataacctgctcagagctctcagaatgcagcaaggcctgcgctggtttgtatttttagcagatgctctttctattggaggatctatttttaaactcaccaaatgtcaattctctctcacctgtccattgtcattctcaaagacatgctggtttgtttgtttgtttcttcctggtagaatttactctgcagtatgaaaggtacatttcagtcattgatggttctttttggacagaagtaacattttcttgcccacactctacaacatcttttgttttttactgaactgagatctaggagaatcaatgaaaagggaattctggaaggaaagggtccaggatcttggaactgatttatcacaccttcttttaatgtagtttccatcatatctgcttctttaggcacgtagcttgcatttaaagtcgtcaagctgtgggagcaaagcaagctttataaaatcattcagcgtgaatagctgattctggcttaatttgttactactccaaggtaaccaagtgctgtgaatgttaagtgacgtgactgttgctttaaaaaccaccatatagcttacacatccaaatgaacatggaactccctgaagagcctcccactttggaagtcattgtgcatgatctgacaatattttttcactcaaagcagtttttggaattacttttccagaattccctggtggctcagaggttaaagcgtctgcctccaatgcaggagacccagattcgatccctggattgggaagatcccctggagaaggaaatggtaacccactccagtattattgcctggagaatcccatggacggagaagcctggtaggctacagtccatggggttgcagagagtcggacacgactgagtgacttccctttcactttctttcttttccagaattactgtcccatgtatggatcgggttctgaaatgtcctcaatgatcatagctctgtgtccttggggagcatggggcatttgctcaggagaagatgcagtcccattccggtggtgtgtgtttgtgtgtgtgtgtgtggggg

SEQ ID NO: 58032 - DNA, 1704 bp, Bovine  19866880604611
atcatgcagtgtcctctcccactgcatgctgtgtgtaaggttattaaaatgcacagggctgtgagttttctcagcctcgctttcttcatttagtgtgtcttggcagatttttctacttcctaagcagacttttcttatatttcacttacagcgtattgatctcagaacactctaattagcattctcatagctactcaagaatagtcaacaaaacagaataagtataaatgaaatataagtacaaattgaggcctgtttagtgactaaaaaccctctcccttcctttctgcttctttccctttctccttcctaatttcatagtgaaatatcatggagggttatagcagcgagggttgtggtattgtttcagtccccagacttagcatttggggaactgagacccagagaagggaatgacttgcccaaggtcagccaggtggtggtagaacttaggctggagtcccagcactgttgattgccactccaacctgcttttcactgaagacttactggaatctttgtgcttttaaaaaatatttcagaaccaactagaaacagctccaccccatgagttaaagaatacattccaactacttcatgagatactggtaagtcatgaatgttttgattcacttgcatttagatatttactaggcagcatgcatttgcaaataaaaactgtatgtccttgtgttgcttttgcattcatttggtctgcactcaccaagtcctcttcacatcaccccattctccttgctttaactgattcagaggtgagtggtaataaatttcgttatgtttagtgaaggagctagacaaggacacaagcaattctagtgcagaaagcaaaggctttacttaccatgcacagaaaatggtgctcagctcaagggtgatcttgtgtgaacctcgcaagaaccaggagaggtgaatggctggctctgcagcctgtccatgtgctactgaaaatatctctatgagccacggaactgaaatgtaatccactataaggtgcaaaaggcaggggaaaaaatacaactgcagtcagtgaaataaggtattattagaagctgaacttagagaagtggagtgacctgcccaaggacatcgtcagtaactgacagtcaggatctgagccaggtgactggccgtggagcctgtgctctctacaaatgcctggtttgctcagtgactggaagaggtaggactaaaaggagtggaaactggtggggcttggggaaggagcccagaccagaccaggaagagttccaggttccagtgcctgtggactttttccctggaggccagtggtgacacactggtagccaggttccacctacatgtcttgtctatttggcccaaattgttctgttctttaatttctggatgccaacctgtcttcagaaatcaggtcatctggccaccctggtctgtttcctgcgtgctccagccacccagagcagtgacagcatgtcctttccgtgaagcttgtggtctccagttcccactgcctcagcactgctgttgtctgccacgtggctcatttcttaccatctcggactctagacatttaagtcagtaacttctgccatcagtgatggacaccatggaagggtttgcggcaggaaagtgatataacctgatttatgtcttagaaagattaccccagcagtgtcttaaaggagggctaaagaaggaagcagg

SEQ ID NO: 58033 - DNA, 2504 bp, Bovine  19866880632380
caaaatgattacataaaaatttggcatatgaaagagttattggaaaattgacttaagtgacccagctcatttcctgatgaagccagattaatggcacaaccaaaaccgaattcctcaagaagtaaatgactcacctctcctcctgctgggctgcctggagctttccttgtgcttggccttctgccctttctgaaaacccagctgctaggatgggaaactcaaccggtaaggagaaaagtgagaatctgttgtttacctccaggttctccatttattagatcctaaactaagtggcatctgaacagccaaagtagacacccctctcaccaagttgcagagtttacaccaggtaataacctggagcttactgaggaggcccaaggtgatcaagatgcccaggtaggtggggtattgaaaagaacaagattaaaggatggtgtcaaggagtcctggggatggacctctcagaatgggcacacgacaggaggctatctgtgtctgtgtacatgttcacagcttccctggtagctcaactggtaaagaatctgcctttacaaaaatgttcacaaaaaatattcatgaaaaaatgttcacaaaaaagatacagaaagatgttcacaaaaaaaaatgttattactacaaaggaacactcaataatcagatagtcaaggtatctcattctatgaacatgcagcttcttttcccagccactctgatgctttttcaatggactcagtaataaggtggtcacagtcgcagaaatggaggtgagcagtcctgtggccagatcaacattggtcacagaagtctatgttattgaacctgtgcatgtgttcaacacagcaacagcagagaccactgctgagcctcagatatggcattatttcaagggagaccattcagtcacatggtctgatcacatggaggtgctttatcctcacttcagcagataacaacatgtatatgaatttgacttccctgcctgacaacatctccatctataagcataagaatgtcttgttctctccatcatggaatccatcacaacattgcttctcatcaaagaactcattttacagagagaaggaggacaatgagcttggaaccatgagttttattatgaacttaataactcagaagcagagagtttgacagatagaatggtgggaagggtggaatggcctattaaagactgagttatggtactggcatccagtcccatcactgcacagcaaagagaaggggaaaaagtggaaagtgacattttattttcttgggctccaaaatcactgtggatagtgactgcagccttgaaattagcagacatgttctccttggaaggaaagctgtgacaaacatagacagtgtattcaaaaaagagacatcactttgctgacaaaggcccatatagtcaaagctatggtttttccagtagtcatatatggaagtgagagtcggactataaagaaagctgagcaccgaagaatcgatccttttgaactgtggtgttggagaatactcttgagaatcccttggactgcgagaatatcaaaccatttcatcctaaaggaaatcagtcctgaatattcactggaaggactgatgctgaagctgaaactccaatactttggccacctgatgcgaagaactgactcattagaagagaccctgatgctgggaaagattgaagacaggaggagaaggggatgacagaggatgagaggttgcatggcatcaccaactcaatggacatgagtttgaacaagctccaggagttggttatggacagggaagcctggtgtgctgcagtccgtggggttacaaagagttggacacgattgagcgaatgaaatgaactgaattggactgaggaagaagcaaggcattaattgaattctgaaagagacacaagtgcaatattttcaatgtatttcacattgtttaagttgtaaagggtgcatagtttgtagtgtgaaaacatatatgtgcaaactatagttacataaagatctcatttattcttaataaaatactaggaggattgaaggttaagtagagtgttatgttagaaacacaatgtagaaaaaaaggacacaataaaatgtgacactttctaagaagtcaaaggagtattgaatacaatggtaaagcacattagagaataattagaccgatgggaggaagggaagctgtaaaaatttgtgttttgtttaaacatgtgaagacattttctaggtttgacaagtgtcaggattttaaaatgtatataatacaatatgtaatatataattttatatgtaatgtgtaataagatcacattataaatgagtagatttatttttttaaagggtccaaaaattaaaagatgctgttctccatgatatcttcataaaggcaagggctgtacctctttgattccccacctgtctctttggcacagcactgtgcttggcacttaattatgctcaccaaatatttgaggaacagagaaagtagatgtaaca

SEQ ID NO: 58034 - DNA, 1095 bp, Bovine  19866880648444
aaaaagtagttttacctttaattaaaaagtagtttacctaatgctttctcttgtaatttagggtaaagtaaatgtgagaaatccgtttatgaggtgacaatacagtgtggcagaaactacttgtctattacaaactcgggtgactttagatgccaagcaatctcagagtaaaacaccagaacacaactgatgagtgaagatatttttctattttttggaaaacaatattactgacagctttgagaaacaaaaagccatgagccacagaactgacaattatattttcgatcaaagacaaaagatatttatttttaataccatatcatatgcagttatgttaggtgatttactgaaagatatacccacaaatatcaatcttctaaccttttacttcgaggtggttttattaaagattaaaaactgttccatcatgacaaagacacctcatgcttcctctttagagttctttccaataaatattacttttatagttcaaacgcaaaaagatcaaatggatgctgtaagtcatgcaacaacagcacaatgccaggtacctcccggtaggtatatcgaccatccactagcgttgagccagttaagcctccaggtccagccacggctgctgcaagccgatgacaagctatcaagcttcctgttaccagttttactatttcaaaatttttcttcaagtcttgaataatgctcttggtgaaaacaaacgaacaaaaaaaaggtatgagaatgtgcagctactttgtcagtttaatacaagcttctatttgagcatacagttgaggaacagcaaacataaaaatttttcactcacatttcctacgtaaaagtaaatgaaaacaatctcatatgtacatttacttgggaattactatagaattaataaacttccctcgaaaatttctggttctaaaggaattttttattatttttttaaaaaataagtctttcaaaagcactatttcacttcttgcatacttttccagatctttcttcccaagtctcttacactgaagagcctgtagttccttaagcgaactaatgttttttcacaatataaaacaagtcttgcgaatcttttca

SEQ ID NO: 58035 - DNA, 1649 bp, Bovine  19866880661749
gaggctcctggttggttttgctcgcgttgttgctgcagtgaacatcacttgccctttgccagtaaccttgatttccccatggctgcagtctgccaacctgctgatgactttttttttaatgtcatacaacaaagtgacagttacgacaggcttaccttggaagaggttcatttttactgccaatctttttggatgaagatgtttttataaatctttcaaaatggtctgcaagtcgaataggaattgcacaactaaacccaatgctgtgtgtccttaagaagctcccttcatgagatccttcttaggatggccaagtcagtcccttagagacgtcctgggaaagaaagcaaaggagccttcggacaggcatcccagcctgtgacttccctggagcccacacgtgggcccagagcacattgtcaccagactcaccctctcttgctccaccctccctgcaaacatcaaggtgtgtgcagttaccttttgagcttggaacaggcagactggaattttcctctgctacctcttgtgtacaaaatcttgtttatacaatttcaaaaagaagtagataaactaaggaagaaacttcattctaaatttggttcactgagtggcagagttcttagcttctaaaggtataaaataaatttttcaaaaacagagttggaggctcactgacatttttctgtgtataccagaaaatggctgtggttgggggaggggtgccaggggccggtgacctggaaggaaatagtgccgattccttttcctactttgtaccaatgatgtgaatagggtccattctttaatgataaagggcagtgggtctttttctaagctttagtccctctggatatcttgaccatttcaggattcacttgcaaagctggataaggatgtgcagagctcagaccagtggcctgcagctgtcttccccttagctttcaggcatccctgcggtccccagcataaatcacatccctgatcaagctggatttcttgttggaccccacgggtctcagccttactcctgatgccctgcctctgcccacatggttcccctctcctgggctctttgctgatccatctactctgcagtccacacccattcctccccggctcccagtgaccagctatcatcgtctgcaaaaaccaggtgttcccttttctcaaatcttagagccttctgggtatgaacagctaaggagctaaactctggctcttgggtgatggggagaggggtctctggcatgtaccacagatagggtgccactgggcccacttacacagatatcctctggcagtcgggtccttagcagctggcaggttttaaacactttccatgacactaagttgtccaagtttgagaggacttctgcctttgcaggtccattccctgatcacttataatatgagctgtttcgagctaggccttgctcaaggcagcaacactcgccagcctcaaagtggggctgggggtggggggccacattgcatggggtgattattatttttgcaaagtggaaagttctgagactgttcttaatttcaaatcatgaaaaatgaccctggacataattgtcattacagatgcctcagccactcatttaaacctttgccataaacattgactctgtgccaggccctgg

SEQ ID NO: 58036 - DNA, 2018 bp, Bovine  19866880710789
aattaaataaagatttatggagggaatttgactgtttagtcagtttgaaaaacatggagtgactcgaaaggttgagaaaaccagtataagttgccacttacttgtaaattttctttggctgttgattttccacgcttagcattgaggggtgtggagcagggcctttggcgctctagtctttggtctggtggtccctctgagtccagcttggttcctccgatccatattgtagtcagagtgagctcccaacaactcatctgatcatgtcacttcctgctaaaatcccacaggacatgtaattgaaatataggagggggcccaggggcttcagtgtgatgtataatgttttatattttcatctaggtggtaggttcataaatatttataccacttatactttgtgtctgctgaaattatttttttcaattaaaaattcatgtggaggaagtaccaaggctaccatgctcattgccttgtcctgacatcatgcaagctgtctggaaggggacacagaatcctccagggtggtgggaacaggagggctctgaatcaattctttaggtcatttgagatttcaagaacgtactattttctagaaagaaaccaaaaccgtgttcatgaattggagtctttctttcccatacggtgtttgatcgttttcccagggagaaagaaaaaggtggaaaaagtagaaatataccccaaatgcatgcagtcacagcaaaggagaaaagggtcctcatttcccagcttcagtctgaaatgcagaggaaggccctaattgtctcccaggccccagggccctttctaatttatagagggaagggcccaggaggtaaatcttgatgtcattttctaagcctcctaaaatgagcccattaaactactggctcatgaatggaggcgtttttcccagggttggagccccccaccctcctcctatacccagtatcacccaagcaccgccacttaagaggctgagtggcacatctgacaatgcagcattcaggaaggccttcctggatggggtaggaagactgttttatgccctgttaattactgcaacaatttataaaattcatgacaaacataaagcccttacagagattgtatttcaaatggtatttacctgtaacagaatcccctttgtttgtaattcctggatttatgagctgttgcacaacaaaatggaaccaccccttgtccccatggtgggcactggctgcaggatcttgattgggccatggagatggaaacctacccaggcttgaactgagacactgccatcccagatcgacttctagtccttggcacttctcgttttcatggcctgtgaacttgggagaagggaggttgggacctgggcaggtaaattttcttgcagagaatctccgtgtctaaatctggaaggaccttgggcatgagctagtccaattgtgtatccatcataggagtcctccctacggtttctctatctctgtttgcatactccagtgacagggagctccttacctgaaaaagcaccccaggtgattgcctttggtttctagtcttgtccctttctttttctccccaaccttcccttggccataagagtgattttcctaatactcacacctaatctagttgtcctgcttaaaatccctcaatagcttccctttgctttggagataaggcccaactatgtaacaaagcctgcaaattcctgcctggagtggtccctgtcttcttgtctaccttcatcttcttatcatccatttttcagcaaagccaagtgagtttctagttatgcacttgcattaaaagctcacgataagaaccataaaacagagaccaaggacttaactttggggcagcaagtgagagtgtgtttgtggagctgggggtggtgccttctccagtgtccagtgtcggggtgaggagatcagagccctgcagagggaagaggatgctgacagctccagagatgagagggaaggaggaccctggcaggaaagggcaaaatggaggagggtcag

SEQ ID NO: 58037 - DNA, 1394 bp, Bovine  19866880793546
atagcaggtgctgggggctgtgaaaggcattgtttccataggaaataagggacagaagtggcaatttcactcctgaatctgggttcctgagtgcagctgccagcgccatatccttgtggctggcatttcaaggtcacattccgcggggtcgctttgtgaggaggagggcagagagagggtgggggggcagcagggtgtgggtattcacggactcaaaaatccactttaaaacatcacatttaaatttgcaagaacatcagaaccacataaaatctgccaaggacctccggccctttctctggggcgcagctctgctctgaggtgttggccctccacccagctggtgtctttgacagacatcaccactggccagtcctgcaattacagactgcagcctggccgcactgtaactgcaccttcggcggtgaggccacagagtctgcagtgcgcggcaggagcagctgtcagccccggcatgcatcctctgcgcctctctgactctgcagacccttgactggggctgctcagtgcttccagaggctcccctagtcctgtgcgtgggagcacagaacaaggcagagcacgcaactaaagagaaacaggattgaaaatgtgtgcagtgactcaaaaccccaaaggtacacaatatatgaaccatgtcggcatcccttctccactccagaaaaaggagtgggctggcagcgaacctgaaacgagtgaatggcgccaagacctgggaaacacagctaaatgggtggttgttcagtggcttgtgagttctttcttatccatatcttttcagtgtcagtcaatcatgatgaggagaaatcaagtctcctattccttctctgcggtaaaacgtccagaaactcacaaagcagtgtctctcaactcaaatatttaacttcatatacaaccagtaccaagggttttagtaattaaatttccagcaaaagcaaatgattgcaggtcacatgatttaagactacagtttattcaatatgtctccaagcattaaaaagattttatgaagtcaaactaaataaaatcatatcttaaagtgctttttattttgctctttgtaaaatttgttttgggaacaattagtgattgatgtcaaagaatgcactctatacttctagagaacacagcatttttttaattgctctttcaatctcaattttatcagaaaaataccttaaagagcttaatttcccaatttttgatcctggtaacatttcattaagatccaagtttatgcccagggctctcatccagacccacctgaaattctatacaaatagggagacatattaaatacaaaggtctgtgtaaactgaattctttaactactattttacagtgaaaaggaatttttgtcacatatttttaca

SEQ ID NO: 58038 - DNA, 1840 bp, Bovine  19866880828003
tgcactgttctaaatgccccttatattatctgcaccaaataggactcaggaacattcctgcacttacaaggtacagagctgtatcagaactaccaacagtgagtttgtcagtgtgcagtctcctagttttgcatcccgtcttagtgtctgacccgtcttacagtatctgacacatctgtttctcacaaaacctatgttggctccagaagaaattgtacttaaaattgtcactgatgtcagagaataggctgcatagacaagtacttcagtgacaacatttctgcccatagtcactctcaattggttaaaaaaaaataatttgcttatataattatagagctgaataaaatataagtattaatcacttttaattttagattaattctgtaactttttttcagaattattgatcatacctgaattcagatcttgttagtggaagccaaaaatgtaaactgaaaaaaagaatgttaattaaaactaaatgtcaaaagctctctgattgtattacaaagataactctaatctctgatagtcaaatcatgaggataacaaaataataatgatagctaagtaaatacagataatgaagttgatggaagagcttaggagatgatgagaatcaggacactcctaaacagaagacaccaaagccaaagagaaatagaaataatagcagagaataaggtaatatgtaacctcagtagagcacacacataggtcagaggtcaatagtggctttatttggatggattcattatgtcttttcatgtgtcttgttaaaatgagctgtaatctcattcatttgctttggcaaaagacaacttaaaaattatataaacctcttcatgtgctatacaaggtcactgacttcaaactggtcattgaatgtcgtcaactcaaaaaatatttaacattagtcatatacaataaaacttgaaatgccctgaaaccttatagcttgcatatgaaagaaactttatagatattcccccaatttaatggttatcctggaaatttacatgacattctcagtaacaagttgggctgctaaaactttttctaaactacccataagaaaaacaaatttcaagggtccatgctggaggaagaagggctcaatgatctttttgttccctctgcagaaaatattacaaaattgttattgtgtgaagaggtgatcaaagagtatgcagccaaaaatgtagggaaaaaagctaattaacaaaaacaaaaatttgggattttatggtatttgtcagcttttaaaaatttatagtgtatggtcatttattttctcattctaagtaaatattcaatcttgaattgacttttagattcataattctgtattctttttctttaagagggctcccacgggaacaaaccatatgaacttcaggctgcaccaaacttaaatcagcctcctccagcaggcaagaaatcgtattaatagctgtggcttctttggccctcacaatggagaaacatgggaagaaaacttgtccagcagggtctggagaccaagaagttagggatttcttgtgtaaggtacaagataagacacttttatttgttgaaacaattagctaccccttagagttggactgtgaagaaagctgagcaccaaagaattgatgcttttgaactgtggtgttggagaagactcttgagagtcccatggacttcaaggagatccaaccagtccattctaaaggaaatcagtcctgggtattcattggaaggaatgatgctaaagctgaaactccagtactttggccacctcatgcaaagagttgactcattggaaaagacttgatgctgggagggattggggggg

SEQ ID NO: 58039 - DNA, 1164 bp, Bovine  19866880883150
tatatacacacttgcttcttttcccatcattcctcatgtgtcatttcatttatatcataaatgctgttaaaagccccagcaacccactccagtagtaggccgtattggttatctgtccattagtagcctgtgacctaatactgtctcgtgtgtgttgccagtgccttatttctggcatgatggttaaagtagtaagcattcatcttttcattcctaatttgtgcttgttgaagtttaatacctaataaagagtgttccaaaagcataaaatgctactgccctcaaatgttaaaaagttaaattttctggtagtgaatatatgctggcagtgaatctgtacaggagttcccaggttgtgactttcatccaaatacgtgattataaaaacacttaaagtactcaggcaccctaaataagataccgtgtaagtaataacacgtgtagaacagtcattctcaatcagagattatttgacctcccaggggacatttggcagtgtctagagaccttctagttgtcactagacaggtcctgctggcacctggtggccagtgggtagtgagtacaagtcagaaatgccactaaacgtcctacaaagtccaagacagtcttccatgacaaaacagcttccagcccaaaatgtcagcagagctgatgttgagaaaccctgatgtagaataatttcttgtttaggcagccagttcggcacttggtggccccactctgacacacgctgtgaccagagcaacaaaaatgctgacagccactgccatgccaaccgtagccacgtcagtccagtctccttacaggtaagcgactacagaagttacagcagatgcacaacacacaaagatcggtcagcttaaaagtaaaattggaatcttttttcttcctttggagatctctgttaattgttcatttcctcattttatttcatgtatttttcaaatagtcatatccttgaaaattatgtattccctgtcatgtattttatcatttgactcattttactttaactccgtgtaatatgagtagcctactctatgattgaaccaagatatattctttgtatgaagaataattttttttcagatttgaaatatttacttagacataactttttgaatagacaaatcatgacacagtgtaagcaaaatgaagtgg

SEQ ID NO: 58040 - DNA, 743 bp, Bovine  19866881041843
tatttaagactttttttgaaaatgtgaatctgtgtgatcatcgattaaaaagacaaggagctcagttggtaagtagcattgtttgcaaatctagataatttggataatctagtaaaacttgatattcagcaaaaaaaaaaaaatattctaattgagagaagacatgaggttttttaaaaagaatgggctcctccttgactgcagtctcctgcatcattcagagagctcctcagagtgtgagggcattccccttcccatacaggtgacttctcagattcctctttggtttttgctgacctgagagagccagtggcctcctgtggctgggtgaacgcagaatagggatagttctagcccagcttctaacctctcagatccaacagttcacaggtacctgagaatgtaccaaaatcttcagttttgaggtctcagaggcaaggatttggagggaaatttttagaacagacagagaagcaggaaaatgagaatgtatacagcttacatttatatttacgtgagtagctttaaaaaggcgaaaaataactcttgttccagatctgtttcattcatgacctgacttcctagaatttttacaagatcttgtaagccctcgatctggccatttctaactgagctttgaaaagaccagattgagccctgaggattagtaaccacctctagcttgactccctttcctttgaagaaaagctcctgcagggggtgcccatgttattcctgtatgt

SEQ ID NO: 58041 - DNA, 1044 bp, Bovine  19866881054817
taaggctgtcttgagcacggcaatcattccatggattagggatgtagagtaggcgcggaagatcactgtctacggcgaagaagttaagcgactcgggccaacatcacatattctggtatacagtgggacagtaactcaaattcagtcactcagagaccatccccagttccaccactaccagtacccaccctccaactctcccctttgctcctggctcatgagatgttaaacacacaaccagagggcaagggattgaatattctgggccaggatcatcatcaacctaaataagccatgcttatttattaatctagagttgaatgctaaggtttttttccaagatgcaggaatgggaagatcccagcatgctcactggaaggaaactctcagttctgcagaagcaggttttccaaaatattcagtccccatctaaatgcaagcaagcccatgccacattcctatgctaagtccagaaccaaaattttaatttcttttgtgggaataaggagtggcccctgtgagaataaaatacactactgaccaaaggggaggggatgaaaagggagtcaatttggtcattgctaaaataaaaccagggagcaaggcccacagctgcctccccaggaagtcctattactacggacaatggcccaactgttctcccctgcccaaagaaaccatgcagtctcgaacctgggggccactgactgtctttttctatttctttccttgaaacacaatttattggaaatacttccagatctccagggggaaaacaaaaggctggcagtaaaatgaaacacctaattaacagagagaactgctccactgtttccagagaactttctgcaagactcctggcttcctgaagagagaattaggggaggggaacccaagcagcactgagcccctcttattgtgcacaccatagtgccagaaggtagcatagagtaatggtgatgagcactggctttagagtcaggctgcctgggttcaaatcccacctttgccacttactaggacaaagcccataacctccctggg

SEQ ID NO: 58042 - DNA, 761 bp, Bovine  19866881072984
cggatgacaggtacgcacgttccaaattacttcgaggtggtctccagccccatttactgtccccaggagtcctatccagagtttgatgcggacacattagaagcacacatgaagacaatgatgtatatgtgtttagtctgaacttgtccagcatggctgcgtcactgtggagagcagctgcctcagaaagaaaagaaaggtgggggtgttaatcatcatggcaggcccgttcttacccctaaacctatctgccaaggctgcagggctgatcaccatctgaggagccttcatttcacccttctctaaaaatgacatggatatcctctgcgttggagacaatttcaggaattcaactcaagtccatttacttcaacatttccagaatggctgtgtttcacttgtttaaaaaaaaaaaatcttttggggggcactgaagctcaaaagatgaggaaaggaatcatgagcaaggagagagagaccttgtcctcagggaacctaactgtgccatgccgaatctgtgctcaaagaagaaaaggcagagtggatgctgctccctgtgtgcctaacagggagcgcagctgggcaaaattgatttcatgcccaacactcagtcgaatattatacatccatctcccaaacaatcctttcaagaaggtattattctggtaacagataaggaaacagcctccaagttcttaggagacttcccagcttaaagtcaggaggcagtagaatagattcaaaccaaggccattcagctg

SEQ ID NO: 58043 - DNA, 1010 bp, Bovine  19866881098558
aataaatttttagttatttgtgatttgaatatatgatttacaggttctgatctgctgtgacttgttcaattagaaaatgtagaatctatttataagttttacagttaaaaaaataaaataattcccaggacttccttggcaatccagtggttaagactctgtgcccccagtacaaggggcagcagttccatccctgggctgggaactaagattctgcataccacagggcaaggccaaaaaaagggaaaaaagaattccaaaattcagttgaaagtacgtgaaaaatagggactctgaaagattaattttgaaataaaaatttctttataatctagtatatatgtgtctcctttgcgaactaggcatatgagttcatctgacttgtaattacgtgaccatttgctattagaatgaatgtaatttggcatgaaagaagtaccttttgtgtatcagtgaggcatattctagtgaaatcatagtaggtagggacagctttatgcaacataataatcctgttagcttaaaatttgaaaccaataacagtattagaaaagtaaatgttgttttaataatttgaggaaagaatttcaaccgtaatataacctaaatagcagacatcaaggtattccacagcttcgtgcttactgctcaaaaagcatataacatggattttatttgaatttgagtgcaaagatgaaaaattgttgcttttaataagaattattatattcaggaagatttggttcagtaataattttcctgtctgtggagttcagttttcgcagaagttttttttatttgaaataccaaagagaaatgagaagtaaaatatataagattaaaccatttcaaaacaccctcatattccacatgcactcaagaacctgcacttcactcgtttgtgttttagtttttttattttatttattgaattgcttttgtttttgactgttctgggtctttgttgctgctcacgcttttctccagttgcggcaagtaggggggctgct

SEQ ID NO: 58044 - DNA, 637 bp, Bovine  19866881203198
cctagggatggccaagcccttaggacactgtgcctccttaagcctgagggactcaggatttctagcctgtcaggggtaatcagagatgccagacaaatgaagtctgcagtccatcaaacatgcagacagatgtggttggcagtgagtggggctatgacttagaaactactggagtctcattatggagacacatgatccttgtgtgctttgcttacgagaaagccagacttttttttttttccccttcttctgtatttcaaatcggcctgcagccctgagattgctcattaggagagaaatgtaaaaagacataaaatctgatcttgttagatacagaactctgtttacacttgatatttaaaagtctagggttttggtctcagtgcctttggctgggaggaggagacattcaggtcctctctacataagcctgcttcagctcattgccctgttctacattaagagaaaaaggctgattcttaatctattttcttgtcacagatccctttggaaatttgacaaagtctattcctcagaaagtgaatgtgtttgcactcctgctttagcctcatggaaaattttgtctctttctttctttacaataaaactagggcagtttttccctgcttctaaataa

SEQ ID NO: 58045 - DNA, 1358 bp, Bovine  19866881283239
cccacctccccgcatgcccctcccccctccccccagccaaggggcttcccaacacatttggaataattgtatgtttttacttaccctcatgaagttctatgtgatttgtcacttttgtgaactggtattgcaaccccatcctgatttccagacacacacacaagcctccagctgttctgaccttccttttaatgcttgaacatattaagcttatcactaccataacttctttgcttagaacactatgctctctttagcttaatatggacaatttctattctttcctaagctatcatccaaggaaaagagatggtagttatcaccatctgaaattgccttgttatttttttgattatctgttcattgcttgtcttccttcttgagaatgagagtaggaaccttgtgtgttgtattactgatgtatacatacacatctatctccaacacctagaaaaatatttggcatattctaggtgcttaatacctttttgttgaataaatggccaaataataggtgtcttaattacagtaattgttaacaatcttcacagttaaatatttctctattgctatgtaaaaactcaacaagtcttcttaattctttctcccctcaatgttttacttggccctgtgctctccatagtgatgaaacctttaaacattttaacttctttattttcctaccccctcgtgaaacctctccccctatacccccaactcctacctcttgggttttgccgagtaaattcagtgctttcattctattatcccatattttcttacaatatgcctcttctgtttcaataatcctcacttaactcatattacaattcccagtcaagcattaatcatttgtttttaaatttaataataaaataccataagattcattgcttactactttttcttatacttgtcatcctctgtatcttgagacttttgttttaatttaagtttcctttggttagaatccttctcaagtggtttctcagctaggggtatgcctttttttaaaggcacataactctttgacttctttaatgtttgaaaagttctttcaataagaatagcaacaattagaaggctatatttggtagtagtttgtgctgttgctgggggaagagggtatgacagaatagtcaagggccttatcttcacagagctgaagtttttttcttggtctttgcactggtggaatagcctagttcaggaattaacactcccaccctcaatctcaaaggcttaaaaaatcctaagtgtcctttttgctcatgcgaagtttgctgctgatgccagggaacttactagggagcttatcgactatgtgaaggctcagtgttttgagtctatatcaacag

SEQ ID NO: 58046 - DNA, 1659 bp, Bovine  19866881290553
ctcctttgttaattcctattcatcatttaagactcagttcatatgtaacttcctctggaaaaatttaggaatgatggtaaatccaatgaatctgttttcatattcattctgtgatctgcacagggcaatgataagactgatttttgtccatcgttctatcccagtgcttggcaaggtactttcttacttgatggacacttaaaaaaaatatgtgctgtgttgtgatgactgattttagttccaatctgggttctaccatctttcatactcaaagtcacttcaatagtaactttatcacctttctcatctgtaaaatgggcacaaagacacccactctgcagtattattgtaagaatcagagacaagataataaaatgtacagcccataattatggatttaatttcctgagtgcctattctcattacaaggttttggggaaagaagaaaatttctaacaccatgcccatcagtcatagtaaattaatcaatattggctaatgcctaccagagaggcacagcagtaaattcctggatcagggttctgtttacccttggaagggaaggaatatcagttcttagttttcaaatgagacctcctcttgcatggcagcacataaaagagttgcctgggcatgagtccaagtttctgtaggcaacatatgtggatgttcaaacataatttcatttattcatgacccctacctgtcaagagtccacatctaaatcaagaaatacaaatgattagtctttatggtaaaggtgtaaagggaatgatagtcgtgtagcttactaattctattatttttcatccctctgtctttatatgctcatctattttgtaggaaacagcaaagatggctaaagatcaaactctcctaaataagcatgagaaatttctctagttgccaatcttcttaccaaagccaccgagagttttggatctgggcaaagcacttacaatggtatctgaagaaattcttggccaagtgggctggcagagaaccccaaggcttggagattagaaacaggctacaagattattataaaagatcttttcctaatggtccactatcttgcagttaaactgtgtgtccacttggattaccttgtgtgatctttgtgcaaaactctgatactgtacgagttggtattatccaattcatttacagagtaggaacaggctcagagattcacccaaggttgaccagttaatgctactgccaagacttcactttggttttgtggctcaaaatcctctttttgtcctacatgtactttatccaggcaggctgagccccgagtccctggttcttatccctgcctcttccttcagtcctggaggtctgaggagggagggatgctttatacactgtcccctcttctctgctctcggtctcagcccctgaagcctatcttgcccacttctccagatagaactcatcactccctctctgctctgttcatctggtatgataatgagtaacaagtaggtgtgatgcaatgtggtctgagccacagggaagtatgaactacattgtgggtttctgcttaactacatggtatcaagagagagggctggatagggaggatctaacaatagttgggtagattctaggtatcttacttctcataacggtgcacagtatgcatttctatct

SEQ ID NO: 58047 - DNA, 1298 bp, Bovine  19866881341901
tgctgtatgatgcagggaacccaaagctgttgtctataacaacttagaggggtgggatggggagggagatggaggggggttcaagagggaagggacatatgtatacctgtggctgattcatgttgctgtatggcattacatcaatgtttataccacaacattgtaaagtaaatattctctaattagaaaaaaaaaagaaatgctaggctagagggagacgattccgaaagagcctctatagacctgcaaagaaagctctgactctatgaacagagtctaggactgctattagaattggatgggattagtaaatccaattcagaggaggagagaggagaagagagaattaagcctcagaatagagttgagagcttgaaaggactcccgacttttcctaggtaagggcaatggagactgagaggggacagagacttggccaagtcggagtcaggacccaaggcagctcctgctctctgtgagggcggctctcttccctcgcgctccatctcagcacattgagaatcatgctccccagcgacaagagagcttaccgtatctttcccgggatctgtgggaacagagggaacagctgggtctttcccagaatctgcctccttttatgtgtctattcccagaggtcagccctggagtcaaggctgccgccagccctccatccacaagcctttgtttgggttcccagaccacatttcctcccctgaccggcgtgcatctcccccacccttcaggcctgctggcccagcctcagcctgcccagaacagaggccccagaatagcctggggctggctcacttgggcagaaaatgccttccaaggaagctgaggccttgaggttctaatgcttttcttacccacagacagtagtttccttttttagaacatgaactcagaggatgtggctccctgcctcttcacgaatagactgtctcccaggcacagcattccaggaaccacggggccaccagagacaacggcctctcaaggttgactgcagggggagagtgtgtcccttgttgtgtagctggagccggctccaagggtctgaaaacttcatcctggcaccaagtctggcccaactctggacccaacaggaatcttgaggatttcccacgacaccattcctctaccctcaaatcatccacacttattcattctgcccttcatgcaacaagtgtgtatcaagcatccactatgtgctagcttctttgagacagtaaaactttttggacatatcagataaaacagacaaaatcccagctctcaagaaatccatattttaa

SEQ ID NO: 58048 - DNA, 890 bp, Bovine  19866881422192
tcccatttgagccaggtttgctgtgagaagacccagctggccggtggaggatcgtgtttcctctctggatggcctccaaagaggggtcttctgaggaggccgagtgtggccagccgctctgctcctctgtttaatcacttgctctgtttgctgtctcactggttcctcgtccagtcactgccccccacacctcatcagttaccctgggctcgaggaggaaggcctaccacactgctgtggagacccccaagtgcttggtgctgacaacgcagagctggactctatctggcctgatgatctggggacagataagggccattaacacctctcttaattacagaaccccaaagcgggcctgctagtccccgacaggcagagctgggaggaaacgtgaagatccagccttcatctgattttgtttattttattgaaatgagttaatatctgagagccctaggaagagtgccgagcatgcagcaagtgccaggcaaggccttggtactgttgtcaattgtgcgtgcttagtcgctcagtcatatctggctctttgcaaccccatagactgttgcctactgttcctctgtccacggatttttcaggcaagaatactgattgccattttcttcaccaggggattgtcctgacccagggatcggacccttgtctcctgcatcttcctgcattggcaggtggattctttatcactgcccacctgggaggccccatgggtgttattagtgctcttattttataggcagaaatgagacttgctcagttacacagcaagtgacaggctgaactgggacgggtccaggccagggctccttcctggacatcttgctgccctcggaagggctctgagggcttgtttccaccttgtagcggcattt

SEQ ID NO: 58049 - DNA, 1884 bp, Bovine  19866881424937
aatgaggtaaagcaacacagctgctgacatccatgcttgactttagagcctatgatctcgttaactctacccttccaaatacccgattctggcactcggggcagagagcaattctgtgccacgagaggcaagtccagctggagactcaaggagagcaccaccacatagccacacagcttgccgtaaccccttctctttctttgaccatagggtttgccagttttaacttcaagactgatgctttcaaacaagaaaactctagaatgtcctggaacaatttggccaggttgcaatcattcctcttacaacacaagattcattggctcccttctcctctgataaaggagagtgctgactgatccatgaccccagcatcctttggcttaattatctttatcttgatagaggacacactgtaacaatgtctactaccactctgtaaccaccccccctccattttcatttttcaaacctcaattatttgcttctagttattctcaaaagttttccgtttggttttgtatcatctagaagcatttttctttcattcaacaaatgtttacttatttaggaccaccatgtccacagcagcatcttccctggtggctcagagggtaaagcgtctgcctccaatgcgggagactcaggttcgatccctgggtcgggaagatcccctggagaaagaaatggtaacccactccagtagtcttgcctgggaaatcccatggacagagaagcctggtgggctacagaggagcctggtggggttgcaaagagtcagacattacatgacttagtgactatacaacaatttagccttattatactctctgaagcctttctttaaactctgggaagaacagactgcctcttccttgaagtcccactataccctgtgcatctctgacactctttaagggaattagctgcttatatattcatctctgacatcgaactttgaatccttggagagcaggaaatgtgcctgactcaccttgtatctgcagtatccagcacagggcctggcacaagaggaggcacttagaaaagactggacaagaatacaggttttctggctccctgttggcccacgggccccctgtcagcctcctgccttgatagaatactccatgactgaacgaacccagggcatctggtgcccctcccccaccattctcccacatctggctgtattaggtgtgaatgaatgaaaaccataaggatcccatttgctctctccctgcttctttttaagctgcatgcatttagaattaatcagccaagcatgactgagagttttgacaaactcaaaatactagagaaagagttcaagatgttttgatgatcctcaatgcaaaaatggttaagccgttggcctaggcatttgttgtatctgaagtcagtgaagttttggaccacagcagcctgcccagtctcctaggtgaagtgggagatgcatagagggacactgagggtttgtctcttcttaaccccaggattcacactgcctgggcagtagtcagtaccagatggaccagaaagtcagaatgttgagcatctttccagcgtcagagcttatgcccttggctcaggactggaatcccaaatgctgcagtttgggacaaatctgataccactcactgctcccagggtttatatttcagttctggaagttcatgatgacaggtgtacagccaggcccagctggatgagagagtcaagaggtcacatgacttaaaaattgatgcacagccttctcactaagaaaacaaatgaatttctttttttcttataacaaaaacagtaactgcttttctgttatggaaaaataatcatagaacgatttattgggaaagaaatccgcttcaattccaccgtgcagag

SEQ ID NO: 58050 - DNA, 941 bp, Bovine  19866881551402
ccttttaggtagcttccatttgatgtttgcttctttgggcagtagagaattaaacagctgttataagccgagccttgtgaaagtcactcagtcgtgtccgactctttgcaaccccatacagtccatggaattctccaggccacaatactggagtgggtagcctttcccttctctgggggatattcccaacccagggatcaaacccgggtttcccgcattgcaggaggattctttaccagcttagccacaagggaagtccaagaatactggagtgggtagcctatcccttctccagggaatcttcccgacccaggaattgaactggggtctcctgcattgcaggaggattctttaccaactgagccatcagggaagcctgtggttgcaaagaggaatcaaatacagctatgtacttttgggaggtgacatttgggaagataaggttttttacagaagtcactaaccctaaccataatatatggaatgcttcacaaatttgggggtaattttagacacagataattaccatccagcagacatgagtgagtaaaaggccagggacagttacaaggaatatccagaggcagcatgctgcattggcaagagtctcaactctggggtgaaagcatggttcaaaatctggttctactgtttcctagctgtgtgacctctggcaagttacttaatctctctgagcctcaggctcaagaaagatatatcactggaacaagactttgaagtttatacaagatttgagcatctagaaatattaaggaaagaaatacattaaaattattagagttataagattatgagtaatttctttaaacattttttctatgtagggggacaaacacacatgaaaacaatagcaagtatttctgagttctagagttggcagcagaatgattttttatttttgtagggagatttcttttttt

SEQ ID NO: 58051 - DNA, 1422 bp, Bovine  19866881567930
gggttttttatagaggacttcccctgtggctcagatgataaataatctgcctgcaatgcaggatacccaggttcgatccctgatttggaaagatcccctggagaagggaagagttacccactccagtattcttgcctggagaattccatggacagaggagtcttgtgggctccagtctcatggggtttcaaagagttacacatgatttagtgactaacacatgctttttacagatacatggaaagcgttaaaggaatcaacaaaggatggaaaggtatctagcattggcaactgcaggaagctttttccacccctgggtctaagggagaaggggagaaagcagtaccattgaagcttggtgggaactggagccacagaagaggccccatctgccagggaatgtgagaggacagaagagccagcccaacaataggacatttgggatgggctaacaagcctgcagacatggatggtgaaaaagttagtggaatgtggataattattattaacttactgaccacagatgtagtagtaagttttttgtcacccaaatatcattgactggagatgtatccatattcatttacataaccgatcgcattgactggagatgtatccatattcatttacataaccgatcgctggcaacgggtgttagtttctgcaaaaatcccttggtcaataatgttttaagaggtcacaatctattgggttggccaaaaagttcattcaggtttttgtgtaagatgaaacaaactttttgcccaaccaaatatatttgtaggctagggagatgtagacataagaattacagcaacaaactcagaatctaagaaactcagaatcttagaattttaaactatatatagtcatggttaacttggaaaaaatatatatttgggtgaaactgaggctctgctttccacctctgtggcccactgcattttcctctgactcaacacacaaagtttgctgagttagtttatgtgtgttgccttcttttcagctttcctcagatgggacacttgaaaaccatggtggcaggtttatttgcttaaacatttcctttgaatgagcccacccagagcatcaaggcttttgccttaggtggagtgcttctaccccagctaaagagaaataggccatcagaccccaccacgagccccaaccctgatttcattccaggaacacccaaggaactgttgttcttggggcttgggtccccatgtccttctcaaaaatgtgcttggaaaccacaggggtgcctggatgatggcccagaatgtgtggaatgtagggcccaggattctgtggaccaaaaaatggatgcatacagtcagatgtctctgagagtggggcctgcatagagaaaagagaaagatggccaagagaagatgatagccatgcccaaagccactacca

SEQ ID NO: 58052 - DNA, 1111 bp, Bovine  19866880347103
caaagaatatgttgagtctggagaagatggttgaagagagactgctctgtttgggtacatagtaagaaatagtagagttcttgtgtaataatataccttattggtgctcatttgtgggacatgagaaggatggtgacagtttgatgatgaagaaatgccatagagttagatccccatttacaagacaatgttctcgaagaactgagcctagatgtttgcagtatttaacccataaatgataaggagaaatgtcattatgatggtgaagggagaaagtggtatttattaatataatatgtttaaccaaagtgcctcttacgtatactttatagaataaaagaacattttgacaatgacacatgaggttaaccctcacaatagcattacacaatgaggtcctaaatgtaaattgtccagaaggcattttattagcttcctaagcagcacctggtccaaacaacgggaatcccttcaaccgtcattccagagatgatcttagagatggccagcatcactgatcatattcttcttcttctttttttggccatgccacaaggcatgcaagatcttacttccccaaccaaggatcgaacctgtgccccctgcagtggaagctcagagttctaaccaccggaccaccagggaatcaccaatcatattcttctttgatcaaagaagaaagcttcagctctctgacatcttcagttctgtgaaatgaactgcattgcagtccatctcagtatctaaaaatactgtttccagggttaaaaaccaaggaacttgagtgagcttatttgaaaagcctcccattgtctttctgagaaatgtggtttcaccaaatagcggaattttcagttgataagggaatatgtcagtagtttagtgaccaatcttccaaaagttagtacatgtatttcaagcagaaataggtcagcaggaaaagaacctgacctaaagactccctctcaagtgctgtctgggattccctctcatgcctaggtataatctggccaagctggacattctggtggactggagatttttagaaggtcaacgactcagtcagtaaagaaaccgcctgcaatgcaggagatgcaggttcaatccctgg

SEQ ID NO: 58053 - DNA, 2609 bp, Bovine  19866880543389
ggagccctccagaaaggcgagttacatctgatgtgagaatttaaacctagagttaatacttgcaatgaaaaataattatattttctcctttgtttaatttgggaaaaaagcttcccacccagggttcatgtgaagacagaattggttcagttattactttcagagaggaaaaggttaaaagtgcttctaagttttttctgtgtcagttttctttttatctcaactgtaagagttactgattgtaagcagctggggtcttgcccaggtcttcagttcaatgattcatacagcttctcatcgtaagaagacgatttggaactgagtttgtgagcagccccctttctttaaaagaatgtgcttagaagaaaggacagtggaaacttctgccccctgctctcctcttccagggagaagagaaagaaaaataccccatgcctgtttatttaaagcatattttcagagtccttgcagagtagatcagaacacatgtggctgttttactttttaattttccttctctaatctatagattgataaatagcaaagctcagggtaagatatcaagagtttccagtttggaaagtctggataaatcaagagttaaaagagagtaattaatgagcaattctttttctttctctaccctcatccttacctgtatttcaggaagataataaaacatgataaaatttcaatcttatcattatcattaaagttcaaggtagctttgcaggcagatttttgggagagggagcatctgaatctttggataatccctttcttctttagggtatatgccaatcagccacagaattgactttttatctcaaattttaatttaaattgtagattatgagtgagccctgtttagcttggataatacattttttttccccctcctttctgggttcccaggaactcaagaataagcatataaagagaatgatttaagatgttttgtattaatatatattgcctttctggtttccaacagaatcattttttttcatatttagatctattttttgtagtcttcatttcattgtagtaatccatatatgtgaaaatataatattatggtgatttctttaatatcttacaaatgccaaaaattgcttagaacactgttttcaaaaataaatattcagtccttttaagcttctctttctctctagctcacttactcttcaaaaggtccttggataaaaccaattgcagcataatgtcataattgtggaagcttggccttcatccatgctgaaacttcatcagaagctgctggtacagggagaaatttagtagtgagcatgtccagagacactagaaatattatattatgggtgtccctctagtattttagtctaaattaaatatctaaaagggatatggagatttcagattcatatttaacaagaaacaaagtggatattaagacttaaatgttgtagtttacatttaagcccagtgctttaattctagcgtgggaaatggacatacaattaagaaaaacccccaagcatatggtcagggcacccatgacaggtatgtgtatatggcagggcaggaggaactgaggcaggggcgtggctagaagagggaagcaggagagggatctgatacgcatgtactcagggcagcaggattcattatactctgctgcttcatgttggtgagtctaagcccacaggaatgaagactctcatgatgaggactggctcagggtctgagctgagcaaaacttaaaagtttagtaaagataatgcctgcagattagagaagttggagaaattaggcactaactcgtccatcttggaagcaacccaggtcagaacaaatgacctgggtgagtgtgtctctgggtttatatgagatgcccttccctcactcattgtcgcctttagtgtccttcaacccaatcctcacaatcaggtcacatagaaatgtacagatattgcaactgtctcaagtgtgatagaacaaaaaaatataattatagatgaaataaagaaacccacatttcatattatttgttttgtgacagtgtgaataaatagcataacattttcaccaaaacagaaactagtaagtcatgataaaagtgccacctcctagagatatttactgatactgtactaatccatcttctgtcaattatgaagattgcattatttggggtagaggatgttgttgtttatatcttttgatgttattgaccagaccgaatgtaccccaaagaaagtatatctctataggaaagactcctggtggtcataaattccattttttcttcttgaccagatataaaaagcacattttgcagctttcttcaaagctgggatggtgctgtgtgactgagtttggtcacaggatgtggcaggagtaaggtacatagttttgaatcctggtgataagagccccgtgtgctaccctcctcaccttttcccatgtacagatgtgaaaaaatgaaacacattgttgatccttggcttagaccacctcacagccatgaaattaaaagatgcttactccttggaaggaaagttatgaccaacctagatagcatattgaaaacagagacattactttgccaacaaaggtccgtctagtca

SEQ ID NO: 58054 - DNA, 2786 bp, Bovine  19866880580668
cccataacagacaacatggcctctgccggccgtctccaggactacctgctctgatggaagtcagctgccgtgtctagaggtattcgagcagcactatggaaatgtccttatgctgaggaacaaagacccccccccctgcctgctaacctcaaacactaatttgctaggttcgtgactcaccttggaagctcaggctcacgctccaatcaagcgatcagatgactgcagcctcatgacaaaccctgagccagaaccaaacaaactaagctattcctagattcctggtccagagaaactgcatgagacactaaacgtttattgtttcaatccactaagttttaaggctatttgtcacattgccattaaaaatacaccattctttgaaaaaattatttcataaagaaatctgaggaacactgggtgacataaaaataagtgtctttcttgtgggacttctcagagattatgcaatgtgattctccaaaaaggagacactgcatgcaggatttcccaaacacacaagtgtgaaactgtttgaagaatactgagaatctgagaaatagtcctttattacatgtaaatcagtgcttctaaaatacttgccaaaacaagtcaaaaccaaatcactctcttttctgtctagcttgttgttctgtatattttacagaaatattttaatatagcttatgtatgagctttctttcagtggtaaatctatgaattatgttgctgacatagtaaaattcctttacttcgtagaagcatcaacaactggcattttctttaaataccataactgtgttcaattttatacaaagaagttgcacatggagccacacaagtatgcttactgggaaaattccattgatgcgactaggttttcctttgggatacggatttcctgggattgttccacaagaagatatcatcgcatgaggagctttgcagccccctttgaaagcctgtaacataacaaagaggaggattgttaaaaaacataaaataaactcacaaaatttagcattctggatattgggaagccctgctaaataggatggattaaggaagagcatcacattcaatctgttcatacatcagtcagcacttccactggtgaacatgactaaaattagtaagtaaaatcacttcacttaaatggaattatttaaatggtaaccgaatgtttttatcgttgcaactagtagactcctacccaaagacctcttcacgatggattctataaattgtgtgcaaggactaaatacgactgggctgcagctcctgggggaacagtccatgccctcctcgagcaggtttctaacctctaatccagtttccacctgtcaaaatcctaagaaataactaccttgaatgacgaatcaagttttctagacttgggcaagtacgacttctcccactattagagactttaaatgaacaaactggaatttagccttataattattcatcttttctaagtttgatgaaaataagcccgatgacaaataagtcaagttcctggtggtggtttagttgctaagtggtgtctgactcttgtgaccccatggacggtagcccgccaggctcctctgtccattggattttcccaggcaagaatactggaatgggtttgccatttccttctccaggggatcttccccactcagggatcaaacccatgtttcctgcatcagcaggcagattctttattactgagccacctgggaagccccattattagataacaccccaaagcataaaatgtacatgaatccatactgatatggatgtgactgaaaaaataaatgatgaataaaagaacaatatagtatctttgcaatgttcctataaatttaaaattatttcacaatcttaaatttattacaaataatgtttataaagatatttcataagtagaaatgttctcaacattttgctaagtatgctgaaaaactgaataaacaatataattcctatttagaaaatgtaaaggaaaatatatcaaattaaacccctcaaatctacagcaaacatttttttttttctctaagaatgacaaatgttaaaatgttggtaatcctgagttgttcagattacaaagaggcagtttcacagagacacatggaggtagaggtgcaattggcatgaagtatctcttggagggcaatttggcaacatataacaactgaaaatgcacttattattttacttagagggtttcctaataatttttcctacagaaatctttgtacatatgaagaatgccctatgcacatgaaaactcactacagcaactttctaatatccagtgtttgcaaataatctaaatgtccaccatgatgactatgagtatatccacccaatagagtacgacatcagagaaggcaatggcaccccactccagtactcttgcctggaaaatcccatggacagaagggcctggtgggctatagtccatggggctgctaggagtcggacacgactgagcaacttcactttcatttttcacttttatgcattagcagcagcagcagagtactacatagctgttaaagaggttgattgttgttgttgaccggatgccatgatcttagtttcttaaaggctttatatacaccgatatgaaaattcctccaaaatacattgtttaggggaacagcagtaagttgctaatggtctatttggcttgattacgatatatgtgtacgcacgctcgctctctctctctctcgctcgctctctctctctctctctctctctcgctctctctctctcacatacaaaaa

SEQ ID NO: 58055 - DNA, 1131 bp, Bovine  19866880667461
tgaaggcgacttagccagcagcagcagtagcagcagcagcatgtgattataataaatagctataattacatttataaatttataatagtacaataaggcttcccagatggctcagtggtaaagaatccgcctgccaatgcaggagatgcaggaaacttgggttcgatccctggatcaaaaagatcccatggagaagggaatggcaatccactccagtattcttgcctatgaaggaaagaaatgtatctatatattttgcttgcatttcttataaagtattattggaattattaaagtactctcacatagtagacatttaataaatattttggggtttgaattggaaggtagtaaatagaaatacaaattttttcttctggagaagtaaattatgatgcttaatttaaaattacattaattacacttagtttgcagatggcagcacttaagaaacaactagaagacatatgcatttctgtgagagggtaaatttttttctaataatattacattgaatataaaccaagaaatgaaacgttttgtaagaaagctttgtaatccattccaagacaaataaaggaagaatgaaggctaattaaaaaaaaaaaaagaaacaagatcttttcttgtttggtcctcattttaaaatcaatacgtctgagttaagggaaatttttctgcttggtgcaatcaattttacttcctaatatgacatagaaattaactttaggtataacctttccacttaattacaaagtaaaaggatttaaggaaagtttaagaacagccagagttaatctttaaccgaggtaaaatagcaatccagtcatgtggttcaataattaatgaatacaggacatttaaataaatgtggtatcttgtttgctttaatcatgaatttaaaccaaatgactttgtatgctatgatatcagatacttagaaatttaactaagtatgtcccatccaaagagtaaatttaatttattttattccctattcattatctttttttgtggtcctctgaaatgaatcttttcctcattggagcttaatggtataaatctttgtttaagcctgttgactctttttttgtaagtagtcttgaaaagagtgtaaagaatcagaagaga

SEQ ID NO: 58056 - DNA, 1333 bp, Bovine  19866880679425
caggctcctctgcccatggaattttccaggcaagaatactggagtcggttgccatttccttctccaggggatctttctgacccagagatcaaaccagcgtctcctgtttggcaggtggattctttactcctgagccaccagggaagcctttaagatgcatatggggttacatttcggtgagaagcatttatccgtttaaccgtttggtgcttttatccggagctcctccagcttaggtttttgatccctacctgcagcattgagagctattttccaggacccagcaccacttctacataagttttgttgagtgatgtcagagtcactccaggaagcccactgggcagcctctgcgcctgggagtggagagggagagagtttaagtgagcctcttatccaaacaaataacattttgttagcctaatatgtttcagcctattgtactttgaactcctgtgtacaactcatacatgcattttacaatttagtacaaaatggacatccaggaacacagaagggatgtgactaatcttttaaacatgagaaaatccccacccaactcttcatcaatttctgatctgttttggtattattattttataatttaatatccttgtttattattatgtacagaattcaaaagaaaaattctatgatgttctgttcacaaaacgaactggaagatgccaaatgaaaagggacatcattttcagaatatggttctttatgtgttttatttcaaatcctggttatggatcttgattgaaaaatgtcaggcatcgtgattgtgggttcgttctgagaagtgagaccaccagcctgacccctggtgcttcccaatgtctggagggctttcctttcttccttttaaagtccaactctgtttgacttgcaagtaatgataagatcagcatttgaggtatggcagtatgcctgaagggcagagttcaatattttgtttcatggtaagaagaatagaggtccacatttattttcaagtagcctaaggaaatcagtaaattataatttttttgactttttaatttagcttgccttgattgaggtgaaagagtgactcttagaaattatttttggtaaatatcttgggtacttgggtttttttaattacatagaaagtgacacatacgtttatttacttaaatgtattttgcattgatgatcattgacaaaatagtaaaatattaaattctcatctgaaagcaaagattattgatagtaatgatccctcattaggataaatacctcagtgttaaaatatttctatacttaaattggcaaagaaatattttatgaccaacacttgcaaatctta

SEQ ID NO: 58057 - DNA, 1006 bp, Bovine  19866880768649
cccgggccgggccttgctgtccccgggatctcgcgggggttgcaggggtccccgcccgaagaagccatagtgctggcgaaccgcgggggctcgggtgcccttcggccgtgaggtctggctggatccgttgcaggacctagtgctgcaggtgcaaccgggggatcggtgcgcagtgaccgtgctagacaatgacgcgctggcccagcggcccggccgcctgagtcccaagcgcttcccctgcgacttcggcgcgggagaggtgcgctattcgcacctgggcgcgcgcagcccgtcgcgggatcgagtccggctgcagctgcgctacgacgcgccgggtggggcggccgtgctcccgctggtgctggaggtggaggtggtcttcacccagctggaggttgtgacgcgaaacctgcccttggtcgtggaggagctgctggggaccagcaatgccctggacgcgcggagcctggaattcgcctaccagcctgagacccaggagtgtcgcgtgggcatcctgcctggtttgggcgcgctgcctcgctacggggaactccttcactacccgcaggtcccgggctcggccagcgagggggacagccaggagcccctcctgatggactgtacagcattccaggaactgggcgtgcgctaccgccacaccgccccaagtcgttctccgaacagggactgggtgcccatggtagtggagctgcgatcgcgagggtctcctgtgggcagcccggctttgaaacgcgagcacttccaagtgctggtgagaatccgaggaggggctgagaacaccgcccccaagcccagctttgtggccatgatgatgatggaggtggaccagtttgtcctgaccgccctgaccccagacatgctggcagccgaggatgcggagtgtgccccagacttgctgatcttcaatctcacctctccattccagcccggccagggcttcctggtgagcactgacgaccgcagtttgcccctctcctccttcact

SEQ ID NO: 58058 - DNA, 2594 bp, Bovine  19866880892641
aatactggagtgggttgccattcccttttccggggtcttcccaacccagagatcaaagccagttctcctgtattgcaggcagattcttttcccatctgaaccactaaggaagccccaagctgcatttaagctgagccctaataggtgagaaggatttagaccaaggaagacttgggagaaaatgagacactcagaatgaacagtgtgggtcatttctgccaaggcctgaggtagaaaagtctcacctcttcagaactgaaagaagaccagagtagctgaaggaaagtgaagtagagggaaagtgagtggaagccagatcattcagagacattaaccctcttaacaggcttcccaggtggctcagtgctaaagaatctgcctgcaatgctagagacattggatcttccctgggtcaggaagatcccctggagaaacaaatggcaacccactccagtattcttgcctgggaaatcccatggacagaggagcctggtcggctgtagtccatgagattgcaaagagtcagtcacaactaagcatgcacacaaccctcttaataaccatggattccatctaaaatacagtggatgtcatggagagtttctgagcaactgaaaacattcatctaatttacttttggaaatctatagagaactgatctgggcatctttcaagctcaagtaattggataaacggcaaggctttttggtggtgtggggatgtaatttggggaaaatgaaaagttctactttaaacacagcaagactgagatgtttccaaatgaggcggcaggtgtgcagtttcatatgggatctaggacttactgaggtctgggcccattttgaaatgtgggttttattattatttatatatggtgaggccaacagattagtctatgactgctattaaaaaggtagtttgggtggtcctggtggtccaggagttaagacttcaccttttaatgcagagggtacaagtttgatctctggttggagagctaagatctcacctgcctctgggccaaaaaaccaaaacattaaaaaaaaaaaaagtttgttactcacagtccccaagaggcaggagtacatcatgtcatgtggggccatgtggagacgcaccagggttggggaaaggggaaagcatgggtaggagcctttactgtttcttttgcacatgcaaggtggagtaggcaggcttaggacaggccagtttgaaaattttcagcagtctctggagaacacggctgtctctagcagtctggtacctggccctgggatgattaagcagaggagtatgcttcctagagtgtaagaacctgatggaggagttggtaaagagtacaagctctggataagttgctttgcatatgaaaagcctgtgactgggagcaagaccccagattccagaacatcaagaatacagaaaatcagggaagactcagtacttgcttcctatgcagggggcgcaggttcaattcctggttggggaactaagatcccttatgccacaggatgtggccaaaacaaactacagaaaatcagaaaatatagattgttaatctaagactggaggtatgaatttgtaagtggcatctattatgtgtttatgagggcaggggtgctaagtaaaggttgagaattattcactatcccagatacctttgtgctaagtcacttcagttctgtcctactctttgtgaccctatggaccgtagcccaccaggctcatccatccataggattctccaggcaagaatactggagtgggttgccatgccctcctccaggggatcttcctgacccagggatcaaacaggcgtctcttttgtctcctgcattggcaggcagattctttaccactagcaccacccgagaagccccttcccagatacctttggtaagtgctaaaaatgatatctgaaagactggtggaaaaatactttttgttgctttttttcccccctccactagaaaagagtctggctgtagggagcttagacaaagaaattgcaactgctttcttgttgcccaaactattcttactgatgttttagcctagatgtgtgattgtgggtagaaaaaaataaaatatttacccagtatgcatataatgaacttaacagctgttgctgcaccttcatttggaatccgatagctgtttctaaaagagttaagtggtggttcagctaatcggtaagactactgccaagttgctaggtattttaattaaaatagtttaaatgaaaggtggtgattgtcaggtctgacaaagtaagattctttcctgactttaattaaggtgcaaagaaagtattgttttaattccccaaagattgtcggaggtagtttttatgctttaggtacaatttcagctgtactgaaccagaaattttcctctattgcaccaaaacatctctaaattgtaggtatttaggttttagcttctaaaggatagaaatctgtaccatatcactgatacaagtaattttaaaagaattcctctgcatagtgtactatttgatttgtttattttaaatgctatataagatacagatctaccttctgcttttcaaatgcattgaaaatgtttctttt

SEQ ID NO: 58059 - DNA, 1597 bp, Bovine  19866880924164
catgtttgatattaactctgggtcatagactgaatctctgaggtcaagtagtcaggcagtaggatgaaaaaaatattaccagatataaactctgcttgattctatctttacatcatcttgttagaacagaggttctcaaaatgtgcttctgaatcagatactctaggggtggggccttttaatcggtgtattaacaagccctacgggttattttgatgcatgctaaaatttgagaaccgcttctcaagcaatgtagacttagctgagtcagtcaaatcagtgttaaaaaaaaaaaaaaaaagaggtcagaattccaggcaggatttagaatttagaatctaagtcagtgtttctcaatctttggctgcatattaaaattactggaggagttaaaaaaaatagcaaatgcttgggtctcagctccagagattcaaattcctgggactggcttgggctttgggatttttaaaaactgtccgtgcacttttgatacctgactgggactaagaaattactctctctaagctataggtagtattcaggaaggacggtcagtgttttcattttcagagtttgattttctggcactagtagctttgggcaccataaggagataatgagtgtgtatttattccactaaaatgtaagagtaaacattacttaatttgctgttacttggaataaaatttggcagatttcattcaaatgactggattcagcagtgctaaaatgttattaagagttaaactagtctcagaaataagagttatgaaaaaagtcaatattttttcccttgcagcttcacagtgtgttgaaattgtgttgcgtgaatatgcatactctttctcataaaatgtgccattaacctggcttttggatcagcatcagtcgatgtcatctttgacacatccatcattgttctgatacaagtgatgagactgcacattttttttccctaagattttttctgatgtggaccattttttaaaacatttattgaatttgttacaatattacttctgttttttgttctggatttttgcccacaaggcatgtgggatttcagctccctgaccaggggctaaactgcaccctctgcactggaaggtaaagtcttaaccactggaccaccagagaagtcccagtggaactgttcttaaagatcagtttaccactgtcccacagcaaaggggctccccaggtagctcaaatggtaaagaatctgcctgcaatgtgggagacctgggttgggaagagcccctggagaagggcatggcaacccactccagtattcttgcctggagaatcccatggacggaggagcctggagggctacagtcattgggtttgcagagtcggacatgatggaacgactgtcacagcagaagcacccagtggctataaagctgtgtggctggcatgcctttctgtccccggcggctccctctgcctccctcatctccctctggtctgctgtcttgacccaaggctgatcctctcttcagggttgctctgtcttgccttcctggtccctacctatgcgcccattactctcttccctctgatgtcttatcagttaatctcagtttcctcaagt

SEQ ID NO: 58060 - DNA, 1159 bp, Bovine  19866880968280
tgtatctatggctttctattgaatggcaatagttcactatacaaatggaaacaaagctccaacacattacagggataaactgatttacatgtccagggcttttattcaggttatctttagctggatttcaaaaccacaaaaagaaatttatcaccactgctttccttggagcataacgattcatgttttttatgttggaagttgttttatcacttatttgaagaagtcaaatccattaacccatctcatcaggcaactgcatcagtggagaagtaggaccgtgtggtctatgtgatttctttaaagaaagtggtgtgttttgttaagcgtcatatccaccgccacccagtagggttaaccgcaattcttgcagtgataaagatttctagaccacctgggtttagtagtcatgctcaactcttttagactaggcagacttgaaaaggagaaatcagtgaaccaagtgcatggaattatttcaaaggaacaaatattagaaacaggtgtgagatactccctagggaaaataaagcattaattcattctaactggcagtggaccatgccacatttcctgaagaattagctgcctgaaaacattttgataaaggagttaattatacatgttgctagttatttttcatttccggcccaatttttctgaaccataaaagtgcattaaaaacttttatgcaattatgaagtctcaaaaagcatttttattttccatctatttcccagtaattatattttctgagcatctgtatatatgaagtgaattttttattatatggaaagcttataatccatgttttatacttgtcctatggctcaaatcctacagtaaaatgtatagcatcatgtatatatctaatgtttagttttatgaaattttttacccacttgcttcattcctgaaaggatttgaggttgtggcattgaggaagttgcttattgattaccttagttttaactgcatcacatactcttttaatatttaatttttatatgggaaaaatgctcttattttgccaaaaaattattgattaaataattacttgtttgataagagcatagcagttataatcttataatgtcaataaaacattaatcactataaatgtttaacatcagaatgtttaactatctctatggctcct

SEQ ID NO: 58061 - DNA, 1335 bp, Bovine  19866880996074
atatagtattatgagcagaataaggaagctttcaacaacttaattgagaaaaataagcccttttgatggaaacatcacattttaaaatccataaaatatagtattataaaaggcaaaaggacaaaaaaaaaaccacactaaaagcaataaataagaggaaggttattaaaagtaaactgaagagtttctgggtataatggtcttttgatgggtctacttggctaagctacaatgcccaattattcaatcaagcaatcatttagttgctgatgtaattcaagttcaaataagtcgacattaagtaaataatttgggtcggcctgattccatcagttgaaaggcctttaagaggagagatgaggcttaggtaaagaagaaactcaactggtagacagcatcttcagctccagagttctagcctgcctgtcctgacagcccgcctgtcaatatgggacttgtctaccatccccaggactacataagccaattccttgcagtacatgtcttaatacacatctcttactgctgttccttctctgattgaacactttctgatacaaggcatgcaaataacaatgttaatgcttttatataaaacatctatctcagcccctcattttcagtggcaaaggacttgctataattgcatcctagaaaagaaatttcctaagaccatggacattttaaaaataaatttacttaaaaccatttcggagagctttgtgttaacaggggttgaaaactatatatttaaatattttaaacaaaacaccttaatactttgtaatcaggaagccataaccaaggaaagtgttttttaattcatttgatgtaacatataaacaacagccaaataagaaagtttcagcagagtgtttcaggtcattactttcataggttttaagacaagtacctaaagtgatagttagcattcctagcttatttgtttatgcaatgagagccattaatcattccatttgcgtccaagtatttgcaattgaatctagaactagagtgctcatagagtatatacttgaagactgaccctgtggaatttcttttcttactttaacaaacaattcagttcagttcaaacatttagtgaatactcattagttactaggaatacaaattctttaggaataagctttggttatttgcctattgaactcgaatataaaatgaatgtcaagattcaaatacttacacgactgagaaatgttacaaaattagaaagtcaccattattcatattctgaaagtagttttcttccactgacactcaagtgaaactatttctaatattttcccaatcttaaaccatacctctgtcctt

SEQ ID NO: 58062 - DNA, 1876 bp, Bovine  19866881120205
ctgaaggagatcgccctgggatttctttggaagaaatgatgctaaagctgaaactccagtactttggccacctgatgcaaagagttgactcattggaaaagactctgatgctgggagggattgggggcaggaggagaaggggacgacagaggatgagatggctagatggcatcactgactcgatggacatgagtctgagtgaactccgggagttggtgatggacagggaggcctggcatgctgcgattcatggggtcacgaagagttggacactactgagcgactgatctgatctgatcccctaatcgtgtgattggagtacctttttttaataacactattcagtaccatggacttcactagaagtgctgattgtgacataacctagcactccaactgagaaattacgattgttttctaacttttcaagcagtgtgtctcccttatttgtaaatagcctctttttatatagcctttctgaggaaagtagaatatatatattttttaatagatgaacatattgagagatgtggataagaaagagcacataggagaacttagttcttcaattaaagtaattacattgaaaaagcctagttttaatccacatagttgttaggacttacttttgattaagcagatttcatctaatatttatattaagaacatttaattacagtaccccccacccccaaaaggcagattctggcatgaaaatttctcatgttgaaagtagaattattattttttattaatagaaaatggtggctgttcacccaggagaagtggtcaatatactcaactgtttcaccttcagtaaagacaaactagttgctcttgaactgttagcttcgtaagtatttcttcttctttttactcagaaaaatttggaaaacttttcaaacgtcttttaactcattagtgtatgttaatgtgtcagaattatattggtaaatggaactaatgaaatgtatgaaagcatagagctgaattcttatatctaagtagctagtgtgctcattacacatgattataaacttgtaaaattagtggtgcttattgagtttagttattgtgatttggctgcgtatcggtgacttgctttgccttcccactgggaataacttgagaggcttgttggtaaatccagaggacgtatggctggatgggttttccacgctctgacagtgtatgtatttttttgcttcctatacacttattctctccggatcttgttttcctcaattgtgaaaataaggatcttatctatgtggtagggatgcagatttttaatactacaaaatttaaaacacccagcacagcatttgagaaatgattgtgaaataaatttgagaaatgaatgttagagaaaaggaacctactctcctataatgtatttatgagagtctacaaattgctatgtatttccagcacatgcagtttttaagtccctaatatatttataaatgaccacaaaaacacaaatttaaaataaaacataagataaaacttcatttttagatcaaccttgatttttatgcatttaccacaggggtttgttttattgccattagttctcctgacacagacagggtagatttgcaagaatctcaaaatagtgattttttttgtttttaatttgaaatattgctttgttactttcaagtagccagataaacatcattcagttactatatgtaccatatttatataaacatgttaattacactcatcaatcaaaactgaataaccatactcttcttgttacatcatggaaaaaagcttactcacatatatctgtgtataaatgtggtgtgtccaggttcttaaatgaaaagctaaattgtatttccttgggtagaaacattggttgatg

SEQ ID NO: 58063 - DNA, 886 bp, Bovine  19866881197485
tgagttagtgatgccatccaaccatctcatcctctgtcatcatcttctcctcctgccctcaatctttcccagcatcagggtcttttccaatgggtcggctgttcgcatcaggtggctgaagtattggagcttcagcaccagtccttttaaagaatattcagggttgatttccattgggactctggtgtttttaagcctgattaatattccattgtatgtatagaccacagtttcattatcaattcctcccatgatggacatttgcattgtttccatcttttggctattgtgaataatgtttctatgaacatggatgtgcaaatatttgttcagtttctgttttaagtctttaaaacagaagagaaatttgctgggtcatatggcaattcagcttaaattttttctcacaattatttttatgcctttttttattttgtggtgtgtatatttttctttttaattcattggcattaaaccttgaatctaatgaaacaaaacctcacttattttaagggaatgcttttaggaagtaaatatcaaaaataattcctgttggcaaattagcaaatctgttgcaaagtatacataatccacttgtttcattcaaaaaacccattagagcagtcacagaaacaaaacttcatcctgctaagcatccctgaatgtgatgtaactattcttggaatcttgaattaaaaaaaaaagaaaaaaaatcaggccacccaagatacattgaaaaaatttaattattgaaagggattgtaatgaataatctgtgcaggggggagatatttgctattgctagaactggctttcagttgataccagttttttttttctgagcctgaaaagtagttggatagcacaagtctccctttggactcaa

SEQ ID NO: 58064 - DNA, 632 bp, Bovine  19866881247891
cgcgcacacgccaacttaataagccgagagaccatgcttaatgcttaaatctgtaattttttttaacgttcataaatctttgcaaataggttagggccttgagacatttttcttgggttaggcagcttttggaaacaatccaagatttataataccagaagaggaacattcttcaacagtggcaaggatgaaaagattaacatagcaaatagggattttgtaaagaaggtttttttatgtcgggatttacattaaacaaactagccatgtgtttaccatcttctgtctttactcttagagtctctttactccttttactcctcctggcctagtgtcctcacgttggcagaatcagacatcttgattttaagaaatacacactttgccttactgtacaccagaggatgtgtatcaggtgagaaacaatccaagggaacacctttggtaaaactgaccttttagagaagggacatgtggacacagcggggaaagggaaggacgggatgaactgggagagaagcattgacacatatacgcaaccacgtgtaaagtaggtaactagtgggaagctgctggataacgcagggcgttcagcctgggtaccagtgtgataacctagaggggtgggggtt

SEQ ID NO: 58065 - DNA, 1618 bp, Bovine  19866881263369
ttgctcatttttaaactttttttaattgttaaatttttatatgtttttaaaggttactgtctcatttacaggtattaatattacaagatattggctctatctccatgtcatacagtacatccttattgcctatcttgcatccaatagttttttcatctcccacttcccaatccttatgttgaccctcccctctgctggtaaccactcatttattctctgtgtctgtgtcatccactcattttttaagtgaatacgttagactgtgtggtctggagttctctgcagccctgacagatatttacctgcacatgttcccttaagagttgcacagagtattttacagagtgctttacacaaagccttgcacagactacacatatagcgatattaaatatattaattctgcagactaaattaaatgattattcatgatctctgttatgaatttctcttgcagagagttgtgaatttttagattgccctaggattaaattttctaatgagtagaattgtgtttctaggttgctctgggtcgagaatggtacgtacacaccatctacacagtaagatcgaaagacagtgccaaccgaggcattggcaaacgcagcgtggagtaccggtaccactctttggtgggtcaagggaagccccaggcagctaccaagagccggaagaagagggagatcagaagcagccctccgctggcgtgggaaatcggggctgagaacaatcggggaacgaacatccagcacgtcgccctggaccgcagcagcaggaagcagatccttcacgggagggtttcccctgacggcgtcctcccccgggagctcaacagtcccagctctgaggtcagcctgctcacggtggtggggggcgtcgtggtgggactcctggccgtcatcctcactgccgtcgcggtgaggatgcaccagggcaagaagggtgccaggaggaaggacgcacccaaggaccccggcagccgtgagcccatgatgccctcagtgagccaccacagcgacagctcggaggtttgatggctgcaggggaaacccagccttttcctccagtgcccaagaaaagacaatcaaaaccaacccagtgcttctgttgacagcagagaattggggacttctgtgacaaagctgctcagaggacctgcctgtactagtgaacattgactggcattctgtctactcattcaggcatcagaggacaccttcagaccgtagaccacatctttcctcttgcccagaaggcatcaagtgcatatccaggtgtacacagagccatggtaggcggcgacgaatgtactcaccttaggcattttctctacgcagtggagatgaacctggtgctcacagactccttcagaaacttaacaggagtctcttgttgctatgttggtgtgaatcttgaaggtgcaattatcacactgtttattcattacataacattttagtactcgaaaggttttcatcagtagtcttgaagaatgataaacacattgtttatggtgacaagttttctaataggcgaagacagcatggaattatgaccaagggtagctcaacccacaaatcacctttttttcctacttgagagggagtggaaggaaaga

SEQ ID NO: 58066 - DNA, 894 bp, Bovine  19866881344594
ctacagaggttcatgatacgcattcatcctgtggaccgcctccctcccgagctgggcagcggctgtccccttcggatggtggtacaggaatcccagctcacaccactgaggaagaagtggctacgctacacggacctggacacggatgaccgagaactccgttacacggtgacccagcccccaatggacacagatgaaaaccactcaccagccccgttgggcaccttggtcctgaccgatgatccttcggtggttgtggcccattttacacaagcgcaggtcaaccaccataaaattgcttacaggcctccagatcaggagctgggagtggctgcccgagtggcccagtttcaattccaggtggaggaccgagctgggaacgtggctccaggcaccttcaccttttacttgcagccagtggacaaccagccacccgaaatcctcaacactggcttcaccgttcaggagaagggccatcacatcctgagtgagactgaattgggtgtgaatgatgtggacactgatgtggcccacatcaccttcactctcatacaggtgcccaaacatggccacatgaagctgtctggacaggtcttgcatgtcggtgggattttccacttggaggacataaaacagggtcggatttcctacgcccataatggggctgagtctctgaccgatagctgttccttggaggtcagtgacagacaccacgtggtacccatcactctcagagtgaatgtccggccaatggacggtgagctgcccatgctgagccttcctgcaggcactctggggtcctatctagacgttttagaaaacagggctactgaaatcacggccaatgttatcagggggaccaatggggacgctgatgatttgatgttgactttc

SEQ ID NO: 58067 - DNA, 816 bp, Bovine  19866881425973
gattcttgcttttctaaatttacagtcagttagggagacaagaccagtaagcactgttcaagataaaattcagaggtttacagaagtctggagatggggaaatcatatagagctaaattagcataagcaaagataactttcttgaggaggtgagactagcgtttgatgtcaaaaaagacagtgtttgtacagcgtaggggaaaaacagatggtttctgagatgtgcgaagcaaggaaagcaaagggagcctggtgtgtatgggaactgctgaaacagagcccagattgcatgttaggaagccgtgggaaatcatgggagaccagtaggtcgggccagattctgatgaggcttttaaagttactgttaactaaagtttgagatttttctggtagctgaagcaaatgattgattgatgaagcagggggtggggaaacattgcactgactaaatgttgaccattataattttcagcgcaacagctgctactgaaattgcagtcattcaaaacgaaaaatagacactgttgttctgaaatagcttggactatttggaaccctggagcctgagtgctggcgatgtggtttcactaagaacatgatggagtgcgggttcctgtttttcttttttttccataatgatttgttctatggattgagaattcaaactgagcaacaatttcacagtcggagttggagtgtgggttgtataaagttgcagaagcatttttccaaagacttgaaaactcctccctactgcctaattgcactctctaactagaatgatgtttaaaaacatcaatgctactttcctgactc

SEQ ID NO: 58068 - DNA, 1135 bp, Bovine  19866881974092
actagtccctgtgggctctgtcatttcagtgcctctagacatgtgtgtgttcttcccttttcttcctttcttcctttatttcttcctcctgcactcccttccttccttcttttcccttcttccttcctccctttgtttctttctctttttttctctctctctctccatttgtttatttattgatttttacaaagcaccctagtagagattagttaatagaatctatataaactgatgagaactatttgcattttacacttaaaacacattcagtaaaatcatgcatcacttttgtgggatattctttaaaagtataaactttcacatttcatcatcaaaggaaaggcaacaagaaaatattttgtgtttgttagtttctttttttttttcactttatgcttttacttagataccaaccagaacaatctttaaaaagtgtttactgagaaccaagtagagcttaatgagtgtgaagcctatgctaggtgctggcgataaggtgataaaagccacagcccctaaggaactctgaccttaacggagctcctttaatagctaatgttggttagtttccatttcccttttgacttttagttccactgtacatactgaggtttgttagtctcatcccaggttatctctgctgactgttgctctctgctttgaggacctctcctctcaaactctgcttgtgaacttgctcaagaagaaactgtcgaagtctgcatcctctgactccacctggcctgagccatctgctgtaatcactgcaggactatgaccatgcttactggcagctggaagctgtctctcttctggccaaacttagtgttcaagctgttgccctttgattttttgcaatccattaaaattctatgtcctacaacaatgcaaggaaggagctataaatgactttcactgagaagaacaacttcaaaatgacaagtatatcaccattatgtagtattgaatagcaacagaatttgactttgattgatgtgagttgaaaaaaaaattaggcatttcacagaatcaacaggagggctggagaaccaggcttagtgttacatacctggaagaaacaacagcccacatcacacacagaactgatctgctaaagaaacttatttccaca

SEQ ID NO: 58069 - DNA, 764 bp, Bovine  19866882137369
agaagaaagagaaaatctatttaaaaacaagccagaaactcagagggcacaatggagtctatttagtgttaagtacagaaagccttgtgcttctcaataagccaagaggcattgctttattacagagtagtgtaataacagctgttcataactgtgttccggagtctctaagccaagcactgtagcaccctttactctctgattatctcagtccttaacaagcagaacaataaagatagctctctatgcgctttcccttattacatcatgaggtggctttttccatccatggtcacctagcacaatgcctggttcatggcagccacttgtaattacttgtacagtaaatggcttaaaaaaatggctagccatgtagaaagctaggtaggtaggtaggtagacagaaacaattacatgtaaaggttacctaagaccagagaaatacttacaaaaatatataaagacaaattctcctaattcccacagaaatgggagaggtggaaaaaagacaaagtgaacagaataaacatgaagaggttttgggtttgaagagtgtcagctaagaccataaactaccaacatctgtgaagtcagaagaaaagcatctaaaatattttgttgttagagctctagtttacagattagtggcaaaccttagtttttctttgagtgactccaacttgtttctgaacttaagataatcccaaataattctataaaaaaagaagccaactcttcaggacaaaggatgccaccttccttat

SEQ ID NO: 58070 - DNA, 2052 bp, Bovine  19866880353521
ctggaaggtctaaattctttactgcgctttatacctttcttctcttattgaaacagaggggggaaaagtcaataaattcttcattacagcaatctgatggtaggtcaacaaataagaagggccatgggacactccaaagaaaaattatcaaaacaatgaaatttggtacatgtgatctacttcccaggtaattaatttttcacagatgtatctctcttgtccaatttagtatttatgacattaacctacataaagagtgtgttttgtgcagtatttttgcccaagtattatgttgatttttttgtagtggaaataaaatgttcctaagcgtctgttgctccactttttgacatttcaaatatttgagcacctagatccaaaagtgtttggatatacacaaatagaacaccaaaatattattccagttttgaggggattaggagtggtcatttatttttgaaaatctcttattactgtacaaagagtgtttgacaataacttggttactgccactggcttttattccaactaatgaaaatattgttcattttttatatgatatagatttcaaggtagggagacatgtaagtaaagaattattaatccacagggttattaacattatttccatgcatgaatatataatttaatcttctgtgcccattatatagaaaggaggccctaggcctttgtctcaagcatcctaaagccgtgctaaacacagctgttaatagcattgcctatgccccagaattacaaattgagtctgccttctaaaggcattcaattaaacaaagtgttctgtggtaccgcaatgagaatcactaactataggccttaaatggagtcttttgactatttgccttctgaggaattttgctaatatcctactgttattcaagcaattaaaatgcaaataaacatttaagggtactagattgggagctcagatttgaaaaagatatcattctatactcactgaagctgcttgttttttttttaattggatgcttctttgtagatgtgccttctgattaatactattcacctcagacagtcttttttatggcagatagaacttttgtttctgtgcttttcatactaaaatctgattcttctcacttccatgccagcaagaaatgttcatcaaaaaaaaaaaaagtgaaattgtgctgtgcatgaacatctcagaaatttaaaatcctacaattaggtttaaaaatctctccaggatgtattgaaaaaggaggcattgatgtttgcttgaagataaaggaatagcagcaagttacagttgcattgttttcatcaacttaactcttcacccatgaataaatgtatcataaagtacattaatctgtgaaaaataactccttaacaaagagatatccagatggtgctatggcaatctaaatgttcctaatggaattatgtgatgcttctgcaactgatgtcaaggtatttcatctcatcttgtctgcaaatagtctggtattatctcagactataattataaaagctatcataattgttcaaggaatcggtaaagataaaattcctttcataacacttaagattggtaagaggaatttggatttcatgacattttcagaaaatgatataacaggttgagtgcaattgtcaaatatagtttcacttctttgtttccccatacagttgttccccacaaacaacttctttgtttcaccatacaggagacacagatagacatagtgttatataggatattcaaaattgaaatgtcccatttttttttcctagttacattatattatatacctactcttgtgtgcatgtgtgtgctaagtttcttcagttgtgtccaattcttgtgtcccaccactggagtgggttaccatgccctccttcaggggatctttctgaaccagtgtcgaacccacgtctttatgtctcctgcattggcagtcagattctttaccacttgtgccacctgggaagccccatacctacccttactatctcttttaccagttggcagaagtagacatagactataaggtttatcaatag

SEQ ID NO: 58071 - DNA, 1576 bp, Bovine  19866880385366
tctttgtctttcttaagaattattgttctgcaaaaagagtgatagaatagggctatttttattgcaaaacaagactgaaatatatcttacatgttcagtcttattttttttttaaagaatatcaactcttttcctattactcaaacctaaagctttatctcagctttgagggaatgtcaaagtatgtgatttggtttctaaactcaagacaggttctggttgagatgcagtggctagcttctccatgcccagacagtgaaggacattgtgcaagcagcaaatagctataagcactttcttgttcaatcttccaaaagcatcacatactttgcctctggttccaaatggtaactctggagccaaaattaacgtttttttgtttgtttgtttgttttgtttttaacccccaatgaagagaattaaatccagtggctatccacctagcctcttcacacacactttattatagaatctcaagctttgaactgtcaagagtttatctctaggctagagacttgagatacatatttttaactcaatggcttatgcatgtttctctgaagaagaaagcatgccgttctttagcttgtattaaaattatttttatttttaagagagagaagacatgtattctgattggaaaatataaaatggaaatgatatttttattgaatttcaagattcctttagcattgggcaattatttaaataattgctttgtgtaactgtgtatctgtcatctttctgccataatagtttataagttccaagtcaatctgcttgttcattctccattgaatccctaccctctaaacacagtgcctggacccataagaggagatccttaaatactttttattaaaggataaattaataaaataaatgaacaagatatattttcagcttttaagtggtggtttctcccagaaatcaatgccatggagacatttaaatgtatagattcagtaagcaggatttcagctattgggagagacaccctagatatctgcagccaatcaaaataagagaagttaaagtaatagcaatattcttaaattttaaaacacagagttgtatttttggatacagaaaataccagtataagaatgaaatagtcaatagaataaatattgtgatatatatggattgtgattgtgggttttacatgtgtcaattgtacatatacatttgaaaattccagattaacattttttggaactcagaatggggcaggaccagctttgctgcaccagttttcatatgctctaaagaaatacaactaatcgttaaaagttagcccaagcaagagaaaattaggaaggcagttctaagataagatagtcttaaaaatatgtgtttcttagtttccttccaatttttatttatctggacttgactgtttatgttaagctctcacccttcactgtaaagttcccaatgagctcagagttggaataggtagtttcttaccagagatcatggataggagatgggtacttctaaaaacagtagagagaactgagataaaaattaaacaaaaagtcaatttctcagaaggagaaaagagaacccaaga

SEQ ID NO: 58072 - DNA, 752 bp, Bovine  19866880431392
tctacttcccattgccatttcctcaaaacctgttcctcttctgtaaagatatataaaatcaggagaattataccatctcaggcttattttattcccacttcttatttttgttctacaagcttagccatcctgaaaaccctaatggaatctttttttttttccccaaaaatatgaaaagcagaagcgagaaactttacatacttttcaccaagttcaaataatattaaacctctaaacttttgaagcatacaagtaagttaacatcaggattaaaaaatatgctttttggatatgcacttttttttccctcagatgaagtgtaataaataaaccatgtcagatataataggattcagttgaatagtatttcttcaaagagcaagtaaagatggtttttaaattagaattaaatgcatctaattatcagctattatagtgcttaatttggggccagttttaaggaacaggcagtcatttataacacatgtttttaaacaaattgtagaggaatagaaatcactaaattattaacaattctttctagtcttcgaaagatttctaagtgtggcagtagtccctggattttcaatgcctctggatcctggaataaaacaaaatggatgccttggaaaaacctgctatttgttcccttttatcatggcattgtatttaataagcctttagttgaaaacacataatgggggagaaatctgttctgaaatttaaattaatgaagcttttcacagtggctt

SEQ ID NO: 58073 - DNA, 2145 bp, Bovine  19866880436499
atactaaattacctaatgtcagtgggtgtacattaaaaacaatttgtcccctaccagaggacacttggcaatgtctagagacattttttggttgtcacaaggaagtgggtactactggtatataggggacacctgtaaacatcctacaatacacagaacaagcccccaggacaaagtgctaactggctcaaaatgtcaatcatgccaagcttcagaaaccctcccctaaacttttcaccttgaccctaattttccatgaattctcagctcaaaaagaagcacttttccgtggaaaataaaatgttgcatcctggtactgactgcctctcttcctcagtgccacttgatgggtaaagcatttacactagtaaatgtgaattcagaataaaacaagggcaagttatcatttcaagataaaatgactaagatgaaacttcaatagccctaagtgttttattgctttttttactttctctgacaataaacatcatatttacgcttactttctgttttgctaggtgtgaagatagaattctaatgagccatcaaatatcataaaaaaggagtgcgaacaagctcttggctcaaaggtccactgcctgctcatataaggtccccaattcactctggcagtctctataaaacaaatgagctgtagagaaatgctttttgctggcagtatacctataatgtaaaatattttttcaccatgagaaaagtaaatcacacacatagacacacacacacacacatacctataacaaaatatttttcaccaggagaaaaataaatcacacacacacatacatacaagagcaaaactcttattctattggctaaaaaggcaaaatagacacagttcaaagtatgcaagtaatatatttcactgctaaattatttcaagaaaataaatcctgagaacagaaagtgaaatatacaagacttaacacttctaaatgtcaatgaatgatactagttgaaaaaccagcctctcaatatacatcaagaccagttacctggctacaacctacctatgtacatacttatctttttaaaaaaaccgcttcaaaccgaaggatgtgttggaagatattctacttgttaaactatttccatttggccttaggagtgaaatgctgttagtctatcattaaatttttaaaagcttaaaggaaaaggcagaatttaaactcttaagaatttagagtctttgtttttcttttatcaccagccttaaataaaaattcacaaggagaaaggtgccaagacatatttgccattctggatacatttgaaaaaaaaaaatatttagggaaagttttaccaaaccagcatttacagactttacgttttatatttaaatatatttcaaaaaaattttacaggtcacttcatggttaacaaacacggacacaaaatagcaacagaaaatataaattcgaaattttataaaattaatcaagaatataaggaaaagggtaaattaagaataatgtttcttattaaaaataagaaacaagggtgaaataaacacaacatacagttctagggattttagaaatgacccatataattgatttctgttcatttagtaatattttttaaagttgctgaagaattcacacatgcaacagagaaagattaagatgctatcttttggattccgaaagggcgtaagattcaattagactaacattcatgtaccctaactcttttacaagccactagaaatttgggcaaagtctgcataaatttcaataagtgagtaccaaatatgaacttagcacatcccataatcagctaaaatatcccagtctctaaatttagtaagactctagcctttgtctttacattgccttactgaaaaaaataacccagtcctgttaataagcgaataattccctttacctcttctatgccatgctcctcagtgtgtgactctgaggagtcacatatatattacaccaaaacagatctattttctcaggttcagatccattcattcaactgcccgttgggcatttataagaccacaaggtacctcaattcttattcttgctatctctctctacttcattctacgtatatgaatatactgacagccttctatgttcactacctccatgcaagtccaagatactataa

SEQ ID NO: 58074 - DNA, 1340 bp, Bovine  19866880444230
gaattcacagtttctaccatctgcttctgtcttctgcatataaaaacataatcaagtctggttgtttgggggtgtgtgtgtatgtgcacacatgcatgcctgttctctgtgtttgtgtgactgcatgtatttaattctagaggaggaggaaaagataaagttaaaagaatctattctatattactataactcaatatcaaaaatatggaatgaaaaatctatttttcatgtattcactatcatatactgaatatattttgaaatggtattccaaaagtaagcatttgacatcggttctttttccacttgttaactctatcttaaaactttattccctaaatacagtagtatgtttcttctaggatcatccctttaaaaagtccaatacttctagggatgcttaaagagttttattatgttgtgcctctaattttctcccatcttatgctccagccttcttcttagttcgattgtagaccacatcccaatatctttgtcactactccaacagattacctttaaataacttaattattctccatctatgctctcttctgtatctcagggctagaagcctagtaactctgtatcccagaattcctgagaacaaggcttctagattcagttttaccagtgaaagatactcatgagaattctagcaagtagaagacaagaagaagcctctgttgcaagaagcagcagcaggcataagggctttgcagaccaaagacaagggtttccccagcacattctgattacctgagtcagctttctctggccttcactctgcagcccttcctattctcccatatttaatgattttctacatgaactacttggaactattaacagtttttgtttctctgatggatactgaattctacaaatgtcccagaagaagcagactttgaaatctataatgattttatcatatgaataattgacaaatcttcaccttgtttctgatgagtactcaaaggcaaaagatcaaagttgtgatatcacaaaaggtgctgaattaggcaatttttatttattttttacctaataggagtctaaggaaaattctaatcctgtatatatctttttcatgtagaacttcatcaatatgtttaagtattaattcttgttatgatttactgaaacaagatatgaagaaaaactgaaaacaatatggatatcgggaatatataattcagtcctatttataattgatgatgcactaatgaacagtgctaatcctttcgtgttgcttttatataagaaatgaatcaccagtccaggttcaatgcaggataaaggaggcttggagctggtgcactgggatgacctggagggat

SEQ ID NO: 58075 - DNA, 1299 bp, Bovine  19866880448372
tgaggtttacacaggggcatgttcaataactattcatcaacgtttgttactacaaaaccatgtcgattcatacaaaggaaaccagctagacatttagccacaaaccaaataatagtgttgtatttactattaaaataaataaattgtaaactaaacaatagcattccaattatgcaacagtgatactgttattaagtagaggaattcactattagtctgaaatttagttgagaatatcatttaatctaatctctccctagtaataccattatttcagtaggaaacaatggctttcattttgatcacttgtatcacagcaaatagaaaatccctcaaaatgataaatcttattgctcttttaaattatctaccatctttagtggaaaggcagttaatacatatcaactcatattttccctcattattaccacacatttcttctcaatcacatatttgtaaagctaaaaccctcttccaaattgatatcagtcttggaatgcatgggtatctcaaaacctccacattgccttaatgttaattgagaaagtaggtgtttacactgatctcctaatgttaaagcacaagctatgattgcggcaacaaacacagagtgtctctatattcatttctcagtcaaaaaaaaaaatcttatcgcttattttcatttatttttagtgtagagcaagcttccaagttagaatgctcattaatatttaataccttatggaaatatatttgtttatggtgatcacgcatttccatttttgttgttgcaaaatgtttaccagtttgtatgagatattatttatgtttccatatttgggttgttaggaattctcccaatcagacataagcataaacaaccaccttgatttcacaattatctcatttgttctgagtagtagaaaggggcagaagttaaaatccttcacacagtactgtagcctaaaattggtagattcccttaggtgactggagaggaattaatcctagtttccacctttctaaaaaaaaaaaaaaagtactagattcttctgacaaatgttgaaagtgtcaatcacttagtactgtctgattctttgtgaccccatggactgtagcctgccattaccttcttcaagggatcttccagattcagtgatctaaccagcgtttcctgcttagacagcggatatttttactgtctgaaccacaggggaagcccctacaaatattaaattgcctcaaatttatttcaataggaatcattttacatcttacctacaaacaaaaaaagaaataacataaaaacacctcatc

SEQ ID NO: 58076 - DNA, 1479 bp, Bovine  19866880452939
actgggatactggtgggctcagcccgccgggcacagcccctcccgatggggatgctgcgcagtgaggtgtgtttctgcctttgcttcgtcctcttgccgggggagcccgatcctgggggcggggacctaacgcgaagtgcttctaacttgtcaccaccccaccctcccccatgagagagaggggaggtggatatagaaaaagaggaagaggagagagcgggagagggagagagagagaggaaaaaaaagaaagagagaaacacgtagcctactgagcatgcccaggcccctgctagacccacggaaagctgtgtggagattccacttctccggggtttagtcgtgattgggcaacggtatctgagagggttggttccagggccaaaaggaaggggccaaggagtccgtgattaagatgagctctcgctttacttgtgcactttgatctcttgcttggaaccctagaaaagctgcagctcttcgaggaatgcagagacaggcaaggttcacacagtcgctggcattcccccagatccacggtccctgccccaccccttacagtggccccgggatgggtgatcacttcagatcttcacgatctgcccaagctttgccaaaaagatgcaaaagggacccacccagttaacgtgccagtttaagagcccagactcatctattggacaaggtactttggtggtaacgtctcctcatcccttctcctcccccagctttctgtgctctgccctggcatggacatccggagctgaaccaagttctgttcctgtttaactcttcgctctatctcctccttccttttgcagctggtaaaacctggaggaagtgaaacttgatacaaggcactgaccatatcactgggcatgcccagtaggcattgctgagtttggtgacaaaggagttaaatctaaaggaagcttgcaaaaataggtggtagagaagtctgaggtgtgtggcttaattatagtttgagtcctatggacatttaaatttctaaccctattatattcctagtctgggttagttttagagcataaaaagcagacatatttatttcagtaccacaagcctaatagcttcagccttaaatattgttaaggtaagactattttctgcatttcggccctatatagcaaaactgtaagaagtagacaaatttaggagtactaaaataatatacattcctaatctgatatccatttcctgccaaagaaaccagaactcattccttttgataagcctatttatactttcactgcttgtctaagagtctaaataacttggagacaggaataaattatattatttttattgggttcagaaaggcagtgtggtcaagtaattaaatgtgtgggaactagaatcaggttatctgggcttgaatttcatctctgccatgtagcagctgtgacccttaagtaaaatgcttaatcttgcaatgcctcagtcacatcatctgtaaaa

SEQ ID NO: 58077 - DNA, 2063 bp, Bovine  19866880463169
atgccagtgttgtcttcacttcaagttctatttctgctcctttgtttagttttctaagacacctcgtaggatatcttcaagattgctgcaagccatttgatttatggttgcttttctcatgacataagcagtagcctgggaaacattcctgttctgtcaacataaagctctttgcttcattctgtgagatcaggcacaccaagggcactgaaatgtgtgaagtgcaacatctaggtaagagccctacatttaatatagggagattttacatcattttcccaaagcattcataatatactagacatgggacaccatttgacctatagcttgctttctagtatgaatttcactcatcactatagagtttcttttaatattaagagcaaactgcagggctctggttcttgggaaacagagatgtgctatttttgaactaaggcaatgaaaaaggataatattgttacttaatgtgttttggttgcattacttatattttagatcttattgaatgtttgttcacaagttaaggtctatccaggtattgtgaaagaggaccaaacacaatacagccttttttcccccagaaataagaactagttcaattacataggattctctgacaagagatattctagcatttttctgaacaggcttatgcatgatttgatatgcaagaagatgggctccgaggatcctttcagatacaaatggtgcaattctgtataggcctattgattatgtgaataaaatattatgaaaataatgttttactttgaagattaattaagtcagtttttaaatatatgtttcaatgaaatttcagtctctgttaagatcttcctctctctctttctgtcctctcctatacacatacaccacactacatcacacacacacacacacagacacacacacacacactctctcacatactgctttaaaaatagccatgacatttattttagtcatgtttttactgtataatttattaagggatcaaaaattttacattatttataccatttcctttgaaatatcagaaaagttaagtataaacattttaaatatttaataatatgtaaacagaattcagattaaatatcttgggtaaaaaagagacaagaaacaaagatgatacagtacctgaaatattcttctcacaaagtgttactctgttgtagtatatcaagtacaagccctgtaaagattttgattattaccttacccctttcatcctaatcaaataacaagttgaaaagcatacatcattctaatgggaattcaaaaaaaaatatgtcaatagatcttttataattaccactgcctttgttgtcacattgtctgacacacctgtacactggggactcaattctgtcctgatctgtgtacacaacatacataatgactcagagtgcacttgctttaaatgatgaggaagtttcaaaatgtaacctgctcatcataaaggaaggaacaggcttttcaacaaagatgaagtcggacggttgtaaatagagtcaaagtaaatatctgtaacttgattgtacaagaaagaagtaaaaagatgtcaattcgtcttctaatgcaacataattctaagaattcagccccatacacattctgattatatgacataattctaagaattctcttccatgaacctgctcaatctatgatataaaaccagagtgcatcaagatagtcttttcagaatttttctgaaactgtctctcccttcaagataaataactgaatcaaataaacagtgtccactttattcccatagaaatgctgctagctaaataagggggacacaaaacaagattttaatttggtacttgaccttaaaaaataataaatttgagaaaataatggttatcttttttatttgaccttttgcagatctccattagattattaagagtaacataaatgtttatacaaagacattcaattcactacaattgatttaaatttgatgtcagataataaatcttagtatggcttttttttttctcctatgaaagagtatcagtcctcttgacacttgtctattagaatat

SEQ ID NO: 58078 - DNA, 1443 bp, Bovine  19866880608650
taggactttgcataaagctggagaggttcaaggaccacaactctggcattcacacttgggaacccaggcttacttagggagttttgcatgtgaacagctcagttgtgttagtttctcagcatggatttttcatatgctctttgtaccagcagaggcaaatctcaaccaaactacttacatgccttgttcagttgctaagtcatgtcctagtctttgtgatcccatggactctaacccaccggactcctttgtccgtggggcttttcagacaagaatactgaggtgggttgccattttcttctccaggggatcttcccagatgagatattgaacccatgcctcccgcattggcaggtggattctttaccactgagccacctaggaagccctacttacatgactacaacttctttttgtcttctttcccctcagaggagattccttttctctaccctttgttagtcggttgtaagctactgttacaaaagattccaacattttactactttcacatgagaaaggttcacttcttacttatgtcatagttctatgtaggctgatgtgtaggagggaaagatagatggattttgatcacaaaggcatctaagtaccctagtttcttccttcttgcagctctataccactgtagatcctcagggtctttctcattaaggctacagatgagaaaggagtgtaagatttggtactgtagatttttatggatcaggccgtatgtcacaccccaaagcagtaagattgttatatacaaccaaaatagttttgttttgtattttgcccaatgccagccatgtatgattatccatataaaacaaattgctgtcacatttgctcattgcaattttctatttattgcatttagccataattcctcatctaattggtaatgataacatttattgagtgaaaacctatgcctggcacttttctaagcactttatataaatttatctcatataacctttataatgaatctaatgcggttcagtttaattttaaataggaaagtgaggtacaaagaagttaaatcactcatgcaacagcatacaatggtcatgtgtggtagaactgccaaacatctaagactgtgctttaaatatatacccactctagttggatactgtgcattcctattaaagttacataaagtacaacaaacaagacttatggatcagagacagagaaaagattatcacttgagcaataatgtcatcagagtatcaccatttttacacttccttgagctctaaatcccatagggctgtgtgaagagggccagatggtccctgtacttgcaatgggttgcattataggagataaaaccctgagcttaggaaatttgactctttttaaatgagtagacagaaaccatgcctgcctgtcctttgctatcaagcaagacactatatcatccaaggccatcca

SEQ ID NO: 58079 - DNA, 1114 bp, Bovine  19866880629619
tttttctttatccaacaagtattaagtgctttgcatatgcctgaatcataggcctaagtgatacaacggtgagtaaactcttagaaatagttcctactttcataggaaggtaaaagcctcacattccagtgaggaggctcagtaattaaaaaagtaaatacatgaaaactttaaacaatagtatatattttgaaggacaagtacgttgtactatgagaacttaaaattgtatgaactgaattaatcaaaaaaagttttcctgaggggtgatacttaaacaaaaatctgagagataaggaattagccaggtaaagacacaggagaaatgttaagtcacagcctggtgtaggagctgacatggcacattcaggaaactaagggaaggcccttgaatatggaactcttagtgcagtagggccaggtcctgtaaggccttccaacacagtgttgagaattttagtctttattgaaaaaatgatggaaaaacaatggaaggagtttagtgtggaaggtaagggggaggacatcattatcaaatttacatttcagaatgatcactctgactatagtgtagagaacagattgataggaggccagagaaaagcattattttctgtttgtcactcaacaacatttgttaagcacacacaaatgttttgagtgtctacatgcacacgcaaactgtagactgaaccaggggatagagagggaagcaagattctttttctgaggaagttagaattttttgtaagtttggttctgtatagaactctgaggccacttgtttggaacacttttggttctacctgtaaaatgcattatctgaaccctttatgtggattattatgtgatttctttcagatatgcccattgaatctgtaggcttctggaccccattgatagtgccctatttaactatatgcccaaggaccttgctcaatatgccttccttgtgatatatatatgtagatagatagatagattttaggctttcagtattttaactgctccaataaagggaaatactacatagatataatcttcataaggataaaaaaattaagtagttactatatagggtaagtactggacaaaaataattcaaagattttgc

SEQ ID NO: 58080 - DNA, 2141 bp, Bovine  19866880650019
cccctgaagaagggaagggctaccaactccaatattctggcctggagaattccatgggctgtatagtccctggggtcactaagagtcggacatgactgagcaactttcactttcacttttccttaactgcctatctcacatggcaaatctgtgagcctctactccacagctgaggatagggacagtattctccttttccttggatgataccatcccattatgagggtattgagtgagtatagtagacttctcagcttacatctctgaatatggaacttttgcccaataaatgagttgaggaaaggccaataaagaccagaaaaatctcagcctagagtaaatcctctgctcagtggaaagggtgggttgaggaaggaagcccctaagttgtttcaacactcaccaggagtttagcctctgctgtttgggggtggagtggagaagaaaaattcaagtggcctgccccttatgttgaaataccatatctttgactgagaggtaaagggagagggaaaccctattttactggttgtactgcctagattgatgtttctattatcatacttttttttttttttttttttaacagtcaagccttattactttaatagagataaacatgcatatcagtggtcagggcatgaaactgagaaagtaagcccagattctaggctgctgataagcctaaaaatgttgatgagagaaacttgtcagagggaccaggcatgttgggggctgtgctcaccacagaagggtagggagaataggggaatgagggaacaggtcatagtcaagtgccatagacttgcagtgttcttaccaaaatttagtaaattttctaaaataaatgcttcttaattttctctgtgtcattagaataattttcagagtctttgaattgttatctttcttaaactttttaccacttgtcaccagtgtttccctgggactgggtctgcagagatactcaagtttctaccatcccaaacatctaaatttgataagagcattcttaatacagccattggagcagattcagattcttgagagatagttgagatatcaagtttatcaacccacaagaactgagccaatcaaagcaaattattttataggttctcaaaaattcaaaaataaatcttgttcagtccaatagttaatttttttgtgagtcaattttgaacacctccaagcatatttatttggcttaaaattgttgatattaaccatatccttccctacatgctaattttctttaataaattatggtctataaaatttatgaatttagtctaaattatcaacaaaacagaaatcatgtatgtggtatataacatactatttgtagactggaaaatacagaactcctgcattagtctttgtcctacccctatgatctaagtgactttgaatgattattctttcaagttatacccttatctggaacttgagatttgcctagatgatctccaggtcagttggaactttaacagtctttgattctggaagataatagcctgacattcaaatagaaatattaaggagagagttggagataagggattagaagcttactgagagttcagaagtagagctttatattaaagactgattgttattgatttttttaagaggaaacaagaatagatttgctttttgtagaaagacaaatggaaaaaagaaaatcatcagaaagacagacacaagtacaatgaaaaatcaggacactttaaaagtctttgaacttaaagatagtttcaagaaggaaaactgttcaaaatggtcatgagacaatccacagcatatttagaaaaaaggacttttgatctaacagttttgcaaagcatatagcagttttgagagtggggagagaagtagtaagtttgtcagaaataaaggaaaaactaaataaagaagaaactaaaactttgattatataagaaaaaggagtgataagactgtcctggagctttgattacatatacattcgcaagcagctagtaactatggcaccccactccagtactctcttgcctggcaaatcccatggacggcggagcctggtaggctgcagtccatggcgtcactaggagtcggacatgactgagcgacttcctttccttttccttccatgcattgga

SEQ ID NO: 58081 - DNA, 4461 bp, Bovine  19866880749163
tgcttgtgtgacctcggacaccacccctgccaatctctgtttctcatcttttaataagggcagtgcctcgctgatgatgttgtttttgaaattaagtggaataatacttgtgaaatctttaatatcatgaatggtgcataatgggtacaattaaaaataaaaggctgtttgtggccattgcagaggcagtggtgcccagcagcagcccagacacagctgatgatatgtaggaaacagactctttgggctcagacccttagctgtgagccatgggtgcttcagttttgtcttctgtaaaacagtgctagtaatttgtctgcctgatagagttgttcataggattaaatgaagtaatgtgtataaaagaattagaaggttagtacataaaaggattggtgttattgttattgttgtttagttgctaaattgtttctgactttcttgcgacccatgggctgtagcccaccaaactcctttgtccatggtgtttcccaggtaagaatactgaagtggcttgccatttccttctccaggggaacttcccgacccagagatcaaacccttgtctcccgccttggcaggcagattctttaccactgagcctcgagggaagccccattgatattattactggtattttattattattattattattaccctgtgtggaaaagctcattcatggataatgaagtatagaaaattaccaaagaaaactgaatcttgacatgcctcaagaagagttattgaagtctgttagaaagaaaagactagatgtgttagctgtggcttcattggctttgaaatcggaatcatacctggaatatcgccatatagattggcttggggtgagatgaaatggacttgaaagaggaccagggaaggaggtgggaaccctcaaaaatccagcagatatagttgattatctgtgatgtgccccaaaacaagagaaaataaaaagggaggcatctatttcctccatacattcacaaagagatctataggaattgggggaacattttccccaaatgtgaatgttcttggctcccttcctgttctcccatttgcctggtcctccccactcctgtcccaacaatcaagaatataccaagtaaactctaaatggcagggaagaaattcttccgaagacaaagctagaggccaagggcctgtatacaaagccacttctgagctgtggtcatcttttttctgatccctgtgaaacctaaatgatctattgcataccttcttgtgctagtctttgtctcaatcaactttgaacacagagcatgtgagagtagtctgtgagtggggttcatttgtatactttaacacacttcctggaattcactctctttgctttaaacagaaatgtgagcagactgcagctaccctgaatgggttaaggaagctaactggagtgttcagcggttccccatacctgctttttttttttttaattctgctttcaacccactgccttcatctatcttccccaacagggtattgatcagctcttgaaattgtctttctcacttctagacactctctgcagatactgtaggagtgaaggagaatatggttctgcccttgaaatgcagttagtttagaactgagctttaagagcctctgataagggagatgatgcataggaatgctctagtggccatcgaggcctcagtcaacaacaaaaaggaaagccaacccccagtctctgagtggactgtttcaaaaatgcctttgtgaactagttgcttgaaactcagacatcactgcttcattgatacagtgaattcccagaagtctccttaacccttaacatccctgaggcaggtagtattgtacaaccaccattgttaaaactctgtcaaactaacaaagtcaaattataactttggatgccaagataacatgatgtagtcagaagttgcatgggactctagggtccagtcgctgttgcttactcttgtgatctgagcaggaggaagctgaactagagggttccaatgatagtgagaggagaggatcctataatcttgcctatgtgcttcttagttgtcaccgtctctctcaccaccatctgttaacccttcggtgagtaaagaatgacaggctatgccaagacagaaagaataaggccatgttcaagttagatttgaattccttaatgtaaagaaaaagtaaagaaaaggaaatgaaagaaatggaaggcattcaatagaaatgggttctgtagaggaaaaagttaaggcagttcctttcagctcccagaggggcatccataaacgtaaaaatatctatcattgactgagggctaaccgtggaccacatactatgctggcccttcacttgcattatctaattgaatcctaccaataacaatttcatggagaggccattatcagcttcattttatggatgagtaacagtgatttagagggattaagtatcttgcccaaagttgcagaactaacaagtgatgcagccaggatgccatcatgccggttggattctgaagcctgtctaattaatcatgatgctccatgccttccagccacatattcaactgaggaatgcctgtgcgtagttgcctttcgttgagaggacaggatgtgaaacacaaagcagtgaatagagaaatgtcggatgattcagtcagaaaactatgatttagttaaaatcttttgatttgaggaaaacttctttgtaatgtttttattgcagtaattttgatagcaagttaattttatcctgtactactccatgttgcctttaactttctatgataagtatatatttattttgtaagaaaagaacagcattttttcagtttcataactataattatatcattaagaatatgtattcataatctaaagaggtaaaacctctctacctagatttttctctagagacattttttaactaatctggacctcaatttgttcatctataagatggggaaacaagtttacaagattaatagaaatgtatagaaagcgctgagcatagtgctttagccttaatagattctcaagaaataagatctgtgattattaataatgtcttctagtattattatgattgttattattattataaataaatcattccctaatatagcttaccatttagtcctctttggggaaatgatcacctttgagaaagatctccaaggcccctctactcttacatgccctttatattgtgttccttccagattggagatttcctgtttttacaaatattattcctctgattcattattaaaatgttattgtgttttaatcaaaatactagaaactaactttcatagcatttatattttttctcttttcattaaaaaaaatttactgctattacatagttttctgactataaagacatactttgtaagtactactttttaaattgtgtggcttaggtcttgactggttatagaagtgttctcaaaagatgtgtaaactgaaataacatgtggaagaaaaggctcagtgtgagtgagaattccaatccctcacagctgtgtatttataaagactcctgttttgcgttgactctgatttcaggacaatattgagtaaaattaggtcaaagactggtgagtatatggtgattctgttagggagaaaattgtttccatgtatccacattctctcacaaaggtgtaattctctgaaaatttgctattaaaccatttgttattgaataacattcagtttaaagcagttatttctcattctcgtccaaggtagattcttatttaataccaaaaggaattttagagttttcttaatcaataaagaaacaatgcaaatgatgagactctaatgagcattttaaaaatcatgttacagttgaatcagacagttcaatttcttttttttttaatatcttcattacttgttgaattaactgatatgcttttatctttcatctgcagtttgcctttttcattgagtttctggaaaaagtaattgatatgaaaagtgcttagcattaagtctcctatgtatttcatgctcattaaattctaatcattaaaatgctcccctctttcttcaaactttcccccaacttttctttcccatttctcagctaacataaacaattgagccaagaaattatctcatttgaaatattttctgacaaaaataggtgaccagtttcctagatttagtttccctcctccattggcaactccttattaattctgtaaatagagtatgcatgttttttctttttttttttaatttcagtgacctcaagcacaaaactcgctaaattcctggaaggaaaccaggacatttatacttaaactgtatgaagtgaaatcgttcaattgtgtcctactctttgcgactctaaattgtataaagagcaacaaaaacatcaggtagagactgacttaaactcaagttcaaatagctaatcacctcactaatgcaaaaataaaaacaa

SEQ ID NO: 58082 - DNA, 1165 bp, Bovine  19866880794628
attgacacactatcatccacctagtcaagagactattgacacactatcatccacctagtcatgtctgaagggcatgtcctcagaactattctgaggtttagatacctatgcagatttttcagaatttatatatttaggttctaatttctatcccacattttacccactaggaagaattttaaatcttcttttttgtgtccctaattggcacctttgcaagtttatatctatctacacctcctgagagttgtagaatttgtttgatttgattttttaaaagcacccagaagcctcatcatagcacagatccccttttcagcacacagctttgaagcccatactgctttctttaaatctctcaactatggattaaaaaataaaaataaaatataagttgctttcttttgacacctttcataacacctgggtctgatttctaaaatgttagttctagcaaaaataggttatctctgggacccacctttgaacaaagaccgactgtagaagagaaacaactgtgggaggaatgtgacatattccccgaagaaaaggtttatagtttatatatatataaaacagatcattccttgtattctcgggaagcatgtcaagtggatgaggaaataggaatcgatggaagaaactactgggggacaaattgcaattcaatataaaggttgactcttgaaaatgattgtcccagttgtcaaagatggcataaactttgtcggaaagtagacagctccctgccactggaacatttgaattatcacaagcagacttcaagcaccagattaggctagtaaaagattttttaaggtccctttcaactctcaaattttgtctttagtgttttgggattttttccccccaattgttcttctccatttaaggttttaataaacattaacaaacaacaaaaactgcatttctttttcttctctatttaacgtttcttcttccccaaccttttattctccatgtccttataacgtaatctgggaaatttcattcaaactaaagaactggtaatttaatatattacctttctcagaaatatttgcaactcagaagcatataggggaagaggataatgcttgactaaatgaaataagtggctaacagtgaaaactagatagtaaaaacatgccaagaaaatctttca

SEQ ID NO: 58083 - DNA, 737 bp, Bovine  19866880845647
ttatttatcatctgctttatcacctgaaaatccccaaaacaaccagggttttgtctttacatggctcagcatctacagtagtactcaggatatagtaagagctaagaaaatattttttgaaagaatgaactgtcattcaataaccatacactttgaagttgctaatattattcctactaacaatacaaataagacaaaaagagtaaagtgcaaagggataatgcaaccattttagaaatagataaaaggatccaggaaatggggctctgtgggtaaaggactagatgcctagttcaggattgaaacaatgaggaaagaagtaaaaataaaagagattagctatttttgcttgttaatttcccatttaattttaatactacaaataaataccttggaaaaaagctgtaccttgattctgcaaactcaatgtgctttgctaatttcaagtcaaaaagtaaagactaaaagcaatggtcattatttacaaagaatgagaagtgatcgaaaatatataatggtcactgcttaattactcctctattcttctgtttccatatctgacacatgcctagcttctgatacatgttagaccaggcacaaattataatttgaatgtagggtatagaattggaacttgcaaggatgcaagagctaacagcccaaagaacactggaaagtgtgatgagagctaaagaggattataatgcctttccggatttggtggatgaataggtttt

SEQ ID NO: 58084 - DNA, 1398 bp, Bovine  19866880874964
gattttccaggcaagagtactggagtggggtgccattgccttctccaagtcttccccctccttctatctaaaccatgtggataagttttccaaaatatttgccatgagaacctggtggtcctcctgaaagtaaaattcaccagcatgtgaatatgcctccaagtctggggctctaaattttacctatcaagcaaatttacactgatcctccagaaactcatcaattactgttttactgtgtctatgggtagcctcttctcctggtaaattgtgattctgtgtatttacttgcgtctctggtgtttgcaataatggttggccctgtgacctcaattctttagttcatgtgagaagagttgctgattttacattcagtgttttttttgttgttgttttttttcttcttatttttgagcgagaatgacaactttcaagcaccttataagttaaaatggaaattgaccaactacttaatttagtctttaaattatctcaattattagtgtttgccttattagatatgtatttgtacgttttttgtaccatcaaacagaagagaaaaaagataacctaattccttctttatcctaaacactctgtttccttactatgaaaatctaaaatcatgcacattttaatgttgaggcagcagcatgaaaagggggtaatgggcaactctgtatcacttcttaaaaatatgaactagcagatggcatttcctcttctgtgcatttcatcatttagcagaaaacaattaaaagcaaatgaatcttaaacaaatagttggcatgctcatttctgcaatagttatttttataagaatcagagcttgttgtaacatatttagaatataatttaatgttcaattggcatcttagttaaatctggtctattcatttttagaaaaattatgaaaacatcatattgatcttcagtaggtttagacataaccaatgaataaaatataacctttgggtttaatacatacagattgaaatatatggcttttaaaatgtctcgggccaagaggtataagtgaagctaatgaaagtgaaccattagggtacgtctctcaaaggccctcctcagttctaggaggagacttaatcatttgttcatatagtcacatgcttttgtagaatttatgataaaatatactttaaccacattaagactgctagcatttcacttttatttcctctcttccactctcttatttcatgtagaatagtagtgaagttgcaacaggcattttgtagatttagctaagggtaattgagttggggatacctttcatattgggttcagaaagatctagttatgtggtttgaactctgagacatgtctaggtaattgctgcccatcttattgtaacaagaaccttagaaatactcctat

SEQ ID NO: 58085 - DNA, 1485 bp, Bovine  19866880971806
cgttttccaaaagatatgattgtgtcctatttctctgaacacccaagctttattctgacatgtctttacatttgcctatttattgatacatatttttaaagtcctcgtctttaatgtgtttacttttcccttcatgtcttggaagacagcaactttaatagcttaataagtcattcaaataaatgcttatttatttgaatttgtgatgttttattcaaacaaattagctgttttatttacctctgtgtggtattgttaaaatacacagctgccttcgcttcagtgtgggatgctttagacacactgcctgtccaagtacatcgatattcttgtatatttgaagccttacacctcagtacacacttaacagcttccgaaaacaacattctattcatgtgggatgagtagggatattagctcttcacagcaattcagtctatgactacttatttaatacaatttacttgtgatctgtgtagctctgccttgttaaagaggtctcagtcctcttagaagccaggttgccattttaaaatacagcatctttgtgttttcagaatctctcagattacatggatatggcttgattgcttgctccttaagaaaagaagttattttctgttctgactaagtgactttttaaagtaaaatctcactttcaaagggacatatcattaaattattgctcacttccactctcaagggggtgggaagaaggataggaagggtttagggtgaaagcagaattatcagtgcctacaaattgagcctgtaaatggagaagacttctcatccatagctacagtcccagtagcataacaatataattagctttggagttttagtaattaccaaccgaattcccaagaaaaaaaaaaagtcttgaaattactgatgtgcaatcacaaagaaaattgtgaagtttcctgtttaaatttacttcagctcataaaaagaaatgttggccaaaaattttgtgatgaaagactaagcttaaaaaaaaaatctaatttcagaaatctttcagcagtatttttccatatcccaatagcctttcactatttgcagccacatttggaacactggggccattaaattaaactaaatctgcccaactctgtccattcccatgactcattttgacatgtgcgtctggactgagattcgacctcctgtctcctttatccttgtttctcacatttaccaacttaggcccaaacttcaaaatattccatcctgtactaaggagtgtggtaccagtatacatatttgcacatttatacacacactccatcagaatgaaattactaatcctcatattagtccttaacttgttaggtgaccatgattaaataacacaacatgtattgacctcaattttattttccaaactccaaggatatactccctgttttataaaatgtatttgataaattatattgtattattcataatattgatcgactctgtcagtaaattcaccca

SEQ ID NO: 58086 - DNA, 777 bp, Bovine  19866881002345
attagcacatttggaaatgttttgaagacctttatttggggttgcattcaggaagcagcccagacctgaaattgctgtggtggggtaattatttatcctagacatctcaaagactagaggtctttttgatagccatttcggaacagtcatctgaaaaatcaggttattctccttaaagatagttcattgttcttcctttgaatactttgaaaggaaaaatatgattgagagtcctatgttcttattataatattataagcccctttataaactatcttcccacatataatattctatgatattgacgatcagctctgtcacagagaaggaattcagaaatggttagtgaaagtggaatgagtgagattagtctgtacatcaaaactaagctcctctgtctagctttctaggctgtgtgtcaccttgactctgccttaatttgtctctaccacctgcctcctttctaccagggcaggcttatattttgcctcccaagtacctaaagtctaagcctgtgcttgtgctactttgctggtcatatatgagcatttacttcttatcttttcccccaaatcctcccaccttttaagaacctcttcagatcccacctcaagccacaaacggttttgggtgtgtgtgtaattttcccttccctaaaatcctacttagcctctgatttccataaatagaacaaaaaccttaggctgcaattgttaacataggtttctgaaaaatgaagcaaataacaaaaatataagtgacttacctcacagttat

SEQ ID NO: 58087 - DNA, 1696 bp, Bovine  19866881310034
ggagatccttctttgtgctcaggaatcttttatggtaatccctgatccattattttggaatatttatgattttttaaatgatgtatcaagcttttgagccaccaatagcaacttttccatttgactaaacatcccagcacaccaacaatggacagaaacactttttaccatccccttcaccccacagaaacacatataagtactcatgcaaatagacagaatttcatttaaaattatatgacaatccaagtaaagcccatgtttcatttttatgaaaccacacccacaagtccccaggtcacttttagttatggcgttgggagaagttttctgttgagattttacccctgccacattagaggcagaattcaatattctgcagccccaaaggccagtgttcaccaattctagtctcattcaagcaaactgtataacactctaatgccaggtctgaaagcacataactatctgctgtaatcaaaggtttaaatgaccatttatttcatcttgtatctgcctgaggaaatcctttaccagcctattttctccccttagagtaagaacatttgcatgcttgcagacaaaggtaacaatttcaaatgatatatattcttcaatggtgaatatttgctttttaaatacaaagagtagagatctagttattattatgggattttacatattgctcaaattaactgccaagaaaagcctctaagaaataaattgcctttatgtaatattacctttaatttcttctagcaaatgggataagaggtttaagtaggttaaaggaaatcaagtaaacatatttatggaatacaatttttcatggttaaaagcctaaaagcaaatatttcacagcttactaagaatgtaccagggaactaggagaggcttttgtaagacagagttgatttttagaatgacttacaggttacaacaaaaagctgctgatacattttaacaagcaggtctagggggcccagaccttgtttgctagcactggatgtttagcttctgcaaagtttttgtaaccattttggaaaccaaatactgtagaacaaaagctttccttccattcagtatccaactgcatctggtgttacaggagcatcagaagagcactttaaagggacaatatcaacacatttgagtttctactagagaacgatatgaaataaaatattttatagtatctaagtatcttaaaggtctgagttctaacccatatacacttacaaaagtcagaaaatcagggtgatgaaataagactgctggaggaatgggtcttgggcaactcaaatacattctgagtctggttgctctagttggtaaaaggggataataatgtgtctctactgcctctttggttcactataacaaaagcctgattgtgaaaatgctttaaattgtacacaatctacacaaatattagatgatactatcattttcatttttccctactaatactgcagcagattactgagtaggacctatatactgtgtttttaataacataactgggaaggagaaggtaggattgtaggcacctcttttttttttcacacttgatgagattctgaaatacaatcagtcaccaaactcctcagacacatttagcagcatcagaagcagctgctgctgacaatcatgtcttcttccacagggactggagggtgttaaaacaatgagtcat

SEQ ID NO: 58088 - DNA, 2118 bp, Bovine  19866881333491
cagggaagtagatcccacatgccactacaaagatcaaagatcccagctgccacaactaggacccagagcagccaaataaataaataaatatttttttaaaaaagagcctgcacactcggcatcacaaccaaaaaaaaaaagaagaaataaacaatattgatactgtatgttagttttgtaccttgctttccccactgaacatgatatgggcatttccctatcccattaaaaatttcagaaacaaaaacaacaaaccccctcgcaaacttccaggctttctgaatgaaagtcaaagtcctcagaatgccataagtatataatctgaccccactcttacatctgtgagttcatcttcagtggctcccactgtgctccagccataaccaccaacccactgattctttaacaacccaggcaattcccaagattgccacctttcactggttctttccactgtctggattattcttacagatattcatattgcttgccccctaacctcctaatctttgttccagtatcacccacacttggtcttaccttgccttgtttttaccttgccttgtttttctccttcagacttacacaattcctaatataatatataatcactgaagcttaaatacttgttgccttgtctcccatagtggaatgtgatttggggcagggatagttattattttgtttattcagtagcttccccagggcccagatggatgccacacttatgataggcagttcttaaatgattggtgttgctcctggtgctagaaggcaaatgtgtaaagcctttccttctggagaagtgctgggcatctctgcttcctactactggggctcagtctgaactggaggatagacataatgtagagttctgtgttctgccctcaaaaagggaaaaaaaaagaacggctttaaaaaaaacaaaacaaaaaacttttacacttgaaattctcatcttcctttaatcacaaggataatctgctgacccttacaacagctccaggctattattatccccaattgagagagaaagaggctgtagagtctattgaagccctcagtgacagaaccaggagtagtaaagcatgttattggatttcctcttctatacagtcacaatgaactgtagccacatctcagataacagtaaattggcaagtagacaggagtctccttctctaccctcaagacaggcttttaggctgtgtaattagcttgtgaagaaagacacaagcataactacattttccattgtaaggtactcagcaagtcttagtctttcacttctgttatttgttgccttttattgattcaatgtgcaactgcttagtctggatcttcattttacttaattttaccctataaattaaaacctatattagcatcccagggtccagaaatcattcacacctttgattcaacctcaaaatagcctggaggaaagagcaggtgggtatatcttcactttagaaggaagaatgacctaacttcttggtaatcctcaaaccaggacacaaacacagatcttttaagtataaaagcaaaagtcttaacttgctagaaatacattcactgtatttattttttagagagcacaagtatgaaataggaagaaaaattatctaaattattcttattgaaaatgtcttctaggacttccttggtggtccagcggttaagaatctgcctgccaacataggtggctggggattgctccctggttcaggaaaatcccacatgccatggggcaactaagcctatgccccacaagtactgaagcctgcacattctagagccctcattctgcaacaaaagaagccaccgcaatgagaagcctgcacaccacagctggagaatagcccccaccccactcactgcaggtagaaaaagtccacacgcagcaacgaagacctagcacagccaaattttatttttaaaaattaaatttaattttaaaaagaaaatgtcttctagaaatataaatgccacttttgcacttcacttgcattttctggtaattatcctggcagcatccttcacaaacattgactctttggaagttcctccctattcattttcctattggctctatgaaaaaggcaatggcaccccact

SEQ ID NO: 58089 - DNA, 640 bp, Bovine  19866881411519
ccctggaatggccttatgagacagatacctcatagtgatttgcttcagcaaaattcttacccatctggtgatctctagaatgcaaacgaaactggcacaagtgacagaaactcagttaacatagaataggccaatttccttcctgtcttaagcgcatacacttcctaatgatttgggatgcttttacgaacttccagccttcacatatccaacctctaacctcagtcctttagatctcaactacgttagccaaccaacactcccattttacttgcattcataactaccaatttatctacttaatagtactttttatagctgttttaaataatagtgtatttatttatagaatgtatgcctttgctactaggatgccaattaccaagaaagaaatcaccttcatatctacctagtagctaatatggtgccttactctttatagatactcagcaagcatagataaatgaataagtctcatcttttgactagtttgtgcagtttttacattaactgattttggaaagtcatctcctccagatttgcttgtagaatcctggtaattcttcttgtgccaatcaagccagttttccttgatctttctgtttaaagatacaatctctctgtgactctacctcagcat

SEQ ID NO: 58090 - DNA, 1293 bp, Bovine  19866881426316
tcttatgagattacgcctaccattttatatagcctcatcatgttgtggttagtatgatcatttgtattctcatgaatccatagtatagactaaccctttctctgcttataatttgcaccacaggcactgagtaaatcatattctaatgaattatttttaaaaactgttctaagattcttgtaatatattaaactatatgatgttagagttaacttgaaaagaaagaaacacaaaagctttggtagtgctttagcttgcaatttaagtgtttccaaggtatacctttgacatacatactctgtacaactgacccaggtattataactaaagtataaacttctcagtgtaatgtctgctaaaagcttagactgctcttttctagggcccaggaggcattaatttaaaagaggtgtcatttggaagaactaatatatatcttgtggcagtagaagtgtctgccacctcatggggttggggaaactcactttagttcagttcagttcagtcgctcagtcgtgtccgactctttgtgatccattgtgagaatttcacagaattagccaacattttgcagaccctttcataatgaaatctagaaagcaattacccattagcacatctgccctgatcatgagaaaagcacatctgccctggtcctgagaaaaaaaacaaacagttaacactaatgacttccctggtgcctcagatggtaaagcgtttgcctacaatacaggagacctgggttcagtccctggattgggaagatctcctggagaaggaaatggcaacccacttcagtagtcttgcctggaaaatcccatggatggaagagcctggtaggctacagtccatggggtcacagagtccggacacgagtgagcgacttcactttcactttcaacactaatgaaattataagcatcattagttattccttttggttttaatagccaagaagaagcgtgccatcaaccagtttaataaggggactcctctcgtgttggttttactcttattattattacttttcatatcagtgattgtttgcatcagctaccttcagcttccactgactgaaccatcagaggcaactgcatctcaaggtgttcagctgaatgtacaattagcttattgttaaaaacccgcagtacacagatcatatgttaatacaaagaaatctggatgtttctctcctaatgcccaccaggccttaaaggccagcatggagttcaggaaatttctaacaccattcctttctctcaaattaacttcagctctgaagtatccaagggg

SEQ ID NO: 58091 - DNA, 784 bp, Bovine  19866881499130
tgaaagaatgaatcctatgaataactgattttggtaatattgtcttttcattaaaaaacagaacaagtaaagtttttgaaagattattactccggccacttagcaatactttggtttggctcagaaaactcatactaaaaacaagcttgcctcctctaccatacaaaatcttaagctaaaaatcaccactgttgccagaaaaaaaaatattttctatgcctcccttttagataaaaatggccaagagacacaggtctggttaatgagatatataattcggcattttttggtgtccttcaagagggactgattgagctggcatgtgccttctaacttatgccctccccactttcctcactggaatacaaacatgatacctgcaggcaaaatagtcatgtcaagagtggggggagataaacatatgctgaatggtggagtagaaagtgcctggtgattgatggcatcatgaagccaccatgcctgttcctgaccctttttctctgaactttttattatattgaaaaacaaaataattcattcatttaagtcacaacttaatataattctgactgactcatcagcttttcaaagtcatttgaaattctttaaacagtatatttaatggtgaaaaccatgccctcagaaaattcatatatatatatatataaaaatattaaatctcatcatcatccacaggtagtttgatgtatagctatatgcatctttcttaggttagaaattttagttgtcaatgggagtgaaaccaggaacaatagaactcaag

SEQ ID NO: 58092 - DNA, 1000 bp, Bovine  19866881626519
gagcccggtggaagggcagatggttatagccgaagggagaaaatgtgccaagttcttggtacccatgggatatagagatggaaagtgaatggaatgctggctaggagagaagctggccccatgggattggaccaggcaacaggacctactctcccatatggtagccctacaatacgacatctgaaacaccatcctaaattgactctagaatattctacacaagggaaataccctcttttccctttttatcccctctagacaaagaaggtaagagagaaagaattctaaacaagaataggagtgatcctttcttttctctggtcacttgaactttgaagagctattgatgagcttctgattccatctactattgttggtaaatcaaaacagagaataaaaagataattttatgattaaaatatatgtttgtctatttgctcagaccccaatggagagtcatacttctgtcatttctttcattgtcaaaagacttaagttctggttcaatatgtctagtaatttaatcatgcctttgtttaaggagaaagatggttccatttgccttttatacaatttcagagttgggaaaaaccttacaggctatcaaatttaatatcttattcctatgtgcatactacctgtgtcagtatttgcttgacatttcgatttaaacaaactcatgttttacattttaatattattgtaaaagcaaagtaatgtcattaacataaataccgataaaaatcatttgcatgtatcacaaatacaaagcattcatttgagaaaacattcattgtaatatgacccagaacctactggcatttcatgttattctctgtctaatctgatctattgttcaactttcttgccatccaataagaatatcataaaacactttgtgaaatgctgtgtgaacaagcaggtatctgttaattgctaaactcttctcccagaaaggaaattccagagtcgattggttgttcaggtaacccacccctca

SEQ ID NO: 58093 - DNA, 1235 bp, Bovine  19866881760545
agttgtttgttatacctgtaatgcattactttcttgaatgtctgacttattatgggttattgagcacatttctgtgaacaatggaaacggcaaactatttcatttccagcactaaaccagtcaacgtcattagacaaaaaaaaaagaaaaactataaaagtcaataatcagtgtgcacttgaacatgagcagtgttgagcctaacaggctcccagagactcctacgagtttgtcattttaattatttgcatattaagaactctgcaggcaggcaatacttcaaatgacagctcaaacatctccttcagatgtcattaggttcagtattgccaaatacattttagttgcaatacaagtttgaaaactaaagagatgatttaaagtcaattccaaacctgttagagtcagaagaaagattgaggcatctaagtatggccctaggataccagtgcaagctgaaattgctggagatttgaaatgataattaggactattttcctgggactaggacaatagaaagtaacaatacctagcatgatatagctataggaaaagaaaggctttacaagtaaagtcacagagtagatattcaataaatgctagctaacttttttttttaactataattagtggcagaggcaacatcaagagccacattcctgattaaaattacactgcttttccatgggttaattttattttctcaaactaaactacaggacaaaaaaaaaagtcttgttttactaaagcatacaaagtagtttgtctatatgctaattaaatttgccaaactattttccgtgcttctagaaggcaaataatgaatgttattctgggtgttagaaagcacccagagtagttctggatccatagcaataaatgttcagtaactggttatttagtaagcccacagaatgaagggctcaatgttaaagaatcaaaccggaatataaataagtgcagccactatggtgaacagtataaggttccttaaaaaactaaaattatgatatgatccaacaaccccactcctgggcatacatctgagaaagaaactctaattcaaaaagatacatgcatctcaatattcacagtagcactatttacaattgccaagatacggaagcaatcaagtgttcactgactgatggatgggtaaagaagatgtgccatatgaacacagtggaatgacactcagccaaaagaaaggatgaaataatgtttgtagcaacatg

SEQ ID NO: 58094 - DNA, 1086 bp, Bovine  19866882026708
ctctgtttgatacatgctttcctcccttccccaccatgtgtgctgggccataatggatgagtgaaaactagcttttcattgtcattgttgaactcagaggacacagaataagttaatcacagaaactaaaactgataaaatatttgaaagcatttaatccaatctcctaaggaaagaggtttcatagtgttatacctgagtcatttaacaggtttgtagcagaaataggagtataacccacattttgtattttaagttccacagttatctgttaactgttcattttagctcttttttttcctttagtttccacaatcaaagcaacgtttagaaattacgagttaatgaggaatttgacataagcacaagggtgagagaatggtgggagtgtgtttgagatgagggggaatataaagcaattaaatcataggggaaatgtcaaaattacaagtgagattatagaaatataactcataaagacctaaaagttgcaaaaccatacagataaaaaaatggaacttgaaaattaatagaacaattagatgggaaaaaatggaatgtatatctgtgtgcttctgttatttaaagaggacttacatagcatttattaaaagccagtcaccattcacttgcttgctgcacattatcattcacaaaacccctagagatacacaagtgctattattatctgcattttatagacaaagtaggcagaaagaagttatacaatattagtttccttgggcttccataaaaaggtaccacaaactggaaggtttaaagcaaaaaaattttaattctgcacacatcagatttctggaagtccaaaatcaaggtgttagcagagccatgatccctctgaaaccttggaagaatccttccttgtgtcttcatggctgatggtgttggcaattagtccttggacttcttggattgcagatccatcactccagtctctgcttctgccatcacgtgacatgaggttagaaattcaacatattttttgaggaaaacagtttgactaagaccatgtaacttattcagtttttgtgttactaaaaggaggagccaagacaggtcttgttc

SEQ ID NO: 58095 - DNA, 3839 bp, Bovine  19866880427560
ctgcagccccattgtggttttcctgccaagctgcagtggttgctgggaagaacacctggtgggtgagtgatgggagagcttcccgctggcagcagccacctctgcccagagccatgctcatcactgggtgccatggagggcccaggcaggaagcctgagaacactgttccagacacatctgccgtagagccgtgccctggagtgagcctgaccatgtcggtgagacccagttcaccatctcccaggggcgggctctccaagaacctctttgcaatctcccagcctttctttccatggctatgttaatcttggctccaagaccaaatgagtggaagattcagggggttttgagtgttagattgcaggtctgagctgagcacaccacgccttcactccaggctcctccactttcattctaatgttaggaaagcagaggagagaaactggctgttgttgaccttgtttcatggtgtcatcagaggacaggtcattattgtaagagtggtgtttggaaaaagaacggggtcaacgcttaagatacatgggctcctgtcctcactctggcctgagccagctgtgtgaccttgaacagcgagttagtctttccacatctccatttcctcaaccaggaaacaaaagaaattggattgatgtctcccagcgccccgtccaactccaacattttagactgtacagctgcgaacctcaggactgatgtcgttcatttacaaagaaaatgtcaccaacatcccctccccgcccccaggaggatgtggtctgagttgttctccctgttgtgatggtgggtctgcagtgctccacacccgcctgcccgtccccattgtccgccgtggttcccatgcaggagggctgacccccttgcctctgctgtcctctgagtctctgggaggacaccgtcaagaaaccactcgaggctggtaggtctgggcctcggttcccacctcaggaaactgacttgctggttgactgcaggcaagacttggcttctctgagccacatccgccaaatggggcaaaaaattctccctgggaaagtgcttcgggatgagcacggaggctgaggatccaaatcccaggccctttgggaggcagtggacctctactaatggaccacacactcagcagggctttgtgtcccagtgtgctggaaccttggcctcctggcacgtgctggttgtcttgcccacatgcattgtgaacagggatcaagatgccctctttttggattagttctgcatttggttctgggactgtgaatggctttgcagtgcctttcagtgagctcttttcagcttcactcatcaggccttggttggggagctctgtttgcttccagctgactcagtgtggttgctgagctgatgctgttgagtcactcgggcaaggcccgttacttgccagacatggctcacttggacccatctttccagggtaatgaactcataggattaaactgagagctccttccttctcctctactttcacctcctagcttcccattcagcccccacccacccccactccaccaccacccccagcttctggtcctcaggtgggacgtcttgagccagggagcaattagccaactcagacttcaagattctccctagaagaagttgctgttgttgttgtacagtctctcagtcgtgtctgactctttgcgaccccatggactgcagcacaccaggcttccctgtccttcaccatctcccagagcttgctcaaactcacgtccattgagtcagtgattccatccaaccatcttgtcctctgtcatccctttctcctaacttcaatctttcccagcatcagggttttttctaatgagtctagttcttcgcatcaggtggccaaagtactggagcttcagcttcaacatcagtccttccaatgaatattcaggactgatttcctttaggatggactggttggatctccttgctgtccaagtgactctcaagagtcttctccaacatcacaattcaaaagcatcaattctcggagcctagctttctttatgatccaactctcacaatcacagtgcccaccaatggaggaatggagatacaggtatacacgtggaatattattcaactgttaaaaagtaggaaatccaaccacttgcaataacatcaatgaaactttagggttttgtgctagtgaaataagtcagagagaaaaagataaaatactttatgatctcagttatatttgatttttttttaaagccaaactcccagaaacaaagagtagattggtaattcccagggcttggaggatggggtaaatggaaagatcttagtcaagggtacagacttccagttataagataaatgttttctggggatctgatgtgcagtaaggcgactgtagttaacaatgctatacaacgtccttgaaagttgctaagagaatacgtcttaaattctcagcacacacacacacacaaatggtaatcatgtgaagtgatggataactgaccttattgtggtaatcatttggcagtgtatatgtgaatcaaatcatcaccttgtacatcttaaacagacagtgttatgagttaattatatgtcagtaaagtgggaaaaaagtatctgtgaataagttcttatggatattaaacgagttaatacattggacttaaaacagcaccacattgtaaatgcttcagtaacactgagtttattgttatttttcactgagcgtttgctgatctttctggagcttcaaaggtcaagagctctggaacaggactgcctggatccaaaggctgcctccactcagctgtgaggcaggggcggtgggccactcctctcagcgccctggcatcctcgtgtgcgaacagaaataatggcagcacctgccacttagggctgctgcaaaaataaacgatgcgccatgcacttcgcatagggccagacctaaggtaagcatacaacaaatgtttgtgattgctgtcattactgataccacgcgctgggcgcaggagagacaaaggtaaataaggaaattgaagcagagcccttgtcaggactaaagagaaattgcaaatgtaaaacctgtgatttaatgaggttttacagtgtccagtcatccttgaaaagaaagtaggaaaaaggaaatcctgtcagctaatatctcctgtatctagtcattctcttggtttacagcaggtatttcactctttgctttaggcctctcgtttgcttaaaactgacggcttgaaaagggaaattcatctggattccttcaccgagcggacagtccactgttattacgatgatttatcggcgttctttctccgcggcttttgacaagcaaagaaaggagtttgctgtcttaggccttgactttgatagacacattctcccaaaaaagcagcttatgttttctgatctcacatccttagagccctattcgtgggtccagctaaacccaaacctcctgaatttgccctagataaagcatagactcctacttatgtaattatcagatatgttatacagaaaaaaaaaaatactcagtctatcaaataggtatcatatagcaatgactaccatggatcaacctgtctcctaagcaccagaatattcatgatagaggtttggggaacacaaactccaattcttgggaacacagcccacagttcctgggaacacctgctctctacagaacattcttggtgatgagctcttcctgggttcagcagtgccgagaaaataacccttatggttagagatggatgccaataggtgattagacgggttttgtattatttgtatttgctaacacacatacacattcacctgtgtaaactgg

SEQ ID NO: 58096 - DNA, 1532 bp, Bovine  19866880428402
ctcgatggacatgagtttgggtagactccgggagttggtgatggacagggaggcctggtgtgctgcagtccatggggtctcaaagagtccgacatgactgagtgactgaactgaactgaactgacctgaatgaatagaagagtgttatactttaaaggtatagccttgggaatgggctgtcctgtatgtttcagtctataggcaacattctttcacagaaggtgtagagccagcatgactaagcaccgtcaacagagcccagagtttaaagtaaaagaagcaaactcaacatggagtcagatttgttcttccctattccatcgccagtgttcctcaggcatcacccggcctgtctcactcaccctgtccccggcctgactgctatagacattttatattgagattgctgactcagagatcaatgatgtggattccacgcaccgtgaggatgaagagaagtaatatagaaagagtaatgtttccttatggagctcacaaaatgccagccgcaaagataaacagtttgagatataagctaataggttaggcactaaaatacaatgtgaacttgatgatctaagatttttttttctccagctttaaaagtctataattttacactgtgtgagaaggagaatagtttctatttaatgaggtaagttttaaaaattattaaaacatgttttcttaaatatatgccatcttccctttactatgtcataaacaatctatattacctagtcaatgttatgagactaacttatgggtttgaaatgcagaaaatgtgcacacaatgattttgtgaaatgtttatgcttcttttcaagtgataaaatagactaatacgtgtatctccattttcacttacctaataggctcttcctcataaccatttctttatatacagaacagaagatacaatagggtagaaactgccaatgaatttgcaaatgacattgttgagctctgctagggagagcattaccatctaatgggtatatttagaaaatatttattcaggacctgatactttccacagtgaaatgacagtgttggcaaataatcatccaaagacattcttaggtttggttatacaaggtatcaccttgaactttaaagccattgctcaaccaaggccattttgtaaagaagtctttcacgtggctactctgtagagagacgtttgagtcttgatcttttaaaatgctacttttaaaaattcaacgaaaggacaagtgcagtgtgatttcacttatctgaaatacttaagagtagtcagactcatagagacagggagtaggatgatgattggcaggtcataaaagggactggatgggggaatcagatcagatcagatcagtcgctcagtcatgtccgattctttgagaccccatgaatcacagcatgccaggcctccctgtccatcaccaactcccggagttcactcagaatcatgtccatcgagtcagtgatgccatccagccatatcatcctctgtcgtccccttctcctcttgcccccaatccctccca

SEQ ID NO: 58097 - DNA, 2136 bp, Bovine  19866880571267
ctcaaatgcatgtccactgagtcggtgatgccatccaaccatctcatcctctgtcgtccccttctccttcctccttcaatcttgcccagcatcagggtcttttccagtgagttggctgtttgcgagatgtactgttctatgtattgtcaactcttagcattatcagactttttgacttagctcttttatgtgatgcctagtgatatataaattagttttatattttgtctgtataaaaggtcaagaacattttcatatgtttattggctatttgtatattcctttttgtagataattgttcctttttattgtttttttcaaacttttgtaaattctaacaaatatcatgtactccgagatcatgaatatatttgcctatactattttttagaagctctattgtttttcatgttatattttgatctataatttacttggaattgattcttatgtatgatttattttatgtttaatttcatgtgtatttatatgaaagcatttgtaaaaaatctgatacaacaaatgaataataattaaatgagataaatgtaagaaatttatgttagtataaacctaattctatgagggtagatagaataaataaacctcaaattaaaaaaaattttcctctgcatttttctcatctataagaggagaaatattattcaccacctgaacaaaaaaaggaacattaacttatgatgatgaaagatttcattatataatcttaatgtagtatcatgatttatccaaatcccaaacctatgggaagacaattattttctatcaatatttcttcaataagcttaaaatatttttgggcaccctggaggaggaaatgggagcccactccagtattcttgcctggaaattccgtggacagaagactttggtgggccaaggatcatgaacagtcagacacaagccgagtgacggagcacgcactgagcatacacgcgtgtgtgagcacagtgccctcaacctgccttttcctttttcctctatttttttaaagctatcgtttgtatttttcacaataaaaatagctcagggcattgtcagttcttaacaagtcacaaaaaaatacagtttttaggttcagtaaaatatttattccagggaaaccttagtttcaaattacaaaaagaaaattcaatacttaactacagtaaaacagagagaactaacttttaaaatataatcaaactgctctatcacatgcagagaaggcttttttaaaaaataaactgaattcttagtaaaagatgtgatacaaagagtagaactcttttccttaaaaagaaagaaaaggaaaaacttccaattagcagactaaaatgtgaagctggaaaaagaagcaaactaaacacttagccttctgggaaaagaaatcgcaaacaaataagaaagtttagaaagatgtatttagcctttgccttttaaataatgccttggtattacactgcatttagttctcactgtaaaacttatctaacccaagttaattacatttccaatgatagttgtgagagcagttgccaagatttactacataaatgacatataaatttagttgcagaataattaagtcagaatttgagtccatacattaagcaatggaagcataattacattcttacagatgctaaaaacttcgctcgcaattctttaaaaatgggttcaaggcagattcaggctgtgtttcatttaagacttcttttccttcgaatatagtagaaaaaacaactctaatttgagtagtgctttataggctatgccacaattttaaaatattgggatattttacattaagtgctaacagcaatatcaaggggtggctttggatatcagtgtgggagcaagaagttccggcctcttagtgaactccatcagtgcctcttctcttgccttctcaaaaagctttttaccttacaaatatggccttgtaacgttagggtggtttgaagactagtgtcttgaattgctttccagatttctgctaagaaattcctccttcataaatgaacattcaagactaacctctggacttgagatctcaggttatgtctatgaccttgcatccccttactgatctacagatcagcttgacccactctatttttaaaattttatatt

SEQ ID NO: 58098 - DNA, 3685 bp, Bovine  19866880648098
ccttgatggactccttttcctatttggaaccgtctgttgttccatgtccagttctaactgttgcttcctgacctgcatataggtttctcaagaggcaggtcaggtggtctggtattcccatctctttcagaattttccacagtttattgtgatccacacagtcaaaggctttggcatagtcaataaagcagaaagagatgtttttctggaactctcttgctttttcaatgagccagtctcaaagcaagcaaacaagcaagataacaaagaaacacaatgtcttttcagtgaattcttcctatataagaagggaagaaacaaaacattgtcagggtaatttcaagacaagattatatctagaaacaaagaatgcatgctatcctgtgctgatttaacaacacaaaagaaaatttaagtaggagagaagtgtctgcccagttttcaaactcatatctttaagctatttgccaacaaaatgttgatatgcttttggagggataatctcacttaggcagactcccaagaaccttgcctggttcatacagtatggaattgaaatgcctggctaaggcagactcttgagagtcccttggattgcaagggagatcaaaccagtccatcctaaaggaaatcagtcctgaatattcattggagggactgatgctgaaactgaagctccaatcctttggccacctgatgctaagagtcaactcattggaaaagaccctgatgctaggaaagattgagggtaggagaagaaagggatgacagagaatgagatggttggatggcatccctgactcaatagccgtgaatctgagcaaactccaggagatagtgaaggacaagggagccctgttgtgctgcagtccaaggggtcacaagtagttggacattacttagagactgaacagtggcaaaggcagtctagtaaacagctcaaggagtcttagaagaccagctgtcacaggtttccatcttaaagcagatgaccaccatcccagctactcttgaaatctcattccctctcacgctgccaatggttatttcaggtggacccggaaagtagacaaaaagttttctaatgacagaagagaagtctgagttttcatatagattactatggattttcatatagattttatttcagcattttgtcatacactgctgtatttctttcactcttattttattgatagaactacaagctgattggatatacagcacttgatttatatatcttttgatggcttcttatttctccacctttgatatctgagttattatgaactggtttgaactgttattgtggaaaaaatggcatttcagttcattttcttcagcctaagtgctctaagggaatatgtaatttatctttctatctcgagaacctatcatggtcctcctgcatattaagtactctacacatactctttgaatgaaaggaaaaaagtaaacaagtggctagatgtatgtacaaagggaagataaataagtctaaaacaatactattttgggttatcaaagacagtgatgaaaataaatgcatggcagtgacagttacagagggcctagctctccaggaccctgctttgctaaacttgaatcttgtctcctctgcttggaatacaggcaattgatgatgggctctgtttctcttaatgtctggttacaatcgtggccttggtctattgggattagagaagagtaggaaggatttaggtctttgccttaaacataaggctcaagatgaacagagaaagacatgtccatgcttaaactgaaactgtggaacaggcaaggagctgcctctttttgcacagagggtgtggacttgggcagttcaggacgatttataggaaatagtaggtgggctttatcatcagaattggctgccacagcattgagctggtggctttgctgctctcatttggactttttcctgtaagtcacggagatcctttcagcgtatacatgtctgtgttacaggggaatggtttccaatgaatgttttggtcacatgcatgatagtagtaggcttcactgattttttttgtgccatattttaagacaatatattcaccttttaagataatatattcagaatgtctaagcaattctgagatattgttaaccctggccgaatggccatgttaataagactagaatattaacaatgattttggctgcttattcatattaggtggcatgctcagagtcaccctagagtttggaaaaactacaagttccattctgactttgacacaccaagatgtagtattcaatgcacacaaaaaattttatgccagtgggcaatactataaaatgcctttgacaacaattttagtatacactacctattttcagctttcctcgtttgttttccttctatttatatagagctgtaatctccaacaagcagtactggcctcctacattatttattgtttcaatataggggacaattacatataattagctggatgacattactcgtttgctggtggaatttgctgtgagtgtatttgcttcttctgggagttgctttctatttcctgcaccactgctctgatgctgtttagagagacctatctctttttttttcctgtttatttattgcttcactggtccaaggcaggaagaaagcatatgaaaatcggtatggaacagcctgtgaataaccatcacaggaggcagagagagttgcataccaattagaaaacactcaaataggcacaaggtaagttttcaataccaggtttattgtaggtgaagaaatccagatgaatgtgtcaattccttgtgaaatttatgaaaacaatcatttggtgccatggaagatgtaattcacctagtattttatttctcctccatgatatgttctgcataatttgattttctgaatgctgaaggtcactcccttggtatgaaaccctaaagtaattagcattttttaaaaagacagttttctcaactatattaatctttttcctatcttcttagagtttgcagaatataactgaacctactgaaaattctgcaatacatgaccttatgccagactatctcacatgacccactgaagactgaggaactatgataaatgatgcagtatttctgagtcctatacatgtgacaggctctgagtgcagggaaagctctttaaaaagttagagcttagacatctgctgccagtggtgtgctgtaggccacagctgtccatctcgccatcctacatgtgcacacaagaaatcttacttatgttgaactctccaaagcacttgtcttggttccctttccatccatcccagattccgacctttggttttccttatccaaagttcctttagatcgtagtcatattcatttttggcctcctgaactgacttcttgactcagacacagtaatctcactgaccgtctttataaattggggctctgctgctacggctaagtcgcttcagtcatgtctgactctgtgcgaccccatagacggcagcccaccaggctcccccgtccctgggattctccaggcaagaacactggagtgggttgccatttccttctccagtgcatgaaagtgaaaagtgaaagtgaagtcgctcagtcatgtccgactcctagtgatcccatggactggagcctaccaggctcctccgtaccatgggattttccaggcaagagt

SEQ ID NO: 58099 - DNA, 1138 bp, Bovine  19866880687596
actctagattcctctctgccctttggcaggacagggaagtgtagtgacagctccagggctcatggcttccaaggtcgtgcttttagattctgggacttggggctcactgggggtgagacagacgaggttcaaggctggagcctgagagacttccctggcaggcgaggggttaagactctgcctcccagggcaggggtacaggttccatccctggtcagggagctgagatcccatatgtctcatggctccaaaaccaaagcataaagcagaagcaatattgtaccaaacgcagtaaagtcttcttaaaaaatggtccattaaaaaaaaaaaaaaagactggagccctttgctgttccccataaaggtgatagcagggaagtgttgagtaagaaggtgttttcgacaatagcaagagatcccaacacagcttaatgggcctgcctatccgccacccttccatcaacccgcacctctgtggtctaactggattcatccacaggataacgttgatagtgacgaagagcacaagctttggagccaattgtatttgggattaaatcctgaccctgtcactcagcagtgtggtgaccgtggacaaatcacttcatctgtctatgtcttcatttcctattctgcaaaatggggataagagtgctcatttatcagagttgctgtgaggatttgaaacaatgaatctaaagtatttatccatactggctattaagtaggtgttggatgtattactcttactgttgttattattactttcatgcttcaagaaacttttaaacacctccatatatttggaactcattaatctctatgatatgcaagtatgtgattaacaaagataaaacacagttaaagaaatatgtacaagtttgagacgaaggaaatcctataatttctctggagggaaggagccacagtattcctccttgggtaatgtattattaatgctgatttccttgagatacattaagaatggattcaggacagagagagagaatatgagaatttacccagcgccagcgctccaattaatcaacttctgtttctgtaaatagccctaagtgaaagaatcaaactattatgttttgtggatgaacgatcagcaaatgctcagaaactcatctgt

SEQ ID NO: 58100 - DNA, 2844 bp, Bovine  19866880695575
gtatctgggatagattccatagttcctaattctgttgatgctctttgcacattttgtttttttttaaacctttgtcccctaatttctgtgtccttggcttctactcttatacctctcctgtgactcctttgcggtttctcttgtgagccttaccgttcacacatacatacacacatacacctcatgtctctgagagccattcacaagcagaggatctgctatgtaggctttaatgttaacaaatctgtttttacaggttcactcactttttgtgtctcctctcttgaactgggggcttcccaggtttcacgagtgggagagaaatgcggattgccaatgcgggagacataagagaggctggttggatgcctgggttgggaagacccccagaggagagcatggtgacccactcagtattcttacctggagaacaccacggacagagaagtctggtgggctagagtccatagggtggcaaagagtcagacacgagtgaagtaacttcgcacacactcctgcattgactgctaggactttactcaaatgtccttgagatttaaacacaaattgtaagggaattcagtcttctacactggttttcccagtatttgtcattggtatttatgtttttaaaggttatacgtattgcacaagtttaacaaatacctaatgataattgtgggtatgctgtttttatctgcattttttaaattgtagctgcataggtgattctataggaaataagaatgagtaagttggttagttgtatgtgactcttccaatgttttagatctattcctatttaggtagattaatatttcctgggtgaattctttttttttttttttccccaaaatgtagaaaaagggtacactaaatcccatccaatattctagtatgttaatttaatatctataatgtcagttggctagatagtaaatggctagacatgctttttaaatgtatcaacaaatatattctgctaagtgatctcttcaacttttcacatcatgaacaagaaactccaaactactcagcatattttgataaccctctcaactacagagttaaagacagctgactcaaatcccaactttgcccttcactagttgtataacctcaaaaatctaaataatgtcttagtgacttctatttgtaaaatgtgggcaatattggtacctaatttattgtgggattaactgaggagatgtcggtaaaatgcttagaacaagttttgcttacacatgagaaagaacagctttttatttcctttaatgttagacttctttaagaagtatgcaattcttaacaataataagctctgattaaatttgatataaatatggcaaaatgtgcaaagcactgtgggaagaaaaacaccaaaaacgtggcctggatctttaagaaacttaaaagtaaaactatttctctattttcctaacgattttgctttttaaaatagacctcagaaacagttgattttattattttgatttcagcttcgcactagaaccatattatttttcatcattaatttattactttttccttcctatttctcttccagtccacggccacttggcaccatcacaaaatcacttctcacagacactgcttaatttccttgtatgatttcagtctgcacacctttcccttggccaggagtcttacctttgcatctgtccctgggaattagaaatggagtgtggatggcagaagacatgccttcacttctaacaaccaaatgactcaaatgccctgtgcttttaatggtaaacccagcatttaccattacccagctcttacccatagctattaatgacagtcctttatttgaaggtagggcaaagcaaaatatttaataatatatctctcgtgcccatgaataccagtctaaaagctgaaagaatttaaatacttcattcaagcatttattaaaatgaaagcagcatccagggtctactggagcatggagagccattgccacgttccgtgtatttttagctgttgtcagtggtacatgaaaaacatcctagtgtgcagtcccgtcctgctgacatttccactaggtaatttaccttttgcttcactctctctggaaaaccctccagttattctgtgagataaacaataggtgccttttcttcagtgaacttttgcttgaacttaacgacctgctctgactaaatgcagtggcctcactcctgtaaaaaagaaaatgtttttaccaacacccctttgcctagcaattgcttctcagtgctcagtgtattttagcattgggacagttctctgcattggtttctctgatttttcccttgcagtgggtcacaggcacccacatctggaaggttttagtggtagtcagtgtagcattgggataagctcaaggagtacagagtagggcagtctacatttcaaatcatggttctgctaggtttatgattatgaactggtggtttattcaacctaagactcagcttctccacctggaaatgagaaaaataattttgcctacataatatgacttagaatagggggatttagtgagacaatctaagccaccagggaagccccagtttctcatatattcttggtatgagttctattttggcctatggattgcataatagtggggcttccctggtggctcaattggtaaagaggctgcctgtaatgcaagagaccggggtttgatccctgggtcaggaagatcccctggagaaggaaatggaaaaccaatccagtattcttacttgggaaatcccatggacagaggagcctggcaggctacagtccatggggtcacaagagtggacgtacttagcaactaagccatcccca

SEQ ID NO: 58101 - DNA, 1013 bp, Bovine  19866880814864
cttccaaactaatgttaatctcaggaactccccaatgtttgatcaactgcctgggcactgtggcccagtaaagtcagaaccacccatcacaccgatgatggcagccaatgttcagaaatgagtgtcaaagcatctccaactccccttccttacaaaactcttctatcgttgccatttattaatattttcaaaactcctgtgtcatctgtttatatttctaggaatgaaaattcttgaaaataaaatttaaacatatgaaaagaaagttgtcaacaatgaagcatagagcaatctcattaattagattgattctgcataagatcatcagcgaaaataatcctgaatattggatattcaaagatatgcaggcttattaagtatgactatatattttagcctaaacaagattgctacaaattagcaagtcaattttctttcaggatctgctttaataatcagatttaaatgatcagtaaatagcacatcaattactgatatggaaataggtgctgaatggactttcaaataaagtattcttagcagaggtgaaccatgtgccctgcagcttagttttggttattaataaatgtaatttttcaagcttatgtctaacttgaaataagttctacgtcaatgaagtccaaattgttcatgtttcttttaagcagagaacaagtagggtttgtctaacagtttcactgggtatctgaacgttttttaaagacataatcctttcccttagtgcaaatgcagagaaacagccagaaaatgccccttgtcttccactgagagggatgctcctgctggtgtggtcagtggagtttccatttatttatttacgtttggtcgctctgggtcttcactgcttcgggctggctttctctagttgcagcgctcggtcttctcactgtggtggcgtctcttattgcagagcccaggctttaaggtgctgggctcagtaggtgaggtgcttgggcttagttgcccctcagcatgtgaggtcttagttccca

SEQ ID NO: 58102 - DNA, 753 bp, Bovine  19866880815291
atgattttggaatacccaggtaaataaaggagtggaatggaagataagcctctttcacaacagagtatttgttggtcgatagcatttattactcctcagctcaggaaggagtttacggccaggttgtaaatataaaataagcacaaatgaagctgcaaaaactcttgcaaagcaatataatacataagtgagtattgatggcgaaggacagacaagttagccaggcaccctgggtaccagaagggaaggagagctgggggcctgagaaggacagtcagcaaagggtgcctggaggtgagattcaagagcagccaagtttgtgcaaagcctcacagagtgggaaaaatgaccactgaccacagttgtcttgtttcttgactaaggtttacatcccaggcacgcataccggcaatcaataactccttagctgccgttctcacataatcggaaggctccaggggaactctgggcccacctttaaggatgagtcacgacgtgacggctctatagagagaggacttgaatttcctccaaaaaacgctggtgctgacactctgcggcccagagtcagcctttcagtaaaaactcaataacctcttgggtatgcttcctgaaagagcagaagtgaaggctttttctgacagttacttaacctcttcaagtcagagctgcctcatcggtaaaacaggaatgtcctctgcctctcagaggtgctgcaaggagaaacgaaaattaccaaagctttgtaggtcc

SEQ ID NO: 58103 - DNA, 1382 bp, Bovine  19866880866524
tccaaaaactcttcccaaagtacataatgctctaagacctcatggatacgattccttgcacatatgaagggagaacaagtattaaatttcctatcaaactattttctttctattcagtctatatctcaaaagagctcccaccaatataacctttttgccaaatggccaagatgaaatatatttggggggcatttgatatgaaatgaacagtctcaaatagctttacacatgttgaaagtttaaaaagttgtttattaactactttagttataattcatttaaaaatcccattatgtttggttacacaagagtgactttaatacacttaaagatgcagtactccttagctgtgacatatttatagtctgagcattaaaaagtttataaaatcaggccatattttctcagtgtcaaacatccctcaatgaagacaattattcagcctgcctatttgtaattaggtatgaaataatttatgattatgaagataagtgagcaaaaattttagaaggactgcatattgtattttattattaaaagatttccataatctttccagggtttgaggagtcataaattgcctggatctgatttccactggattttgcttagaattaataaacatatggatctcatctaagatcatgtgtcaaaaataatgaaaagaatggcttcacacaaagctgaaaatgaaaccagactgacatgagctgactttggtttggacaagtaccatgagctgcctaaagtcaacccacaaagaaagagactggcagtgccagcagggagagtacgccccacggggcagaaaggcagccaaggttcaagtaagccagggctgcagagctcctgctttgccacacttccttctcaacagggaccaaggacacgtgcaacatgctattattgcacatggcatctgtggcttcctgggtacgcaggcagctaaaaacatgaatatttattggaaggactgttgctgaaactgaagctccaacactttggccacctgatgtgaagagccaactcattggaaaaaaaccttgaagtggggaaagtctgagggcaagaggagaagggggtggcagagaatgcaatggttagatggcctcagtgactcaatgacatgaatttttagcaagctctgggagatagtggaggacagaggagcctggtgtgctgcagtccatggggttgcgaacagccacacatcacttagcaactaagcaacaacagcaacaaaaatgtggggagggcaagcagcccttctcctcagtccctctcccaagagaataagcagacacaaaaagcattgaccaatttctcgtttctcttctcttccattcaaaagaagtcataggaacagggggctgctactgttc

SEQ ID NO: 58104 - DNA, 1697 bp, Bovine  19866881002499
ctgggttgggaagatcccctggagaaggaaatggcaacccactccagtacttttgcctggagaattccatggacagaggagcctggtgggctacagtccatggacacagagtcagacatgactgagcaactaactcttagtagactttgaaatataccccactgccaaccagtactccccagatgctgagggctttggagacataaattcaaaagtaaacaattaggagtataaatctttacaaatcagaatgtatcataaagctgaatccgagtgagttttggcaccaagaacatcatcttcattgtacttctttctcatttgttcctaaatgtgactcccaccttcacgttcattgacaaaggtaattgacagacaacaagagctaagaatgaacattaacaatttctatccaaatgtcccttttctctcaaaataaaaaagaagaaaatacgagtcgggaaagcttacaaaagaaaggaaaaggggaccattggtcaaatactcctgtgagtttacaatgaattacatcaaaattcaagcaggctcaggtagggcttcaataattttcagttaaatgatccaggctgtatctcccgagtgttacatgaccattttgctgctgactcaccgtggtagatacaagagacaaagcttccaatttgtacggtgtttactgctgagaccaggctctgcaggcacttggtaaaagctgcgctaagtgattttctgagtaaggctggcctccctctcatacatgatttagagccacggggcctcagccagcaccgggagacggtgagatgagtcaagtgtgtctttcaaaaattaaatatacggccccacgactgtatgtgtgagtgtgcacatgtgtgtgtgtggttcctctacctctgtctatcactgatagagtgcgattgggttcatggcagctgaccttctaccagggcagatacacagacatgagcctccctcattctggtacctaaagcgtgtggctttcactttaaagcacaacctcaaggctgcctctttcccgggcacaagtctgtgccctcacggtggctgtcctcgcaggacatgtgtggccacttcacggagcgggagttattggaccctctctcagaccagctggcgcacctcacacatgagctgcttcgaccccaaaccccaccaagagattaaaccacctcattttcctccatgtattcacgcgtcagctacgtagcaaaggtttctatgtcccaagacacttttgagacaggctggcacctgagacccttggccggaaggcctgaacctggtcacactctcctcaaacagcaggatacaagggaactgtgtggggctaaaaactgctgcgcttattcgcagttgggcaaattctggacaaaagacacagagaccaaaaaacttagctgccacttctgaagagccaggagcgaaaacaggttgttgggaacaaaagcgggttaccaagtatacaccctgcactcaacaccaccaaaggggtgggcaagccacctgagtcatccctcctgcctgacctgtggacacacgcccaccctcaccccatacgaggagcaagcttaccaccccacggggagcaagcaagcaaggtgttgggggccagagtgaggtactccgcccgtgacaaaggtcatgaggaaggaggcgggatcgagcctcaggagtcc

SEQ ID NO: 58105 - DNA, 908 bp, Bovine  19866881018470
catattgcagccctttaatattataaatccctgagtaattgaaaatgcatccatgcaatgatggtgactgttccacctggttcttaaaaaaaatcaatttgtaaagaaagtaagaatttgcatctgcctgaagcccaattaaagtgacagatctatattttcagttgcaaaagacatgcaaagggatatataaactcttatcccaaaactgtaaaatctgcctcccattgaggcacacagcttactaaacttgtggctgattaagtcaagaaaaaattagaagcaacagtttgcttttgtttctgtagcaaatccataataacacgtttatagcctgtctgaagcaatggcttaaaccctagtttatcttaacattttagtttccttgtctgtccatttatttactctagtaaatatccatctttaccactgcggaagataaactacttgcattcccatctggctcttaggaaatccctacagatattgctacaaaaaaaaaaaaaaaaaaaaggcagttaaataggataatagtgtgttaggtattatacattgtatttctaaaccattaacaagaaaatggaacataaacaaatcaataaccgaacccataaaagcataaaaaggaaggaccttagagtttaaagaatgttcttgtcattatgttactggaatttactaaaaatatgcaccatagggataagtcagtttacttttattgttgttgttatggctgacaactctgggtgaaatattcagaagaggctaaaggagagtgctatttggagtcaagtctccagtcatttggtgaagattattacaaggtgacatgcaaaactcatagcaattgccatgcaagatgccacaacatttcaggaaacccagaggaaattcagaaatttgacaca

SEQ ID NO: 58106 - DNA, 1210 bp, Bovine  19866881088850
ttgagttccattcaacagaagtgtgtcactgaatccaggccatactcaggggaagggaatgaagtaagatatggacaccaggaagtgcaaatattgagagcagactactttatcattggtaatccttgtaaaatgaaagttaaatgtagaaactcaattagattgatgatgaatatctttaacacaaaaataggaaggataatggtttatactttgtattgtatgacacctggaataaatacataatcaccccgctattaccaaaactaaaattgatccctgaatagaggtaatggaagcttgattcctccactgtaaaattatacttttctttttcaaccagaatgcgattagtggattttattttggtatcacataactgtccatccacaaagggttttaacactgtatgccagtgattgcaaagtatgtttttgcttttcaactcataatagtcattctgtatttctatctgaatctcggtcaaatagatctttcccttttgactattcagttaccctgaaacatagcacttatcagaagggcaagaaaactgttcgtttttttttcttccctctaaacttagttttcagtacccagagtttactgatgtctaaatgcacatctgtaatcaactctgtcccatcaatactcctcatttgatgtggtctgtgatagttttctgggaaaaataattaagttttaccaccgtttttatttgtttcgtgttgttactgaaattcccttcagtgtctgtattccacagggcactttccttaacaagtcttatgtagccccacgtaagcatgtactcaacccatttaatgccacctttctgctgtggcactgccaagatgtatcttaaacagtttgactgtatcatttcttggatgctggattgattcctgcagttttataacgttctaatcctaatgttcggttccagcttgctctcacccttagtgccatttatgcacatctggcctggccaactcgtgttcttttatacggcctcaacaattatttagatgaccaatattcactaaagcacgcatgccagagatatggcacgcctgccaagaaagtcagtccctgcaagaccgcaggagggtctgttgtaaaattgccctaaaattgatatctttatgtttattgttatgagattttgtcttttttttttttttttgagctttgttgcaaatctaaataa

SEQ ID NO: 58107 - DNA, 1330 bp, Bovine  19866881120721
gaacgagcaaacagaaagagaaaactgcgaaaaagtagaaacagcaagatgacgggagagtgagagtgaggactgagaaaaggcgccagggtttccataaagaaacaaatatatttagaaagcagcaactccgtgtgacatttgctaagtgattttgatgattgacttttcaattgagtttctgtagtaagaagtgaaggagggtggggggtgaggaaaaagcaattttcccaatgggggtataaaacccttcagcctaatgaaatgttttctctggtttagagataacaacccacttcttttgggttttatgcctaatattgattctttgtgtattttttatggaagccttgatgaaattcagttaattgtattttattggaatgggagagtgtcctgtttaatattctccaatctcctcacccatggttcttcctaccttccccccttctccctatcaatagtttagctttgatggatggtttgtggtgatttaaaaaaaaaacaacaaactctcgctctacctttcttgatccgcttccagtttgcacagttgcaaaagcactgaaaaagccaagttcttttaagctgtaagatgctgaaatatggtcattaaatcctgatgggtttttttattttgcctctcataattttaaggaaaaccactttctgagatggttgggtaaatgcaggaaatatcatacgggggaaagtgaggtcccagggcagcttttaaacctgcagggtgttgagtttatttacaaacaccagcagaactagcgagttaccagggtagcttcaccaagcggccgggactctggaacacgagacagcaggtacaggggcgtcagccgttcaggggctggcttgtgggggactgccctgtcttccatctttttacatctcggtgttttatctagagaaggccttgtcttgagagaactgctttgccactgggcaataagatgacttacttcttgggatgtctcataaaaggatcaagcaagaacacttagttgttgagagaagctgtaatctttcttgactgaatggggtggacatgggaagcagaattagatttagaattgctcaaaggataaaagggttcggatttatttaaggccccaaaataatgaaaacgaaaggtaatagagacacaggatattatgctacaaagagtcctgccttagtatttagaagccttggattttttttgagtcctggttttgtgacttagaagtcaaatgtccttagggaaatcacttctctgagctttgagttttcctagatgtatgaaaagggttttctgggggcttattttgggctggag

SEQ ID NO: 58108 - DNA, 783 bp, Bovine  19866881172318
acaggcagagtagggaaagacaaggttcgagggcaactcagctctggagagtgtctttccctcttacctatcacgtggtctgtctcctagctgagaaatgctcccagtgcctctgaatccttactcaccagtttcatggcactgtttcccttaaaaatctcttgtttattcaccttaatggcgttgcagcatttagttgccacgctatgagggaagctattatggcagatggttccacaaataattaccttcatacttacttgtgtgctctatttatttttgctgattactggtgcattttttttgaacccattaaagccctaaagctctaccagtaggcacctaaataaaactctatcatcttgaaggagaagaatttagtatgtggttgttgagctactaaactctccccagccacactactgtttcagtcattgagagtttaacggaggagaaaatcagaatgtattgatttcctcttctgtcccttggaagaggcattccacgttgttttcatgatgttttgaagcacacacgatggtgccttttaaagtgtttgaggaaaagcaaatctgctgggtgagcatttagccagcttgccgttgaggtctggctctgtgttaatgtcaagctgtgggttagtatctggaggcagaaggagacgagacagcctttcccttctgggaagtgtgtatatctgaccacaagtcagattcaagtactgagttttccatgctgactaaaggactgcacccaagctctgtgaagacctatgcacatagg

SEQ ID NO: 58109 - DNA, 1113 bp, Bovine  19866881184841
ttcctgtggtcatgtatggatgtgagagttggactgtgaagaaggctgagtgccgaagaattgatgcttttgaactgtggtgttggagaagactcttgagagtcccttggactgcaaggagatccaaccagtccattctgaaggagatcagccctgggatttctttggaaggaatgatgctaaagctgaaactccagtactttggccacctcatgggaagagttgactcattggaaaagactctgatgctgggagggattgggggcaagaaaagaaggggacgacagaggatgagatggctggatgtcattactgactcgatggacatgagtctgggtgaactccgggagttggtgatggacagggaggcctggtgtgctgcgattcatggggttgcaaagagtcggacaggactgagtgactgatctgatctgatgtgaacatttttatggcacaaacatacaaaaaaaatcaaagaaaagaaattcaaaaaagcatattttactctttcagctgtttaaatgtcctgttttattttttaatttggaattttgttggtgctgttctccaaagaaactcaaatgtgaatcagaataaagagtactgcataaccctgtgtttggtccataaaaatagaaacatttgaaatttagcacacaatatcaggtgttcattatatgctacacatcacttaccatacaactcattactgataattaggctctaattagaatactgtggcacgtatacataatagaatattagtcagctataagaagggacacagtttggagtcagttcttacaggcgcatgaactatacagagtgaagtaagtcagaaaaagacaaatatcatgtattaacacatatatatggagtctagaaagacagtacccacaattctatgtgcagggcagcagacgagacacagacataaaggaaagacatttggagtcagtgggagaaggaaagggtgggatgatttgagacagtagcgttgaaacatgtacatttccatatgtagagtagatcaccagtgggggtttgatctatgatgcagggaacacaaaccctgtgctctgtgacaacctggggggcttggatggggcgggg

SEQ ID NO: 58110 - DNA, 727 bp, Bovine  19866881259237
tagaatggaataataaaaagtattgtttttcataactacaataacaatataagtaactgaagaatacttgatcgttttacaaaaggctttctcatagactatcaagtaaatgatggatgtcacggttacacaagccttctagtgtctgacaaggcgtccgtttggggccccggcctcagaatcagactccacagctttggagtccaaccatcgtgctttatggactctgtgatcccagtcaggtcacctggtcctccccgagcctccgtttcctcatctgtcaagtgagatgagcatcacagcttcctcatgggtggtggtgaggattcaacgagagagtactcagaatgcacttggctcagtgcccagcactttttgagggaagtgctcagttgctcactcgtgtccaattctaggtgaactcatggattatagcccgccaggctcctctgtccatgaaattttccaggcaagaataatggaatgggtggctcctcctggggatcttcctgacccagggatcacacccacgtctctttcgtctcctgcagtggcggcggattgtttacccctgtaccatctgggaagcccatccagcacttcctagtgacttatcagtgttggtggcctttattactgttattggtaatagaggctaccgtccaaggtgaggtgcgaaaccacgggcaagactgtgaacaaaacgtgggttctgactgcctcctga

SEQ ID NO: 58111 - DNA, 1420 bp, Bovine  19866881265668
tgagacgtaaaaccatcttatgttttaaaggcatgcaacattatgagaaatcttggaaatcttttgtactggatatgcaacctgtctcacaaatctcaacatttcgccttttaaactgtgtgacccaggagcaatgtattcatgggaacaatgggagacagttgagtgcctcagtttgtcttgctctactctaatttctacacgttatttagaaattctgaggaaaaaaagtagcagggctcccatggcaatcaacatcagctgccatgcaatcaagctcaaagagtttgcaggtgttttagggactttgctggggaatagttgacatttctgtataacgtgtcaaaccagggcaggagttgaaagagatcaaaatgaaatggagagtaaactcctagcacttggctaacatcacaaccaattaaacaaataacagatgctcactggaaactctgcggggagcaagctgtagacaactaaaaaaacaaaaatagccatcacagcttttaaaagaaatctgagttggctttgtgtgggtgaatgtgcatgtatgctggtgaatgagggtatgagtgtgaggtttaacaaggtttccaacaagatcttttcaagttgtttctgaagaaactactattctattacatctctattaaaagtatctgtgtagcagtagctttattttctgtaactaaatgcactttgggccagctttattacagaaaaagtaatgagtattttagcacagaatttaagtcggcatgaaaattccagagggggttaattagaaacagatcctatggcaaaagggaaactgaagccaaggttatttgccctggccaagttccaatcactctctggagttcttgctataaaaagataagatactccaattaaaataaatttatattaaaaaataaaaaagatgagatactgttgaagatgaaattattcccactcccaggtcttcatccaattttataaagtgtacagtaaaaatgtgcattttcttgacaacatggactactgacagtaagtaaaatattaagtctgtggcaaccctaaattcctattctcaacagtcaaaagattagtcttacctagaaaagttttgctcaaattgatttcctgttagtcgttcagtagtaagaaaaactatccaaatcttggaaataggtaaaaggatgattgcatgcctcttaatatagtgctggaatatgctgtaagagcacacctcaaggattatttatgtctctaagggatttgcttttctgatttgctatttactattgagtagggtctagagtttgcaaatgaatgctaatttatagatttttgtctgttggcatgcaaataattcggtcagatataaaaaataatcccaaataatatagctttattgccgtgcctgcatgcacgcatg

SEQ ID NO: 58112 - DNA, 837 bp, Bovine  19866881433489
agattgaagaacttgtgaagcaatctggtactagaatttgcactctcaatcaccaccctttgcatcttaggaaggctttcagctgaaatgtaagaacataaatgagaactgattttgcaccttgaagtttttcagaacaaagccattgaagaataaatgatggcacaaagcagtttatttgtgccatgccaacatttgcaaaccaattgtacttcagttgcagagcgtatgtccacatgactcttttgaatagaaagaggtaggtatttttttgttttttggttctttttttcccccagaaacaagtgtacagcagaaaatggagcaaacgatacatatgttaaaaatcttccctgaggctggaacaggtaggtaggcactctgtatgctcctgaggaaataataagaaaggaaataaatacactcctagcttttgaaagtttccgtctcggaagcttgccaaatacacgcagtatgcagtcttccaccaggccttggtgagggtttaattacgcggctgcgaagcatcattactgctaaccaggagaacttgctaactgaaagagacctggcagttcacttcctccacagatttcagatttttctttttcatttttgctttattaagttggaactctaatggaaccttccctggcactcatctcctagtaactctttgaactcacaccaccagagagaggtggcattgactgaaccttcacaatggcgaacacgagcaccgattaatcagttcccttgaaaagaaaattggaacaggtagagctggagactggctttcagacacaggagttggaatcattattctgaaataatctc

SEQ ID NO: 58113 - DNA, 1733 bp, Bovine  19866881480295
gatatctacaaagtcttaaagtatattcccgagtgaagttgctcagtcatgtccaactctttgtgatcctgtggactgaagcctaccaggctcctccatccatggaattttccaggcaaaaatactggagtattcccttctccagggggtcttcccgacgcagggattgaacccagttctccttcattgcaagcagatgctttaccttctgagtcaccagggaagccccattaaacataaaaggaaaaatagtaacgtacagcataaagagacctaagcaaagccatgttcaccaagtgatggaagttaacatcaccagtaaagagaaaaaaaagtctgaatagcctgtagataagatggttgaaaagtattaatattaattttcagaatttgttgtatgtactttggttatgaagtgaaaatatacacagggaattgcctggtggtccagtggttaggactccatgctttcaccgccaaagggcctgagctggatcactcatcagggaactaagatcccaggggtcatgcagcaggccaaaaaaaagaacaaggaaatatatgcaaaagtatccaggattaatgaggcactacatctgtaacttacagtaatccaggaaaaaaatttcgcgtgtgtgtgtgtgtgtgtgtgtgtgtagacagaatgaaagagggagagactggcaaagaaaatgttataaaatgttatcaatagctggaaaatcttaacatagaatatgtgagttcatcttgcaaaaattttgtgaagtttcaattatttcaatttttttaaaaattgaagttaccgttagatctaaacagtggcatattttctgaaataagattactcggtaaagtatttcaacttcatgattcttactataagcttcatgtttctatatgaattttataaaaggtttagagtagctcaagcaaatgcatgatcatactaacaacaagtaaaaagaaagatgaagagcatatttactttcaaggcttcctatttaaagacaggtgagttacaaaaaaaatttctaaagacactgccaaaacatagggatagtaaggtggtcatttctttataactagccataacattttaaagtatgaaagttgagagaaaagtgcatgtaaattctatcacttgataaaagatatcattcaaaacactaagtattttatagcagagatggtgggaaaatagaaaatgcagcagagtacatggttcccctttccagaagcttgccaactgaaaaaacccatctgggaaaactaggaaggaagatatcctccaaacacagcaggttttctcagccttggcacgacggatattttggaccaggtaattctttttgaaggggcactgtcctgggcatccctgtaaccctggcctctcttacccactgctggtagcaccccttaaaccgtaacaatcaaaaatgccttcagatgtttctaaagggttcctggattgggggaggggtgggatcaaattcatccctggttcacaccattgaaataaacccacacatgtttgtccaacgtgtgagaagtaacactctcctccccctggaagtagtccattctcacatcctggagtgctctctcatgtgcttctagaacattttaggtgtaatagagaaagaaagaaaaaaaaaagagagacacagagagagagatttaacccagagaaagaaaagtaagaggctttggcaaagtttcagctaaagttg

SEQ ID NO: 58114 - DNA, 3087 bp, Bovine  19866881506830
tttacttcccccaaacttggtgtggctggcgtcagtgtcatggtgatgctgcctaacaagggtgctgctcagctcaggtgatggaagcaaatgctgattcgtagcaaaatgtgttgtactagaaaaagcccagtgacagacaacaataaacatctacttctcacacacccggggtattcagctcagcatctctgctgatgttggctgaacacactcacacatctgggattctacgatggcctccgctagagtgataaagcaacttgtctctcgtcttcctcccaggatgagcagggtgtacctttttcacagcgatggtggaggccaaacgtaagcagacacacacgagcactttctcaccctctgcttcgtcaagcctggtaacatccactggccaaagcgctccacgtggctgagcccagaatcagagacgaggggattataatgtcatatgacagaggatatggatggggggggaagggaccgggggcctctaaagccagccatctactaccccttactttagacagaagacgttatggtcaattaggcgttttcttctttcatccctgcataattgaactcaaggaattaaagtgaattgcccagaggcacacaccttgactagtccagccagaatgcagacctgcagccaatccagtgctcttccaattccagtgtgccagttccctaaaaggcaccaaccacacaggcccccatttccctgtgcccacagtaggcctggtatgaaataactcaaaattcttgtaactgagcttggggtcacatggtgtacttatgagcagaggaaaatgcatggctaaatttaagtctgtgccactacctcctcagagtattttaaatagctcaataattataagctgtttgcctgattttactttcctgggaggttgtgacgcaggcttgaaaaagctgaagttgttacacgtacccagagtccccataaggataacacatctacatttcactaagtgcacatacatcgttcctatttatgctcaagtcaaagtaagcctatttttttctgcatttcatgctaaaaatcctcccctattccccaatctgtttagccatatgtgttggataactaggaacctggtggcaattctttatagattttatccccccccccccgctttttttttttttgtctcctgacttatctctacattaaataagtggctgctaaataggagaaatatctggagacagttttgactgtctcatcttggggattctactggcatatagtgagtagatgttaaggatgctactaaacatattacagtacaaaggacggtcccccacgagaaatgattcagtccaaaatgtcagcggtgctggtttgagaaatcctgcattaaatacgtgtcagtgcatggatcgctgataccaacaaacttatcacagaacatatttttgtttcttttacattaagacaatctactctgagaataatgctttacttaaactatagaaatagtaacagaccatgaatgttggtcccaagtttcatcattgctatgtctactacttctcttccctttaagtcacacagtagtcctgagggatgaggggtgggaggcagaaggatgcagggagcgtggaggaggctggacggacctgactttggatcccagctatgccgacgactagctggatggtgttggttacatttacttatgccccctctgctgcagtttccctttttgggaaaatgggaatatggccaactacctcacagggttatggggaaaattaatttagaagatctatataaattctctggcccagagtaagcactcagtaattaccaattcccagtcattcgtattaaaactcctcttaatttcaaatctgggtctcatatcctggtatttggggaccagccagacatggcaccccactccagtactcctgcctggaaaatcccatggatggaggagcctgataggctgcagtccatggggtcgctaagagtcagacacgactgaccgacttcactttcacttttcactttcatgcattggagaaggaaatggcaacccactccaatgttctttcctggagaatcccagggatgggggagcctggtgggctgccgtctatggggtcgcacagagtcggacacaactgaagtgacttagcagcagcagcagcagactctagaaagagccagcaagtacttaatgagaaaaaagtttctgccaatgagatcactggcttatattttcattcccaaaggatcaagttagttcatagggggcttccaggagcatctgaactgagctctgcccactcgttactaataagtttggtgtttatatgtcatatcacttgcatgttgaccagctgagaagtccaacaggggtttcaagaatggttacgtgcaagtctgaaaacagaagaagccagaagcaaatatattctaacacagccagagtttgtgatgcattctggaaaatgacggagaatatagtcctagggcagaatccactgaaccaatgttgatgaatccaggttagaaccaggctcacttttattcttcccagggccttttcagccttcagtgaaaatataaatgccctttaaatgtagctcctccaaaatcagtcttcttccaaatagactcgttgaagaggtgatgtgacattggttagtagcatgttaagtatcaaattgaaaagccttttcctgggttgtagtaggaatgtgtactgatgtatgatttcagagctattcataagactccaagtagttttgcaagccacactgtgacacaagcaagcactgtgacccagcaagtccacttctaagtgtctatcttgctaaaattctcaggcagttatgcaagtatatacccacaagaatattcgcttgtaatgttatttgtgaaaagggaaaactggaaataacttgaatacccatcagtggtaaatatagctaagtaaatgatggcccatctattcggtggaatactaaatttaagaaaatgatgaggtagctctatttacgtacacatactcaagagaaggttataaaatattgccgcatccagaaaacaaa

SEQ ID NO: 58115 - DNA, 1216 bp, Bovine  19866881517691
ttggctttgggctgctatataaagcacattcacactccaagcatttaaactgaggctggggattgggaggtgatacagtaagtgttacagtggccattaaaatgtcttaaacattaaggttccaaaaaatgggatatttagctatattaacatcgccaagttaaactggctgctttcccaagcatgagctctggtaattgccacttgatagaacagtgaccctaacgaactgacgtgtaagcaacagaaatgatggtcacatgcccccacacacacacatgcaccattaggtacacggagcctcaccaattgctcagaaaacggaaggcctgtgctttgctttggactcttacaagcatcagaaatgtttgcacaggtttcccctccacgtgaaaggatttaaaaagaaattaaaccatgcataggtgcaaaggttaacagcgtcagccgctagtggcgaatgagtcactgctgctctttgctgggcactgacctgagtgcttcagaagaaaccttctcaacaacactctggagcaaactcgggttcccaagttacagagagggcttaggatagtgatcagagcaggcagaaaccacccccacccccgcccgccggagatgcccacatcctcgtacggaacccaggggtaagctacctgacatggcgaaaagacccctgatgagcttcagcttggggtgttgacaaggggagatgatactagacgatccaagtggtaatcacaaggatccttgaagtcacaatggaatcacaaggatgcttaaaacatggaagagggagacagaaggtaaagtcaaattcaaagagagatttgaaggtattagattgccggctttgaagatggaggaaggggccacaagccacggtgtccaggcagcccctggaggctggaaaaggcaggaagtgggctctccagcaggaacacagccctactgacaccttgatattagcccaggggaccctttttggacctctgacctccagaactctaagacagaaaaattgtgttggtttaagcagcaatgggaagctaatacagtcaccacacattagtaaatgatggaggctggacttgagccctggtgtgctggcctccacagcccgtccagagcttgctcactgttgtcagttgagtgtcccccaccctccccaccctgggaataaaaagttgaaatcctaaccctcagtgtctgtcaa

SEQ ID NO: 58116 - DNA, 1266 bp, Bovine  19866881553509
gaaactgcttgtttcgttatcctgccttgagagtgacggtctttccccaactattcaagtgccccgtcagctcacccataggactcagggtggctgttcccacaggaaggtgctgaaatctgaaagtgtaggtcataaatctctggatactgggaagcctagttaccccagaatcccgtcccaccacatgccaacaattccacagtgcgatgggccccttttgcatttactggcctatttgcaaccaccacatgccactcagtcagtgtcgaagaaatgactccctcccctctgaaccttgttccctgccagtgctgtgggttttgatgagatgctcccttctttttactgttaactattgatgctttcaaattgtggtgctgaaaaagacccttgaaagtcactcagactgcaaggagaccaacccagtccatccgaaagaatatagaccctgaatagtcattggaaggactgatgctgaagctccaatcctttggcctccttatatgaagagctgactcattggaaaagaccctgatgctgggaaagattgaaggcaaaaggaaaagggggcggcagaggatgagatggttagatagtgtcactgactcaatggacatgggtttgagcaaacttcaggagataccagaggacagggaagcctggcgtgctgcagtcgatggggtcgcagagtcagacacaacttagcaactgagcaataacaacaatttccttttcccctccccacactattaacctttcaaagcgttaaagtgatccctgggttatcactggagcaactgcatggtacaagaagtcacggcatctttctggcagagggaaagggtttcccatgttacagcacctgcctcagttcctggatgctgggctcagggattttgatccctctctggaagacttccctgccccctggaaggcagttcacctgagagttggtctgggcttcccaatgggacccagcgcagcccctaaccacactggccctgtggactcccgttttctcaccagacgcccctccacccacccgcaatccactcctctcaggttcctcattaaagcaaaaatcgtcaggttcttttaatgtggctttttgtgtttcatttcctttgttggttaaaaaatgttgccagtgaaacattttataagatttctatacagtgcatacattttgaacattttgttcctattaacataaaatattattctcatttcctctcatgtgggaagaaagaaaaaaaagcattc

SEQ ID NO: 58117 - DNA, 1099 bp, Bovine  19866881751630
tacggtcttgaaatcgatgatgggaagtggcagatacacctgcagcataatatcaaagaacaaagcaagaaaggattatcttgtcactaaatataatggtatacattattttgttttattgtgtttaaaatctggtgtcagctgccatagaatgaactaggcaacagcaggtgtcttctgtaataacctgcaaagacatactgaattctcctctgtattctaaaaagagaatcacttgcaaggagtattttggctccttggagctatggagtcatttacctgctcaggatggcttacgggaggattctgagaatttcaggcaggcactttccccatggtggagcaattgctcatacggagtttaacttgtctctatggcttccaagatgcttttgaaatgttctatttagaggaggagaaggaaaaaaaaaagttgttttcaagcaagagatatatttaaaaaatttaaaaaaggatgtatgttttattccatctgatctttatttttaagctgcagtgtttaaagagatgtgcactcgccactcactgcctctcatcctgggtggcaaagtacaaaattgtgtcatttggcagctccatcattcacctgctgtggaagtttagaccaggtacttaatgtctctgttgtttcaactccatctgtaaaataaaggatgctgttagttgctcagtcatgtctgactctgcaaccccatggaccacagccctccaggctcctccgtccacagaattctccaggcaagagtactggagtgggttgccatttccttctccaggggatattcccgacccagggatcaaacccaggtctcccacattgcaggcaggctctttaccatctgagccaccagggaagaccccaaattaaaggacgagaaagtatttatttctaaggaataaatgaattgacaggtaaaatgctcagaacagcggtctttttctgtgctaaatactgtttgtgaggtccaaaggtcattgaacaaaatttctttttcttctgacgcatcttggttcaaagtgtggtgaaagttcctgttaaaaatgtgaacagtcggaatttactaaaacatttatcaaa

SEQ ID NO: 58118 - DNA, 599 bp, Bovine  19866881858446
tttgaaaggcgagctttcgaaatatgtaacaggatgttgaaatgagaaaagggaaagaggcagagagacattttattgaaaagcatagtgtagagcttagcttaaaattggacacttgcctttgatgggtctgcttttaaaataggaaattgattttcagttaaccaactgaaagaaaaatgcacagctacactctgctcttaattctgcaggcagtccttccttcctaactgactttcctggtaaaggcatttgaatactttgcaaatagaaggtgcatagggtttagcatgctgtgtcctgagcagttcaggctaagtttatgttgctgtgccttctgttttccccaggactgaaaaaggagcacttgcattaagacggggtacagctgagtggaaactgcatgtgcaggcagctctttgaatcgtgacgtgtaataagtgaattgcattctagtatatgaagtgtgacatgtgcgaattaattactgttactaaattgatttacattaaattgccagtgatttgtcattttaaattatctatggaaaaattattttggtttatggtccatttcaaatgaggaactttaagtaggca

SEQ ID NO: 58119 - DNA, 2563 bp, Bovine  19866880382584
aataaacacaccaatgtgaggataaacaagcagttaagaatgaatgaaatgtggctatttcacattgaagtttcacatgtgcatgtgtgctaagtcacttcagtcgtgtttgattctttgtgactctgtggactgcagcaacccactgggttgccatgccctcctccaggggatcttcccagcccagctatggaacccatgtctcttacgtctcctacactggcaggtagaatctttaccactagtgccacctgggaagcccaggcttcatgtaagtctatccataggttctggctaggaaacaaaatgcatttaggatgaggacacaacttttataaatataagaactggctggatacatggagatgaaaaagttcatcccaaagtaacggttctattagaaagtgaaatgaagaaaactgtgggaggagcaagtttttagatggacacactaacaaatgatggcatgttgcaacatactttagccatctcaggtagacggcaaatggctgtggataaaatatcacttggttaatgaggaagataaagtatgaatagtcacaagggtgagatggggttatgtgctgtgtcatttactaaaatattagaaggagcacaggatttaagactcagaaaaaatacagtatttcatatttccccaaaattgaccttaaagaaatttagctttaaaaagtcagtaagtggaaatttaaatatagcattgtatgcaatatcaactatagaaaggtacaataaaagaaaagaatgtatgataaaagatagtgactccacagccaacagccataaacagaaagatataaaaaggtcgatcatcttctaaatatatacttttaaatagataataaataaaatatttgaaatgaaaaaaaagtatgtggcaactaaagaaaccaaagggattgcataagaatgtctctcacatatttgcatttttagacattaaaatacaatatgatctaggatctatctatccttgatgtttatatgtgtatgtgactacatgctcagtcatgtttgactcactgcaaccccatggactgtagccatcaggctcctctgtccatgggatttcccaggcaagaatactggagtgggttgacatttccctctctatgtgaataagtgtatatatgtgtaagtatacatgtattcatgtatatatgtgtgcgtgtgtctatttgtgtatttatgtgtgtgtgtgtgtgtgtgtactagaacttactgtggtcttgataaattaattgataaattagtgtcagatccaaaaaaaggaattaggatcctgtgattagagttatagacagggagattacaacaagatatcaagatatcaaataacaacaaaactatccagtcatttaatgggatggtttgcttatcatccaaaggagggtttgagcagatactgagtgaccagatggagggaatggtgtagagagaactctagaaacatatgggtggttgaactaaaaatgttccaggtccttttctgggattttctttcatccaacattcatcccacgcatcatacaagtccctaagaattttttttttctaatttattcaactaactgattgtttccattattctccacatctgggtactcttgacttttcagtcacaacattcatgactttcctcttcatcttcactccgtaaagggcacttaacgtttccatgcttcattttgctggctagttaatgtgtctaatcaaattaagttgcagttggatgccaccaacttttactcagtactctcatgactaaaaaggatacttcattattatattcattttcaactttcaaatatagagctaattcacttactgtgaacacttaaaccaagaaaagactattgcctgggcagaatgcctggtttgataggtctgctggattagtccgttatattgaatcacaaagacaataaaaagcaaccaaacagcaacaacaaaagcatataattgggttaatactgatcttcagaaaatgatgttttaaaatctctcccttcaactcatgcctacacttatcaactctcatagccaggaaattatggtttatatctctcctcagtttctcaccctgtagtataaagtcatttcctttgtcttgattctctgcagctgggtatctcaatagcaaagtgatattattttccacaaaatgagaaacagaataaggtcatatcaaccatagagatcatgtgtaacactggccataatgatggactccaagatgcatcataaaacaggttggcagctacacttgctgtgctgaaaacacaatattttgatagcaatagcatgcccagtttgctcaaataaaagatgttaacagccacatattttcatgtattggatggcaacagttaaaatgaaagtgaaatacattttgtgcagatcaataacactccccaaacaacttactcaccatttactacttcttactatagtaaggcaagtgctagaaatagcatgctattctaaatcatgctagaaatagatatagtcctaatgtactagtgaaaacattaaattgatt

SEQ ID NO: 58120 - DNA, 3014 bp, Bovine  19866880439479
tgcttttttgctttctttttcctggggatggttttgatccctgtctcctgtacaatgttacaaacctctttccatagttcatcaggcactctatctatcagatctagtcccttaagtctatttgtcacttccactgtataattataaggggtttgatttaggtcatacctgaatggtctagtggttttccctactttcttcaattttagtctgaatttggcaataaggagttcatgatctgagccacagtctgctccccgtcttgtttttgctgactgtatagagcttctccatctttggctgcaaagtataatcaatctgatttctgtgttggccatctggtgatgtccatgtgtatagtcttctcttgttctgttgaaagagggtgtttgctatgaccagtgccttcctttggcaaaactctattagcctttgccctggttcattctgtacttcaaggccgaatttgcctgttactccaggtgtttcctgacttcctacttttgcattccagtcctctataataaagttgaaaaagtaactttctcaaatataagcaaaagtttaaactataatataagggaaagcatctgtttctttgtttaatgatatatatctgcttggttatgctgtgtcctgacataattggatttctgttaacaatggactcctaacagataacatattttctagtttaaaatcattgaacctgtcatcatataaatattcctcaaaaataaatataggacagaaaaaaaagtgaagacatgaaagaagctaaatttcctatggagtctatttttgttttttttcaatcttcaaaaagttcatttttagtagcaaagagagaagtcagtttatagatccctgaatgctttagaagagactctgcttttaacgtgaatagtgagacagataattttctaactatgaaattgctaactagtttttgaccttggggaccacttaaaacaagtaccctctgctctcctggtgggcttggagcaaaggcagctgtattttgcacagcacactgaatcgtaatgggccatgtgctgttatgaatattcataaagctaccatattctgcctgccccaagatgattccagtggatgctgctggagggatttgaaatatcacttttgtagtatccttgaaaagaatacacacaccaggaaaaatagaactggagcccaggtaattctgtccttagtgtgcacttcagagctctcctccgaacgattttgccctgtagcaatggcacagaaatctattgtaatgacagagatgagaggtttaaactttctgagaatcttaaaacaggttaaattaaaatctaagtggtcaccatggcatgctactgactgacgcacttcctcatatgtgaaaagaactggtctgattctgtatgacagcagcggtcactggaggttgtgatttcctgatgatacatttaactaaaattatagctgctttcaaattacaaccaaagataccaggacactcttgataaggcagatgattatgtttcaacacagacattttcacctatgctttcaagttaattcagtacttctcattacactcccgaccctttatgttaggctatgctgactataaagcttatttctatacctcttcctacacttcattttttattccacagtggaaattgaaatcaaacaagcatagcccacatcggttcagttcagttcagtccgctcagtcatgtcacatacttgcatgctggagcatcctcgagatgcctttgtagagaggatcttggtgcttgtgcattcatctgctgttgttgatggagcattaggttgttggtgtagaaccttgtcccgggtcgagctctgtatctctgcttcagcacataacccgtagtctcgccacacattcacagccacacctttgtccacaatgattggcagattctcgtttcctttctgcttcagtggtgcacattttgaatagtttatttttcacattttcctttgattttctctttgctctaaaggagttctggattatattgttactattttattatatgtgttatatatacactattgtataatatgtgacattactcccattatgttgttcacattattatgttccctttgtacacaatattgttcagtgtcgctctgtttactatggtaaaggagaggactttggggtgaatttagtaatattccacctcaaattcagaatcttattcgaattgttaaatgcacatcaaagttactttctgagtctctgcaggagggattgagttctggggaatttccctagctgttcaaactcataagagtcggatacactaaggataatagaagtttcttaatttaatatttgagagtctgtctggcagtcagtaaattattcatggaatcattttttctacatggcgcatattttgttagttttctaatgaaggtgctctaacaaaaacccacaaagcgattgaaacaacagagatgtgttgtctcccaagtagctttggaggttagaagtctgaatcgggttgtcagcagggttggttctttctgaggcagaatctgttccatgcctcttcctagcttccagagttctctttgtcttcatgccatcttccatctccatgtatctatctctgtgtccagattctcccttttctaagtattcctgtcatattggattagagacaactctaatgatctcatcagacttgatcatgtgcaaagaccctattttcaaataaggtcacagttacaggtactggtggttaggacttcaacgtctgttttggaaggttacaatgtaacctgtaacaattagtctatcatctgatgatgaaaactgctgtaattctataacccccttgggtcattataagactgattttttatatccctttggaagctgatatttggatgagggcctctaacttattttacccttagctagaaataacaccaaataatagtaaagtctttctagtgtaaaaatattatttcactca

SEQ ID NO: 58121 - DNA, 1926 bp, Bovine  19866880690774
catttttatcactgttatttcacattcagatgtttaatgcagatgggatttattttactctcgtgtaaattcaagttaaaacacatacacaaattgtcccaaagtctttacactcaagaaaaaaaaaaaaaaaaacaattaacatttggtgaatatcacgacagttatgtatagatttgcacaaatgaaaagatcaatatattgagagacatatacttgctatttattattagtatattatacataactaaacagaaacaatagagaaggcaatggcaccccactccagtactcttgcctggaaaatcccatggacagaggatgcctggtaggctgcagaccatggggttgcgaagagtcagacacgactgagcaacttcactttcacttttccctttcatgcattggagaatgaaatggcaacccactccagtgttcttgcctggagaatcccagggacgggggagcctggtgggctgccgtctatggggctgcacagagtcggacacgactgaagcgacttagcagcagcagcagcaaacagaaacaaattggaaagaactgctgaccttaaatattttttcaccatgagaaaggtttttttctaaacttacctttatagttaagaataaaagatgaataccattaagaagctggatgcattagccccatgttttaatttcagaccgtgttcattaactccctgccgtgcgttttgaggtgattagctttcctccaatttgtcttcacccctattcattttcagggtttttttttaataattacatacttaactttgtcagagttcataatatttacattctgttctgctagtttaattgccttggcactttggtcttaattttacatacagatggctgtcagtctcaccaccagtccttcttttattatggattatccaggactgattttactattcaaatcattcttccttacttgtatttcattgttaattagttttgtttgtttgtttgctattccttgaaatatttcccgtgaaaggcttctgttgtctttattcttttctggaatattattaatggttcctctcttcttttcctgttacttcattgctctacaaaattctagcaccggatattgctattaaaagtctcaggaaagcctggtatttttctcctgttgatgccaggcatgttctgcctggatgcctgatacatttttgccatttcacttctttcatttcagggaccttttccatattatatcactcaatatcattcagttccatttgttgaggtcttcagagaaagcaataattcttatgatctttttaatcctctgcagctatcataatttctctattttaaactttgtatgttttctctgatagaaggaagttattatctagagtctttcttctatgccattagtttatttttctccatattaatgttgcctttgctctatataattcgtgtattttatttacaagggtgttgtcagaatttgccttaggtccatatagtcttttaaatattttattgtctttgagctctggttttattaaaatcaaaagttttaaatactagaactgacagcactttccttacctagttcgcattatccctaatgagcctctaccacatatgaggtagagaattactgtctagcagctttgtttccctggagacattgctgatgggaaggggcagccaaactgagttcatgcttgtatcaaccagatttggactatactagttcaatggggacttggtggccctttctgcctctgtagatgtcttccaatgacatattcagtcggggtggtttttttttttttttttttttccccagtactgtctactctaccaccttctttcctctatccaaattagttgatttggattaaacttttctttatattttcagaatatatcatcattc

SEQ ID NO: 58122 - DNA, 1190 bp, Bovine  19866880979442
accacctgcttttaaaaaatgaaaaatgcttgttcccaagatgcctgttgtgagaatatatactcgtatctcattgacattaatggaatcatgaatccatctccaaacaaaaaaccatcaacagcttgaagggatgtatgtgctgactacattggaagaaagatctgaggacaagttcagcttccacagagttacacagactgcatggggaagggatgaatgcctgaaaagtgatacgaatggataatggaaaacccaaactattaagtgacttttcctatatatttttggaaatattagtatatcctacaattcttgaaggagaatttatttagactcataatgttctgcattatgagtctaaataaaaataatagagaaatactgtaaatgtgctcatttcaaatagtgaaaatatataccagagcagaaggaaatgtgtgttgcccattaaataactagtgccttaccttaacattctagaatgctgctggaaaatcataccagtaggagaaaatgcactagaaaattgttggtatatgtttgaaggaataaattcatcatataaggttttaatgtaactaaagattttcctaagctaatccaagggatccacaagaagcctgaaattttatgttcagcagaactgtttacaaccagaaattaagctcattttagtataaggagctttgcatataagctgattttagggactgctgaaattcaaaatgtaaatggctttaatctaatggtgttcctgctttgtaacaaatgcagtgcagcctgtatcttcgtttccattatcttttttttttttttccaattcactttgttaagaccccaagtagccaaaatattggaccacacacatttctcaactgtttggctcacagaggtaattttaattcctttatagctggaaaatctgtctggatggggagatgcttctaattaaaaaaagaaaagagctgtctctcagtacacacacatggctggtggctacatatttccaatcagaatgcaggtatatgaatcagtctgttttgttaggattctaagaattattgaagatattttgagaatttctaaatttcttcaaggattttcatttgtcttttagacacctaaatcagtattttctcttcttttatttctatgtctgatgctgccaacaaataaaataataaatc

SEQ ID NO: 58123 - DNA, 1432 bp, Bovine  19866881067257
tctaaatatatttatactcctcaatggggccagtttggtttcccagtcatctgagacacaaagaaagcttaagataatggccaaggtttcccttccagataagatatacatcactcttatcagtcacagattgagtgagtctagattttagccatgatgatcaagtcacagtatgacctgtcatttaaaaacagtgtagtttcataaaattttgtccaaaatcaaagttgaaggtcaggatagagatggatataatatcgtagtacaaggaaaaaatattgaaacggctcatacaaataatggtagtgaacatcatttagggatcagcaagtgtcaggtactaagttcagaactttgtagaagagtttatttaaacctaaattggtactgatagatccactatgtgtgggggaaagcatggctaaaagatattaactaactaacttgtcacgtaccagtaagtggtgaagctagatgacacctagatgagagtctccataagcctgtatccttgagcattaaatggttgtattattatcacactggctactgatcatgtatgtgaattttatcctgcttcaagtcatttcttcttcccatctatatactatagtcctccagtgtgcccattttcctaagcaatttaaaagatgtttaaagactgagtcatttcaccctattctggatgagatgagaaaagtagcaaggcccatctgtcattcataccatttttctctaaaaccacttgtgattcacggtaataattcccagatggaagtcattaaagtttaatttgtatgcatatgtgacatcttgcttttcaaaatctttttgacttcactctttccattactgaaactaattgatatatatatatatatatatgagaaataactaattaaaatgagtgtaaaacagttctctcaaatataaaacatgctataaaatgctaataaaactataagaatatatgaaaaaaaatctgtcaattagaaaattaacttcagatgggaaagtaaatatcatttatcctttacaatgtccaaataaatgacttgtttggcagctcaatgccttatttcttaatattaataaaatttcgagaaaaatagtctttctttcataaggcccacagaataaaactttgaagatgataattataaattaaattggaaagaaaacctccaagtagctatttgctggggccatattgtgattatgattaaataaacataaatcactagttggcaaattgtatcagaatagaagagcttccttctcatctatgagcgactcctggctaagtgataggaaagggagaggatgcaatttagaggcacgacctgttcatcaggggaggcagacacagtgagtaaatgagcagaaccaaggggccagacaattacggttggaaacatcagaagagacacag

SEQ ID NO: 58124 - DNA, 857 bp, Bovine  19866881250987
tttaaaatcttttaacacattctaaaaatagttgaaactgtctaagaatatgtgtaagcagttcatagctgcttacagtttaacttttgaaaatgctgtaatattggaaaatacgacgctacctcaggtatttaaaggcaaccatgagttgttttgaattctctaatctattgctgtgacttaggtttcagcatttccaaaaggttgatgacagtttttttttgaggctgttaatttttaactgaagtgtataaagatattctagacctatcacttaatgttactgaagttgttgctgttactgcagtctcatgaaattttggttcaattttcaaagaaaaaaaaaggaggtatttttattaccaagcactttccataaccgttattatttaagccatatagaaatatctacttattaataattaaaattaaatgtacatttgtatatcacatgcaaatgaccctagttaaaagtttgaattatttgtttattatacaattatctttcaccagatatgcttagatgcaggtgaatttatcccttctttcacattcattctgaaacattctctatggtagtgttataccacatgccaggtaaaaggtggttaatgcaaaactttccccttctgccaaaagttcatggtctaattggagaggttctgaaaaatattctgctggaagctagtcataacgggtcgcatctggggctatcaatccattaagatgaaaggcttccaaacactgtagagtatattttcacctatcattatgacagatactaaatgagataaagaccacagcctgtctcgaggattcaaagtccatctgtctgaagggacaggttttatctctct

SEQ ID NO: 58125 - DNA, 1754 bp, Bovine  19866881404391
cgtgtttctagggattttagtggatagttaatggtgatcactcacaagtatgttgtgaattttatgcaaatatttttaaaaaactattttatcttccacatttagaaaagtcacaaagtcatgtgaagcactccacatattttgctctagtgaaagaataaatatatcacctgtaaaaatctcataatgcacttgcaccaacaataatacaccaaaagtaagacaatgatatagaatacatataaagcatctctgtaaatcttacctcaaaacagtgggaccgattctcccactgtagaaaacaaacgacagtagccagaattctgtgtaaagtgagacagcaatccacctgtattacggttccacttgtattacagtttaccatgaatatattcttcctcatcttagaactgtcattaaaaatggcttttcttcaaacttcttccattagtaatgagctcataaagacaaagagcaaaagcttttcagggccatattctttaaaaagggaaccgctgacttcctaaagataataggaatcacctaatcttttatttgataaggggataaatcaaatcactcttactgtatttttttcaggaaaattagtagatttcaaaatgtaacacagaaagctaatgactcagcagtattattagttaaagtagtattggataatattgaaggcctgcttatgaatagattcacctatacactatttttacatgttttaatattatattatgtaaactatgtttatttactctttgtccactgttgaattcaaaagtatgaaaattatcctgaacactatttttttaacaaaatatctagaaatatatcatattaatacagataagaattttataatgagataaattatcttcatgcaaaaggctattttacttcttagtatatagggaattttaagaaaagtgaattcatatgatttatgtgattttattagactcgactaggtacgctattttccttagagctctaacatgagaaattcagatactctcaaaaatgacaggggatacctaacttggaggaaaaagataaattccctaggcctactcaagtctttattcacattgagaataaaccacacacattcatgtattacatcaaaaatcttctttaaaaaagctcttatttaaatagtgatataacttaagtacttgcagcctacatttgctacctaacttgaatggaagattagatttaaatcaagatattaagaaacaggaaattgggcagaatagtaaaagcaatgaaaattgctttacagttaagttttaacatttacttatagcatttcttgaagatcaaagccagttctaatacgaaaagtcctggaacagctcatcctctgcccagagaagcaggcatgtctcatctctactattaattggagaccctgcaacttttgcatcctgtgggtgtggtggactaaagagtaccaaccagctgggacctatgccatatctaggataaaatctggagacatgtggcaaatattcattaaaatatgatcctcattcctgataaatggtaatactggtatgaaaacttgctttaggcagtataaatctgagaagttctttatgaaattataagcaggcaagcataatctggccctatcttctgacatagttcaaactggactgaaactttaaaaccataggtaggaatccatggtgacttctcaagtccctctccccaacttgtatcaaatttggtttagttgt

SEQ ID NO: 58126 - DNA, 1658 bp, Bovine  19866881433499
gtcacctccacaaggagaccttccccaaacatcctatctaagacaactccctgactttaatcactccttattacagcagcctggtttattttctcagtagcatttacaatgatctgggattactctgttcatttatttcttatctgtctcctccagcatgcagaaccgtgccggcacataatattgctcaagaatattgctcaaaaatatatatgaaatgcattgaaggaatggaaggaaaccatatattattattaatctggtatttttggagaataattaaatatatttaatttaagaggaattattttggctaaattccctagaaacttttgctaattaagaaaatagtatgtgtagaatggccacctgatgtgaacagtggatcactggaaaagagggcgtctgccttcattctctccctgatgctgggaaagatagagggtagaaggagaagagggcatcagaggacgagatgaatggatggcatcaccgatgcaacggacgtgaacttgtgcaaactttgggagatggtgagggacagggaggcctagtgtgctgtagtccatggggtcacaaagagtcagacacgacttggcgagtgaacagcagcaaatataatgtggaaagcaggaacacaggactgggcaagagaagaagctagtccttaacaccctacaactggggcttcagctgatcctgcaaggaagatctcagggaccaactgctgctgggagttcagcatcagttcagttttctggaagtgaagaaagtggactctggaaccagactatatgagttttaatctcatgcatcctgttaatagtaagctgtgtgatttgatcaagttagtcaacctctctgtgcctgagttttctgtgaaatgggtttaatgataatacttgtggacttactttgataattgagttgatgtaagtgaagatcttagaaaattttaagcactataggagtctgcctgctatcattagccatagtgaaaagaaataaagtgtaagttgctcacttgtgtctgactccttttgacctcagggactgtagccatgggattctcctggcaagaacactggagtgggtagccattcccttctccaggggaacccaggaaaggaacctgtgtttcctgcattgcaggcagattctttaccgtctgagccatgtacagtagtaggagtagcattcgttttgtaaggggaggtcaagtagaagaaactctttactgagattatcctaatttatattgggtggtatagatgatcagtcaaggtaacatttcattctagcatcttaattttaataagcattatcacttgatttatcggtataggcaggtgcttccacatgtcatgacattcatgaagctgctgctgggcgataagcacaattaaattacccgcagcatctggccctttaaccagtcactgacaggacattaaggttttatattggtttcctcttagctttctgacattccaacagctcattaactctggtcaaaaaagtactattctagatatgaatatttcagatgaacataaaaataaatagtgaatttaatgtcttctattaattacatcattttacattgatatttattgaatatatacattaataagtaatctgaactctacaatatacat

SEQ ID NO: 58127 - DNA, 919 bp, Bovine  19866881524918
cctttacagacatgtaagtgagattcatgtactcttgaaagtttcagaggctggtaggatgaaagtgactatacaaaccatattctaaatttaaagaaaattgatgtagagtctcaatcttttccacttataaaacaaagctagtggacttcataatttctaattgccttaggttgtaaatacctgtggtttttagaaaataaataatttacatgtgaaaagtgtaacatctggcaaaaatacaataaggcacttgtggaatatgcaacagagttacagaaccatgacctgtttatgctgcatcccaaagattcaagatcggtgtatcaaagctgctcctcttgggcagtgatccattgcccgaattatttaatataatgctccatttttgggtagtcgaaaacctcaggaggatacaaattctgctcattattgctgtgttttgctcgttttgctgtatttgtcacttattatttcatatttatttactcatgctgagttacattagtcagtaaattatttccctggactctgattctgacaacgttatatgaattcagttatattctcctaacttatcctgtcttcaggattttctttcccagcatttgcaagcttcagcactcttactccttgcttcctcttcagccttagaaataaaaaatgagccaccgtggtttccatattgattctcatggtacctcgcttgtcactgtgctcagggttgaaacccttcctttctctgagtcagttgtctctgaactagctattctatatcacagacagtgcttgttaaccttggggattaatgtttggttggtgatatatttttaaaacctcactgaaattcaggtactgtaattatggctggggtttacttcagtcagatctgaggtattattcctttataaaaatgctg

SEQ ID NO: 58128 - DNA, 694 bp, Bovine  19866881577707
aacccaggtctctggcattgcaggcagattctgagccactaaagaagcccatataactatctatctatctatatatagatagagagagagagagaacctgcctgtcagtgcaggagacatgagttcaatccctgggtcaggaaattccctgaagaaggaaatggaaacccactcccaggagtcttgcttgggaaatcgcttggacatagaagcctggcaagctacagtccatgtggtcacaaaaaagtcaaacacggatatcgactgaacaacaatatatgccaatccaggcatgataaaagctaaagctaagtattttacccttggataaatttttaaaaagacaaaatttgtgtgtgcttgaagttccaggctttacgtaaatttctgatatcagaatctccccactaagtttgactctaatattttatgaccttcataacatagttgaagatcaatgaactcaagatttattcctacagatttctcttcatagaataaagctgaaagaaaggtataagattattagcggaaagtgggtagagaaagtacaggatcccagaagttcagactccttgaagaaaaaaaagaacttaattctcagaatcattctccaagtcaaatttcctgttttttcaatctgtaattcctatgttatcaggtcattccttttttatacgagagatgaaaactg

SEQ ID NO: 58129 - DNA, 682 bp, Bovine  19866881916918
cagagaaagagcaaagggcaagtccacctcttcatggaaatgggctgaaaattgtaaacatcattttcattcataacctcattgccacatgaaggtgtgaaggagctggaaaaaagtgtaatctctagctgagattctataaaaaggaaagacgagcatatattttgggtaaaattttgaaatctctgtctaaagacacacatggtaattttttttccttctatggtcctcatgaggtgtaactcacttgttcctattgtcttgagagagacagagatcaaaggtatctgtcatcttggcttgttacacgctcaacagtgggatggccgcctacttcttgggatgttttacctcatgcaaagtaaagatgttccttttaattacaacaatattcaaatactcattctgtactttctctttattaattgtggttggtgcagactaatgtggtctgaatgttgcttcccaacaacttaattcacttctcaagcttgatttgactttcttttttctttacatcggtgttatattctttgtggtgagttcgttggttattttgccttcttgtgtctgcgtttttttaattaaaataacactttatgataagacattgctaagttcaaagcaactaaattgagttctaataaggaaggcccacagaggtggtttgtgttttggtgtg

SEQ ID NO: 58130 - DNA, 703 bp, Bovine  19866880446568
gtatgagtaaatgtaaaggtcatgcaggtgccctattaggtagatgttttaagcttaatctagtttagcattgactatgatgtttcctttctcacttagaactctaatgggctttacccattatcttgctcattaatgagcaagcatttcagaagattaaaagagagtggtaagagttgaaaattattcccacttgtgttcttcattctaactctacatttaattgggggagctaatgcttttctatttcagttttctattcatgactgtttatgaatagaaatgcagtatggtttttgacatttcatgtaagccacaccaaatttgtattctacatttatttaagcaagtttcataaactgttgctgcatgaataagctctatgtttagtatgcaaaattcacctctgaatttcagcttttgaaattaatttctgagtgtttttacacatgagcttctcattgaaattgccattcatgctgatgtcaatgaagtacaccaagaaattgtacgatgaaattctgaataagccattctagataattaaaaaaaaaagttaagctaaaagcatactaaatgagccaattatttgtagaaataaaatgaagcaaatatttaatcatagcagataggatgtaaggtcttttggggtacaagagggataagttagggagagtgttttagttaattttcccacttgagg

SEQ ID NO: 58131 - DNA, 1769 bp, Bovine  19866880523983
ttgataaagaaactaggtaagatgaataatgagtagtgttagtgtctaaaattgtatactaagtaaaaattgaaactatcattaattaatcacaaattcaacaaataccccaaaactatttttagctttatgcttcttttcataattttttttttttttgccaatgagtaaaccaaatttctgtgggattcagagagataataatgcaattttttattggactatgacactaacaatacaataaacctaacttggtggtttttattaaaatatatttctatttttatagaattttaaatatatttttaatatttttatgtatttctctctatataaaatctctctattttataattcttacagcccagtgagtgatacttattcagtatacttattcattttacttattcaataagtgatacttattcatttttccccctattgtgtatttaagagtggaaaaatcaatatatatttaaaactcattttcaaatacttgttttgaaattcatgttttgagatatttgaatgaatatatggctaagtgctattttaactatcagacatttatgagaactaattatttcatagcataaaaataatttggaaaacatatacagaagataaaatgcttctcaaaacagttgtttattaatgtattttgaaaataaattgtgagctatttccatcatgtttttgaaagttggtacaaattaaaatgtcacagaagtaattgttgagggctgccaccaaaatatgaagtgtgcccttctagaaatttagtaacacattctcttatcctcatttaataacacattctcttatcctcatttaataacacattctcttatcctcattgtattaatttctccatccaagaaagggctaacttgtcaaagccttttttttttttttgaagggaaaaaaagatggcagagaaggaggactttgagctcacttactcccacaaacacatcaaaaatatatctgcatgtggagcaactctagctgtaaagaaattggacactggcaggcagctcttccacaagcaagactgtaagaaagacccacacaaagataggtaagaaaggaggcaaagaaatcagagtttgaactacatattgaacacctcattcctggggtctcacattgagaagacacatcactttagctggtttgaagatgggactgtaagaaactgagattttacttttgaagaatgcacacacatccacttgtttttgggaaaatgggaaggaagcagattgaaaactctctgggattctggctagtttttttttatgaccatcctagagctttaatacagatttaatgcaattcctaccaaaatacagtgatatttttcacagaactagagcaaataatcccaaaatgtatatggaaccaaaaaagatcccgaatagctgaaacaatcttgagaaaaaagaataaaacaggaggtaatcacactccctgacattattatactaaacagctacagtcatcaaaacagtatggtactggcaccaaaaagacaaacagatcaatggaacagactaaagaccccagaaacaaacccatgtacctatggtcaattaagctacaataaagagacaagaatatataatggagaaaggacagtctttttaccaagtcgtgctgggaaaattggacagttatatgtaaaagaatgaaattagaacattttgtcagaccttatacacaaataagtgttaaagacggaaagtattaaaggtggaaaccataaa

SEQ ID NO: 58132 - DNA, 1691 bp, Bovine  19866880695247
agtatgtttgaatttagaagagaaaaatatgagatacactatgtaaaagatactttcatgagaatctctttgaaaaagcagacttaagatttagagtatttttaattttataatgtgaccgaatgaagatcatatttttgttaatttaggagaatttcaataaattttaatgcatttttcccccacaggtcaatgagaaaaataatcggtacaaaaactcctttgtgaagtaaatataaatataaaacaaaatttatttttaaagcatacagttgtgtaaaacatgctcattaaaatcttaacattcatatctctattataaagacaatgcaaatcattattaaattaataaattacctgaaaattataattttaagcactattagctattattacattgatgtttaaaaacataataacaatatatgatgtttaaaactgggtatttcatgtgattagttgttgatcattttcatgttcattcttttgtcctttgaaatcttagcatttgattcatttccaatgaaagattttcagtttttaacatctgagcatttttccaagaacaataatataacaaaagataatacaaataaaagtaccgaaatgagttcaggacaaacttattcaaagcctcaatagacttttgttgatcagaacatcaatgccaccatcactaagatgcagccttcacatagctgggaattaaaattgcctacgggcaaaataaaacatcataaaacacagaccaaaacttaccataatagtggttacaacaactgttctgttttcaatagctgctgtgtcattgccaagtgtgggtacatcttgaatcaagactaatttatccatatcattccagtatccaacctgccaaatagaaaaaaatcttgaaagcacattttagaagagttttctctagttcttattggaacaatgagaattattaataagaaaacaaaacaaatttatgaagcacacacaaaaaaatgtgtttggaagttttcttaattgatgatgagccagttttcctaatgttaataatactacttacttacacatttgccaactttacaatttattaatacactcatggactagctaagacattgagaatgaatgggttcaaaaaggaatatggatacagatggaatgccattttgttctgatgctcttgtagtgaaattgattggaaacttctatacttagtttacatgatttttatcaataatgttacagattttatagtaaggagaatagatttacatggggcacatgtacaggatgttttaaaaacatagatttgtgtattttaaagcaatatagaaatagttttttggtttcatatgtacaggatgttttaaaaacatagatttgtgtattttaaagcaatatagaaatagttttttggtttcatataacctagcctctagataaactagaggctagtttatcatttctaaaatgctaaatatatcaaatgttaatgattatttaatattttcacttttgaaaattttaaatttgtatttttaaaatttcaaatccttatattactcgtttagactcgaagcaaactcttttccataaaatatattaagtaattagttaagcactatacaatgttacaaactaaaatgggattctactggaaatttaggattcttttcagaatgcagactacttcttta

SEQ ID NO: 58133 - DNA, 1351 bp, Bovine  19866880737441
tgatgcgaagagctgactgattggaaaagaccctgattctggggaagattgaaggcagaaggagaaggggacgacagaggatgagatggttggatggcatcactgactcgatggacatgagtttgagtaagctccgggagctggtgatggacaggaaggcctggtgtgctgcagtgcatggggctgcaaagagttggacacgactgagcgactgaactcaacatgtagcaaaatgttgtccatgtcctagtgctagaaaagagcctcatacatgttgtgcattaataatactggctttttctccttcttgcgggatgaaagaggctttgttttagtagaatttggaaatggtgtcagaaatccaaggtttcattactatagcaacaaaaagtaatggacagactaaatatcagcagattcattgttgccttagtgacaatcagttgccttaccaaatatgtttattgttatattttggttccacattttaaatatgcttactctatatgaatgttccaaaagggagaaaaagttgaaaatgatttaagacagagaaaagtcctttaagagatgaaagcaatttgtttcactctccattatttagtaggaagccatagtccacaaaaatcctacagggtaaatagaagtaatcatttctgttcaaatattcaatcaattctgtttaaattctattctatttgcagtcagagaaattgaagcatgcagtcaaaggcatgtctgtattgtcatttcatgctatttcaaattattttttttctaaacttctgagaatagggaattctgtcacattgaaatggaggactttttaagcagtagaattgaagactgcatatgcctgccagatagctgaacctgagacaggattattaaagcaagcaagggtttaatttagctcctttgattatcttttccttttcctttcagccgcctccttcctttgctgagaaagcattctcattatagtaacttatcaaggccctctccatcccacaacatcctaatgaccctgatttacacctttctctaccttttcccaaaattatttcctctagactaaacctagggaggacagtgctcacttttaccttttaaaatgtagttcattttttaaaaattgggttgtttatatttttgatgttgagttgtagaaactgcttatacatgctgaattttaacccccagtttggtcttatcatttgcaaatatttccccctattctgtaggttgccttttcattttgacaatggtttcctctgctgtgtaaaaacttctaagtttaatcacatccaattttttaattttgcttttatttctttgtttagaagacata

SEQ ID NO: 58134 - DNA, 2032 bp, Bovine  19866880861157
tccttacttattgtaaatattttgcaatatagttgttttctgagtggaatagttactagtagttattcacatttgaaataattttaaaaatatataatttattcagggacattcatatgcaaattaataataataataaactagttgagcaaatggctaacatctcctccataaaatataaaaatttagaaaatattgatttgtgtgacaaatagtgacaaaatatttctgccccatgccacactgtgcctgacaaaatattactagaagaactgcataatgaactttctaccttaaattttataaagtactaaaaatacataagataaaaacaaacaaatacctttggaggtgtctcagatcctggatattctctctgatctaatttcttccagcgatccattaatttggtcaccataggtgtgttaaaatctaccaactggaatcctgtaacattggctccaccatgtataaatctctcaagagaaatatccttgaatccctataaaaatcagtatgacagtttattaagcttagttaattattggagttaatagctaacattttggctcctcaatgttaacatgaattgataaccaatattatttaaaagtggtggctttaaacaactggaagattatgtaaatattgacataataacaattatgtcaatttagctgttaaactctgtcattcaaaatctaatgcatgacaccacatcaacaccaaaaaaagacaaaaatcacgtgatcatctccacagatatagaaaaaaaaaacatttgacaaaattcactatctactcatgataaatattcccatcaaagtggatataatggaaacatatatcaatataataaaagctatttgtgacaaacccacagtcaacataatattcaatggtgaaaagctgaaaaccttctcgctaaaatttggaataaaacaaagatgcccactgtcacctcttctattcaacatacttttgaaagtcctagccacagcaattagacaagaaaaagaaacaaaattttattcaaattgatagggaaaaggtaaagttgttattatctgcagatgacatgatattatatatagaaaactctaaagattccacagaaaaactactagaactgataaaaaatttagcatggtaataggatacaagattaacatacagaaatctgctgaatttttaatactaataatacatatcagaaagtgaatgtaaaacaattattagatacatcaaaaaaacttaaaatacctaggcataaacttcaccacagaggtgaaagacttaaatgctaagatctataaaacaatgataaaggaaactgaagatgattcaaagaaatagaaaaataacccatgcctttagattggaagagttaatactattaaaatggccaactacctaaagtaatatacagatttaatgagatccttatcaaataactatgacatttttcacagaactagaatgaataatcctaaaatttatatggagccataaaagacccagaattaaaaagcaatcttgaagaaaaagaacaatggtggaggcctaactgaatcatacttcagatagtaatataaagctacagtaatcaaaacagcatgatcttggcacaaaaacagacatatgggttaatggaacagaatagagaacccagaaaaaatccaacacaacctacagtcagttaatcttcaatgagggaggcaagactacataatggagaaaaggaagtcaatctcttcagcaagtggtttgggaaagctggacagctgcatataaatcaatgatataagaacatgtcctcacaccatacataaatataaactcagaatggcttaaagatttaaatacaagacctgatgccatataactcccagaagaaaacataggcaaaaccatctctgacataaattgagcactattcccttcgtcagcttcccaaagccaaaaaaataaaagcaaagataaacaaattggaactaatcaaatttaaaaacttttgagcagcaaaggaaat

SEQ ID NO: 58135 - DNA, 799 bp, Bovine  19866880945508
aaaatagatgagccccatttttgttgcagtagctcttaggaaacccaatggatctagacatcagaatgtaagatttctctgtttgctttttttttttcctaaaaaacatgtattaaagttgaatttgttattgatggaaataattgttttatatcaggtagaggttttagctttttgttttttttaatgatagactttagaagtgttcattatctaatccttaagatcatttgggttttcacagaaatgtttttaaaatatgttacctgctacttcgcattcaaatacacttaaatattacaaagaaaaaattttggtagtactcttccaatattcatattttcaatagaaattcaagataattactatcttggtcatcttaacaatggtttatttcctggtgaagtggggctgtcgtgaatataagaaaagttatgaccagcctagacagcatattaaaaagcagagacattactttgccaacaaaggtccgtctagtcaaagctatggtttttccagtagtcatgtatagatgtgggagttggaccataaagaaagccaagtgccaaataattgatgtttttgaactgtggtgttggagaagagttttgagagtcccctggactgcaaggagatccaaccagtccatcctaaaggaaatcagtcctgaatattcattggaaggactgatgctgaagttgaaactccaatactttggcaatctgatgcgaagaacggactcattggaaaagaccctgatgctgggggagattgaaggtgggaggagaatgggacaaca

SEQ ID NO: 58136 - DNA, 1576 bp, Bovine  19866880996041
ttttttaaaaatgtagactatccagctatatttcacttataagattttaaaaatgtcaaaagcaaactaagaaaacagttcaagtgtggctcacctttctaggtcccgtgctctttagttcaaacacatccattgtgtaattgaccctacgtccatagtggtcaaattgaacatttcctgttagtccttgaatttgaacctatgaatgaaaaataaaatctacacatgtaatcatttgccattttacttacagaaatctttacttcatctgctaggcttatgactacgcatgggtgtggaactataatctgtaagcaactcactaaaaaagtcatggagtatttgagctactgggatagaattggatagaaccaatacagtattgtaaagtaattagcctccaattaaaataaataaatttaaattaaaaaaataattggatagaggaatatcaaagaaatatataagcgattctgttatgtacttgaaagataaattttttttttattatggcatttccattgtacttcttcaattttgaaatattatctataagaatagaaacatggtttcctttttagttacttttcagttttatctacacatccacataataaataaccctgataaccacagcagatcatatttctccttgctaatgttaaacttaaaatattcagaaaaataaacatatttttgaaaatattcaagtgtactttgttccaaatccttttaattcatttaaacttatgttctgaacctgtggcatttcagaacatttaaaatgtattactaaaaatacacacatattacagtaatcatttgaaaaacagtgttagtataactacaaaagactaaaataaatacttaatccaaggttacaagacaatttgaaggtctattgaggcagtcagtagattagtagactaagactgtatgccaaatatttcaggttcttcctcattctgggtccacggtgggcttgttctttttggacactttttggttagctaggtgtctgtgactctttctgacaaaagcgttgttaacagatgtaatgagtgctaaagcattttatttatttatttattttactttacaatattgtattagttttgccatacatcaacatgaatctgccacagggatacactagaaacctccctacaactcttttccttttgttacattcaagatggtagctgctatgtcagcttgtgtccctaagtgattataaaaagcagagtgtccctactaatctgatgtgtgtctgtgagtgtgaaatcctcttttgttgttttaagccactgaagcttggggttgtttattactgttacataacctagcttatcctggctaaccatctacataacatataaacaccagtattctatctagtgggcttctgaggtggctcagtggtaaattagctgtctgccaaacaggagacgggggttcgattcctttgttgggaagatcccctggagggagaaatggcaaaccattccagtattcttgcctgggaaattccaggacaaaggattctggcagactacagtccagggttcacaaagag

SEQ ID NO: 58137 - DNA, 2508 bp, Bovine  19866881003822
tggggggtggtgagagaatgatcaaacatataaccctaactggaaaatataaattatgcagcctttttggagaaaaattgggcaatacttattgaggctctaaatatatttaattcctttggacataattaaacatgtacttcaaaatgtggctacgaggatattcaataaaccactgcttacagtaaaaactgcagacattcaaaatgcctagcagagaggacagaatgagtcagctatggcataccttcctcacagcaggcagtgggcctcccctaggtatcactcccccagactctgccttaggcttcttccttaccaagagttccctttccacagaagccaagagtgtcaagttcagctttctcagtgacctgatcggggtcaccagaaactttgtggaaattttctgggggctcactaacaaaactgagatgtgagaggcaaaataggcttttctgcctttcagatgcatgagggagaccagcctagagcaaaacaaataagctaagatggaggcaaaaaaaaggccctaatggcaactttaaattgtttgttttgtgacacaataaatgtccttggttactaagccaggttgaaccgtaatacctatggtcaattgcatcttgatagtagctggaaaacagaatacttaagcagcactaaaagttatgctacaccagtgtagttatggacctcagatgtagagtcaagagaaaacttaaatatatttatgttctattaaaaaaaaaagagtaagtatattaatagggcatcattcaccaagaaaaagatctgggaagatactccatgttttaaggataggtacctctaaaatagttatctctgaaaaataggaatttgaacattctctattttgtgtattccgttttatcactttaagactctaccatcaatttctatttttattttttatcaaatccaatgtgattttggggaggaagaagaggcaaacatgtattctagtcacaaatcttgatctgggagtctgcttttttaataggaaaagttgtttcttctttttaaaaatgttttgtgaaacaaaatttgatactctcaggcatttattttttagtgaatacagaagactacagttttcacttccctttgttactcagaaaatcatatcatgactttgtaccatttcttattgaaatctcttctgtaaagcaaaaacagtcccaaaatgaaggatcttcaggggtcataggaactgcagatgatattaaatcattaaaggtgagaatagtaaactgcctctgggttgctttagaatcatcttgagatgtaacctaaaagggggaaaaaaaacccttagattacctcaaaattataatgtgtattaatcttatggtcaattttataattaggaaaataagaaatcagtaatcacatttcagtaatattaagttacacttcaataacattaagtaacacagtgggatttagataattgtttctatttcttatattagtgctgtcaatataaacaagaataatatgaaataatctgattcttatactttttgtaggtaacaattgcctgtggttatttgtttaaaatgtagatttactgagccttacgtccaacaattctgattcagtagaaaaggatccccaaatagataactttaacaaacaagtgggttattctgacagggagagaccaccaggtaaacttctgagaaatactctagagggtgcatctaataaaattgctgtaactacttagagatgtagcacttcattagtaagtgattcattcaacactaaatagaaattatatcttacactctgtgatacaccccttgttcataaactcagcccagtgtggactgtctttaacattctatacattctagtaaagacagtacttgggtcttctgcagtgcttttacagggtcagtatgtttcatatgatttaattctcattactatgttgatatggttatgttacctcatttctatagatggggaaactgaggctcagtaagatcattcaatgtatacaagtgtacaacatagcttaaatggtagacctggacctggaacccttgcccttttctcactatgatactgctgcccaaatagactctcttcatggaaatacggtactgctatgtgcaaatgttacaaaaaatataaagctctatggaatcataaggtatttgcagaaagggtaatgctgagacttcagcatacaaggacagctaacctgtttcagaacatcttcagattaaaggagtcaattttaacatgttgtcccttttaaaataaaataatctatgaagaattttactcttttttaatctatccaaggcatgatctgtattgagcttttatcctagaagtaatgatgaaaatatactgatcacactacattcccttatgcagattccctaaaataatcatatgcatttaatttcaattattgtaacattatcagtattccttaaataaatacttctatagaatcacaactgtatg

SEQ ID NO: 58138 - DNA, 771 bp, Bovine  19866881023832
actctcacattatctacagatggaaccaaaggaataaaacatctataatcatcatacctacagtcaatatactatacagtactgtttcataaagttttgggccatttaagtaattcccacataaatatctgcggtttcaacattctgaaactgaaacatagctaaagaggtgctcagccaggctaagacagggttcttcaacttcagcaatattgctatttagggtttgatcattctttttaggggggagggtggaaactgtcctgtgcattgcaggatgtaggcatccctagcctctatctactatatgccagtagcaatgtgcccaactttccaattgtgacaaccaaaaaatgttgccagacattgctaaatgtctttgaggggccaaagtcacccccagttgacaactactgagctagaattttatacatacataattgtaaactctgagtccatagactatacaagactatgtgtaattttactaatttaaatagtacaacaatttctgctatattgtttatgctagggcacatagttttcatagaagacttaagcatataattatccacaaataatcatctttttcctactaaaaacactaatattaaacagggaaaaaaacaacaatacagctaatcctgcaatgatttttaaacctaaacctgtggtttacaaacatttgataaatggagacctagataaatcactgcaagtgtccttccttcgaattcgagtctctctttctctactgtaagcgttcctttt

SEQ ID NO: 58139 - DNA, 1847 bp, Bovine  19866881194631
catggatggaggagcgtagtaggctatagtccgtgggggtcacaaagagtcggacacgactgagagacatcactttaactttcttctataaaagggcaacgggtggagaatactgtcattttttttcttacagtatagtctggcttcaaagaactttacaagaaattctacatgcttttttgcttttgacttttacaaatgctaattactgttgaataaagaaacttatggcatctagtttagtgtccctggatattaaggagaaatctctgaaatatgtcttggttttgatttgtagagttgagtacttaaattgttcttataaataaactttcaaattggtaagttattactatgaatcaaatcatagtaatcaaatcaaatcaggttatgcaaatgaactgtatgtaactaacaaatgaaacatgctacaatattgttcagcaagcataagatattgtaggtaaatatgagcaaacatttataaaaccactagatggcattcattcactgcagttttggccaaatacagcctttaaagttttatcaggacatgaaggattaggagcaagtattatcccttatttgatgatatttttctatcgtttaatgcaatgacagagttcaattttaccttttcctatatgctttaaatcaagtcaacaagcactgaaagtcttcattaaaggattcttccttgggagaagatttgaaaaccatcttcactgtagtggcaatgtatttacttaaaacatttagaagaaaataatcacagtatgtcacttaattttgttttatttcattgctttattaattcatttggatatttctcacatagctagttctctaaaggttataaaaagtacagagtcacattttgtaatattctaataatctttagaattagtgtttatgaaaataggaggtcaacagctcttgagtctcaaaaagtcctttctattgtacagcttaaaaatgtatgagaaatagtgcttctaagtacattgagaacaaaaacggtctttggtgttaaaaaattatgatttagtcttgcttgtgtgtgtgctcagtcgctaagttgtgtccatctctttgtgaccccatggactgtagccagccaggctcctctgtccatgggaattctctaagcaagaatactaaagtggattgccataccctcctccagaggatcttcccaacccaggcatagaacccaggacccctgctttgtaggcagattctttactaaccacattaccagggaagcccttacattaaatgtaaatggactaaatgctccaatcatagactggctgaatggacacaaaaatgagatacacacacagcctatagtatcccagagatggaaggatttttcaatagctgtaaatcaatcagtatgatacaccacattagcaaattgaagaatgaaaatcatacgaagaacaaaaatccatatctcaatggatacagaaaaagcttttaataaattttaacatccattcatgaaaaaaatcccttttatcttgatctcagaaatgccaccaattacttagcaagaaatgaagcaccatgtgaaataagagacctgaatttcttcaggttttttttttgggcggggggggtgttgtttattctcattttcacagttaatttggtgagagcctatgctaacactgctaaacccatggatttctgtattttgttacactggaacttgacagagacaattttacattatagaagctacttcatattgcgcttaagtgttttcattgccttaaactcacatcttataaatatgagaatagaattatctttaggccaaattactatgtggtgaagca

SEQ ID NO: 58140 - DNA, 1219 bp, Bovine  19866881366992
attttgctagtttgaattctgtaatttttatttcttgtccataatttcccaccaaaaattaagttaaaaaaaaactacacacacatatgcacacacatagggacagtacattagaccaaaagtcaacacaaactatgacttatcgtattaagcagagtcagactgatttcactgctactctgaagtatctacataatgcagcagaactattacacagtgcagatgagctagtctaagctttgctagctataaaggttcccagaaatgggaaaatccttgtactgtagaagaatttgcattacaaagagatggtaataccaaaaacttaagtggaactgaaaatacttagcattaagccaagccatccctttgtatatatgttatttcaactcctgtagcacccttcattcttcaaagtaataaggcacttgacaaatgatataaatatggtttttttcgcttgtatgtgataataaccaagataaagtttaaatgtcagcagaagactttgcttggagtgctgcctgaagcctatcccaaaggaaagcaacaatgtctttgagaaaaaaaatctgaggtttactgacctttccatttgattttagttgattttagagaatgatttgttaagtttgggaatgttagatacttacttaattgtatatgtttatgcagactgatgtcagcaaagtagattttaacctcttgggaaagaaatatgttttaaccatttttgcatgtatataacatttagcataatgttggcaaatagtagggtattcaagaaatgcagttttttttctaccaattttccttttactatatttgttccattcttattctatttccttgtaagcttacttaaattttgttgtcttttggaagtagagtaattaattaaagtgtgatgaactgagacttaattagccttgtacactgaaaaaaaaaaaaatagcacaacataaaagttgagagctatgttttattcagcaagcttcttaggatctcaagcctagaagacagcatctcaaatgaatctgagagactgctcccagaaggcaagtagggaaccaggattgataggagtttttgcaacaatgggcaggtagtcagaacatcaaaaggttattaaagaaagccaggtatctcaagttaagaaatttagggcttttctatgtatgggtcatgtagtaccattgatgactgcaacatcctttgt

SEQ ID NO: 58141 - DNA, 4126 bp, Bovine  19866881459666
tttcgatgtttggcaaaccatacatattgtaaagtttaaaaataaaataaaattaaaaaaaaataaaaataaagtcaaaaaaataaataaaataaaatgatttaaatagtatattgtatctgaaaattgggagaaatttgaaattagatctgaattttcttgtacacagaacaggcttgtcttctctggaacaatctaatcctaacaaaataagcataaaattttttcaaattatcaaagcctagacagttgcctcttttgataaggatgtgttgttttctgagaaaatacatgtaaaatctccagggcacatagtaaacactcggtgagttttagctcctcttctggtttcttttatattagccatctttctatatttttagagggaaaccccgatgtttgttcatctggcagtagtccttgaaccagacctttaggcaggagtgaccatcagaatattgactacaattcacatttattagatgaaattcaacattcatttttacaacatgactaaaaggtgaataaacattttaggcaattttttcatcaaaaatgtcagcaatatattttctttaggagagacacagtaaaagtaaaacttgcaatgagtttttattgacttttgttttcatttcaactgcttttgagtgagccagatcagtctcacttacatcttctcaccacgtgacaataaaaaaattataagcattcagtgaaacacagggatgaagttcattttttaagactctaaatgtccagtgctttttccctttgatgatacaaaatgaatttaaaataagatctggaagcatttgttgttgcttttcttaaaatcaggcctctaaaacccattttctgaaattgtatataagagccattctgattacaatgataaatgaaaatttgaacccacaagagacatttagtgcctgaggtatcctagagtcaaacccaatagaatttttctaagaataagatgtatacctgaagttatgccagataaatgtgcccaatttttatatttatttattttaaaaaagctattgagagagttccctggtagcctggtgcctagtggttaagagtccaggctttcacagtggtggcccagccaggttcggtccctggtaggtgaactgagatcccacaggccaggtggcccagcccaaaaaaggctactgaaatacttgttagcatcttaaagcaaagaacaaaagctactcctttaaatcaagatttaattgcttttatccataatctagaaatagaatagtgactgagtacaattgcacatagacaagcccaaagtttttctttccaaattttgtggaaagaattgatcatgaaatagtcaattcactcagatcagaatgtttatagcatgtcttttctaatagcagaaaagcaaactgataagatcaagttttcttagtcattacagtaatgctttcatcttaatatttacagaactgaggaaagattttttttccaaacagaaaaataatatgtgacaagtttttagagccaattatttggacttcattctgtgatgaatttcataagatatatttttaaatttacctttagcatagcaaatgcattctagaaaaattctagaagtactcacatatgacagttcaatacaaagtcctggggaattgctagaaagagatatgcattctcataagaaagacttaatagcattcagagcaaattaaatgatatgcacttgtagagatttgagagtaagcgtttttagttgtactcccatattacatggctttttcctttcaaaaattctactgagcataattatgaaaatgactgataatttagataatatttagtgtcagaatttcaaaaacaaaacctgaatgtttactctaaaagtaattatccctcaaggaaacacataaataaagttacagccattgccacaacaatccaaccagactcagactatatggtaaatttataagaaagttttgcagtttgagtagtctcaataaggtcgcataaagatgaacagaaatgacattttatgtaagaagccggagatttaagtgtagaatataagaatgctgagaactaagaacacgaagatttaaagagagaataagtggttggcagaattatcagcactcaattgcattaatctatagagaaggaaagattatttgagaggatatggaatccttcccatttttgatattttcatttccttataccagcaatcaagaaaataaaaggaagaaacaggttttatgacaaatcttcctgaaaagtcacaatgcttttaattagtattaataaatactaaatgccctcttcaaaaaaacaaaactaatacattttttacataattgttttacttaatattaaatgtttaaaaggaatctgaagaaacaaattcagactgccatcttgcttggtttaatttagtgatgagtagttcctgtagagattgtctcctgactcctgattataaagataaatagattttaatttttgagattgttcactaaaggcaaactataataatgaccttggtgtttatcatagatatgtcagtagcattttgacttcaagtttctgaaattatcagggtaaatgatcattaaaacttttcattataacatttttaatccaatttttatttcatatttaatatatcattattctaatatttaaggtatagagtggaataaatacaaggatggaaattccaaaagaactgggtaaacttaaattcacagcaaggaattaagatacaatataaattatgagaaaattatgatctaaactacaacaaacttagggaatatctcctttaccttattttctcttgagttaacattaaaattcagcaactagaaagaatttaaaggcatgaatgaacagtcagtagatttcaataataatgctttctgtttctcctcagtgtagtattattacctgctacctaatatgacagagcaagaatataatgaggatttcaaagacctgaccccataacatcaatctgggaagtttcccagtgatgaccattcatgaagcattgaaacatgtcccctttcagtgcacttccctttaagcacttaaagcttcttaaaatatgagccttaacttccattataggcatagaatgaactttatgtgactgatttgcctttctatagctgtctatagcagctgtagggaatgagtgaaagcatctgtggatagatctgtgttttataaacaggaagatctgttataaatagtctacattgagttctcttaaacaattcatcatgattttaagagtacaatcatttaacggctaagatattttctagcagaaaaaagaaaagatacaaagaaagattgctgtcaaacctaagggaccttctaagttcaactggaaatactaaggtgtagagcacagcaagttaaaagatgtgtcctgcccagatttgtcaaacaaaatcttgcaagattttagaaaattagttcttaaacaggaccagtaactccagagtgattcattcttccagatcgttgagtttctttttcctgtgaaaagtagttttaatatgaccaaaagagtatgggaaaaaatgcagatgtctaatcattgatattttggtgtttgttgtgtcatattttgctgaaaagacagaaatattgtaacactccacattctttctgtttcctttccatgcaacccagctgaccttttctgaagccataagaaacaaagccagattatccatcactgggagtgtgggtgaaaacggtcgcgtcttgacacccgactgccctaaggctgtacacactggaactacaattagacaaagttcaggattggctgtcattgcatcggaccttccataaaaaccaaaaaaataattgagtgccttaattaaactgtatttgtgactgatggaaacgcagccctgagggacaggctaagcgcaagtcttcgctcaaacaatcctttggctgagagcgggaagttcgtcctaaggcgccaaacatcagcaacgtgtgcatgagctcagctcgaaaacccaaactcagattttatatcaggaaaactcacaatttagatttttttcgggtagtgggggcgggggaggag

SEQ ID NO: 58142 - DNA, 555 bp, Bovine  19866881556973
caccagatgaaatccagatgaagttcagtctaccacagcagcaggtctgagtgggaagaagtttcaccaatgccaagagctttaactgaattttactgccaggtgattcagtttaataaatacagagacccatggttttctaatcatttctaaatgtagtgtatgattagacattctaaagcaattgcagttctagaagcctgcagtaaatttattaactttaattattggtaaaaaggtctttacagcttagtgagataaaatagaccttctataagagaattactatgaatgtataccatattagaaaaatactatgaatgtatactatatatgaattagcagttcccagaaacttaaaatacacaatacattctaccaaaaactgtatttaatttaatcttggagaataggatattagtattttcatatgtaagtaaaactcaggctttgatgttttgattcttaaagtactttatcctgacagaaaaacaaatcatacttcacataactgtacaatgtaaatggggagaagtctctttaggtagtaaaaat

SEQ ID NO: 58143 - DNA, 1219 bp, Bovine  19866881683487
gttatatagactaagcactagtctttgtaatttatagaaattatattaacaactaataaatgttgttagtactatgcacttataatattctatgataaatatgtttcttctcaaaatactgttttctatttttttaaaaaaaagatgatgttatgaatttatacttctgtcctctttaatcttatcacaccatatgccactgtttcatttttataagctcctagaattttggatttgtttccaaaagaaaatggtatttgacattaacttctgttgcttctgaacagtgctaatctatctacatagtaaagatttcaattttcatatgcaataaaacagagactggaactgtaccaaaaagattgtcatgagacatgattcataattttaaaaatggagcattaaagtaaaagaacaaaatagctattattgactcattcaccaaatatttataaagcaactgatacatgccaattttaagccatctgctgggcatatagccatgaacatgatagaaaaggatgcttttcttattatactctagtaacaggttataaaaaatagataaatacataacaacattatttttaagtaccatatagtaatatatacatatgaacactcaggtatggaaactaatttcatggctgggcttccgaggtaccactagtgttaaagagcctgcctgccattgcaggagacataatagatgtggtttgaccacaggttgggaaggtatcctggaggagagcatggcaacccactccagtattcctgcctggagaagcccatggacagaggagcctggtgggctacagttcataggtgctcaaagagacagacatgattgaagtgagttagcatgcaccattagatggcagcccaccagggtctgccatccctgggattctccaggtaagatagagtcggacatgactgaagcgacttagcagcagcagcagcgtgcacctactgaatctttaggataattaattcaagagaatactcatttggccttaaagtttcaactgcttgtcttctaagccagtgtttagatagaaatacagtttttagaaaaaaattgtgagtcagaactgtgtccattagaatcaagtactatctggctttccttttgtagagcctcatcttccactaccccacttgcctttacggttattggtttagtcattcaggtctgtactttgccaccttatttttt

SEQ ID NO: 58144 - DNA, 711 bp, Bovine  19866881732597
aaataaaagttgtattatgcttcatggatttagaaagaaaacaacaggtttaccctttaatcagcagaaaacatccaaatatgtgaatgcctgctaaaaagagcaaaattttgaataatcttgctgaacaacatagggcatttgattttagattaataaattagttggatggaatcagtgaaaatattgaattttatcctggggaacaagcagcacaggaaagagagaatttggctaaagataaaattaaagcaactgatacgtgtccttcaaaatgatagagctcatcaagaaatcactatatccaaatgaaggcttaggatgatgattaaaataggctttactgaaggcagttagctggtagtctttcttgcatggacttactgctggattggcatttgtcatttgctgaacattacttcctttaaccaccaaatgaaatggaaatagttgtattaggcaagagcagtaaagtttatggtcaatttagatcagttcagtctctcagtcatgtctgactctgcaacctcatggactgcagtgttcaaggcttacctatccatcaccaactcccagagcttgctcaaactcatccattgagtcgatgatgccttccaaccatctcatcctctgtcatccccttctcctcctatcttcaatctttccgagcatcagggtcttttcaaatggagtcagttcttcgcataaggt

SEQ ID NO: 58145 - DNA, 1241 bp, Bovine  19866881778760
aggagcttttccagaatatacctgtcttcaacccttctcccctgagacctaactgactcctctaaagaagaggttataggtaaatattaaagcttgcttggatattcaggtaaacttccccttctatctccctagtgtctttgagaatttcacctgatacctgaaaaataagaataagcatactttttgcataagctacaataagggaaaaggcaaatgtttgctgatttcttttttcagaattatttttataagaaattgcgatatttgcaactgtgtttaagcatttttttaaatgttgattactgtttcctttttttaaagcctgctatttctgaagctgtctagcctgcactgcaaaactgattgtaatgctacaacttttagcagattatatgccagattagattctgtatacttgagaagaagtaagagagggatgatttatttagaagtgatgagttgaatttttattagaatgcaatcacccttcctcccagttataaaattacccatgcagggagtcttaagtggtaagagaagaaaggaagtcacaagtgtgaaccgtggttgagatagagctgcaaggactgcagagagtgcatgctgagggaattgtactaaacatgttgtgacaaggaagtcacaagtgtgaaccgtggttaagaaagagctgcaagaactgcagagagtgcatggtgagcgaattgtactaaacttgttgtgactttcagacttacttcaagagtcttagactgtaaaagagaaatgaaaattcttactttaatctatctgggaaccagaggcagggagacctttaatctatctcttcagttcctttttctctcactctatctcctacattcctttggtaggtcaagtcccaaatgtcaaggccccaaaggcagtttttggtgtcagcaacttccaaaccccaacctggcagtacacaaagggttggccagaattgctcagtctcaggaggaattttttttttttttttaatgatcacttactaatgaaacagtgatattggtatgtctattgtttttaaaaaatgaaactcagaatggactgtcagacaaaacacaggacaacaagctaaatttgaatttcagataaacaatgaataaattttttgaaaggtatattccaaacactgcatggcatacactaaaattatttgatgctcatcagaatttgaaatttaactcaacaccttatatttttacttaccatat

SEQ ID NO: 58146 - DNA, 1750 bp, Bovine  19866880426941
gtggcaggggacagaccggagcttgagaggaagtaagaaggccatccattaagggctgtttctagaaataccagagcctcctcagcccatcctcccctataggcaagtttggaaatctggctttgggacaagttgtgtctgtggtggtgtggctgaaattggcatcagagaagggtaggggactgagcgttcaaagcaggtcttctgaggctgccccttgatgccacagcttgtgtctcaagccattgttcccgttcacagcacggaaggtagcttgagagaacttgctattgaggctaccagctgggctgcgaccggtcatccatttgcagaaatgaacgtctgtcctggcttgaagcgcctgctcctagtgtcacctggcgaggctgcttcctctttctgggccccagtggcccaggctgtcaaatgaggaaacggagatggagggtgcatctcaagagcttcttcaggctctaaggtcccgaggatccccagacctttccaaagatctgaggttctttggaaaatggatatatcttacaggtagtgattcagagtggcttattgtacacttcaaaggtggctagtgtgatggagggactgaattttaaattttactacattttaattttaagtttatataactgtatgtggctaccttatgggacagcagagctccttaactggaaaatctaacataaggtgagcatttggaatgcctgtatacatttttatatatatctactttgaaattgaaagaaactttctaatttcagaaaaaccgtttgggttctttacagacaatacagacaagaagaagaaaaagaaagtaaaaaatagtcacgaaaacacctactcagagataactgctactggcatcttggtgtataactttctaaattcccttctgtgctcatgtcttaggtagtcagctggctttcaacagcatagcttgaaatcatccaggaatggatgagacatgttaggagagaatgcctgctcactgcccagcagaaaatactgagaaagactttagcaatctgccctgactgatgtttcttttctgggtgctaggttatcaaccctatgggctgggatgcatttggattgcctgccgaaaatgccgcgattgagaggaatctacatccagaaagctggacgcaaaggtatgtgtttacaggcatattcaagcacttgtatacattacccttaaacaactttttttttttaaacctgtgcctgagaaatagaaagcaaaggaaacaaaacactgcagtctgccaagcaataaaaaaggattgtctatgttggtatttgctttttctcacactgtattcttatctaagacacaacacaaagtgtttggctattcattcatgtgttcattttgatgctttgttatttacagttattcttcctttgaatatttgcatttggaaggaaaaaggaggaagaaaggatgacatttgttaaacttctaccagtgttcttcatcttcttgaccatagtttgagccatagccaaatgccacattataattttctctgcaaattcttttaatttttttggcttcatcattctgaagcaagaggaacaaggaaatatatggccactttattctaggcatggctttctccaaggaggacatagtctgagtccccgctgtggcctcaggctgccatgtgctcaggcaatgctcatccctcttcctcctgataaagccttgaggaacttgtactagaacccagca

SEQ ID NO: 58147 - DNA, 2120 bp, Bovine  19866880491297
tcattctagccaggcctctcatctaattgccatgtgtctcaagtgagcactttattttattgtcttgttcatgcactagttcaagagcctgggctccccggtcagaatacaatctccagcttctcttaggcaggtgtgtgtttgcagtttccttatcactgcaggcccacgggaacactagggacacacagccatgcaaacaaatacttcctgattgtttgaagagcttcttagatatttattctgggaataagcacgtggctggaatctgggtctccacgcctatctcagccctctaccagatctactggccttctctgctgttgagggctctcgcctacattgagttaagctctacttggtctgtatgtaacctttccccttacctaaaagagctggctgaaacagacacaggggcttcctacaagcaccaccctcaacattcccctagagaaaggaacacattccttgcttttggaattaaaactaactatagcttatatggcattaccactcccataacaaatatattgtttagctgctcagtcgtgtctgactctctttcgactccatggactgtagcccaccaggctcctctgtccatagggtttcccaggcaagaaaactggagtgggttgccatttccttctccaagggctcttcaccacacagggatcgaacccatatctcctgcattgcaggtggattctgtaccactgagccacctgggaaactgacaagaaacaaggtgaagtgtgaaagtcaaaggtgctcagttgtgtccaactcttgcgaccccatggactacacagtccgtggaattctccaggccagaatacaggagttggtagcctttcccttctccaggggatcttcccaacccagggatcgaacccagatcccccgcattgcaggcggattctttaccagctgagccacaagggaagcccataagaaacacagttcagttcagttcagtagctcagtcgtgtccaactctttgcgaccccatgaatcacagcacgccaggcctccctgtccatcaccaacaccgggagttcactcagaaacacaggcttccttcaaatactctggtgaatgaaatgaaaggggacacctgcataagggggtggttaggaatgtaggtatgggatcgaggttgtctgctctcaaatcctgactctactgcttcccagttacgtgacctgggaccttggtcaagacaatctctctgtacctcagtttcccaatctgtaaaataggataatagcacctgcctcacagggctattgttaataggaatgaatcagttagtctttgtgaagtgcttcagaacagagttgggcacatagtaagcactattatgcttcagttattattagatataattaataagaatacagagatttaggacagacggacctacaaatcagtatgcacgcaaaagaatctgacagtgatgggaaaacaagctggttaatagaataatatgccatccttggtgttttgattttctggcaaacgtacagtctttgaactgcttcagtaaaccaaaaagaactctgaatttatggggttttgaaatatctaatgtatgatcacaaccaatgtgataaaaaatgttctggctgcattaaagtacaacagttagtgaaggtgtcattgttttagcagagaatttaaaatgaacattcgattgtttgtatctcttgtatcgatttaggctaacatgtcagacattgtttgtaatgttatttagcaaatactgccaatccttctccagcagagaatctttagtcatttatctgggaaacacttcaaatgtatgttctatagttttaaagacacactgaaagatttttacataaatatgatcccatggtatccaaactcagaattttctttccctgtcttttctgatctattcgctgccactttttaaacccttgatcctcttagatatcctacctattaaaatttcacatccgggtctcttctttctgagcgatctcgagcgcaagacaccatttctcacatcagaagtcccctgttagctcatcacccaggtgctcattagaatccaggtgttcaatcacacaaacgcctcaaggtgcatttgt

SEQ ID NO: 58148 - DNA, 4335 bp, Bovine  19866880524040
cgcccccctgctctagggcaggtggtctgcacccgactcgtgtcccacttctcgctttgacttatgacaaaagtataccctcccaccgggcacacaccactctcatctgcaaggcccagcccacccccttccctcttctgcaaaactctgcactggccagcggcttcctcccagcctcccggcccacctgtctgactgtgaaagcctgagggcccccgggacgcccctctcctgctctcgtcctcccactgcttcccactttgcactgcatcctcaccatccgtgtgtgtgctgggggcaggcagtaagcagctgttgcatcaaagctctggtattgttacaggaagtaggaaattataaggataccacatttcgaggcttgcagaataaagactgtgtaataatgtgaacattaagtatatttcagccctagcttcttttgcttttgagactctgaaattccaagtctaatttttccacacccatttaaaaatggagggacttcactggcagtccggtggttaatagtccaagctcccaatgcaggggacaggatttcaattcctgttgtggaaactgagatcccccatgctgttatggcattgccgaaaaataaaaaaatgtttaaaatctgaactatcctttgggccttcactaccaccggcccccggtttcattaggagctcacgtgagccctgtactcacacttccaccacacaggtagtgatccaaatgcacccaccaggtcctgattctggacaaaaagaactctgccaaagcagcgggaagaagatgaatccagtcattctttcacgtttgctgagtatccactgtgggccaggcactgcttgggaacacaggagtgacgaacattccagtgcacagaagcagcaacaggcagagtgcagcatagggtgggagagagctgctacagagaaagtaaagaagaaatctggacgagtggagggagcccagcaggggcatcaagaagaacaaaggccctggggatcccggggtcctgcgtctgtgttaaagaatcactctggctgctgagtggtgaacagactcagggggcagaggcagaggtggatgcagaactggcagtctagagactggatcctaggtacattttcaaagacaagctaatgggatttcctaatatcttggatgtagctgttagagcaaaaggaaggggctggaggatgataaagttgactttatatggaaaccatttacaacgtgctcgtgtgggggctgctgttagcactggacctgaaaaggggggagaggagctgatgaagggaaaggtgaagaagggggctgaaaaggggccacggccagggctggagcagggccaatagggaggacctctcgtctctcctccccagtgcagatctctgccagcgcctcacatcggtcactccatccagaacccagaaggcaagggaacctctggcgctgctgtcctcaggcccagtcttggggtacacagggcagggggagagcagaagaagcgagaggcagagaatcacaagcacgccagagaggcctcaaccctgggggaagtgtgtgcttaaacaccacgttgattgttcatgactgctttccctggacctgtgcttaaggtgcagctggagaaagtcaagttctctggaaagaacatcatggttggaatagtgattgggtactaaaaatcagagactgtgaaatcctgactcctgggggccttccagatcagacttaaacagtcacaggctttagatgtcagagagcttccaggaggcagaagaataaggcagagacctaagaccccaggtctcccccattgcaggtggattctttaccatctgagccaccaggcaagcccaagaatactggagtaggtagcctatcccttctccaggggatcttctgacccgggaattgaactggggtctcctgcattgcaggcagattctttaccagctgagctactggggaagcccggacctaagactcaggaaggcatttctagctctggtgttaaggtatgtgatgtggcacttttccaaagcagccaattataatggaaccataagtcattttccaggcagagtctatactagcagattgacaattcctatgtaacccttttcatggcagacacatcttgataattgggatggtgtagatgggtcttaaaagtcctcatacattctagataattaggatgctttggaaccaaaaggaattcactgtaagctaggactaaacacgttgccttcttagtgtgaaatttcttttaaatcaagactttttaaaattcctttttctccaactaaaatataggttttcacaggcaatcagctgattggagggtggaatgagacacaagaggctcttcatactgcagaaaaagattcctttgaagaggtggactggatgatttcaatcgtctagtgtcttgttattcatttctataaggtctatactgttgttcagttgctcagtcgtgtccgactctttgtgatcccattgtctgcagcacgccaggcttccctgtccttcaccatctcctggagtttgctcaaactcatgtccatggagtcggtgatgccatccaaccatctcatcctctgtcaccccctgtatgtataaataactaaatatatatatttggctgcaccaggtcttagttgtggcacaaaagatctttagttacagcatgcaaactcttagttgtggcaggtgggatctagttccctgaccagggatcaaacctgggccccctgcattgggagcatggagttttagccactgaacccaccagggaagtcctaaaatactttcttaatataataaaatacctatcccaaaataccaatcaatattaaccttaatagagaaatactacagttagaaaatatgatggggaaaagatcctctacacattctaaatgaattgatatataatatatacatatatatgcaggtatattagaaaaggaacttaataagaaatatataagacctatgagaaaaagagctaatattcattgagaagcatatagaagactaacagaattacagagcattttcttgaggcagtgaatgtgtgcatgctcagtcacttcagtcgtgtcccactctttgcgaccccatggactatagcccgtcaggcttctctgtccacgggatttcccaggcaagaataccagagtgggttgccatatccttctccatgggatctttgtgacccaggaattgaacttgcatcccctgcattggcaggcggattctgtactctcagccacctgggaagcagggataacatttataaagatattcagtcccaataaaaatcataaacaaattttataaaagttttttatttaaaaactttctgaaacaataaacacatgggaaaaaaatgagataattctgaaaaggaaagcagggagacagaattgagcctgcaaagtgtcaatatcccctgcaaagcttcaatatttaatacagtgtaccacagctgcaagaaatgacaaacccatgggaagttctgaaatggctgagtgtacatacaagtgagcaaagtaaaactatgattttctattaaacttcagtgggacttgtggacgccagaaaactccccaaatgacatatgctgctttatgtctccaggtgatggagacatgaaactgaccactgttttagggctgcttgtttatttccttctggtatagcttcttgaatgatacctcagtaaagcaagaaccaagtcagtgttggagggtggaattaaaaaaaaagaaaaaaaaagattccaacaagctgctcatcaaacatcccctagctctgtggcccctcctccagggttcttgctgctgtgggatcatgtgaccaattctggccaatgggctttgagaggaaatgacatgctatttccagtcccagagaagagctccaccccacaacctctcagttgccatggcaaccaaggaaaacaactatttaagatagtgtccttgcaaatcagggtgcctccacctacttctctcctgcatggggggaagagtcccccatcaacccttactggacatgcagtgtgattaaaaaaccaaactttgtcacaataaaccactaaaatactgggattcatcagttactgtaggatgacccagcgtatcctggagggataaggagatgtcagcatttcaaagcaatggttctcacattagaattctctaattctacacgttagaataatctggggaggcggggacctccctggtgacacagtggttgagattttgccttccaatgcagcaggtgggtggtcaatccctggtcaggaag

SEQ ID NO: 58149 - DNA, 1461 bp, Bovine  19866880542907
ggattatattatgaaaccaatgtcaagaggagcaggaatttcccaactggtttgacgtcaaactctgaacatataagtaactatgtgtgtgtgtgtgtgtgtgtgtgtgtatgttagtctctcagtcctgtctgactctttgcaacccccatggactataacctgtcaggctcctctatgcatggaattctcctagcaagaatactggagtgggttgccatttctttctccagggaatcttcccaacccagggattgaatccaggtgtctggctttgcaggcagatgctttactgtctgagttactagggaaaccaatgtatagataactctactgctgctgctgctgctaagttgcttcagtcgtgtccgactctgtgcgaccccagagacggcagctcaccaggctccccagtccctgggattctccaggcaagaacactggagtgggttgccatttccttctccaatgcatgaaagtgaaaagtgaaagtgaagtcgctcagttgtgtccgactcttagcgaccccatggactgcagcctaacaggctcctccatccatggaatttcccaggcaagagtattggagtggggtgccattgccttctctgatagataacgctagtagacctcaaatctagagaaggttgagtcataagagaaaattgaaagatgacgccatgatactaacacatcactaattctccttttactatattccttctcagacttgtccatattcataatgatagttgtaaatatacaataagtacaattttgcattctacttcttctacttagttttttataagtatttttcttattgctattaactcctttgtggctcagatgataaagaatctgcccacaatgcaggacccgggtttgatccctgggttgggaagatcccctggagaagggaatggctacccacttcactactgttgcctggagaattacatggacagaggagtctagcaggctacaatccatggggtcacaaagaattggacacgactgactgactaacactttcacttccacttcagtatcattttttgactacataacgcaccaccaattaaactcattacaatttacctataattttgctagtatcagacgtttctgttgttccctgaggtttaactactatcaataatgctatcatgatcactctagacacacaaagttttcttctcattgaaatatattcctaggataaaactttcataagtgagttactggattggaaggaatgacattgttttgcagtactgcctactgatttaaaaaaaaaaaaaattgactgggtgcttcactgggagttcagtgcttaaaactttgccttccactgaagggggtgcaggttcgatcctttgtcgggcagttaagagcctacataccttgcagacaaaaactcaaaacataaaacagaagcaatattgttacaaattcaat

SEQ ID NO: 58150 - DNA, 861 bp, Bovine  19866880545006
agtcggacatgactgagtgactgagcatgcacacatttacttattctttaaatctggggagcaaagtcccatctgaacaagtgggaagcttgaataatgaaaccttaataaataggaaggaaggaagataaaatgaaaatgaattacttctaaggcgatacagtaaaaggcattaagaattaacagaattttcccaactagagattggtcgtgttgaacttactggaataaatacatctaaatcaatttgaaattagctaactgttcatcaaatggaagctgccaaagtgcttggaaaagattttttttaaagagtgcttaacatctctccacctgagtcttgtttacatgttaaatttgctcagcggattcaagggcaaagactaatccctatcaaaatagccacatttccttctgagttgaactaatcacgtgtgaacagttcaattccacccatcaaacatctgaacattctgtacacaccgagtgtcaccttaggtcctgaagagaaagaaaaaaggcactgaacttgtgtgctcagaaggctggggtgcagtggtggagatggacagtggagccccctccccatcgtctatgatgatgggcagcacagagactaaggcacacagagcggggacacatctctcagcccagacaggaaggagaggccgcagcggggagggagaaatcaggaaaggcatcctggaggaggtgatctgagctccgtcctgcttgtgtgaccggaagacagcttctgggatgttcattcttcaagtccgcacaactggattcaggaagatggggtagtcctctggcctccctagtcatgagttgctggctagcaagtcttcagttccttgg

SEQ ID NO: 58151 - DNA, 1629 bp, Bovine  19866880598057
cacatctaaaagactttttgtcctttttaatctaaactctgtatttagcctatcctaaatgaaaaagttggcttaaaactcaacattcagaaaacaaagatcatggcatctggtcccatcacttcatgggaaatagatggggaaactggaaatagtgtcagactttattttgggggctccaaaatcactgtagatggtgattgcagccatgaaattaaaagatgcttactccttggaaggaaagttatgaccaacctagatagcatattcaaaagcagagacattactttgccaacaaaggttcgtctagtcaaggctatggtttttcctgtggtcatgtatggatgtgagagttggactataaagaaagctgagctccgaagaattgatgcttttgaactgtggtgttgggagaagactcttgagagtcccttggactgcaaggagatccaaccagtccatcctaagggagatcagtccttgggtgttcattggaaggactgatgctgaagctgaaactccagtactttggccacctcatgcgaagagttgactcattggaaaagaccctgatgctggagggattggggggcaggagaagaaggggatgacagaggatgagatggctggatgtcatcaccaactcgatggatgtgagtttgaatgaattccgggagttggtgatggacagggaggcctgatgtgctgtgattcacggggtcgcaaagagtcggacacaactgagagactgaactgaactgaactgaaatcatcttaggatattcaacattttgaatcttttaagatcagaaactctttctatattatttgctgttgtatgtctagtagctaagagtatacctggtacatgctcatgattgttgaatgatcaataggaaatgaaagcaacaaacgaacagaaagtataccccagtatatacagtaagcacttgagtatataatgtttcatattttacaagtagttttcaacattcatctctatttgagagagatacagaatggttattctttttattcaatatgtgttcttactaaagctatgtgaagtggaatgtcttatgaaataggtgaagatgaaacttcctttcaaaacctaggttttctttttctatactgaaagttggcaaaatttttctcctaagactcagttagtaaatatttctacctttcaggctcaccaatccctgtcataggtacccagcttcaccattttaacaggaatgtggccagagaaatatgtaaacaaatggacttgactgtgttccaataaaactttattaaaaaaaataggcccatcagttgtaatttactgaccccctgatagacatttatgccacatttccaacaacatttttgggtacttaatgtttcaagtgctgtgagaggaaatacttcatgagggaaaaattcaccaaacacttagagctgaaggtcaactgagaacaatgacagaacaggcattaaactggaattcaaatgcaagtgtcttcttgaattcgatgttgtgcttgttattttgcacaacacaaagtccgccctgttgtttctaagaggagagagtggtttgagtcctgcgaagttttatgagccaactcagtgtatgctgag

SEQ ID NO: 58152 - DNA, 1563 bp, Bovine  19866880689723
gagaaagggggactcaagaacgtctaattggatggagaatttggaaataacggaggatgtgttaaaagcaaccagcacaaggggaaaagaaagacaactagaaacttcaataaaaacaaaatgctgctccaaaaagaaaacagaatcataataaattacttacatctgcagaaacatgtatacagtcataataacattcatgctgtttatttcaactttcagaacaaatcaataaacaaagcataaatgactatggttacagaacagaatttaagaattgtcagacttgacactttcagaggcagagaggtggacaaggggaggagacggagcatcccacattctaccaaattctacatcccacattttaccaaatggagaattagagatactgtttatagttaatacaataaaactaagtttgtgattataataaatatttttcctgattataaaatttttgttccttataaaaaatacaaaaattatttaaaaaaattttaatcacctataattccattatccctaggacctgggtttgagcccaagctctgaaatttaccatttgtatggctccaaaaaagtcacttaaacatttgtaactttttttttaatatttccttcatgtcttttatctatatacttttaaagagtatacagtgtatgtaacaacattttatgagaactgcacaatatacacacaattttgaatccagatgcttttcactttaaagcccaaagtaaaactctggatacaagtatcatgtccttctagacttgtaaatatacttcttggccatggggaggtcagaggttttccagagatgggcctgagccaaatattaaaagaaaccaaatattaggcaaagcagaagggggctgtggggcgtggtgatgagaggtcacaggcaccacgagagcaagttgcctccaggccgcagtaaaggtgcctgagaaacgaaacccataggctggaaagagatgataaagaacttggtaaataaacatgttaagggatccagctttccagtgagagacatgaaaagggggaaacgcaggccttgcttggtttggtaccccaggacctagcaccatgtctgccacaaagagagtgcataacaactatttttgtcatcaatgcctgatacactggaagccagaaatggctcctgggtttctggtctgggtgttggatgatgccaccatttgctgacggggggagggggggaatccaggaggagcaagattgaaaaggttatgtgtctgggcaacatccctagagattccgtagtctgatgttaattttgaaaaatgtcactgggaattctctggcagtctagtggttaggattcagcactttcactgcaggggctggagttcaatccctggtcagggaactaagaccccactaagtcacacacagccaaaaaataaagttaccattctgtagcaggtgtgggtgattacatagtacatccccaggtgtgacttgagaccccaaaggattctcggattggcctctgggagtttatatgcctcccaaatgaacgcaaaactgagcgt

SEQ ID NO: 58153 - DNA, 786 bp, Bovine  19866880710258
tctggaaagaattcaagagaccttggacctccccagcatttagatgattgcaaaacttttcatggaggcaaagtagcaaggggacaagtccagacagtgcatttccaaggtgaagccactgaatttgacaacccgcatctattttttaaaggaggttttgccacagaaatattgactttgggactgtgctgacaagccataacacaatccttttcctcctggacgagagcaggggccacgaaggcaaacgcctgcaggagctgggctggtaattagtataaatgaaggatgtgggctgggtgtgaaaaaacaactttcctgaagcacacatcaacctcaagacttgtctttttatgtcacttgaggtatgagtcctgaactttccattatgggagaagcagccctgaagggcactcacccacagcaacagaccctcagcctctgtgggaggcgatagggagaggtgtggcctgcagggaatgggtgaatcaggtgccccctctagagagcagctgtgtgtcaactccagacggctattttctgatgagcacgcaagtcccagcatggccagatcttccgatccagatttgttatgtaaacattttatcatttcaaatgttggtgagtaattctttaaaaagatgctgcaggcctaacaaaacacatctgtaggctggaacattctgtagtctctcctggggcgggtcgagtgtggtaggcaggagaaaggtccatgtgctaatgcccggaacctatggatatgttaccttacagggcaaaggggat

SEQ ID NO: 58154 - DNA, 885 bp, Bovine  19866880738617
gttttgaaaagtgaggtacatgacctgcgagtcgttcttcattctgcagacaaggagctctcttcagtgaaactggagtacactttattcagagagagtcaggagaaagaactcaacagcctttccgagagacacatgcaggtccagcttcaactggataatgtcaggtagagttctgttctgctttcaagttgcctgattggcttgtcacctaggactacttaaagcacaagtgctgtttacccagctcaggctagtttaaaaaattcaggggtaatttattgggacttccctggctgtccagtggttaggactctgtgttttcactgctgagggcccaggattgacacctgatcagggagctaagacccagcactctgttccaggtggggcccagcgtgtggggccacagggggaaaaaatggtactttattgatactgggaagccccagaggtgattttggtttcagggacagactagattgagtctcaaacaacattgtcagtatgcactcccttctctgcccaccacccctgccaagcttttcttcctgtcttcctcactccttcggtgctctgtttccctctgtgtattgccctcgttctcttctcctgttaagaaccttcctctttttgacagggaacagactgcctcagacagctccatcttctgtcttctggtgtaacaatccctgcaaagaaatagtgtctttcagttgccatatgtcaatcccagagaaaattgcggttattcttactggagtcatctgcttacttttggaccagtcatttaccaagggttggcccagcctgggtgatgtgcctgttccctctctagagggaagggtgtgctcttactggacagtacaaggtagaccagatcag

SEQ ID NO: 58155 - DNA, 1317 bp, Bovine  19866880748929
ggaagtctcaggcttttctgccccaaagcagttccctccagccaaggcacttccccagagagggacacactcctgaaccatgggcaggcaacattcacgtagccaggagatggggggcagcggggggaatggtttggggatgattcaataaattacaataaattacatttattgtgcaccttacttctattgtttttttagcctttattttttttaccttttaaaaaaagtatctatttttaattggaggatgattgctttacagtgctgtgttggtttctgccaggtgttgttcagttgctcagttgtgtatggctgtttgcaaccccatggactgcagcgtgccaggcttccttccctgtcctttaccgtctccccagatttgctcagactcatgtccattgagtcagtgatgccatccaaccatctcatcttctgccgcccccttctcctcctgccctcagtctttctcagtgtcagggtcttgttttttctgctacacaacatgaatatttctactcttaccaaatcagtgccacctcagatcatcaggcgttagatcccagaggttggggagccctgcactccaggggctgaagaggtggggcagtgaggggcccagtagcgtttgtgaccagaccgttttgtgactgtgtttcagactgcgtgtcaggccagtgtccctttggggaggtttatcttcagccttccacgtcggtgttgcccaccctcaacagaaccttcatctgggacatcaaagcgagcaagaatgtcagtctcgagctgcagttctccctgtcacgcctgaggcagattgggctgacggagaactgcccggatggagtcactcaccgcatcagcggccgcgtcgacgccagcacgatggtcaggattgggaccttctgcggcaacggcactgtgtcccggatcaagatgcaagagggagtgaacctggccttggacctgccgtggttccacagcagaaacgtctctggcttcagcatcgcaaaccgctcgtcgataaaacgtgagcttgcccacccccatctcccccagtagtggctgaggttgaaacctacaaaatcagcctcactttccatcagaaacagtctgatggggcggttttgtgattccatctgaccccttaaagcacatcccactcttttgtgaacacgcgggacgcctggtgtgagcccacccttcgctgttacacagaccctgtggcgactctttcctttgtccttggtatgtgacacttgtgttcaagaaacagaacgggacggctgcacaaatctatcgctccggactctgtttctc

SEQ ID NO: 58156 - DNA, 2252 bp, Bovine  19866880756622
agagattttttgatgaacagttacaattttgactttccaaaaccgaaactttctactatttttgcaactctttgtaagtcaaaaattatttcacagaatgtttttttttaactgcagcctacagttttatattgagctgtgcctgaagaaaaaatttttcactgataagacaccttgaagaaaggacaatcagtgtatctctagattgtatcaaatagagagaaatccctaactactatccagctccttgacatataggggaggtgggtggatcagacctaatgcattagccttgctatgaggccatttcccccatgtaaattttgattatattaattaccttttctttagattattgtataatggactcattgacatggatattcccattcatagttatttttatctttataaataacattctgatgtatttatcaagtgcttgagtatttcctaatatgttagtctgtctggctgtcacttgaacagctgacagatagagtttgtgaatccagaaagctggaagccatccgtaacacttggtgatgcaggcacattgctatcctgacaggttttgtgtgagttatcagatagtatcctcagacaacagctctttctcatttttctgtttactgggacagtgatatcccctcccccacctttttttcctctatgagcagggctccacttccaaccttgaagtcttttacaatcaaagcaaagagaagatttgtggatgttgaatatgcaaggagctgaagagagagtgattggaagagagatttgttcaggtgagtgagcaagtgttcaccagtggaagaaataggagggctttggaaattttacaagagaaactgaatgaagctcagaagagaaaattgccctctcttttgggatgttggggtgaatgtgagtgagcatctcttggggccagcttttccctggtactcatttgatctcatttccactatttggctcgtttacattctctcactgttttgccctaatcttagtctgttatttgtttgtctttttccttttatctcccttgtctctgattgcctcacttccttggtgtctgcagctacccatttctcattaatgatcatcaccttatcctggtgcagatctcttccaccgcttataattctgaattacttgctcacttgctcttattgacccttactcataggccagtattaaggcctgtcaaaatgaggtccctctaagttaagggacttccactctgccctacacaagagacatttactgtggtggtttttttcaggttggatgaacaagcctgctccagagcagaatggcactgatattgagttgccaggggtagcatcaaagagatcccgagaggatgaataccaggattctacatttgaagaaaaacgtatatatgagaacatgaaggaaaaccctcccagagaggctcctggaccacgctttttccgagaaggttttggagcaataacttttatccataaggaagcacctccagaaatgattagccaggaatatcattttgagagaggcttgcttttgacctcaagtcttgttacacatctcagggtttctacagaagagagcctacataaatgggagacaagtaacatacacaccaatgagatttcaggccaaagtaaatgtttgaccctctctacacagaaaaaatcttggaaatgtggtgaatgtggaaaaacctttactcagcgctcatcctttacccagcatcagagaactcatacaagaccctacacatgtgaggaatgtgggaaaacttttagtcgtagctcattccttattcgacatcaaagaattcatactggagtgaaaccatatgcgtgtgagcagtgtgggaaaacatttagatgtcgatcatttcttactcagcatcagagaatccacactggagagaaaccatataaatgtaacgaatgtgggaattccttccgcaatcattcacatctcactgaacaccagagaactcatactggagaaaaaccttacaaatgtaatagatgtgggaaggccttcagtcagaacacacacctcattcatcatcagagaattcacactggtgagaaaccttatttatgcaacgaatgtggctcttcttttcgcaaacactcaaatcttacacaacatcagagaattcacactggggaaaaaccgtataaatgtgatgagtgtgggaaaactttccatacaaaggcaaacctctctcagcatcagagaattca

SEQ ID NO: 58157 - DNA, 1850 bp, Bovine  19866880768648
tgttaggaattgcatttcactcggatcagaaatttaaactagtttcttcagtagttattttaacgagaacccagtttcgtgccaggacagtttatttttctccagagtacttaggactccctaacataacatgaagcatttacttatcacctatctctcatttaaacctcctaagggtggggatattttgttcatcgtcttacctctaaatgtcctggcatttactagaatagtgcctggcttgctggctatcactaagcatctgaatgaatgactaaatgttaactatctttcccaaatagattaagagtcactactgtataccaggaactagagaagaatctgtctcatagtaagaactctacaagtatctgctgaataaactaacacaaattcttcttactagagtcattatcctactgctggctgaaacgaagagactgagagagatcaccaaggagaaggactctgagagagggaagaaagacaactgcattcatgttaaggaccagaagaataaaggaacagagagagaaagaatagtagaaaagaacagaaataatttccactggtttatagtagaaataaaccagttcccatcttccaataataaataccgtgatttatttacagaaggtcccgaattctaatcaccaccaattcatttaaaaaatactattcatttaaaaaatactgtagacagttattaaatgttttgaaaaatcaagtttctctatatatctgtttatacaaaagaatctggtattcattttgaaattaaaaaaaaaaacaaaaacctaacaggctatagcaattaaaaaaaaaaggccccacaagataaagaatgtagtagtaaatgatattctagtcaaccatgggaaagataaatagcactcacttagaactgttttctttatcttcttcaaattgtaataataatttgttattgcgttctttttctgcctcaaaaagctccatcaaattctaaaagacaatgttatattagattttaacgtgtagtcaacaaacacacggaataccttccacgtggtagccacagtgggccattacacaagtcaggaataggtcaaatagtcatacatccaggacaaattcatcaataaccagtacctttcttaacttacattcagatcagatttcagagtttcattttcttttttgcagttttggaggctttttgaaagttggtcaatttcaaacttcatcacttcttgtaagttgtcataggaatcctgtaggcaggttttgctctcaagcagcttttcattttctaatctttatcaggaaaacatttttacaaatgtaaatagagacgttaaatgaagttctgctcgccagacttatctgcagttcactgatcccatttacagaccattcccaacttacagaagcctgactgatgtaaagcttctcacagacttgtgtgaaatggtcatgatgcacaaacattagtgtgagggggatggagaaaacagggtgagtgtgtcagcctgtagccacctatttcctcattctttctcccatggagtcaaccagacatgcttaattgatcggtaatttcgggtgatgagactcatttagggaggtccagacctaacccctttgtaaaccaaagactggccactgacttaattttattgctagctcaactctattcactcagcacatattctccaaatccagaaagacttttcaagatggcaaatgtggcttcgatctgaacaagagaataaattccttcaggatagaactatctttttaagtcacatgattattatttactgctttttaagggtttcaccctctcattctgcttcgcaacatacagt

SEQ ID NO: 58158 - DNA, 2034 bp, Bovine  19866880785415
tgtgttgaagagtattaaaagttgtttttgtgaagttgtgaagcaacaggatgaaggggcatatttaaagcaacactttttccattaagagaaaagaacaaataatgactgaagtataacacccacactgctggatagagaagtatcaccagttgaattttgcatgaattagtgtcagcagtcaatgaatttttagcaaaggagataaacagcaaaggcagccagttcaaagaacttggtatcatttaccaagtagaaaatactaatttttaggaattccttagatgactgaatttgttgaagagagtaccactaagtttcagtatgggaaaataccacataaaaattgatcagagactgatgtttagaagatagtgaggtccagaaattaccattagtatctttggaagatagtaagttaaggtactatagaggccaaaatggccaatgaaatatagagcactgtaggatatataatacaaaaaatctgattttaactttgcatccaaaatcatggtctctctacaagccatattccaagaattttattcttttgttaattcataacagaatggaaaaaggcttggaaaaggaaattcataaaactttttttttctttatcattgcagtataaaaagattagaagtatcttcatttcaactgaattcatttcaacctaaaaagaaacaaggactgaaacagaatatgataaaaggccacgaaactactcaaagaatgagcaaacattctgtcaccaaatcccatagcattaataccaatagctgccaagcctgtaagttagattagtactaactaaaccacttttcagaaagtaacagtaaacttaaagaactaatgtataactaacagaaccgacagtggcaagatgacccgcaaacaagacatcaggatcaaaaactgtgctggctggaccgtgagtctgaccgctctgaccaatctctcacaccatatagttgttaatcagggggataaagatgtcagctctacagtcattcagattgtcattagttaagcacttttcaaatacttaacacaggaaaattccatttaataaaaatgtaaagtatcaagatctgcaagacagagatataggagtattcccttgctcgtgggtatctattagcctacatgaagaataagtatgtacataggaaatttgcacaccaagtctggaggctaagtgcaaaccctcagggcaaggcaatatcaaggtccttataaacaatctccctgcccctagaagacatgtttacacaatcatgtcttacttttgtcatttttctctgttccagacacttcgaagaaggctttttccaggattgcaatggtctgggcgtccatttcgtgggctcttttcacaggctctaacagtctcagtcttctgttctcctccctgagggaatgattttccatagcatattttgccactctggggtggtgctctatctttgacatggaagaatcagagacatatatttacaaacgtgaccattttagagaacaagtttttctaaaaaccaacagaaaacactgtggacaccacaggaactatggagagcacctcagtttttatgatcagactgaatatgtgcatatcctacaactctcaagtccacatttgggtctgaaaatttgaaacttctccatctactcttgaaactcacccagacatcttcaataagcatatggggtgtaccctgtggcagactcttcatgcaagggagactgcttcaacacactgaacataataagaaagctctccaatgactacagcgaaatgccactcaagattcagtaaatgaaaagggtgaggtgcaaagaagtgtatatggcagctgtcttttgtgcacaaaaggaataaaagccaaaatatctgtattggtctgaaaatgcataaagacctcttgaaaaatgtacactctgataagagattatctttgtttcttaataatgtgcctggtgtcaactatccatcctcccagggaaaaggaaaaacaacaaaactttgatgag

SEQ ID NO: 58159 - DNA, 1723 bp, Bovine  19866880796524
tgtctgccttattatcagtttatttttagagtaataatactctagtaactgaagaatgagtctcagttctaagatgttgaccagattaacacaaatgagtttaataactacttgttgaatgaaggaatggaacagtaaatgtataaattccaaaagagaagtggaaaagtcctgcaggtatcagtgaaaatacacctggttttgtcatcaggtgtagaggagtgagggacattaacaaaaaactttaccttgacccaaggcacggaggaagcatcaccgtttatatgcagaaagattaagtctttactttaggaaatgatatcaggtatcactgatacctgatatcctgcaggtatcagtgaaaatacacctggttttgtcatcaggagcagaggagtgagggacattaacaaaaaactttaccttgacccaaggcacggaggaagcatcaccgtttatatgcagaaagattaagtctttactttaggaaatgataaagtccaataatagaaaaacaaactcattttttaaatcactgacatttctgaacatcactaaaatatgctttttttttttaagcaattaaggaacaccacatacccttaagaatcagagacaacagccaatctgtttctgatctgggctggatcagcaatgtcctactgtgcagagagggcactctctcaggtcagtgaggtctgagaacactacaaagtgactttgccttcctgagaagcacacagcatgtcagcatactaaaggctctgcaggttctgcagatacccaagcatgctgagctctcaccaatacatatttccaaacctgggtgaacacagaaccttgcttttgtgtgaagcatttgtgtcttgtgctcaattttaatatctttttggcgaaagaacttacattgatgtcctccagttcttgcctcagggtgtctattggtttctgttttctcagagactgaggttcttagctcctggatctggctcatgaggtcagttacaacttcctgacaaggacagaaaggtatcttcataccgagtgacagcaaagagaccattctttaatggtaaatagtttacctttccaaaggacaacagaagtcaattttattttagcagaatatcatgtgtcacattacattattaatatcatcacattatattatcaatttatattttaatgattttctaatattttcatcatttgcattggttttatgaatgaataagagctgaacataaaaggaatgtatatctaattattcacatcaggggactgacaatcaatgagaaaaggttgcattaacggcatcttagttaaagggggcaggggatgtgttttagaaacactgcagttgtgacataacagttggcacttcaagttatgaggaaagttaacttaaaagacctcattctccaggaactttggaagatgagcacagcctaaatgcatacagaaatgctggctacctatcaccttgggagcaggaaaccagcatgtgaaggcagcatttataaggaatacacagggggctataacctcaacctcaacctaccttgtcagcgtctctagacttctccagagaactgattactttttcattagcacacaaactctcctctagtttctgtacttttgccatctatgggggggaaattaatatttttagaaagagaattaaatcacaaagttaaccgtgcatatatatccaaaaaaa

SEQ ID NO: 58160 - DNA, 3391 bp, Bovine  19866880824959
tccctcaggagagccgtgtccttctcagttgagtcagttccagcctttttctctgtgaaacaagataagaggcctcggtggtcaccacctgtccccctgtctggaatgactgtgaccttgggggtcctgtcccttccaggcccttccagcacacacgcagcgaaacactgggctgctgaggaggagtggtgctggagcgtgggttctgagtcctcctggccctcccgcctccgtgggggcccccctcaaggtctgccttgcggctctttcagcgtctgcaagcggtgcattcggaaaatggaccaccactgtccctgggtcaataactgtgtcggcgagaacaaccagaagtacttcgtcctgtttacagtaagtcagcttccgaatgccgtccccaccctgcggggagcactcgccgtttgccttgctgctggcaggacggtgcctggccatgcagacctctgcctttctgccagagctctccttggttccacacgggcccactcccatgcccttccctcgagcgtctagaaaactgcttccagctgattagctctaagcaaagggccgtgttctgggctcccaggcctggtgtcgagctcagtagccaagaaggcggccaccctccctcagctgcaggtaggtcgagggctggagggaccacaggcagtcagtgccctgacccttcaagcgagaagaggcagcgggcccggagcccccaggacagcccgagccccactgcccccagggaatggccgcgcacctcagacctaggggcgggggctggctggggggaatcaccaggtggctctccggcccctccctgcccagccctcagcctgagcgttcctgagtgggaggttgcaagcaccccgtcccgggcgcccgcacggccaggcggttctcacagcaatggcgtctgccctgctttcctgttgcagatgtacatagctctcatttccttgcacgccctcatcatggtgggattccacttcctgcactgctttgaagaagactggacaagtgagtatatgccagggcttccctccctgctccaggaggggcgcgtgaccggagtgggggcgggctctctgtctctgtcctggtgccaggggctgacctcattttattagatctcctgcaagcctatggactgaccagggaagaaacagcagaggcccgaatatctcttcatgaaataaagcagccccttaaagtcagttccacaggtaaagtcgtgagttggacagaccctcctgggtctgagggggcccaggaaaaatgtaggccccagcggggaagctcatcccaggagcagagccgtgcctttaagtgaggagctttaattgaaggtcattgcatcccaaccttgcagaaatccatttttaactttctggctaggacatgggtggggtttttgttcatttgggtgtttttgtgtgcgataatttttttagctgcttaatcaccaatgtatgttaagatggtagacaaattcttcctgcttttgaagtatctcgtttaaagatgcaaatgctgaggagggaactccaatcacaagactgcataaatcctgaggggaaaaatatagatgctgaacgtataattaaaatttgaaattttttaagaagaataaaaatgagatataagaaaagaatttttaatatagtagtccccgcttatctgcaggaggcatgttccaggacgctccgtggatgcctgacacctcaaatagtacagaaccctacatatacagcgtttggtgttttttttttttttaaatacggatgtacctatgataggggcttcctgggtagctcagctggtaaagaatctgcctgcaatgcaagagagccgaattcgattcctgggtcaggaagttcccttggagaaaggatagactacccactccagtattcttgggtttctctggtggctcagatggtaaagaatctgcctgtaatgcagagacctggatttgatccctgggttgggaggatcccctggagtggggggggggggggtgggcatggcaaccaactccagtattcttgcctagagaatccccatggacagagaagtccggcggtctatggtccatggggtcacaaagagtcggacatgattgagcgactaagcacagcacagcatacctatgggaaagtttaatttatgaatcaggcccagtaagagagcatctgagcggccagcatcactactctggcactttggagctgctgctaagtagcataagagttacttgaacacaggcactcggataccgtggcagtcgacttggtcaccgaaacgattggtggcatatgtagcatgtacatgctggacaaagtgatggttcacatctcatgtggacagagccaggtatgagatttcatcatgcttctcaggggagtttgcgctttaaaacttattatttctggaattttccagttaatatttttgcaccaaggctgactgcaggtaaccgaaactgcagaaagcaaaaccaaggataagggagagactgctgtagttgctggaggaatgaggaggctgcctgccgggctcctcctttcacacgcagtctgtgagacaaacacctcgagcagaaacatggtatttccacccttttaccattgattggtccccttcttcatgtcatcattttttatgagttttgctcttcctgcatgtactgacttcttaggtatctttagctcctgaccagatattaagagatttttctagcctctcttcctagcttgcatctgcccccttctgtctttctggtccacctggcttgacctcatctaggggaagaaaaatcccatgggtactggtcacctcaggctgctgcaacaagatgccatagactgggaggcttaagtatttatttctcacagttcaagagtctggaaagtccaagatcaaggtaccagtcaattccatcccttacgaggacccttttcccagcttcaaatggccctatcctcatgtgtcctcacccagcagagagagagaaaagcaagctctctggtatttcttcataagaggtcatgagggtggggccctcgcagtagaattcgtgcccttaagaagagacgtgcgcagtgctgagagcactgagggccactgttggggcaatggagttggctgggaccattgcttccgtgttcccacttagtgcacaggagactgtcagcgaggccttatctcaaccttgtaacaagcctgcagggtaggagagatactcccccctttgcagatgacaaaagtcggtgtttgcagaggttgagcaagttaccctgtcacatggctaagaagagggcctgtgattcaggccttagtcctgagcgggcttttcctaccctgtctggaagacttccaccaccca

SEQ ID NO: 58161 - DNA, 661 bp, Bovine  19866880957103
cgactgaagtgacttagcagcagcagcagggcatttttcactttttcaagtttgtgatttgttgtcatctctttccttattataaataaatactcacttttcacatttgactttctatttgtaattctgtattctttttcttaaggtaattaagttcagccccacaaacctgtatccactcctctctgtgtctcacgcatttcctgttttaatggaatacattctccagtatttgagaaaaggtgtgtgggagtttgttgtttggaggttttattggttttctttctgttttagatgttgaatgtctaaaagtgctctttttctactttatcacttaattggtagcttggatatagaattcttagttggaaattattataccttcacaattttgaaggtattgcttcattgtcttccagcttccagtgctgctactgggaaatccaaagccagtttgatttttgtttctttgcataagaccctggaaattataaaatgttctctttgtttataggctcccgaaattttgctgtgatgtgccttgatgtgagcctgttttatccattggactggacacaccatgagtctttaaatcgggaaactcatgtcattccagacctggggaatttcttgaattatattactgatgatgatatctctg

SEQ ID NO: 58162 - DNA, 1556 bp, Bovine  19866880978588
cctccaattctgcatcccctgaccaaatcacctgtcaaccacacccccgaaactgctgaccctcccttggctgccgggcacgtggggacaccatacttctgaattctccatcctagaggaacgcgcgtttctgtctctctcttttaaagagagaaacccattttctttcaagttggatccaacagtttaagaacaaaaatctattgaacattttttcccccactttggtctcttggtaagatggatttgggttttgattctgtcaaaatgagaaatttgccttgttctgtaagatcagacattggaagggcttctcttttctttccctttctttcatttcttttaagccctcaaaggcaggggctgacaaggaagccgcatctgactcagaactccccagcacacacctcggcacagccagctgagctccatcgcccaggagcccattgccgaagccctgggttttggcggcacatcatacacagcaccaaggctgtgccacacacgtcctcatctgtgatggggcgcctgtcagataagagaatgccccctctcgatgaagcactgccgctccaaaggcctgccttgtctagtgacaggaacccgtggagatcccgcctctacactgccttctgacctgcagcaggtcactgagcctctcagacctgggtctcagctggaaaataagggcttagacagatgggtcttttgtgacatagtggtccttgtcccactgatgccagtgtgctcagagtcccatattaacccaattcggttcactctgtaataaaacataaagtgtttctccccaaatttaagtaacatgaagcttttctttatcctggttttttatgttgttgttgttagatttgtgtgtgtgtgtgtgtgtgtggcagtagctacaaaaatgacactgtgcagtttaaatagagtgaatgtggaaatgaaagagcgtcttagaggcagggacgtgaagatacattttcaaacacagcaaaggtgactgatgggtgagtcgtttgcttactggcatcttcccctttctctactgctgggttctcttttgaggaaccctattttgccctctggagatactctgcagggacaatcagtcaagcttccctgcctactgagatgaggatccaacaagtctcccaggcgaggctggttaactctgcttcccaggaagatggagacaggacccagtgccaagcccaggggccagtggaaagggctcccctcagggcctggttgccgaaagagcgtctccattcttccctgccgtcaagatgctatcttcccgagacccagatgttcagctttgtcttcaacttggtgtcaccctgtgtccttccactgaatcccaactttcaagttagtcagaatcagtctgttgcttgcaaccaagaaccctaaatctaatggacatttgatttctcctctcctcctttcaatgtttcctaaaagcacaaagaaagaagaaaagaaggaagcgacaaaggacggaagggagatatcaatgtttttaaaatgtgtttagccacagagcctttttt

SEQ ID NO: 58163 - DNA, 1748 bp, Bovine  19866881058677
ttggtcccttttattcctcggtggcctggaagtgtgtttcgtctccagttcaggtgagagaatagtaggctgctgttcctaaaatggcagtagttctgtgcaaagctctggaatcaaggttaaatcttggggcgacctgtgtcttacaggcacagaatctagaacattctagcactccagtcctcagcattcctgagggccacgacagagagcatggttttctaagtatcctcagcgaaaagttctttgtgtaagaatattaccgagagggctccccctcagggctcagcggtaaagaatccgcctgccaaagcaggagacgcaggtttgatatctggtctgggaaggtctcacatgcttcagagcatctaagcccacgagccatatctattgagcctatcctctagagcctgggagccccagtggctgaggccgtgtcccaggactactgaaggaagcccctgtgtctaaggcccggctccacagcgagagaagccagcacagtgagacccctgcacatggcaactggagaggaaccccccccctgcccccggtgccactagagaaaagtcaggcagcaacaaggactctgcacagccaaaggtaataaataaataaaattaccaaaatgaaaaaagcatatagctgaggaatcagcacaatatgtattgcttggtttatagatgaatgaagcttgtttactaaatacttgcaatgtggtctgttgcctcaggagcagagcgagaagcaaaacattagttgggaaaagtgactaaaaattggcaaagaactcaccatattttatgactgcctctccagccaggcctcacaattcattcctcttctggtttagaaatgtcttaaccactcaagaaaggagctaatggaaccgagacatccagcgcctcacttggtgaagtgcttgttgaatgaatgagcagatgttgccaccgaaggttcgtcctctcctctcctcccctacgctgtgtctcagccctccctcgtagcactttatatggtaacttcttctccaccagcactcagcctgagcatactgtcttacacaggaaagtcgcttagtgtgtctgcctccttgcgaccccatggactatacagtcattgggaattctccaggccagaatactggaatgggttcccttctgcaggggatcttcccatcccagggatcgaacccaggtctcccacaatgcaggtggattccttaccagctgagccaccagggaagcccacacttaagtcttacacataatcccacacttatgtcttacacatagtaggcatttcatgagtacactgaaataactggattgaattggatccacagcagaatgaataccaggcagttgagtgctacccacactgaaattcctcatgaagatcaaagcagacttgttgccatgttcaattatcgctcaacccttggcaaggatctgaagacaaacagaaacatcttgatctatttgtgcaaaaagtcagcttgcagcatctgtagcaagtatgaattctcattttaaaaattgatgtccctggcctggagaaaatagattaattttttttttttaacaccaaagacaaagccttcattatcgcaaaaggagcttgttacccatgttgtttaagaaaaatataattgaaaatacagctttatcctggatatattggactgatttgacactagacattttttaaaaggtataagggattttcaccttcattattagaagtac

SEQ ID NO: 58164 - DNA, 1155 bp, Bovine  19866881087788
ctgcgtcattttcttcttctcgtgattgtgtaaggcattttgaactggaaaaacttctttccttcacattcttccaaatgatcagttggaatataaccagtgattcggaatacaaataagacccctttcatctcaacccccccacccccaaaatcattctacgcacccagagcccaaaaagtacaagacaggcaattgattttgtgaattcagaggcaaatcgtgttcacacagggcacgaggctgctgtggtcaaggacccttcttagggctccagccctgatctcccaggccacaaggggtgagcatccaacttcagcgaggttttaagtcccatccaggcacctgccactgcctcctgggcagtgggaggtcacgggccctcttcactctctcctatgggtcccccaccaggcgtccgggccagtccgtccacgcacaagcgtcacgactcaattagtacaaggaggcgtggcctggagacagtggcctccacgttagtcatgccagacagacagcagagaggaaaccagaggccagagaagtgattttaaataggaaaaaaaggaaagcagcttcggtcaccgaaaaatagaagggatgatcttttcaaaaataaaaaccatggggactttttttttttttctctgcaatgttcagccatttaacttgaggcattaaaaaaaaaagtttcagagtagttgtgttgcttttttcggtttagacattcatgagaacggatcggacggtagtgctgggatgtggtttgtgtctgagtggcaatgctgctcagggtccttcagaccacatactggtacgggtctgccttcccttggtctggcgtggcaaaggggctggcccagcctagagagaaggggtggccaaaaacggctttcatgttcatccattttgtttttttagcccatcttctctcttcctttttcaattgttctattccctgaaaacaagaacaatcatactttcagtcaagcactttactgctgtggtttttgggggaaaaaaatccattagcttgaggtgaattgagtaaatgcttcctttttaaagccatgaagcttatctacatagtacattttttttttcttctctttctctcataaaaagtgctaaagacaaaaaggaatcatcattttt

SEQ ID NO: 58165 - DNA, 1023 bp, Bovine  19866881118885
catatttggaaagttaggtggaacagatgctgctctaatttggtagagattacatacactgtggatgtaggaattgtgcatgcaacctctgggacttctaattctctctgccattttctatcaagctgctccccggaaactttgatggcctgtgacactctaacacaattagctgaggagtacttgtctttataactgtttaccttcccatgtatagaatctattggagagacaacaggtaaactagagaccaatgcctggagtcctcccaaggtgagagagatcagctttgattccatgggggtgaggggagagaggagcagagagcagtgagacttcagtctggctacttaaatgaatttactgtaatatttatctctagatgtgatgacttaaatattaactgcttggtttatcttataatggattagcatacaagccaaaaaaaagttttcacttaaaactttcctagcactttaaaaatcctgcatagtaatgatttgtaaattgatattggagtggcacaattaagagagtcttcttccgtgggccttgtcccctaacagaaggacatgctctgtgaggacctggctcatgccactgagcagctgaacatgctcaccgaggcctcgaaaaagcactcagggcttctgcagtcggcccaggaggagctgaccaagaaggatgccctcatccaggaacttcagcatgaggtgagatgcagggggaccattactcaggatgggcatgggggtgggggaagcagggctgcattgtggttgagctatgaggtccccaccttgggtaattctcctcattcagaaaagcaggctagcagggtgtgtagctgggctcttaacaggttgcttctttgtgttcagacttgcatggctgtccttctacccaccctggacccttgacacatgccagcaagttctgactactatggcaaaaggttatggctgacttccatcctcattttggctattgtggttttatattttgtaattttcctcagatgac

SEQ ID NO: 58166 - DNA, 790 bp, Bovine  19866881125434
accttcgggtaagataaaaacccccaaccctccacactgaggatggtgtgtcttattttcaaagactccccagaaggagtttcactggtaaccgagaagacaccagacagcctggactgaccttgatctcaccggccaaagattcatctccctcccactcatggctctgagaacaaaactatggagtaaaccttgaattaaactctcggtcaaattaaaaatgaactaaaaactttgtaatggtgactgtgaatttcaaaatcagccatatagaattcatccattgtgactgatttaaacctcatttactgcctgagaagatcatgcaccggccccccaggagggttctgctcccccatgcaagagaatgctccaaagattcatctctctctccatattccttcctctgtgtcctctgaaccacattctgaattgtcaaagcagaatcataagcatgtctgcataaggatttttatgttaccacctcaagaatccaggacttgagactatggttagttctcatttatgccctgcctgcttccaaaaaaggctcgagacctgattatttgttccgctgcgtaccaaccatcacctcctattgtcagagagtgatgtcagagacttatttctaactcctggaattgtctacactagcctaatggtaaagtcaggattaggattcctcattttgcgagaggaatagcccactcaggtacccctttctcttcaaattgacaattaagtcgatcacaaaagcaaaagagttctccaacgagaacagctaaggggg

SEQ ID NO: 58167 - DNA, 978 bp, Bovine  19866881185798
ccactgcccaggcttcttcagcctcactgtcccccctcctctcggccccattcttccatgcctcttccttcaaccatctgttcaattccatcctggctgagtttctgcctgtggcctcctttaccttcccagttctcctccttttttgcagagctgagggaacaggtgttaatattagagtaattaattaatcatgaacctaacatttgtctaagaactcatttgtatgtaattatgtttcttcatctcaggactaactttagcctgaaaatgagcatttaatgaaaactgaaaatgacaaatgctagacactccgcttttacagagcatgcgttttattctcaaaggtcttgtttttcaaatctagggctacagctgaattttcgtcatttgaaaggttcatgttctacgtgctctcgaagccaatttagagaaggagcgttaaggaaaaggaaatcatggtctttgcagttttgaagacagctcacactgtctttctgaactgaaatcaggctgaccagtaggctcctcttttgctattctcctggccattattttttgagcactgtcaattttatggtaacctgaaagctgtctcctgctacaaagggcacaagtttctgtaaactatccataatgggacaagaagcaacaatttgcctaattgcttggtaactgttctttgccagctgacaagaatttcatcaaggcagtcagacaatagggacagcttttctatctagacagctgggaatggaaaaccctccattcaactacagatgagatgaatgggtgtgagttgtaatttgttatcagtctacttgggcagaagccagtatttcaactattcataccaaaccagctctccaccattgtttcatttttcctgggaggaaaagaacattcattttatctgcaatacacttgaaaatttcaggatcacaggggcagtgtcctctgaaagatattttttgagaa

SEQ ID NO: 58168 - DNA, 958 bp, Bovine  19866881202632
tttggggggcgcagggggctcttgaaggagctgtcctggttactgaacagtacttggccctctctttatatcttttaaatggtatccttcccctcacccctaatacgggcaggcaataataatagataagtaagccacccttggcttattcacctcaagtttttaggtcttcaatcatttgtcctatattttgctctctctgtctatggattcaaggatctgggggactgtagaaagaggggagaaaaatcactccatgcatgccttttccacccctcctctacacgttacatgtttacaatttgcagtgggtatattactttttaattgtaaaatcacaacccatagaagttagcctctcctccactcctcctttttatgtaacttttagatatgtctttggatcagtcagggtcccagcagaagaaaagagggcctgcctgacagcagtcactgaagaaaacgtgatgaaaaggcggattctgtgcagagttcggggaagcccacaccccaccacaaggggtggtccggcacctgtggcactaggagcagaaggaagcctttgcccacctcgggtggcaggggcgacatcggggagccattcctggaactgggagagtggcagctggagcagtaggcgaggccggcccgtgagccacacgggaaggagctggttgaaccagctggttgaacccagtcagagggcaagggtccaggttaatgtgggcccaggggacaacttccatcacagaatgtggtggaaagaggatgggagggccaaatcgacaatatccagcacgtcttattagaatcgttgattaatattttacaacacaacatatatgttccactgcccaaacacgtctctgtactcgttgccctctctgtactaagtagtgcgtaatgtcataaaggagtgagtgctttggtggtcccttggtggtcccagtgctggggg

SEQ ID NO: 58169 - DNA, 937 bp, Bovine  19866881258648
ctcaattaatcttgacgctttattatgtcctccaattcatcagaggaaaccttaggcttctcaaagctgccttaatcttaactgagactgggtgtctcctttgtcctacattctgactgtcctgagtggggaagggaagcgccaccccagcgggcactgggccttacctgcatccctctcatcttctggaagcgtgcaatggtgtcgctgatggtgtacacacgcacgtggcccatatgcagcttgccggagggataagggaacatggaaagcacgtaaaacttgggctttgatttctaggaaagggtgacggaaaaatgcagtgagtatttattcatcattcacagggaactaggtacacatataatattttggcattttattcaaggtaataatttaacattttcaaaagctttcttttaaaaaaaagaaaagaaacattcccataaggtaaatggacaaaaatgccaaatgccaaaattcaaagcactgggttatcctaaagaatgtccaaaataatgccaaacaacctcacagtgctaattacccctacttatttttaaatctgcctttttctcttttagaacagctatctaggacttaaagaactgtatgtttttccaaacgaagctctgacatatgtgtccataaaattcatggagacaacggtgaatcacagagatgtgacaagtctaaaatggagccgctccctaaattccgggagctgcacgcagacttggactgagagggtccccaggcgcggattcaggttccaggtttctctgctgtactgcgagcttatctttcaacagaaaaagctgaaatgggagggtaatgagaaaatcttagccaggttgctgtttcccagggggtgatctacaggcagcctcaggccagggttacataatgctccagcatccaaagacacacagtttca

SEQ ID NO: 58170 - DNA, 1218 bp, Bovine  19866881460221
cttccctgggactagaggaacgagatctgcgtggccggggccctgccattcagagtgctttccctttcctaatttaaacacactcgtcccacgtactgagacaattaagccacaggaggtctttatcaaataatgcactctcttgcttttcccatacacagtaatgagcgggaacggaggatttaataccagggtaggcgacactcaacagccacttgcacagcttggtatatttagctaagtccttgggcagaaaaccgtggctttgcccatgatatgcactgagagatgcctgtcatggcctgaaacaggcctgtccagcttttcaggaaaagataagcctcgtccaagcaaggtaaaggccactgccgtgcaggtttctgggcctgggtagggctttaatttttaatttcatctccacctagcgccagtcctgtcttcactaggaggccccaaccccacccaagcggcagcgtgctttctgcttggatcatccggccccagcctcctggggccctcaccgtgcctttctaaccagaggctgggcttgccctggccaggcccctcccacggcaggctccattcatgcagacacgcacgtatataaagtatcgttcaaccaacccagacaggccgcggcacagacggggtccccttggaggggcccgagtttcccacccctgtgggaaagagaacaggccctcctatctctgcgttcccaaggtcagggggcacatgcaggctgcggccatgcccgggccagaggaggagagtgcgggctggtgaaaacgagcccagacatactcacggggtccgtcagcatggcccggcagtgggaagccagggccaggaaggccagcaggttgaacacaagcccgttgatgacgctgtacacgtagtcccgggacggaatcagcatgacgaagaggaccacgaactccgcgtagaggaccaggaaccaggtgacgatggcacaggcgatgccacagccggtcgcggatgaaccacatggttcccgcgggacgggggtgggggaggcgggatgcacttctccggctggaggtactccggcttccgctcaatgtcttcggaagtggtgggcggggataagcatcataaactattctgtccatactggcatctggaagagagagggaaggatccagaaatggcgggcgtggtctagtcgtctgggagacttgatgaagctacctttcc

SEQ ID NO: 58171 - DNA, 1741 bp, Bovine  19866881477263
cccaagacgcatgctgaggctgtttgggtttgagtaggaggacagaaggcctggggttaagctgctctaacttactgcagtgcattagccaatagtaaaggcatgacactcagcagcatggggaatgttctagaaacaagccaagcttgttttagccctctggccaaaatggttaattttccagggagaagagactctgagttaggctctacctgtggtgacgaagcaaagtgtaggaatgttggccagcaagcccagaagtgtgtccccaccacctggctgtggggctgggtaagttcatggtctccggacctaggacaagacccacaaccccagccccaggcccctcctcaggacagggtaggtgtgaaggtcgagggagctggaggtgcctgttacacacgctacggaccgtaagaccctgcacacatcacagacggtgtgcacgtcctctctctaggaaagacgtccattcctccagaagcacgtgctgagcaaggtgcccgctctctcaaggctccagccgagtctctggagacagccgtgaaatcgctaagactcgataacggaagtctatctgtccacggcgtgtgctgcaagacagcaagtccagactcccctcctccggctctttatcttacactctgtggcctgtcgcttcacccaccaggtttctcagaaaccatggtggcctccagttctctgccagacgtaggagccgagggaaaaccaccccggaacacagtctctgaggcaggcaggcgacacctcagtctgtagagaacttgagtcccctcaccgcagaggaaatccctcaacagcggcaatccctcaacagacaatccctctgtctgctttcctgaaggacaagagtgagctcgcaaaggcttctccttgccctttgcccaattttcctccttcctcgactgccctcacccccagcgaagaaagaggacctgaactgaatacagtacagtcatgaaaagtaaggacgtgtccagaaagctgagaggggagaacagtaactatgactcaagggacagacatcccagagtcaaaagttgcacagactaacaggaaagaataaggccagggcctcccctcccaggctggcagagaatcaatggctgaaaggcaggtaatgtggattgcgtgcatttccaaaggaacactgaaaaaaaaaattttaaaaaggaacaccgactcaacaaatattcagagtgactatcatattcaaccagttttccaataacgcagccttgtgctcttcacaagatagtggcgatcggtgttgccagggacgacttcgcagcattagaagatgcaggggtaccgtctgcagcaccgaagagaagggctgctggagattgagaaccggggccatcagagggagctgacccacggcagggagattctaaacttccagattctgcacaacccaaacccaacaaatgaaaagctgaaatttcattatgattcaagagctgatcaaggctcaccattttgacaatgtccaaatgcaagggttctcccggtttttcctgttgccatactgatttgtatgcatatcacccaggcccccacaattgctgtctaagctctaaaccagtaggattttattggaccaccgccacactttgattacacgtattatagggtctatgtctgttctgcattataatagcaaggctgagcagctgtgaggaaagactcatagcttcaagtatttagtcggctcttt

SEQ ID NO: 58172 - DNA, 1407 bp, Bovine  19866881564735
ttggctccatactggccatacttgatacctttgtccatatgaggttttgcgttgtgtattttttaatgcaggagaaatggtggaatgtttaagatgttcattaaaagaatttttgacccctgaagttcttgtgttgcaggaacaaatgagtgcccttcaagtcaagttggatgaagaagagcataaaaatgtaaagcttcagcagcagattgacaaactggaacatcattctactcagatgcaggaggtgagattgcaagcatgacctcagaaaatgtctgaacctcaaagtaaggaaggaaggaagagactttagaaagcttgggtcaaggtctatttgagttgtattctcttattatttcagccactcctctgataaggagacacacacccctagtctgaatttaaaactgcatttgaaaaacagaaacaaagtgattggtgtgtgttttagcttgttagtattcctcttccagtaaattgatctctttcccaaagcttttctcatcagaaagaaatgattggaccaaacagcagctggagcatctctctcagttgaacgtccttgaaaagcagcttcaagacacacagaccaagaatgactgtgagtctgaacactgggagcttcctgatctgaacgctgtaactcagtaactttttactgatacggcttagtgttgtgtctgtgtttttagttggttggtcctgtttcttttaaattagactagatgagtaatagtaatataaagggtcattttctccaagactgctctcaaaaaaatgatacaaatatttgcttgaagtttgaagaccactttgaaaatgcagtgtcttaaatgcatgtgatgaatgttttaagagttttagtagtgacaaaaaaagcataaattatatatttgtatatatttgtagatgtgggagtgtcatttaattcccagtttttccagtttatgtctccttttatcaaagtatttacagtagtttactaagacaaaaaagagagccattctcttttgtttgatctgttaaaaagttgcccagttttaattccagtttgagtttttttaagaagaccagagtgtttaatctatgttcgaaagttctggtacatctccaaagggttttcaaaaagtaaagattaggtcacctaaagtatgttaaaatctcttgcattttttcttatattaagaattttgatgcacattctacaggagaaatgtagaaaaatcaaatgacctacacgtgagggtcagatattaactttttttgggggtaggaatatatcagaattcaggcttccttggtggctcagtgctaaagagtccacctgccaatgcaggcgatgcaggttcgatccctgggtcaggaagatgctcggagaaggaaatggcaacccactccagtatt

SEQ ID NO: 58173 - DNA, 1188 bp, Bovine  19866882029137
gcttttattttaaaaaggaaaaggttttccatatttacaggtgactttaaaagctttgaaatggcagcctctaactgcagactgccagttgccacaggtatgtacagatgcggtgttcagaaacttgagggtcagccaccacccccaccccctgcccccaggtacaccattaatagtcatggctcttaattcagctctactaagtaggcatgggtagctcttacttttataaaaggggaaaaaaagtctcccaacaaggtaggcagttgatcaggatctttatggctcattctttttcctttcttttaaaaataaattttcagcacgcaacttttctgactcctggtaagaaaaagaaaagaaaaaaaatttaggctctaattcttataggaagaagtattctcagaatgcattaagtttaaatttccactgataaactcttaacggtaaacaagaatctcattggtacgataaccgaattacgcttggactagcagtggccaactttttttccaagcagttgagtgattcaataattaaattttaattaaataatcatttaaaaatcagcatgagcctatttagaacaatcaggagtttacctcagtaagtctgacattttccttcttcaaccgcactacgtactggatcttctgatggaggttttggtgacccaccaactttccattctcctcggccagacactccacctgtttccttaacatttccatctcctgtagggaaatcaatacagggaaggtaaaaatgagctgctttgaatttttcatttaaaataacattattgcatgccttccaggaggagagggagggagaaacagagcccaggctcccagctttcgtgaccacacatctctacgtgctctgagcaactctcaactacagggtgcccaatcgcagccagcacccttatgctgatcggctctgttcataaaaccaacacacaaatgcacctggcatgttctctctttttcttctttcagctcttcgaactttgatctcagttgttccttttcttggaatgctttaaactccaacattctgactcgtttgacttcctcagtcatcgtcaggtagtcggtctctttgttctgaagggtgatctggagctgctccaggctgtaatggtaactattgagttataatattccaaagggacacaagtataag

SEQ ID NO: 58174 - DNA, 1648 bp, Bovine  19866880404345
cttttctgtgttttctgtgatttgatttagctctgtaagcctaagttccatgaggtgagaaataaatcagatgtcagtctctgttaaacgtgtacttaccgtgggggaacaggaacagcggagacattgttcgggccctcccactgctgtcccatcgggcaagatggcgcatggaacaccagtgcaggacagacgctccgagcctggctgccgagagcagagtctctgctctctgttcacaggctgctaggcagggctgccacctgaacaggtgcacgaaaagtggatagaatttggaggaagaccaagtgatgacatgaagattcagatgttgatgggcttctgaaataatcactacttattaatttctgtgtgtgaaagcgccctggatactggatggtataaagagtttgtattcacagagtttcgtttacttcagttgagagtgaagagagtactggtggggaatcgggtcttccttgaggctcctgggtgccatgagcctgcctgcctcggggacttgccaagaacgcctgcctcctggagggtcctcctccctgaagacctcaggtcaaacactgcttgttcaggagcgcctcctatgacatctctggggaggctatagctcagtgcctcatcagcatccttaatcctggtcctgccctttctagcagcagtcacaactgtctttttatttttttattgaggtataattgacgcacgacattatattagtttcaggtgtatggcgtagtgacccagtatttgtacacactgtgcaatgcttacagtaaatctagttaaccgtccgtcagcatgcgtagttacataatttgttttctctcagaactttccagatcttagcaactctcaaatatgcagacagaattgttaactgtagttgccatgctgtacatcacaccccagggctcatttatctcatagctgaaagtttgtatcttttgacctttacctgttttccccagccccacaccttgactgtcatttgtgtgactgcatagtgatctgtgaactcctgaggactaggagctccatgagagcaggtgttgggccctgagtctctggtcctgggatccagtacctagagcagggtctgccttcctctccgccgagggcctgagccctcctgtcacactcttggcagagcccccttccgcttctggcttccggagcctcccaggtgtccactcttccctcactggcacatgttgttcccctgggtgggggtacctttggctcctgtcttccatctgggatatgatactcattctccagacccaccccagtttctccctccaccaggactcctccagtgggctcagtggtccctctcctgtcagctgcaccaggtggatttccccactggggtcttaccatgctgtcctgcagcgctcacttcacacatctatctcgcttgctggaccaagtccctggaggacgcggagcatgccactcatgtcattgtctctgttttgtctccatccttaaatacagtgtctgtcacaataaatattttgaatgaataaaaatttctcttattagttatccatgtcccagaaatttactaaaaaaaattcccaggaatgtcagctcctgttctgactaggtgctgggccctcagacacct

SEQ ID NO: 58175 - DNA, 644 bp, Bovine  19866880449811
cactgaaccattggggagttcaccccatgagcttcttacagacaccagaaaatgtttcaactttgtgttccacattgttctgctgtgttttatccaaatgaacttttatgagccagctgccattcagtttcttacagattctcttgcctgtaatctcacttggggaaaccaaatcttccaggattacatcatgcacggttgtcagactgcagctcctgggatgcttttgcttatttttttgtatggttttttgagttggcttaggcagaattcttctctgagcaacagacgacgtgtttcctgctgaacttctccaagtcacgcagtagtcagacctggaatttttggaaatatttcatttgaggaataaaaacaaagattaaaagagctttttgaccaacactaacttcagtggccttggcagctgtgatgttcagctcccgcagctgagttttcaggtctgagttcatctacaactctaggagggtgtagaagatttcagaccagaacttgtccagcttctcaccattgggcttcatgatctttgccctggaaatgaacatggctttgatcttgccaatgggctgatacagttttcccccaacactggaggcctaggcctcaggagagctgttaatccagga

SEQ ID NO: 58176 - DNA, 1433 bp, Bovine  19866881011249
atgaatattataattttagtcctatttttgttcaataagtaagctgttaagattttcagcaaagataaatggaattttccatccatatcttttgaacaaacatgggagctcgctgtggaggtttgtgggctcttggtttctagggcccagcatggcacttgacaggggacacagggctggccccagagctcctcggtggtgaggagggagtctcaatgaccccctttgggcagcaacgtgtacatcaggatgaaagcacttgtaaacctgaacacgacaaaattctgatttctcttcatcatttctcctaagctttaaacaataacagctgtcaagtcatttcagaaattcctgttctgatgtttaggtgccgcttgcctctctcttgttcggagagccagggtccacgaccgtggtggggggagagtggtccagcccggcaagaggggatgttctcgtgggccaggattaccgggcgagagtccgcctgctgggtgtctctgcaggcgggcaggcgtggtaagccggcagcagatgcagaaccatgttggttcctggcgcacactgcgtttctcattttgtacagcgttttccacctaaggatattgataggtgtcagggaatgacgccaatatttacgaagtgcacatgttacggtatctatgtacagaagtgaccctggatgttgagaagtcttcagatgaggattacacacatttggaagaacagtgtctctcttcaccacgtaatagtagatgatttgttccgcttcttcctttgcacaagcagaggtttttcaagatttagttagttaaaatgttcatgcctttcactccttcagcataggttttattttttttttttgcataaaattatgaagttataatgtcctaattgtgaaaaggaaacaacagcttgaaacatagaaccatctcactgtaaatgactaaagtggtggagaatctggaaaaaacctattcaatttccaccttaaaaattattgtttagctttatgtagcacagctacacaacacaaatatgaatcttctaagggccaaatcatgttttctgagactagctacagtgcaagtttctcataaaattattatgaggagtgaccttaagtgaatgccttgctagttaagttggcaaaaatcttatttcataacacgaaagttggtaagacctccactgtaaatggccaggtcagtgcttctaaacttctaaatctaagataatttgaggctgatgggaaggtgtccttcagaatactgcaggcagtttagaatatatctgagcgctttcactcacagcagaacgtctcagcacacctacggactcacaagcagcctggtcaggttagcgtctcagagggctggtacttaagcttgccttggactagtttttcacatgttattaaaaaataggtttca

SEQ ID NO: 58177 - DNA, 1494 bp, Bovine  19866881109389
tcatatccccctcgatccaagtaagagttttatcatggatacactttttttttaattaagtaaatgaaagcatcatttctttgcttcaatttacttctaccatgaattaatataagcatgtcttgtttgggttgcctaactattggactttacttgaaataaccaaaatgaatatactttcagatttgtgtctcgttttacttctgtgtgtggctttttaaaaagatccacaacaaaggggaaaatgctgtgtgctgcagtgccaaaggctgaacgctgtctgctagggacagagcgccagttctttttaattttccttactcaccccttctatggaaacagaaagaaacacgaatcgtcgtctgtgaggcaaaggtggggaccgcccagggcagagcacacagcacctagtgatctgctctatgggcagcaaagagaggaagaaatccaaaaccatccctgctgctgctgctgctaagtcgcttcagtccctgaggagccctcaatgattcctacttcatctcactctttagaggcttaaagcatgtgtaagtggctgattgttttaagaacaaagcaaaacctggctgggattggtcctccgagggctccagccacagtcctctgacctccacctcccgctccacttggcctgtttctggagaagggtgatctgttttcatttctgaactgtctgtcaagaaagtagcctccatgaatattcagtcccaaagcaggggctcctaaagaaataaagcgagtaagtgctggctggctctgggctcaagtacgggatggtgagaagaggtaccctctggacagaacctgtgtggtgtgggcagggactcagccgacctcagggtggatccttcattaagtctgattcaatgggacccccggggccaggttccaggcttgcagccataagggcaggatgagctgactaaagcttggtagtgacatcaactgcaaaaaggcaactggggagtttcacatttcatgctgttgcagactgcttggctgggatttctaaaaatctaattttgcttgtatgaatgtttgtgatggtggcagcggatgatttttttcatttgctaaatagctaaattagtggacctcattgtaaaaggactggtttaggatggggtgacgagcacaattattcataggtatggggtggggagcggaagagacacaaagtgacaaagtccatctaggtaagcacgtttccgatagacagccgttcactgggtaccaacctgcttgccatgctggagaccttggggttttgatctctggtttggaaagatcccctggagaaggaaacagttcaagtattcttgcctggtgggctatagtccatggtatcgcaaaaagctggacacaactgagtgactaacactttcactgtatgggtcaacagacactgaagtaaatgctacaaattgaaaagataaataaggcaaagttcctattcttagttagactccaata

SEQ ID NO: 58178 - DNA, 777 bp, Bovine  19866881380390
aagtcactcttctcctctgaatccaccaaggtccccttcttccatctcctgcatcatttcctgggatctgctttcctcagtgagccatttggctgttcttcccctacactgaactgaagggtcaggaaaattaaaggaaaacatgaagaaaaaatgcaacctgaagaggcaataacctttgatttataacatgtatctcttctgcattgatgctttcaaaggtcttcctcttactgaggtgataagccccagggatccaagcagttctgtgttctaaactcagagcagctccaagcatgctgtcagcacctaattattaatgcatgaaaacaataaaaacaataccagcacaacaggcagattctgccatctgctactgctctgggctaagagggatgtgcgttcaaggctagctgttttgtttttttttttttggcgggggggcttcactttttcctgtaccatgtgcttcccatttgagggcacaggggcctgagaacatttttagaatttgcttctctaccaacatggcatgaatttccatattatcatcttatggctctaatattctaatttctatgtcacgttacaaattctgctggaatatttcttagctttccccatatcctttttacccagtggaaatcagagctgccaaaaagcttccagatggacatgaactgggccatgtagagctttccctgtctcccagtggagggtccctcccctggtagaaaccgggagatgggccctacctccccagcagcaggaatgcgg

SEQ ID NO: 58179 - DNA, 1878 bp, Bovine  19866881460258
cggccacgggcgccgcgtggctggcggtgcaacctgcctgctgttaaggtgagggcggagcagcacctgtcatttgcacgtgtggggtgtgcttctgtgtgtacgtgtgtgcatacatgtatgtgtgcacacgtgtgcacatatgtgtgtgtgtgctcagtgcaggaagcagggctggatgaagtgtgctctccttctcacctgagatctgtggggaatgtccctccgggccttgggcggtcagctctccctcccggggcccgaatcctatgagcagatgggcatggccaccccaggacccagccttggccgttacgtgtcgagcgcacttggacctgctcatctctgtaatgaaaaaaacatgtggcttctcatgggtaataacttctgacttcctggatggctcttttgttttgtttactttagcataaagtattccaccctttaaaaatattaccctctcttttatctgttttatagtattaaaatacacaagcatgtttatattttaaaatgggaaatgtcaaaaacatttttacagcatctttcttttaatctttgtttaaagtgtggggtgggtggtggaatagcttctaggttatgttcaattttttccatttctggaagagcttgattgagaattccaaaccttttgtactggacagatgttcaggataaaaataaaaggcctatcacgtccctcggatcctagtagtttgcggtgtatgttaatacaaggttagaatcactagggttgaaatttttgctactgctgctgctgctaagtcgcttcagtcatgtccgactctgtgcaaccccatagatggcagcccaccaggctccccatccctgggattctccaggcaagaacattggagtgggttgccatttccttctccaatgcatgaaagtgaaaagtgaaagtgaagtctctcaatcgtgcccgactcttatcgactccatggactgcagcctaccaggctcctccgtccatgggattttccaggcaagagtactggagtgggttgccattgccttctccagaaaattttttttttttttgctaatgatatttaaattttttaacagcattcaactctttgaaggacgctgtgttgtaatacacatttcattttttattcctgctatttggaaagtaacttgtgatgccattacgggacctggggagattatgggtggtcacggtgatggctgccgcaggcttgtaggaccctctctggagtgcttgagtgagtgggtgaaacccccgttttctgtgaaatagtgaagtggctacctgtcctgcagtctggggacaaggactaggagcgccctttgctgttgtacctccaggctgatgtgagcagcgctcacgggaaatttctcaatggtgacagtataaatggacaaattctgaaaaaagtttttaaaattctacctttaaatcaagagcttgtttcttttcatttgcagataatgaatcaagcaaatacagtttgcccagatattgtgatgtttcagaatttttttttttggtgggcaaggtatttacgatcattgttctctcttcatgctaagttttattttctcattaaatcaggtgaaaacctgtgatactgtgctattaagccagagtgactaggaggaaatgataggatgttattaatttattagaattccatgtatcgagtcatttaatcagctagaattacagagatactcctaaaaaacagtcaagtctgctgttaaagttgcctcattaatgttttttgccaaggatttgtacattcctaaaaatacggaagaaaacccagaaattgaaattgtcatgaactgaggctcccttagacgagctcccatccagggcagagaacaaac

SEQ ID NO: 58180 - DNA, 1055 bp, Bovine  19866882055824
caaggaatgctttacacacagcgcacaatcacggaacacgctgtagtctcttaaaatatgggtaaaagctgctgtaagcatcgaagtctctgttctcccgagagcaggagatattgggttactgcctgctagtttgataggtatcatttaaacacttactttaaataaaaatacacataaaacagagcccgttctggatcacctttgatctctaagtgataccaaaaggcctacgttttactgggaactcacctagcctcttgcaaattgcttggctgttcatgtatttttaaaaaagataaacattctgttcctcccttgagatcaaaaaaaattctgtaaaggtgtttcaatgtcagttctcttttttaaaaaaagttgtttttttttctggcttgctgaaatctaccatacctgtggaatttccctccagcctgcttcagctaaatacataatcaacactgaggcccatgggacgctattggtgaacccatgagtcagggttctgcaggtacttcatcagggtgaagtctttgttggtttacattagatcatgtacttgaccagagtcactatatggaagggttgcctgaatctgtatttctaatttttctttgctgagaacgcccatgaaaattcatatttttgaagatggaaagaacagtaattttcaggtctggattgcattctggatatgttcctgagggagtaggcatttctctacccatcattgttggggagaattaggctgactgtggcttgttaaaatttttaatattacatacataattaaaattatatgaatctaaaatttacatatacatcattgaagttacatgtataatactaaaagcattttatattcatatttatatatgcataagtctgaaagaggtgatcttttgttaacacattattgactggagacacattaacgacactggcattagtttctgcaaaaatcccctggagagtgatgtgttaaaactatcttgatcggtcattttgggagacaagtcaagctccagcaccatctatagaaagagggcatagag

SEQ ID NO: 58181 - DNA, 972 bp, Bovine  19866881245290
gaaaaagacctatatgagtcagtgagttaatatacagaatccttactgagcatgatgtctgttttattttttttttaatttataatgtgaatggaatatataatttatttaaaaaatagctttaatttgtgtcattggatgagaaagctgatattcttgataatgcacaagtccttgaccacaggtggacactctataactcatattatgtatattacagtcatttttgaaccatcttcaaagttttcccacacaaaattttcagtaagtgctgcttgattttattaaatgcagacagtgtcttgaacgtttctactgattgcctgctccaattcatcatttcctaacaagtgataagacaaaggctgctagatgatgttaaatgacttctgaattacttagggcaggactcagccccaccttacatccttctgtttctatggtcccaagttaaatacttttctaatcaaagtatacagaaccatcttttatttattgtcatttgactacaaatgtcactgtgtacatctctaagctctctctcatgatggaagaaaagctgaacataaattattagaaaatacctcctgctcagtacttaaaacagaggaaaaacacagctgtaccattcaaagcaaaataatctatttgtttaagctcagcatgtcacttatattaccaactgtgaaaggcattagtcactgagggtttgaaataaaatattgcatgacaaatacctgttttctctttgggaatttccatctaaagactgtcaagcacaagagtgtgactgatgagaccactgtaggcctgtctctagttcaacacttgctgtttgcagcatggtaatagcagttgttaccagtgaaaataataactcatcaacacagtacagtggatggcccaaaaggtggcctgctgagcactcagttgtagctgacagctgtcctgatgtaaagaatgatggaaaag

SEQ ID NO: 58182 - DNA, 1218 bp, Bovine  19866881461894
aagaggtgagaaagtgttcatcctttcattcacaaatgattgcagagctggtgccagatattacaagtgaagccagctgaaataaatagtgactaagacacatttcttccttaatgaactaagcatctactggatgacacatagcagtaaaaaggccattatcattcagttgagcatgttttactataagtttaagtaaagtatgtatacaaaagagaccgcaactgtcaggaaacttttctaattcagaagagtcattaccataactggaaaaagaacattaaatgcgtattacaataaaagatagtcatgttctcatccaccactgtataactcacatatttgatccctacatttgtcattgcttatccaagattagaaaactgtgtaccaatagagtggaaaataaatccaggactcctaagctgcctctgtgaattcctcctttttgaactagtgaatattagtggaactggaaaaaaattactaaaatgtcttattttcttttgtcgcctatttatatagatagatgtacagaaacttcttgaaatttccaagaacactatccaataaatatctaaaggtggatatggaaaaattaatcaaatggatgtctttcaatagaaaaattatttctctgggtttgttataaagtatcctgatgatcctggaacttgcaacaattttaatagacactctgtatggagaccttgttgataaaccattctacctttggtaggagtatggagaaatgtagtcctataactaggcaaatactatgatattttatggtgttataagatttattataacctgaaatgatagattggttgtcctctaaaaattgtttccctagagatttagtggcaaaacttccctcctaatatgtgctactgtaagagagtgaccctttattgtgacaagcagatctatcagagttacctgcaggcccagacactcagactagtaatgacctgaaaaataaattggccattccagaactttctactcagctggaagagaggtggtgacaccacatctcactctagactctagctgctgctcaaagtaagagattccaatcactagggcttattgagctatgtcagcataatgtctttagttcccaactgattacaggtcaagtgaaagctcaacttaagggggtggaaaattaccactctcttattatagggaaaggataacttagcagaacat

SEQ ID NO: 58183 - DNA, 1163 bp, Bovine  19866880369565
aaggaaatgcaaccaacctcccaggattcttgcctagagaatcccatggacagagcctggcaggctacagtccaaaaggtcacaaaaagttggacccaacttagtgaccaaacagcaatgaacatttatatgctttctttttatctactataaatgatagtggatatttttgataataagtctatgacgaaacatctgatgactttcttaagacacattcctagaagtaaaatccatacatggaagaatgtggtcatttataagtcttttgacatatactgataaatggctaatttttttttttaacaagtgtgtacaatagtagaggatctgatgctctctaaatatcttcattaatattgaatattttaatttaaaaaataatagctaatttgataggtgaaagtgttaatgattgatgtgattaggacttgattgattggtagagaagttaattattttctatattcattgaccatttttttcctgtgaattatcttctcatgccttttgtctacatggtttggacaattttgtttttgcataagctcttagtagtataagggtgatatatattcatctgctatatttggagtatttcccagtttgtactttgctattcaactgcttgtgactttaagaaaaatatttgagcagtttttagtttttatgtgtttaaatctattgagtacctgtgtgatttctgtcactgattttctttaatgtgtagaatatttagatgattctttattgaaatattttgatgatagggaaaggttttcagaacctgtggcttaaattttagcttcatttagcaaaagatttccaggagttgaatctgtttctaggagtataatttcactttcagttgaaataataaatattgagggataaaaagccctaatttattgttatgctaattttggagtagattagaattttactgggattttggggaagattttgctccatattgcatcaaagctgcttctggtaggctaattcaagcatttattacagtcttctatttccctagaattatatgaggatgatttcacctcaaggcacttttcaatttcacaacttatttgtgaaagtgttaatcatgttttctaaagatgccccagttaccagtagctccagtgaggttagttgactgtaaa

SEQ ID NO: 58184 - DNA, 950 bp, Bovine  19866880938168
gtatttaagaccttactactgaaaactatatatctttattgaaagcatttttgatattctaaaagattcaaataccttgttcatggattggaagactcaatgttataaagacatcagttcttacaaaataaattacagattcaaagcaatcccaatcaaaatcccactagaattcttggtggaaactgaaaggctggttctaaaattgatatgcaaatgaacagccaaggcaatcctgattaagcaggagtaaaggggaagggaggagaaagggaaggaagaagaaagcagcaagaagacctacattatttgattgtgaacttgttataaaatcacagtcttaaaacagaagagaattaacacaagcatggacagatgaatggacaggatccagaaccaaattcacacatagatagttttctgatttttgacaacggtgctccagcagggcaggggaaagtaaaactgagaaagcagttaggtgtggggcgcaggcttgttcttttaacacaacttttgtaaggagcatcacttccttcccagtagtttatctgaaagaccttcctctgtgctccttcgtattctgtgcattttaaaatcaatacacctatctaattgtggaaatcaattctttacgtgtctgtatctccagcaccctacatgttgctggacacacaacgggtaagaaactgaactaagggtaagaggtccaacagaaactgctggaaatcagctccagtggtaggagttaccattgttgtcaagaacaaaagctctttagagctgctagaaagaaatggcacctcagaaatatttgaccctttgtcatctttaacaagggggtaaatagagagattcatcatcttgcaaaactccaggggaaaggatagactagcaatttctgactagtgaagctggaaaaccaaacatgctgtgcagagggggtcagc

SEQ ID NO: 58185 - DNA, 1376 bp, Bovine  19866881201068
ctgtgttgtgaactgcaaatttcttgtaggcttagtgttttcttttttttccccctatcctgagtacttaggcggctgctcatttataatgggaaatcctataaggaactccatgaaacacttggaaatgagtcaacagaatctcaatgaatgggtgaggaaagcatctctagcagattcagttcttgtgactacatttctccccggctttatcactgagactattcagaaaaccagaacaattgcaggcaggacaccaagactctggtcatcaccacaggatgagaacatttaataaaaccaagtggaaaccttgcgagctcttccttcccagctgacacacgggctgccagacaaagggctgattaatagaagggagcccgttgtcaggctctggcattgttgggtcaggctgagaggggcagtgattccaggtcttctcactcccgtgtctgtgtccggcttcttccttctccacttctctcatggcccttcgtgctcagttcatagaaggcacaggtgcatgggagtttgctgagggacatgactatcatttattttttaaaatagtctctattttatttattgatcatttaaaattttttatttatttattttggccgtgacatgtagcatgttggatcttagttccccaaccagggttcgagctcacactccctgtggaagtgcagggtcttaacaactagaccaccaggaagtcccagctgtgggtttctttaaaaattagtctaagtctcatgttaggtatccaaaccaatatctacaaatttaatctttcccagtaatctactgtaaaatgagagatttctttccagtacggaccaaactaacgtgtgacatctctcattttctataattctaatttgacacaactaaaatcagtatcagagaaggcaatggcaccccactctagcactcttgcctggaaaatcccatggactgaggagcctggtgggccgcagtccatggggttgctaagagtagggcacgactgagtgacttcactttcacttttcactttcatgcattggagaaggaaatggcaacccactccagtgttcttgcctgagaatcccagggacaggggagcctggtgggctgccgtctatggggtcgcacagagtcggacacgactgaagcgacttagcaggagcagcagaaaatcagtatcccccctttacatttccgtctcttctgtaatgcctcgtcttactgattacaaataacggtatgtgaagaagagtctcagccagcgtgagataaagcagtgatggcagaacatctgcagatggaataaatgcctgtagtgactgttacatcctgtatatgaggacgagtgtctgatgatactatcg

SEQ ID NO: 58186 - DNA, 2159 bp, Bovine  19866880417516
cccttatggcagaaagtgaacaggaactcaaaagcctcttgatgaaagtgaaagtggagagtgaaaaacttggcttaaagctcaacattcagaaaactaagatcatggcatctgatcccatcacttcatggcaaatagatggggaaacaatggaaatagtgtcagactttatatttttggcttccaaaatcacttcagatgatgattgcagccatgatattaaaagacgcttactccttggaaggaaagttatgaccaacctagacagcatattcaaaagcagagacattactttgccaacaaaggtccatctagtcaaggctatggtttttcctgtggtcatgtttggatgtgagagttggactgtgaagaaggctgagtgccgaagaattgatgcttttgaactgtggtgttgggagaagactcttgagagtcccttggactgcaaggagatccaaccagtccatcctaaaggagatcagtccttgggtgttcattggaaggactgatgctaaagctgaaactccagtactttggccacctcatgcaaagagttgactcattggaaaagactctgatgctgggagagattgggggcaggaggagaaggggacaacagaggaggagaaggctggatggcatcaccgactcaatagacatgagtttgggtggagttcgggagttggtgatggacagggaggcctggcatactgcgattcatgtggtctcaaagtcggacatgactgagcaactgaactgaactgagggtactctatagtttcaaacattgacaagctattgaatcaaaaaacactaaataagagttttgagctcacagaggctggtaggagatcaggtcctggttaccaaaaaaaaaaaaaagcaaggggggcagttaagattaacccttgagtgacaggctcaggaataataggtcacatgtcacctgctcatgccaggggtgaggttggcatttacatcagctttagaaaaagctaggctgagaagatgctcctttggtcaaaatgattgatctgtatccataaagctgattcacttcattgtacagcagaaactaacagaacattgtaaagcaaaaaaattgatcatataattaaatataagaggtaaaactagaaacaagcataagttgaaaaaaagattgaaaagaagatagaaagattcagagtctgtaatttccacccacatttaattatttggataaactctgctgtcataaccagatggaaatcactaaaaacaaaggatccctgagactatttcacatgtctgatcagtggttcactacaaaaaagagccaaggtgtgtggggtcctctgcagaccacagcccaggatcagaagctgttggcttttgttgaaatttatagcaaatttatcgacttctgagataaatattgaccaaaccaaagtcaaggttattacatcttcaggaataataaatcctggtgctctcagtgacacaaagtcaatatgtgctctgctgtgtaaattccaggcaaaaagcttccttggaacatctgtaaatctctccatcatgaccacaagactagctttttgaaaattatttttgacagaagatggagatctgggcaacacctcctgttcaccaacatagaactcaccaggcagccccgttgcgcagtgatggacttcctgactttttcactggaaacatagctcaaaggactggtacttggcatctattgtcactgattctaatcatgaagaatcaagatcttctcattctaaacaagaggcagaataagcccacatactcctgacatctgctctacattgtggcaaaagataattatatttgaaataataagttctatcaaagttgaaggggaaaacagagaacacacacgcacacacacacacacagctgaatcactttgctgtcctcctgaaaccaacacaacattataaatcaactgtagttcaacttaaaaccccaagaggcaataacagtacatgaaaaagcctcataggacttaatttccacaagctcagtcttagtcagtgatgtgaaaaagctgcccaaaacattaattacattgtgatttgcattgtatggctaagaaggggttagagttctctttgctcctcactattaaagtgatgctgaatttgaga

SEQ ID NO: 58187 - DNA, 989 bp, Bovine  19866880657398
tgcccatctacaccataaagcaaaggttccagcggaagcctgcctcaggagatacatacaggaaactgactggtgaaactcgtccaggggatacatacaggaaactgactggtgaaactcgtccagcagcccctgcagaggggctggggggacacccgctgccccacacaggctgcctgatgctctcagggtgataagggccccacctgtgacaggcaggtcactgccaggccaagaagctcctctgacccacttcccaccccgtaagctcctgtctctccttcagcagcccaatgcctgccaccattcccactcgccatctggagttttagggcccagcaaggaacaacacagggcctgattcactgcaggcaagtgtgcacctcaatgacaaccctgcagaaaaggatgctgtggccacagagatgaactctcccagagcgaggaagaaaggccgtgccgacgcgcaggacgtgttcacggccccgcgcagcacctcctcactcatcggctcgggatggcgggcaggttatgagctccgcccgcgccctggcccttgccagcgccccccatcagggcccgccgtccgcgcccccctaccttggtggtacggatggtgcaggaaggaatctgggccgcctgctaaagccatcggttcctccccgcggtcttcaaaccacatggactgcacaggacctggaacagagacagcctgtgagaaacccagacagagggaaggcccactgctctctaggggctcaggggcagggggctgaccctggacaccacttgcattctgggtgagtcaggggactggcaccaactccacaaccttgacctgtggtcacagggcctgtcgggcagaggtgctcagaggggtgagccacacagagaactgaaagccggaccgctcagcagtccccatgagtcacctgactcttcttctgaggacagttatacaacactctgaagactttctcatactgtgg

SEQ ID NO: 58188 - DNA, 1277 bp, Bovine  19866881069397
tttctttatccagaaggggctttttaaagacttcaagattgtacttaaaaaatctcagagaaacacaccattgatagagaaaggcacagtacttggataacagactgctttccatacttcagcctttaattctcagttttactcaatcagaatggtcagtggagagaaggggctttggagtcacacgtacctgggacttgtccccacgtctcattttggtagctgctcaaagcctctttgagcttccattgtcccctcgcgtaaaatgaggacatataataatggcacttgtcctgctgggctctcatgagggtcatgtgaggtaatgcctgttgtgtgcccaatgcccaatccatttcaactaattattactatcaagaacaaaccacagaaggaaggtgtgccccgttttcaagctttgctggcttcctagctctgaggttggggtttttgtttctgtgctaatagtctttctaccacttagaaagaggtgtgtcccatgcctctgcatcgttacgagaacacggctcacggcggagtcatgtgggcagaagccagacactgtgtctttgtttggtcattgagtgatgtaaccctctaagcatcctctctcagatcgctctgttgggaacggtttccaagccattaaaatgtaattcttcccatcttcccatgttcgggtgggggaatggagacaaaactcagtgtcacttggcctttgtctaaaatgaaagccccctcccgcttctggctaacacacagggtgaagctgctcatgagtttcctgagatcagagccctggttgcctgctggtaactgtggcagacacaggtagagaaccatctcgtcagcatgattttcttggatttggaacaggcaggcatcctatgaggagctcacagctgcagggatttaagaaaccatgggcgtgggaccaggttccatggacagtcacacagcgaaccgctgggataccagaatgaggagcaatgtggtgtcttctctgtgaaggagaaaaggacctgaatttgtcctgaataactgaaactgggatgtcagtcagggtttcacccaagacaggaaactaggatagacgtgaaggaaagcgttagttgctcagtcacgttcgactctttgcgactccatggactgtagcctagaaggctcctctgtccatgggattctccagacaaaaatactggtgtggtttgccatttcctactgcagggatcttcctcacccagggatagaaccccagtcttctgcactgcaggtag

SEQ ID NO: 58189 - DNA, 1877 bp, Bovine  19866880486053
agagcatgggttgtcttaaaaaaatgaggaatggaaggcagcctagccatagccatccaaccactacattcccagagagaaaatttcactctggttaaacatgctctcgctatcatgtaattataataaagcagaagtcaattgttttgtaaaactacatatagaaaatttttctatctttacatcctactgcctagataggtgggttacactcaagtaaaaagattctggtttaggtaagtatacacctaaagaatttaaaatagattctcatattccaaaaggcattcaatattcttacagacattttaactagattatttttataaataccatcattaaaaactatacaaagtattttaggaaattatcctgatcggatacattaaatatagttttgctacctactttaagggattcaatatataaaaaagtgtaacgggtagaactttgtaagatttgaagtagaattattaaagaaggagttttggaaaaaaaagatgtaaatgatttgtcaaagaagagcatttctcaaaaaatgatcatattcaccaagggtttatgactgccaagttaaccataatacttcagcttgcatgattaattcactagagtatccaattttatctgtctgtcacagcagccagtaagatttttagctggaatgctggattagttatttctggaaactttcccatcaaagagataaattaagaacttggaacgaagactgacgatccagccattccaaaaataaacttattgagagcctagcactagcgagttgtagcgtccccaaatttggattaatagagtcttaaaattatcttttgcaagactagtgacaatattaaacactgccatttcttatatgagtaggcctagagtctgaaattaactcagagcatataaaactttaaacaggaatatgagctaaaacactaggatagcaacagacgctctgtttaaaatcatttagctctgaaagtgtttgacaattaaccaaaggatctcatttttggtgagcttggtttttgaatccacaacttcatatctgtgtgcattctcaacaatgacagtctaacatttacttttaggaacttgtatttatatcttggcaggtagcagtgatcagtgaataatcaaatccttttcggtgacaaatctctgaaaacagactcagctttcagtcaataatcacagcacaatgctatgtaatggttaaattccccatcctggaaatacttagctaaaacgcaaggtctacagatgaacaattatctccactaacttgctaactgatactgcatctgataaaaaagttttgttttcttttttttttttttaaaaaaaggacagaaagaggttcctaagagatgtgctattttcttctttgttacttcaaagcataacaaagcaagtagggtttcaaattgttgtggtcccagctgcgaatgaatctaatttggctcttgatcacagagttaataagcttagtactctgtatttcagggcataagtccttggtccctcaagagaagtgattgtaaagaaaaaaagaaaagccaaagtgcccagttactccctgtaatataatctgtccattaactttcctggtcagccatagttcaaccgcccataattcatttgtaaggcatcagaaaagatttcgtctttgtttccatctcttggaaattttgcctggatacaggccttaagttaccaaaaccacggtgagaagagagtcttgttttaaaacgtatactgatgtataatgtatccaaacttttatttttcattcttgctaaattaattaccattggttttagaaactggatgcaaacacaaaatttctagaaatctaataaactgacctt

SEQ ID NO: 58190 - DNA, 2106 bp, Bovine  19866880562447
ctggagatgcacagaaccagagaagcatctggcaggttgaatggacaggccttggtgacagagtggaggcaggaggtgaagaagggagaggattctgacttgggcagcagggtggactgagggaaaatgcagagaagcaggtaaaggatgggggcagtcttctagatggttctctaccccctacccaactccaattaggccactgttttcactagacatacaaatggtttaattgagcaaaagtaaacatcaagagtccagccaactatagtgtgtctgattcaggccaatcgctggacacctacaaagtggttgattgctcaccttgggctcggagcttggccagctcttcactgagcgagtcctgggactcttcaagctgtctcctcttctgctccatgttctgcatgtagtccgtcagggatttgatcttggcttcgtgctttaaacgagcaaacagaaaggggctatgaatgacgagcgagtgattatcctggcttgtccaggactgtccaacaggaaaacgcaacagaagaggagttcttgactcctctgttcgagtcccaacagccaagtgccaattccgcccttggcttgggatctgggaccacagactaagtcttcttcttcccatgagcttctctgcctcatccccctgcgcgtggctttccttaccaggtccttccttaccatctattaaatagaaataccaaaccccaggctggttttctgctttgtaaaaaacagagtctgctggaaagaaaggggctggaaaagtgtcaaggctgcgggcttcattctttgaacctgcacctttggatttcttctttggaactccagtattatgtctttacactttctgcctttcaagcacagcaattcctatttcagaggctttgtttctttttcctctccctaggaagctctccccaacaccctgccagacatgggcctggctggatccttcttacttgggccccaacattttcttatagcacctaacttctatttgattcatctatttttttttctacttgttagctccatgaaagcatagagttaatatataataatggagcgaaggaataaatgaatgaatgagagcttgtgactaaacaggaacagtagtcacctcgaggcagatggaaatatgcagacacctcctcccccatatctacatggatcatatttaggcaggaggaccctggagatggagctctaatgtaatgaaataacctctgggaaatgggactttgttggagcagatattttataagcatagcttttggtgacaaggatgagtataaacaaaggagataatagcattttagctggaaatattttgtcaggttccttagatcatgtcagaaaataaagaaacaaggtttttcttacttttgaaccccaggcaacaatgactaaatctttggttttgtgtaaattgtggcagagtacaaaatagcacctaagggaaaactgtatttgttcctaatgcagaaagcactgtctaaccacggttattctttaaccccaaaccatcctaatatttttgagtccaatctcacacaccctgagtgtgtgtcaccttaagatctgggcaactggggccccagtcctgggcctgacacttcagagcaccccacttgggcagtcctctggctgtaccccagtctaccgagcaaagttctatgccaagggagcgtgcccacttggaacccacatcctcttctagatcacagtgagtctggaaaactagaaacttgttactctaatgaccctgaggtcacccccaggagcagcagtgcagcttccatcatccatttacataggttacagctgacacagtttcacagctccatcagctcatagaacgtgtggaaggggcctgacttggacgtggaggctgatgtgtccagatggaaggaaagacagagggctttgggccgcagggcttctgtctgtgcgtttgcattggccttcaaatgttagggacagagtgcttcagaagcacatgctctcagagtaacaggtgacctggaaatcagacctgaagtgtactatgcctaatgttctcaattttcataaattataaaaatgtcaaagagt

SEQ ID NO: 58191 - DNA, 1749 bp, Bovine  19866880580714
tgagggatggaaaactgcagggctggttggtgcttggcaaaggacaggaaagaaaagaacaaggttagttgcccacaccatgatgtttctaaggccagtgcccctcttttgccaaaaggtttcattgaatgttccaggtatccagcagagaaatgacccaagtggatcgcagaaatagaacaaaatttcatagggcgctccacacctttccaagcacccctccccactctcctacccctgccaaattgcaagaaggcatccaccagccacagatgctgaattattcaattattctagcagctttcaaaacacatgtgcagctagaaaatcgcccccaaagaaaagaatcgtgttatttaggctactaggtcatttcttgaacctctcttgaatcctggttggccacgtaattgttcttcaattgaacagtagctcattgacacccacccctcctagcaaaaacagaggcaaacatataatcataagacatctgctgctaactgtgcacttccaagcaggcaggttacttttggattttgcacagtggccaccaggctcccacagtcacccaagattgagacctgatgcagcatctgaaataaataccaacaccaaccatccactatctcccactatacacaccaagctgccttgtttccatggggaaaaaaggggggctgtggactgaaaaaggacttgtgcatgctaacctccaacacaaagcaaaaaccactgaaatgatctgtctgcacgtgggaaacccttctccaacgcctcacccatagtccacccaccactgcacgtcagctctctgagatattttctctgaggagaacacaccaaagagaatgctttagggaaaaagaaaaatgagtcacgaaacaagcctttgagactccattttaggaccgagcttcttcaggaatcctctatttctagctctgaagaagcagagcatgaagatgagttgagccaaaaaaaaaaaaaaaaagcaaacatttaccagaggtgacttttaactccaaatcaattataaaactcacagaggagagaatgacacttttcatctaatcaaaagcaatcaaaaccccaaaatctcaaacactaccctctacacctcaaatgtggctaccggagagtaatggatagaggcgcatctcaatggaagcagattaaggcaaccttgcaaacagtcacttggccacactaagaatgtatgtcggtcaagtgacagggtgggggcagggatcagtgctagggaaaacatctgctcgttcacacagcttgctgaaaggccggaccaagctccaccatcacccactctttcccaagtgtcccaggacatcaatagtcatgggggggaaaaagcacacactcatacctcctccttcctctccttcttccttaccatttctccatctgtttagctccatctccagatgctggataacattcttcaaagtcttatttttctctttctctttttcgtatttcttcttccattcttcagctgtcagttccaggttcacagagacagtattcttgatggtcttagccctggtgtgaaaaacataagggaaaaattctgagcagagttgctagcatttgctaaatcatgaatataattaaacttcaaattcctttcacaccagaagattaggacttagggagcaggaaggatgctagagcttttactaccaccctcttagctgctttagtggccccactatttctaaggctccaaactca

SEQ ID NO: 58192 - DNA, 1827 bp, Bovine  19866880588286
ctgtctgtgcgtttgcattgcccttcaaatgttaggggacagagtgcttcagaagcacatgctctcagagtaacaggtgacctggaaatcagacctgaagtgtactatgccctaatgtttattgttcttcttctcaattttcataaattataaaaatgtcaaagagtccagcaaatccagaaaaagtagtataaatttcacccataaaccactctatccaactactttccccctatattcctggtcttatctatataaatgcatattttatcaagttgcaaggtatagcatagatctgtcactcggcatttccatttttatttaactttatataattatactttccaaatgactaggttgcatacatttttggtaagagctgcataatatcctttcatgtaactttatgttattagtctctctataaatagttgcctattttattttattaaaatgaaagtaatactgcaatcaacatcttccatgtaagtgctaatattttaaatcagggaatgataataccatatgaaatgaaaaattttcactttcattaccaatgaaaaatgctataagtgaaattactggccaaagtatacttacgtttttatgggttttgattcccaaggtgctttccaaagggactgaccaaattatacttttctcaacaatgtatataaatttcactattacacactagcattgactaatctcttcaacgcttctttgcttactatgttatttataaaatggaaacctgatgctttaatttgcatctcttaaatgattacagtaggagacgaggctggagatggttgtatgatgacacattcctatgtttaaaagcatacaggatgaagtatgctttcatctgctcctcagcactgtcagatgtgccgttacacgctggtatctgctctccccaaatgactttagctatgttaatgcctggactgaggcagtgtgcagcacagactggaccactcacagaggcctcagccccaaacaccagcctcaggtgcaggggcagaccagaaacaaggctgcagttttctgaaaccaccatgctaaactgaaaatgcttcctaacggacagaagagtaccttatcactggggcttgaaaatcccttcaaggctttgagttcccacacaaaggtttgagttccagctctgcctttcactggctatatgagtctggacagtatatttaatctttcaagtctcattctccttatctaaaaagcaaggacagtcataacacctgcctatcagaattcttctaaagatcaagtgagagaatgcaggtaaagcgcttaatagtatatagggcactgtaagcactcagtaaaatgcttcctgctactgctatactggtagtggcggcagtttctgctgtcccatattaaaccggatctgtggtagagaccaaaagatcgaagagtgctgccttagcagagaggtgttttagatgccacccaatcttttccacttttccagggaagcctggcatgcagcaatcgatggggtggcaaagagtcgggtatgactgaccactgaactggactgaatcttttccactcattatacatcactatctatcctacctacctacctaccttatttataaatagctagataaagatatgtagacacatccattaaaaaaaaagactaaaggtaattcatgtaatttgtacgactaaacctagccttaagaataagcctggccggttactgcctgggaggccatggatacggtcatcagttgtccctattaggtaccatcagcctcagtaagagcgggaggaaacagatttccagagcacaag

SEQ ID NO: 58193 - DNA, 1296 bp, Bovine  19866880651444
tgttttgaaggatggggaattagtgctgagaagtaggagtcctgatgtccttttgggagaggaaactggaaaaacaaactcctttggtgtgtgggtcagcagaacaaggcaatggtgatatcaaaggatgttgaatttgtagccatacattcatcacgcccctgtggggaatttttctctttcctttcagagtttaaaaaatctttatagtcgtagtgaagtaaattctttcatccctgtccctgacattaaaacagtaaaaaataatatgttcaggtgctaatccatgagttgatcttttaaatgtctctctagttgaagtaagaaggatattaaccctggggaaaatatcatgggcaatgaaacattcttggctttgcagctcacaggatgagttggtaccagttagagctttttttttttctttcaatattgtttaatctaatggaagcctaaggaacctaccaactcagtgtgctttttcaacacattaacttagccagtagaattaatttcaaattcatttctgcatggatcatttatagtattaatgtgtgagtttccacagcaactgctttttttttcttttttgcacaaagtaagtaaattttgccagttaattgtttttatgcttctctctcttttttccctaaagcaatggcagttttttgtcatcagtggttggactagatcaggtgcttatctatgattttttaaagacctctgtgcacacagctgctttggcaagtcaggaatcaaactgacagccctttggaaaggcgtatcctgtcacaagtctaaagagaaacagagtgacagttcccaggctcaagtgcgaggcctgcctctcaatcttcttcagctggctaggatcttggctgatgcagggctccagagccagacagcagagggcctgaagtaacagaatgaggcccagcgaggtaatcgggactgacagcctgtttgcctgtccaaaggcgtctccgcaacccacagccacatttaattcagcccgtgagagtctgagcacacacacacattttgctctctctctctgctacttttattattcttactttgtattttgggcataaatttcttagtctactcttcctcttggtgtataatttgaagagtggcatggaaatcattttttccctgtcttgtggcaggaaacatacctagacatccgaattcaattaggcctgaagtgaaagtcttacttggtatctttgagggatctttcacagttcacgtgttcagctgctgtcattggtgtgttgttgtgctcagtct

SEQ ID NO: 58194 - DNA, 2744 bp, Bovine  19866880657945
tgggctggcttccacttctctgcagccaccatttaccatcttctaattgctttgcaaactgcaaatttctcccgaaatcctgcaccccaaccgtggacctttgtccccttctcttgtggctcagctggtgaagaatctgccagcagtgcaggagacctgggttcatctcctgggctgggaagatccccctggagaagagaacggctgcccactccagtattccggcctggagagttccatggactgtgtagtccatggagttggaaagagctggacacggctgagtgagtttcactttcactttcacaaccatggataggatcctgcaaagcacatcaaaagcccagctgtaactttacataattttttactgaaggcctgaggaagagaggatactataccaccctcccctcccccacccctaccccccacaaaaacaaaccaaccatacaactgggcattggactctggcttctagagtctattgcccatgggcttgtttggaggctgccccgagtcctacctccctggcgctgacctgtcccaagttgccagcaccatcttacctcccctagatgggagagattcttggacaaggtccccttgcctgagtccagaccccacctccaaaacacaacaatcaacgcaaatgcagcttggcccctagagaagatagggttactcataattgaccacatgatcctttcaacccttttaatccaagagggaagattttgtttcatgtggccaggaagctcatcaaaatgttgcttcttccatcgccctgaacaagcgctgttaaaatgaattaaaaatttattgataatgtcaaacaccagtttcccctacttctatccatgaagatactaaaatgttgggatttggtatcatcagaacatcatgcattctacatcagaaaaaccttgatttgcctattggcgtattcattaatgttgtgcggtcacgttgttagtagctcagtcatttccgactctttgtgaccccatggactgtagcccaccaggctcctctgtccatggaattctccaggcaaaaatactggagtgggttgcccttcccttctccaggggatcttcccaaccgagggattgaacccaggtctcatgcattgcaggcagattctttaccagctgagtcaccagggaagcccaaaaatgaaagtgtgaaagtgaagtcgctcagtcgtgtcagactctttgtgcccccatgggctgtggagtagcctgccaggctcctctgtccatgggattttccaagcaagaatactggagtggtttgccatttccttctccagcggatcttcctggcccaggaatcaaacctgggtctcacacagtgcaggcagactctaccttctgagccaccagggaagcccttttgatgtgcttaataaagtagaaatttaaatttttcttgattacttatgagtcaactgctatactatgttatagaacatagcaactccctcagaggctgttaatgctaggagatgaatcatgtacatatattaataaccccagttttctttgctttttaaaaaattgttggatttttgttactaggttacacagtaggtgaggaatgccaatgtagttcacattctatgaatgagttatggtataaatgataaagtaagttctgattgttcacttgccaatgtaatcccaaccattttcatccatatttgtttactaagtatattgacattatcatattattcatgaatagaaagtactgtagcattatggtaatacatttgatatttatatttaatatgataatataacatagttgagggcttctcaggtggcacggtggtaaagaatctgcctgcaaatgcaggagatgcaggagacatgggttcaatcccctgggtcaggaagatcccctggaggagggcatggcagcccattccactattcttgcttggagcatcccatggacagaagagcctggtgggctactcttcatagggttgcagagtcggacatgactgaagtgacttagcatgcatgcatgcatagcagatttgaatggataaaaatatatgtaagactttactatatattttcccctctttcctatgaattcttgcccagattagccaatggaataggcctaagctattttgcaactcaggataaaggtgtactggggagttttgacaccctgagttggtgtctatattttactttgaattggatgctttagtcacagttatgttttctcagagtgcagtgtttatataccggttccttctatttctaggcctctgaagttgacccttaggcaccagcatcttctgtttagagatgacattatacccaagggctcatagaatgacctcactccttttagctctggcaaaattaaccttctgtctgcaacataatctcactcaattaaaataacaacaacagccagaatgtaaataacaacaacagcaggctttactctccagtatgtctctttcaccctggatggaaatgacccaacccagagcccccgtttgacttactttggcactagctgggtgaagctgggcctggcaggcaagcttccagtttctctctgtccacaacaggcaaaatggccgtgtctgcatcatttgaaaactacacagtcagtgaaatagagacaaagaaatgtggttgctgtgaaataaaatgactgtcacaaaggagagatcaaatgtgagagaaggtgcatttaatgtaaaaaaa

SEQ ID NO: 58195 - DNA, 1090 bp, Bovine  19866880667647
cgtgcgccaaaagccgtacagacagcgacagcggcttcgtctgtaacagctccaaagcagaaacaacccaaaggtccaacgtatttatggatcgataaattatggtatattcatataaatgaatgataatcagcaatgaaaatgaataaactactactgcacaaaacgatatgaatgaactcacaaacataaagtccagaagccagatagaaaagaatatgtacctgatgactgctgttttaaaaagctcaaaatcaagctggcctaatctatgatgcagaagattttgagaggtgatcacctttgtggataaggaaggggtcaatgagtgcccactggaaagtgcccactggggcttctgggattttggtgatgttctatttattgactatgaggtagttatgtgagtgtgttaactatgtactaattcatcaaactgtcactttgacttgttcagttttctatatgcacacatacttcaattttaaaattttattaaaacagatttttactaaaatgactaatacaaaaaatggagaaattaccttattgtatcagagtgatggacaatttaatctaagttccctataaggtaaccaagagacactcattaaagatgctatatgtgcagtcatcattaagttaaacttctgtcttttgtccaaataacctgccctgacactttaatctaataatccattattaccttcttcaagttacagtatttttatttatttggtttaacaagttctatatattcataattgctatgaaaaatatgccttctctgtattaaatgatctctttcaagcctcaaggggtatcccacccatcctagtatgccagaagttaatgaataagtatacattcatattttataattttgtcagtacattttgtatagtctctccatactcatattcccacattcaatgcttgtaagctttattctctgtgggtagaccctcagatttggactttggcttcccgagcattttagcagctttctttgaacctggtctgtgttcatgaagtctttcctagtttcattgtccgggatcctaaggagggggggggagctctacattgc

SEQ ID NO: 58196 - DNA, 2160 bp, Bovine  19866880673864
agttgttacttcctgcccgtgcaacattttgcaacccctgggaaattgtgaagactagttagtaagagaaaagctggttacaaaacattcattataacctgattttttgtaaatctatgtgggcatagaaaaatattcaatatatgggaccaatcatattttacatctattagaatcccaattgtttttttaatacatttgaatataggtatgtcaaaaatgtaatgcaaatgtttccagtatgttgtctcttcatttgtacagaagttttaaattttaacatattcaaatctgctcattttttcttcacaggttgcttctttttctttaaagccatgaaaattgttacttctatgcagaactaatacatgctatattctctgctagtgtttctatcctttgatttgcaatattcaactctccagagcttacatttggtgaaggtccaattaatatcttactatatccaaaccatttattaaataatctattaaataattcttcctcattgccttattttgaaattttagcatatttgagttatagttaggaaattattccaatttactttttaaagtacaagaacctcaaagtaaaaatccaaatatacataagagttttgtaagaaatctcagtaagagattatgagcaaatcaagacatcatcaagccatttcatcttcagtggggcatcattcaactgagccataatttccgtctaaaatcagttcttcccattcggtacaaggctttagtatgtaattgtggggtatataagtatacagcagctgagtcaccaactgtttggattctctgcttattttatggggaggggctacttcttgggtggcaatgttattctaaccctgacacacctggaaataatacccctttgccctgagaaaaataaaagtctaagaattcattgtttaactggtcaagattcagaatcatggatttttactctattgatttttttctccagatctactagaaacctaccatacatagtgtgtactatgtaaatcggctcttgtgttttaggttctaacgtctgcaccttgccactcccatcaagacacaagctcctggaaagccaggcctgaagctactcgccaatgaaggaaggagagactcaagtagagtcattgcagagacctctagtgagccttacccacagcggacactcaggaaaggctgccaatggatcaactatcttagcatctcagtcataagtgatacttgaaggaaaaaagaaaaacaacatattatcactgaatgctttcatctgaatttatctcctctacacagtaatgtggacggatttttgccatcagttcacaccctgaagcacaaggcatgatgatctttcatttgcatagctaggactcatcattatccagatttttttgactcaacaaaacagaattacaccattaggatttcagcatgtctgttcttgcagtaactatcttgaattgggttttttagaagcaaccactgtatgaaaaaaaaaaattataacctcgaaggttcatacatggcttggttttagaatctgagcttttctggttcaattccctgctgcttttccaaccagaaaagaaatggctgagcagttcctctggaccaaggcactggatggcagtgctcagcctggcattctctgctttcaatcccctctaccaaaaacgaactagagagagcaccaccatcaaaggtacaattactgagcacctaatgttctccaagctattaagtatgtacttgttataatatatctggtgctgcttaccaaaaaaaaaaaaatcctaggatgcatttcttccacatctctgaaaaaattgctcaatttaatattacccttaactattaagtataattttagagatcttgcttaattttttagtctaatatgtgaacagcatattaagaaatgtgatattccacttcacaatattgtctcatatataaaataggaaagtccaactataacactgtcctctctgcttctctcttttctgtcacagaagaatggacacttttgtatgcagcataaggaggccagggaagaggagggattattttacaaactggcaaagcaaccgcattcggctcctcccatctctgtccccatcctcctcccaagcgccaggggagg

SEQ ID NO: 58197 - DNA, 1276 bp, Bovine  19866880713503
gatgttgttctttgctagagtaaaggagaagaggaggttgggaagtatcctttctaccttcactgtgccttagtttttagtattgagctgcaaggatggaatgtgaatgagctaaacagattttgaaaaacatcatttatgtattcaacaaatatttactgatgtgacttcttggtgtcaggagttggagatatagtagtgaacttttctagggcatatattgtattaaagaaagaggggaaacaaacaagtgtgtttctggtgataagtggtatgtaaaagtagggagaggaaaagagagaaaagaaagaagaaagcaaacttccttcccttgctgctttggatttataagctagatattgtcatttttaccacaggtttatgaggtggttgctgttaaatgggagtcatgcgtatgaaatatttgttatggtatttgttgctgttaagtattatctattacatggtattctgacttttttacaaagtcacaaaaaagactccaacccaccaaaccctttattgcttctgaggtatttgtaggcatagaaactattcctttggggatgggaatgctgcataaatgtaaaattgttttacttcccctgcagttctaatcactagaaagtgttcctctgaaataaaagcagtttgcttagggatagatttgaatcaatgccaggcaccccattctctcacagtgaatgacgtggcagaggggaaggttggtggaggaggcggcaaaggaatgcactggttttgcattagccaaatctggaagtaagccagaatccacctagaaagtatagagtccatctgtgttgtccatcaccatctactagcccagagctactggatcaacacctctggggttggtgtgctaaacagtagtgaagaggcaaggctgagaatgtgcttagtaagaagataccttcatatttttaaacaaagttactttggaatcatggaaaatattcatggcaagaatgaactcttcaaagcagattactcctaattaggtctggttttcctagagaccttggtaatatcctattgtaagctatgattttataacttttgagagttcctttaggttaaaaggatattgtttagtgacttttatggaaagattgaagacaggaggagaagggggagacagattggatggcatcactgactcaatggacatgagtttgagcaaactccaggagactgaaggacagggaagcctggggggctgctgtccatgtggtcggaaagagttggacatgactta

SEQ ID NO: 58198 - DNA, 1821 bp, Bovine  19866880844485
tcatgagagtctcagggtctaaggctgagttgtattcacctttaatactccaaagtccattttagtatctggcacatagcaaaaatcattcattcattcattcattcagtgaacaaatatggtgccacattcaagagaatgcttgaaggtgttttctcctgctgagggtgggtgaataaaaatcactcactctaggattcttctttgtaaatacagagcaacctggcataatggaaagctttggctgtgaagtcagatgcacctgcacgatgacactgattctgccactcaactcgggcaagtgcctcaattctttcatctgtaaaatggggatactgatgctcactatacaggcttgtatgaatgttagaggaaaatcatgtaaggcaactcaagcattgtctaatacagtgtatatgctcaacaaagaaagtttattatcgatgagtatctccaaacaagagtgcatgtttaaatccaattacatgcactacatcatgtcacaacctattcatcatctgtaaactacatctaacaatatttccattcaattactgtctactgacttaatggactgtgatacttcgtgctggacatgaatgatgcacagtacttagaacagagtcagccatcatatcctgagattcaaaacataaactaggaaatgaggcctgaggtcaagtagtaggacctgcatcgctgagggcagtaggcttggctgcacccattccaaatagcaaggtcccaaggaattttccagaaaagtaggctgtctcaaagcagggcagagagctactaaagcagcataaaaatgagtcaacatgaaaatctgcaataaaataggaccatgggaagtgctgggtaagtagagaagaggaacagtagacaagcgaggcttccgtaagtttgctgaactggtccgaagtagccagcacagcacataccttcacagctaccctctgtgtacacatctcccctgaggacaagggtgtctcccacctccccaaagggcagacaagagataagtcaaagtataaatgaagtaagagggtgctggggaggaagaggtcagaaagcagattacacagtagagctgcaaggctaaagattttcaaaactggccagagcctgtttcagattttcaacagagagcattctgaaaatgactgaaggtccaaaatatgagtgaactacctgaatggaatatcttctgacaaggaagtcaaagcaaaataattattataattgattgcatttggttaataagaagcttatgatgattttcagagtgtttacacatatattgttctgtttgagagtaatgctaggaggttaaatgctaacgaatcaagagccaggatgggcagggggtgtgctagcatgaccccgagagagccacaagtcagggtctggaggagggactaattgggaacctgaagctggtccacctccattctagataggctggcactgggagagatgaactttgccttgaacaaaaaactttacaaaccaaaaataaagacaccaaaccaaacccccattgtagtgtcaggtcaaaactctacatctgggtgacctttgctgctattcaaatacagccattgttatgaaaatatgcctggatagagtttgtaagcccagaagcaggcaggcacaaatgtgcctccaggccattcattaatacatgaagccattttggcgttctctgtttctaattttcatatttccttaatttggttctcgtcctcttattggatcattctccctgaagtcaggactatgcctagctgtgatttttgtcctaaaatgttaactttt

SEQ ID NO: 58199 - DNA, 931 bp, Bovine  19866880894408
agcccacgtgcctagaacctgtgatccaaaataagagaagccaccacaatgagaagcccgtgtactgcaattagagagtagcctccactctccacaactagagaaagcccgagtgcggcagcgaagacccagcacaaccaaaaataaaaattaaagaaaaaaaaagaagaagaagaacgagccatggctccatgtccaaggcctgtgtctgtaattcacattactaaataggcaccttggccctagagtccacggcctgaagattcttattcagttgaaaccaacaggagccagcctggatgactcagggagaatggtaatgacggggtgagtaatcaccctcttgaagtcactagttaggataaaagcagttgttgattacctcatgggacaggtttctcaggctggccaagaacagaacaaataaatcaatgtcactttccttcctcacatcttaaaactcggtatttacagtctgtatttcagcccacaattccaggcaacctctccacagaactccccattaggcccctagtctccacagagatggaggagaggggcagagatggaggcgagaacatctgtgaccttagtggagagaaatcctagaggaacagcacatggctctctgcttgtggtcactgccttggctattttaggaatgtgttctataaaactaagacgataatagggtgaacacatgcggaagagtgaaagtaaaagcctctgccatggcagtacattttaaagacttgaaaattgaaaacctttccctttcagagttgtaaccaattcagggagcaaatccagaaatgcactgctgctgctgctgcagcttagtcgcttcagtcgtgtccgactctgtgtgaccccatagacagcagcccaccaggctctcctgtcccgggattctccaggcaagaacaccaga

SEQ ID NO: 58200 - DNA, 2825 bp, Bovine  19866880902858
aatgtgtgctttcttctgcgcggaacaccgcatccatcagctgaaaaggaaatctgggacctggcttcaggttttcattaaaatgcaatagggcatccggaagtcggatttggaccaacaacaatgagatatttttcttatagttcctttcctctgaacagacttgctatgggctttaaagccctctctatgaccaaattgggtgaagttgctttttcctcctctctttgattgaacctggagctttgggtaggggagtgaagtaagcagaaatgaaattgccaaacttatggttctcaagtaaatgagattttctctaatgcttaccaactgtcaccaggtcagatggatttttctgcttgaagtccctggatgcattaatttctctgccgtcttagggtatccttctggaagcaaccccagcagtcagaaaaacataagaataaaatgcatagcacaactggtgcacaaaaggacagtaaagaataaaaagtgaggcgagggcaagaagaaagtcttcagacaagcatgtcattcgcttggtttttgactcagagggcaattcacacagagctcgactcagacctacaaggaaatggcataatgttctggggttgggtcggctgaactagaaatcctgaaagacaatggcatgtcctctttccttcattcatctagtgtggtgactttaaaaaaaaaaaaaaaaaaacttcctgaagcaaagaaaccacaatatatataacagctgacagtgacctctcactggctgagctggagtctcgtgagcagggggcctcctctccccacggagaagcccatacaggcttccaaaaaggtatggggttgaaggcatgaaagacaccattctagagggtgttagtaatccaggaagtggcaacacaggatctcatttttttgaatacagatgactgacatctaagttggagaccaaggagacatcttctgtaaggcagtcatgtacaatttcttactcattttggtttcttgagctaaaaattagtaccacttttaataaataccacgtctttattacctgccgtctaactgccatcattttccttccttccttcctttcaacatttattgaatgcctctagtgtccaaggtgcaaggcactagctggttattaaaaatataaataaggacagcattagtagcagtatgagtagcaggtagtattagtagcaatagtagtaataactatagcaaacacttctatagcatttgtttggtgccaggcactactctaagattttcaaatgtattaagtcattcaatcatctaaacaacattctaggaaagatgtgtattctttccaatttacagatggggaaactgagacacataaagattaagtaaactggcagagatcacatatctaacaagtggcagagcagagacttgaacccaggcagtctggctcctgaatctgtgctttaggtatgattgctgcatgtgcactatctttgggatttattgtctatgctacaatatggaagtttctgctcctagagctttcaaagtctatctcctttctggaacttataaaaggaccgtgggcattgtatacacaagaaaggctaatgacattcagggacaactgaaggacagttggagattctcgactatcaggagagaagagagggtcatgggaggagatcatggaaggattgtgccttgccagttaggcaggcaggggctttggagcattgagattcaagctattactacaaatgtgacacacatataaccatccctgtgtgaagcgcgggacttacaaattgcatacataacattttgaattttaatccaaataaatgtgcagtctctgttatttaaaaaggaatgatggcagagttatatttcagtagatagatctttggggcctctgtaattcatactcttccatctttcttaagttgccaaacatttattaaacattgccattctttactttatcttcctcctaaacaaccactaaattatcttgggtacatgagccagttaagggttactgcaggcccagagaataacaggtctcagtatattccatgttcctgttcaaacttttgcatatctaataaaaagggacaattgcagctgacatcatcatctccttctttcttcctgacatgaatgtggaagggttgtctggagcagtagcagccatcttgtaaagaggaggaaataactataaggacaaaaagaatacaaataaattagatccaaatggcatttctgagcagttaaaaagaacaatggttctacatcaagctttcttgttatggtagatgctactgatatttaggccacttttgagtaatctgttcttacagctaaacaccttcttagctaatacacaggaatcatgggaaacccatagctgctttacctttcatttctcaataagaatctgtttttttaagacaacagcatgtacttatataatgagccaatattttttattccagaatgaccttgacatgtctcttcacagaaattaatgttgccatcacagctgacatacatttggcaagaacaataagtctgcttccattcttatccagtttagattctatgatcatcattacagtcagctttgaaatgaccttcctctctaagccccactccactctcatattcaattgacaaaaccccaactatatgcttggagaaatccaagcatccccatctccttgtgggcagccaagttactaaatgtagactggtatcacgttaggttcatacttaaaaatctcaaaagggccctcaactctgcacccaaatttaactacatttcttta

SEQ ID NO: 58201 - DNA, 1228 bp, Bovine  19866880927968
cccagggcttgtgctaggcggagctgagctgtctacacacggggggctgagctcctggcagaggcgaggagagcccctggtgttgccccggacagaagccacccaacaccagggactcacttcatatttatttctggtggtgagtggagcttgaagagccacctcctccccctcggatggtgtggactgccgttggagatgatgcagggtagtgtccagggcggatgggcttggctgtgtccaacagacagaaaagagagaagagacattcagaaagggcttacacagctgcatccagatacctcctggtcacatgcaaaaaccaagaggcacaatcttctcatcaacattgcaattcttatcagataccagacttttctgaagacaggaggtttgcccttctattagcacacttagctaatccaagccacccaatatatatcagttacttcaattctgattaatgaaaattagagacaacagactttcagttttatctgaggcagatccataggtcccgatgagttccaacagcatctccctaaaactggatgcagaattctgtctatgatgcatttttaggggaagaggtccacaggtttcaggagattttccaagggtataaaaatccaataaacgcagtgaagtactaatctatgatcttaaaactagaaacaaggagctgctggtttcccaaacatatgcagagcagtatctgataagaaatattattacatattattggagatatttccatgtaagaagaagaaaaaatgctctctagagaacacccctaaatctcttttcctcctatggctctatcccaggaactatgactcaacagctacactctcagtctttgcaggtagacatccaaatccaggcatggaaggggctggatgtccaaccccccatgcactcactgatgccgggcctggctctctccagggtatttccaaacctgtacttgcaagaggctctccctgaggcttctagctacatgcagctccttcatggttctgccaggtgcaaaccacaaggggcctgcaggctttgctgagcaagccatatattctgcatatattctggtatcgctgggagagtgtatctctgtttacagctaaacccctctgcctgtagccaggacttgctggcttctttggtcagctcggtaattttgaagatcaccatgtcctctgggaatctcaaggaagcacgcatctgatga

SEQ ID NO: 58202 - DNA, 1082 bp, Bovine  19866880945116
tccggagttcccgctcccaggtcccctggatgagtgaagcctcggtctgccatggaagctggccccgccctggcctggctcctgctactcagtcttctggctgactgtctgaaagccgcccagtcccgggacttcaccgtgaaagacattatctacctccatccttcaagtaagactcccttctcttcgctgcagaaatgtcacctgatttcaaataagatttgaaagctgaaaactggccaggagtaggcagccttccatgtgggggaaacctggtgacttattgttgggagtgtacatgctgggcttcccaggtggcgcctcgtggtaaagaacccacctgctaatgcaagagatgcaggttttgatccttgggtcaggaagagcccctgggggaggaaatggcaacccactccagaattcttgccgggaaaatcccatgaacagaggagcctggtgggctacagtccatggggtcgcgaaagagtcagacatgacttagcgagcgactgagtatgcacacatgtgcatgccaccaaaatatgctgtgtgtgtttacctcccccttttacagggtgtttgtttttaggtaaaatatttggcttgtttgctctgttccctgcaccatggctctgattctgagccctcttctctctgactctgccagatctcagtcagttatcaaagtaaatgaccgagtcccagaggaaggtgttagtaaaagatcaggcctttataagcaagataatagctggccttcctgtctgtgcatctaattctcagtttcagcataattacctctcaccacttcctattgcctatcactttcagtttcctgtgtttaagagttatcttcagagtgcagaataatgtgtgtcccaggtcccttccccagagtgtctaactgcatgtatctggggcggtccccatggatttttgctttcagcaagaattcaggtgattctgctgccgcctatattctaagaatcacactttggggaacatggcagcttagcttcctctgttgggcaccatctctggatttatctcatcttttatatttgcttgaccctctactggat

SEQ ID NO: 58203 - DNA, 1417 bp, Bovine  19866881013235
cacttaaaaacatgagtttcagtattaacctaagcaaaatgtaattatagaagtaaatctataatagaaataaaaaagtgtagttctctgcaatgtccaggaaaagtgacttttggaattaggaagtatctgctattaagaagtattttactcacaagctcttctcgtctacttattcatttattcactctgtaattatagggaacatgctaaatatacaggaattgaaccctaatttgaggcagatgatggaaaactgatgctgctgaactgatgttgaacaactgttatcaccattcacctgtgggtctctttccagagatgtcctttgatgtttaagaacaactgcaaagtaaaaaagaaaggaaaaagtcaacattggccacacttatggctttgtcttttgtccagagaggtcaaggtggatttacaggtaaatctttcacaaccaaatgccaattatacatctgaatctcaccctccatgggtattgtcctaatctctcccgaaatacagaggtccccttgaaaagtgcctcaaacacactctaaattaccaggattacttgctgtttctttgaaaatgactttcatgtgaaaatgcttcagaaacataaaagttaatcacccctatcattttctagcagcagaataaagagaaaattaaattcttcttcattctttcctacaaaatgaattagaacctcactcactcttcttcacgttgtacgtagaaatggaacacaatccaatatttctctctttctctctctctaatgtttctcactctctctgtttcaaaaaggaaagggtaaaatacagactattttaaaactgtcacagttggtgagaaattctagggggagttctgtttttatcagaagtatgttgtgaaggtctgaaaatacaagtttatgagaggttacgtctctagcaaatgagatgtaccacactgacgtcttcaacagaaaccatcgaagtcttcataagtatgttaccctatacattttatcatcagtgttcagcacatccttgatgtttatttttaaaaagaatgtccaatcccaacatttcccttctatttcaaactttaccataggctagcctgaatgtaaaatggaaaccttgtgttttgctaacttcagggtgctcagtttgagttccatgaataaaatatgactctgatcattaaaatgtaataaaagtcagtgctttgaaaccttaacctaaacaagcttcctctctgatcctggaggcgaacttcagctgttctctcagcagggccttttctgcagaaagcccaggtctcatacaaagcatgggaacctgctaaggcaacatgcaccgctgagcacacagtcagagccattgccacagtagggatctcccaggcctctcagcacttcatcacattcagg

SEQ ID NO: 58204 - DNA, 748 bp, Bovine  19866881102181
attgttgttgctgctgataagatagttggcaaaacctaataccaatttgtaaagtttaaaaataaaactaaaaaaaataaaataaaatatatatagtctgagaaaaattcaattttagaggcccagaaatattggacaaatgtatgttttaatattatatgtttgaacaagaacagcaactatgtttattccaaataacatttagtctcttcattctcacagggttggactctgaattttactttagatttcaaaaagatctgctctttacaagtaagaaattggggaatcctttctggaaagacaaaaattcaagtggaaaagatttgtcacttaatttatgacagaagtagttgcaagttggcaaccattatattatttcagtatgaaaaaatttatcatgtgattaattttcccccaaatacctaagaaatagctaagaaatttaaatgtttcactagaaacatctttcaaacacccaggtgctgaattttccatttatgtcacttaaataaatggcatgtgtgtatgttgtgtgcgtgtgtataccaatatacccaaaacataataaaagtgagctgcaactctagaagctacagaaagaaattactcctctggagatgagatgtatctcaaaaataagtcaattaataccagatataatctttaatactccacagacagtttatctcattccttatggactggcatctactcataaatgatatttcccatatgtcagagagga

SEQ ID NO: 58205 - DNA, 1008 bp, Bovine  19866881186463
attgatttcctttaggattgattagcttgatctccttgcagtccaaaggactctcaagagtattctctaacacaacagctcaaaagcatcaattatttggcactcagccttctttatggtccaactctcacatccatacatggctactggaaaaaccatagctccttcattagctaatttgtaaatacctacgtgtggggccaaggaaagagagtcccagccatgctgtgtgatctcagaaccacggactagtggcaggcaggagagagaagtgcatgccgggaagtccactttcctgtcccacaatgatgcttgagtgctattcgttcaggaataattgaaagggaggtttgtgcatacagttaccagacaggggatcagagagcctcaacttctcctggcataattatggttcttccaggggattagaaagctctgcagttatgcagatgacttgcaaaggcaacatgagatattttactactcaaaccaagttgagccatctcaataacccagcagctagctgacagtgccaatcacatattgtaaaatcaggcggtttttgtgttggtgaattgcttggaagcccaaagagctggttaacctattttaagggagattttttatatttctgacaggggtgattaaaaaacaggctgtactgctcatatcagcagacaggctgcagacatcatattttccccagattgctaagtgggatacagttctgtttgcagtgttggtgaatgctggaaaagtaattttgatttgtcacttggtaaactgggcattctgaatatgaaggagttaatcagttcacagagggctgtcattaatccataacttacaggcccttttggaaatgtgtcttgccactaatgtcattgcaggcaaagtcacagtcccctcagaatccttcatcccgaaatggtcccttccagtcctgccaggggcgaactcagcttgcactgttggtttgtatatcatctgtataaactccaattttcc

SEQ ID NO: 58206 - DNA, 971 bp, Bovine  19866881199022
tgcctgtatacagtcggatgtttgcattataactgacactgagtaagtactttttgctcaaaattgccttgtctcctaagattgagggagggtttagatgcagctccctgactctctcagggttcagttgagtgtgcttcagggtggctctgtagatgaacacattagtaatagtctcacccagcacatgttaacatgttcactttatttctgccatcaatggtgatcatactccctgagaactgcttctctgggcttgttgactgatacgaccataaatatatctctgaaggctaaagctgtagctgtttcagcacagatggaacaaaaataaatgtcccactgtgttagtattacaaattatcatccaacagtggcatgaaatttaaggtggtgatagtttaattctgggcttgccaggcggcacagtggtaaagaattcacctgccaatgcaagagatgcaagagacacagattcgatccctgagtcaggaagatcccctggagaaggaatattaggcaacccactctagtattcttgcctggaaaatcccacggacagaggagcctggcaggttacagtccatggggtcacaaagcgttggacacgactgagtacgtacacacacacacatacacacaaacacacatacagttttaatttctactcttttttgtttacataatggcagaatgactagaattaaaaaatattaatcaaataagttttgctgaccatattgtgtacatggttcattgtttgccctgaaagttatgaaacattttatatttaaaaaacagcactacctctggacattcttacttctaattattggtaataaataaacaaaattgttctctgggtctataaatggattttgaggaaaggaatatatctttgccttatagataccaaatcatgatgtttcttcttcttctgttatcatgtgcatccattcaatcaacaaata

SEQ ID NO: 58207 - DNA, 1270 bp, Bovine  19866881208690
ttcaccctgcctggtctgggttcccatccctcatgccaagtccccatcctcccggaaacagtctctgcctataaccgagtggatcagcctcagggcccaaagggaatgatcagacacagggcaaacctggctgacaggagcccatgcgtcacagccttgccccaaggactctggcaacggtccagcatatgtgttttcatcaccaaaaccagcaggagccaggcgtgcattgcctctaaaaggctttacttgctgccattctcctgagtctctggcctctgatgatcctgagtaagtggacaccccagggcctttgcacttgctagtccctctgcctagaaggctctggccacaggtgccttcatagctctttctctctccttcaaacttcaccaaaatgtcttaattagccttctctgaccaccctttttaaatctcaaatgctcttttccctgcatttcttcttcttcatagcacttatcacactgacattctgtatgtttccatctatatctgtgtgcctttcatgtgcccttcaccagaagcacatgtgctgagagtcatggaagggtaagacaacttcccagagagaaagaaggtatgaatgcaagagaaaaccaacaaatgtccatcaagcccttttcgttcttcccatgccacagccatcaatgactgtttcccagtcattgagaaacctcttcctgaaggttctccttcacgtctctgctcccctctctcccctttctccagacccctcagcattgtctattccatgcaaaccatactgaccaacagcacctgcctcagtgggaggactgagcgggtcagctcatgcttagggaagtactaggatgttgcagtgctgtttattagccaataaatcagagccattattcctgttatttagtttaagtatcttgtatcacatatactaattaaactcttattcccacagctaggttacaagcaaattgagggccaacatcttacgtgtggatttttaaattttcctccagagtacttaccattagtttttaatgattattgtcaagtgatggaaacaaaggatttccatgtttaaagtttcatttgaaaccctttagaacctctatttagacagtgattcaatcctttaacctcttccaggactgaccttgtgtgtaaatatggcaaatccctgaaaatggcatctatcatgggaactttgctagagtagagccaaaatactctctacaagatcaaacaaatattgactcaaaagaattttccc

SEQ ID NO: 58208 - DNA, 1012 bp, Bovine  19866881222707
tcagggtaaactggtgaattcaacagatttaaaatctagcgcaggtaaatcaaacttaacttcccttgttgtctagctgaaataccaactgaaaaatatattttcgcaaacttttgccatatttataactgctccctcccaaattgtccttaagaaggataatactttatattatcagagactatgttcccactcccaagatctggatatgggaaatatatatcaatgtttagtgtgtgcacgtgtgtgtcttattatttgtatttgtgttcaccagagccttatatggctaaagagagatgtcagaaatgcaaacatcaaatacataggtttcatctgtagaaaaattccagctcatttaaactaccaaaattgcagtcagctgctgggagaaaaataaagacaaagatcctgtttacaaggcagctagagttcagccatcagatggttttgggttaagatatattttctttttatgctgatgtttctataagacattttctatgagttggtgatggtccaactgtcatatgttttcctccttcttgtgtttctatggtgtcttcatagtgatagtgttaatttttgaaaatctttactgaaaacttactcctctgcagctcttctgccagtgtgtagaattgcattctataatgggcaaattctgggaaagattgaaggccagagaagagggcgtcagagggtgagatgattagatagcatcaccgactcaatggacatgagcaaactctgagagatagtcaaggacagggaagcctggtgctgtagtccatggggttgcaaaaattggacacagcttagcaactgaataataacaacaaatgggcaattttctgatttttttttttttttttttggtgtgtggttttcccattgcttctcaggggctatttctgcccttctcttacttctgccagcaaggagctggtattaaacttttaccccatgaaattattaagtatttaagcttataagggactttccctcacta

SEQ ID NO: 58209 - DNA, 1060 bp, Bovine  19866881408549
tggactctatgggacataataaatgattttgacttgagtactaggtgattagtggtgcaattcttattcagatacagagggcttgatggttctttttttggccagttaagcttgagatggctaatggacatcaagtggaaatgtccagcaggtgactgggtgtatgaatctggagcttgggcgagatttgaaggctgacatgttcatttgaagtatagagagaaggctgaggtcttgggccagacacactgtcgcttggaagtctggaagagatgtcaggaaaggacatggacagagtagccagagaagtctcagaggaccatgagctaaatagatgcccggaaaggaaagtgtctctggaaggagtaaatggcaacctagtcattcaggttcaaatgttagcactcagcacccatattaaaatgtaaatccaaaaatttattctgcagctgcaaacagtgacagctgaagcaggctgggcccactgcctgcccactgaaaccctcagctatagtgggagactctgaaacagggagactccctcagaaacagggagactctggtttcctaggcgtctttgctgcagtctcaaccaggatttgtgagattttcattcccttactaaaacagcagtgatgagttggttgttattgttgcttaaatgtatgcagctgtatacagctggtacactgtgccataaatcagttcttgaaaataatcagtaactaaattctaatccagattctagtgccttgactttaaggttcacctaaaataaaaggctatgaccaactcagtgcatgaaaagacacgtagaaatgcttacaattttaactaatttatgctctgatcctgacaagataagtttaataacaaatcattttctaaattttatcttttctcaaaggcagtttctgtttgggaattaacttttgcttatggaaaatcattgtattatatgtttgtcacttgataaatgtgatattattgaaatgaggagttagagattttttgctttctacctctcttaaagtgaaagcataacgtacccaaccaacat

SEQ ID NO: 58210 - DNA, 1495 bp, Bovine  19866881432755
aaaatgtggtacctaactcttaagagaagcagttttatttattttttaaataaagcagaaaaactgggaaatgagcctgtgtcttctgcctcttttccagtatcttttgtcttggctccaaggttaaatatactcattgcagacacaggcacaggcatagatgacctcataggggctgaaaaagaaaatagaaactgcaagataggttaaaaaaaaaaaaaaaaaaaggatcattgctaaggtttgtgtcatatttgagcaaagtaataatagttgagcattcattggatgctcactttatatgtgtgagcccctgtgctgagtgcttttcaggcattatttatctatttctcatgcagctgtaaaaggtaagaaatgataagagcaaatacccaagtagcattattacgtgttaggtagagttctaagcactttgtaaatgtcaactcatggaatctttgtaacaatcatgtgagatatgtactgttggtattcctgttttacatataaggcgattgaggcacagaggatttcagcagcttgtccgagatcatagttgattatcactggatctagaatttgaacccaggaagggtagatatcaaacagtgcaatgaccactaggtggtagtgcttttcacctactttctctgaagttaaagggtgatcggtgttttatacctaaagtttttgagtacttgatactcaaagttaatgtcttctcagttgccaagattaaaattgttgaagagagaaagaagtctaaggtgaccacagccagggcaggagttgggggtaatatgtggtgaagatgggtgaatatgtgccctgtgaaagcaaaaaaggtgagagaaaacaaaaaacatgcaccctacttaagtatgcccttttgtgtgacttgacagtttcttcagcctcggcccccgaaagattcattctgagttgcttggtagctgcactgtgtccaaatagccatcatcttttatctagactgtattcctaactgctattcctgtccttctagcattctttctccaccctaagagccaagagggagcttttaaaagtgtaaattatgaggattccttgttggaaatcatccaaaaccttccatctcactgggaataaaatgcagacttctcaccctggagtttagggctctgtataacctgccctttgcctaactaggtgggatattttagttttgaaaaggacattacaagatgggtatacattacttagctaaaaatgttctccttaatataataatctgtgctatcagacataatggggaaatttgcattcatatgcttagaacttttcaaagatttaactgaaaaaaaaatcacacttttttttctcgaacagttttttacttccaacgtttgccccatgcactgccctataactggaaaactcacagttgtaaaatcacaatttttatgattatgtaaaatcataatttatgatatgtaaaatcataatgtttcaatgt

SEQ ID NO: 58211 - DNA, 1234 bp, Bovine  19866881435356
ggacgtggtgtaaagttgtctatgagtttaggaatacagggaaaacgagagtaaatactgctatcaatcaagaacaatttgccacaaaatagacaggacattggaaaaataagagtgacatcaaacaaaatagctctcttgaggtataattgacataaaataagctgcatgtatttatttatttggctctggtaggtcttagttgccgcaggcagaatctcagttttggcatgcagggtcttgttcccaagccgggccccttgcactgggagtgtggagtcttaaccactgggctaccagggaggtcccagctgcacataaagtatagtttgagaagttttgacatatgtgtacattcatgaaaccatcatccccacaataagataatgagcatgtctgccaccttcaaaagtatgtggggctattgctggtctctctggtctatttcagtgatctaatctttataccagtaccatactattttgatgattgttgttgttgttcagttaattactgtaggtttatatgaactcaagaccttctgtggagtagccattgataaacatgtgtagattttatcaagctagggaatagtgttatagtattaaacttctacctcaaaggttaaaaccaaattcttggagtttagcctgttagcctttaaaaggccgagttatacttcagtctgctttggaggaacactccaggttttgagttgggattgttaaatactagacaggcctccccaaattacttttgtttatggacatttctgggaaccactgaaagctcttcttaggtggtataacagatcgagggtttagagcatatgacctcttgtaaacccaatcgttctttcatagaatctctgttgtaactgaatatttcatgaatctttgcaaatgaatctaattttagcataaaattctccggtactataagattaaccctattaagttccagttcagtgattttatatttgaggatttatttttagacgcatatgttggtgttgagctataaacttctgaggttggggtgattaaatggtccttgcaatatgaaggtgcagttgatttatgggaagttggtgcctgccgctgataatgataaaggaagatatttttatgccaagttctaaaatagagctgatgaaaaatgctaatgaaatcaaggagtgtctgggtggctttggaattaaaaaaaaagagtctttacctttaggaatataagt

SEQ ID NO: 58212 - DNA, 1107 bp, Bovine  19866881437301
gaatggaagagaatgatttctgaagacagttgtatggaaaactttccattatgtgctccttgagagaggacatcatgtctcttcagtatgcatgaggaatgtatttggcgttccccttcggtgcttttatcctaactccagaaatggaaacctgaaaggagatgatatgaattcaaagaaattccacttctctattatttgaacaatgctttttacaacaccaactaaaaaattaagccaactcttaggaactcaactctttgattttccagatccttgccccatgctatcggtatgtttttctttctactttttacccacttgacattgaaaattgagttggaggaccattacatagacaaatatctgtggatttgtccaccaatacagtgtcctatctgtgataagttttattatttagaatttaaatgtgtaattagtgggggaaaagacctagaaaaataactaagaagttaatcataaattaacttagtgcagtgcatattgaatgaatggctgtcaatatctcccttagcaaacatgagaaacacactgagccaaaggcacactcaccaacctccaggaccttcatactctcatctcaacccccaccaagcctccttctgatgttgggtgggctgacgcacaggcaagaagtagtgaggagccaggggtaagcccctttcagggaatggagaattgacgttagcaatcagactcaatttctagctctcactaagtttatggatattaactgaatttgagagcaaaccctccaaggaacttagctgaaatcatctcataaatcttttaagataagttaggatgccaggtctgaagaggcttcatgatgaatgataaaacagaggcgcctgtgtggcatgcccctgaggaaagcaagtgagcaatgtggaatgagaaccaaactctatatgcacttaaagggcaaaagacaaccaccccacaaactcctgcagttgttgttttaatggcttatttatggtgctacagagccagacgtgtttactctgccccgcagttagttatcattatactcaaagattcagctaatgaattcttcccagtgaagaaaaaaaaaaaaccttc

SEQ ID NO: 58213 - DNA, 806 bp, Bovine  19866881501374
ataaaataaaaatttttaaagaaaacttacctgtttaaatattcagacatattcttagtggctgcataatattaaaatgttcgtagctataattcgtctacttccctattaagaatactaggcagcttttaatatttctctaaataaaaacccacataatctttgtggtgcacattactagattgatttatataaagttcttgataaagattaccaaattactccccagaaagactgaagcaattatagtctcagtaacagtgtttgagaactacgtcttggacccaagctcgcatactttttggaaatctttgttaggctaaaaggtatattttcaaatttataatttttagtctcaaacagtaaacatttaaaaaataagatagcctttttctcttgtaagtaagtcattactcttttgaaaaattttgcacttaaaatttatatactcagataaaaaaaattctgtcctcagagctggagaaggtttttctttgaccctcccctcttcttcccattattcactggctcttcccctctcctcttccttttgtaacaggagtgtaggtcttgctgtgaggggatgatctgcaatgttgagttacccaccaaccacacgaatgcggtcttcgctgtgatgcacgctcagaggacgtctggtagcggtgcccctgcgctctacctaccggtgctggcctgggccttcgtgctcccgttgatataaggccaccttcctgggagaggcagagacccgtcctctgaagcacaagctaacaactgtaaaatggtgaactttgaagaccaat

SEQ ID NO: 58214 - DNA, 874 bp, Bovine  19866881589385
ccacacataacaacagcctggggatataggaccaaaaaagtcctcagactgaaaaaaaattttttttcacataaagaatgaaaaaaacagaattcctatcccttgtgttataaaaactgaaaggtaagggaaattttatagacccagaaagtgatgaaatgaagagaaagacatcaagtctacccaaaaggtgataaaatattttatttgttttttggttgtgaaaaagaaaataaatcattaaaatgactgtcagaatggctccaggataagggcattgaataagagttggctataaatgttggagagagtaataaaagagttggttttgtttccttagcatttgtctgggctgaaccctcctatttcaacacaggaatcatggaggatggtaaaagtcaacccaccaagtgacctgcattagtgccttccttgaggcctgtccaagaacctcagagcagctgcttcccacctgcacccaggctcccatccaacgcagaccctacaggacaggctaccaatccaccagcacttcaggatcacagtatttcttctttccattattactatttcacatatgcctgcttataaaacaagcatttttcccagtccttgtttttctcagtcctaggaattcaagatgacaaaggaaaggtccctgccccaagcagctcagtttacagtttaaagggccttggattaattctgatgttgtttaatgatatatttcaagtgcctggagatagacaacagtgacagaatagctgttgtaaaagcaactgttgattttatttaaacccgggaaggattaggtgagaaactgtaaaaggggtaggattttgaactaacccataaatgtgtatcccaagatttg

SEQ ID NO: 58215 - DNA, 1317 bp, Bovine  19866881931206
cgtgtccgactctttgcgaccctatggactgtagcctgccgggctcctctgtccaagggattctccaggcaagagtactggagtgggttaccatgccctcctccaggggatcttcctgacccaggagttgaaccagtctctggcatctcctgcattgccaggcgggttttttaccattagcgccaccagggaagcccatatattatggagtagaatgtaattgacactcaagagaataaaacatgaggcatcaaatagatttctacttgctaccttgggctggatctcaaacgcccttgagtaggcctttttgctttacaactgggggtaattaagagaagaaagttgagaaatactaggctccatcttcctgaactaaggaaattcacacacagtgaagtcctcgtgcaaaaatgataggtcaggagaacctctctgagaattggctatgcctctgtaatattcacaacttaacagcaggtgtgaggaggtcgggaggtgagctagtcagaggggagatgaagagagggggagagagggagagtcatgagattcctgcctgaatgtttgggtttctttttataagaccattggttacatttgaaatctggtcttcacatacaatagtccctttgtattcacagggggattggttccaggaccccagtgaataccaaaatatgtgggtccttaagtcccttatatgaaatggtgtagtacagtcagtcctctgtatttatggaggcagcacccagggatgtacaatgctgactgtagttttagcttcgctgaagtcaaatacctgttttcttctctgtgctggtgctttatgagccgctcaactaaatctgttttcaataacattcaagttataatgtaagtactatgacttatattaaaaggaagattaaaaattcttaacagcctggtgaacttaacccttcctaatgctaggcacattatctttcttctttcctgaaggactgggaaagttccagaaagttctttgcccaacagaatgggttagtactgttctacacactgtgttacccttttcagtggatgttgtcaaatcaagttgcagggcaggacataaaggtcaactgtacatgattttagggggagaggagagtggctgggaggtaaaatataccctaagctttggcttttaaagacttatgaatttgtagttgctttgtgactctcgactgatcactctttaaaacattttttaaatttatttatggtttatttttggccgtgctgggtcttcttttttctagttgggacgagtggaggctactttctagctgcagt

SEQ ID NO: 58216 - DNA, 663 bp, Bovine  19866880438167
gtgagcaaaagggagaaaccaggatacttctctcttttccctgtctcaggaaaccctctccagcaatgatgatatcttctctgtggctttagagggttttggctttggggaaaacatgatgatgagccctttcctttgttttaggactgtaatagttggctggggacacaattcttatagtttaatggtgcctccttgtgcgcaagcgtgcagttgtggttacaatcaccccagttgcttctgtttagaaggtaacaagtttataagaaacgaaaaggctaaaacactgcagcactcgcgcattaaaaccccgtctttctattttcccactaaaagagagaaaaaaaatactgtgatccttttctggaacatcttgcaaagttatcagaattttggtcagggcagccaaggtttagaaccgtgactcacatgatcagtaatccacatggaagcagctgtctgaattttttttttttttttggctaacagtagtaagtagagaagcctacccttgcacaggaaaattgcatgtgacccggagtgagttgactgtgttacttatacatttatcgtagtagttaccagtaattggacattaattctgctctggcatctagattctttacatataatgatacgttttcatggtagatcaaaattacc

SEQ ID NO: 58217 - DNA, 1255 bp, Bovine  19866880518856
acttggacttttctattctgtcctttgtttcccatatcccaccagtcttgaactggggaaagggaagcagaagtttgttgtatttctttgtctctgatgtgacctgctgtgcaggacttggccctcgcctccaaattctccaggccagaatactggagtggatagccattaccttctccaggggatcttcccaacccagggatggaacccaggtctcctgcactgcaggaggattctttactagctgagccataagggaagcccaagaatactggagtgggtagcctatcccttttccagaggatcttcccaatccaaaaatcaaactggaatctcctgcattgcaggcggattctttatcaactcggagaaggcaatggcaccccactccagtactcttgcctggaaaatcccatgggcagaggagcctggtaggctgcagtccatggggtcgcgaagagtcagacacgactgagcgacttccctttcactttcactttctttatcaactgagctattagggaagcccgccattcccaacttaaactccaccttaaatagttctcagagcccctgagagtttgacactgtgcacagcatcatccttggttgtgatgtgacagctgccattcttcttttctcttttgtggctccttggtttgttatcatggtcatcagcaccgccaaatttagtggctgatgccccagatagccgctgaaggttctgctgattctggccatgggtgtctgtgccttcacagcctcccaagcctgtgttgagagctctgtctgtcaccactgccttgtcttccatggaagctgtgctgaggcagctttttttttttttttttggcagcctcctcttctgagaagtcagacatgatttgaagatagatcaggggatgatctgaaagttggattttattaaaaacacttcctaggaggctgcttttgtcctagaaaaagcttgtggggctctacttgcttcccctgggatgagcctctttgtctctcttttaaaagaccttgaggacccaccccatctgattatagagctgcttgaatcttaagtgaatggagcttttagaacaaaatgtaaatgaatacttgcgtatgtataggcatcttctgacagactttccattgttactgaatagtgctttatataatcctaccactgtgataaagtcaactcatgctgaaacattggggagtgcaaatgtgtcccaggacacacacagctttcttatgttaa

SEQ ID NO: 58218 - DNA, 900 bp, Bovine  19866881065364
atattctcatctcctcctgttactggacatttagactattgttagtgtttgatagattctcttgattaggtaggagaagttatcttcccgcacaggctgtgtgaccttggggaagttacttaatctctcttcaccataattttctcacctataaaatgacaataattataattgtatctacttcatggaatcattgtaaggtggtttattactgcccataattgtcaattttgattacaattagaatgattattaccatgtctttgtgcaggtactgtgctaagtgctcctggttctatcaagtttcccagcttcccaggtggtagtatcattacttaggaatggtggagctatgcttgaatcctctgactgtaacgcccatattcttagtcaccaccttcctgtgactggaggtttatgagaggataaatccaagaaagagttcacaaattctggcgccatgctacaatatcaggtatctgagagtgaaaagcaagaggacttaggatgccttgtgacaattctcgtgttgtcaccaatgttgctgctatttagaccactcaatcctaattgcagtctacaagacatcccacaaactttacagaaaacacttcaagaatgtcacgcctattttctttaccatgaaaaggccaacataactttaacagttttgtttggaaaaaggatgtttttggcattgaaccatttagcatgaggatattttatggaacatcaaacattcgatgatagctaacgatgctagttttgcttaaatgaaagccaacatgaagcaaccaaattgttccacctagccaagagccgcaagactcattaagccatgggggcatctgtatcaaagggaaagatttcccagctactacttaaccagaatgttcatct

SEQ ID NO: 58219 - DNA, 1325 bp, Bovine  19866881198038
actcactggaaaagatgatgatgatgggaaagattgagggcaggaggagaaggggataacagaggatgagatggttggagggcatatctgactcaatggatgtgaatctgagcaaactccaggagattgtgaaggacagagaagcatggtgtgctgcaatccatggggtttcaaagacttgaacatgacttagtgactaaacaaagagtacctccctggcagccattcctgaccaggctgcgggcactatcttaaaaatcagtgtcctccacagtgtgataagaatgggggactaaacatagctcagaatctaagaatgaatcagatatgatcaagaactatgttctcttacagtctctttgtatttttgctgtttgctttagaattaacctgctggccgaccaggtcaccaaagtaactctgggccggttacacttcagcgaaaccacagcaaataacatgagaaagaaggggaagccaaaccctgaccagaggtactggtgtggtgtgtatgcctttgctggggcgggggggggcgcggtgggggcgggtagctggttatgctacctgacagcccagggcccccagaggcccctctgatcctcttggccttcctcagctgccctcctcccttctctgactctgctgttgccgcatttcatttacccttagacatcgtccttcttccatccccacaccctgctatgcctcctctcctgcccagcctctgggcggcttgttttcattgtccccgtgatccttctgcaggggtccccaaccacccggatctaatgcctgatgatttgggatggagctgatgtaacaataatagaaataaagtgcacgataaatgtaatgcacttgaatcttcctgaaaccatgtcccttccaccccagtccgtggaaaaattgtcttccatgaaatggccctttgtgccaagaaggttggagacagctgcatttagagggaccatgtgttcatgtcttgtgacgggctgagggctgaggattgatggcatttctcgaattctgtgtgctggtcactactttaatgccctgagctccaaagctctgctgtagccttttttgattgaaaatacatttacattaatgatttacacctgtgattctcagaatgtgctcccaggaccggcagagatggtatcacctggacacttattagagatgcaagttgttgggactcactaaaaacctacctgatcaaaaacttggggtgaggtccagcagtctgtattttaacaagcccccctccaagtgatttgatgcatgctcaagtttaggaaccacgattttagaacaaaggt

SEQ ID NO: 58220 - DNA, 872 bp, Bovine  19866881198358
ttaaacaagtgtgccagcagagtggacagagctttagaagaggctgagtctctactgtgattttctgccatcatatcaagtcagaggatgaaggcagcgaaagagatggattaccgttccccctgtttgacgagtgtgtgaaaattaaagaaaataagcctccgtcaatggacactgtccgaagagcttgcatttagtttgtttccttcttcaaatcaactgccaattagttttacactcatccatctctcttacttcctctctccttccttaagttccataagtttagcacttttctatagttcatggtcttatatggtgataggcggtcttgatgtggagtcagttccccagtgtgatcggggctgtggaggccagctatagtaacaactctttggggccaggaaatccattgactcataaggtgctattttcgcattccttgtttttctgactgtaaccatactccagaaacatacttggactgaagcttaagtatgacgcataaaagcccacagaatgatctgaacacaggataattttagttcgtaccactagtcatgctagtaagcaaggacattttccactttagattctcattacttctcagtttgaacggaaaacaaacttctgatgagtctgtggtttgtgtactaggttattttgctcagaaaactggaaggctttgttgggcgagagaggtaagaccttagttagaataggcagactaaaccaaacaaaagatctggtttgttggggccaatagccaactgttggcatcctcagggaccctcaaataatgattcatgaaaggccaggaaattcttttcttcttcttcacctctcctaattgtgtgtgtgcatgtatgtgt

SEQ ID NO: 58221 - DNA, 1567 bp, Bovine  19866881273694
cttagataaatagaagtcgtttcctgctgtgtgcctcccagtatctgcgtggttccctgaaacccaactacttaggtagtaaatatcctgatcttacagatgggaagcaggtacgcaaggataatgaacttcttgtcagctggaatttgaacccaaatcatcttactattcatcatcacatcattctaccaaaccaattaatgtctgtctctgactttttcaggctcactgagcctcaagttctttaacttcaaaatggggataaataataccaactttgtgtgattttgtgagaattcaatgagataatgaatgtaaaggtcataaacatataataaagtgtcatacaggttattttcaaaaatcaggtccaggaaattccccagtggtccagtggttaggacgcccgaactctcactacatgggttcaatccctggtcggggagctaagatcctacaagctgtgtggcacagccaaaaatgaaaaatatatatatataaaattgttttataaaagtcaggaccatcagcctgaagcctaagctatatcaagcttaaaaagaaataaggctgagaggacttccctggtgatccagtgggtaagatctacctgccaatgcaggggacatgcgttcaactcctggtctgtgaagattccatatgtgacagagcaactgagcctgtgtgccacaactactgagccaacatgctgtaaccactgaagactgagcaccgagagcctgaggtctgcaaaatgtgcagccttgcctttaacctagcaggctgaaatatgagcaggcttaactaaaccagtaaatacctatcaaataaagcctctccattcttaataccttcaacctgcatagtgtgtttactgaagcttctgtgcttgccctctatgcttctagattcatcattacctcgacgcatgggattcacaagagatgaatgttgccgtaaacttttgcaatgcctagatttttttcctcttaactgaaaaggttaggatacgctctattttttcagcaattaaaataatgatatcccttggttattaaaatatataaatgtcagctcactcgtaactcagagccatcagtaataatgccttccttttctataaaattaactaacagctctgtgcctatggtatgtggcctctgagagctgccccctaagctttttgctctggacttaccctttaaaccaggagactgtaatctttggagccatggcttattgacatttgctaataccaaccattttacgattccctcggccaccatgtaacaaatgtgttttccacttgaggagccatgtaagcacacatcgattttgccatgtaacatcagctttcattccaatctccaaagccctgagccctgagtaaattccagaaacaatgggagatagtggggggcttacacacccgcactggaggcttctactgcaatagcgccgatctattatttgctggatttccataatctgaatagaactgatggttgtatcaatcccgaatgagaagaaatagagaaagtaaacgcttctgcagaggaaaagagca

SEQ ID NO: 58222 - DNA, 804 bp, Bovine  19866881391368
tgccaggtgtccttaaattattgtcatcaaaaaatgtgagaatcttgcctataaaaggcaaaattgtgaagagggcaacagtttatttcaccataacctaaattaaaattaaatttttttctttcatcatctttcttcttcatgaagatttgacctccagagccaaaattactgttctttgctacatttatctcagctatgtattaagaactcaatattatctaacttgcactgtagtatttctaattattaacccttccaaggttgaatttttacgagaattttttttaaccagaatgaaacactaattgatagaatgtccagtaatttagcaaatttctgaacatctactgtatcaaggtgggatatcaactcattagagaaaagatatattttggagataaatggatagccatctggaggaaagtgaaattagactcctacctcagatgatagacacacatagtaagagattcaagattaattatcatgaagttgaaagtaaaaatcataaaacttcagactaaaatacagtaaaatttttaattattcttcacattaagccttgtctgctactgctaagttgctttagtcctgtccgactctgtgtgaccccatggacggcagcccaccaggctcccccgtccctgggattctccaggcaagaacactggagtgggttgccatttccttctctgatatatggaaagtgaaaagtgaaagtgaagtcgctcagtcgtttccgactcttagcgaccctatggactgcagcctaccaggatcctccgtccagggattttccag

SEQ ID NO: 58223 - DNA, 1004 bp, Bovine  19866881622496
ggaacagaatcttaaatttttgacacttcatgcttatttttctatatcatattaacttttctttttatgcatctaagatttcttctgtagtatttcaacttcaatcatagacatagcatttacattttagaagaaagactgacaggtacacaattagtgtactcattaaaaaattatgtgttctgatttaagaaagaaacaaaatcttctctctattctccttccaaaaagtctctctgactctgcttagaatgtccgtaatagttattcttctaggcttaaggccagttataatcctaatagttatctggaaaaaactaacaaaccacattcactcactaatatttcagaaagaatagtttattaaatcatcagtattgattacttaataaaagcctagggaagtaagacagagaacctggcaattttgttggacctggtggctaaaattgaggactccagaaagaaacaagacaccagaaaattcatggaactctctatttaagcactgtgcattttactatatatgttataccttggtttacaaatattaaaaaaatttgggacaatagtatctacctcatggggttgttgcttggattaagtgagctggcatatttagtgctcaatgaagttagcaatcatgattgtcatcactgttactgttactttaaagaggaagatgaaaagtatgagacaaaagagagaagctacattccacataaaagacttgattaaagtgaagtatcacaaaagggcaactctgaagcctgtggacagagtgaaagcatggtgcttgaaacttgaaagttagtgccagtatgatctggtaagtttaggctcttgaagttggatcacctgagttttgatggtacctaccactcactaggtgtgtgaccctgccttgggctgtatatgaaaagtagggataatactatctatttcatacatctttttttttgtgcaaagaaaatgcatttggagtgaaggagaaaataatgaat

SEQ ID NO: 58224 - DNA, 1017 bp, Bovine  19866881648715
cccacttgcactcttgtttcaacccttttcatttgttttatacagtttttgtttggggaaaagaaatagttaaaaaaaattttttttgtaagtttgaaaatcactgacctacagttgagcaaacagatcattagattttttttcttaaatattgtatctaagtaagtattctcttatagtaagaaataattgctctttggttttgccctcctgataatgagagctaatttatattacttactttagaatatttagttgagctttaagagtaaagcaataattcgtttggttggttttttttaacgtctaaaaaccatcttcaatcaacatcacagatttgtaaatttgccctactatttggattccaaccatttacatagtgtggtagagctgagaaaacatgagtttaggagtgagatagaagtggcttgaaatgatcttggtatttcctatgtgtgatcttaggtgagtcatttctttcagtttcttatctgcaaaacagggataatgatccttatttcacaggttacaagttatataaacaaattatgcaaaagcaccttgcacacagcatgaccaaataaatgtaaattttctttgcctcaaatattaatatattcaaaaaactcttttcacagatttgttataacaacttttctgatttcaactttttcatgctaaagaagtctagtattctatttattacttagtaaagttaaatttttacttatattttgctttctatacatgcctaattgaaagttatctcaaatcagtaagtagctaaagttctttctaaaaccataattcaaagagattaaataatagatgatttatatcttaaaaatacacattgcctatcttgattcatacctgacttttggaaactggcataaacctcatgaatgggcagagtgccctaaaaacagatggatgtgaatgctcaggtgccagaaatccttgtgaccacaattcatgtagaatgttaaaatggtgacagttctttaatggtccttt

SEQ ID NO: 58225 - DNA, 1200 bp, Bovine  19866881754705
tgtcatgaggcagcatgaaaagtcctatggagaaacatggcagaaaaaactgactgtggtttagagaggatatcagtatcattttccacagtctgttttagtgtgaactaaatcacaaattaatatatcaagcaaactttttttttaaaggagaaaaaaatgaagccagttgccaagaaatttttttaaaaatattctgagaaatagtaattccagtgaggatggagagaagtaggtagattcaggagattttggatgatgaactgtgtgatggatttcctgcaggaggagggagtcagagatgatgcttgggaacctgtgttggactgctaagtggacatcatatgaccttgtgacccactctaaataatacagttataattctactctaaggctttctactcattacagtaaattgtaatatgacatttattatggtttagaaccatagaatgtcattcctatcttcgtgatttctgacttgtttttataaaacaaatttagaagtaaaggaaaatctgtaccagaattagaaaatttagaagagcctttgtcaggagacttttttttttttgctttgtttttattttgtgctttatttatttttaaacatttttttagtgaaaaatttcaaacatacaaaatgagagagaagagtaataaaatttatatacttcatatacagtaataaaatttatatacttcactcagattccacagttatcaattcatctccgatcttgttttagttaaataaactatcctccctcacagctgaatttttgtagctttgttgagatataattgacacatagcactatgtcagtttaaggtgtacaatatgatgatttggtataaacttatattgcaaaataattgccctaataaggtttatcaacaaacccatcacctcatataattacattttgtgtgtgtgtatggtgagaacatttaagatttactctcttatcaactttcaattatataatatagtattgttcgttatggagaaggcactggccacccactccagtactcctgcctggaaaatcccatggacggaggagcctggtgggctgcagtccatggggtcgctaagagtcggacacgactgagcgactttttccctttcatgcattggagaaggaaatggcaacccactctagtgttcttgccggagaatcccagggacgagggagc

SEQ ID NO: 58226 - DNA, 1834 bp, Bovine  19866880439304
tgatctggttactggggaagaaaaagcagttttaggagagacgcagaaatgactgtgtgacattttagcaaaagtccttaaaaggttaaatctctctttttttaatacttttaattttcacatattttcaaattaatgtgattactttcttcctcacagtggcccatttggattagtgaattccattgataatgattttaggcaactgtggcctcataaattttattaggaaaaaatatcctccaggtgtgtttaagcaatagtcttttaatattagtgttttgaagggcatatattatcaaagtccatcctgaaatataaaaaaatgaccatgaaaattgtcatcggagtacttaatccatcccagaagtcatatgctttgtcaagctaaaatgataagaatgtatcccccttcagtctcttcagtaaatggcactattgaggaaaggattgtcccgttatgtcatagttactgaggcagtgaaatgagctttatcactcatatctaattgaaagagtcagtgaactgtattaaaattaaatctacatttcttttcttgaataggcaaagcaagaacagaaaatcacctcagctaattccaattttggaaaaaaaaaggtcgctacttctttactgtttcaaaaatttcaaaggtcaaataaaatttagataaaatttttaaagtgatgaatcaagtgcatgatttgggaactcttttaaacaccaaatggaatctatacaataatgtaacagatatggtttgcaattttctttttcctttttttgaattaatcaaactccacaggataagatttcatttcaaaacctctcatgatgttaagtctggtcatgtatctaaatttggataataggataaaaacacaagtgccatatttcagctgcttggaatttcttcaatagatagcaagagtgttttcctactttaatttgttctttcctggtttgtttgttcttttttctgttcttttttctatttgttcttttttctgcttcctttatataaatgtgatgacaagtgctggattctttatatttcccatatagaaaaccagtagagtctaagtacataaacaaggaagatgaaaaagcctaggtatctggggactccaaaaaggaaaattgccacaccagtcctgacatgcatatctttagactttacatgaaacagaaaaaaatacttgtaagagctcttatttatgacactttgaccttggtgctcccacaaaatctaattccaacagatacagtggcatatcagttcaattcagtcactcagtcatgtctgactccttgtgatcccatggactgcagcttgcaaagcttccctgtccttcaccaacccccaaagcttgctcaaactcatatccatccagttgttgatgccatccaaccatcttatcctatgttgtccccttttcctccagccttcaatctttcccagccatcagggttttctctaatgagtcaattcttcgcatcaagtggccaaagtgttagagcttcagcatcagtcctttcaatgaatattcaggactgatttcctttaggattgactggtttatttatgagtgaatgtttgataaattacaggctttattttgagagagctaatactgacctcggagaaggcagtggcaccccactccagtactcttgcctggaaaatcccatggatggaggagcctggtaggctgctgtccatggggtcgctacgagtcagacatgactgaagggacttagcagcagcagcagcagcaatagtgacctacccatggtaataaatatattcagttcaatgtaataggctataca

SEQ ID NO: 58227 - DNA, 2081 bp, Bovine  19866880589917
tgaagtgattgctctgtggcatcatcaagaatagtggttggatcaacctaaggcagtgatactcactgtatcaacaaagggatctcttctcctttaaacttatcttaggaagtaatagttgcctgcatatgaagttgtctatgttggaatatcaatggttgtggctaaatgctattacagggaatctcatgaacacgagttacaacatacacatatttttgaatgttgtatgtggtgcagattctgtattgaaatgagatgagaaacactgaaggttgatcttcacatattttgatcaccaaaaattttgttagtgctcataaaggtttacaattattgcttaattattatttagttatattaagctgtctgttgggttctatagtatacttctcatatggactcacttagccattgcacctcagcaaattcttgtaattattttaatgttgcaggaaaagaagcagatacaggccaaggttaaataacaaagttcatacagtggccctgatatgtgacatctgatctatgagaactgaaagacagcactggttctattcttctctacttttcacacagtcttgagttatattttgagataatgataaacatagggtcctccccatgttagaacagtgctcagcacacagtgatatatatatgtagatgaaattagcaatatgaatgtaattaaatctttattctggtttacaaatgaattgattccatacgaaggtttgaaaataaagttgatcattatctagcaataggaagtgaccggtttttcagtactttgctcattaccaaccaaaaatacgtttaaaatgttgcatctattttgagaatacacttttcaaggctatttttccactctactccgttaagcttatttgaatatataaattgactttcaggtatgcaaatatacatcacaatctgaattaagtttcatatataatcaggctggtagtcaaattgttgtttttattgtatatttactttatttttgctaacagggtgtattgcttaaggaaagacatttttggtgtttacaaatgtgtctgggtctgcatacttggaaaatattgcaaccaaactcagttcgattagtcaatatgtattgatcacaatcagagtaattcaggcatagtgattataaattgcagcaataacatttctttttataataataaattataactttaattagaaagtctctcgtgtgatgtttttcatttgtgataatctctttatcgttatttagagcacttgtatacaatcaatactctattagtgcttcaagctaacagtttgtgtgaatcaaaaactcaaaagctgtcctcaatgaaaaaatcattatcattattacctttttatttagtatttattgtagaccacatttcttcattgagcttagacatcatttatattagttttaatggtctcactaaattacttacaaaaaatgagaaaaaattctatttactaaatttgaaaggctattatttttaagcttgaggttctctgtatattgaattaattaaagttgtatttgaagaaaagatataagaaaatttgagccaaattacttcaaagatttctaaagcatgaaaaattcttttatatcctttttacattttgcatagatattattccaaatcactgaataattgaagaaattaacaatagatattgtcttccattttcccatgcaacgttccatattttggtttcatttttcaggatgatatgttgcaaagaaaagacaattgcctattcaaacacatccacattctccattgcttaataaatattagaaactccattcaattttgaaatatagatattattaaaggaaataatcagtttacattcccaccaacaacagggtttccttttctccatatcctctccagtatttattgtttgtagatttttttgatgaatggccattctgactggtgtgaggtgatacctcattatagttttgatttgcatttatctaataagtgatgttgaacactttttcatgtgtttatcagccattcgtatgtctttttttgttttttttgcctttcaca

SEQ ID NO: 58228 - DNA, 1377 bp, Bovine  19866880624140
tgatacataagcccttctatgaattgctctcttttctagattctgcttcatttcttgctattttacaccataaacttcttataaagtgcttcacacaatatatcatttcacaattctattattttatttatacagtttcttttgacagaaatggtggccccacatttttctttaacatttatagttctgtttcttcaagtcttggttcatttctgctcttgatacttgcctaagaatagtggggtagtttaaatgtttatcttctaggctccatagcattccgaatgtttatcatcttttgtatacaaatattacacaaaaataaatgatttttttttatatctcccccccatcaggatgtaaactacttgaggagtgcacctttactttttatcctttaagcattactatttcaccatgcttgtcatgtaatcaatgaaataaatttaaaaaatacattgaactaaattctctaatgaaacctgaatcacaggaaagatgactggatctgtctaggggattatgtttagcgtgaagatagttaatttatattttaatcagatgttggaggagtccttctgaaggggggatcttagtttaaatttttttgagcaaattgtcacattcaaggcgataatactgatggtgataactttttctaaacagttgttccaggctaagcttgtaacatattgaataattactgcttataatagccatgccacaatgcgtatcccattatcaagggaggaagtagaaaaacagaaatttaagaaaatcagtgcacgatgaacacataatgaatgataacaacaaaaatcaaagtactgcagtctgatcccacacactgaacatatccatagagcttcagtgttggagtttacagagtttagcattctagtttaaatttaacaaagattcatagcatgattaaaatgacttgaagaagtcagataagaacagtgctcccagtgatgagagaaaaactgaaatgaacagttccagcagttctcaagtctacatccaaaaattattataactgagaactgtatgctttggtagaatatagaatgaattgttataacaatgtaaacaaaagaggaggttttcatggtctaatggagctcttggtggaaaatgggctttgttttggaagtcagtgtgaagtaagaatattagaagtgtgagccttatttataatttggtttcatagcaaccccacgtccaaggagcgtaggctgcacccggcgttggagggctaagaggagctaaccacgttcaaggtcaggaggggtaacctcatccaaggtaaggagcagcagctgcgttttgttggagcagccatgaagagatagcccacgtccaaggtaagagaaa

SEQ ID NO: 58229 - DNA, 1758 bp, Bovine  19866880677759
attgcatttagaaatagaaatacattttactttacttagactagaatataaatatacttacttagaatagaaatacatttttcaagatatccaacaaatcatttggtctgtgttttgtaagtgctttcaatttttttaaaattttatatgaaatcttgtacataatgcaaagagataaaagatttaaagatgaaaaagaaaaagaagcagtaactacagattgaaaaaaaaggaaaaatgaggcatcaaaatattttcctaaatctaaaattttaatgaataaagctaagtttctgtgaagtttgttgttattacacaaattacaatagtaaattcatgttatggtatgataccaggtgactattattaaagatctggcactaaatacctttattgttatccattcctcccacagcatacagagttccgactgtagattttctaggtttagttcttggactttgcattaaagttcttctttctggcaacagatggtacttcattgcttctagaatcagcttttgacattccagatcattcttaaataatgcatggttttctaggtctgccaatatctgtgaataatacacatatatgttaataatggtttttatagtatgagcatatctaattagaaaattagaagcttagtagatttgatattgcccttctactgacagggatgaaaaatataataagaattgattacattgagaaataaatatgagttaaatgcatggctaagaaaaacagaaaagatattatttttgattccatattatttattattattttgccattcagagtacaaagaaacttctaaatatcaattttcagtttcatttcctttttataaaatctgttcataaatcaaatatagttgcctttttggccataaacatttctggtaaagtagattaaaaagaaaattctgcaacaaattaagccctaacaaacctatcataaatagtcacatactttaatgtattccaagccactttaaagcttttaaagttttaaaagatataataatttaatatgttcaagcatagttttaatccctttcaaattaaaacaattcaataaaaatagaaaattatactcataacacctttttaattatgcaaaccattgaaaaactttacttcaggcaaagtaatagtttccaatagtgaaactgaaataaataaataaaaattaccaaaaatccagcacctgagggagaccagaattttatattattccttttttttttaactatgaaatgttatcatctccacaaattctttttctgtacatttttttgaatatatcgaaaatatcttttactttcttctttctctgcccttctttgcattttctttttccttgactctttcagtatcgtattctctttttttgttcatgaaacctattttatttcaagagagttaaatatgttgcatggatttagaaaatttataagtagaaacattaacattgactcactgaccttttcttctcattggtaagacactgtaccacattggtacataaatgtttactgagtgaataagttaataaatgatgacaacatataatttagaaattgatttgaaccataatcaaataaatttatttaactactgcaataaataaattactgtttgaagtataagagagaacacaaaaccttatcagttacttgattattctccaatttaaaaaaagatgcttatgaagttaaaaaaaaaagtattagagttactaggtgctttg

SEQ ID NO: 58230 - DNA, 1485 bp, Bovine  19866880739151
actgtgtttatactataacattttaatacacatatggctaactatggacagggaagcctggtgtcctgtagtccatggggttgcaaagagttggtatgactgagtgactgagcaacaacaatggcaaactatgaatttatgaattactaaattaatacctcacaattttacctatcaggcaataatgtttttactaattgaataattttttaaatgtcctagtaaagtcttcatttttatttatcaaattattttgcatttttgtttaaaagtaccttttgcagtttcaatatattattatatatttcatatactatcataccattagcctttggaacatataacacattagacataatatgtgcttaatgaatgctgctgaatcaattattaaaagaaattcaatatttgtttctttttatttactctaatcactagaagtaaagaattacacagtacatgaaattaccacatagaagtcaagcattttggaatttattgaatctcattttataaacttattattttaaaattccacttcgtaacatctttaaattcaacacatgtgaagaaatgtatcatttaaattcaatgaagcaaagataacacagtagcttcccaattcactttaatctccataagcctgggattttttttttttttcttttgctgactctctgaattgttttcttcttcttttatttatttattttctattccattaattctggtggatttaaaatattgttaacctatttagtctcatttctttatataaaaattatgtatatgaagaagttagaaagagtagttatatttcaagctgaaatatacgttttaattcttgaagcattcattaactactaaaatgtttattgctagcattcagacatcacaccctaaaataaaaaatcctgccaagggttctttgtttaactaaggttacaatagatacatcggaaagattagttactatgaaaatctattaactcatgaatgtagataatttaaagccctatttagttttaatttttttttttctgactgccttgcacagaatgcgtaacattcacaaatgagggcatttgtatattatctgtccccaatatcacattccatgtaaaattaagaagttaccacctaaatataactctttgggaagtattaacttggttataaaagtaaacaactcttagttgatcatttcacatatctgttatgtgacattgtatagaatctgtatgtcatagatcattgagttaagatacttgaataaaggtaaaaattttacatgtagtgagcttaatattcctagaaaagaaatttatcttttatcactgatcactttttttgttaaatttgggacagctatgtggaaagcttagcaaaagattttcattcttcaacaaaacaaaacaacaaagaaaacaacaacaaagaaacaaaaaaatcacctgaacttagttaacgaggaaatattccaca

SEQ ID NO: 58231 - DNA, 1812 bp, Bovine  19866880762178
ttgatctgtcatttcaatcagggcctttcaaatgaatgttcatagtattgccgtagtttcctgacaaaactttagcaaaaaatccagaggatgctcaaacatttacttctatacacatgtatgaaacttttcaaataataattcaattcaatatgaatattaaatacacctaactgaaagttcctacaactcaaacatttaaccaaaaagcaaaattgaatgtgaatccaaacatttttttggtggaaaattttctcttttatcaatcattttctaaacacattcaagtaaatgtgtatttgctccaggtgaattctgatccttctgaatcttttagacagtacttctacaatgtctagtaatttgcctctacataataatactcaacaaaagcatttgagcagctaattattatccaatctgaaagttcaaaccttaaagattcctgtactttagtttgttttttgttcatatttgttttatttaatgaaatatatctatggacatcactagaaaatatttaaaatgagtggaagtggaaattaaaatagttctgtaatgatattttcttcctgagaattaatgaaataatgccatatagcactaatattaagtaagttcaaatattgtatcaagggcttatacttcttaaatcaaataaacgttacctgttcaaagtctattaatcttgattacagtgtatgtatagtttagttagtagcaattaaatgactgcttactaaacatttgtaggtgttaattgatccttaggggccattttaatccactctacctctttggtttatttgaccttcttgatttgaatcaggcaataaatgtatatgcttgagaagttctcatacatgtatttctgagttaactgcatgagtgtaggaattcaaaatgacactaaaagagtgcattcatattaacgatgacctaggtttcatttaattatctttttattctcaaaattgtgtgcagaatttccaaggtgaaaattcactattttgacatttgaagtaggtgctctggttatagtcacactgctcagaacaatatgatatgatttaagaaacccttactttttttatgaaaatatttctaaaaatatataaatatacagacaatatattaatatagataaagagaaaactgtttcactaatattttatatttccaaaagtgttaagatttacatggaataaagtaatttcattattttttatgtcatatttaaatttttcattatcactgtgaggtaacctgtgcatcctctgaaattttttaccattaaggacaaaataaaatagtaggattatagtatatacaatacatacttagaacttatagagtttatgatgtcaatataaacaagaaaatagtaacacaaaatttaaatattagcttcaacatagttgcaattaccttttcctgcttacgagacctgaaaattagagccaacacagaatgaactttgtggatgatattttattgtgttgtgtctcatatggacataggctcttggaaatttttataagattttctcacgtcaggtttctatacctccatctttctatctggatgaacatctgccaagcttttatatttgctttcatcttcattgttatcagatctgtaaaaaatctagagtcaaaaggcctgtcttaagaaactaagattccatttgccttattgcaattttgactaggtatataacataaattatagatggtttacaaatgctccttttcccagaagtccatgtgttaagtaacatgtgaacatataagagttgagagcaacatttca

SEQ ID NO: 58232 - DNA, 1709 bp, Bovine  19866880801828
tctgtatgtgtgtatttgtgttttcgatggatgggtaggcatttgaacaatggtgatcagaacactaggcagaggagaaaggaaaatacagggagctggatattttcaaaatctcaatgcccaaatagaactgaagtaattaaataatagagtgttatccttggccacaaaaaccgattaacttatgtgatacagtttaaactgtagcctgggaaaccaaccaggataattattattgcatttctatggaaacactaattttctctccccagaaaacaactttacaagaaaactttaagaattcagtctgtttgtcaactggggattcatgaataattttggatttgtgtaaggactgaactgaactgagggataatgtacaatcatttacctcaaattgaaaattgtgcatattttacctaaatttttatgcatttggaactaaagttgtatactttacttacattcattcttgattctttcttctctatcaaattttattaaatatacaatatgctctatgttcattgcattgctgttagcacaaacaaacacaaaaggggaaaacatacaaaacactaactcaaagttaaacagtagctgaacttgcaaagagcaaaccagcctggaaacatttatagaaaacataattaaatcctatattgtaatttagagagcctaaggtttttgccatgagtctgtagtattgacagagaaatgttcaggaattaaaaattttagaaggtctttcattttaaaaccagcttcttaaaattcaggtggatatccaagcaaaagatctacatgtacccatagaattaatattggacactgtcagaagttctataataacttcattgtaagcttattcatggttgactggaaattattttaattgtggcatgacagtactaccaagttttttttttttattattatcttggaaaaaacacatttaaattaatgtgaaatattggaaattatatcagggtaccactggaggcagagaaataatctagaataaaattgcctattgactctttctggtagatagcataggctaagaagggcacaaaggacttgtgactaggtcaactcctaactcatttcactccagaattataattttaaaataaataaataaattagaggtatagctagacttacatgatatcatgtatcttagcataacttttttcagttaactccagtgtattctaggaaagggtctcagaagggaaaatagtagagagctgtgagaaataaatgttggaattattttttgtttgttttgctacatttatcataagaatatttattcaagtggaacccagaagtctttccaaatagctttttatactgacaggtaattgacttcaactggcagagaaaataactggcaaaattctaggtaaaggaggttgaatgtctgcagtataacctgatcactggtgttatttggaacttctgaactataacagtcttctgcaactcaacaaaatgcagttgaaattaataaggtaccaaagaaatgcatgttcagcagcttaattaacttaaagtggatgaatcaaatcccaaataaagagcagatgctccagtatacctagggatgaatatattatagattctgaaaaatgaccacactttcacatttctaaatgtccaaggaactgaaaatcaaggtagctcaagtatgacaatagttt

SEQ ID NO: 58233 - DNA, 1280 bp, Bovine  19866881149092
ctgagttttccaaatttgctggcatattgagtgcagcactttcacagcatcatctttcaggatttgaaatagctcagttggaattccatcacctccactagatttgtttgtagtgatgctttctgaggcctacttgacttcacattccaggatgtctggctttaggtgagtgatcacaccattgtgattatctttgtcgttaagatcgtttctgtaacctggagttacactcttcattaaaatgtttttgatcatgtctatatactattttctactatttacaccctaaatggcttacttaagtctgtatccttatgcttcacacaactgttatagagtaggtgtccaatagaggcttgttaattttgcttcataaagatctttaaaaaaaataaatctctcattgccgtatgatttaaactgactaaattggtaattttactcttacttaacatgtttttaaaatgtgcttcaattttctaccacctcttgagaatgcaaagcttgagtgtaaattcacagtgcagacagtaaaaagcacagctggtaaaccacagggcaaatttgcaaacccttttgttgcctgatttagttccgttaattactgtttattttgaataattatgctatagtctgtattttaaaaaacgtttttgtctgaacaaattgatagaaatatttatcaatgtctttagctaatgctttaattttccctgaataatcactgtggaatgcaaaatttaaaacactggtctccataataggagttgatatatgcttagccttctctttaattttttttccttatctttgttttgatgaaacaatgaatgttagtggtaaacctgggaattctgattaccatctgtctgatgcacctgctaaggccttatttcaactgatgctgaggtgctattgaacaaaggcattgcttctaacataaaaataaatctaaaaaattctagttataataagttcaaataacttgcctttgccaagtttattttcccctaaacacaaagataaaaagaataaaatctaagggaaaatattatggtctctaaaaccttacactcttcttagaattttatttacacagtatttattgctgcaaggtgcatttctttcccagtgttaatgaacaatgaattaaaagatgaatgctttcttgttagtgactgtagtaggaataggaaaacacctcaatattcaacctgtcattcttattagataacttcccacctcttcccagtctattatcttcttcttaatatggttca

SEQ ID NO: 58234 - DNA, 1081 bp, Bovine  19866881439352
tttctatcaatcagcatattttagtgatatatccatggcattgtacatatcaatagttcattctttttttaaaaaaatttcttaatagcaatctgtttatccagtttcatgctgatgaacatctgggatatgtccagttttagctattttaaataaaacttctgtgagcagttgtgcacaaatatttttttgtgatcactgcactttcatgtataagagacacataaaccaatgttataaggcatatgattttccaaaaatgtgagtggaaagcatcacaaaaatatctccttgtgtcttgaggacaatacaaatatatgagcaaataaatcacaaaaacgtgctgttttcactatggctgatcactactaaacctatttacttgtttgtgatttttattctactataatgatttttattctactaatatcaaccttttcatgatccaacatcacaattattttagtaggagcaaatataataattactgccctatattccctgtacatgctaatcataacacaacaaggaaaatacactcaccatatcaacaatatttcaccttccttcacaaaagaaaatgcactcatatcactacacattctacctctattacttctatacctaaacccaatgacatgggttctactctaatgacatgtcacatgttgggtagcaacttggacttttggagattttttttttttttgcatagtaaatatactgaaattattggaagtatttgtatttaatgacaaaaattttgaagaattttatgttagttctgtttcacactcaggtagttttgatagcttgacttttaaagaatccttttaagatcatgaagcattaacacatttcagaaatactaatgtagacctgaagataatgatctacacacataatgatatacctgtcaagagatgattaataccaagagcaaaattcatgaataaataccatggggaataagcacatttaatttactctatcacacttgagtcatattaactatgcatattacccaaggaatccaaccatacattctgagagagataggggtaatgattccaatgatgag

SEQ ID NO: 58235 - DNA, 1932 bp, Bovine  19866881595113
aggcagaagaggacggggaggcagacgaagaagaggaggcagaagaggaaggcttcttccagaaagtgctcactccgccccttctcttggcttttgagcaggcggctctggctaggtccccagtgctcgaagctgctactgccgtcctgttgcaggcagctgcccccggccgggctgccggccgacggcgacgggtggctgaagagtttccagcggagtcgcaggatgtgcttcacatcgaagtcttttcgcccagagcctgacataattgacgcaaggaaggagaagggacctcagctgatgcaggagtagacgggttggggaggcaggccaacggagccccgggttggaggaggaggcgggaggctccctctgcaccccgggaacagacgggaccgggcggctgcgcgccctgccaggcgacgatcggagcgcgaacagaagagccctgcggctcagctgcggtcaggacctcaggacccgcgtgtggggaactcaacggcctggtgcacaggcaggaactggacgcagaggactgagaatccccgatctccttgcggggtcccgaggtgaccgcggtgagggacagccctgatgccggagacgcgcgagggagggaggtctgcgcactcagagctctcgaggcgaaggcagctggatacacttccctagcatgcacggatggcagagcctcagtcgagaagctgttggctcccctatccttgcagcttagagttcagtgcctggagattgcagagagaaagatccccaagtcgcggaagaagcacacaccccctcagccttctcgatgcacctgcgcccctgtccctgctctctaggaagatgctctgagagctgcgggtatctctgagaaagtccaatgccttctgcaaggcgagaaggggtggttttatctagtcagtttgtaaaagagagagagagaggaaaaaaaaaaaaatccagcaaatacaggagggcaaaaggaaagcccgcgccgtgaagctgtcaaggtcctcacagtacaattttctctctgcctcggcgcctcctccttcccagtaagtgacgcagatgtgcattgaggcctatacggagagatggagggagggagggaaggcttcaatcttctttatgcaagtgagcctgatgctcttattgtccccttgtgtgggtcctgtcacctttttttattctccttcctcactacattactatgtagcaataaaagtaaagcaaacaggcaatatggtttagcatcagtaagcaccaaatgtgaatcatggcagcgtaaacttgggctgccatcgctttgcaggttgcaggttaatggcttgaattatttaataaagcgcatcctttaacctttagccttagtttctctgtaatgagaagaaagaaacaggatgctggcgttaaagtgtgacgatgccaccattctgacaattacattgtgattctgccattaacgcactcaggcagtgctttcaccctgggggccagaggcacacggtagaaatttgaagatgggcatctgagcacaggggacgagttgtgcaaaatcagtgcatttaatgagttgccgtagaatgaaagctgttctccgtgtaaaccaagaagtggaataaaatgataaagtgtaatttcaaggcataaccttctagtacaaaaatcgtgatatgaaatgtatggaagaggttagggggaaaaaactgaagatacccaaaggctactattctgcagaaatctcttgtttgaagaagaaaagatgtgtttttccttatatttagaatgagaagatttatgatcctttctagctatgaccacgaagaaatatttcagcttttcctttaatgagcctttaaaatagaaccgaaatcatttttgcctacgtcaaacagatcgagagaagttgcagtttccctaactcaacaa

SEQ ID NO: 58236 - DNA, 1105 bp, Bovine  19866881704448
aaaattattgaactctataattgttgaagcttatctcagttaattcttccaaggaagtttacctattcactcttaaatgtttaatgagattataaaaatagctacacacggttctttcaaacctaaaagactctccagactcaaggaaattgtttaaatcattttaaagtacacttaccccatctctactggatgcagaactagacagctaataattaactgtgacttcttgagacagttgaacctccttagtttctctgaggctacccaaacttcagaattcaagaaaatattatcattggatgaccctttaagaatctcactgctcattcattctttctccttttctgagatgtgtttatttttagccttctacaaaggaaaaccttagagatcagctagttggctagctaaatagacacctcttatctcttagatacagagatacctcttagtctttcttttctgtatcattgtttacttgatctctactgttgttagtcatttcttacattgtgtatatattttaaaaaaggtacacactttctattatgactaacccccaatattgtgcaatattatgatgcaaattattagctcatctagcacatttctataacaactggaaatttatcaaccttgaggtaggtatggatatattaatatgagcaaaggccagagtggcagaggtaaccaaaaggcagctttgtatctggtctgccctctacaaagcagagccaaatctgggtcattatattcagcaggaagctttgaaacaccttccaacctttctgttgcacaacgataagtgtcttttgacctagtttttcgctcgaggaatgcaaggctgccaagaagccatagaggctgtaagtgttggatctatgtctttatgtttgtagaaggattcctaaaatgattcttccctttctaggaaacagtagtgtgattacattatttggctcttgcttggaaagtcagcaatcttttatatcattatatcaagctgcttgcaatttgaaatcaaacaagatggtcttaaagccccctcagcttcactaaaatttaaacagcctacttcttgactcgaagccctttgatctcg

SEQ ID NO: 58237 - DNA, 1094 bp, Bovine  19866880367850
taaaacttagttatttaatgtttctattttaaaacaccaacacagatgtttggcctctctgccttgaaactctatgcttttgtaaaaaaatgttcagaatgttatgttaaatccccacaagtattgtaacaagaatataaatattaataaatcccaagttggtaaataagtaattcattaaaataaaagtatcacatatgaactcatttataaccaaaagagcctctctataatagaacaaagacaagatctaattttatgaaatactgaattacaaaacattaagagctcattagtgcaggtgcatttggaagcagcagcaacaacaaacccaagcttcccccgacagaatatgattattccaatgaaaaggagtatttttctagcccaagggtacctggctattctgtaatcaattactaattggtttatgctaaaattaagtttagataaagccttctaatttagttcttcagttaattcagttcagtcgctcagtcatgtccaactctttacaaccccatgaacccagttaattacagcacataaaatacaaatggaaaaaagcctcccaaaatagttttttcagttttatcaccaggtatagggaaccaggatattatctaagtttaggacttcttgtaaccttgatctcttaatcaaattcttttgttctctgcaatgacagtaccaaaggaactgaaacaaaggaacagaagtagcaaaagacttgtgatttttatggcaaatgaattatgtcttactcttctcataaagtttcaataattccttcctacaaaaatgagaatactccttctgttataaaaaacccttgttgtatgttttagataatttaattatgcttatgtgtatgcgtgtgtttcaagcagagaaaagtttaaatggaagtcaaaactcttctaatctatatatgtcagagataaccattactaaggatttagtgtaaatatccttctagattttcattataatatacatacctacatacatataattttaggtcaaaatagaattatatctaccttatgtacccctggtggctcagatgggaaagaatctgcctgcagtgagag

SEQ ID NO: 58238 - DNA, 1486 bp, Bovine  19866880657590
ttcataaggcaaatacatgtcattgcttctatgtcctctattctgtaaaagtgtgtcttggagccccaggttagatatgagtaagactatagatataccagctcttcataagctgtaaagtactatgcaggtgtgggttactgctattgtttaactcttcagcctatgggaaacccctcttaaaaatcccatggacacctgtatacccatttaatgataatgtttgactcccacatttacaaggaaatctagctctacttttttgtgacttgggtcattctgtctttttcaaccagagagcagaagaaaagaaacatagcggagtattagaaaatgctactggcacgtttgaccagagcatttacaggtatttcaggtcaataatttgttgtaactggcgacttgaaggtgatagagccagagataagtatcaataaatgcagtgaaatgttagcagtgagaagtgtgtatctcagtgctttgctgctgtctccttggatttgttacatggctccattcaaggcctgttggagctcagaaaaaagaaagactaagtttcgtgttcttgttatattttttaaatgtatttccacttttactgacataggtatttaatagatgaactattaaaacatcttccatgttttttgaagcttgtgtgaagtgacagattttgattttgttttggtttggtttggtttttaggataaacttcctgatgaccaatatcaggagaagacagcgatggacctggcagctgagcagctacgcctttggcccactctgagcaaatcgactcagcaggagctggtgcagcgtgaggaaagcactgtctttagtcaggccattcactttgcaaacctcatggtcaatctgctggttccgctggattcaagtaaaaacaagctcctaagagcgtcagccccaggagattgggagagtgggagcaacagcatcgtcacaaacaggtaccgaaatgtgggcacacacagacaccctgtccttcttggtttagcaaaacatacgaagtatttggggtaaatggtgctatacacatttcaaaaattaaccattgtcctcaccttcagacttgctcagcttttctctattaaagacgttgactacatccaactattcttaaatacctcccataccctcttctcttttatgacctctgactttttaaatgtctcgcgcattactgatctagccctttcagttactttctgccacagcaacttgcagaaagcactgtgggaaagtactaatggactctgattaaagtgattatttgtttcttggcccgccttttcctcatcttaccccttgcatttgcctgtaatcgtgtccccaaccattccttgttctaacactttccctagtggctcagatggtaaagaaactgcctacagtgcaggagacccaggtttgatccctgggtcacaaagatcccctggagaagggaatggcttcccactccagtatc

SEQ ID NO: 58239 - DNA, 715 bp, Bovine  19866880856962
cctgatgcaaagagctgactcattggaagggaccctgattctgggaaagactgaagggaggagaatgggacgacggaggatgagatgattggatggcatcaccaactcaatgggcatgagtttgagcaggctttgggagttggtgatagataaggaggcttggtgtgttatagtccatggggttgcaaagagtcagacacaactgagagactgaactgaactgaactgagcgactatagcactatttaagaagtccaaaattagccactacatttggggaaaatcttattcacagagcaagtgaggatgtgatgaaacagtgagcccttgtttattattgcttagccacctggagtggaattttgccaggctttcagtccaaataaagcagccgaggtttccatggtgtgggtttaaattgagcggattggtgccttgttttgaaacttggttgaaaaaaaacgccagtagtgactgaagagtgttaacagaaaacttaaagattgtcatcagttatgtaatgaatatatgaaatgatgattaaacatttgcaatatgtgcttttatacatacacacacacacacacacggtctgatttgatcctcatgctaatcctatgatgcataactggaattcttatccccatttaactcaggaggaaatagagaacatagctaataaggggtagaataggtttgaacttaagctatttca

SEQ ID NO: 58240 - DNA, 834 bp, Bovine  19866880900745
ctggcatgctgcgattcatggggtcgcaaagagtcggacacgattgagcgactgaactgaactgatagcttattaacaatgttgtgatagtttcaggtgtacagcaaaaggactcagccatacagcaataatatgttcacactggaaattttgctaagtgagatcttactttaagtgtctttgtctcgtgccaaaaaataagggggtgaagggaaacttttggaggtgatgtatttgtggcacagactgtggttttaccaatgcatgctgctgttgctgcttagtcacttcagtcgggtccgactcagtgcgagtccatggacggtagtccccccaggcttctctgtccatgaaattctccaggcaagaatactggagtgggtagccattcttttctccagggagtctttctgacccagggatggagcccccatctcctgtattgcagacagattctttacccttggaatcctgagggaagccctgtatgtcaatcatacctcaattaaatgtttcatagctcttttcgtgcctagcgcagccatggctcagggtcccaagaagcacctgaaacccgtagcagctccaaaacattggatgctggataaactgactggtgtgtttgcccctcgtccatctaccggcccccacaagctaagggaatgtctccccctaatcattttcctaaggaatagacttaagtatgccctaactggagatgaagtaaagaagatgtgcatgcagcgtttcattaagatcgatggcaaagtccgcacagatataacctaccctgctggttttatggatgtcattagcattgataagactagagag

SEQ ID NO: 58241 - DNA, 603 bp, Bovine  19866881055759
ttcggttgtgcaggtttaatgccgcgtgagcgattggcatctagctccagagacaccgtctcaagggagcagaagtctttaataatgctttggctgagatagatacttcagaatcaaagataacacagagaggaactaagtgcatcccattcagaatgatgttttgatactaactgaattcttcctaatatttaaaatggtttcaaccatccacgtgctggcagaccccttggttttacgtttgtagttactgtacagaacatctctggtgtgtgtgaatgcttgtcctaatcagacctttgccttaataaacagcaatatgatcattcctagaaattacacatgaaaaaagtttttaaaatgtatttttgtgatgtgctatgttgagagggaacaaaatatttataattttcaaacattcttacctaaatattgtacaatgtaatatgctgaactttcttaattttttggctaattttctaagatatgttaaaactgttttgtatggttcttgtttgttttagtcaaatggagtcgataagaaaataaaaaaatatgggaagagcatacattttaagctgtctgatttaacggaacaggagg

SEQ ID NO: 58242 - DNA, 1513 bp, Bovine  19866881154578
ctggccaaatttaaaaacacttagttgaaaatctatgcttgagaaatgaataaagattcaaagtattcatgttgctcctcaaattgttttcgtttagattctcactagttgagagctcttttacctcagaagggcacaatttaaaacaaaacaaaatcctgtgtttctaaaaacaaaaggataaaagtgcagagacagtaagcttatttcaagatatttccagcactgacatgtaactcacactgcaaccataattataaagtaaaatcataatagaggttgcaaaaatatcactagattttactataattaagaaaacatttactaataacaataaaaggaataattttcaggaacttttttattgaagttgatttataacattctgctagtttcaggtgtacagcccagtaatccaggtacatatacatgtggaggggggtctaatatattctttttcagatttttttcccttttagattactacaaaatactgagtatagttccctgtgctgcacagaaggtccttgttagtcatctgtcttcaatatagtagtatatagatgttcattccaaactcctaatttatcctttcctccccccttcccctttggcaaccataaatttgtttccaatgtggaaatttatttcctatagatattatttcattcttctttatggccaggtaatattccattgtgatatatatatatcttctttatccattcactgtaaatagtgctgcagtgaagagatgcatgtatctcttttaattatagctttctccagatatatgcccaggtgtgagattgttggatatggcaattctatttttagttttttaaggaacctctatactgttccgcaaagtggctgcaccaatttacattcccaccaccagtgtaggagagttcaattttaaggtacatttagatttctagaaggaatattaaaaaaattagtaaaaatggttaccttgagggtagataactagtgtgggccagggtatagatgatacttacttttcactctcctaaatgctcttttgaaaattatgaattttatatcatgtatatataggaggtattcaaaaaggttttttttggtttatattttttaaatgataggcttcatcttttcatcttcttagaattgcatgtattcgaattccaagaatccccactaactaacactggagatttagtatctttctgcaagaccatcgaaattctaaatcatctgaagatatttttaaaatatcagtgcagtgcttccctggcggtccagtggttaagagtcggccctgcaatgcaggggatactggttccatccctgatctgggaagatcccacacactgcacagcaactaagcctgttcgccacaaatactgagtctgcactctatagcccaacagctgcaactacgaaagcctgggtacccccagaacccatgttctgcaagaagaaaagccactgcaatgagaagcctgtgcaccacaagaagagggtagcc

SEQ ID NO: 58243 - DNA, 975 bp, Bovine  19866881254509
aaaaatcttttggtcttggtctgcaatcaaactagttttccccccactgttacttgtttcttatatatccttgtagagttcataaatttttttcttcctttttcttttacacagaagcacactgtatgtagtcttagatacattgttttgttttgtttttttttttcacttaagttacctgggagatcttttcatatcactacacagtaagttcctcattgttcttaatgttttatggatataccataggttaacctgtgattgggagtttttacttgggtaaagtcccaaataattttaaaatctgaaagactattgggccttataagaggactgtattctttatttttctatatttctacagtgtgttgcagtttttaagcactttatattcttgaagtagatcctcacaaaaactctataggtgttacaaggtaaataaagaaaggaaatgtctatttaggattttttgactgtggtgcaagattcaataaaagctccaccgtgcccttttcatgtgctgtactactggcaaatagagagtttacttgagaaacacagcctgctttgtagggctgataaaagtcttcattacttcatttataaccatttgtgtacttccttcactttacttacttccttaaaaccagcagagcatgtagaaaaggatctccacataaatgaagctttgagaaacaaaacaaatgtagacagaagatatgcaaatgttatttttatagattaattttttaaattgtaaaaaatcctaactgaaatatatgtatgcagaaaaaagtgacttgcttaatggaattggaagtattcattgaggtgaatgtggctcctttaagcaattgaatgggtagggctgagaaaaacagggaagattttaacctgggatttaacatctaataagattctgtgttagaggaagtaccgctttagctgtagaatttgacctgtttagaatgcaca

SEQ ID NO: 58244 - DNA, 992 bp, Bovine  19866881426175
tctggttgtgtgaaatgtaagccttctaatctgtaggtccagacctgctctggccacatgagagtactgatctcttagggatttcttcattattccaactgccaaaggactctaaactagaatgctgtggtctcagagctctgcctcttccgtagaagagccacaggcatttcctccagaaacagatgccaagagacactgtctaaaggctctatcaaacacatgggtctaccaattaggattctagtcaaactgaattttttctccctagatttataagtatctctggataggaagacacttccttaggcaaaatcccctatctaggaccaccagtggttgttaaacaaggacacaattcctactccagccactataagttaacttccctatcgcatctaaaaaagacagtcctgaattccctggcagtccagtggttaggactccacactttcattgctgagggcccgggttcaactctggtcaaggaactaacatcccacaagccacacagtgcagccaaaaaggaaaagaaattgagaaaagatagtcttaaagaaacccaacttcaacatacattattttccttaccaaccaaccatctatcacaagtaaacctttctgagccctcaatttattgagcccttttttatttttaaaaattttaaattgtattgcatgatatccaaagtcccttcaacctctaacctcttgtcatttagtattgttatttttttgttatttcagtaattggcggggaagctgcctagaaatccttaatgtttctgatatgtttaatttcttctgtctccagttggttaaagtggcatttgatgaagaagtgagcccagaagtcgtagaggtcttcaggaagcagctgatgaagctccgttaccctcagtccgtttttaccacctttgcctttgctgctggacaaactgccccacagatcatttcacccaagcagaaggagaagaacacttcctttcggt

SEQ ID NO: 58245 - DNA, 976 bp, Bovine  19866881613740
tactttgagatgattatttagtgcttgcatattggttcagcaaaatgagtattctcatatgttgaaatccaacagagtaaacggatcacatcagttagttagtgtatgatcatgtctgtgtgcagtttgcttttgttctttatacaaatacactgttaagggttccagattttgattactttattctaagttagcatagactcaggggcattttatccatacccttctccttgagggtgtcaagattctttaaagatacacttggaactataaaagaatatttcctaaattgaccttttaatttagttatttagtgtaataacatagatacatacttaagtttaaaagttttttttttttgttatgcaataatacttattaaattctttttctagattgaatacctgcttaagaaacttacagaagctatgggagtaagttggcaacaagaacaatttgaaaattataaaatcaactttgatgacagtaaagatggcctttctgcgtgggaactgattgagcttgttggaaatggacagttcagcaaaggcatggatcggcagactgtgtccatggcaattaacgaggttttcaatgagctaatattagatgtgctgaaacaggtaagcatcctgtaacagtgtttctcctcacctttagaatttgacatgtttgaaataaaagatttttatcacaaagatgagcctaagtcacttatattttcacactaatttagaacaggaataacatttcttattttctcagtcttgtgttgggcttacattataaataattacagttaaacactgggaagttactattttgaaagaactgtttatatgatcacatttctgaacgtagtactttcgtgttatgccttcatctatactcattcatctgaaagatcccatggcacgctcttcagtgaagaaaacaggttgggaacagcaggtgtcttgtaatccctttcatgcaa

SEQ ID NO: 58246 - DNA, 1504 bp, Bovine  19866880473957
gtttcacagtagtctggacccatcaccccaaaccttctggaattttctattcacctccatgttctggggcccctagggaatatttttggctgtgatcttcaccgagagaaaacaaacttgagaggtatatgtcacagccaatgagaaaggccctggatatcacagaccattaatgcttttacaaacaaaaccccaaagaaccctaaccccatttgatggaaatttggatgaaatcttgcctcacagactgttcaatggcaccccactccagtactcttgcctggaaaatcccatggatggaggagcctggtaggttgcagtccatggggtctcgaagagtcagacacgactgagcgacttcactttcacttttcacttccatgcactggagaaggaaatggcaacccactccagtgttcttgccagggacggggaagcctggtgggctgccgtctatggggtcgcacagagtcggacatgactgaagcaacttagcagcagcagcagcagcacagactgttcagtcccaactctggctgagaattaccagtctctgtacctttcactaagcttcacttcctgttgtctgtgctttgaaagaacagactttccccacctgttttccaaatatgaaacataataacattaaatgttctttttaaaagtacacatacccctcccttcaaaccaaggcttgctgagcccagcaggtctgaaccagagtgagcttaaagccttaccactgagttacatgggtcactgcaaagccatgctgaagaacttgcgcccaacctccaaggctagagaaaagacccaagttgaaccacctatgggtttatacccaaattacacaagaattgcacacacaagactgagtgcaggaattggtgttaatatagcaaagcacctctggcctcgtttagaagctagacttaggtcctgactcttgtagtaggtcttctgcacaagttttcctatcccatggctttctgctcaacagcgcatacatacttgagttcctactgcctcacagctaatccacaccccgtgtgcagagattcagggttaagagggctggattacaacagctctagcaagtgatcacccacttgtttagcaccagtcaggaacagaggaggggaaaaaacggggggaggggacttctctggggatgcagtggttgagacaggaacataggttcgatccatggttggggaactaagatcccacatgcctgagctgtgcagccataaaaagaaaaaaaggcctcagttagctctgaataaggaagtgcatttctacatgtccctcctctccctcaataatcttgtttactcaaactcccccagttcccacagcctcaagtagccatgtttcaaggacttggcttgtggggactgtgataagcgctaccagcagaatgggaggctgggccactctcacgcaactcttacctccgcttttgttgctctgtttctaggaggagaggaacgcacagtagcaa

SEQ ID NO: 58247 - DNA, 1689 bp, Bovine  19866880625800
tgtaaagaattaagttattgtgcacctgtatattgtacagctttgttacccttttaaaagatggtctgaaagactactcagtggcatagaaaaatgtttttaatatgatgagttggggtggggagcaagttataagattgaatcatggtccatttcgatacaattatgttcgggcatctctggttgtgcaggtgattttcatctcttttcctgtattttcagaatttcttacagtgaatgcatattttacgtgagcacagaatctgagcacagagtcgttgaactaaggagagatcagggaaaaataacagtaagaccaaaagttggcatgggtgctgtgacgctcatactccaaatgtattgccagccttctagtagagagtagggaggcacagggtattttaagagcaatatgtttatactttctgatctagaagaattttttttttttggtgtgaatttcgccaataatccaggaaaaataaaagttaagctttgtagatttatttctactagtactaaacaaacacagtcctaaataaggtaaagctaaatgtccactagttgagtagtgattgagtgagtatgataccgggaatattatgcagccagtaaaaatcacgtttaggtagcctctgtagttaaatggtaaagtgtaattgcgctaaaattatgtctgcatataaaacagaagggaaggactacatacatatatatgtacagttgacttattgccgagttacgattgagagtattcacaaagactaagctgtgttactagtacaatgcgtgtacgataaagtggcaagtatgtgaagtatggattagtaagtttgggattgtccagatttgaaattccagctgtgaggatgctctcatttgcaaatgcttgggttggtgattgcttttcctgtgggctggtgtgttgcaagctagtgcttaccttccactgtggttcccccacccatgtgacttgcatcccgcctgaaggcagaggtggacatgggaggtcactccaagtggatggggtgggttggtcaggagtagagcttggaggagccccttgtcctgtccctgctcacatcacatataaagtgactccttcctttgtccagtcaaagggcctttcttctttcactttttacccctagctgtgctcctgaaacggatctttgctcaaatgagtattttgtaattctcacccatgtagggaaggatcgagcagagcattctgatcagggcagaaagcaggagggtcccacagagaactccagtggaagcagatgtatatagctgcctttttcttgtgagtcatgagattagcgctggaagggtccattttactgatagagccactgaggcccggggacaccttgtccagatcctgttattccttgggtcttaaaacccccgttgttcctcatgttcctaatccagacctctgtggtgtctcagcaccttctttctctctttctgtgagtcttctgcttggctctgtcatattcctctttttttccttttctagaaagaaaagtcaaaatcgaacagttccgcagcccgggaacctaatggctttccctctgatgcctcagccaattcctctctccttcttgaattccagggtgagttgcatccgcatgtctttcttgcaggaaaagaatatttagagacccatcagtaatccgaaga

SEQ ID NO: 58248 - DNA, 2164 bp, Bovine  19866880669141
cttttagatgtggggagacagatttcaccttctgagagtccatgaaatgctggtctttaaagtcgaatgcccacaaatcagagcagcccctttgtgcctcagttttgagtataaaataagaacagttgatcttgccaagctttaagttttctctaaggagcaaaattagttgaacccaaatttaaaatctgaattttactcttctgtggtgctgccagtagagggcagtatttggacgctatgaagaaggaagtttggactttatattttggaatcctgcagagcgaagcatgtgggactgtttaatgctggagcttttaggagcccctatgttatgttctaaaagcccctcagtgattgacttctcagtgtctaaagttgtggtgtgacaggttaggatatactttccaaggatgaaaagacctctctaaaatcatttagttgctctaaaaactgaaggttggagggggaaacgatcatttaaattggtttggtgtattttcaaatgtaagggaaccaaaccataatagatatgaatcgggactcatttgtctggtcggggcagaggaaggagggcagaaaggtgtactttgttgggggttcatttttcagtgggagagggggcagtgaaatctcctgctggtgcttgagtttctgctgccccctagtgaatgttaaccatctattctagccctgagtcgatttggggatgtaagttagaagccccaaaccctaaatcacctgtggtctagttaatactgcatttgctttcagaagatgactgtgctctttaaaacggggtcgcactgcactggaacgttttgtcttctgtcgggttgactgaggctggcagctccttcttaacaagtcactgactgtggccgtgctcccgatgtgctgtacatgttatctccttgcaggtgaggatgacaagctgatcttatgtgacgagtgtaataaagccttccacctgttctgtctgaggccggccctctatgaagtaccagatggtgagtggcagtgcccagcttgccagcctgctactgccaggcgcaactcccgtggcaggtgagaatttcttcttcttttaaaaacaaataaattgataagtagctgttgtgcttgagcttcagttatttaaaccgaatgagctggggagctttaagttcatcttttgtgtgccgacccccttatttaaggaactgcagtgggtcggggagtggtgctcaaagggctctgatttaattttctcattgtggacatttctagttttcattaccagccatgttttatattttcttggtcatcccttcttttcaaataacatatctccctctgtcttttatttccactttgcccacttcttaatttctgatgacttctgcagccacctgctgctaaaagtcatgaaacttattactttccttacctgtacctactctcttccttccttggcgtggttagaatttgggtgtcagcttggacatcttcccctcccctgtctctgtattgccaaatgttatccattcagtgtctagatgtctgcaagtcagcctcctgctgtcataaggccctcctgcatcgctcatccggcttcctccagtggcttctcaactcgacctcatatcttcctccctcttctctttccagctttgtggtgataccagaatggtttacaaaggacagagatttgcttacatcactatcctcttgaaacaccgtggtcttcccactgcctctagaatgaagtccctggactaacttttgagactgttcttacacagcactagcttacgattttatgaactcttgttcccttcttgtgtgcttgttacaggctgtttattgggcatccttgcctctggtgttttcttcccagagggcctattccctggccccagaactcctgcctggctaaactgccttccgcctacctaaagttgcactgctttctggaagcatgcttattacatccttaggattatttctcctctgtgtaacagcttggcttctgatgtctataaagtggaatactggtgcatctcgccttttttgtcagtttctccccagctcgctgtcttccttgggattgttcctgccctgagaggagaggtggacgctgtgcccttcaccctcaccaagtgaggccggccacagggcctca

SEQ ID NO: 58249 - DNA, 1698 bp, Bovine  19866880754962
gcggaaccgcggctgccctcccgtgcccgccctgccccgtaccagccggagacaccgggaccggggcaggtgaaggacagaaggtgtcaggaccttccaggacccgacccacctttccccacgagctggcctgaacctctcctttgtggggaatggccacctccacacatcacttcatcctctctcaaagcaaacctactttttttcatcactgcctttgctcaagtcagtctctcctcttcctagctcatcatagcccttctcaatctcagccttggggcttccctgctagtccgatggttaaggatctgcctgccagtgcaggcggcatgggttcaatctccgatccaggaagatgccatatacctcggagcaactaagcccttgcgctacaattgtggagcttgcacagctagagttcatgctctgtaacaagagaagccaccaccatgagaagcctgcacaccacgactgggagtagccccctctcactgcaactggagaaagcccgcgcagcaacgaagatccagcatagccaaggataaataaataagtaaatatgaatcttaaaaaaaaaagcacagccttcctaagtgtgcctcacacttcataccaccttgggggcctttgcacacatgaggcttgatgccttatctctaaattccttctctgcactgatctgctggcaaactcctactcaaccatcaaaacccatcccataagtcccctccttgagagtcattcctgcctccctaaggtaggagaggggttgccttcagctcctgcaacccccaaccccatcctggtcctcttgtttcacaatactcagcactcttgcccacctcctctttctttgatgggctgtctaaggcagaggcctcatgcacgccttctctgggtccctgacctccatcttaggctaatgaggactcggaatctccaagttcaagactagaggctccctccttttataaagaggccagaaggatcaggcctccagcataatccacctcctatacatacccacattctctctgtcattccctgtaacccagtcctgggccagagaccaaagagtgtcctggccatcacactttatcctgatcacagcaagtcatgtgaatgacaagagccccttaaagaggaggaaactgaggctaaaggttggggggcacacacttacccaaaccatactccaaccagcccaggccggtacccgggaggacacgcgggtggggaaaggtcagtgagtgcaagggcagaggctgtaccagctgcctgatcaggactgaagacactcgtgggcagggtcataccagttgtccccatgggggcagggagatgaccagctgagtgccgggggcaggacacagaaccggggcgtcggctccgtgacaaggctggtgtccaccggcggcctgcacagacaggatggcagctgcctgcccacggcgcccgccacccggcactgactgtccttggctgtggacacagcccagggacccacgtctgcagacaggactgggtgtcttagcagagcctcgcttctgcagacagctgagacccctcctcacagccctcccacaggaatgcgtgacttgggatggagactgtgtcatccaagaaacattccatgttttccttggtgtgtgctctgggaacgtggcaagaacggctgcccacacggccgtccacata

SEQ ID NO: 58250 - DNA, 1981 bp, Bovine  19866880819653
cccagatgctgtccaaggctttgagtacatccagcttctctctctagctggggtgtaatcactgattgctcagggatcttttttattcctttcttaggtgtttatgaatttcctccctcttctctgctctccatacttaagagaagctgaagcctttgggctacagaattaagaagatcgagccatgttgcttggccagcctcagggaaagaatatcctaacagatttttgaaagtgttttctggaaagtcagagcagctcccgagaggctcaggtagaagtaaaggctagtaataagctcctgtagttgaggttctagggttcctttagtcctggttcagagagtgtcggccagagtgagccctggagctgcaagctccacagagctcagtgccgaggctccggggtcctctggggtcaggggttcccttgttccaaaacagccttcctgtgtccggccatactggtcagttgccaggaaaccctaggagcagatcatcatccctcatagtgtgtgaccagattcagacaagaatctgcttgatcctgttcttccgaaagggattaaggagaaactcaaatccactgtagagtctataaaggtatttcatgcctccaattagacgcgtctgagtcctgaataaataggaacttgcttcaatgtatttttgtgattttgtatgttgtcagttctgactgactttccctgcatctccacttcttttactcctcccaacagaggtgtgttttcctgggagtaactgggcatccatcctcttgttggatgagggttgtgccattttccaggcagactattaggtagtctcctgatctttaggaaatctgtgaaatgctttttcctccagctcaggagatctctgacgtcatccctttgttgtgtggactataaatactccacatgggttggcaccttttgacgggccccttcctgggcagtgcttccgctggtggtttcttcggccccttcgccctcttcctagcccctttcggcagccattgttgttgctgttgttcagttgccaagtcatgcccgactcttcgtgaccccatggactgcccacggcagccttccgtgtctctcaccatctcccagagtttgcccaagttcattcatgtccatcaagtcagtgtgatgccatccagccatctcatcctctgtcgccgtcttcttctgctttcagtctttcccaacatcagggtcttttccagtgagtcggttgttgtcatcaggtggccagagtattggagctttagcatcagttctttctaagagtattcaggggttgatttcctttaagactgactggtttgatcttcttgctttccaaggaactctcaagagtcctgacagccataacaggccccgaaccccattgccaactgaggtttacttctgggctcttagtgaatgaggtatcaaagaagactagttaaattcaggagataaactacgttcctttttctaatcttcaaatcagtgatttattgaagtgcccttacctttccgtatgggggctgaaaaacgggaaatctggattctcagacttagcttgttttctgcgacatcagccaagtcattgaagccctctgggctgcagtcttgccatctgtacaatgtagcgatcagatctttaagatctctctgtacctccttcgttcccgtcagatgttggctcagtctgtttttaatttcttggattcatgattacctaattttgaataagccatgtctctaggcctgtgtaacccagaacctgacttagataaataaggatacaggcacatagtgaaagaagcgaacatcagtagcaaagaattaatgtgaagtcacctgggaggagatgtggagagaggatggactctgggagcacaacatggaaccaagaggacaggctgggagccgggggacgagtgggagctttagctgggaaggctctggtgggcttcacggagccacgca

SEQ ID NO: 58251 - DNA, 1374 bp, Bovine  19866881004205
gccaggaacaccagcgggaaggccagcagcagcccctgcgggagatgggggggtagggtgacagcggcaggcaggaaacaggcccttttgggggtgtcctgcccaggaagctgagtcagggcccaggagaaggggcccagtctcttgccaggggcccctatccctttcatctgccctctacaccgccaccagttctcctaaaactcacactgaccgccaagtccagcccctccccagaccggctgcacacgctggacaccgcttcctttttcatcctcacgtcctgtccctccctcttgaatgaactcatttgattcccctaacaagcctccctggcatgtaccctcggtaccacacagggacatcagaggtcactcggctggtgtggggctcaggacacgaacgcgggtctcccttatgctaaatctgtttctaatgcccatgtctgccgcctggggggcctcgggaagctggagggcaggtctgagaggttgtgtgtccagggacccagctcaggctggggtcacaccagaccgagaaggcaggcaggacactcacggaactgggctttggcggcggccttagcagcagacttggctgcagctgggacccctgctcctgtgggggagaggatgaggtttaaggacggcacccatggaggattcagagcaccctcactcaggcccacttattcacacggcttacctatgacaccaccggggcccaggccaatgccgggagccacgccgacaccgggaaccacaccgacgccaggaaccacgccaacgccgggagccacgccgactccagggcctaatcctgcaaaagcgagcagagccagtccttaaccgaatcctaaccaaggaggacagaagctgacggaaagagcagcgggctggggggtcaggaaccctggatccttgctccagctgggcacagacttgctgtgtgaccttgggcaagttactttctcttgatgggcctcagcttcttcatccctaataagaggtctgtgcaagatcaggagctcaacttttggagttccagggacccctttgagactctgagggtgatacaggcagactcatgcagcagctaaacaactgcaccaccgtgtagtaaagggagtttggcaagacaggcaggcctggcttcaaagctcagctcagccaccatttagctacgtgagtatgggcaagatacttaagctcctggagactcagtttccacatctgcaaaatgggtgcaacagaaccgatctcataaggctggtgtaaggattacctcagcaaacgctgaaagtgttagtagctcagtcatgcctgactctttgtgaccccatggactgtagcccaccaggctcctttggccatg

SEQ ID NO: 58252 - DNA, 1302 bp, Bovine  19866881033077
ctaagtcccctgtagcggaagtctggaatcctaacaactggatggcaagggaagtccctacagtttcagcttctggctggtcttttccggcctgtcctgttggttcctaaacctcggaacttcccaaatccactgtcttttattatttcccttccctccatcaccttgggggaggggcaagtgggaagtgagggcttaatgggtacgggtttctgcttgaggcaatgaaaacatttggagctgtatagtggtaatgcttgtgcattgctgtgaatgcacttggtgccactgaactgttctttaaaatggttaaaatggtaaattttatggttgtgtattttaccataataaaaaattaaaagaaaaacttaaagagtcagccacctaaggacctggagctgtgggaaacacatcccatgtacatagggttgtattctgtgtacaccggggcagaagtataactccaaggacatgacaacctcaaacagagtctccaaatcattttcactgaagtcactctgtgggagtcaagacaactggcagggcccagcccacagtgacttcacaagcactcagccaccatcaccaccagcccctgcccccacaaccctcaagaatgacacactcagctgccaacaagacatatttcaaatagtttaattttaaaaatatcctattcagtgctaaaatatgtcttcactcaccgttgtccatttccattttcttaaacttttttgaaacaaaaaataaaatcacaaggttcgatgaaacatgcagatttcgaagaaaagggaactttctagaaagtctgggctgaaggagtactgtggggatgagtactgtcagaacctcaaattctcgctggggcagagtctgcggcaggagagctggggaccatggcaggaggcagggggatactggaatgaaatgtccaggtggaaacagctgcgagtatgtgcgtgtttgtgtgtgttgggggaaaagggtggctacagtggggggacaaaggactgtcagcagccagagagcccacgagaggcaggacggcctcaggaatgggtccaagtgccaggatagcatgaagtctaggtgggacttttctgccgtcgtatggagttaagcccttcccttccctccagagtccactcaggcattctccaacagcagcctacagggtccctagccctatgggcaagtccatgaatctacagtctccgttcaagttcaagtaagccctcagcacgctcttctctgggagggtgccttccccctctctttcctcttgcagaagcaccagcagct

SEQ ID NO: 58253 - DNA, 1422 bp, Bovine  19866881128611
tcctcctttctaccagggttacccctactcggcctcatggacagctccaatttcaccccaagaagcctttcccgatccccacctggtccgtgctgccccttctttctgacgtatctgccagtggcacttgtcacctgaactgaacttgcctcccctcctggctggggctaggtctaaagtccccgtgccgggctggcccagaactgctgggagagcggtgcggaccagcctcgccgtgacacacacgctcagactcccatcttggggttgctgaagccctgttaggtactcggctctctgagccaggaaagtgactcgcccagggtcactcagcttaggtgatggcacggcccctggaactgagctgccctgaccccctgtggccatttgctgcaccgggacctgacctacaccactcacggaccaggaccgtggtcttagatggaggttcggaagcaggttcacccagttcccgggccccagataggctcaaggggaaaaacactgtaagaagaaaaagaaagacttgcctggagccagtggcccggacaccacctgccagaacaaggggatggcatacaggatcttaggacacggccagtcctgcatacaaggtgaccgtgctctcactcgaacccagcgcccctctggccagtggctcatctgccctgtgggactgcgggttcccaacgcggttctcccgggagaaaccaggcaggggctagatctcagagctgatgctgaacacactccatcccaccagacagacgtgggaggcgccccaaacaggccagtgttgcttgagcggagcggcaatgaggtgacctctgactccttgccaggaggccacttagcggcagccgccggcacaccggagacacccaatccatcagcaccggccatgtgatgggccggcacccagccacggccgtgaggggagccattggcgggggggccagacgctgctcggggccctgcctcagagctgggagggggccgaggtggccagcccaagggagccaccttgctcggtgacaggctcagggtgctcaaagccagcttgagccccactccgctcgccatttcccaactgggcatggccgcaggcgggacccctcactactgacctttctgttccttctcctggaaatggcctaggttgtactttagaatccctgaggagccgtggaaaaattccagggccaagtggaatccttcctcgcagattctatcggtctagtgatggggtccaggtgtcaggatgtttaaaaaactttccaagttttcattctaatatgaaacgcacattgtgaaccactgggaaagacgctggggactccccagtcccgcctgtctccacacgttggcccccagcaccacagactcagcacccccaggtctgaatgcaccttcctctcccca

SEQ ID NO: 58254 - DNA, 542 bp, Bovine  19866881148190
agcctctctccaggacagggggcggtgaaactgggccaggcctgtgggtcagagccggcctggcccggactatttttgtactgtctggggggtgggggctgatgaaatcccagctgcatttcaccaaaacactttccccttaagcccagggctccatgtggcgcaaattcattgtcacttaactcatcactcagggctctgagccgcacccctccccctcccaagaaagacaaaaacacacagtctctggcccgggggaggtgggcgtgaggggctgcgacaggcagactggctgtcttgacctgagctgcccccggcaggcaggcagccggcccctccatcttcctgcctctttccctcaaaggcaggctgcatggcagggcaggccccccacgagggactgggcgggggggtgtaggtgggagcctggggtcactgagctctcctttttgccccacgcagcgggtgctggaaacaggaaactgatgagctctgcaggcaggagcccctactcccccaccggggccgggggtcaccccgtg

SEQ ID NO: 58255 - DNA, 1130 bp, Bovine  19866881258212
tgggttgagaatggggagtgttgtgggaagaggccagacgggtgtcacagggtgagcggggccacccactggggcagacccaggggaaaccgtaaggggtctctcaggagcctcagcgaccccagcctgactgactgacacccctaccctatggggcagttgtggggggggcaggaatttgccctggtgacctccccaggcacactcctgtcaccatggtgatcaatcgcaaaacaagcagcttgattgtccctgctcagcggggcaggtgaaaccccggccacgtgaccgatactgggccaggtgcggttaagggacacccgccgcctccctgtcttaacccattcaacacctcagtgtccctgccgctgcaggccccacccccctggctctccgtccccagccagatgggtggtgacgaaatccccggagcactgactgggagtcacaacccgggaaggacttcgggctgggccaagcggggactgtgtgactgcagctgggtcacttcaccccccgcgtctccgttctctcagcaggaaaatgagggtgctaacaccctcccccttcccagggaggttggaccactggaacagagatgcggaagtggaaagccatcgcagacatagagcatcctcgttctgtaccccgcttcttccctttcatcagcctcagtatatcaggggcttgccactttccccaagagggagaccctcaccaaccgccagcgagtccactggcccattcctgacatgctggaagggcggggtgggcagccctcaggtggacccctccccaacaccctatcagcagagtccctccgaggtagcaaaaacccctctcctggccccacagctttttctggagtgttcaagtgaaaacctcaagccaactggtttttctgcttgccagccagccaggccctaaccagccacgtgatacagctggggcccagaactcagaaacatctcaagactgcttctgcccctagacccagggctccagccggaggcagatggtcaagggctgagggccaggttcaggttacccagttagacagcaggctggggtgggggtgggggactcacttgaaaccacctttgaaatgttacgcttctgaatcactaaca

SEQ ID NO: 58256 - DNA, 2272 bp, Bovine  19866881261050
tgggcagcaagagtccataaactttttattatgaggccaataataaatatcttgggctctgcaggccattagatgttatggcctactcaatgctaccattacaagtcaaaagccaccacaaataaggaaaccagcgggcacaggcgtgttcaaattaaactatatggacacccagggaacaggcctggggtgtagttggtcaagccctggaaaagaggaatgggttaagaaaaggcaataacggggagaagggggaatctaataaaatgagaggctttgcatggaccaatgacagacgggtccctgaagtattttcaactcaattctggggaaatatatcccataacagctaagaggcaatcaaagaaagaaagaaagaaagaagacgttacctttttgttgttttgattttcttccacacttacctccttgctgtctgtcacaggaacccacttaaatatcctaagggacgtgtcacccacagtaacccacttcttctccctaaaacaaagacacttctcagaaccgataaaataaaacagattttctgatcagaacttgtgcttttctacttctcaccagatcatgtggtcaaccttaaatgcttcataaactgtcaaatcctactttacttttcaaggcaaaatcaccctttccagaaacacttcactatcgaattcctttagccccgaaccttccacctgtcacctctgctcacatggtgtaccaaaaccatttttttcctcacagactacagtagtatggagtatgagcacattttcaaactcaggtatccatcttgcataacttcttcatctccccaaaattaattcaatcccactgattttataaagtcctattataaaataggatatgtaaggataaaggatatataagatagtgtccctatcttgggaactcatagcaatgaaagataagtaaagaaatcattgtaatatgtgaaggcggcaagaaagaaggctgaaagaccaggatattccatggaaggcaaaactccgtgaaactctgggtgcgtcagttgctcagtgtgtccgactctttgtgacccccatggactgtagcccactaggctcctccacccatgggattctccaagcaagaatactggaatgggttgccatttccttctccaggggaatcttcccaacccagggatcaaacctctgtctcccacattgcaggcagactcttttaccatctgagccaccagggaaactgggttgaaacacaattccaataaccaaggaacaggacacgatgctttcagctaacagaactgagccttacactggcttttggaagaggtgaaggccaagcgccatggaaagatggctttaagatttcattttacagaagagggtacttttgagataggccttaaaaaaaatgagtagctgttctcccctccccacacatacctggggaggggaaggcaagtaacattcttgaataagggtgcagattacggatggccagagttggggagcctgaagtgtgacttctgaatgtttcaagtcccaatgtgagaacagaaaagccaaaaagtaactgctgttattgatgatgctattcagcaaatgacatcacaaaaatgtagagactgtgatgtaacagaaagaagaatgaactaaagacttagaaactggaattaattcctggacaagccactcatttattcctcatttattcaacaagtattgaatctacaagaccctctgctaggtcctgagcacacagggaacaagatacacagtcctgactctcctgagcctgaattccatctgtaaacagacaccacacaactcatttcagttagaaacctgattattagatttaaccacatcaaactgccatttctgcagataaaaaaggcaaatatagaggtcttatggttcaacctaatgccactgtggaaagctccaaataggacaggacctgatttagactggggctcttgaaaggtttcagtgaggaagcaactgcagagcagagccaggcactaactaggcaagtggaaggagtgggtaaaggaaggttgctgggcggaaggaaaggtagtgtggctccaactgaaagatggccagcatcttgcgaaagagggcagtttgagccagtctagtgaggaatgaaggatcatttttggtctttatcctaaggacaaaaagagatcaatgaagcattatttcctaagcaaaagagtgctaaaaaattcacacttgagaaaaatacaaagtaacgaatggatcaaggg

SEQ ID NO: 58257 - DNA, 658 bp, Bovine  19866881355306
tgccctcttccttacctgctacaaggggatatagcagcatatgtattgctcatgtggttggtgttgatggtggacagcacctggcctttcagattccaaatgaggacggtcgtgtcactggaagcagtcatgatgaacttccctggaggtgagggggcgtaacacgagctgaggtcaatgacctgatcaactgacttacgaaggcctctgctgcccttcacatcatgctcccctcccgcaccaagggtcgccacagataaggatatgactgaagactggcgattacctgcctctcctagggacttgctgtggctcccaggaactccaggggagcccaaacaaggtcccttttgtcacaccagaactgagcatacctctcaggctgcattcacttattcagtgaatataacagtccattccctcttgcctgggccaagctccatcctctgaatgcctctcacctgtgtcagcgatgccaatgttgacaatgggtgccttgtgctttttaggaaagtcctccggggtggccgtgaaagtatagcctccatcgtctcgtttcatcatcttgaagacacgggagggtgtctccattagcgagccagacgatgaatgctctagaaacagggagcagacaagtctctcactccttcagacacag

SEQ ID NO: 58258 - DNA, 1768 bp, Bovine  19866881444060
cattggagttttcctcagttactcccttttttacgccccctctgccctactacacgattaccatccactccaccagaaaattctttgggttacatggcagtaaatcctgaatctgttactcctctccatctcttctgataccatcctggtcctagccactgttacctacagggccactataatgtagcttcctcattggccttcctgcttcctggcttgcctcgttaagtcactcttgtacatagcagagtgatctctgaaaaatgtaaagcagatcacatcattcccaagttagaaaccctcccaagactcctcctcacactcggaatgaaatccaaaattctcactgtggcatacaaggccctgtgtaatctgggttcttcctcctgtgatcttgttaccactctcccagccgtgccactcctccaaccaagccaagttatttccagcttcaaaggggacttgtgcctctgttcttccctctgcttagaagcatttttttcccttctcttggcagacttgccatgcttgtcataattcagttctcagtttcagttacactttagagaccctccctgaccactcaatctgaagtagccctttccaccagccatatcacattagctcattatattttagtttgcattacttaatgctatctgaaattattttgtttggatatttgttggcttcaggggtgtcaggtgggtaatagaagtaggtgagttgggccacagttgtctgggtgaaagacagtaggaaaaggtgggaactgaagtcatctctagaggacctttgtcctgggtcaggggcaggtgtggctgtgacttaatattctggaatccagtagaagttgcccatttcagagaagccagaagttggcaatttattttcaaaagaaaaatgttaagcactgtaggaaccaaacaaaacactaatggcaggatgcagcccagcagtctctcattggcagcttttgggttgctcattaagccactggaatgtgacaggaatccttgtcagatttgctccatgtcccacacacactgcctggaatagagtaagcgctcaataagtgttgaattcgaaccaggcagctaacagaaatgtcagtaccctctctgcactgtggtttgacgttcctaaggatagacttctgactgataatactgtgcacctgggtcctggtgaagcttcgctttctggttgtcagaagaatgagactaagacactttgcattcctgcttggctctggctttgctctgattgcatatccaggaggggcagtgatcgcaggatgttgagttactgaagtcagaagtctttggttccagtttcagccggggcacttgttgaacagacacatcacttcacctctctgagtttgtttcctcatctgtaaaatggaaataaatctggcccttcatgccttgccagggctatgaatttctaataaaatgaatgaaaacactatagaagagtcattacagagatgtcctggggacagaaaacagctcctctcagtaaagatgaggctgcttccctgtcagcatggcgaaagttacctggatattcatgtagcccagaggccactatgtttttttgataaaaaatccttgtgtgtgaaggcagtgttaatactttaatattactatttcaatttatgtgggtttgaaagttttcagaataaaaatttggggaaatttaaaaaaatggtatccagattatttttatcagtcattaaaaataaaaatcttaaagcgcaaaa

SEQ ID NO: 58259 - DNA, 554 bp, Bovine  19866881880673
atatggtggtaaggaggtacctcttaaactcttgaaaagagagatacataatgagttagtctaggatttgaaaatatcttatcatttatagcgtacacaacctttggagaattgctttgacattttgtctgcaattataagtacagcagtggctggaacataaaaacttcaattggcatttgccctgaggggttatttgagagtgagtgacttattttggtaacctaaaatctgaaataggattcagaggcagctgactcaatatccttctgataggctttttttttttcccctccttttttaaaaaaacaaaaacaaaacataagtcaaatgaataactagaaaagaattatataaacttaaaagtacctcatgataggggttgttgtagaaatttcagttttaaacttttaaaattaatctaatttgaataactagtcaattaaaaattgtgttgtcagaggaacttcgttcctaaataataagcattaggattgtactgctgttctatggggggagaaggcaatggcagccgactccagtgttcttgcctg

SEQ ID NO: 58260 - DNA, 1352 bp, Bovine  19866880367254
gtcgtttgtgacaacagagagtggcaaagctatgctgacaaagtggggccgtcccgtcgagtgtggtgcgttcacgtgactgaaggtggaggggcaccgggtgggagcctgcatccgcaggagggaccctgcgtctccttttgttttcagcactgtgtacgtgttggcctgtgtaggagcccctgggtttccggggaccacgccaagagtgtcccctggagggcctgcctcccaacctgctgtaggtacgaagcacagccttcattttcactgctccgtgcacgtgagatccgctggacgagtgaccccgccgtgcctcccacaccggacccaggctggcttcgaggcggccgtcagcggcgtccatcagattccacccctggggctcccctttcccggattcttcactgacttcctctgagctgacttctatttctttttcctgcatcataaaagtggattggaaaagcaaatatcatctccaagattcactaatgttactttaatgaaatgcacattacctttctaagtgttctgcctcaaagtggtgaagccagagaacgagaagccgcgtggaaaccgcagctccttccaccctctcacctccttttggacgtggcagattggattctggctgagtgtgtcagaattccgacttggccgcggtcaagctctcgctgctactgcaaaggcagtaataacaaccagctgagtgaagaatggagcccagactcggaaaacaagagagccgccccttggtgaggttgtgctgcttggtgatccccttgttgggggagcctgggtgggaggcgtgggctttgggggggtccaggcacgactgcgtctgaggtcactctgctccccaactcggaggtgccaagccagccgtcagccagtttgcgaaggtaagactgaagtggaggtgatacagagttcaaaagtgaggtctgcagtgcagtttgccctgtgattgtctcaaaggactgaagcagccacagaacaaagtcaggccaagtttaatactctaaagccagtatatttcttaataagaatatgagtggaaaacaaaacagcttagccaatattcccccaactgccgtaatccctcaacttggggagaaattccaccccaaaaataacaacaaagaaaatccaaacgaataggaaccaaagtcagcctcccccccacccccaggtggcatttccgtggcagacgggccttgggtgaagagccagttggggaacgcaaggcgtgcgggcccctgtggccacgtggccccagagcaaggggtgtgttggcgtctccgtgaggcctcctgcctcttgccccacccacggggcacccggatggg

SEQ ID NO: 58261 - DNA, 1373 bp, Bovine  19866880697030
ctacctttagtatctgctggacttttgtttctaccgaatgagcctggaattttttcaatggctccattctatatgaattagcaaactttagttttgccagggcactcttccattctttacctagatcagcaattgagtcatcaaatggaggctctacatactgaacatcatgaattgattctctcagtctttctcttaaaatttgtgcatactgaaaggagaaggagagagacagagaaagatgattttttaaattccataatgaaaatttcagttttaaggacccgggggcagtgggacagggctgacacaaagcttggaaatccattacaacagacatctatgattatgtggttgcgaaatcctagagtcaagcctggctatcaacttgaacaaggagaaaaaatatacaggtgtcatctatctatctataaacacaaaaacacacaaacacaaatttgaatgcataggtttagaacatccatggaagatgcggaagaactagaaacaagagtggcctttgagagggcaactgagtggctgaaagacagttacgtaaggaaaacctttcaggctccctgctctggcactggggcttccctggtggctcagcgggtaaagtgtctgcctacaatgtgggagacccgggctcaattcctgggctgggaagatcccctggagaaggaaatggcaacccactccaatacccttgctgggaaaatcccatggacagagaagcctggtaggctacagtccatggggtcccaaagagtcggacacgactgagcaacttcactttcacttttctctctgacattatgaaaatattatcctttattgccttcttataattttaattattttatctttgaataaataatacatttgtttactcttaagttttaattgaaaagacaacaaaagtggtatatttggtatatatgtcattccatgcttttgacattcaacatttatttgataacattcaacctgccttaaagaactatttatttagtggctattatggttaagtacggagaacgcaatggcaccccactccagtactcttgcctggagaatcccatggacgggggatcctggtgggctgcagtccatggggtcgcacagagtcggacacgactgaagcgacttagcagtagcagcagcgtgattaagtatggggttcccaggtgcactaatggtaaaagaacctgcatgccgatgcaggagatgtaagaaacatgggttccatccctgggatgggaagatctcctggagaagatctactggaatggctaccaactccaatattcttgcctgggaaatcccaggacagaggagtctggtgggctccagtccatggggtcacaaag

SEQ ID NO: 58262 - DNA, 1489 bp, Bovine  19866880709938
acgactgtgagcaaggctgtctgggacctctgggccagctgcatcaccagatggctgaaactgcaccactttcctctggtgaggccagaagaaagtccacccagcccatccagactgagtctgacccacaggacgataaggaagcacgtgactggtgtcacaagctgctcacttctggggtggggctgcctaaatacaccccagtctctctggttatcagtcaagtccgtgttgtctttgcactccatgttttctctgctgggacttgctgcctgatctttagcacggctggttccttcttgttgtttaggcatcagaggatgacctccccttctccagaccaccccaaggggccacctgtccacctggaagctccccattccctaagtgtgcaggtggatgcggtagaattctctcctccctgggagcctggtgactgtcctgtgggcagcagccttccctgggccaagtcctcccaccatgctcccacgtggaggtacttacattgattgcctgacctgtcttttgaataaataatacttttataatgaacttataacggtggtatccaaattctttgactgatgacaatatgcggtctgctaattcaagtgacaaatgagaaaagactttgtcgtcatatttgacatcttgaagactttcctttaaaaaaattaagaaagatattttaattttcaaattttaaataaaaattgaagtagaaaatgtgtctaattaatatacgcagcttttggaaacatacacatatctctaaccaaatgatattaaatgattgatatgcttaccaatttatttcaataacaattttgaaaaaaatttgatttggttttaaaattatgttcaattgctcttcattagccatccttaggagaaggcaatggcaccccactccagtactcttgcctggaaaatcccatggatggaggagcctggtgggctgcagtccatggggtcgctaagagtcagacacaactgagagacttcactttcactttcatgcattggagaaggaaatggcaatccactccagtgttcttgcctggagaatcccagggactggggagcctggtgggctgctgtctgtggggttgcacagagtccgacacgactgacgcgacttagcagcagcagcagcaatccttaagttttcctttactaggttactctgccaaacatttactagggagacacaaggtgtttttttgccactgggcctgtggaatcttagctcccttaccaggagctgaactcacaccccctgcactgggagcatggagtcttaaccactggacctccacggaagtccctatccctgtcttcttgtctccctcagttaaaggccacttctttctaatcctgtccctatggctactcactctactgcttttttctgtgacctgcagatgagtaatatggaagtcaaagactgctcatcatgtttgtcagtaaattaatatatagctgggag

SEQ ID NO: 58263 - DNA, 1053 bp, Bovine  19866880772763
tttttgtaagttttccttttcttcctgccaatagtttgttttgttatccagatgggtaactacaaatttagtacacagtgattcaacttggagcttctctctataaacagttgctactgaaattcaaatgacatgtgacaggcgttaatgacctcggggtcgtagccagcgatgtgcccacggtggctcgagcctgcaggcacccaggtcgctgggcggacacccctgaccaccgtgctccctgagaaagggagcagacatagagaagaggtggtcactcggacgataagagcaccaatctagcaaatactggtaatttaatatggtttggtctaatagtaccagtaccaagattgctaccagatatctggagggctatcctttcaaacgttgagttgtccacgccccacttgaacccctccttccaactgaggcatctgtaggtgtcagcacgtcccacagatgtcatcctttccactgtttatccgtcaaccatttgcaaaacactaataatagaacctttattatgaaaacacccaggcaccttcctcccaaagtctaaaatccgaagtcacttctactaatgaaaaggaatgcactcccacatctgaaaagaatgtctttaaacagaatgtcaaaaatgagcagaaattgtttattccagaatttgtttagaccaccccctctgcggcaaggcttgggtggaccacaatcacattcttgctttgttgtttagaaagatacggtatgccaaaagttgtgcaaacccatgacatatgccacataacatgagtcattttatctttcaaataccgaagaggaaccttaatagcggttgtgtgccagttccagcctgtcaataaccggcactgtgactggaccagcccttgtggttctcattatgattgcaagacgctcctcagcactgccattgggaaactccaaaactagaggttcattacttatagaacctggaattgcatggcacagctggtgccacactgcaaggtcagggcacagagagacagacagaaggagggagggagagacggg

SEQ ID NO: 58264 - DNA, 1613 bp, Bovine  19866880870547
cccttgtccctgatgttgcctagaaaaatgaattgaaaagtggaccggtgacctaaacataagaactaaaatgaggagactcttagaagaaaacataggggtaaatcttcatgagctcagatttactaatggattctagatatgtcagcaaaagaaagagtacataatttggacttgagcaaaacttaaaatgttgtgtattaacagaatgaaaaatcaacagaatgggagaaaatatttgcaaatcatatgtctgataagaaattagtatctaaaatatataaagaattcctacaactcaacaacaaatacaatttaaacatgggcagaaaacctgaatagacatttctccaagaataaactaatggacaggtagtacatgaaaagatgttcaatctgactagtcattatggaaattcaaatcaaaatcacaatagattccacttcacacctttcagaatggctatcattaaaaataaaatgggaaataaaacacgctggtgaggatgtgaagaaattagaaactctgtacgctgctggtgggaacataaaacggtgcatccactctggagaacagtttggcagttcctcagaaagttaaacacagagctatcatatgacccacctacttcactcctaggtccacacccaaagaagctgaaaacggggcgtctgatcagatatatttatccccaatgttcaaggcagcactatccacaccccccaaaatatggaagtaagtgtccatcaacagatgaaaagacaacacagagtataattctaacaatggagtacaatttagccttaaagaaggaaattctaacacaagctacaacctggatgaactttgaagaaattatgctaaccaaaataaaccagacacaaaaagacaaacattgtatgattccacctacgtgaggtacctagaataggctaactcataacgacagaaagtagaacggtggttgcccacggctgctaaggggggaaatgggaatcttattatgtaaacgttttggaaatggatggtggtgacggtcacacaacactgtgaatgtaatttatgccactgaattatacatttaaaggtagttaaaatggtgaattttgtgtgtattttaccacaataaaatttatttctttgaattgcattaagtagcaaaaagcgactttggtgttttacaatccttagtaattgcctttgccagggctaggggatggggaggagagagctaacacagagaaaagacacacaacacagaaaacattaaaaacaataaaacggcagtacccaagatcctggctggaagtgtcgcagctcctggagctgtctccagagcccatccgcctccttttggacggttgggtcccatcatttgaattatcttcattatcatcctatacattcaaaagatgaaaaaaataactggacaaagaacagtaaataagggaagattatgtaatcctcccaaacttgctaaaaggctcaacttgaaggcttcctaaagattatacaaatgataaccagggacaagaatttggccttggcaagacctggaaaaaacccaaaaactaatcttcaatacaaatcaaaatagaaaattttcaataaa

SEQ ID NO: 58265 - DNA, 1053 bp, Bovine  19866880937107
tttcttgatgggagagctgagtcttgatcttccctgaaatcacttgtactgagcactgtatcttaaacatagtaggaatgtttggtgaaaaaaaaaaattgaaataccagactagtctcagaactaaattcctgagtgctgtttccactggtcatgaaaatatgctttgacagtatttttctttcaacatttaaaaaaatgttattccactggtgttctgttgctgttattgtttttgttttttgcctgcatggtttctgatgagaaaatctgccatcatttgagtcactgcttctttttttaatgtattgtttttctatggccttttcaagatttcttgctttgttttggttttaccctttgattatgatgagtaagagcgtgttttctttgagtttattctatttgaagtttgctgaattttgtatatctgcaaataaatgtcctttaccaaatttggaaaattttcagccattatttcttcaaatatgtttctgcacaaattttttctcctcttcttccaggactataatcataatgtataagaacttatgatattgtcccacaggtctttgagagtctgttcattttttatcaaacttttttttcttctgtgttttccagattggataatttttattgattgaccttcaagcttattggccccttttttttctcacctccattctgtttttgaggtctctagtggacattctagttctgttattgtatctatcaactcaaaagtttccacttggttctttggcacatcttctatttctctgctgaaaatatctatcttttcattcattttgagaatgttcacccttaatgcatgaataatcattatgagatgtggttttaaatattggacaattcctacatctaggtcattttagagtttgcatttgttgattacttcttcccttgcaggttatttacatcttcctggttctttgtatgttgagtgactttggattgtatcctggatactttattatgttttgagactgactgtgggatctgttgaaattttctgaggagtgttaattt

SEQ ID NO: 58266 - DNA, 747 bp, Bovine  19866881098885
ctgcaactcatttaaagatagagttttcaagtcgggcttataaatcatttacagagaagctgagcagggctcaaactgccgtccaatcggcacattcctcagacgtgagcgcagagtgggggcgggggcggcggtggagcgagcgcggaggccagaccgtcaggagctgagctcgccctcgccagatattagatcaacaaccattaaacataatacgaaccatcttccgtggccagggctcaacagctgcgcgtacaaacagctacaaatacgtcccgggaggctcggggcccagcccgccgacggccccgcgcctccggccgccgcagggccctggttccccgcatccagatgcactggtacgttcgttccccgtgaactgcacacacgccggtccccacgccggcctcatgacatacctacccgtgtggcttctgggggggggggggtcggaggaagtggcccagcgctgcagaaacccaggccggactctggggcagagtctgtggctcgtgtgtcactttcgtggggacctggctccggggtgtgtgagcctggggttccctgctggtgaagggcagctctgtcctgagggaggtcagaggtcagtgggcacgtctcccctgcccccttaccaggccttccacctattctgtggatccgataaaaataatacatcagttactgaaaaggtgaaatttaacactgagacacaggtctaaattctatgattacagaattactttt

SEQ ID NO: 58267 - DNA, 744 bp, Bovine  19866881444780
ctttcccctcactcccctgcgcttctctggtctcactccctctctctccacaccgattctttttctctttgagctaagcctgtactattaatataacatcttctaacccaaaaagcagtggtcagaaagggaaagtttacaggttaagacattttaaagagaacagtattgatgggcatttgggctgcaggcaaaatacaaacctgattctgtataaaccacgcagtctgtaattttcttccagcatacttcaccgttttgagttacaatgctgctgatgtcgcaactttctctgacttcaaacccaagtttacagatcatgtcatacactgaaggagaaagacaggtggcaatcggctccccaactaatatctgaaatataaaacataaaacacactcttcaacagaaaatattaactttataatatatttaagtcacaggaaaactgttatgtcttatagaatatactcaggaatagttactgtgttaacactttctggatgtcagaagaactatatgattaaaacactgtgattaaatattaactaaagattacttatgcaaatattttcaagtaaatgtttaaagatattattttattaaacatagtatttttaacataagaatttacagaagctcagaatattttatggatagtgcatttcttttcagcattcacaaattatcccaaagttatcaaaataagcatttttaaatgagggctagaaaaatagaatatcaag

SEQ ID NO: 58268 - DNA, 874 bp, Bovine  19866881610010
ataaaacagactccgcacctctccagagcacaagagccataaatctatagcaaaacagacttcagctgactgacgttggcaacttgagccctggagtaaattctgctactaacggttcaaactggaaatcctctgtctcatgctatggaacacggcgccctctctatgtggctgttacagcctcacccactcgggtggtttccagcacaaacaacagctcctaccaggttcagaggttcagcttccttcatcttctgttgaagaaattctgtcagaaaccttgaggtcaacaccttatttgtttcatcttggtaaataatcacctggacaggttacgcctacactacactgaaagatcgagttgaggtcctttttctggccgtcacagaaaattgcttgaatattaaaatagatgacgtgacagcagcaggcttcctactcctcacggctgcacgacatttaagtttacggtttggctgttgactttgctaagatctgcagaacattttccaaaagggagatactgtagattttttagaagtgaaattaacttttatgatgtgggcatgatgagaaagtcaggaagtctctgggaataaaatactcttcagaaccagagcactgtataggaaaacacatgtttgaaagcacttgatgcctaaaaacaaaaagcattaatgccacattcacagaatatgcactgcctctcatagaatggagacaagcagctcttctgcagtcttgatgcagagcgcatctccagtcagaggatctgtgatggagaacacgctgctggtccacaggtctctgtgagtaagaggtggcctcccctcttgtcctgtgcgtttcagaccccgtttctccgggagccttc

SEQ ID NO: 58269 - DNA, 2249 bp, Bovine  19866880350650
ttagttttctgaatgttgagctttaagccaactttttcactctcctctttcctttcatcaagaggctctttagttcttcgctttctgtcataagggttggtgtcatctgcgtatctgaggttactgatatttctcccagcaatcttgattccagcttgtgcttcatctagcgtttctcatgctatactctgcatataagttaaataagcagggtgacagtatttatagaataatactgcaaaaaattacatattacagagaaatggaaacttgctaacattttgtcatatttacttcagaatataagtatgtgtatatatatataaatatgaatgaatgagaaaaccatgaataaagtctgttccccagtcccattcttcttctatctcaagggcaaacactactataaattatgaattgatctttgtgtttctggaccgttttttatacttttataccttatgtaggtatctttgagcaatatatgatattgtttgtgtgtgctttttagaatttacctaagtggaggaaatttaaaattttctgggctatccagagtatgttgcttaatttctagacatttgggaaattttatatttttgttattacttttggttttacttaatgtttggtctgaaaatgcaacatttcagtctttgaaaatttactcatgcctgctttatggtctcattgtaaggcctatttggccttacactggtctcattgtaagctgtatggtctcactgtaagaccctgtttggccttggatgctgcgtgtatactttcagagactaagtcatcctgcagttgtggggtgtagtgtccagtgttgtcactgtcagatgggccattttttttttcccctaagtttctcacttgtgtccaactctttgcgaccccatgggctatatagtccatggaattcttcagacgagaacactggaacgggtgacatttcccttctagagatcgaacccaggtctcccacattgcaagcggattctttactagctgagccacaagggaagccctgcatcaaagaagatgttcctaaagacgtagtaatggaattggagaaggttgccattcctgatgaatagagtctgtggaggcaaaatgggaaaggaattttcactttttaagcagatttttaattcttaaaattagtttatcatattgatagttatagagcaggctcttgaataatatgtgcttcataactgtgacggaataccttgaagattcctacaatgaccaggcataggctttaaataaaaatttctccaaattctacatcttgtgatgcatcacaggatattcatattagacaagggacatcgcagatgagtctacactaggactcaagacagtacattgcgtatgtttgcgtgtttcacgcctttgaaagccttaaaggtatgttttggaattgtgactagaaattaacttttcactgtttaaacaatgttttcccaaattctttatggacctagtattattctgtttattgttatacctcattatttcatggatgcaagaggaatttaaaaccagtgctcttaatataaagttcttgtattggtgaacagggaattgaggactgggagccctctattatatggtgctgatgatggatgcaggctgcctctgagtttgccctggatccctcaggtgctgcagaaagacactgcaggttgttctcagaacgcatggggaaaaaaaaaaagaaaaagaaaaagaaaaaaaaagaacgcatgggaaagcagaatcctttactgggcaggtaagagtgagagggaaaggaagagcaaggcatgtgacaaaaactctgtctagatatatatatttaagattttttaaaatatttgttttggccttttggaagtaaacattgcaatgattcctggggatgctttagggatgttgtttgtacatgatggtttttctgttcgttattatagttattattagttcattcattttgccaatgtttattgaataccagatactgtcctaagtttggggttccagtgatgaacaagactgacacagtttctactcttatggaaattccatgaataagagaatagtgtgatttgtatttcacaaagaaaaaagcaaccaattttatatgaaaaagactttttttgtttaaagaaatctttcctttaaaaaactacataatatagaattttaggattgtgcaataaatatttgtggactgctgtcattactaaacaatgctatta

SEQ ID NO: 58270 - DNA, 990 bp, Bovine  19866880494541
atggaagaatattgctttaacttattcccatggaggtagttcttgatttaatgacatcccagcagaaaggaatgtgatagatgttgcttcaaataatcctttgatatatctagtttcttgttaaaaggaagctttaccatgttctgtttgggaagatagtttctgttagactttttgctcagatttagcatagagaagaaaatattgtataaaggaaggaaagctaaataatcaggacaaaaatgggtggggctctcactggcctgattgaggtcatgaatcattaggtgtatcatggagccaaagaggttgatgctgtggggttacagagagaggtgttgcaagattacttgttcttttttttcccttaaaattttgtttttaatttacttatttttaattgaaggataattgctttacagtattgtgttggtttctaccaagcatcaacaaggattgcttgtttttgaacttaaaggacaaaatctcagggatgttagtctactaactgatcatatggaacaagtctctctctctctctctctccccctcccccgtggattttaataatgcaactttcctagcttttgcaacacactctttcagataataccacacagttataattcaagtgaaaggaaaaaaatttcataaaaatcggttatcaaaggagggaaaatttgtgggttgctcccttgtgagcaatatttgcctctctgatttattttgcaagctatttctgtcagccatgaattaaagaataatgaaaacacagttgttgcttgtttttataacctagataatttcacctgaaaagagttggtatgttggcatggcctatttaccattcagattaaagacaggatgtgccgagcaaaaagaaaataaagtccagccatattcttgccttttttccattacattttgttggccctaagtagttagagctccttttactattcatttctcagagccaaatggattttccag

SEQ ID NO: 58271 - DNA, 1354 bp, Bovine  19866880532977
cagcttagcagcagcatcaaatcaatattttcaatggtacaagaaatgtcctggcctgtggttttaaaggcttcagtatctagaatcaggaaggctacaggacacactcccaccccagaatctttcgtccagcgcaattcgttagctcatcactttttaaagttttaatttcagttatttgatttgatgcagcatcaaatctttgattatgttttgcttgggtgtgggatatctaccggtttgagagtcaatataagtttctatttcagttgatccaagttaaaatgataaaacccttttccacagagggtgttcacttaccatttgacttggctgcatcgcaaactaaaaatcattaagtttgattcaaaattaaatcagaagtcaaatgaaaatatttcctgcatataagaacattcatgggtcatagtttacaaagagttcattttgaagggagagtaagaactgagtcataatttcttagattagagctttctattttattctgttactcagcttttcttttggaaactgattccatcagacatcagtcatactcacaatggtatcttttctatgtcatggaggccaggagatatgtgtcattctttgcccttctatttatttgagaagacagacatgatacaaaaaaatcagaaatcagatttaagaaggttaagagaatggcatggtattaatatatgtcattcttaaagtctcagctttgaaaatttattatataaattaggttctggaacttggaatgctagtattaatccagttttgggaatgtaaaattataggttggtatggctagatagagatataaacacccatatttacatccatgttgaatgtatcatgttgaacttgttgaaatttttgaaaatatagaaaaatgttaaaaaaaaatacacacattgaagtcatccagtatcatgccgccaataatagcccctattaatattttggagcaatttcttctaatattttttagtatacaaacatatatatatattagaaactgaaatgctaacttttaaaacaggtttgaaccattttcctgggacattaatatgttccaagaatgtaggtgttagatatggaaagtacagtaaagtcagggtggcctccagaaggaacaagaatgaggcttggaatgaagtttattacaagcatacctcattttattgcacttcaagatactgtttttttacaattgaaaatctgtagcaaccctgtatccagcaagtttatcagcttcatttttccaacagcatttgctcacttgctttttctgtgacacattgataatacttgtagtatttcaaactttttgactattactatatat

SEQ ID NO: 58272 - DNA, 1440 bp, Bovine  19866880551603
gaaatttcctacagatatcagagaggacaggtcgcatagagaaaaatcccactgtgtcttgccactctgcaccatagcttttatgttttcgtattggggtttattggtcaatgtctgttttcactgcatcgtgtgtgttagttactcaattgtggacagttaattcttaggctgagcaccgaagaattgatgcttttgaaccgtggtattggagaaggctcttgaaagtcccttggactgcaaggagatccaaccactcaatcctaaaggagatcgatcagtcctgaatgttcattggaaggactgatcttgaagctgaaactccagtcctttggccacctgatgcaaagaactgactccttggaaaagaccctgatgatgggatagattgaaggcaggaggagaacggaatgacagaggatgagatggttggatgccatcactgactcgatggacatgagtttgagtaagctccgggaattggtgatggacagggaggcctggcgcgctgcagtccatggggtcacaaagagtcggacatgactgaggactgaacgaactgaaacatatatgtgtatatatgcatacattcctgtcatttgaaagccattatacaatccctaagtatggaatgctttctataactattattttgcattttatgcccttttaaaactgtgtttttcgtatttctagttgagttgaaattgtaactagtgcaaatttctaaagttcatactctggtaggggaagagcgttgctgttggtaagaatcagagatgaccttgcccttgctctggggaaaccaaagattgtttgttcatggtgaatttattcttatggccagcaaaaacatttctctggtgcttcagagtctcctctctggtactctgagtaggcaactttggatagttgctcccactcacatctgagcagggctgcaataatagcaaatggtccttggaaatcacagtcgcattaggctgctgttcaaatagcttttagggttgtgataataggaggcattcctaataactggtgactctgtgagaccctgcccagaaggcctccaaatggcagcacacaatttaaattttaatctggaaacagtggaaatgatgagattccagctggggaccttctggtctgagggccagcgttcagcctccccattagatgccccagaggttcgttgagtcaatgagtgaatgccctcgctctttttactctttccatactcggtgacgtcttccaccccacgccccagacagaagcaagttgcatttccccgcttccacagaggctttattggagctgatgaagcattcccacattgctgtgatccaactaacacatttgtgcctgacatgagtggcatgataatttcatctttctgacaagtgataacttcctaaacttttttccttccatgtgctgggt

SEQ ID NO: 58273 - DNA, 1223 bp, Bovine  19866880603569
gagggctgatttttctcattgctaggtgagtcccctgtttttgtcaggagacatatgtgggaacatttttggaatctcctgcttattattgtttcaagaccctaaaaggagaagaggggagaaataagaaagcaaaatgagaagtgactctgggcatccctagagggggcattcctccacgcagatgtcccatgaacagtgccaccagatcttctccagatcctgactttgacaggtcctggggttgaggagacaccaggatcatgactatcaggtgtccactggccagaagaaactgtgacactgtgcaagtagtcaagagggagagaattaaagcaaaaagtgctcaggtaatctctggaaggaaatcaacactgaatattcattggaaggactgatgctggagctgaaactctactttggccacctgctgccaacagccaactcactggaaaagaccctgatgctgggtaagattgaagacaaaaggagaagtgggtgagaggatgagatggttagattgcatcaccaactcaatggacatgagtttgagcaaactccgggagatagtgaaggacagggaaacccggtatgctgcagtccttggggtcaaaaagagtcggacacaacttattactcaacaacaacaacaagaatctctgaaacccaccttcaaccaaagagtcactgagaatgagtgacaccccagcacctttccactgggtcttgagctgaggctgctcccagtgaatcaggaaaacaaataaccttggctttggggtagaggagaattttgtccacttggtctcagcctaacttattgactccagcagctggaaggacagggtaggatctgggagagagcaagaatgccgaggaggaagggatgccaaggagatgtttctggcgatggagcagctggcatcctgctgtcactgagattggcctgcccaggaggatcctaattacggcacaactgttgcctccataatcactgtgacaggagctgtgtgggccagaaggagatgtgagatggagctggctaatgctgaagaggatgttggaatcactgcgacaggagctgtgtgggccagaaggagatgtgagatggagctgggtaatgctgaagaggatgttagaatcactgcttcttgccccagcttcaaacaagaggctattactgccagctgcctgctaaggttgaaccagctgctgccaagaaa

SEQ ID NO: 58274 - DNA, 1782 bp, Bovine  19866880620812
tagctgggcaaccctagaacactgtcaatggcatcctactttctaacaggatgaaatgaccaagttccttcattttctagtgctggatactaaagtaagaaaggaattagctgtccttctctagtttggtaatcaaagtcataattacacatcctctcattcacatagtactttaccacttacaaagtatgtccatgaacattctctcattgatccttcacaaacattctatgaggtggacattggtacctccacattatgaataagaacacagaatcatggactcagatccaggatatttgacaataaccttggagtactttcaactcttttacaactgcctctttcacttcagaaatctttatttacaagtatgtagcacactgtggcttatgggcagtaaagacatgattctaaattgaatttttttctggtgaaattatggttgcccaaggctgcctaacctccctccacccttagtcagtacgagctcaggtaaaacaaagtaattgcaccagtatcctaaacaaaacataatcatgaaggttaaaaatcactaggaaaaaaaaaattattcataaaatgtgtggatccaaactttatattggtagcagctgggaaaaagaaggaattccttccataaaaatatgtgctcccaaaacccctccccctagaatgtgtgcactaaacaattcattcacaagcacgttttcttgagtactgtcttaagtgtcaaaatataacagtgaatgtgaaacagttcctgcaaccaaaggtctatagtcgaatcatcaggcaactgcagtagagtgggaaagtgcttatacgctaggaacagcccccggagctacaagtgcaggaagaagggtcctctgcaagtctcttagagtcaaggaagcaacacccgaaagccacctctgaaaagtattcattattaaggaggcatggggaagggagaagggaagttgatgttttctcagattggatacactctgtggcctggatatttctctcttagctgcactacagcttttactggtttctctgttttcattttataagctcgaaaagacatgttcagaaaatttgagagacttacccaaggtcacatagctagtatgttagagatccaagaactaataccaagtctgtatgaccactgtggatttagagaagaaagagcaccagactggataaagtcagacaactggaattctattctgtcaccaaatccctgggcagccttcaacaggtcactgaacagctatgctctgcttcccttatctgtaaaatgagaagatttaaactgcatgacctctaaagtttctgagtttttagtctaatacatttaactctcatctcctgatgagaaaaattcaagctcagaaaaattcaagttcaagaaaatcctgagaaatgaagaggaactactaacaggtatctataacaatattaattcctctcatagacatatacagaaggggagatacaccacaattctctctgaagcataatataatttttgacatgatggatgtgttgcttggactaattactcttttggatgaacaaagaatattgcaaaatgactacaatttgatagtatttcacctctgtggttgttgggggtggtgaatggcaaatcagacctattaagggatttttgtggctacttctcataagtttctttattttgctatgttttaattttctggttattgtgtaggctgtacaaaagccaacactctaagtataatgaataagacactcaagcttccttgg

SEQ ID NO: 58275 - DNA, 1133 bp, Bovine  19866880661817
aaaagaagtctttaaaaaaagaaataaaactaataatccagagcaaaaagagagcttttcttcctcaaaggttctatgaaaaaatacatggaattgggtctcattgatttagtttccgccaaatgcccagttataaactgaccattgggacaagaattcgtatatgtttattgacaattccagtagtgtgcacctccaattgcaaaaagccaaatggaataagaatgaggaaggtctcacagtgatagaaaattagatgctgttatcagaagaagggtaagaagaaggatgggtaccagctagcaaaaaatgatattcttcactgtaaaggactgataactattttccaaacatttgtagggctgtcatgtattagaaggattaggactattctatgtatccccaaaggggagaactggtatcagtgtgcagaagtgaagaggaaataagatttttgtttctacataaggaataatattctcatagagaaccagtatggtgtgtgttgtaaggtaacttgtgccctgtcgctagaatttatgtaaaaatttgatggatattatagaggcaattcctgttttgtattaaagaactgcccaggtatatgagacaatcccttctatttccatgacttcattatcctatttcctatgtgtgtgtgtgtgtgtgttccagtgcatacacacaaccttgtggttcttaaatctcccaagagggaggtttaatccaattgcttgatgagggcattgtttaacacctgttgtttttgagtggttacttctgtgcctgctgaattgattccatgtttctagttcttaatagagcattaaccatggtataagtaggtatacatgtggcaaaggagatataatgctgactaggggcaaaggattggaaagacatatgggtggggtccactttatcctcatgtacaggtcacttccccaagcagacggaatattcaatttccactttaaattccagttccagaacgaaacagtgagagaatgcagactataaggaagaaataacactaaagggaagctctcaaagataattccatcatccataacaccaggcgcttcctggcattatgactaataaaactcagcaaaaaacatgttctaaatatt

SEQ ID NO: 58276 - DNA, 1793 bp, Bovine  19866881086435
ctaagggagatggaaagtgaagtgagactggttaggttcccctccttacactccggtagaaccctcccatgagaaactaggtctctggcagccagccctcaggtaaagaaacagagttccctgagcccatgtggtgcgcagtggacaaacccagtgaatctccttcctgcacctcgggcctttggggtgagggttctgcaggaaggatgttcttcacaggcaagcattgggccaagggtcttagatgtgtggagcctgtggtgggctagcttcctcctcaacaagagctgcgtctgtcctgaacctctcagtgtgaccttactctgccagattatgcttcctcttgtgagatatataaaggttttacatattcactgatgggtaggagtagaatatcattcaagactaagatttcttttcacccaaggctgtcaggtttgtgttaggataagtccataggatgtaaaacattactactttagagattataatgccctgctgaataaggactaatttggggaaaaaaagcccctattggtactggggaccctttacatccctatgtgattagatacatgtcttgtttctgactccttctgagacttgaaagaggattagatcacccacccccaactggtcatttctctctgtagatgggagaatcagagctaattgatacttttttatgtttaattacacttaattttttctgactggctgccctgaaactaagaagaggaaaacagtgttctacacgcaaatcttctaccataaacatttcttaacctcatttacttcagaattggttcaaatacagactccctaagataaaagctattcagaatggtttcttatctgtatctgatcttgtttttgagtccttccttcttggaaccatctctgtgatttctgtcatgggaatttgctcagtcctttcttctctaacattgatctcttctgtattcactataataattttccagtccttttgttagtttgcttaaatgaattcaaaaaccttaggtccccttctcctttgaaccaccaggcagagggctctggtcacagtgttcttctcaatggatttgatggcatcaccccaccttcaaaactctagtaactttctgcttacttctgggtaaaattcctggcttggtcccaactcactgttccctattttctgctattccttgtacctgtccagctgttttatgtgctctctcctcagtgtcctgtgttttccccatttggaacatccaactgcacctccttgtccttctgaattctgcccatctctcaagaagcagagcccttctctcctgctctggaaggccttcctgatggcttcagccagatgacatctttccctcctttaacttcccatgaatttactgtcaattgcactgatttggcaattaagggagtcagccaagggcattggaaggatagaaatctcttgtgtatctaatcctatcttggtatatgttccaaagacaatccaaaataatgcagaaggggttccagcctcccccgtactcaccagaactcttagacccttgttttgacctatgccccttctttcctggtgagctcctctttgggactttcctctttgccagtggaccttgggtaagagcctttctggtccttgctgacagagtgtcctaattctgaatttcaggcactttgagttttccttcttcagaagacctgtagtgtctgcaaattgtctcaccgctcatcagctctcatccagagctcagcagtcaaaggggagacatcttcagtgtctg

SEQ ID NO: 58277 - DNA, 1227 bp, Bovine  19866881099710
cctggggattcttgatgtagaatatagtctgcacatcaattgtataattttgtttttgtaaccttttattttgatatcattttaaacttataagaaagctacaaatatagtggaaaacactcataaatattcctcactcaaataccctagttattgacattttatcaaatttgctttgtcatcgtctatcttcttttcttcccctacatctcccataaacatgtattccatttttttgtctgaatcatttgagagtagattgaaacatgatggcttttaccaccaaatatcttagtatatattagttaaaagaaataattctcttatataatttcagtataattgtggaaatcataacagtaaagtttataaaatattaatatctaatttatagattattaaaatttcagccattgtcttattaaataattttacagagaaaaaaattgtggacagaattccatcatgaattgcatctagttactatgtcttgtccactttactctggaatagtttcttggtttttgtgaccttggcatattttttgatgatggacagctattctgaccagtgtgaggtgacaccttcttatagttttgattttcatttttctaataattagtgatgtggagcatcttttcattttctaaatgttttaaaatttgtatatctagttatcagatttgctaaataaaatatatttactctttctgaaaaatgcagcatcagaattacaaataaaggtatcaagataaagctttagcatgactaaaaattagcgaaaagaagccccccgatctggctggatttattgttactgcacatatctgagttttctcttgattgtacactgatgtttcccacgtggaaacaggccccaaggaaagacctttggtgcaggtaaccaatttagaaggttaccctaaaaagtacaagggagagagcagggaaattgagacaagaagtggagaaaagccaaaaaaatgtgtgtttttgattagcctagcacggtggacaagtgagcctcagtccaccttggaggaatatctttaagaagccagcttttgcctttatacatgatcatgatgaagttgtttctctttaatatgtagttcaattacaggaaattaattttctatgctggaagcatatttgaaggttgattagtttattttcctctgaagcattttggaaactatttctcctttcttataatagctgattaac

SEQ ID NO: 58278 - DNA, 755 bp, Bovine  19866881279012
atttaaaaacttaaatccagttatttcaatctattggacaaacactccccactccccacaaaaaagtaagctaattctttcatagtatttctgtgagaagacatattccttcaatttgccaaggaaagagcattaatgctttcttcctccttttcttcaaattccagagctctgcttctgataatgtagcactttaggttacgtgaaatcagcccctgtttaaagattcttcgtggatccaagcttggagagtatattaatgtgggggagtacattgccatgacagacattcttgatacaaaatttcaatttcagttgagtccctgtgatcccctgagcagctgtaaatgccctgttctataatgaggcagtttaagacaaagaaaagtattcaaatctatgtccatttatatttatactagtacaaaacagtgatagaagaagatactgatttttttttctgacgtatttatagtttcaaaggaaaataaagacactattgagaaatctctaatgaatgattaaaaatagtttggggtgggcctgccattcaaaatttttcccagagttctcatctatgttctatacaaactgtaaataaaaatgtacacaaccaaccagatgtattttacatacattggatatcaatatgtacttgtgaatttaaagttccttaatatacacatccccacttagaatataatccattacataggcaaaggcatcattctgtaataacaggtcagggatagcag

SEQ ID NO: 58279 - DNA, 795 bp, Bovine  19866881447052
ccccccccccccccttattttataggtaacacataaatatctttgcttgttaagaataattctggttaaggctgaggttccctttgtgatgctctgtttgtattacaatacatgatccttcactgttcattttcttataaaatgcatggaagtataaaatttttcctccttaaaggacaccaggaatttaagttctttcctctgaacgctttcctatgtaggtctagctcacagagttgactctgcttcatatttgtgtctcctgcaagctttaatgcttccaaattggctcagctgtggctctttgccttcacttcaatttatcaggagtagcttcatcagcaaaggattcaatgcccaatccaaaacctgtttgcttatgtaagacacagtggaaaaggcagctccccttcaatgtcatggaagctggtgggagtagtgactggagaacttgtgtcctagaggggcacccactgggagccagggaaaaggaaaactttcctctcttgtgtcatctggtccttccagctgttgctcagcagtgtttgatccaggaatcttgtccaacatggaattatgaaaggcaggacacagatggttggttctgatagcattactttaggcacagcctttgcttgaagttagtagccctgttaaaaaggtggtgactcactggaagcagtttccttactgtgttagggcagtaacataaccatcacttacaggggaacatgaaccatgtgtctggaccatgtcagatgtgagcagcaagcacataaatgcctaccatcacag

SEQ ID NO: 58280 - DNA, 648 bp, Bovine  19866881695346
tggcctaaaaccagtccctgtgacttccttcttctcaataatatcaggagagagtatttgaaacaggaaagaaacagaagggccagagaggaaaggaagccagagagcaagcaaagaggcttccttccatagcattcatagctgtattcctggctctctgtctgccccagctccgctcacactgcctcttcaactgtgattgagaaactggttttacctgaaaagcagctcactcctactggagttttcaaaggcctccaggatcactaatgagaatgacactgcatttcaatttagaatccttttttaccataatctctaagcattgtctaacctaagctccagtcttgattaaattacgtattcaatttgcctcccacccacattcctaacattcaggtctttgaaggcaggctgagctaagagaccctgaggaaagggagggtatcctacagaatggtgactgcctgcacaaatttctccatgcttccaaccctgcctctggtcactcacaggctggccctgcagctgctactgtcaccaacataacacatgatgttgccgggaaagtgacgctgggaacctttttgcaggggctggaacgttgtttctgacatatgttcccacggccagaacaatgacaaggct

SEQ ID NO: 58281 - DNA, 913 bp, Bovine  19866880562898
aaaaaagacaataaaacttcaaaactagtttaaagctttgcagtaatattttactgccaaagaaagcagataagactttcacactgtgctgaaaactgcaggtaattaattcccatggcagggaagtgaaggaaaagcacattccatattctcagggcaaagtgtaaaaggaatttgtagcagatcctattaggtttcagcattagactgcaagggatacttagagtagactaggatgaggggaagctatgagagtacaaataatataatagaaatgcttctgacaacaaatcatccacaacaagagaaaaagctctaagtgatacaacagaaggacttcttaggtgtccaagtttttcactcatttcacttttagccaaatcattgctttcctttccctgccatgctttcctaactcgaccacaattaagctcagattttcagagtgtccttggcttttgcctactctatatcctgacttttaaaaactagatgtttcttccctttaggatttataattctgatttgcctcatccatttcagtcattgatttcaaggggtaatctgtagtttgtcactaattcaaggaaatatgtgagatctcacaaattctggaagctgtaaaaagaaggtggggatggagtgagtagaagacaaaggcctgcacacaattaatgaggaaaacttgtaattttcctggattttgccaaaacttgactgtttcaaactgtctgcggtgtgtttgaaatatcaacagggaatatagtaaacagttcaccaggggagccaaggcagatcataacttcatatgcatggcatgtatagaatatcaactttctttaaattcttcgtaagaagcattcagttgggcagtgtttaaatattaagattatgactatgtgtagaacaatga

SEQ ID NO: 58282 - DNA, 2424 bp, Bovine  19866880626691
tgaactgaactgaactgaaggaaaaatctaaacagatggtgtatgtttatttcttcctcatttgtaaggtatggagaatatattttattaaaactatgttaaagagtcttgtttgctatattttattttaaaaagaaaaaaaaaaaaacactagaaagaagctgatttgatgtgatgtatggcagaaaccaacacgacgttgtaaagcaattatcctccaattaaaaaataaaattagcgtgctatcccaatttttttctccatttactatttcttcaacatattctggggcctatggtagctaatgaggatacaaatatgaataattcacagcctttgtgcccaagctgcttagagtctaggtgcagtgaaaacctgaaaaattggaatgtgtcatacaggctgtaaaggaaaagtcgcaagattgagtagtgccactaaggagcaagtagatttgaaggtagaacagacctaaacatcatgtttgaaacagttttcaaaattaaatcctggcaagtaataaaatagattaataatttgatttctttaagttaccatttataatagatcagcaattctttcaaagtcaggtaaaaataaaatccttactacctttaactaaaaggaaattaaggaggagatggggagagatcatgggcaaaactatttcagttctttctgatatatggggctctggtatacttacactagggattcatgagacacacagcctgcattctcataatgaaaagatgattatatttcacatacccctcccttaggggagaaaacattgtttaaaatcaggttagccagcaaatacaattgcttaatttcatcatgggtttggaacccaagtgtagctttatagccatattagcaagcattagttttggtgtgtttttctaccaaatccttttaacatttctttggggagatgaaaatacagattatcagatttcttttaatgcctttatccactgtctctataaccaatttcaagatgaaaatgccagagagactttatgataaatagcatcactgtgctctgggatattacacaatacaaactataaatcaccatcctcagagtggctccatcttttgttgttgtaattttactagcttctagcagttaaagcagcaaatagaggtgaattaaaaagtctgcaaagtactgagactatcgataactctattctggtctgaatttccctgtctctcagtgttcaaatttagagtgtatttatttaaggaaaatgtcttaagaagagcattcaacacacactccttttaagtcatgttgaacacagtgctcttgcattacctacatttgctcctgtttcaaatctgaattctttttctaaaacatttgttattattttaatttgttccatttaaattattaaatcatactatatgacacacaacaccaattaacaagatcttagtaaaggccacagataaagatttgaattattaaataaacaaatattagtttccttgcaaaatttcccccttatatcaataaataacactttttcagttcccactctcttaccaatttatgtataattaaacactctcttcaggtgcttctcatgcttccttgactgccttctttgtcttttattaattttccttctcttcctatgttataaatattagtgttacctgaaatgtggtgcttttccctatactcatctctacacttttcctgagccattttgtctgctcctaagttttcagtatatttcaactctgtaagcctattaaaattataatcttagacaagtcttctcttctaaaatcttcaaagactgtatacctcaatttgatattcaaatattttacaacataggtttcaaacattggttatgtccttcattttccaatttgatgtggaaattccagtttttttcatttacacattatattaattgaaacgttctcaagagataaaatcaggagtgttgcatggaaggagaaaaaccttgtttcaaccttgttccaaagagaatgtaatatatgtatttttggctcatttcattcaaacagtatctattctaacaattagtcaataattgaattattaaacaattactttgatagtctttatggaataatcttatctgttctgttctttattgtatttgaaatatctgactgatgaattatgtatattattccctgccaataatacgtagtcttaaaatattatggttcactatttctaatggatgcttaatgaactatcacaaacagaaattaattcatgtattgattcagtttacaactttatactgctgttcattttcataaacatgaatatctttacagcagaactggtgaaaaataacgcgttaaaaaaaactttaagaaccacttaattttatagtgttttggagcgatttttataagcag

SEQ ID NO: 58283 - DNA, 4035 bp, Bovine  19866880731002
cattcacgtttcataaaacattcatctctaagaaaatatgaaggaaaattttatgtttcaagagctcattgtagcttttcagtataaactactgtttttaagttggcttctttataaatgctaactagtcttttaaagccaaattaatcacattaattaaaaatccaaattaagtacatcaaaacccccccaaaatatttttactagtaaagaaattaatcatattttactataatttactataattgaattcatagtaactattgcaaatacttattgaccagacaacagtgttctgaaattgtgtgtcaataaatactttcaaaattttgattattatttagtagtaatagaaaaggataccatctttaataattagaaataaattataaataaataaagccagtctagtttcaggtattattatattaattattgaatattcaatcttttcccttattcacttattttattggctcacagaacattctagtagtttaatgactgataccttttgaaagtaacgtcttaatcaaacactgctcccttttacatgtgggactgggggtaggaaatctttgttcaaaaacagatgaatgacctcatttaaattctcaccaaatatttttgcctttgcatttcttcattagatccagatgttacagcacgaactgcctgtagccatttatactaataatccatgaattgagattttttgctaataatatagcaagctaagtttttattgtcatttttacttaaaatgctagaagagatggaggatgatggcaatttgcagtccacatagtagcctatttccaaacctccctctttgaatgatacattaggaagtaataggcaagatgttgttctttcaaaacttcactgagtcatgtgatttaaaaaaaaagattgaaggacatattttactgatgtatgcaattgatcaacatgagagcaaatgccaaataatttattacttagtcgcaacactaaacaaagatcacattataaaaaagacattactcataaattaaatatatttgtatatatttccatacatatgtgtataagaggaatatgtggtatgacttcttacagaagactgaagttactgtacttcccatgttagtattactatttagatggtatcaaatggacacagtactcattcatcaaaattagtagtgtcttattttttaatacatgcttttaaataaatgacagccacctgtggtcttttagcataatccttccaaatgaaaacttacaatttttctgagacctgctgtttctatgggagactttaatctgctaagatattttccgatttcatcttattctgggtagtatttatttttctccatcttagtttcattataatgactgactttctttgctttctgtcttgctaatttttttttttaatttgatgccaactgttccccatctatttttttaatcctagtcagaaaggtaccagcaataaggagacctccacagaattatgccttaaataaaagctattaatttggatgtttctttccacttgatgacacctttctttctttggaaattcaataacatttaccacaataatctactgacaatataataaaatgctattatatataatatagatagttgatattcatatctggttagtatctatatcacagcagttatattttattcaaatagaaaatctgaattattgtaaaagttaaaaattaatagaaaaattaacagagactattgattaacattatatggagacagattttgttaataagttaatatattcagttttttacctattcttcaaaaagaatgaatttacacattataaaagagagagtaaagtataagatttgacattgttgggacttaggtggtccagtggacaagacttggtggtgcttcctctgcagggggcatgggtttaatctctggttgggggagctaagatcctgcatgccacccagtgtggccaaaaataaaaacaaaaaaaaagatttggcattgttgtcaaggggttttcaacattgttactttaaaaaaatcaataattttagagagtatatgtaaagtacaaggtaacagtttctctaagattcataatggaaaagattatcatatgttaagcatcaaagaagattccacaaatttataaaatcctgacaagtaatatattgaaaatcaaaatgaaaagagttcaaagatgacaaattgtcttaagaaagcataaagaaagatatggcatgagcaagtaccagtgcatatatccttcataattgtattcattctactgtctggaaacaactgaagaaaagagaatgtgcaagcaattattagaaataaaatgaatttcccaacaacacactgctattatagagggcagcatttatcaggaacttactatatgctaggtactattgtacacatgttaactgaattcatacgcaagtaatttatgaagtaggcattatattccattttaaagatgaggaaactatccaaacaatctaagtcacttatcataaactacccagataattctatcctagaaaggctgactccagagcccatattcttatctactacactatacttgccctaagccctacttcttgcctcccacaactgacagaatactttggattggctggaatgaaattacactttcttagaatacagtgtgaatgggggctgatatcccaatttccttgtctctacatgcttcaattattccatgtcccttttataaaaaactgtatttctcagtctcacttatgttttactttagtggagcatttgttttctatctctttctctaaaacaagtgtttttaagagtcaaaattatttttgaaatactcataaatactagaaatcctaatttccaagtagaattcacatatccatacataaggttctcagctgcatatttctccccatcaattaacacaaatgtttggctattgtaatcaatcatattattattgagagcctcaaaatttacataatccattgatgacaaaggttttataattcaattagttcccagaaatttatatttaatatattaaagtcataaagtaggctggtaattttaaaaacactttaatttactaatgctgcatatttagcatttaaataatatgagtaattataaataaataatacaatatttgaacttttattttcatatcttatgatcactttaaaatttttattaaatcaaaaattgcttgatttccaaaaggatggccaatttatcacataaggagttagatgtaaaaacaggaaaagaaaaaattttactgtaaacattctatcttctttatgcataatcaatgaaaatttatcacattaaaacttacataatttagtttaatatcaaaagtaaaacaggaatgctatttactgaaaaccatattttttaaatgaagctctactattcactaagaatactacatattgagatctataagtggctattttgaaagtaggagtacatatatactatacagttctaggagcatttatgtaatgaatataacttcaatatttattgtgtaagtccaataatcactttccaaatttcagtcaactaagaggaaaatgatgcgctaattaaagaaatataaatgtttaacaagaagcagtaatctatatatatgtattgtgcatctgttttatttcttcatttcaagcaccatgagcatttttttttatatataggatgtctctattttcctaaccctacactgtctaccaaacattatacttgcatttttatttacttcctggtttatattttcctctggatttcctttggcctacagctaaatcttatattgttgaaaatcagaattagaaacttgaccctctttttgactctgtctttcacttggcatcagtattctcccattcactatctttatagacatcatatcctcagaatcttccttaattctaggacaccagaaaagataaaggaaacagattctcctctcagattcttcataggagc

SEQ ID NO: 58284 - DNA, 3095 bp, Bovine  19866880805136
ctggaaggggctgcaatggtaaagcgtgtccacaggactcctcctgaaacattcatcactatggaatccatggtgacaaggaagcatcatagatcatataagaaaacaaaccacaatactataggattgtttaatttttcttcagcttatttacattgatgtcatctcattcaaatttttagcagatacacttttttttatttactgtagtctaagtttctttttagcattattgatattatctgaaggaagaagttgattgtgactgaatggtagaagttttttacatttaaaaatatatgaacaagcacttgagactatcacaacattgtttattgtctatgttgctgctaagtcacttcagtcgtgtccgactctgtgcgaccccgtagacggcagcccaccaggctcccccgtccctgggattctccaggcaagaacaccagagtggcttgccatttccttgtccaatgcatgaaagtgaaaagtgaaagtgaagtcgctcagtcgtatcctactcctagtgaccccatggcctgcagcgcaccaggctcctccgtccatgggattttccaggcaagagtactggagtgggttgccactgccttctccataattggctataccccaatacaaaattttttttgtattaaaaaatataatattaaagaaaaactatgcgagcaagcacggacttagaatctttctttcatgcagctattacaaaacaagacaaatctctctccttgaatgaatataaactatatccattgtgtggtaaatcttttcacattttaaaattattttgtgaatattcatctgtgtgtactttaattgggcaagaaattttaggaagtttggaaatttaaaatgtaccaaagtacatatgatcatacagataaaatatggcacatgtctctattactaaagttttatacatctctacatctgtagcaataaaacataattcacaatttttatgtgtatcttgctacaatggtctgaataataactggatataaattaaaaaaaaaaaaagcatatctcttagtcaaagagaaaacaattatttagacctccatgttattctgacctcatgataacctcagtgagaatatacgggcaaaaatgagaagcgctgctgatacgactaggagtcagaagtaatccacgtgttagtaaaacctgtaatatttctcttccactttcagaactgaaacatgatcacatctggctcagtgtatcgttgcattccagatgttaacagagttggtgtgctatcaccctcttaatcacctttcactaaaggaagaagtcagggactggtcacctcaggcaattgctgtagtttcacatgtaagaaactgggtgtttttgaatggttcaaagtttgtcccgtctttatatggcattaaaatcctatgcaatgtcattcattcaaagttccaacatttgagatagcttataccactctgttggattatatttcatttttgaatcagctaggaagtgttatattcattttacaatacaacattgcaagagccaaaaattcataccccatctgttatgaactaccaagtattcctggagaagggctgagaatgaacatactatggtctggtcattatagaatgccaagtgatcaagtgaagtgtgtgtgtgtgtgtgtgtgtgtgtgtgtttaaaaggaagtttggttttttttttagcttttgattttgttatttacttgaagtagacaaaaatgtttaaatgaacacatcactatccaaaattttggaatctgtactatacatatacttaaaatagtatttgtaacctacagatgtaaagtggaaatgtaagccttatactccttgaaaataaaaggtaaaaatggttgaggatatgagactgaaaactactatgttgggaaagcaaaaacttgaagactcattgattgttaaattacaaaacaagagaaaatagggaagtattgatattccctatttgtgacacaagaaaagatgacctggaatgtgatgggtcaatggtgggctagagctactgagagaggactttgatggaagttgagactgaattaaaaaaagactgaaaaacaatggaatggtaaaaaaaaaaattataaatgataaggattgcagtttagtttattagaagttactttaaccactagagttcttgaacaaaagacttggaataaaaatggttatttttgaaaaatatattttagagattttatgcaacatagattcccaaggataagaaagtcatttacaagacgtttagatgtgcaactgtataatcttgaaaaccagagcctgaattttttttatattcaatttatctttgtttgggaaaatatcttgcaatccttctatgaattgcatgagggagtttggagaaatgggctctgagaaaccaaggtaaaaaagatatttgctacaaagctagagcctagtctgggaaaatggtcaagagtcttcaggaccaataagtatctaacatagattcttcatcgcttgtagtgctatttgcaaaatcttttatttctgcaaattttaacaaagcatgaaatgacaatatgtgggagtagaaggtgctttgcagcatccatctattcagttcagttcagtcactcagtcgtgtccaactctttgcaaccccatggactgcagcacgtcatcaaatccatgatgccatgcaaccatttgatcctctgctgtccccttctccacctgccttcaatctttcgcagcatcagggtcttttcaaaagagtcagttcttttcatcagggggccaaggtactggactttcagcttcagcatcagtcctgccaatgaatattcaggactgatttcctttgattgactggtttgatattcttgcagtccaagggactcccaagaatcctctacaacaccacagttcaaaagcatcaattctttggtgctcagctttctttacagtgtaacactcacatccatacatgactattggaaaaaccatagctttgactagatggacctttgttggcaaaatagtgtctctgctctttaatatgctgtctaggtggtcataacttttctt

SEQ ID NO: 58285 - DNA, 1461 bp, Bovine  19866880814749
accttgttagtaatccccttaaagttaatatcttttcgagacgttacctttgttgtcatatacacatgatcctctaaatattgaaatcttttataaagtatggttgctttaaaagctgtctataaggtaaaaaaaaagtctctaaggtaaaaaaagaaaggtgagaacaaactacaacttgtgaatcacttcacgattgtgaatatacactgatgactttaaaatttactaaaaagtaataaagaatatttatttgaaagtattttcctctggaatataaaacataaacatgaaacaatagttatccttgcttctactagtctgaaaaatttcaaagttgtttaaagcatatctaactgtctgagaatgcaggaatcataatatgattctgggtaccttataaccacatctagtgatgtaagttttggcaacaaataacacctgcatttttatagagtacaaatatattcatatatttttcttgctctcttttgaaaaattttccctatctggagtgtttatgtatctgagggacttgatttctaagagaaacagaattattgtaatcatccattcctttacatgctgatgattatctcaaaaatgaaatatgcaattaaaactgttaagaagaacatcaacagattaatgtcagtaattcagatgaaaacagaagcatgtaaaaagtgttactgggtaattttttctaaatgactatgtgcataattacctttttagcaaatattcataaaaacccatgaataacaaattgttggttaccaattcatgtttatgaacactttttctttaagtttgtgtgcatgaaagatgatgcaactgaccatttgtttcagaaataatcgtctttatcttcatgtaaaattaccagtataatatttaattttaacatgttttaaaacatattcatatgttaatatacaaaaattggtatctgacaatcaaaaatagtagctaagtcaaaactgtatttttcaaatattattataaatttttcctttattcaaaagaattttcatacaaaagttaaatatggcacaataaattttcgctaatttgttttagaatgcatagcatgtcctttgtatcaacattatttatttagcaccatttccattcctttactggacaacaaaatcggaagcatgaattttgaagatgcagaactatatccactgtgacaacagtgagaaaagggatcagtctgcacctaagtgtgccttatttctatctaaaagcttacaaaaggtccaaggaggagccgaatattgaagtgcaggaaatttttatggtcaaatacatgttatgtaggcaatacagcacatacccaaccgctgatgtatatttattaacagtatttttcaaaattacttctaaagtgatattaatatattatcaatatattgcttacgagagtcaaggcagtatactcgttagcttcag

SEQ ID NO: 58286 - DNA, 2162 bp, Bovine  19866880927597
taacccaccccaacacacagacccacaattaccatattgaatataatcactatttcagatctttgtcagaacctattgtgcttctctggtggacctgcctgactttatagaaacttgcttcctttttgtaactctctgctgacatgtgcctgcttcttttgattttacctcctgccactcagtctcagcttagtctgaatccctggcacttcaatcatcctgtccatttggtctttgttttctgtttcttcccactctatttggaaatcttgctgatgacctcagactaagcacttggattttacgccctgtttgctcctttcctgttgccacgggagtcattagacttggagcacgtcatctctctctggagttacagtatctgttttctaacctcctgggtttgggtctgtgcctgccagacattcactgtcttcaaggtcattccagttggactcttgatcttggctttcactggtctgccccagctggctctgtgacagtttccaatagttagcagacatgaaagaagtccttcctttcctgtcacagctttaagtaagtcaaatataacacttcctacaaactcacagggccttgttcaatgcagttcagtactgttttcaaatgagcactttctcttttaggttttctcgtaacatctatttctcctcaccacactctctattctccttccttactgtatttttccccactgcacatactatataatatacttacttatttaacatgttgtctccctcctactgctgggacatgaacgtcattaatacagggctttttctgtttttctcactgataggtctctcagcctggaagagtacatggttcatagtaagacacttaataaatatataatatataaatggatacatgaatgaaaatgagtaaactcttggtaggacagacaaagtgggagtaataaaactgcaactaacaatttccatttccggtaggtacactaagactggcccactgtggtattctctaaatagttgggaatttgcactctgggcattcatgtctgcaataatctcactgtttactagcagggaaatcaaaagttaagtttaccttacacaatcctatgagcaaaatgaatagctttttaaaagtacagatttcagtaaacttactgacacttaaaaggcaggcatggcttactctttccattagttattttatgagacagaaatcacattgctcagtgattcctaaccttaaattgctaaaaaaaaaaaaaaaaattacatttttcatcattcatctattttatgccttttgtaactaaaatatgttttattctcattgaaaatttaaagtttggaatctcccagttgagaggaatgatcatacacttgcatttatattggatgttggaatggcaattaatggtgaaatgaaagcattagtagctcagtcatgcccaactctttgtaaccccgtgaactgtagcctaataggctcctatgtccatgggaatctccaggcaagaatactggagggggtagccattcccttctccaggggatcttcctgacccagggatcaaacctgagttttctgcattacaggcagattctttattacatctgagctaccaggaaagctaaaaatatgttttattctcagtgaaattttaaaatttggaatctcccagttgagaagagtgatcatttctcctcccactgtatgataattggattgttttcactttttggctattagagataaactatgagtgttcatgcccaagtttttgtgtgaatataagttttcagttctttgggcttgttgcaaatagcaataatgccggatcatgtgataattttatgttttgttttatttaaaaaattattttctgtattggctatgccattttacattctacagcaatacataagtgatctagtttctctgcaatgtcaccgatatgtattattgtcattatttagcctttgtgataggcatgtggagacagctcacagtggcttcaatttacatttgcaaataaataataaagctgaccatttcctgtatttatttgacatccatgtatcctcctcattgaaatgaaaagtttgtgccttttactcattttgtaaagagggtgcttatttatttttactggttagttttaa

SEQ ID NO: 58287 - DNA, 1119 bp, Bovine  19866880948477
ttaaaagttaaagtggttttatgtatggtgtgatttgtaccagtgtttataatcatgcattttattgtattgtaaatgttcttttagcattttgtgatttttttaacattagacattttctttataaaattggattagatttaaatgtaaactgaattctatcagatcaaagaaaagaatggaatatatgataaacattccatctggtgagcattgagagagaattgcaagtaatttgccatcagtctcagtgcaattaaggaacaaacaaaactgaatacgtgtacttgtataggtcatatagaattaaacccaatttagtgcttcccaattactttgctctcagtatggttcttttccacataccttacttactcaagaatagtgttttcaacagaaagagactcacatacttagagaatgaacttatagttgtctggggaaaggaagggggtaaaggatagttaggtagtttgggaaggacatggacacactgctgtacttaaaatgaataaccaacaaggacctactgtaaagccctcatcaatgttatgtggcagactggatgagaggggagtttaagaaagaatggatacatgtatgtgtatggctgagtccccccactgctcacctgaaactatgacaacattgattatcagctataccccaatgcaaaataaaaggttaaaaaaaaaaaaagaatagtgttttctctcttaaacacaattgcattttattcttccatttcataaaatctttttttttttaatggtcatttttgggtcaaagttatatttattaataattttctcaaacttgtgttttaaagtgagacctttctttataaaaagtggtagtctctaacctctcctcaaaaaactgattctcaaaagcaattacttttaactatgttacgttgttgtatttgttatttacatctaagtctccgggagttagctccctttcccacaaaatgcaacaaaaacactttccttctgtccattcgtaaacacagttatagttctggatagatcacttatcacatttatatgattatgactatgtagacataattcaaaactgagtcatatagaatattaaggctactttttttctttt

SEQ ID NO: 58288 - DNA, 872 bp, Bovine  19866880997882
tttgaaatttgtggtaactggatgtttgttgtttttggctaaaatattctcttctctttcttttcaaggccaatgtaacacaaactgaaaaaaaaaaaaaaaatcaggctccctctgtctttttattcttctaagttttctacaataagatggagaacccttaattaaccacactgtgtctataatagaaaattgattaaaaaaaaatacctgtggctacaggagtaatttctttataaaagtgaagaactcagctgttctatattagaagaaattttgcttgttttcacagctgaattatcttgctttctatattattagggaaagtactaagaaaatcaaatatgagattttcaagggattttaaaggaaaaaaatgcagcttctaacagttaagctttttgttgctagcatatttttttctagatcatgaagcacatactttgtaaccctcatgaaagagcataaaataaatatgtcaggacttccagcagctcaatactatggggcagcctggatgggaggggagtttaggggagaatgaatacatgtatatgtatggctgagtccttttgctgttcccttgaaaccatcacaacattgttaataggctatctccctgtacaaaagttgaaaaaaaaataattcttaagtgaggcagatttaatattgtcaaggaaaaagttatattgaaacagtttattatattagtacagacactggaaaggtcagttagtatgtatccaaaagaactttaattccaaaaatataaccccaaaacaattagggatgaacgcaaaggagcacaattatttataatgatgaataacagaaaatctattcaagattacaagattgaattattctgcttg

SEQ ID NO: 58289 - DNA, 814 bp, Bovine  19866881071980
tcttgcatgaatacagctaaatctttaagattgctgttatttatttaagaacaaagatacttcaacaccttatattcgtatcaagcactaagtaatcataggtaaaaagatctattatcatcacatagcattttcttattactgttttttctacctgttaatatgttacttatttctaagaattatcaagtttttaatgcacttattttttcaaaaacaattgtctttatgaaatatggtaagtgaattagtgaaagtaaaatactgaattcaaactgagtgggtaggatttgaaaatctatgatttaaattattgttaataacaaagaattttactcaaaattgtatttctttttccattagaaatagacttattagatctactgccatgaaaactaatgcattccattcaccagaacaaatgacaactatgggctggttttcattgccatagaaaacagatgaaaatttcaaagttagcttttttgggattggttcctgtatatgcagtaccaactgaaaactcaccccatccttgaagatggaaaggtaaacactccctcaacgttttgtgattcatttatcattcatgataaatgaataatggaacggatgttttatacagatgaatactcttttcctctctggaagaggcaatgaatgaacaacccttcactatcatttgttcagtgtcagacagagcacttggagggaagtttcatgcaacagggttttatgggaagaaaacatcttttgactttttttttttaatgtttgggaatcattttatatgttggcctattttccctcccag

SEQ ID NO: 58290 - DNA, 1339 bp, Bovine  19866881090252
tgactcaatgaacatgaatttgagcaaactctgggagatagtaaaggacagaggagtctcacgtgctacagtccccgaggtcacagagttggacatgacttatcaaatgaacaacaataatccaggtgacctgatttgaaatgtcacatatgagatgctaacttcctataagtatcctcagttcttctcattactaaaaaaaaggaaagaaacaggaatgtatcaatagcatatcttgccatttgtataattaagaatagtgcaatgtttgttgacaatatatccatgattttctgattttttaaagttcctaatatagttatgaacctcatttcaatgtaacaatgaaaaaataaagtgcatgttaagtgatgctgacataaatgacttcttccatgtaaattgctataggtaacagaattcatctttgcagtaaatctttcaagtgtatgcctaggagtaaagcagaacaattttgtataaatcatgttttgtaaaaaaggacgtagaacaggatacaaatgtatgtaacttaatggaaatactatcactaaggatacagattgacaaatggaattctcttgtctccagaagctgtgtttactgcctttttccaaagtgacttaatggatttttaaaaccatgtcttcagttacattgttcttgttaaatggaaactttaattttaagtttctcctgatttcatttaatggaaaagtctcttttgcataatcccatagcttttctttattggaaatatcttttgtaaaatttttctctgtacttatagttgatggaagaattttgaaaaatgaaaaggcacatttcgaccataagtcttgctccttatttaggtatattactggaattacctctgttaaacagctccagatttctcaaatgatataagatctaattaagggaagagagtgcattatgacataaaagatttttttaaacatatattcaaaataaaatttccatatatttgttcaataaacatgtgttgagtgcttactatctgccaggctaaggatcaagaattggaattacatagatatataagattcctagattattcccatatgaactattttttgttctacactttgagagtttttgcctataaaattaaaactttattttctgagctgcaataactttattataattaacgctttttgaaaatagtaaaaactcatcattcacaaaactaagatcatggcaaccattcccaccacttcatggtaaatagatagggaaacaacagaaacagtgacaggtttattttcttgggcttcaaaatcactgtggatggtgactgcagccatgaaattaa

SEQ ID NO: 58291 - DNA, 870 bp, Bovine  19866881313502
ggtggtggtgtgtcaggatgaattgaccctgctgcagaaagtgactaaaactaaaaaaaaaaagaataataatagcagtcaatttagaaagtacttttagaaacattttctaatggagaggtcagtagtttgcccttaaattcatatttcttaatctgtttaaagtatgtcttgtcattcatcatgttactttgcaggaacacttttaactctcatttcattttacttgatgtagtgtagattcaattggcatgctagcaaatgttcagaaacattataactccaattggaatttctctagttggcacaaacagtaagataatgagacaactgcagatttatggccttctgcttcaaacccccattttcatctgaaatgtaattcaaaaagatagtcttaaaacatacatgtataaaatttttcctatgttagaaatataaagtctacaataatacatttaacattcaaataattagctaagctatatggatcaatataaaattaaatttgaaaacatgtcctatatattaataaataaaagtctaagtcagtgccaagagtttaacttattctttgttcttaaaaaacatttgcatcatatactgtgactgaagtgtgggaagtttccaaatatagggaatattacattaccagttttctacttaatctatgtattataagagcacagattcaatgtgattatatacagcaaagtatgttgtaatttgaaggcccagaaattatatttctaatttgtgcacatattacaatttggttacttccagtgtattaaattgttggattattagtgttctatagagatagaggggctttcttggtagctcagctggtagtgaatccgcctgcaa

SEQ ID NO: 58292 - DNA, 1519 bp, Bovine  19866881347818
tcatgttgtctgctgttctctttatgagccaatttacatcttttgggagtagacagggtgaaattcagaatgatttaggaaccagctggatacagtaacttgcccatgttttttctctgcctatgaagagaacatctggctagatatgctggatggagtgtgcttttgtcttcagaaggaatcagacatgttcatgtatttccattctgaagagaaaatgttgctatggtgtattaaaaagaaaaaagtcccacctgtaagtaacaatttgctaatacactatggcagagttatgttctattttaaggtcttggatggaatgcatcttcactgcacaaagagtgaggagaaaatgagctgagaccatgcttgccatggcctttctttaggttgttaaatctcctgctgagaaaacacaggaaatattaatattctgacaggagctgtcaaggttcacatggcggtctcatgccaagcaggcttagtaatacttgaaggaaaataatcctaaacaagctggagaaaaatctgagcataaaattgttaccattttaaggtctttcttttaatattgaaaaaataatacacttattagcagctaagatgataatacccaatctttttggctaaagcatattgccaataattgactaactataccactaactttcatttctaccaagtagtatataaacacatttaaacacatgtatatgacacatatagaattcttattttacaaatttaaaaatagatcttgtatcagaaatagctgctggtagatattgttacattatgtctatagattcctttttcctcccatcatatatcagtactacaaatgaccaaatacacactgacattaaaggtactttgttgttggcaacagccatcatttagacttctaattctttgattatttcctggtagctttaaaatgcaaaaattacttcttgcctaatacatgcaaatactcatccaaaaacgttttattctcagaaagatccttaaacttcattcaaatggtaatgtaataaaactatatacaaatcaattaattatatgtatggcattaattttatcttcatctgtaccacatgttcttagtctaagctaccagcatcccttctcttatctattgaaatacctactaaccaattttccacatcaactgttgcttcctctttgatcacttaccatgtggcatactgagcaaccatttcaaaaaacatatttgaccttgacattctctgctgagaccacactttgtctttccatcactcttgacaaagacctacagggctctgtgtgccccagcccctgcccacatccccagatctctgtggtcggtgtcatgcagcttctttcctcccctcctgtaagtgaggctcatacccctagtaggtctttatcaacttgttcacattgtttggagccctctttccccttctctctgtccttagttaactcctaactcatccctcaaagggagtatttcttactctacttccttccctct

SEQ ID NO: 58293 - DNA, 2404 bp, Bovine  19866880397329
gttcatctagtcaaggctatggtttttcctgtggtcatgtatggatatgagagttggactgtaaagaaggctgagtgccgaagaattgatgcttttgaagtgtggtgttggagaagactcttgagagtcccttggactgcaaggagatccaacccagtccattctgaaggagatcagccctgggatttctttggaaggaatgatgctaaagctgaaactccagtactttgtccacctcacgtgaagagttgactcattggaaaagactctaattgatgctgggagggattgggggcaagaggagaaggggacgacagaggatgagatggctggatggcatcactgactcgatggacgtgagtgtgagtgaactccgggagttggtgatggacagggaggcctggtgtgctgcgattcatggggttgcaaagagttagacgcgactgagtgactgaactgaactgaactaaagaatcctttaataaagaagagtactagtatcattgaacactgaagtaatgctctatgttggttattctgtgtcagagaataatgggaacaatggaactgcattccttgatgatagtgcaaataattggatgccaaagagttagaggccaattaggggtccttattcaccacagaccaaggtggacacaattatataataagccacagagcagtgataaaaatccaaacattttgacctttggggatgtttggtggcactgaccatggagccttcagaaacaaaacaaaagggcagtcaactagggagcttcttggcatgtgtggggagaaaaatcttaggcctagtgggcacaaaattaacttgaggtacagtaatgaggatttattcttatcttgttcctagatttgagctacttcgcaggcctggagctctttatttgaggaggccagggcctatatggaatgacccggtgatagggtcagagatatagtatgactctccctccacgtctgccttaaaggtacctgcagctagttaacaatgattgggtctagagcagtagttcttaaacttacctaagcttcagaatcatactgatggaggactttaaaaacagatccctgggtcctattgatttggtatctttggtgtgaaaaaaaaacagaatctatgtttctaacaagttctcaactgatgttggtgttactggtttagaggctactctgagaatcactccacttggaaggaaagcagatagacctcatgggtttattagatattgtcttttacatgatgctaatgcctgcagacctgaaataccactgaagtccattggtcagagttggaatatttgaagatctgataattctgtattattggatggcccaggtccgtttttagacgggtatctggaaagacttcagaaccagttttttttctttctaacagaccaagaatatatggtaagaatatgaaaatttcttaacaaagaattccctgatatggagagagttctattgcataataaggaccaaatgaagctcctcgatttgtcctcctttgccaagattaatcaaaagcaatacctcatcccaagagaatgtgccacttccaatatttaaagcaattacagagatggtgaatgctatgatagcctccttttcctctcttgctatgtaaaagttagatgggtcttcaagaataaagatatattatcaaaacttaatcaagtgatggtgctaatcacatctgatattcccagggtagtatcttataatgaaagtgaaaaaaaaatttgtaacttgtttgtaactgatgcgggtgacttcttaaataaatcagatagtttttgactactggaagaatatattaccagatttaaaaattattattcacaatgtagtggctacagacatgaaaacctttaaatataaccatataactaatactttctctgtcactttgtcaaatctgctaatttctgtggtgtaaattctctatctatggctagttttaagctaacactgtggtatcactgaatgtaaagttacaaagagatggaaagtagcctattatgtattatttctgtcaaacagttgcaatagacttaaatctcaagaacatatataatagtaaaatatagtaaaataattgagaactgatgaattttgaatatttactacttttcctttaagtataatttatttagttgtaagtttgtatagcttaatttttaataacagctgtttgacaaggacttgcaaacctcaaaaactatactagcctgttttcactaaccagtccatgcttgctctgccacaccattataaaaataaaattgtaaaacagctctgctgttatttatcccaggatactgtattatcccttatgggattctatatcttgtctgcaccttgcaaataaatagtttgt

SEQ ID NO: 58294 - DNA, 1054 bp, Bovine  19866880448499
tgtggggaaggtgggagaaggatgaaaactgcctgtgatgaagacagactccacggaaagatgcaaggaaatgcagtggaatcacagcatattaaattatgatgcaaaggcatgctttgcggaatataaaagtgaataaatctgtaggataagtgacagagaaccttctagagcctcatgctcagttaccagagaggtttatgtgattcatgagctcaatttcaaaatgtcaaaggaaatatcttggaaatcacaggttatcagtcatcaaaaactgcctatgggagagaaaggactttactggagggtcttgttcaaatgcgatgctgagtcaagaggtctgggtgaacctaagactctgcatttctaagaagctccaggagatagaggtgctgctggccctggcaccacagtctgagtcacagggaattaggaagcaggcagggtaagggggacagtctgggactgaggagaggggtttctgagaaaatatcatgtaaaaaaggagcaaagttaggaaacatatttttgcacattatagcaaggtctagtaagcatctctaaaaatggattatccaagcaatagctctgagcaagaaaaaaaaaaaatcaatctacctccagtgatggaaaatgctctaaaatggcccaggactctctaaaatgatcaaatcaattacaaaatcatctacgtgagaaatgcagcccatgttcagaatctacccaggaagtctagggtgatatttacctcgtttgggggctttatttttacttgctatttctttcacgaattagaaaccagcatagtaccttctacactttcttattgactctatcgtccaggaatcaggacagcaggggaaacaatggaaaaagaacagacccccacttctgctgggcgggctcactcccatgtcccttccagcagcctcccccaatcaaatctaacaccaaaggggtgacccggagtgatgggtttgggacaggtgagcaggagagggaacatggggatgtgcacagggtggagtgccatggtttcatgaacacactgctg

SEQ ID NO: 58295 - DNA, 1698 bp, Bovine  19866880449195
taggaacctggcaggctacagtccatggggtcgcaaagagtcggacatcactgagtgacttcacttcaaaatgcaaagaggaaaggctgtaagttaatatgaaagatcaaaattaggtattgcacacatcttgaatagactattaactctattcattaattatattctatacattgaggtcatatactcagctgcctctagaactctgggctttcctttcaatccttttggagcagatactaaactgtccataatgttcccaaagcaatgaccttctatagaatttagatgttctctttgtattttccgtaatgattgggaagtacctaagtttagggaagcaggcatttggaagatacctggaactccctaaatgctatctttttctcctcttttaaatgattagataagatgatcttttaaaaaatttttagacaataatttgcaaaatttttgaatgaattttcaaaattattatgattttcaaaattgttgttacaatttattagtattcagcccacccctgttaaagaaagttaaagtcaaatcttttctccctttattctgtgtctctgctgtatgtaatcaaatatattctcaggaactctctactttgtttccctttattctgtgatgtgttccctttattctgtgtctctgctgtatgtgattaaatatattctcagagcctctctactttccctgattttttctttccgagtgaattattatccttttatgtttattttcaataatgtgtgattcattcagaaagaaaaaagttatctgtaaactctatctcattaaaactggggggtggggagaaagaaagttaaacaggaataaatcacatttaatttttgtcaaaaaaatttaagcacgaaagtagctctacttgaaatctccaaatcttactctatgttgaaaaattcaaatgtgaatttgacagagcatcttcatgtgttaggagaatagatccctattacattattacatcattacatctgattatcattttaatttaaaattttaatttagtcccttggtcatagaaaggatctatctgaatgccactttatacagccataacccagaacaagaacatgtgacattagggtattttaaaagggttcattcacttctttccaaatacagaaaaataatgtcggcctgactcatcttggcttctctggcagaaatgacaaatacactcaggcagacagaaccccatgtcagactgatttataaaagcctggagatgggtgttgtgggaagggaaacctatttgtcaaatggccatgcctgcttacgctggcttctccagtaggcaaggaagccatctcggattaggctataaggaacactggaatacttttttttacattagatatcggaagttcaaatatacttatcctctggaaaagaggtgggtacagaatcgcaaaatgtgaggttgtcacacacgaactgacagcatatgtatgattaccgcccatccaggcagcaaaagagaatcacatctcctcagagcacaggcctggactacccacttcctgtatgcagcacgagggataggtatagaacgagaaaaagagaaatcataaccaaacaagacagtacaaagcaaaagagacaaaccaaccaacacagaggttccaggcaactcaaaagaccaagtagagggacggagcgttccta

SEQ ID NO: 58296 - DNA, 1162 bp, Bovine  19866880460912
agccaggtcattagtttgaattggcttggatttttctttctgtttcaaagagctgtaatttgtgttatgtgcacctcaacacaaaatggcatgttgtgtcatgcatgttttagctccaagtttattgagcccgtatgtgtcatctctcccaactactttttaccactttgaataaaagcgtaggtgttattacggcagctcctaaaagcaagtctattgatctattaaaagaagcacttttaattaagcaataatgtgtggttgaatcaagatgccaagtcgtaaatttctatgaatgattgccaggggaaggcattgcagaaattttagttattcgccagatttgaaagctgttcttccaagaaaatgtctcttcctcattgggaaacccatatatttaatagttgcactttttatactgtttatgttttaaggacgtcaagcctgaggttagccacatttcaagatggatgatcccacctaacttctgctgggacgtccccttgcatatagagctcttgcttccctggttgctcaaatggtaaagtctgcctgcagtgcacaagatatgggtttgatccctggatcaggaagatctcctgaagaaaaggatggccacccactccagaattcttgcctggagaatcccatggacagaggagcctggcaggctacagtccatgaggtcgcaaagacttggacacgactgagtgactaacactttcactttcacattgagaggcatttttccatagtggataatttctccctgttctcttctaaaaagagaaaagattgataagctattaaaacaatctcatattgttgcagactttaaaattttcaaatcctgtgcaattagaacagcagatctgctagggatccaacaaacccagtgtggagccttagaatcatcaggttcttattgcctgaccctttcagttgcctgagtgtccctttctgtaaaaacattaatgctgtagcatcaaggtctttctcagtcttaactcctgccctttcttatcctgaaatcagaccccacctagtgggttcttccctctctctcctatctatccagatttcagccaccgttaagcccgttcaaaacctaccaccctcatcagtcttcccctaaaatcttgacacatcttcatgtttacat

SEQ ID NO: 58297 - DNA, 1164 bp, Bovine  19866880476872
cagtcacctctcatggaaagatagactagataagctaaattatgtattgtattaccacagaagccaagtatttattgcaccattttttttttttgatagggtcaaatgtgatggcttagaaaagattagtaataataaggtgaaaataatacttgatcaaggacaataaaaggcagttattgatacaaagagtttaatccagtaatttgattaaaggatcaaagttatctcagaaaatgtcttctttgtttttgcaggcagtttttcttttcacatgttaaagtctctgttttaatggatcttaaaaacaaacaaacaaacaaacaaacaaaaaaggcagaaatacccacgggaatgcttctagccagcctttgtttggtctgtgaacttgaggttctaaggaatgatgctgggtcatctcagctcttgtttcctcattcagtatcattgctcacctggggtgttttctctgttattcctgtctgcttttcagtgattcaagctatgtgactttctaagtgtttattttgtaaatgaaatgcatttatcaaaagctgcacacagaaatggagaaggcaatggcactccactccagtactcttgcctggaaaatcccatggatggaggagtctggtaggcttcagtccatgggttcactaagagtcagacatgaccgggcgacttcactttcacttttcactttcatgcattggagaaggagatggcaacccactccagtgttcttgcctggagaatcccaggggcaggagagccaggtgggctgatgtctgtggggtcgcacagagtcggacacgactgaagtgacttagcagcaacacacagaaatgcagcaatgaatatctgaatgcaaacagcacaacctgtgggcaaaggtttccactatttaccaatgagaagtaagctgagactcagaggcagaggacttttactgcaaagatatatgtgctttttttttttttttttttttatggaaactcattttataaaggtgtcctcttggctttagctacattacttatccccagaagcagtctttcagtaaagcagtatcacatcttgacagtgattgttaattactttaaaaagactttgtgaaaggttctgttcctttgctactataaactaggtcaaggttgggtttcc

SEQ ID NO: 58298 - DNA, 1580 bp, Bovine  19866880667511
tctatagttaacaatacctcaggtcttagcatctacaaaagacagaagtactacgatgatgtgtacccttttcattgtcttgtagcacatttatcatggctaccatgttcaacattatatcaagactaaatgacctagagaaattgaatactctatgtgacccaattttcatatatgtttttaaaacttatttgcattgacatacttgtcaatgaaaacagtatgtatggacagaaatcattactaatattttgctagagaaggatcatctgttgtagatgaatagaattggatggtcactacatctcattttaataattagctactttctattctattagagagtgaaacagacaaatttcagtttcatcatttttctctctttaggagaaaatgaaaatattcaacaaaggaagcaatttacatattgactgctgctgctgctaagtcgcttcagtcgtgtccgactctgtgtgaccccagagacggtagcccaccaggctctgtgtccctgggattctccaggcaagaacactggggtgggttgccatttccttctccaaggcctcctacacaaacctaacttgacacctttgatagtaccgtccaaaagaagggccatcggtaagttcaggcattcaacacatacaaggagacattctaaaatggagatggtggggaataattaaattaattgaacaaataaacctaaaaatactaaattcttaaactattaaataacaaatgtaaacaagcctctaagaaataagctgtatcttctgcaggatgtcagaaactccctcctacagagacatggattaaatttgaagacagcttgtgatgaatataaaaccagctgacgtggcatacataacactgacaaaagatgtatatattttattttaaataaatgttaaacagatgctggaaggatctaacaaaccctgttagctatgatgtaaaaaagttttaagagttttttttacataataattgcctttatgtcatttaaggttaaggaaaaggctaaaaggtaacatcaccatattttcaacttcagcactttgcctgacgcaccactggaacatcccccatgagcgtgagggcgtaggatagcgccaggccaacctgaccagcgtccaaagctaaatgaggaagaagaaaggaaacatttcagtcccactgttaaccctgaactggactccttctgtcactgtgccgagatcactggcacacagatagtgttacttttactaactactgatagagaccgtgaaagtaaaaaaaaaaaaaagaagaagaagaagaagaaataaaacaaccactatgaacacagaaaactattaaaagagcatattaatcctgacagggttgacagtactcttgacaggtagggaaagaaacacgtcatcatgcagactttcgtcactatggtttcaaggatcatcagtgtaattccactttttacgtgcaacgcagccacagttgaaaaccacgaaaaacaagtcaattggttctaagagccactgcttttaaatctagaatactgctcttgtgttccattattaacccaagattca

SEQ ID NO: 58299 - DNA, 1335 bp, Bovine  19866880671033
aagtatagcctgctagaggatatatattgaacttaagagattaaaatggtataaccattgcaacagaatggaacatatcacgtttctcatttttcccccactaagcatgagtcttttgcagatgtaaaatgcagtcttgtctaattataaaacctggctgaagagctgcagctttctaacttttatactgatgaagtggatattagaaagaaaatgttggcttcacatacagtctgaagaagtcctccgtttgggatttcccatatcaataatttattaaggaaaaatgacacaggtagttacatgcagcccgctgttaaaaggctcgcttgcatgctttccctatttaaggcaaataacaaaagagccaaattatcaagcaggtcttaacataactgggacgttaaatctactatgtcattatgccaatttagtaacattaatgatctgtaatattaattcatcatcctggaaaatagggaaggtttgccataattaactatattaagccacaattaaaaagtcatccaagctgttgtaaagattcgagtgatgataagggtgttcgttatattgcaaacctttctgaccatggacattttgaacataagactttgttaccaacagccccccaaccctgcttcaaattcagatgcgtcaaaagagcagccacccacggaggtggtgacagcgaccagacgccttatcagccatttccatcgccttctgtggtttaacactttcttacagggagaatcagctttgaaagaggtacaaccttttagcatatctactttaattcctcacgggggagcaaaaatgggctgtctagcgaaattcacatctgtgggacagactatctactcccctgagattagggtcatctttgaaattcacatttcaaactgcacaaaatgaacattttgatgttttaaaatgaagatcttgtaacatctaagcctaaatctgagtcgcctatcaccagatgtctacaagctcctaattctcctccccacctatttgaagtctttatcgtggatgggagtctttgagtcatagacaatattgggtgaaagataaatgggaccaggaaaggggtgagctgccgcccagacgatgactgatgtaaccgtccagcccaaaggacttcctttatcagtgacccccaacctttctggcaccagggactggttttgtggaagacagttttttcagggaccggggatgggcaggggtatggttccaggatgattcaagcacatcacatttattgtgcactttatttctattatcattacatcagttcctccttcagatcatcaggtgtgtgttaga

SEQ ID NO: 58300 - DNA, 1384 bp, Bovine  19866880686449
acgttttggttctgttcctcagtttccccctacgtttgagcatgctctgtgtacacactccagggagcgtgcttacaaaacagtgctaagctttgtatccatgtagataatgatcactaaccattgtaaacacagaactttattttttcactctctatgtctttgtttttgaggcgcaatgctatttgataaaagagaatgtttgtgtaaagtgtcccaggagattattcaggaggcagccatggatagagcatagactgagtgtcaacaggagccaccttttaattcctgctctgtctcataggactgtagagccttgaggaagtcacttgtctggaggtccagcgtcctggtcctcgaaccaggtctagaaactaatgtgacacagatttgttgtgagatatgactaaggacttccctggtgcttcagtggctaagactctgctctcagtgcagggggctcaggttcagtccccgttcaggaaactaggtgtcacatgccataacaaagaccaggtgcagccaaacaaataaattaaacaaatactttttaaaaatatgtggggttccctggtggctcagatagtaaagaatcttccagcaatgtgggagacctgggtataatccctgggttggaaagatcccctggagaaggaaatggctaccccacccccagtacccttgcctggagaattgcatggacagaggagcctgatggtccatgaggtcacagagagttggacatgactgagtgactaacactaaaaatgtaacttagattagaaaatgtttgtggcccatggctgattcttggcaccagtcagtcaatagtaattatacgtattcttaagaatgaaggcactgacctttcaggtgttatttctaaaagactaacacattttggaaaggctttgctctttcttttcatgtttttgtagtccttggtgatttgcattacttttattgcttataatgtaaaccacattgtttatagaaatttaaagagcgaagcaaaattaaaaagcaatgcagtagagttttagtgaaaagcctaactgaaaaatctatgaaatgtcttttctccaaggagcaagaggaaagaatatcactttttctcttagttattggctcccctcccaccaggttctttcctgacgatcaccctgtaccccagtcatacttttcagtcccccacgaagacttctggcatttttctcaatgctttcaacattcttgacagctgtcttgctctccttgaagacatgacttctgtctcttatttctattgctctagtttttattgcagcccctgacaagttacacagtattaataataattcctaacacttgggaattcttaacacacgtggcctctttcctaccc

SEQ ID NO: 58301 - DNA, 1598 bp, Bovine  19866880697820
gggttaggatggggaacacatgtatacctgtggtggattcattttgatatttgtcaaaactaatacaattatgtaaagtttaaaaataaaataaaatttaaaaaaaaaattacaaaatatttctaaaattaaagaagacctaaataagcagagagagacaaatattcgtaattgcagatccaacattgttaagactcagatttctcaaaatattctatagctaaaaggaaacattaataaaatgttcaggcttttatttaaaaacaaattgaaagatttctaaaattgatacataaaagtaaagaatccagaatgatcaaagcaaacttgacaaagaaacacaaagttagacaatttaaactatgggtttcatctcttgttaaaatgtacagtaactaagaatgcagtattggtataaggatcaaaatattggcataaactgcaactactccggaacaaaatctattacacagatgcagatttccttaattcaatgcataaaagtgtttaacaaatatgtccagaataattggaaaaaataaaactcaaccactaattactctttcacattttaaaattagtgcaagatgcatcaatatccaaaaaggtagaacacagaaaagtatcttcacactcctaaggatgtatccaaagatttcttaggatacaaaaacatcaactacggttcgatgcacgatactggatgcttggggctagtgcactgggatgacccagagggatggtatggggagggaggagggttcaggatggggaacacatgtatacctgtggcggattcattttgatatttggcaaaactaatacaattatgtaaagtttaaaaattaaaaaaaaacatcaactacaaaagaaataaaaaaaaaggtaaacattagacttcatcaaaattaaaccttgacctccactaaggatataaatggcaagccactgacaggaagaaaatatcatggcattgaaacatgtataatatcatatatgaaatgagtagccagtccaggttcgatgcaggatactggatgcttggggctggtgcactgggacgacccagagggatggtacggggaaggaggagggtggagggttcaggatggggaacacgtgtatacctgtggcggattcatgttgatatttggcaaaaccaatacaatattgtaaagttaaaaaagaaaattaaaaaagaaaaaatatccacaaaggactagcattaaatatatattaaaaataaacatccccaagggggatttgaggaaagcggttggggaagtgatcaacacatcacagaaatctcaaaatgacaaactcattattcagtgggagaggctgcaatactctacacactttccctgacatctccacacaatgaaatgcaagggtcagtggtgttgagacaagtaaaggctgtaaaagcaagtgacccataataacctattacactgaatctcaagctacagttctcaatatccagatgcagtggcatgttcttttgtactcccctttctggaaagaaatgaccacattcacattttctttttcttgggcatttttacttcatacaactgcagtcagtgcattctttt

SEQ ID NO: 58302 - DNA, 1658 bp, Bovine  19866880734520
ctgacattgcagttagtaatgaggttctgtgaggcaggtcatcctgacgcacaggtgagagaacgtggggatcacctggtgcagaatcagaggagatctctccaaggacagaggagccgcaggccccaggagctgacgttctctttgcatgtgtagggatgttccattcatgcatgtggagagagtccccaatcccagaaggctgtttgactagcatagaaaatagcctactttattgttcagtgcaaatgtgaaaaaatttaacacttttgctttgaggcacaaaattcagcttgtgctgaatcgttgtcttggtatttcccagtatcatgccaggattgacagttaattaacataaatcttgatgtaaagtttctcatgtaattatatcctcagtttgtgtatgtctttaagcagacatttattaccagaatggcaatttaaaaaataaaataaaaatttcctttctcttcttcagttattttttttccttaggatgaaaatacttcttcaacactttcttctcttagtgtttaataatccagaggataatgtgtagcacacttcatacaatggaaaattactttagagatactgttttgtgaacatacatttgcaactttattgttaataattgcagagaattttgataatttatattttcattcttttctataaacgttggtttaaaatgaaaagagattatggtaataacatttactattttgtggtatttaggaacctgttttattcactggaacagtgaggaaaaatctggatccctttaatgagtatttgggagaagaactgtggaatgtcttggaagaggtaatttatgtaatgtaattaacttgttagcatcagtatctgtgtgtgtacatttgtagcattgcaggtaattaagggaagcttatcacttgagctaactttgtttactttctaggagaacagtgatgaaatgggtacacttaaaatgtgtgtattgataatgaaaaccaacactataatgcctcatgttttcattttaactttttctatagaaccccaagcaactagatacattattttgtccttagcagagcactaaactagacattaaaactgtgggatcaaattctattagtgacctgctgctgctgctgctgctaagtcgcttcagtcgtgtctgactctgtgagaccccatagacggcagcccaacaggctcccccgtccctgggattctccaggcaagaacactggagtgggttgccatttccttctccaatgcatgaaagtgaaaagcgaaagtgaagtcgctcagtcatgtccaactcttcgtgaccccatggactgcagcctaccaggctcctctgtccatgggattttctaggcaagagtactggagtggggtgccttctctgattagtgacctagtaaattaattatcctaattacctgccagtgttcatttttttcctctagccttaggggatatctaagtggaaacgatagtttatcattattaactgaaagataaacaagatcataccaataaaatactatgaagtttcataagaaagtgtttataaaggcaaattatatagtggaatgtgatgacgattacttattgacgattatatcattttaatgctgcagcatgaatgcaagtaacagaat

SEQ ID NO: 58303 - DNA, 850 bp, Bovine  19866880741944
actgtggtgttggagaagactcctgagagtcccttggactgcaaggagatcataactagtcagttctaaaggaaatcagtcctgaatattcatcggaaggactgctgctgaagctccaatactttggccacctgatgcaaagaactgactcattagaaaggaccctgattctgggaaagactgaaggcaggaggactcagtagttgaagctcatgggctcagtagttgttgtggcatactggcttagttgctccacagcaagtggaatcttcctgagccagggaccaaaccagtgtccgctgcattggcaggcagattcccatccactgtaccaccaggaaagtcccccatcactttccataatactgtccagcttctgaagggctatgtctgatatgtcctaatctcttgcctctcagaccagacccaccttcccccatttccttcacaatagaggtctgcagccactcaaaagagaaggtccagttaaaatttattccctcacatgggactactaacattacatagcaatttatatggctccaaactgaacagtcaaggttacagcaagacaactcatgttataggaggcctattcaccatacattgacataattgtgactctcccccaaacagtggagataattccaaggtaaataatctttccccctggacagtggagcctacctgtttacctaagcagtaggcttgccctacagagccaagtctccatcagaaatctctgacagcacatgtcaggaatccgaaaataaatttggggtaaatactaatccattaaagcaactatggcttgtctgaaacaaaagctccaagaagaaatctaaggact

SEQ ID NO: 58304 - DNA, 1465 bp, Bovine  19866880749649
atgaaccccaaaccttcccaacacatcactgcttcagaattcagcatcataccttagagagcctgattgcgtgggcatgctgtgcagcctctagctgagacttggtgagctgcagctgctccttcaacgtgtcgatctcactttggagcttgtccgtctgcgcccttgtcttatactctgttgtaacagaaatatcgttaaaataccatctcttagaaacgcattggaaaacttacagggtacggtgctactaataagacaaagacaaaggaaactgctttttcttgggatattactgcacgagccaactttactctttactatgtattttcagccctttgcatcattgggcaccgtttatttttaagtagattctttcagccactgggttgaggttggattaccctgcagaggcagggtgagagcccattcagggagcaaaggaataatcctgggctcttctccaagacgcctgtctcaatcagagaaaggaaatcaacggcttcgaccgcaggtaccgcaatattgaaatctctacggtcaccatctttctggctcccacggaactctcctgaacatgtcatcagtgctcagacaagcagaggccggcactcaaaatgcaaacttgggccacaacccatccgcggggcaaaaatgaactactgagaagttgtaaaaggaagcaacaagtgaagggaagaacacttatgttcatgtacttacatgcagatgtacacatgattgaatggatatacatgtgtctgtgagtgtagacatgaaaggtatggaaaccaaagtagaaagtcagaatctcaaagatgacctgaagaaataatactcatttcagagtctgaaatactctctgaaacgagtatgagatagaataagatactgaaacagaagagaaagaaggtcagtttcacactgaagaatgataggttaatttaaaaaatatttaatctccccagtttcttcaatacactgttaaactgtatccacgattcatggcttataagtggaattttatgctattcatattgtttatacaaagctcagctgtttcctaaataaatctatcagaaataggcagaaatggaaacaagcccaaaagggagggaaaagcaggtacaggtaggtagtgagtaacaagctagaaatataaacgtccagctaccaaaaacatttagatctaatgagcatttccatggattactgtggcaatctgtagagttgctctgatctgctcatggagaaataggccttgcattctttgcttctgagaacatttagattagttgcaaacctggttccttgcaagccacagagcccctccccttttctgctccttcaattagcccctctaggcactggttaattcacactggcacccaaacacatcttagtatctcccactgcaaataagacaatactctcccctaggtcccactttccctccagatactgc

SEQ ID NO: 58305 - DNA, 3788 bp, Bovine  19866880797148
gagggatatacctgttcttggattggaagaaacaatattgtgaaaatgactatactacctaaagaatcttcagattaaatacaatccctgtcaaattatcaatggcatttttcatagaattagagtcaaaaaatttacagttttaatggaaacacaaaagaccccaagttgccaaagcagttttaagaaagaaaaacgaagctggagaaattaggttccctgacttcagaatatatcactgagttggccaaaaatttgttacataagattttatggaaaaacttaaacgaactttttggctagttcaatacagatctagagtaatcacgatggtgtggcactggcacaaaaacagaaatatagatcaatggaacaggctagagagtccagagatgaactcacacacctgtggtcagctaatctgtgacaaacaaggcaggaatatacgatggagaagaggtggtctcttcagtaagtggtgctgggaaaactggacagctatgtgtaaaagaagaaaattagaacactccttaatactgtatgcaaaaataaactcaaagtggattgaaaacctaaatgtaagaccagatactataagactcttagaggaaaacacagggaaaacattctacataaataactgctaaatgtttgattgatcttttcatttcagagaagtgtggcatatttttaaaaatcttttctgtttgtttgtttgttgtttcacaaatctgaggaggattgattgttcatgttggtttgaattggtatgtttgtcatttagtgtcaccctcccatggaagctctgaaatctgtaatatacagatgagccttgactgtgagcaggcagatttggaggtatgaccgtttctagtcagtaattctggtttctgaaggatattaccactgagtctttaaacacccaccctgcttttcagcaacatgtggattttgttttcttaaattaggttgattgcttcaccttctcctgcctgaaaagcagtgcacctctgatttcatttaaatttgtgagtctttgcttcagcttcaacatcagtccttccagagaatattcagggttgatttcctttaagattgaccagtttgatcccttgtttccaagggactctcaatagtgttctccagtaccacagttcaaaagcatcaattcttcagcgctctcttattgtccagctttcacatctgtacatgactactggaaagaccataggtttgattatatggacctttgtcagcaaagtgatatctttgctttttaacacactgtctagttttgtcatagctttcctgcccagaagcaatcatcttctaatttcaaggctatagtcaccatctgcactgacttaagagtccaagaagaggaaatctatcactgcttctaaattttccccttctatttgccatgaaatggtgggactagatgccatgatcttagttttcttaatgttgagttttaagccagctttttcactctcctccttcaccctcatcaagaggtatcactaactcaatgaagtcagtttttaagtgaaccaaaaaccctagttattaatttgtaaatgatgcctaactggatatgtgaacccaaactcacagagttaaactgagaattagtaggaggaaaccactgttttcctctttaggaggaaaggaaaagatggcataaaaacatttaaggtcctctagttctgtttcttcttcctctgcagagatggacactcaggaggaagacattcctatggatgctgcctgtctcattttgttatttttctaaatatgcctaaattacatttttcatgtactgaaaactttccaacttactgtaaactgataaaagttcatcagaaattagtgctattggggagctaaaaagcaaaggcagctccaaaaatataacatgagtagtgcctgaagatgaagcactgtatcattcagaggttaaaaggtcatagtagataaatctctggaagtgaatcattgatgtgttgcttccattaaaaagcaaaaatgaaacaccttagatactgggatttggaattaagagtagagtatgggggcttccacagttgctgagtgatgaagagtctgcgtgcaatggaggagaagtgggattgatccctgagttgggaagattccctggaggaggaaatggtaaccgactccaatattcttgcatgggaaatcccatggacagaggaacctggcaggctacagtccataaggcccacgacttagcaactaaacaataacaaaaatgtcctgtcaaaactgggaagaaatagtacaggtaaatgtctgacattgatagtgtctctgttaggacacaagcgtgtctcatcacacaggaaacaaagatacagaaacctgggcatcagcagcctgtgcataaggaaccacgtggttcagtccttgctgtggagacaggtcacatgtccatttcccggggccttgtgttaggtgaacttcctttactgctggccctgctctggtaaaagctcttccccatctgttgattgcatttcagtgtctccttctgagccacaccagattttcttcttgaaaagtaagaaagttccacaaaatgtggaaaccacctgacctctgtgttcccctcctgtaaggggtgacagcacctactacacagagtgcacacagcgatgatggagacaggatgccttaaagtccagtttattattcttcagttttgctatattctattattttcccaagctcaaaaacaatctgaagtattctatattgagatgtatagttttgaatagtagttatttgttctattttccttaaattataactttttcagtgctttcctttatttaaagtgtgatatgatatcttggagccagttaattgttataagaatatatcctttttacaatgacacttaataagaaaacagtgatatatataaattaattatccatatgaatttagtttctatggtatattttatttttttaatataaatttatttattttaattggaggttaattactttctaatttacagaaacagataagtcacacaattacagtcacttatgccttcattcatgttgttgctgtttgtcgcgtctgatcttctgcaacctcatgaagcctgccatgcccctctgtccataggatttctcagtcaagtatactggagtgggttgcgatttccttagccagggaatctccacccaggatcgaacccaagtctcctgtttggcaggcggattctttaccactgagtcaccagggaagcccaccttcatctagccaacaaatatctactgagagcttgttaggcaatgttgcaggttctggggctgtcacagtcatcaagagacaaaatgtctgtccttctggagcttaaattctcctgaagaagttgaaaagcaggccaatgcatatgtaacgaaatctcagtgctgatacatgcaaagtagaaaagtgaagcagaacttgaggaggggctagccgatagcattattaataatgggcaatatatattgatctgttacaaattctgcatgtactgactcatttaatattcttaacaatgttaggaggtgcacacctttataattatggtatcatagtcttagagtttaggaagctaagatagaaggttcaggaacttgcccagttggtacagccaggcaagacttaatccccaggctgcctggcttcaagtctcgaatttatttttgtttggctgccaaaaaaaaaaaaaaaaagtcaacaaaagaacctaaaatgccgta

SEQ ID NO: 58306 - DNA, 1158 bp, Bovine  19866880848615
cttgactagacggacctttgttggcaaagtaatgtctctgctttttaatatgctatctaggttggtcataactctccttcctaggagtaagcatcttttaatttctgtactgaactgaactgaactggaggtctcagcactgactcataaggcttcttctctgagtcttaggtctggagatctgtcctagggcagtcattgcttcctaaaattattaccccagtgattcatttttccagccctccaattcttatgtaacaaatttcctttattaaatcctttctgtctaaatactttttctcattaggccttttgtcctcaacgactcccctctgacagcacatattgtgaatgtcccaacaactgggaaattctgcaagttcacctaacaactgcctggcagtctaatgaaatgctgcttttattaagggaatacaaaaatgctgaaagaactgtgacacagtaaaaatgactttgttgcaccactctgaaatctgaagtctcattgtgagtttggaatattttcatggttggataccttaaaaaaacagcaattcaaataaacttttaaatggaaataggaaattactgtttcctattcctaaacaatactggaatgtattgtttaatagcacattctgaaactacacttaagtacttgagttattgtcaaggatgagaggaaaaaataagaattaattaatttagaagttttaatcaagttttacaaggaagaataaatttaaaaattgaaggtaaatggaaacaatgggaaatcccacaaatggccttaccattatcctgtcactgtcaataatggtgcttaacctgtgtgcgatggttagcacagtacactgtgcaaatttctcacggatcttcttttgtattaactcatcagtgctggaatcaaagaagtgcatttagttaagtaaagataggaaaagcagacttaagacttaaaactatcacatgatatttttatgcttttaaaaatcaatacttaagacataatcctgctcttgaaacactaaatataaaaagtctttgttgttgttgtttagttgctaagttgtgtctgactcttttgcaacctcgtggactatagcccaccaggctcttctgtccataggatttcccaggcaagaatactggagtggg

SEQ ID NO: 58307 - DNA, 892 bp, Bovine  19866880857738
cctaatgcaagagccactcattggaaaagatcctgatgctgggaaagattgaagacaggaggagaagggggtgacagaagatgagatggtttgaaggtatcaccaactcaatggacataagcttgagcaaactatgggagatagtgaaggacaaggaaacctggtgtgctgcagtccatggggttgcaaagagtcagacacaacttagcgagtgaacaacaatgattgtttctgttcaagtattattggttaccttattattattaatcttttctttgtaacacgtgctttattagaaaaaaaggtgaagtatatatttgtcttttatggtaatacaatacacaatttagttcatcttggctatcttttcatgagaggtgcttgtttctattatgaaatatgcttacagtaaagggaatccacaccagacacctgggaggcagagggagaaccacttacccagcatgtgctgcttcagaccaaccctgacatgacagagtagccattcctgtcccaggtgttactaatgttaactcagcctcccaatcacagccacacctttctctcacaaacatggcttttatttaagattaaaggacacatcaccaggctgaaaggcccaccctcaatccctgtgaaaaggccttgagaaacaggctctctgttcttccctgtgagaactctgacaggactgatacattacctggaagaacttttgaaatgatgaaggcagcacatcatccatatacccaatgtctttggagaaacgatttaaaattcttcctgtaagaacgggatatgagaaattactctttgacccagacaggccctttaagacaaacaattcatgaccaaataaaataatattttaaatgcatatttaatatacttc

SEQ ID NO: 58308 - DNA, 2380 bp, Bovine  19866880873852
atattggcctggcaagccagatattaatcacatagttgaggacaccaataatattgtgatctcaaggaaagaaagagaaggaattctaatttctagacactgtatttctccctgattaacttctttcttaagtagtgaagcccaagagatgagtgtggtgaaggggagtttgcatacctgcaagggaataacacatttacgtgggacacttgctgacaaaggatttcactcaggatcaataaaagccatggtttactcagaaagaattgaaacaatccaaacaacagggtagggatccatttctaatccccttgcccattcatgtaatgatgtaagctttagctaaagcaacctattagaatagacaatagcacatatttccagtgactgattttctcaatatgcaattctggtttaacaaccaaaatccagtacagagcaaattaagagtcttcatgcacccactttattctagtagattttaaaaatactcattctaattaattcacagagtaaatgcaactcagactcttcatctgttaagacattactgaattactcctgggagctctagttgttcacacaggctcctagtaaacacctcagactcttgtataacagaccagatgatttacctgagtgaactgttgagtaccagccagaatcaggtatctcaattacccttcctttcccatatttcatggcatatagggtactctgtccatttgccctagggaaaagggaagacaaagaaaaagtattacactctagatagaatttaggtaaataacagaaaaattgacctcgatttagaagacgtgttttacggtggaaaatggttcccagctcactgggccctgtgtccgtctaccttataaaaagtccatttgaatcacaactttcagctctaagaatttgaggaagctgctgagggtcaaatacggggatagtctcactccatcagccagaagtttacttctttttcagagaaactatgtgagagtccgaagaagaggctaaacaagccccaactaacccccctgctgtgggaaagtgaggcttcatgtagacttcacagccctttgggtcagaccaggaatcactcaccagtatgcaagccaccaatcctgcaggacataggtaacctggagcaggaaacaacagtcactcacacactgacatcactgagcctcacaccccgctcactaggttgggagatggaaaggctccagaacgtggagacggtccttccagctcaggtttgtgccaagccccacaccccagatgaccacaggtcaggggagggcatgctacattttaatatctttacaagacattctttttcttcctagaatctttctgttatatacaaacaaaacctcacctcaataagtaagcctcacttattttcctcacagatttcattcagtacaaaccaaaatggactgcaaagcacaataaaaacagtataaaagtcaggacttttcaaagaaaaaaaaatttgataaaaactgtgatgatcaagtttctttgtcagcttgcccaggccagtctctagtggttcaaccaaaccctcgtctagatgtcgctatgaaggtattcagtggatatgattcacatcatcctcggaactgaagtagaggtgatcaccctccatactacggtagccttgtccagtcagtcaaaggcctgatgaacaaaacctgaggcttcctggaggaggaagaaattttgcttcaagactgcagggtcagttcctgcctgaggttccagcctgtaggcctaattttacattcaccaactagactgaacaacctcatgagccagttctctgacataaatctcttaatatatatattaaacatgttaatattaataaattaaataaatacagtataagtataaacaatatgtaaataccaagaagagggcacaaaaccgaaataaatgttcttatttacctgagctgcaatgttcactaaaataaggaaaatgatgataaaccagtgcacaccggctgtgaagtaattctcataggtcttaaaaccaactcttccaaccgaacggccctccagtggtaatgtaacctggatattctcagtctgggagggagaacagcagtgaaaacaaaattttaagtaaggaaccctcaaatttcaaaagtttacaatgccctccactgcaaagctgtgaggaaacagatacatctcatatgctcgtaggactgcaggatggtccatttcctccaaaccacatatgcatttacccttggactcagccatcctactttcagaaatctattagaaaaagaacatcatttgcagaaattattcactgttgtgggcttgctaaagtcaatcatactctcagcacagcacaa

SEQ ID NO: 58309 - DNA, 1870 bp, Bovine  19866880897157
tgttcttgcctggagaatcccagggacgggggagcctggtgggctgccgtctatggggttgcacagagtcggacacgactgaggtgacttagcagcagcagcagcagcagccagcttaggtaccaaaggagttactgagagcagctgggtctcattcatcagagcctggctaaatatggcatctgggccatagaagaataaccaatgttggtgaggaaaatgaatggctttcatactggagcgttaattgaacaagctgatacttgtttcaggcaaacaaatgtcacctacatctcaataacaaaaaattcagatgtagtttaaacttttagaaaaactgaatagagacaatgtatttctgggccaatgtgctatgttataccaacactttttctgtttgtttttttccctctactttactataggaaatttctattgctggcagggcttgctcctgatattttctagcccagaacaggcgcacaaatggaggcccacatatgtctaaataggtagaatcaacctaacagagtgttcaataatgtgttatcctcccaccttgataatccttcccaactacctggaaggctcgattcgaattggctcgattcgaatttagaattcttggattctcagagttcttgctgaaacgtggaggtgtggggcaagcaggcccatgcccacagcccacacctaaaagagcctccctcacagtagtagagacaccccagctggtacaggcaagttctgtccaccgctcccctaccctgaaaaatgggctcttccaggcccaggactactcacacctgcggtgttgcatggtgctatcaaccttgggaggatggacttgggcaacaggcccatgcatgttctcgatgtgggctggagccatttgagacagccattctgggtcctgagtaccctgagtgtctacattagtccttctggatctttaaggtgccagtaatccccccagggatcttgttagaatgcagactcttattaacatgggagcctgcatgtctcaccagtgtccaggtgatgctgatgctgctggtctgtggaccacactcttgtcaagcgagcatctggaggagagggctctggacacgtgtgtcctcttggttctcagaggtttcaccccatgtatactggggaggggtgttagaggagggttagactggggtcctctaaactgtgagtctcagggcagaggcctcttgccctgctctaagggaggtctggtcccttctttgcccacgtcctgatgcatccgtgggctctgttcccacactgcaggccctcgtcctcccctaccagctctgccaccgcagccctttgatctcccacccactcttcccaagtcatgtttcttttggctcctttttctgcggtgttcccactccctcccctgattttctcttacgccaagaaacaaatgtaaaaataacatttcaaaaatattgaaaattaatgctgatgaaatcatggttttgttttcttgggatgtaagcaggcagtaacaacaaccagagatacaacctctccagcgcctggctgttttcctgaacagaatcctactgctcacccattacctgaaatcaggatttccaaacacaaatgtttgctggatcagagcagactggatttttctccggtatttttattttgacaaggctaagaaagctgctttctcatcatctgatggaatcaaataggctgctaaaaataacccctgcaagtttctattacaaacagggaaacacctctcccgctccttgcctgttagttaccctgctgatgaagcttaatccttcgacttgtattcaagtatttgcactggttttgggttcctttattctttctaagg

SEQ ID NO: 58310 - DNA, 1716 bp, Bovine  19866880899818
aaatacctcagcaaataagagtctgacttgcatttactctattaattaattggaataattattttaaaaatctactagaagaaggtgaatgaagactcttaatttgctctgtactggatgttggaagttaaactagaattgaacattcagaaaatcagccactggaaactggaaacatgtctattctaatgggttgctttatctaaatcttattatatggatggacaaggggattagaaatggatccccactctgtggtttgaatttttccagttctgtctgaataagccctgtgttttattgaacttagatgaatttctctggcagcaagggcccccaagcaaaagcactattttcttgcaggtatacaaactccccgttgccacactgctcattccatgggcttcaccaattacttaagagagaagctaagtagggagaaatccaatgtctgggaattaattaggattccttctctttcttaccttgagatcacaatgttattacacctccaattgtgtgattaatttaacatctggcttgccagactaatattaatgtggctctgttttcacaacagtgcctagaatatgtgtagcattgcatactttcaaaaggaaatactcatctaaaattttaaaatatttgcacaagaaacatgcatactaactttctgcaaagatagagtgaattagatctttgtaagaacccactcatagaaatttgttatttcttttgttgatcacttgctaaaaaacctaaatccattatgttgtttaccttctgaattggtggactgtgggggcttaaaggaagaaggaaaagattctgttgtatattcattttggatagtgggctaaggcaaatgcctgttgatggaattcaggaattcgaacagcttccagagttggaataacagtgatgtgaaaagctgaaggagaataaatacctgatggaatatttataacagaagttatttccagtttccttagtatcatgggttcaagagatgtttggagggctattttaatttttatatgcatagtaaatactcatttatgtcattaataaaacaaatttcaataattatgtgcatttgcaaatgctttttgtttctataaaaaatgagaatagatgctcttttaggttaattatcttgtgttaagatataatttgtattttcatgcagttcaactatttaagacattttctacttgcaacttagtatggtattttcctattttttaaagctactgggtattttgttcaatgaagtgaaataatttctcctgtttcctgttaattcacatgctggtaccaaagcataccacaatttcacattagggaaaattttgtaaatatgatttgaaacatggagaaagaacgattaactactttttataattaatttttctgctgagtttttattcagttcagttcagttcagtagctcagtcgtgtcggactccttgcgaccccatgaattgcagcatgccaggcctccctgtccatcaccaactcccggagttcacccaaactcatgtccatcgatttggtgatggcatccagccatctcatcctctgttgtccccttctcctcctgcccctaatccctcccagcatcagagtcttttccaatgaatcaactcttcacatgaggtggccaaagtattagagtttcaactttacaatcagtccttccaaagaacacccagg

SEQ ID NO: 58311 - DNA, 2118 bp, Bovine  19866880924204
tcatgcttgactgtcccttcattgtagaagatgaggagataacagtgcctcatcgtgacaacacttctgtggtgaactctcctcccactgcaagggcaggaggggaagtttggagggaaagaggctggcagtcacgattgctcctcagaactcctaaatagagaagcttagggtcacaactttcctaccatctgcagggaggaaatgaatatatctttgagaagttctttgtagttaaaaacacctgatcataaaatccccacctatttggtgctttcaattttagaaaatatacaaatgtaatgagagctattttgaaatccctcagcagaagactattttgtaatgcaagttgattgctgtgggtgagcctgccttgctttgcatggacgtggaagagaagttcctcctattccccaagttatgctgatctgagtatgtgctaagtcacttcagttgtgtccgactctttgcaaccccatggactgtagcctgccaggctcttctgtccatgggattctctagggaagaatactggagtggggtgccatgcccttttccaggggatcttcctgacccaggaactgaactcatgtctcaatatgtctcctgccttggcaggcaggttctttaccactgctaccactggggaaagccccatgctgatctgagtattgagaaagaaatttcgcctccccagtctggctgtacaattgctttgctggactggaaaggtgggtggggtagaatcctgtgctgtttgatatgaagtcagagagcttcacaaatacaggatgttattcatccttcatcctgagattcccaggggagccaataaaatcattttaaaagcttccctctaaaggtaggaaggcagacagaggttggtgggcaaggggaagctgagagcagacccgggtcacttagaaccttctgctttcctggagacggcatatcctcttttccttacctcactttaaaaagctcagaataattaagtcacttcctatttaggaagactagcctccatactgctgtgtctgcctgggtaccatggacatccatttcaatgagcatttatttaccttagactcacagtccttgaacttgaaagagaagtgattatcttataccttaatttcttaactctcatgatcattttacataaaggatgatttcaatagctcacatttcaaatcaatcataggatatgaacacttcacagtcctcatctcccaataacatttacccaagcaaagatttctatgatgctcaaaacctgatcatgagcttgatccctggaccagcgatttcctgattctgctcccaggacagttccgggtgtcaatggtggagatatatcagaggtcactgattcctgggtagggaggatctgctggagaagggataggcttctccagtactcttagacttcctctgtggctcagctgtggtaaagaatccacctgcaatgcaggagacctgggttcagtccctggcttggaaagatcccctggagaagggaaaggctactccagtattctggcctggagaattccgtaattgtggacttccctatagctcagatggtaaagaatttgcctgcaatgcaggagatgggagtttgatccctgggtcagggaagatcccctggagaaggaaatggcaatccactccagtattcttgactggaaaaccccatggacggaggcctggcaggctacagtccgtggggtgacaaagagttggatacgactaagtgactaacacacacacacacacacacccgcaatggggccccactggcaaagttactttttctgattcagtttctatcatgtgatgccccagactgataactctacttgcccgtcagctcgagcatggaaccagccatcattactctgccagcccatttgggaggatttgcaagtcatctttattagcgctgtccattccagtggttctccgggctgtaattgaagtaaacgaggcatgttgttgctacatttctgattctctcaaagaggaggcagacagatgaaggcagaataaatagttcgctcaggtcttcttaaatgcctacaataagttgacagggaagggagagaaggggga

SEQ ID NO: 58312 - DNA, 907 bp, Bovine  19866880976828
cacaccgaattcaattttttaagtaaaaccaacatcacaaattatttttcagggccaaatttttattgtctagaagttcagggtatcacaagtggaatttgggctaataaagacaaagtttcattttcttggcagagctgtttttataggaaactcatacaatcagagtttcttcagcaatcacatctaacaattcctgaattacgtaaaactgccggccctcgtctctatcaacttgtagtatcctggacattacaagccatttgatacagtggaaggcagagtttacaattagaatttggcaggaggactagagtttgtcacttacccttttgtgccattctatcttaaacttgttggaatgatcaccattatctacagatttggttcatattctggacactgaatattcaatttgcagaaatgattattaaaggggctttcagatccatggatgaaagacataagtacagagaattattattattattagtcttgattattgttattattatgatggctggctgttattattgctttattgaaacttgcgaagattaatagttgtgctgatgatcttgaagttcttagctcctttgtcaatactacttgatctatttagctttaaactgttaaggatttaagccaattgaactattggagcttggtgaaaatagctccaacagagttggaggatgaatcatatcagattctgtgagcaagatgtaaggtaatactcaaaaaatgtgaaaatctctctttattggtgcccctcctatcactacgctgagacagatcattttcatattctatggaaatcaatcaccttataagaaggataatttggcaagaatctactctgttgacagtttgtctataggttttgaatctagattctctaaatgtg

SEQ ID NO: 58313 - DNA, 1896 bp, Bovine  19866881021398
ctggcatttaaaatgagcatttcaatcgcagcagattccagcaagggagcatggctaattcatgcagccccagcctgggcagggcgggatccacatggaacacgatgctctaaaactgacagacttgttgggaccctggaatcagccccagatagcattccatgcctaccatacgtgtccctgctcgggcaccgaaaatataaaacaatgaaaacacggccctcatataatgtcagataggaagctagcaaaaacaaaggggaaacaaaagaaactaaaatacatgttgatatacaaaaagaaatagccagcaatgccttataaaaatcaaccctaaaaaaggaggcaacagagagatattaacctgacataaataatatgaatagacaataattgttagaaatgatttcctcctatattcatatataattcatattgaatatattcatatatttctctctgttactggttcaaaggaaaaaaaccctgcatgttctaaacacttgaagataacatccaatatgtgaagaatttatgcattacgtattataaacacatgcccaagggaaccaatccccctgaaatgatcttaggaaaaaaatcaggggcagtaaacacttcatgaatcagtcagtgagtaaagagaataattacaaaaggccatcatacgtgaaccacaatatttctgaagacaaaaaatccaagtcaactggccatgggtttaagtccaaagtaaaaggctaaatagagaagtggaataaagtaatcattagattccagaaacatttgtaggtaagacaggaaaaagatggtccccctcccactttaaatcacttaacacacagcagaccacaggaaaacaatatattgaaaacataccataaaaactgctagcaccttagttgtataaaagtatgtttataaatattcaccctgtctactggatcatgttaataacaattattaccctgtgacctggtccaagacctggatcctggcagtaatttcatccaggggggtcctactttttcctttggtttccatcacgtgtcttttctagattttctcaaccaatccctgaaactgtttgcttaaaaaaggtgactggcttccacattgaaagttatacaaacaatcacgtatgccctgtggcatgtgctggttggctggtctagtaggaaagtcacccttttacccgatacctactactttccaccaaaaatcacagatgctccaagaactactcagagttaaaaatctctacttgtgagcccagcaatagatacattttctactttatgcctgataggtttgactagttcatagtaacattacataggaagactgcagttttattaactgttctgcattcatcaaaatgttttgtttgcataaataacccccacagaagcacttttcagttaataagttatctaactcaggtggaaactgtatataaaacgctgagactttgctgaaacttaccatgtgccattggcagacttgacttcgcatccagtgtctgggtggctggggcattcactgaaaaagcataaaaatgtaattacagggtcctgtatttacagcatctacatctgaacatgaggataaactgagtattcatcaaattagtcaaggtatattaatcatgaggggacaaatgtttcaaatgacaaagatagcaccaactaacctaaaccaaatttataacaatttgaaatacaatccacccttttcaaatatacaagtcagtgggttttaatacagtcacagaggtgtacaaccacaaccactctcaagtttttgaacatactcattacatgtatacctccccaaatacccacatttattagccccatctctccctccctgcaggcccgggcaatcaaagatcta

SEQ ID NO: 58314 - DNA, 2626 bp, Bovine  19866881034548
ggtggctgttctaaccctccgactgtggtttgctaactcttttcgagagtggagggtggcagatgtgattgaggaaataatttcctgatttgctacccacttgattatgttgttatcagtgaaattttttccctaggtagaaaattcgggatttcctctaagtctataaaatccaagccaaactttccaataattattgtattttgaagatataaatggcattttgaaagtcacatgcagattctgttagctgatggtcatatagacactggctcctaagaataaacactatagggccctgtagtgaggacagaaggtgctggaaacagtgtgagctgtgctctctgctatgtgagagctggtagcagtcggccctgtgagaggatgatcttcacgctgaggcccagcactgcagggaatgcacagatgagatgattttccatcttccttcttgtgatcctgtttctgttgataacctgtgggttgaaattttcagtgcatgcttcctggactgattcctgtgtgtcccatacattgtcttgtgttagaacctagttttctggaatcttcaggttccttgggtgtgtaactttgctgtcctacctgtgtaaaaccttctgtagctcaactgagaaaatactctccctcatgagaagcagctaacatgtttttttctgtttatatattgcacttattatggttcacaaatgcagaggcttggttcctgcttttgacgacgtcccgatggctcgctgtgtatctggatgtcatctgtgccatctttgtcactgttgttgcctttggggccctgattctggtagaatgtaagtacacatgtgaatatttgtggtatgtttacatttgatagctttgtttgtagttattaaactgttgtcatcttgtctaatatatactctttgattctaatgagttgtattaaagtgtctgcagcatgtgactccgcagggtgtccatgtgaagtcatttatgtcttgatgagaacttttatcttttttttttacttttacttatttatttacagtaagcccttgttgggataatttttaaaaaatttttttgattggcatatggttgatttatgatgttgtgttggctttgggtgtatagccaagtgaatctgttatacatatattcacgttttaaaaaattctttttccacaccccacgaacattggggtgcctgtattctttttagtaatttgcacttgattaataattcaaatgaatagtcctttagaaaagaatttctggttttgacttttggaatctttaggagcaaagaccaggtatgacatgcctgctgcagcagacctgtggtgccttgggcccctgctttggctcactcaggccattctttcatttttattttaagttttattggggtatagttcatttacactgttgtcttagtttccgatgtacagcaaagtcaatctgctatacacatacatatatccactcttttttagattcttttcccatatagatcattacagagttctctgtactttacagtagtttcttattaattatctattttaatattttatatatagtagtatgtatgtgtcagtcccggtcttccaatttatccctcccctcccatatcccctggtaaacataagtttattttctacacctgttactctacttctgttttttagatatgttcatttgtagccttttgtcatattccacttgcaagcaatatcatattctacttttctcagacttatttcactcagtatgcaaatctctaggtccagccatgttgctgcaaatggcattattttgccctttttttatggctgagtaacattccattgtatatatggtaccgcatcttccttgtccattgctctgttgacaggcatttaggttgtttccatgtcccggctgttgtaaatagacctgcagtgaagactagggtgcatgtatccttataaattatggttttctctggatataggccctggagtgagattgctggatcttagtagtgagagagtcaattcctaggcagattgataagtccaggggtccccaaggagagaggggtctggaattcttaaggaggaaaaaaggacaaactttttttgtccctctacattccttaggattatataacaataatgtatcctgcttgaggacagtctctggaaaaaaaccttctggctaatcctattatcttaaggtgcaaattatgggagtagatctattgaggtctttacaacctccagacattcttttgattcactgtaataactaattagagagtatataactccatggctaacactagcaagggggtagtctttctgcccccttctgatgcctatgtcagaagctttctctatctcctttatactttaataaaactttattacacaaaagctctgagcgatcaagcctcgtctctggccctggattgaattcttctcctccagaggccaagaatcatggcatctttttgtgtgtctatttttagttttaaaagtaacctccatattgttctccatagtggctgtaccagtttacatggagggttcccttttctccacatcctcttcagtatttattgtttgtagactttttataggtcatt

SEQ ID NO: 58315 - DNA, 978 bp, Bovine  19866881072979
tcctctgtccgcaggatttcccaggcaagaatactggagtgggtcaccatttccttcttcaggggctctttccaacccagggatcgaacctgagtcttctgcattgtaaacagattctttaccaattgagccacccagaaagccactcatcacttataacaggtttggaaaataacagacactcaataaatattagttataatttgaatctgtccacacaaagaccttaatctattttttatccatttccgtgaatgattcctgggccttgactcaacttatagaaacctgcccagggtatagaggttccaaaccatcgtattcttgcagggaataactttgacaagcagctcacttttcccccacctccacccaaatgcttccaaaagtaggctgaagaggagaaatctatcgtgaaactgaagagctcaagaagtctctgaaatgatatccaagtaaaatttcccctaacatttatcccatcaattttcacagcatctgggcaactttaacaattttataataagtttaaacagctaacattctgcttgtgtgtttttacttcaccagaaaacaaattggaaatgcaaacttagcatctgtgagagcttttctttttacaaaaaggaagaaaagattgaagctaggatgaaaggatttaaggaacaaaatgaattaaaaaaaaaaaaagaactaaaaaacacctacatagcatgaatgacatcaaaattaaacagttgtaagcaatataactcatccatcttttttttctctgtaacaagtgcttgacttcttcacttaaaatattttaattcacagctgtatcttattttttctccaaattactcatcttatagtaagatattatttaaatagcttttatttttaatttttccttaaaatcatttttcctgaaaaacagggtaacatttgtactagggagacactacgggcatattttattggtccaataatagt

SEQ ID NO: 58316 - DNA, 765 bp, Bovine  19866881154981
aatttaaaaaatattctcccggtatattcattcctgtaggtcagatttcaccattacagccccaaagtcggggggaaagggtaggtattgccaagggcaggaggaggacatgggcagggaacgttggctaggtggagaaggtacaggcaggaaggcacacttgagccatccaagacctgataccaacaacaaacacaaggtcacaaaagaactatactgatagccccaagggcccagtcttccctgtcaccttgatgtacactctgagctgccattttggaatggagcagagggagagccaatacatctgaaaaagtgagtgttgatccaaaagagagtaagttaccctaagcatatgcttaagttagtgggtcaggctgagctgaattgtattgccaacaatgaagagcagatgaattatcatgagggaagaaagaagagattgttctctttcatacttacataatgtaagtacacttgcaactctactatgacactattcacatttttttaatagtacatgggatttcatgcttttctcaagaccacagcattcaaagatggttacaagagttttgcccaaggctcagaaaagtactaggaaaatatgcaggtcagagaagaattgagttgattacagggatgtttatgagccccattgcatgaaggtgggaattaggaaggctcttaaagatttataagctcagtggtgagactagttttagagctgccactcatgaagctttctctccttaagaccattct

SEQ ID NO: 58317 - DNA, 2507 bp, Bovine  19866881158616
cagaggttctcaactcctgaaggcaccttctctctcagaggtattagtcacgaaggaagtatggttactacaaaactcctgttgtttcccactgagatggtagatattatgtgttttaaaagtaatacagaaaatgaaacccatactttcacaggagggtggagaaacagttattccctatgttttaaaggaagaaataacagaaagaccagtgataaaatgtgaaaatagaagaggcaggaggtgtcctaatgagcgatggaaggctgtgcgctgcagggaggtttcaagcaaaggcccctcactgagcagaggaagaaccccaccctggatggattcttcaccaggtgcttggtccgcatccagaacattcctcaagatgtgacctggacagtaagagctcttctgcggctcctttcacagaaatcgtcttagggacaggcctgaagtgctacaaagagttcctaagacacaggtctttgatctttgtggctttgccatgtatgtttttaaaatttctggaatgcacccagggaggcaaatggcttgacagcaaacactataaatatcgaaataaataaatacatacaaacatctggaaccctgattaagcaccaaagttttttttttcagggatgaggggtgtgggtagcagagaagaaacccccactgaacagcatttttatttttatggaaaaatgtcctattctttccgtacgataaacccccctctgacatgacaaaagtttcagaaagctgaagtctgtatgtcatggggaaaggagagtttctgatgttctatagctacaaaagaaggaacttcagtactagcccagaaaaaagatgggaccaaaattcacttttttaataactcatcgtggaatggtataaaataacagtcattacctagaactacaaaaataaatccagacaatacggtaatctcacttgagtttgatgtgaagtttgcacagattttacaaattactcattatacaacaattttccgtgttaaaaggatgctaaaatacattgttttttttcctctttatgaggtcctctgaacaataataaacagtgagaatatagaatttgccatggttatgcctgataaaattaaattaaaaacaaagaatcaaatgaccacaaaccatgtggttaagtgtgaattaagagtaagagttgggaaagtttaaaaaaaagaactgtgtgtgtacaagcatgcgtgctcagtcatgttcgactctttgtgacccgtggactgtagcccgactgtagccaggctcctctgtccgttgaatattcaggcaagaatactacagtgggttgccatttcctcctccagatctctccaacccagggatcgaacccaggtctcctgcgctggcaggtggattctttgccactgaacccccagggaagtgccatttaaaaaacgaaaatgccccaaattcccaatctaccccactacgaggttccacaacgtgacagacctttggaaagccagaaaagtgtatgatcagtcctctcaccaagcagatgctactgatctcaggacagagttgaaagccttcccatcctggcctgggtctgctccctccatcctgcccacagtgatgccactccagacaagcagccttccctccctggtttgcaggtcccatgtcctgggtaatccagactcattctctggaccatcctgtcatccaacagcagcctctcctgaaatctgctcaggtctcttggcacacactgagcatctttggccctatacagccaatcacagcttcttccacaatcactactgtattcagcagaaaacacacaagtttggatgacgccatgcatgatttgagaaatacgtatggagcccttaccccagcagatggattaaaaaaaaaagatgcatagtgcttatagactggcactagagaagagatattatgtgaatcttgttatgagaactgagggcaatgttgagccaggttgacactgaccacccaaaggactgatgaaaaaggatgtgaaaggtgggtttggggacacagggacagtcattggtcaaattcaaaagaagaggaatgctgcaccttctttacgttgcactgcaacacagacagcaacttgtccctgtgacaaaaacatgatggctaggcagagagagatacctccagctcccaggaatcccgccccctgcctccctagccgctccctcccccaacactgcctgaacaacaaaactagtctaaggactgcctgggcacctccattgctcatgctaaatgaggccatgtgctcccagaaacaacagtcacatgtatatggtgcctgtctgcttccatctcaaggagagtaggatctatggaaattgtgtaaactcaacaaagaaaagaggacttcatcatgcctgtcattctaagttccttcctagcagcttcaagatattttaaagttccaaggttgcattcaattgtgattccccacttagatcgtagccaacttctcat

SEQ ID NO: 58318 - DNA, 1173 bp, Bovine  19866881178239
taatgttatatgggtttctgggggggagggtgaaggtgatgtggtggggactggttttatagtgtggtttgttgtttggtttcggctggtaagctatattattaaatatgtttataaaagtttggagtatataaaactaataaaataatcttcagtgcgcctttcccatagacttgcctttgaagtacagtgttgtggtttaggtagtttcaaggctatatttattctataattttaaaatataagagttaataacttaatagtagcaacttgaactgtaattttaattgtgaaactgttcttcctcttgacatcacaattcaatatagttagggtttaaaaatcaggccacaaagaagagcgagtgcactcagattctattctcagatactatttcatggcaaatgatttccatactctttgccctttgtccttaaagctcccataaggtagaccagtagcctgaactttgctggcaaatatctgaatgaaacagcatcaaccttatgtgtgcttggaacattgggtgcttgccattgtgtaggggtaagaggagaaatatacattctcgaagttcaaaaacatgtattgagcccccactctgtgccaggaactgtgctggttgtttctacccacagtatgtcattcaatacctctatcaagtccaggagcaaggagctgagaccacttacattccacaaagggacaaagtgaaagcgtgtccgactctgtgactcaatggactgtagcctgccagactttctctgtccatggaattctccaggcaagaatacgtggctgggtagccattcccttctccatggaatcttcccgacccagagattgaacctgggtctcctgcattgcaggcagaatctttcccatctgagctaacagggaagcccaaagggacaaatgaagtggcaatatcaggatttgaactccagttgtctgattctaagcccactgtacaccattcaaaagccgggatgaaaatgaatttgggaaaaggagacagtgtaaccatgatataagccacgttccatcagaacacaccacagagcaggatatcctaccattctgaaaataggaaagcaaaataaattgaggtcttgcagacttgtctgcaaggatgctggtaacttaggccattacaatgttctgctcccagct

SEQ ID NO: 58319 - DNA, 2603 bp, Bovine  19866881194312
attcttgcctggagaatcccagggtacgggggagcctggtgggctgccgtctatggggtcgcacagtcagacatgactgaagcaacttagcagcagcagtagcagcaggtgagaggtacatgctcagattcccttaattatggagacacactatcaagtatgtcttgaggccttggtttaaaaccctgctcatcacctattaattcactaatctaaattgaaaatttctgtaaggaaaacagaacattagtgtcctactgcatagcagagacatttcacaaggtatctaggatcatgtcaacaaaaaccacatcaggagtacattttaatgtgttttcgatagctgtttcaatagctaggtcaaatagacatagtttgtctaaacctctccaaaatagcacggatggaaacaatagttagctaatagccttacaaaattgcgtgtgggtgctaagtcgcttcagttatgtccaactctttgtaaccctatagactggctgcagcctggcagcctcctctccatgggattctccagcaagaatactggagtgggttgccattgcctccttcagatcttcccaacccaggaactgaatctgtgtctagatcccaggattgagatgggtaggtgaagtctttaccactagtgccgcctgggaagccttaatcaaagaggtatattctaataccaatttaatcaaattacaaatcattgatttaccttttttattttaacaagataacagtaaaggttacctgagttgagagaatattttttcttagagaatgttgataatgacggtttttatcttttctaatgtcagtgcacaaaacaggcacagattgtgtttcatccagggacatagttcataagtcaggatattgtattacaaatacaagctatgtgatttttctttaccttcatgaataaagtgctaatgttttatatttttctccatctttaaaatgaggtcagtggcattaagatacaaggaaacacctcatttaaaagaagaaagcaaccataattaggaattaagggaaataaacttaagaagtgagacagtgagaagtgaggagtaaggccttatggagaggtgaaccaagcacaattgtttgaaaagtgtttatactctcaattcacaagcgatatttacataaggcagtgtcagtaataacagcaaatcatcctcagagtggagcagttcactgtaatacgaaggcaaaagaaatacttcagagtcatgttaactattcagtgaatctgcagcacttctttcttcatgaataacacaaacacacaccaaaagcactgaacaattacatgttaattttcctctgattttttttcagggatagttgatttacaatgttgtgttagtttcgtgtgtacagcaaagtgactcagttatatctctatatattctttttcaaattcttttccactatagttccctgtgctaaacagtaggtccttgctatttatctattttatatatagtagtatctattaatcccaaactcctaatttattcctcctcccttttccccctttgggaaaacataagtttgttttctgcgtctgtgagtctacttctgttttcctctgatttttaaaagacagctattgttatcagaactaaggagtcagaggtgataactgctcatatttcgcatgtattttaataaatgttggcaccttcctttttgtgtgtgatgacactagctgtatcgcttctctcttcgttctcctatgataccttctgcagtggtgatggaagccgagtggcagggccccagacaaagcagagccctaaagatgctaacatgctccggaggactagcgagccttgccaccctccttcttgccaccctccttcttacccattcccctcaaagtccgaccaataaatagagcccagcgccaatacgccttccacccggaaattctctgatgaagctgcctgatttgaatcctaactagaaaaaccaaaggattcgagctcagactccaggggaagatgaataacataaatggccttctcccctggaaaaaaatctaattatatgtgtatagatttttttaaaggttggcactgaatactcagaaatatattaaaatcatatttaccctcaataggaaaactgaaaggggaaatgatattctgagacaaaaggccaactttgaaattcgagagacgatgacagtcacaaaatgcagacatgggatgaaagggtacccataaaatgctgacaacatccttctcatcagacatgtagggagagtcagaagctaaaaaccatcatcctttcactgtccccttctgagcatcttctcagtaagtggaagctccttttctcaccttgaacttaataaaaaatctttttgaacatgagggttttgttgttgttgttgttagtgatgtttatggatttgctataaatctatcctaaagaattcaacagttgttaatatactgtcattactaaaattaatataaataataacataggaaggcaagacagcatagtactgagaacatgagccttggactcagaaaggcctgactttgagttcgatttttttaatgaccagagaaacg

SEQ ID NO: 58320 - DNA, 1303 bp, Bovine  19866881201709
atgggagacggaaagggtccagaatagggagacggtccttccgactcaggtctgtgccaagccccacatcccaagatgatgagaggtcaggggaagacatgttatatgtctgtaaaatgcattcttttttttttttttttctagactctgtcacaaacacataccaataagcctcacttattttgttacccaaagatagcatatttgaatgaaaatccaaagtacatgtcaaaaaaaaaagtaggagtgtaaatgctcagggttttgaaggaagactcttgacaggtactgtgatggtcagttttctgtgtcaccttggccattccagtctctggtcatttaatcaaacactcctctagatattaatgtgaaggtattttttgtggattgtggttcatatctataactagtcaacttaagtaaaaataaccatcaacaatgtggtgggccccatccagtcagttgaaggatgtaagagcacaacctgaagcttcctggaggaggaagaaattctgccttaagactgcagctcctgcctgaggttccagcctgcaggcctgctcttctgctttcagattcacccaggtagatcccacagcttcatgagccagtttttttaaataaatctcttcataaacataataataattaaataaatagatacagtataaatagtatgtgaatagcaagctaaggacacacaccaaaacaaatttccttacttacctgagctgctatgcttactagaacaaggaaaatgatgacagaccagtgagcaccagctctgaagtaattcttgtaggtcttaaaaccaacttttccttctaaacgtctctcctcagatagtgtatcctgtatattctcagtcttggagggaaaaatggcagttaaagacaaaattttaaataatgaactacaaaagttcaataatgccctaaattgcaattctgtggcgaaaacagaccacacctcacatgctggtaggagtgcaagatggtccatctcctatggacagggtatggaaatatctaaccaaaccatatatgcattgactcttggacccagccatactacttctagtaatctattagaaataaagaaatatcatttgcacaaggttattcattgttgcgtggctttgcttaaagtagcagtgctctgtgatgatctagatgtttgggacagaggtgtagggggaaagggagtccaagagggaggggatatatgtatacatacagcggcttcacttcattgcacagggaaagcaacacaacattgtaaagcagttaactccaataaaaaa

SEQ ID NO: 58321 - DNA, 1347 bp, Bovine  19866881211842
catgcattggagaaggaaatggcagccccactctagtgttcttgcctggagaatcccagggacggtggagcctggtgggctgccctctatggggttgcacagagtcagacacggttaaagcaccttagcagcagcagcaggtgtgttgaaggatggacctcctttctggtcattttccttggattcatggtaaacatcctcttctccctcagtttttcatccccttcttctcagagctggtgttcacaccttggaggatgaacttaaagctctgtagaaatgtcactattacactctaagccatataaaccctaaagtgcataagagtgcaaccacaggattattgaatcattactgctctaatgaagtgtgttaaggataatgatgcaattttatttagaactttttattttcctcttccatgacttaagtcaaagtgtattacttacaaattagagattctaagatctgttagtatccaagtgattgtcatacctaggttgcctaaagagcatattccattaacaccagaagtgaggttgggtatctgagcacctagatcagagacacccactctgctggtgtctccaattgctggtctcactgcccaggtctcttgtgtgtgcagcaggaggacaaggccctgccttcatggggctccttttatggggagggtgtgacaaagagggtgacttcctggctgtctccttgaggagctggtgcctcctggggcctgagtgacatgaaggtgggggccacacagtcacctgggggagggaatctgaggcagggggtcctatggaagggagctgacctggcaggttggaggaactacaggaagaccagcatgtctgaggagagtgagcaggggatgtggaggagctggtctcctagcaatggccaggggaccggaagtggcatggaagtcttggatggtacagagcagaagagggatgtggtctgatatcaaatttgagagatttctatgatggtcactggaggggtgacagcagaagcaattctaggtcttagtaaagttgagaagacagaagtgtgggctcaggctaaagtatcagcttctagagttgctgtaaccaagtactgcaaactgggtgacttaaaacagcagaagattatcgtcttcctgctctggaggctacaggtcccaaatccaggtgctgacaaggccgtgctctccctgaaggctccagagaagaatccttccttccagcctctggtgtttgccggccttccttggtgttccttggcttccaactgcagcactgtggtttctgcctctgatgccacttggccattgtccccgtgtctgagtcccttctcataaga

SEQ ID NO: 58322 - DNA, 1094 bp, Bovine  19866881244142
atacacttccaaggatacaatacaggggatgtggaaacttggcagcaagcattggctcaacaatgaaatcttctactagttctattctgacaatttctaactctccgagagactctatactatttgaatatcttaagcttcccgtgcctctcgctggctgggagactctaaacaatcatatgcatagctataggggtccaggtaaacctgtcaggcaagttagagagccatctgaggggtttgtgaactaaaacactcttgtcacgcccaggaactttattaactggagctgtaagttaactctttttcagagagggagatggtggtgggggacagccccccattaagtcagaggtgtaggtgagagcacaaagcagtaaagcaggcagactctggttttggggtagaccactcaggcaggcccagaggggcacccctcgagttctggctcgccttgcccaccagaactctcccacataaccttgttatgggtagggactcctgtgctggctcccggcatatgttgttatgaatacttctaatggacagctgagtcagcaccgtgattctgccatgatgtcatctattccaaaaggtgtttttccaatagtttttgcactgcgtaaacgatgttatattttcctacagcctcaacaaatagttacacatatatgatagtttgcagtccatggggatgcaaagagtctgacacaactaagtaactgaactgaaagtttattttgattttttctccatccttacccaatgatttcaagctcttacaaattatttgtatttatatgttatattgtttttttttcttatgcaaatcagaggtacaggctaccaataaaagctatctaccaagttttttgcctcaagagattccagagccaaaactcattttctaagcttaaagataaagtcatcacagatttttactgccccccaaatttcattgtactttccagttatatcagggattctatttacttgtagactgtgaagttgccattctgtctcatcacttcctttaacataagtaagatccattattccacctaaagatctctgttaaaatactacagagaaaa

SEQ ID NO: 58323 - DNA, 1381 bp, Bovine  19866881267190
cttggctgcggtgtgtggcatatgaaagactagttccctggccagggatcgaacccgtgccccttgcattggtgtatgaaatctcaaccactggaccagaagccagggaagtcccttctcagtcatttctgatatgcacaactgtctgggaaagggaaaaagtgaagtgaagtgaagtcactcagtcgtgtccgactctttgcgaccctgtggactgtagcctgccaggctcctctgtccatgggattctccaggcaagaatactggagtgggttaccatttccttctccagggaatcttcccgacccagggattgaacccggggtctcccgcattgtgggcagacggcagacgctttaacctctgagccaccagggaggccctaagtacttggaagtgaatagtgctaagcgtgaaaaaagtaaattcactggctgtgaactcaagactgctaactccctgattcttgtttctcacaaaaatcccccacttctctgaaagtcaagtggttgaaattggaaaagtttaataaattaatactttaacccttgagtagccacaggcaactctgctcttgtaacaaatattaagtggtaaactgggaagcatatatgcggataaatattgaccaatggccattgcttagtttcatattttaagtgtagactaaagaaattccctcttataatataaacctgtgaggagaattgcacatcttggttttaccccttgtcttagatatgctatacactgttattttgcaaattgctctaaagaaaagaaacagtagatctacaccattcaccatacgtgaatattgccaagtcccagtgaatctatacagttgtgctggaaagagcttaaattttttgcttagagtcttaaaaaaaaaacaaactgcaaaaagatgtatcaggcagattaacagtttggactgatcctttcacatagagcttcagtacagttttgacaatttattcagtattcagaaaaattcataaacttgaatataaactacatacagtcctgtcttcattacaacaaactcatccagttttttgataactggtattgtgctcctttaaaaaatttttatcaatactcgaagatgctgattcttagggcagtggaatatggctgatacagagccattgacatggaaagtagtcaaagtgctatttgaactttttccccctatctcttgactacctctataatccaactgaaacctacgttttctaaggatacaaaagctctcctttacccctacacctgcagtcaccattcgaagtttattgagctttagagcacacaaagagagtgagaaaatccaaaccaatctctttcctttcacgttctaaatcctgacatggtccatcac

SEQ ID NO: 58324 - DNA, 967 bp, Bovine  19866881385002
atttgctctatgtaaaaatacttgctactttgtaattattcacacgccgatcctttcctatattgagtagaaaataaaaaatgaaatagaagtcaaaggtgctttagagctgaatgatttacacaattcattaaggacggtgatttttcagttagcatcagattaaatggttacttactctcaaatagcccttggggagttgaattgctgggtagcaaacagattaaagtttgcattgaaagaaaaattgaattcagaggtaatcaatagcataataggggcagtgagtggtgcctgctgcctgaaatgaaattaccatatttttaatcttaattttccactctgtttatctgacagtgtggatgtgcaatccaaacagataatgagagagtgggatattgacactgctgtcctctggagtgcttgttttcagtgattaaatgctgtgatctgtgattactttgtgcaaagatgtcggggctgctggccagaaccatgggaggggcactcactccgcagctgcagctcccgactctcccaggtcctaatgtctgaaattcatcttccaccggcaatatagaaaaatacaggttgcctatttatgtgtatatttcagctgcacaaattacaataattaatcccgttattattcttgtcctgctcaaaaacatccaattagattaatatggagtgaaccctctaagttttctattaatgaacccacaaacttgcttcttacaggaagatgtgggtcgcaggaaatgataggctgggagactctgaaggggaggtgtattaccattggagaagcaggagacagaagaaaatttggggcattgttgaaggcatccagccccagtggctgcaattatataacaagctgtgataattttctgaaatgcaaatctttttctctgggtattgggagaaagtcctcttgtacatttaattaaattaatacctctag

SEQ ID NO: 58325 - DNA, 768 bp, Bovine  19866881396133
ttgtctgggagctaagattccacatggcttttggtcaaaaaaccaaaacataagagagaagcatattgtaacaaattcaataaagacttttaaaatggtccacatgaaaaaagaagtcttaaaaaaaaaagttcataatctgagaggttgaaaacattctccgtttgtcttattccaaaacttctgctctggtctactatggtgtacttactccagcttaaattgctatacaaatagttatggtttctgggatatttgtatcaaatattgcttgaagggatatttgtattaaacattgcaattggctgggactcattttttcaattcagattttctggtgtggtctttgtcgcaatggcattgatgccccatttctactcattgccttggacccagccctctacacagtcaacatatgcacattctcaagggacatataaattaggcccaatattggttatacattttatcctctacaaggaaggttatgaaataattttaaaatttaaatgactatagtcattttgcaatcataaacattaatttgtagcatacactgaaagcgaaaagtgctatataaatgctaaataataacattgtaaagcatctatattttgtgataatgagtactatataaatgctaagtagaataaaatagaaaatgcactgttttgaattggcttatgaatgtatcaggcttcttgtgttccatacatacaaaaaattatacctaagccttaaagcaaaaagtcaaaatcaaatacttat

SEQ ID NO: 58326 - DNA, 1583 bp, Bovine  19866881416417
atttaaaaagagaataagaagaaatagttgctttcctctatgtagtcattatttttagaatttttttccctttttagttcatcagactgatctgggctcataaaatttatttcctatggtagacctataaatctattattcttcctttttggggaataaagtggcaataacatcttaaaattatatctcatgataatataaatcttcacgctattttcctttttacttagcataaaaatgagaaagttgtcaaatatggcttaatgagtttcaccaatgggttatactgtagacagacgtatttcttattggtgccaacttttaaatgttagtcgtgacataatcctgtaaacagaagggaaacaagcacataattcaagatgatgattaatcagtattgctagaaaattgttcttccttgacttcaagattaaataaatagttgttaacacaaatggctgtggtaataaaatgtagcacctctgtaatccagacagtcagtggtttatcagataagctgctgttttttgtttttttttcttaaataaattgtcaagcctttagaccaggtgagtagatttcactcatacattagggagttctaaaatttgagtgatggtggtttaataccccttgatatctaattttctaaccattcaaatctcctttactagttaatctcctatactagcctccaggtgtatcttttgcttcttgttataaccaagttgctaactaacctaaggttagggtttgaaattttgggtgacacagtgagtaccttataggttttagataaatattgagtatttttttaaaatatataggtcatctttcggagaaggcagtggcaccccactccagtactcttgcctggaaaatcctgtggatggaggagcctggtagggttagggttagagtcggacatgactgaagcgacttagcagccccagcagcagcaggtcatcttttttctccctgttaattcttatgtccatttttcatttgatgtcaggtgagaaaactgtgtcatcagtagaaaatttaaagctattaatggacagggagttgggatgtaggtggaaatgttagagctttcagagagctgtgctagtcatttagctggcacagtcaagttcctttggattggaccataattgtcttaagcagcattgacgtgtgtgtgtgtgtgtgtgtgtgtgtgtgtgtgagagagagagagagagagtgtgtgtgagagagagagaggaggacttctttgagttagattgctataccagcataagatccatattattagattctattaaagagatgtgaaatttaagatttgaaaattaatctagtgaataaagtgatcttggacataccaacaccacactgagttgttttcttttattttccaatagtggttttgaccactataatttgggacccaaagtgcccagtggtaaagagaacagactttggaatcaaccgatctgaatgaatgtgaatacagcctgactgcagatagacctttgtccaggatttaatcttttttgttatatactggggagcattatagggtataataaagtcac

SEQ ID NO: 58327 - DNA, 1502 bp, Bovine  19866881442196
aatgtaagcagctctgcaactgcctagaggcaaatcctggctccttcatcactaacgtgtgacctgaatcaatgacttcacctctgcaaaatgcagatgaactgactgccacttacctcagagatcaatctctaggtttaaatgagttaacactgagaaagctctctgaaaggtgtcaggcacacggtgaatgccagcaaagtgtttaatgaatcatgtcgcatcaggctctggtctccaaatgtaacagaactgacatgccacctcctcttctctgatcatttattatttagaaaacaaaactaaccagtaaatattcccaaagtgggtgaacttactgcattaattcccaaggtttccagtttctccaccaaactctgctccaagacggttcttatttccttagtgagggaagggttattcttcaaagttttccttatatgtatcttgttgtcatataatttctgttcattttctcttcctaaaataaggtttttataatgtgttaaaaggaattaaacaaatgtatcaaacctctaagcagaaaatggcaaaacacaacttctaaacagcaagcaagcatttataatgttttcaggtctttgaatattttagtcattcagcacaatatataatccataagtattacagctgttaaaattatcttaagcctgcttcaaaacttcaggatcttcaaagactttttcttgattactcaaccaaattatagctagataagtaatgtgagaaataagtctctagggaagcaaaatggggaaaaaaaaaaagtatttaaaagtttaacgttttatcctaaaattatgtttactacttcctaaagaaatcatctctcctaaatccagttagaatttaggtatcatctaatgaagaaaaagccttatttcttttaaataattaagttttatgtaatgaatttagtggatgttaagttcacataaaatttcaaaatgtgaagattatgatctctctcaaaatacttaccaaaatgaaaaagaaattgacaaaagtcttaggaaaagtatattttgcttaaaacaacctgaagtttgaaacaaaaaataacaggacagagtctcttaatgtgtccttccttattccttttatttccttccagaaaaaaatgtcttaagtttaagaaggtttggagaaaggggcaggactgtatgaccttgaacaaccaagtgcttatgtcaaaggaaaatgaaggcttaggaaacaatttcagtgctgggcagttcagacccttagtgaacatcacaggcagatctggagaaggtgatgatggtactatcatcactctgaagcctgttctcctaacaaaagcatttcacccaaagaaagtggcaccaaatgccactgcccaggtctggggctacaggtccccacagagaccccattctttcaaggtctcacctgcctcagcagatgggacttttaggttcccatggcatgtggatttgaagaatatcttaacaacatgc

SEQ ID NO: 58328 - DNA, 1320 bp, Bovine  19866881453034
cttccgaacgggactcctcagttagggtaacctgtatattttcggtcttggaaggaaaggcagagagagacaaaaatttaaataatgaaccctaaatcaacaataacctccactccaaagctgcagtgaaatagacacaactcatatgctggtaggagggcaagatcctacagagagaaaagaatgtggaaactctgagccaaaccatgtatgcatttacccggccatgccaattctagaaatctatcagaaataaggaaatgtcatctgcaaaatgttactcattttcaggtgcctttgcttaaataaacagcatgattaaccgcacacgtacaaagtacctgattaaagcataaacgtagatgctttctccaaaataatacacgaaatgatatataaccaaagtatccatgtaatttatttgtgcccctcagtgacgacagagtggttcctgaatgtggaagttgagggactaatctgaatactcatcagaatcatcccagaatcccgggtatggacaatgagagtctggacactgagaaaactgctagatgattttaaaggagacctagtgcatttgtccatttttgtctataggatttagaatatattacacagtcacatgggccaaaggtttgctgcctactgtatatgcgagatgacaacatatggttccacatcttgaaaaataagaaaggaagatgggaacacattccaaagtgtctgctgtgtgttgggtgctttgcaccttggtgacagaggtgtcctgtcacagaccatctgatgctgaagcaaaacaataccatcagtcacctgcaatgtcagaatattccaacacaaagcaaaagcagctgacttaatggaagtcatagcaggctaggaatgagggattcttcaaattaaccatctggatgaataagggaagccggggtccaccagagcacatacagttaactatggtaacaagagttccactgtcaataccacatacatcgtgcaagtcatagcagtgcaaccaggacttgtctccgtcctacgccaaaaggagaagccgaatcaggctggctccccgcatgctgttttagttctaccaatttcatggaacaaggccgtggaaatttggtgtcttctttggaacacagagatgtcataaacagagcagactgaaggtccatgaggccaccaagagcgacagacccgcgcatgctgcaggacgagaaactcacgtcttggccctctggagtggcctctttcaaggagggtctggaagactgttgagaccaaaccgaagactcggaaaaggtgcggttctcagggtag

SEQ ID NO: 58329 - DNA, 1929 bp, Bovine  19866881453474
tgctgtgaaatctaccatgaacctcacccttccacagagtcggtgggggaggcgggcttgttcagcctcctcttctgactgaccctcttgcagtttccctgaagaaaaagtaaagatcctgctggtggcgtgtgacctcccatggtccttagcagcttcctcacagacagttcagagagctgaaagtcgtgattcaaattgaaattttttttacagtagagaaacaaagggccctgtgagctgggaaacattttgcagcataaatcatgtctcctaaatcaaggatttgcctggaatgcgggagacccaggttcgatccctgggtcggaagatcccctggagaaggaaatggcaacccactccagtactcttgcctggagaatcccatggagggaggagcctggtaggctacaatccatggggtcgcagagtcggacatgactgacgcgtgtgacttcacaaatcaaggatgatttctttttttaatatttacctaattgtatctatcgtgtaatctttttttcttccctgttccctagggccaatcaacagagtgccctaaatgtcactgttaatggacaaggaaatgtaaccgagaagctcaatctgaactggtacttaggaatttactcaggtaaagttgagtcatctggtctattatccgagtctgagtcgcttacaatgagcccatgtgagcaactagggcttccaggagtaattcagtaatgtcttaacagattaagtttctgagccagccgcatttattctgtgaattaattagaataattattttaaaaatctgctagaagaaaagaggttgaatgaagactcttaatttgctctgtactggattttggaagttaaaccagcattgcatattgagaaaatcagccactggaaatatgtgactattgtctattctaataggttgctttagctaaatcttatattattttatggatgtgtgaggggattagaaacacatccccaccttatggttcagattgttccaattctttctgaatgaaacttggcttttattgaccttggttgaaatcctctggcagccagggtcccaaataaaagcattactgcctcgcaggtgtgcaaactctccttcgccacactgctcatctcttgggctttactaatttcttaaggcagaagctaagcagggagaaatccagtgtctgggcattagggttccttctcctcctttcctgagatcacagtgttattatgtccataactgtgtgattaatttaacatctggcttgcctactaatatcaacacagctctttgttttcacaccagtgcctagaatatatgtggcattgcatacttttgagaggaaatcctcatctaaaattttaaatattcgcacaggaaatatacaagctttctgcaaagatagaatgagttatctttgtaagaacccactcattgaaattttctatgtattttgttgatctcttgctaagaactctaaatccattagctatttaccttctgaattggactatgggggcttgaaggaggaagggtgggtttatgttacatattcatataggatggtggtctaaggcaaatgcctgttgatggaacccagaaatttgaatagctttcagaatttaaatactgaaatttaaatttcagaatttaagtgtctcatcagaagggaataaagtacttaatggaatatttattacagaagttatcccctctctgtttagcattgtgaattcaaaaaatgttgggagggtattctactttttatatgcacagtggtactcatttctgtcattaacaaaatgtaatttaaatgctgatgttcatttacatttataatttgtattttcctacagttcagttagattttttgcttgcagatttatgtggtatttttatactctttaaagctacttggg

SEQ ID NO: 58330 - DNA, 1181 bp, Bovine  19866881545153
tgaccctctgtcctggaacaatatgttctgaaattctagactaattttgctacctgagaatccatgaaaaaaaagatctcaaacttggaaacaaataggaaaataattaactagtacttcctttttttttaagatgtcataatttcaccattaaatagtcctgtgagttcaagatcagcagatcatcctctcttttttttcacatttgatggttaactaatctccccacctcttctctttagaattgcactgtaaaagactcacaaacttaaatgaaatcagaggtgtaattcttttcaggcaggaaaaagtgaagcaattggcccaacttaggaaaataaaatccccacagttgctggaaagcagggtgggtgtgtaaagactgtgtgcttacattcttcagaaaccagaattactggatggaaattgtcagacctccaaatctgcctgctcacagtcaaggctcgcctacatattacaggtttcagagcttccctggaagggtgactctaaatggcacacacaacaactcaaaacatcacgaacaattggtcactcagatttgcacaatagaaatgtttttaaaagaaatacaccgcacttctctgaaatgaaaagatcaataaaacatctagcagttattttttcatgtcaaaaagtatttttcctattttcctctaagagtattatagtgtctggtcttacattcagtctttaaatcattttgagtttatttctgtatatggtattagggagtattctcatttcattcttttacatgtagctgtccagttttcccagcagctgggaaaaggctgtctttttgaagagactgtcttttctccattgaaaagagaagagaccgtcttttctccattgcacattcttgcctcctttgttatagatttggtgactatctgtgagttcatctctgggctctctagcctgttccattgatttatgtttctatctttgtgccagtgccatacatctagagtactgcagctctgaagtgagttgaccaaaaaattcatttaggttttcccataacattttatgtaacaaactttttggccaactcagtatcttaaatcagggaacctgatttctccagcttaatttttctttctcaagagtgctttgactatttgaggttttttgtgtttccatacaaattgtaa

SEQ ID NO: 58331 - DNA, 955 bp, Bovine  19866881595264
ctgaggttcgaagtttctgcctatgtgacaggagtccggctcttttctttcttgtgttcgtgaggaagagcctgaacatgaactgtccacttgctttcctgactgtcaagtagctgcaatcacattatggaaatcatggggatgctgaggacatgcttctttaaactcctgtgcatcttttagcatacctatgttagacttgatctgcatattgggcttcttgatttctgacaattgatattctaatgttgagttcttagaagtcagtcctttaaactcttttcataaacatttccttgactttttccatttcatcaactagtttctccttttcttcgtctttccatctatcaaataacttcaaaaattcttcctcttttgttttctgtatttcatattccttagagaacttgactgcgtgcacatgctgtgccgcctgtcgctgagacttggtgagctgcaacttcaacatgtcgatctcactttggagcttgtccgtctgtgtccttgtcttatactcaagatgtgaatcttcagggtggcagcactgaatatgactttgtaggaaagcttggttcataaaggccttgtcacaaaaatggcactggtaatagctggctttggcctctatcatctgctgctgggtaggcatcaacttcttcctgcgtttacactcttccttgagcagcttgatcttgctcgcttgcttggcgaggagcttcctgctcttctcacccccagccaggctcgagcacagcagcttctccaggtcatacacctacaaggtgcgcaactcctgcgagtgcagcaggtatttgatggtgagctgctccaggtggatgagctttagcagcacctggtccacctatgactggcagcttaaatatttctcgtcctccagcttgcagaaggtgatgttctcctgcagcatgagcacgtccacggcaccagccac

SEQ ID NO: 58332 - DNA, 799 bp, Bovine  19866881798433
cttccggtagacaccaaactgcaaaccttctccctttggtccttttgggttagctgcaacccaggcatttggcacttgagtagaatttgactcattcttcacaggtggaggaggttccttctgttctcgcccagcttttctccctatagatctgtcttcctctaaggatgatatgtcccagtcatcatcgtccacatctgtacactaaaaaaaaaaaaaagcggagaaaaatgaatgttccctaaagaaaccgtgtgtgttagagcccctcaaacagactgggccactgacgctaaatggtaagaagttgggagcctcagagtgtctctcatctcgtcatctctgagggcgatgaaatgggtttggaaatctgtgcttcgaaagcagagggaaccacatctttttgtctgttgtcatggaaatgtatgtttcctatgcagcaatcgtgaatttagaaaattccagaaactacgttgtaaagtcaagtcaggatgctccccaaggagcagtcagaccagctctggggctcttacctctgtgatgctaagacatttaactgcaggagacgtcacatgagggccctgcgaaagcggccccggtgggaaggactgtgtatttctccagtgcaccttctaaggaagacacggtggctcttgactgatgtgactttttgtcattttgggcttgggtaacacaaatggcactaacttatgaaagtagttggacagaatgctctggattccacagatgagcagggaagaattaaatctaatgtaggtgaaaaattaaagaaagagca

SEQ ID NO: 58333 - DNA, 1863 bp, Bovine  19866880794281
ccatctatccatccatccatctacccatccatccatttatttttagtttctctgctgtatgccttagtgaataaaccttttccgtttttgaatttcctgtagcttattttcactgttgctagtttcttcataaattcaggtcaaattcattctctaggaagtctctcttgtctcttctaattgacatgattttgtctttctttgagcatccaaagcctataatatatagatttgcctggtaattagttatatattgtcttttaatatcttttgaattgatattaatctactgtatggttatttgttttcaaacatgtatgtccaatttctataatttaaattttaaaattcttaaaattacaagctatgaattatgctttttatattctttcacttgtagaaacacagtaattattttgtgattagttaattctgtaagcaaagactacatatgtagacaaacccattagtgtcaaaactgaaagcactaactctattaaataaagactcactacagactgggacttaatacttcccaggcatatagattctttgctctatgatttttccagaaaatgccagattctaccctcttgctagtagagaaggaacaaaataaatacctggcctaagcatgacttattactagagagcttagtttacctctagaaaaaaaaaattcatgagctagtttaaatctctgtttaaatactaataactactctaaaacatgttttaaaccaaaaaatcttctttcagcctaaatttgattttgcagactgtctcatttctttgtacctatcttcatatttttcagcagctgctgaaatctctagggagtatctctccaaggatacagagccagacagcccaggtctcttctctgttcttgagttcctgttttcaagtaatgatttggataaactagagaccagttttctttcgagcagctctggcagctgaaattaattctcttaagactctactttggaggcaagcagatggtacacatgcacgtgttttagttttgattgtaccagttctgaataatttaaagttccaaatctctataaaatactgtattcccatttcccaacgcaatttttttttttcctttggcctcagaaattccttccttatattttgacatttggctgaaacttcattcattttgtactggcttcattgtcacatacctcctgctgttctttgttacaattttagataagtatggctttagaaaagtaagatgcttttagaaactattttgctggtgattttccccttaccatttgcaaagcattttgtatacataaacagcacattagccaaatgatgttgttatcacagttcctgttggtctgcgcttggctctcgctttagaattaccccaaataggtttgcagagttttatagttgcattatgaggcactcaataatatgtatgaacttaggtattttttccccctgatattttctttgagaaacagcttgtcctatctctgttgaagattcactgctgtgccagtacaacatggtaagaaaggaatggtcacaaagatctctaagtaggtttctccatcttgccaaatgtagtccaaatttttctgtgaggtctagtggtttggtgaagttaatgggggctgtgaggtatgcatgtatgcacactcacacgcatatatgcacacacactgatagttacccaactcaataagaaagctctgctactgtaggcactatagctatgattcaattctgggatgagtttcactaagttttactggcatcttctcttactatggctaatgtacaagcatatctataaaatagaatgggatatattagcacaagtccagaaattta

SEQ ID NO: 58334 - DNA, 2001 bp, Bovine  19866880870651
tgcatgaaagtgaaaagtgaaagtgaagtcgttcagtcatgtccgaccctcagtgaccccatggactgcagctttccagggtcctccgtccatgggattttccaggcaagagtactggagtggggtgccattgccttctccacaacatatggccggtatactgaatttcacccacttttgtttacccatgagcacagtcactgcatttttgcctgtctttctcaccctcattgcctatttctctattgattattttcatcaacacacaaaatatctgttatttctcccagttatatatggcaaaactaatacaatattgcaaagttaaaaaagaaaataaaatttaaaaaaaaataacaacaaaagaaaatttctttggacttcatatagttatatacttcatatagttatgaagttatggacttcatatagttatatacaacttcatatagttggacttcatatagcagataacatcaattacttgttatctacactcattgaaaagaaaccacctcaaaaatcaagtctgtgtttgttgaattttactttgctcctcctattactttgatagcttggggtctaactgatataaaatagaatgttcatttcttaagcataggatttgatgagattaacaaaggaatatatccatgtaacaactattaacaataagatcaagaacaatttcactagaaaataatctcaagttacaatcatgtcagtctcctagcagaaattatataagacattatgcaaagaagagtaataattcttgtagtgaaaaatgaaatcaagaattggctagatactaaaatgcaaaaaatgcctagtcagaacaccagattacagcacatatgtgaggacttgaagaatgaattccatgtttacatttctgaaatagaaaaataagagctactcatacatagggaaaatattggtctgaaaaaatggatttttaaattcaagttaaaacccagtactctgagtaggtaaaagtgaggaagctgaaatgaatgtaaagttagtctgtagtaaacttacatataatgattctttgatttctttcattaaaggcttaggctttgtctccataggtatgcttctaccagtccaacaggtatatttgcttgaattttattaaaggtacataaatatagcttctggagaaatgatataaaatttgcaaaagggattctaatcaaaagcaaacaatcttgtttttcaactaaaataaaatcttttctaattagtttttttctggttataggaatgcatggatattcattactcatatgcaaaaatattcttttagatgacagtatgttctccttccaaagtagaaaataggtcataaatctcttccataaatcaaaattcagttgtcttctctatgattgatttattactgaatattagagtccttggccacatttgaaattatatgttatatgatatatacaagatatatatcacatgttctttaacctctgcagatttacttctatatttaaaattaatgaattttatgttcacttgcttttctttctatggattattatagagaattctaatgctatttgtctaaactgcaaatgttggtttccttttgactattataaatcatattctgttatttgtagtgagtaaagattaatattcttctgggtcaacataatttttatatatgtgtaaattttaactcggagaaggcaatggcaccccactccagtactcttgcctggaaattttaactaattttttcaggaataaaaaaattccacatagagatattaatgaaaatgggtcattcaaaactatacatgctaataatagcaaatttaattttacattatgagatgtaacaatgttgaaaaaatcaacaatgatgacaactaaaaaattataacaataaatataaatcaatgaaatacagagtaaaatacagccagatattattatttgaaaaacagctaagtaagaagaccatatatcacatca

SEQ ID NO: 58335 - DNA, 883 bp, Bovine  19866881236486
gattccatggagctttaaaatgattcaaaccctactgtctgtgttttactattgtaatggcttatgtaggaataactctcggtctgatagaacaaaagcagaggggagttgccatattgtaagaggccattgtcccatctggtctgattcctgcctgtagccaactaattttcttttacatcaagcctatattacaatcccatgacttttgctgggcttcaattccctatgatccaattttcctacacaggtggtggtaggaattggaaattcaccaatggaaaaactggtttgtgccaccagaaataaaaatttgtgtttaataattctaggatgtagaagaggtggatagttgttggttgggaacaaaattcgatatccaccatgtacaactgctttctgcagtgttttttattactcaaataattttgaaattttaggatgtgtataataacagtcaaggatttgattgtttctttttaaagatcatgttcaataccatgatgattatcaagatatttatagctatacctaacctttatcaacattgaatcttcacattgatgttaaaaatgtagtaaaatgtgttggcacgttaatttctggggcattactcatcaccgatacgatatttaacaacaaaaaaattcatctaagatgaaaaatttaaaacctagttcacattctataattttgcacaaaaattattagtgagccaacatcaacttaatatattgaaaatttttctgaaatatgtttacttaaaatcacttgcaactattgcttctctaaataatttttggagatcttatacaaggaccatacaattcataagatcaatcacaattatgaatttggagactgtgtatctgtattctctagg

SEQ ID NO: 58336 - DNA, 1111 bp, Bovine  19866881432407
atgagctgggaataatttctaaattgactgacagctggtttgagtttgaagtaggcacattattagtataaacagaaatggcatcttattatatgaggcccttcaagtgtagctttcattattattttaaaggtttccaggagatgttttcagtgagcagtgttatgaaaatatgtaaaatatcaagactcacatgtagagctattttagcaatatattgtttttctttgtaccttggaatctaaaataaatattaaaaatgtaatagaatgagccattagaaggatatttttaaactactttattctggggaataggtatttgatgattaagttagatatggactggatatttattgagataatctggtgtgtttgattagatctaaatcttcatgtatgtataactcagtataaccttaaaggcaacttttcagccaatgcctgatttctattttttgattccatttgctgaaatctaaattagaattctttccatttaaatgcagattcagactttccacctgaggggcaaaagaagccatttcttttgactgaaaacatatataggagatatatatatatatagtttcattcacatgaatgaagtttcatttacatgaatattccttcccaacacaggaaggtattttttcttctgatttctagaatgcttattgcaataattttataacctccttatatttgcttcattgttttgtgctaaaagttcatgtgctaaataaataagctaaataaaaattaaaatttcagtggacattggaaaggtgtgtggaatttttaaatggaagtggtgaattaaatggcactgagtaaccaaaccaaaattgaaatagaggatgctgaaaagctaggcacattcatatgctgacagagatataatatgtagggccattttatgcctttttcttttctttccttttttcattctttaaaaaatgaatcctggttagagtattttaaaatataaagctctgggttatgtatgccaactcatctaatgtatacttgaaaagctgctacagtcacatccaatgggagatttataacacagagaaaagaaagagcacagataaatcatgtaaaggagt

SEQ ID NO: 58337 - DNA, 1132 bp, Bovine  19866881453859
tgaaagtctatttatgttcctaactggtagatttaacaaaaatttaacagccaagctctctggcttgtgatattaatatattttgtgtcttgcaaataaattcactagaaccactgtcaagatgttcccactttaggatacaaaactgtatatattacattttctaaaatctcctttttataattttatataaaaaaagaagatgcattaaatcattaaaaattaactgttctacatgatggaattttagttgattttttctatttactttttgggtattttcagttttttattaaacaaatatatggtatttatatggagagtataatatatttttatttgtactccttctctttatgtgcctctcaatttagtacccaaatctataagaactcttagagaaaataaatatcagtgattgactttttggctggccaggtgttggataagaaccttattattaatactaccacatttatttattacaatacccctctgttatggatgttcttgtgcttttacaagcagcaactctgggttttctctccaaatgtttgtgattttaaagcccaagctcattcgtatttcacaaaataacttcctaggagctgttaaaacagattttttatgacagtcaaggagggtatacttggaggatcccaagcagaattactcttactctgagtattgttactctgaaagttctgatcttttatcttacaagttaacaaatcagtctgtcacttgctcatagatgttaataagagccacagaacttctgggtcagaaacaagggcctttcttgcacatggcacaaaagacagcataacatcagcatatttgttccatttctctttgctccacaagatgacgtggatggacacagatgcttatgtctgctctcaaaagaagcaccctaagctttgggaactaggatctttaaaaattgtcaacaattagaccttttggggggcttcactggtggctcagctggtaaaaagtctgcctgcagtgcaggagacccaggttcaatccctgggtttaggaagttctcctagagaaggaaatggcaacccactccagtattcttgcctgcaaaatgccatggatggaggagccctggcaggctaca

SEQ ID NO: 58338 - DNA, 977 bp, Bovine  19866881545235
tctctccatatcccttttacatgccactgtcttaacaatacatttaacctagttgagtattaaaaggatagaaagaagaagaatatttgcttctatatatttgtaggtctattggaggttttttgctttgttttataatatgacaattttattctctatttaatattatttgaatgttaatcatatccttctagctacaaaatcacaattattaatttgtggaaatgtttcaaaagagttgaaggtagaggttgaagtgttgttattattctaatatttattatttataatattcttcatattttgaagatgaattccagtcattaattattccctgtcatgttgccttggttacaattactcatagtaactgaagctgtcgaatgctgcagacagagcatgaagagtattgggtcagattaacactgagttacacagaatgaaaatatagtcatcttccaatttaaagctctttccaaattctcctaaaatgattttattagaaacacctggtataaataaaacacatatttgaatagttttcttaacaaaaatattcacttcaaattggtgtcattttattctacaccagaaatcttacattttatactctttcagccacattctcagatacattgtactttatatgcatttgcaatgggtctcaattagtgtgtttctgcttagtaactattcagaacacagagtataatgacaaagataccacataattccatcataagaaacctgaatatgtagtgctagtaaataatacctaacttggagaataagagctttattttttcccctcacttaaggatgtaggatacagagcatttttaaatccttaaggtctatacaaaaaaagtatttgtatacccagaaggaaataaaattatagaaaaatttatgataatattgttcattttcatgtatgctgagaaacttttaacttgtattagtttttataattaaat

SEQ ID NO: 58339 - DNA, 1644 bp, Bovine  19866880226435
tcagtgatgccatccagccatctcatcctctggcatccccttctcctcttgcctccaatccctcccagcatcagagtctatgagtcaactcatcgcatgaggtggccagaggactggagtttcagctttagcatcattccttccaaagaaatcccagggctgatctccttcagaatggactggttggatctccttgcagtccaagggactctcaagagtcttctctaacaccacagttcaaaagcatcaattcttcggtgctcagccttcttcacagtccaactctcaaatccatacatgaccacaggaaaaaccatagccttgactagacaaacctttgttggcaaagtaatgtctctgcttttgaatgtgctatctaggttggtcataactttccttccaaggagtaagcgtcttttaatttcatggctgcagtcaccatctgtagtgattttggagcccagaaaaataaagtctgacactgtttccactgtttccccatctatatgcaaatactatatcattttacataagggacttcagcctccatagattttggtatccaggtgagttcctgggatcaatcctccatggacaacaagggtcagctgtacaataatttatgcaaaaatttttacatacaaaacatattatacttgcttacatatgtcacaagcataattataaagctgtgcactgacttcaggagatctgtacttgggatggagggagaaaggaggtagaggttatggggaataggacagcaaagagaagggtttgaaagaatctttattttaaacttcatttaatataacaaagacctgcagtaaatgtggtaaaatgctaaaatgtattatatctacatagtggattcatgggtacttacaaaactgtgtaattgtacgtgtgaaatattatatacattttaaagaatgccttgcagagctaattttaatagcaatatttttttaaggaagaacactccaaatcaccaagtctatgacaaaattaaacattgtcttttactgcacataataaggtgctataataaaaaatgaagtatagatcaggatgaagtatttttgtgagattataaaagagataaagaaccattcagttcactagatgacacaggcaacctaatccacttgcagaagatagatgtactaacatttttcccagcggtaggctgaagcaatcgttcatatggctgggaaagcagtgagaaaaaactcttaacttttataaccttatattttatataaaatactccaagatatatactcaaaacattttgacagtaagatagaaaggagaaactgcctgaatgcaaagcctaaaaaatactattacttccatcatttcaaaacaattttctcattttgaagatttaatgcaatagcaccttaacagtttagcaagaagagaagtaaaatgttatatgatttttaaaaaaataacttgaaacagtgtccttatacaaaaatacagatatattaagatatataaaacaacctgcttaaatgtttaaaaataatttgtattgaattataatgaacatagagaaaagcacaattctaaatctctatgaattttcataaagtggacaaaaatgtaattacaacccattaaaaatagaaatag

SEQ ID NO: 58340 - DNA, 1389 bp, Bovine  19866880256860
agatgacaatggcaccccactccagtactcttgcttggaaaatcccatggacggaggagcctggtaggctgcagtccatggggtcgctgggagtcggacatgactgagcgacttcactttcacttttcactttcatgcattggagaaggacatggcaacccactccagtgttcttgcctggagaatcccagggatgggggagcctggtgggctgccgtctatggggtcacacagagtcggacacgactgaagtgacttagcaccagcagcagcagtttaatggtctcttcaggccaaagcaattttgtcaaaatgtgatccactacaggaatgaaactttgaaccagtctgtattcccaacccacctacttcacttctacccagtggataagcagaagatggagaggctttaagtaaaaggttgctgacccttgtaccacatttgtttctctctcaagatttctagaaaggatatgtgaatttaaaaatgctaatatcaatatctttcttctgttttttataagtaatgctgtgctatatgtgaaattaaaattagcaaaagtttcatttgtgtaaaaagttattttaacatgaatcactgggttgccatttgaaggaatatatacttgagcaaggtgaatcttaatatgggaatttttgacaaaggattttgtcacattcttaactatcaggctctatctggtacctaaataatatggacctgaagatgagagacagcaccaccagtattttaaagagctttgaagacacaattgctgactgtatttaaatacgtgctttcttttatctgggacaaacacttgctttataaaggcttctctcctgctgtatctaattctttacacttactaggaaataggattctgatcagagcaaggtaaaaattagctcagtgcaatgactaggggttggtccttagaatctacttggccattcatctattgaacctttgtattaacagttcatagtttacttagcactatagatatcttttcattattttggaagaaaatggatttctgaactatactgtaattaaaataatttatgaaattaaggtttgaactgacaatatcacatagcctattattatgcaaaattcctttataaagtagttcaaattacatttccatgcacaacgggaaaggatgacttgcttaggtaagctaatgctacagaccacagggggatgaagtgagttcagaaaagcttataacaggggagaggtgggtaagatggcagagtagggagaccgtgaactcatatcctctcacagacacagcagttacagctgcttacagagctaacatctatgagagtgacatgaagactagcagaaaagagtttctacaactaaagacagaaaaa

SEQ ID NO: 58341 - DNA, 2007 bp, Bovine  19866880275422
tggctattgaaaagcgagacattactttgccacaaaggttcgtctagtcaaggctatggtttgtccagtggtcatgtatgcatgtgagagttggactgtgaagaaggctgagcgccgaagaattgatgcttttgaactgtggtgttggagaagactcttgagagtcccttggactgcaaggagatccaaccagtccattctgaatgagatcagccctgggatttctttggaaggaatgatgctaaagctgaaactccagtactttgaccacctcatgtgaagagttgactcattggaaaagactctgatgctgggagggattgggggcaggaggagaaggggacaacagaggatgggatggctggatggcatcactgactcgatggatgtgagtctgggtgaactcctggtgttggtgatggacagggaggcctggcgtgctgcgattcatggggtcgcaaagagtcggacacgactgagcgactgaactgaactgaactgaaggagagaagaaaagaaggtggaagagaggagcaaagaaagggaggaaggaaggagagtggaggaaagaggggaaaaaatcattaatttggggctggctttagagaaggaaactattcaatttcagagcactgtgggtttgaaatagagaatcaacccctgacttcaaacagactccaatgataaaagctctatggtgattttctacccccctccttttcttttttttttttcctgcagtattatagatactatggttgcaaaaaaatgtgtttttgaaaatatcagaaaaagtttaaaattctgccatatgcaaaaacgattcacttttactttcaaccaattccagaaagtgtttataaaatgcagtaatatttaaaagttcttttatgtaacttcctcatataggtgtggccactgaacacacaaaggaagctagtgtacaatgagtgaggagctgccttagctgttcagctgcctgaagatgggctttcatgtattctatttgaaatgctctttctcccttgtcatatttttctttatttataattctctctttaaaaacacaattcttcactgaattcaaaggcacataggcagaaacagtaaatgtctggagatattaataagcttcctgcagacttcataggttaaaatggacatgggtcaattatatatgcaaacacctccagatagttatttccattctaacatcttgatagctgcagaatcattgcttctaagccatttaattcacttctagatagcactagggtgctagggcataaaaatggatgaagaagaaaattaataaaagtaaaatattccatcagattgcagcaagtacaagtaagacttactccagatttcatatgatcgtaatcatcttatctcaaggctggaagaatgagagctttgcaaggccttacaaactgtctacattcctctctagcatatattcatgaatgtacattaggtgcaatgaaattttaaaaacaatgggttgccattgccttcttcaatgtagatatatagacaggcaaatatttttttttctgcttctgagtttaatcatagaaaaagcattgtgtaggtaaaaataataaaatatatcacatttaattgtgcacatttaataattttcttactgaaatagtggctttctaactatccaggatatgccatgtctgaagctacacagggtcctgtgctgggctaaacagttaagattagctaccagccagaaaaagtgtgagaaaccacttacagtatgtacttctctgtgccttcatgctcaggccaaactcgactcaaagcaatcagctctcacagattatataaactctaaaatcataatatgagaagttgtacaatgttgcaatctatagagaggtagataggtaatatttaaaggaaaagacagcttactgctggtttacttttttgggttaaaatatctttctcatatcttaatagtccaaataaatgatttcctggattatcaag

SEQ ID NO: 58342 - DNA, 1305 bp, Bovine  19866880421436
tagtgacctaaatttgagaatgcatggtaatctcaacatgatgagccaaaatttacattcattctacaagatagtaaatctttgaaagaatagttcaaatgattattcttaaacctgaagaaaattttattaagaaaaatttattaaggtctcccttgagcaaattcaaagaataaaatcactacttacaatgcgtgtgtgcatgcttagtcactgtcatgtctcactctttgcgaccctatggactgtgtagctcaccaggcttctctgtccatgggattctccaggcaagaatactggagtgggttgccatttcctcctccaggggatcttcccaacccagggatggaaactgggtctcctgtctcctgcattgtaggtggattctttaccactgagccacctgagaagcccctaccaattacaatatttataagtattttcctttttgactttactgtaaacccatgtgtcacagacatttttcactcatcttttgaaaccccataacagcataaggtcttgcatatattgagtaactggaaacaaagtgttgaaagagtgaatttgacagtttttaaatcatggacctgaggagaaaataaaagatcccttctctttgtttatggacttgatattgggaaatgaaccaatatacaaaatcataccaaataaggcaagcatttactttcttattgaacctcgaatagggaaaatctcaattccacaagttgggataaatctcagagaggtcctaattttacctttcatttcaagttttatggatttagtgataagaaaaaagcagaaaataaaggctgagcatagcataagcatatgctttagcagagaaatagttaatggaactgtagttagtgaaaagaagcatgaagaattgttgcttatttgttgagcttgcttagcctcaaccagtgagtcattgagacaataacttcatacaaagtgatgatgttaataatacttctactaatagctttgtatacattcagaggtcctcagttaaaaactagtacttttctaccattcctttgttcttggtgaaccataatgtacgtttttgtgttatgttattaaacaaaagactgacgaacatttaaagttttgttttgtttcttattttattggaaggaagtttttttttttttctttttcgtttctattgatttcacggtttactacaattagaattaccataatggtaggatgtggttgggagaaatatatgacatcatcctttataatcactagcatggcatttcccgaaacaaaacgcgcaggatatca

SEQ ID NO: 58343 - DNA, 1049 bp, Bovine  19866880452538
gacacgactgagcaacttcactttgacttttcactttcatgcattggagaaggaaatggcaacccactccagtgttcttgcctggagaatcccagggacaggggagcctggtgggctgctgtctatggagtcgcacagagtcggacacgaccgaagcggcttagcagcagcagattgtaaactcttggaatccaaagattttattatttgcacctctaaatacccagcacctaggatagcacctggctcacagtctatatttagaaacttatttaggatttccatgtaaaatacaagatactattgaattcaaattttagacaaactatgattttttttttactataagtgtattattgcataggacactcatagtaaaaaaaaattatttatctgaaattcaaagtaaattggatgccctgtatttttatttactaaatcaggaaaccctactttatgaatcagtgaatgggtgaatgaatgtcattcttttctatattaaacaagaaaccatttttatttatttatgcagttttcagattagagagtgagccatatagaaattttcatgaatctgaaacccttgactgcactttgaaatcctttttttaatgttagctgagggacttcatcattgttaagagatagcttaatccttaagtactttacagattaatagaagaaacatggcagttatgatggtttctcagtaggtaaacaagaatgaatagaatctattgagattagacctgctataataataaaaataatgacagtaacaaattatgaaaaatattcagagagagaaaatgttctccccaattgctagtggatatattaaaaatacaatctcaaagcaatattaaatataaatattattatatacataaatggataactatatgaaatattttctgtgtacaaatagaatcagtaacttaacctttttagagctccaaaatgtcaacctaaccgtggttaaaggtgttaagaagcagatgtccctgctcaaaaaataccttccttatttgtcatctagtccttataat

SEQ ID NO: 58344 - DNA, 1892 bp, Bovine  19866880475814
ctcctgcattgccggcggattctttaccagctgagcccaagggaaccccaatacaagtggctcccgattgtatctttcactgaattttatcatctaattgtgtctttgtttctcacatcttttggcttatagtctctcccaccaaagaagcctacttagtacccatttgaatctaccttagcattttcctctatgggatcccaaagggttggacacgaccaaatgactgacattactactactagcaattcctctattataataggaaaagtagatcagaacaaattaggagagagttgtactcatttctgcagcaatcaaccaaggctatggataatattgtcatttttgagcagagtcatatgaggattcaactcaaccataatgcaggatacaagtaaaagaataatgaaagactttggtttgacatttgagaagagatttagtgaaaagcatagtagttcttttgttttctgtatagtcatgattgcatgggtgtgtgcgtgtatgtgtgtttctgcgtgtatatccaaaggcataatttagtttaggtctgggacattaatggtaaatattatagagcgaaaattttgacttcataataaggaaacatattttggcaatcatatttcctggaaatgaaggaggctgcctcctaaagtagtgaattgtatgttttggaagatgctgaagtggattcataaaactcatgagacaggtagggtaggagaagtcattactgaattagatccatagctgtgctgcgtgatctcaaaggtcatctaccagttcctccttacacacacacacacacacacaaaccactaactgcttccacacatcttattctgagaaaatctaaacagtgctgggacaatagatggttcttactaattggataatcatgattatgatgttttgtgttttagttattgctttttaaaagaaagggttgtatatgtataaaatatcagtacttaattcatgtttgatggaaataccctgataatctggaaacataattattatactacttctttttatattctaactccgtaggactgattttaagaatattttcttgatctttctaccatggtcaattcccatttgactatttgaaatagatattatgttgagttaatacttaagtctattattactatgctgataggtattccctgctacatttataatttcagtttgcaagaaaatacaagtgattgtcctgatatatgtctattgtaccctgcagttttgtttttgtatttcaaacaacatagagtcccaggtttctttctctgcctcaagtcttattcaaggcatcttctatctctttccctctcctatttcttttatatttaaaaaatggcctttcagatgtttcctaattgctttcttctttctacaaaaccagtgtgaggaaaagaaaatatgtgtattattggtaactagcatgcacttcctgatctgatgggcttccccactccccatgaataaagttagggagcaaagtagatttttaactgagaccacaactggtctccagtttaagtgatctattggcttgccctgccttttaaaattgttttgcttcattttaaactaaagtagcccttactgacaaagtcaagctgtaccaaacctcaggccaattaaaaccaccagtacacaaactcacacttggtatttgtaaaagggacttggttctttcagaagaagattttgagtattcaatttaatatttactcggaatgacacaggttgtctgcggaagtacctgcagtcccttcctgcttctgctgtatctttaagaaggaacacagggatgagcaggttttagttggcagatcatctcctctcctcaggaaagcgggggaggagcccttcaa

SEQ ID NO: 58345 - DNA, 1385 bp, Bovine  19866880490914
tttaaaaagcaaatgcatagtaattgcatcaggatttttttccttgaggcttcctttttctctggggctttccaagtggcacagtggtaaagaacttgcctgccaatgcaggagatacaggtttgatccctgggtcggcatgatccctggagaaggaaatggcaacccattccagtattcttgcctgggaaaccccacagagttgctggtgggctatagtccgtagggtcacaaaatagtcagacacgacttatcgactaaaacaacaacatatgatctgtggtgtgcacctcaggccatatgatgctgaagataaatcctagacattcattgttggatccatccccagctggatgttatagagtaatttgcccctttagagttatgcacacatttgcggcatttgctttgccttgtatgtctacttatgatgttgattaaatgtgactgtgaaattggatagttctctaaagacaaattaaaaatctttcaaggttttattttctagaaagtgagttttgatagaacaacatctcaacaaatgaagttcagttccagagttcggccactgttcttccaaactttcctcacatttctttgaaaagcaatggacctagaataatgaagttccacgaggctcctaaagtaacctttcccctgagccttatacatctaggcatccaagtagcaatgttttcacactgtggagagtcctccacactatgagcgatgttgtgctttgctggggttctctgcggtgcagctcttccacccagttgcacccaatttcactgatcagtagctctggcatagcttcaccctcacgtattcaattcagttggcaggggagtcaacatacctcaaaaggaattgcaacatcttggaagaatgaggaaaattagtattgtttactctctcttggatccttacattttatttggatccgaggaggatcaatagttttagcatattctggcaccagaaatatttattatttttaaaaagatgaattagatgtttattccttctcctgcaaaatggtttcaatctgtagatttctctaaaataccagcactatctgtagttgttcaaatgtggccagccactgggccatggagttgggctgatcaagcatggggaagatcagaatgacaagtgagcatttccccattgaagaaatatctttctgaaactgcactcatgttcagcagctgatatcctgcagagactgcttttctaaaatttattttgagaaaagttgtaaagacagtgcagagagttccccttcaccaacttctcctaatgtgagcatcttatatgaccatgctacatctgtcaaaactaagaaattaacatggatacaataacttataactaaatataga

SEQ ID NO: 58346 - DNA, 799 bp, Bovine  19866880630763
aattgttcacttagagggtcatctaaggaaaagctatcaaggggagttacaaagcttgctaattctatttgagattcaacactaaccaagaaaagatatatatatatagaaaccaaggggcttatttccaaacagtttaagggaatgtgttacatttgtcttccttctgtggcaaataccagctatgtggccacattgctggaagaggtggggtggacctctcaacattttggtttatcagagaggatgacttcctaagtagatggaggtaataataattcagaaggaaagctaggaaaccaagactcttattacacagtcaggactcagatccattacaaagaacattcaataaaagaatgtggtatgaaattggaagaaaagtagaagctctgtttccctgtagcacctctttaagtgtgcacagaagaggaagagagaacaaagaaatgcccccactggaaagtcagtggcatagagagcacatccataaagactatatctaatattcaagagaagagctctttcctacagaacctacatacaaaagtccctcaacaaatatttgttgaatgaataaatgattagattaataaggaggaatcacttctaaattctagaaaatcttatatttgggaaaaataagtatttggagagtgattgacactgtcagtggatcaataggccaatactgaagtgtgctgttctctgaagcacggatccaagaagtaacagcccacagagacaactgtacaatacatttgatccaactgggaatcgaaaataccacctgaagagg

SEQ ID NO: 58347 - DNA, 994 bp, Bovine  19866880684788
atgtgaatttaggcaagtatcctaacttcacagcattcataaactcacctgtaaaatagggtggaaagtaagagccattcttaccttgtgagaattactgtgaggataaaatgcaacaaaatttatgcagagaccaatgcagagctggcccaagaatgaatgacaactctcattcatattaagttagatataaatttaaaaatatataattaatacaatatatgccttataaatgacagaggctcaataactgacttgaatttaaaaactagagaaatcaggaattccctggcatttcagtggctagtactccacacttttactgccgagggcctcagttcaatatggttggggaactgagatcccagaagctacatgatatgccttaaaaaaaaaaaaaaagactgaaaaaatcatcacttgaaaattttttcttccacttgtaggtaaaccacctactgtcgtgatgagaatgaccacattacacagttttagaggttttactgcacaaataaccaatggggtatcagtcactacaaactaccgtcgtaacaaatttaaagtagctgaaaaaattagagcaggaaataaatacctaaggctttccagctgtcagcaaaatgctaacctgcttgaatattttctcggtgtctgttttaaaaacatgagggctgaggtactaaaatttgtgatccaaaactaaacttagtaggacacaaataacagtgtgaatgttttggttgtgttatccatcctactttggttgatgggacttggggaaacagacagtgatgtccatgactgatcactgacagatcctgtattatgcagctacgcattgtgttcatcagaaaaatttgacctctgtgctgttcatggctcagaatgtgatactgatgtggcaaatgacatggcgctcaaaagagaccatattccggaatctgagtactttaccagcaaaactaattctaatatcactacatttccatgaggc

SEQ ID NO: 58348 - DNA, 752 bp, Bovine  19866880716419
agctggtacttaccctttacatacagtaagcaagcaaaggattagatcaccagcaaaataaacccatcaaaatcacctttttttaatctgaaaatattttaaaaatgcattttaatattgtcatacatagaagttttacattttatggttaatattaagctgactgtgatatatctcaggcttccctggtcgctcaggctgtaaagaatccaccagttccaggagacccaggtttgatccctgggtcaggaggatgccctggagaagggaatggctaattcactccagcattcttgcctggaaatgttcatggacagaggagcctggaaggctatcgtccatgggatctcaaagacttagacatgattgagtgactaacacacacacatacatgatgtatctatggggtaagtgggtgagagtttcttaaacttttctgagctctgagcctctgaaggtcctgcctggaagaacactggcatctcagtttgtcctgccatcacttgttggtatacaaggccactgctgagcttgtgggggcttctttcctctgcttattgctattgtttcaggccaggtccctgcagaggcctgcctggtcttttaaaggagggtggctctgagtgttatttcattctcttgttaccagcttggttatgattcatccttggtcaagtttccaagccctgggtctaatgtctagtccattctgggtacacaaaccaacatccttgtcagaagtctttctgcat

SEQ ID NO: 58349 - DNA, 1524 bp, Bovine  19866880722809
atctgagatgcagaagaaaactagcactgcctgccacgtgagtttgggaacatagcagtttttcactaaggaaacccaggcttggccgaagtgatgtgaaatggtcacaaggtcacttaactggaaaggacttcctacctgcaagtccacttctttcccttattctataccttagtcttccctctttttgctaatgaaggattacaatcccggacctttggtctcccactgagaggtaccttgttgcttaatagggtctcctggtcacagtgagaatgaactaaaacggtgctttgtgaagattcctcatgatttaaattgacctgagcttgtgagaccacatttgaatttataacctaacaaagtgccaccatctattttgacagaacacaactcatgccgtgatccaccctctccattcacaatgcgtacaaaataatctttcttctaaggctttttatatttcctgagaggagttttcttcctcttgctttttcctgaatgaggaagtgcttataatctcacctcttaaattacattttaaggcctcacaaaccatagtaaagggacagagtcagcactaatttcataagctatctctaagggaattaattacgacctgacttatttttcttttagaaagaagtcgtaaaggaatcctgtaaattttgaaaaaggaataaattctttctcaaaagaagtgagaactgtagtaaaatgttaaaatagcacacattaaagttgactggaatctcccgtaaaatcaaaccaaggcaaagggtagtaaatatcactctgaacaaaaatcagtctttccagcaataaagctgattaatatattacatttaaatgtatattgtgaaagacaatctgagccaaaatacacagaaattctacatgtcaagaaaaaggattttgagtcaaatttaatatgctttctcaaaattaacactcaaaagagaaaagatactgatttttttctgaaaagcttatacataccggagaaatagttaaagcaagatgttacctcaaaaaaagtagggtcactttacctgtcatcatatgaaatggaaatataattatttctttgtaaattttttattgtagtaaaagttatgtgatataaaacatactattttaccatatttaactgtacagttcagtgacagtaagaatattcacattaccatcatccatctccccagtttttcacctccctaaactgaaactctgtaccttttaaacacaaactccccattttccttccccacctccccagcccctgacctcaggtatctatcaaggcctgtgtactttctgactctatgaatttcactattctatgtaccttgtgtaagtggaataaaacagtatttgtctgtatttactgtatattggagaaggcaatggcaccccactccagtactcttgcctggaaaatcccatggatggaggagtctggtgggctgcagtccacagggtcactaagagtcagatacgactgagtgacttcacttcacttca

SEQ ID NO: 58350 - DNA, 1084 bp, Bovine  19866880788535
actagaatggattaaaaatttgaggtgttttcttgcagattaacactgctctactgttcaaacttagaagaaatcatgtaattatggataatatttatcctgcacagattgctgctatgaaagcatctttgtatgtataaaaacattcataactgggaaaacacttacatggtagccacctggttagagtctagattatacatgcatataaaagctattttatgtattttatatttttttctaacatctattacttgtggttactgttctttcattgcctttaatttgtggacactttctaaccaccacttgtgggtcttcagggagcaaactctttcacagaaacatttatttgccaccacgaagaccatgaggatagagagccaattcaatatttattctgtgtttaacagcatcctttgagagctggagcaaagctttcaaaatgtaaaaccagagggaaaaaaaaaaaagccccaaatccaaaaaccccccctggagttctggggagaatggaacaaatagagctgtttctaatacatacagtatgggaggtatttcatagaatatttgacataataacagcactggaaaaatgtaacaagagaaaaagagagtaaacctgtaaagtaaaatatgaagaccatcggtatgtttttattatatgatacagaacgattcacctagtcttttgtgtctctgcagtgcaaagttactaataggcccatctagaagaagctgaacttgaatggttgtatgaagacctacaagaccttttagaactaacacccaaaaaagatgtccttttcattataggggactggaatgcaaaagtaggaagtcaagaaacacctggagtcgcagagtcggacacgactgagagactgacctgactgccctgacctgagatggttgcttcacttcttaaatgcagaacacaggcagacacttcacctttctgaattctagacttcccatatataaactgaagacaatgacactgattatttttatgtatatcatatgtatatatcacatatgtatatcatatggaaggtaaaaaccaaaatcaaataatacctgt

SEQ ID NO: 58351 - DNA, 3168 bp, Bovine  19866880810340
accaagtccagagcctgagacaggggtggtcttggtgtgtcaaaagcagcagggtgtttgctgcgccttcatggatgagtgtctgtgcacgtctgcgtgtgtgtgtgtgtgtgtgtatggttagtatgcacgagcatgagtgcattcataggtatctttatgtttctctgttgaagacatgaatcttgaacataattaaccatgtgaaccaactcacattggcccagaaatgagaactgtcaaaatactgacaatttgaagtgggaattgtgcagtatcaaagaaaactgccacccagcattgtaccagaagcccctgggaaatccttctaagaagaattatttattaatctggggttgaaggccaggcaggcccatgttgtccctgtccaccaggctgattggaccttgtattgccaagcccagcctcctcccttaccctaaggcatctgccagcaccctgctagagggccagtttccttgtgactatatccctgatctgcagaagccctggtgagtactttggtaaatggatctggggtcctgggtcatatagttagcgctttgacttgatcttggaggcctataagagactttctggagtggggggaggtggggagagggcaagtagaagccatgctggagtgtctctttctctgcttatgctggggcatctggaacttttctggattcacctgaacatttgcaaatgagattgtacctttgttttcaaagagagccaagagggactagatcctggatcctgggctgctgaggtttcctgggggagggacgtctagaaaacaactttgaagatcagatgaaatgttaggattgaaaaatgagaagggtattcaaggaatattgccagtgatcttgacatataggaatacctgccaggaaatagagagggatctagcatcctgcctgggctaagacagtgagaaatttccagagaaaattctccccctggcaagtctttcttgcagtgagaaacaaacatcaagagaaagcaaactcaagttagttgtggctgggttagtaactagtagtgactcttcctccctggatcattagctcgcagctcagtgcctgccactgagtagatgttggttatctggcactgagggcaaaggactgtccagatataaggatgggatgcaggtagcagtagggcccaagtgggagaagtgcaagagcaagctaggtctccattcacgattattccctaagccagcaggcatgagtctctggccatgagtatgcctatttgctcttgcagaggacacagagaacataatcagagatttctgcagtaacaccagaggacaggcactggtgactcattcctctcaacaatgcaattatttacatccacctttgttgaagtattaattaaccagtgtcattgaagaatgtattaatacatttccaaattcccagtttggaggccaggaatggattatccatctctacatcacatgtgcccagttaggttataggttcagtaaatacgtgtagataaagagaacaagatgagataatctcccttgacctttcttacaccaaggtgaggatcatgtcgctgtttacatcacttccttttcttctcctgactgcggtgacagcatcttgtgcagacacagaaacagagaactgtgagaacatccggaagacctgccccgtgattgcctgtggtcctccgggcatcagtggcatcccaggcaaagatgggcgtgatggtgccaagggagaaaagggagaaccaggtacagtttgggctgttctttctctgcaactttatctcccaaagcaaactgcctggattgggaggagggtaatgtatgcatgctgcttgtattactctcaaccacatattatcatttgaaacagagatacggctctgattctggcatcccagactctcacacaggaactgctgacacctggtggtcctgccggctcagggagttgaccctcaagacatcccatgggacataggaggcctttcttctatgatccttacaaacagcagctcagaaaagttaaccctagctcagtgtctcctttcccctgggaagggattgggcatcatatttttttgagaaatagagaggaacacaaatattgagtcatgtttcctttttcctccaacaggtcaaggactcagaggctcgcagggcccccctggaaagatggggcctcaaggaacgccagggatccctgggataccaggaccaataggccaaaaaggagaccctggagaaaatatgggtaaggagtttactttagcaagggccaggctgaagtcccctggggtctgtgggctcaagtatcatgtgggacatgccccttctgctgcttcctggggagatgcccaactctgcttcctgactaagcagcctccagcttctctaggttacttagagcctcaggggttcctatcaattcctgaatacagagtcacaaaccgttcagagccaaaccctcgccagatgcctgctggaggatctgagccctggatatccttcaactgaaacaatttgatccaaaagggagaatatatgcattgggcttattatgcctattttcacaagagtggtagatacatggtatgtcaattatctcttacttcatgagaaacaacacacagccatttatttaaatcaaaattctgtgaatcaaataatttctttgctggtctcagctggagtcactcatgtgtggtctcacatacatgttggctattgggcgcccgtcagctggagtgatgaaggtgcctgagccgtgggtctctcatcctccagttgactcacctggccttaatcacacagaggtgattacaggattcagatgaaaaggaagagcggaaggttaaggcctccttaaggcttgggatacatacactattgcttccgccacaccgtattggtcaacacaagtcccaaggccggctcagattcaaggagtggggaatagactccatttcctcagagaagctgtgtcatatccaagtcatttttgccatctactacacatagcttgtctcatgccctcccccatggataatggacaactcacagaaatcctagtttactgattaacaggacaaactcagggaaaaacaaacaacaaaagaataaaaacaaaacatcgccaaagataaact

SEQ ID NO: 58352 - DNA, 1133 bp, Bovine  19866880824477
tggagaagctctatacagttagcccttggttaaaaatataaattttctatggtgctaataatccaatatttatgattttttttttttactactagataaaacaaagtgaagggaaatgacatgcacttacaaaaggcccctatattgataggacagaaaattatttttgaagtaaattccctctaactgaggaaaacactttatttaatgtgtaagtgattttttttattatggaaaagttttttaaatgagagaggaaattaaaatatcactaagagttctcttaccacaaatgactaatagggacatctttatgtattgataacttttttttttttctgcatagctttatttttgtttatagagatgcaagcataaaatagctatgattaaatatggtttattattttgactttaaacctactataataacataagcaaatgtgtttattctttaaaattccataagcaatattttcacaaaataataggccattacacatatacacatgatagaatatctatgtgtccatctatacacagaagcacagacacccaaagacatacacactcacatacacatagagatgaaggagtagtcatggcaacaccctataaaaaacatttacatttatactctcaattagagattaaacatatggaatttcttttcaaaataaaaatattcagaagtataatcttgactttataattggaccatatgccccttataaataatctttacttagaaagcaatcctgtccaaataatattttttgaaacatgagacaaatacattctgctaatattctaagtctcctaaaacaataagttaaccagtatagctaactagaagtttaagaaaatatagaatttttgagcaatattaataagctccaaataactgtctctgtatctctgcactgatcaatgaataatttaggacatcttgataaacataattgatggcattacagaatttagcattcctggtgcaagtctgaagtaactagtgtttcatggctccctctcacagacactctgtaggaacacctgccacctgtatggaccctcatcaaacaaacatttgaaacaattttgatatcacatgcctttttaaatatttacttggg

SEQ ID NO: 58353 - DNA, 1644 bp, Bovine  19866880905745
aataagatgctgatgtccttattacgtctccctgtcatttaaaattttttactctttggtaaacaacaaaagtctagaaacttctcgataataactaaacagtactaaaccccattatgagatttcttagaggaggacttagaaaaggatattaaagcaactatcagaattctttcttctatgtacttacttttaaaagaagtctagttaaactgagcccattgataatgttcttagaattcactgtatgcatccagtatataaagcaatgacacaagttcattttcttttaaaaataaagtacatatccctacttttacactcttgcttcaagtgtccactattagaaatgacatttttccatctttgcttcctgcatctcacattgtgtgatgcctagctcaaatgtctttccttttttacctcaggaaaaactcccagaatatttccacttgcttcttaaaaaatcttggaatatctatcataaactttcttaatattctattttatctacttccttaaggacaaacataacactcttatgtagttgcattgttttcctagcactgtcaaaacgaagtacaaaaaactggctgcattaagaaaaaagaaaagtattgttttgtcggtctcgaggctcgaagtctgaaattaaggtgctgacaggaccacatcatctcttaagggttcaagagaaggaactgttcaaggcgttttccctagcttctggtggtctcgggcattgcttgacttatagaatcatcactccaattctctattttcacatggaattctactgtgtattttcacataatcttccctctatatgtttccctatgtccaaataatcccattctataaagacaccagtcatattggattagaaagcatcctaatgacctcatttcaacttggttacccctgtaaagatctgattttctaaggtcacattctgatgtgctagcagttgggaccttaatacatctgtaggggagaatgcaattccatccacaatgttgtccagaataattaattcttgaggatcctgggagacactgagagataatgtttaaaagataagctgtgaacacaacataaagccactttctaccaagccaggagcttagatttgatctaacttgaaaagactggaagatatataggagaggaatggatgatcatatttaggtttttaggaaatgtatctattgtcttcatgtctttgtattactcactcaagatttaagagtcctgaaagattggaaggtttaattattatccctttgctacttaaggcaggtagaaaaaggacctagccctttggcagctgaagacatactttttgccaagacttctcttaatggtggattttcccaaaaggaaaaaaaaaaaaaaggactgtatttagaaagagaggttggaggcaaagttgggggggtggggagggagagaacattccttaactcaaaatgattaaaatagagtttactactaattctcataaaattcagtcaactttgcaagaatatagataacacaacaagatttgtgtgttccagttgtgtgttccagttgctgtgtgttacggttgctaacaaaatacttggaaaccttagcggctagacataataagaggttctagac

SEQ ID NO: 58354 - DNA, 1404 bp, Bovine  19866880948972
ggataggagtcagaccagtgataagagtccacagtactcttgcctgaatgcatcacactccagactcattggaaaattactgattttcttggatcaatttaatccaacccagaattatctggcttctggaacctcctgagactttcagaggggttagcactattgttctcaacccttaactgttcatcagaatcacccagagagtcagccagggagctgtaaaagtgtatagataatatgatacttcttccagacattgctgatttactagccctgtggtgggacccctattaagtggtttctaaaagatgctcaggaagttctgatgtgcagcaaatggctgaagatgacttgtttggatatttccagaccaattttccaaagctcaaatataaggatgtggggtcggtgggtgggtgggggacattgcaagagcttaagtaataacaccatattgtaaatatataaaatggtgtcagagtagtctgaaacagtttactcccttagtatctgaaatttctaaatccagcaagcacatggaatattattcaaaaaaaagtcattaagaatttgactgccaggaaatgcttgaacacatacaaacactgtcattgggtctgatcccaacagatgtcccttttagacacctgttggagtgaactgtgccactgaccctttaaatgggatggagctttaattttccaaaagcagggacccagttggaatgctagaaatgcacatttgttgcttatgttccattctagtaaaccatctcctgaagaattatgttgatctcttgattgtgtagttaatgagataagtctacaagtagcattcagattgactagcagtcttatttatagaggtgtactggaaggagttgatttcccataatcagctaaaaggagaagcaatgttatttttaccttctcaagagtctttcaagaattgatgtgtgaaaaaggagaactgtcctcctaaactagaaactgttgaaagctcacctagaaagctatttcgcatttctcccaagtggggagtctgaatgtgtgtttgatcataatggaatagctaacatgttagcacagcttaacaccaaacatgcctgtggatgattctttccaaaacccgacataaacaagctgtcttagtatcattatttcaggcacgttcatcatgtctatctatagcatactactgaatcaggtactgcctggttgaaggtcatggattacacatagctattcaaatactttatttttgagacagctgaattactccctgacctgactttagtgagtgggaggatcatctttatgccttcctgccctttctaaaaatagtagagccttttaacaaggagatattttaagcagctcatattcactgtctcatcaggagaca

SEQ ID NO: 58355 - DNA, 747 bp, Bovine  19866881064971
cccaataatcgagactttatttcagtgtgcatgagattgggatactaataatatctaaatgttatgtatatcaaaataactgtggatttaggtctgggggtggcaagactataaatatatataattacattttttcctatatatgtatattttttctatactgttcacatgctttaaaaatagccttttcaccaacataatatgaaaaatgatatacttgccttcacactgaattatcaaattgcttcttttcaattcagtatcataagccaaaagaaatacaaatagtcacactttacaaagtaacagcatgtttttaaagttaagaaaacaagttagaaaagtatccaattaatgcatatggcattgagaattttcacgaacaaagtggaaactgagaaaagaactaaattttactttattaagaactatctgctactgtcattctcaataagaagtgaatgttttcactaaaacaccattactcataagcaatttgcttgaatctccataactcggataatactaagctcttttgagaagagacaattctaagatgtgacttgaatccatatttttgttttagaggagatatatgattatttttactcatgtttctggggattaggatttgggaagaaaaaacttccacttcatttcttatttttttctgagcccttcaatctcctttaaacggaatagggtcaattcctagttgggaataaccacaagacaattagaagttaa

SEQ ID NO: 58356 - DNA, 1075 bp, Bovine  19866881094329
agcttgctagcctcctctgtcctgggattctccggcgagaatactggagtgagttgccatttcctcctccaaaacaagaacatctctgaataactactgggtgggtaaaattatttttataactgcttcttaggaaaaagatgttatctgtttttctgtccaatgggatacattttcatgttaaaacatgagcaagaaatttacatttctcaacaagactcaaattagtttaaagagagaccaaaaaaaaaaaaaaaatctaagtctatacaactgagatagaaactagtgttgtcattgatagataagctggagccactcaaattagccagaggttgaggatgtttggctatttttgtggctgaacagtgctcttttctcagtgttcagacataattacagagtggtcatgtttgtatcttgtttgactacagtccctggtagcctctgattattgataatattctttgaaaaacatttatattctgagaaaacagtatgttgttagcaaccaggacaattttttttaaccttctagagtttcataatttcaaaaccataggattctttccccattctttcccactttttcttaaagattattagtcagagagtttcatcaaaattaatcatctataatttcccatgtcagcctctgatataaaatcaattagagttggcaagttaaaagcacagaagcattcaagatctatttgcaagattcatttgtagtagaaagtgatgaaccatataagatttatgcgtagcatattgaaacacgcatcacttttctattagaaaaatttacttaactagctgtaacaccctctgcaaatcaaaggaagcaaataaatactgcaattagtactctgatatacaataagcaattaccaagtgaaatgtgatggacctaaaagctagaacacaacattcagaaaaataagaccatggcattcagtcccatcacttcacggcaaatagatgggaaaacaatggaaacagtgacagacttatttttaggggctccaaaatcactgcagatggtgactgcaaccatgaaattagaagacacttt

SEQ ID NO: 58357 - DNA, 1670 bp, Bovine  19866881197483
agggagagaatatatgtgtatacttaggggctgattcacactgttatatggcagatcgatacaatattgtaaagcaattattctccaattaagaataaattctttaaaaagaattcctcatcctatttttatgaaagcaacttcaaacttactttctaaatcatgaatttcctaaggaaagtcattgaaatgaaaagcaaaaatagcaatttcattctttatgcaaattacaactacagagttaaggaggaagagaaggactaacaacatggtcattactaaaatatattttgtgatgtctatacagtcaacaaggcagagtggaccagtgtgtcttccaggtagggcatctgcctcagctgcctcaagcttctaaggaaacttgtttccaccttcttcagtataatctaggcagcatatcctttaacccattgcatattgtttattctttggcatttgaataatggtaaaccttagtaaatgcttgcgtctatgtgtgtgcatgctaaatcacttcagtcgtgttcaactctgtgctgccctatagactgtaacctgccaggctcttctctccattggattcatcaggcaagaatactgggtgggttgccatgccctcctccagggtatcttcctgaactagggatcaaacctgggtctcctggattgcaggcagattctctactaaccatataaaataattaaatctctctatataccatttaggagtaaggttaaaaaaaagtctattaaaatatataattcagactgaggtggtttgctttagaccttagattgggagattcactggatgttaaccctgtaaccgaaagaactcagtcacatatacttatagatattttacctagcagatctctcaagggaactgtagcctctttcaggatatgcatttattcctcttcaattaaaaataaatacaacaaaaggaagtaggataaacttacaccctagtaggcttacgattcagaggtggaaggaggcaaggtcagaagagccttgggtactattttggaaggaagggaaacagagcctacataaccacccttgcatgacctgtggtttgagaaacagagctccgaacagttcccacacaacagctgtttccctgcatccccatcgttgaggacaggaagtggaatggcacagagagtgcagtttataggatctgttctctcagaaagtgaaacaggatctccaggctattaaattcactccagtggcgcatctgaactcactggttaaaagcaattgtctgcctacgaagaaaaagcttgcatttgtgaaaactgaagagcttttagaagtattatgtaaacacttgtacagtcacctggtttaaacaaaactatatgaaaatttagagacattttgatccatttaattctcataacaggatcaaggtgatctggaaatatatatatatatatatatatatatatatatatatatatatatatacacatatacacacacacacacacacaaccacataaaggccaaaggttcaattctctctaagggccatggaaaaaaatgggtatctagttccagccataggaatcaaaacctatctaaggtgctctacagacctgcttttactaattgcatctaattctgggactaaactaatgcttaaaggcaaagatgag

SEQ ID NO: 58358 - DNA, 1187 bp, Bovine  19866881240328
gggaaaaaaaaaaaaaactctggggagagaataatatatagagtaaggtgttgggattatttgttgttaatatttatttcctaccttactggtaatgactatcatattctggattatcagtgaaggcattttagactcaaaggattattgaatactcatgcaggcagtttgtaatctgaagggaaaacagtataattgcattttctaattggccaaatcattgttgttcttttcagttaatttctttattttattttcccatgacttttccaattctcataagcttgtaaatgggttgtgcatggctaattaaagcctccatgctcaaaatctattcctacgagtatgtaaatgtttgatgagtcatttacctctagtgtgaacacagaaaggaagaattccttatagaaaagctcactatgaaaataaagaagtcctgcaaggggacatgcttcttttctttattttcccattttcgtttcatttcaaatagtgctatcatttgcctttcatgcacagtttctctaacttctgctgaattttattatggtgaaatacaagtgggtaatattgtctcatttgctcaacaggctcttggataatagaattattagcattaaattatattttgttaaaaggtttgaagaattaatgatgataagactcagaaagatcaatggcatttttggggaggaccagaaaatgataatgatttctttactatcaaatatttggaagatacctaaagggcagttcacctagaaaaagcatcccaaaccttattaatttttaaatttaacaatacaaaataaccaccgtacttttgcattaaaaatatttccaagagtgataaatatagaataaaatttttaaaaaagtaaaaccaaatccaaattattcaaagttaaagcttcagtttaggttaagagaacactgccctcagttgctatgaccaaagattttgtatttcagctgttcacacaattcagtatctttgtgctcaatcaagaaggaattacatccgacttaagcacaaatcagccagaaggctaagaaatatctaatactttctgtctgtcctttctacgactgtcttgtcaattcttaaaatgagaattacttgggattcagtatttcttaatgatggccttatgcttgtgatcaccacaccaggcaaaaggcactga

SEQ ID NO: 58359 - DNA, 1214 bp, Bovine  19866881356961
tgcctttacagcatcggacctttcttctatcaccagtaacatccacaactgggtattgtttttgctttggctccatcccttcattctttctggagttatttctccagtcatctcctgtagcatatcggccccccaccgacctggggagttcctctttcagtatcctatcattttgccttttcatactgtccatggggttctcaaggcaagaatagtgaagtggtttgccattcccttccccagtgggccacattctgtcagacctcttcaccatgacccatccgtcttgggtggccccacatggcatggcttagtttcactgagttagacaaggctgtggttcgtgtgatcagattggctagttttctgtgattatggttttattgtgtctgccctctgatgccctcctgccgtctcatttgggtttctcttaccctggacgtggggtatctcttcacggctgctccagcaaagcgcaactgctgctccttaccttggataaggtcaccccctcctgaccttaaatgtggagcagctcctctcagccctcctgtgcctgcgcagccgctgctccttggatgtggggttgctcctctcagccgccacccctgacctcagggccaaacaccatacgtgacactaaatatgaataggtgattaacagagctttggggcttaacgttgaatagggagaataatggtattaataataaatatgtcattaaaattgcaataagtaattaagactatgatggatttctcacaaatgtctgatacccttccttggggaaggattttacttcccagtcctattaatggcaggctttttggccaacaggagacacttttttggccaacaaattgtgggagaacatagcataaattattttgctgaagaactttaagtaccaatatatggtttgctatatcttttttcctctatcacaatgacaagcagtgttccagatagaagcatctctgtcagtctaagctcaaaagtgaagaaaacatagagtccagttgcaaccaccctgagatgtactagtagcaagaatataaaatacatttttgaggttgcaagccactgagatttttgaggtcactagctaccacagcatatcctagtctgatgattcactgacttttcttttaattgaaaaaattgaagtgcaagagtgtgcgaggccacataatagagtccctaaaagcaggaa

SEQ ID NO: 58360 - DNA, 1079 bp, Bovine  19866881375092
actggcacagaatgtgagttaaagaaccattaatgagttgggagagttgaaggaaggccagccaagcaggcaggaccaaggcatggcttgtcaggcaggaagagaaatacataccatgagatgagatgacagcaccagccacacgtttccttctttacaatttctctctctagatttatacatgtgttaaacaaaaatacctatctatacagttttagaaacccaaacagatatccacaagcacacacatacacatgaacatacaagctcacacacatacagtgggcaagtggagaggagagaaagagagaggggaaaaataatggaaagaagacaggaatagacactgtccttttagagaaaatttggaaaatatataaaaggaaaagaaaaagtgatgaagagatgagtgcttgtgattattatcctatctttcatataacttagctttcctggtatctcagctagtaaagaatcctcctgcaatgcaggagacctcagttcaattcttgggtcagaaagatcccctggagaaggcttaggctatccacgccagtattcttgggcttccctggtgtctcagtcagtaaagagctcatctttaatgcaggagacctgagtttgatccctgggttgggaagatcccctgagaaggaaatggcaatacactccagtattttgcctgggaaatctcagagacagaggagtcactcctctgggttcttaaaagagtaggacacaactgagcgactaaacaacaacagcagtttaacttaagatgaaaggtttttgcagagtttggaatgcggggtggggagagccaggaaaaaaaaaaaaaagaggaagaggattttacagaaatttagggagataaatggcatacctaagaatgagagctttgcattttatgttgttctttactcgaaatactcttgctattcaagatctgggccttgcttggacataatctgtcattcttgccaaatgtgtgtggtattctggggatgtggacaaatctccacaggaacttggctgagacctacagatatatttttacctccaaaggcaaacaaccaggg

SEQ ID NO: 58361 - DNA, 1382 bp, Bovine  19866881427271
cgggcacatcaggcaacacctggatcaaagttggcaggagaagccggcaagcaaaggaggctctgaatccttcttacttctcttctgataaagttgatacttcctgaaacagaaaagccaaactgtgagtgaggcttgtttttagacatgggcattcaaatgacctgatgttggtcaaactttgatttaaaacatttttagaagtcatttcaaaagaatacaaatatgctacaatatgtaaaaaacttacttacctttgacattttagctattcatcccccaaagctttaaattagtaacattgccttcaatattttaaaatttcctataaaatttcaaacttttaaatttcatgtaactttcaaaactccatcttcttttaacacaggggttttttattttcggtttttgtctgaaaattcaaattttttgtgtatttctctgcagagctaagccttcagtgttaggcagctcttggagctctatacaaaaccttggtttatgagataatctctaaggatgtgaaagaattggatctctgcttttgcacttgtgaggcttacattccacccagcatgagaaatgagctcatgttggctggttaaaaataagtaaacatgtcaactgaggacaagattatgccaagtgactacacagctcattgtttcaaagcacgtttgatgtagcctgaatgaaattaacagaagagatacacttgtatatgacaaatattatgtctttgtgaagattacagaaaaggctttatcctgtaaaagaaacacctagaaactagtcacaaccctgcacttgaactgtccatactcagatgcttattctggttactttccttgctaagtcatggcaccacctggtctgtccatttgaaactttgattaactcccccaaataccagggtagtcacactgcatcggtatcttcctcgcatagaacattagaaatagaagagagatacccaggtccaacgccttcattttacaggagaggaaactgttagctgttctagagaggcagacatagtcattttaaagtcagacttcttggaaatgttatgaaatatggcttttcagtgttactgtacccacagatgaaatattgaaccagtacaagagcatcttccttagtgacacatactctgggatgcttaatgtaccttttctggtccctagggtaccatttggaacagtgaaggagttgagttacattttggtgcacacatgaatgtctcagagcagctttttactccctgggagaactcaacattatttcatcactcatttcagttattctcccagtttgattatatgcacataaactccaacagtaaaagacaaacacaatgttataaatattcaaatagttta

SEQ ID NO: 58362 - DNA, 1179 bp, Bovine  19866881455554
tctaccttctgtatctctaagtaaaaaagtgctatcctatagattgtagaacaagtctcccctgaatatctagatccctaaccccttctgcactgtgtttagaacagaggggcaaggaattctagaaatccagaaatttggggctattagttgagagctccggaagatttgtaataataagtggtaagcctgattgcttggtgcacaggggcttactctgacgaatttgcaataaaggtagctcagggtcctgggcagaaaactccatacccatgaatttagctcttatacaaactgctggactccagctttcctggaatcaaacacacatactcaaatctggcatcacaaactcattaatcactagaagctcacattaaatatgataaagaccttccctctcactgccacccttcaacactgccattcatttcaccttcttctccagaagtctcttttcccactagcagtcactaagcactcagtgtccactcatggtccctgagaaaccataggaaaaattcttcacatatcacagaaagtgtgtgctctccaagtgtttgattttggccagtaacatggctagtctcatgcctgattgtactttcaaaccatattcgctgcctgattaggataatctgtgtcaaaattgctatctctgtgtagcatatctagaaggatcctaaggaccagtactgtgtgtactgaccttaatttatcctaccttaattatttcccaatctatttatctttctcattgtttatattttccaccaattggtctgtttttcttccattggtacatatacatttctgggaactacatcaaattctttcttcaaaggagaagtgttatataaaaacataaataaataaacattttttgagtagcactgaaggaacattatggttaaacctttagccagaacttatttaaatgaagagcattggtggtctgactttcttaaatgttttaaaaatttcctagcattctgtgagggtgtgaatgataaatgatacattatctgctaaaattttattatgagaataatactaattttgaccatataggaggtaaacaggaaagtaaaattagatgtgattcagtttggcacttataaacaagatggtattataatgttgtttgaggggataaagtttatttatgaggtataaagt

SEQ ID NO: 58363 - DNA, 1737 bp, Bovine  19866881619068
tagatttcaagtaaagcaaaagtttgtactattgaattttcctagcaaaataagaagaggggatagggaaatgacttgtttgcacttttatttaataattatttcaaaatcaaagcaatagaacaaggctacctttaactgaatgtcatagattatcgtttactgtgaaattgataagatacacctcttctctcttcctcctgttatgcagttaaactgcataaagtttaatcctcactggatccttgataagagacatctcgtcattttgcccacattagaccttatgagtagctacagcaagcatgctttttaaattcgaattttccttcaaaaacgagtcattgtcttatcctacaactatatcagtacaggaaaacacacagaaaaaatctatactgatggcacaatatttgtcataacaaaaacactggagacaatttcaatatctctcagtagtgactctaaggtatagcttttccaataggctacactcttaaggcaactgttgaaaggaataagacacctctctgtattacacagaagaatctgcaaggcacgttaaataagagtgcaaggtacaggatagtgtacagtatgctaaactcgtttgataaaataccttgggaatgcattcccaagttcatgtatcttccattcaaataagttgtttagaaattcaagtttcagcagccgttgtctcaaatgtttgagattctttaaatgatccttttgattttgtattgtatctgacttccaacttctagcctccattactaataaagtgtctatagttttgataaattcctttttcacctttttcgatgtgcagaacctctttgtgatatcccttcgtaagtagtcagttgggcaggaggaagaggcatgcctcctcggtgggcttctcattctcccatccccattatgggatgggaagcaaggagggctagaaccagggctgatgagctgatacatgcagaggtgaagtctggccacagctggttcctgtataaatgaagggatcccatcaccaaggccttttaaatgattgctcctctcccttctggaaacagaggcccttctttcttctttccgaagaaagggcttcatgtttcctttcctctcttgtgctttattggagatggcaggccttagaattggccttcttggcacatcagccaactagcacaggtagaaaaagaaagtttctccagggtaaggaaaccggagcttccaaacaaaaggaatgtaatagcagacatcccgccagttctcttctcgggcaagaaccaaccaacacttgtgtcctgttggcaaaaccccttgagattgaaccacttccgggaatacaaaaacagcaaacattctaggacatctgtgttatttcatgaaactttttagacaaattgatcagtgacttttctctggaatgccttggacctagcattttgtggttttgatgtagactttttgaatattaacgaataggtgtgaattgggacagttgctctcttcttcagagagagcatcagatttgtcagtatcaaagttggcaaatgcaaatacaaagccagtttaggcttcatttctgtgggttttcttttaaacagtatatcctatccttttccagtgaacagatgtctggttgaacaaaaattgaaatagtcaattcacctagcaagagaagcaaagaacaaaatgagagaggatttgtgatttttaggtaataattattta

SEQ ID NO: 58364 - DNA, 1390 bp, Bovine  19866881782493
aatactggagtgggtagcctttctgttctccaggagatcttcctgactcagggatctaaccctggtttcctacattgcaggcagattctttaccatctgagccaccagggaagcctcaagtatatatgaggaatttcatgaaatgaagagaatgatgcagagttaaagatggaggtgactagaaacagaggcagtgttcaaaatctaccctctcaaccagtttgctgtgaggagaaggagcaaggctgggcactgtaagtggtaacaacttaaataagaaatccacatttgttctcttttaattaaatctgtttccaggagaggcaaagtagcacttgaaaaggataagcttggtagtatgaacaaaagtatatgttaggaggaaggaagagagggggaaatattgcagctttggggccccagataggaaaagagaagaggaaaggaaattatttcagattgaaggaaaacggagaaacttgttgtcatgggattatctaagccagctttccctgtccttctcctgaccactgacacatatttttgagaagcaaaataactggaggggggcaagaaatgcacatgtagattctggcaaaacacccacaggctcattaacaccagccgatctatcctgcccggaactatgtagcatgaaaaatggattctaaaaataaggcctggatgtctccctaaaggcacaaacttaaaggaaaaagctctttgtggaattttacttcaggctatttggcaaacccaagcagatatagatccatacagggacacttaatgaacacaaactaatcatgtcacattttgctctgggcagtcggtattctaaaattaaatgctagctcccacttgttacccataacagagctgaaggaactgtctaacactgtcagaagagatttccatgcttgaatcaagcataggaaatgtgtaagatctggggttaataaacgtctcagaaagggactgaacagagggacaaaatctaaaggtgttcagaagtcagaggcttgtctcagccagcacagtcaccaaatttggctttctttttgtgaaggacttatttttgctgcatttgtaagtattctaaagtttatccctaaaaccagactaataacattggttgcaagacagtggataatggagaagagaattcaatataagaatttacacattccctcttaaaaagtaaatgtatatatatgtataaccaaatcactttgctgtacaacaggaattaacaacattgtaaatcaactatacttcaatttaaaaaagtgaaaaaaacaaaaatgataatttataccattctttacaccactagtttcacatcactggcagaggtttgggggggttgggaaagccatgggcttatctg

SEQ ID NO: 58365 - DNA, 1200 bp, Bovine  19866882056595
tgccccatcctgggcatcccgtcatggaactgcggcacaggtgaaatgcgaggtgacctttgccctccacttggcaagagccagacccttgttgtgcccaaccagggtgccgtggtttaagaaagttacggagaaagtggatatgatttaggagtttgcaccaaaaatgatttcctatccagaggttaaggggtgaggctttacaatttagaagagaaatggatacgttagagcagactacttcaggttcacaaaggttaatgtgaggatgactgaaaattgtttcccatctgcactcatgacagatcagaaagtaaggagcttagtggtttgggggaattcaatacaagctctcatagtagatcatttgaagacctcaggctctttcttatattggggaaatgcgtgtattctcaggacttggcctgacaatggtagaaaagaggaaaattatttcatcccttcccttttctacaggcaaagctgaaaatgatcaatgggtagttattattagcatattttagtaataataataacactgccaaaatgtactaacctattatggggaaggcactgttttatggagtttaactcattcaatctttgcaatctgttaggcacatacccttttattattctcaataaaaaaaacctctgaggctcaagaggtttaagtaaatgactaatcacacacagttggcaagatctgaatccagaaagactgactccagattctagcttttagctaccatgtcatactgtctcatgtctatttttccctccatagatattttaacactaaactaggagccacaaaagagaaaagagactctctgaaggtttgacagaggaagaggtgaatagtggatcatcataaatacaggttcttgaattctaacagactttttaaaaaaaagaaaacaaaggtatacatatgataatgaagtgtgacacttgtctgattttataatggtggctgttactggcgtgacagaatctaaatatttttagaagtcagaatgattacaaaagaaattctagtttaaaagtcagtagttctgggcaataacaacagctctttcagtgccctgtgatcttaggtcacttatacacattactcctgacttctttcctgtgaaatgtggattatacctcccagagtagtataaaggcaaaattatacacaggatatgagagcaa

SEQ ID NO: 58366 - DNA, 1457 bp, Bovine  19866880408608
tcatgtatggatgtgagttggactgtgaagaaggctgatcgctgaagaattgatgcttttgaactgtggtgttggagaagactcttgagagtcccttggactgcaaggagatccaaccagtccattctagagatcaatcctgggtgttctttggaaggaatgatgctaaagctgaaactccagtactttggccacctgatgcgaagagctgactcactggaaaagactcggatgctgggagggattgggggcaggaggagaaggggatgacagaggattcgatggacgtgagtttgagtgagctccgggagatggtgatggacagggaggcctgatgtgctgcgattcatggcatcgcaaagagttggacacgactgagcgactgaactgaactacaatgactaaatataaaatacactcaaatgatttcagtatgacttttactacctaaaaaacaatggaacttggaatttaggtaattccatggcagttcttcccaagccagtaacaataaatcacaaaatttaagagttagaaaaggctgtaaggataatttaattcaaccccttatatcacagacatagaaacaaaggccccaaaagtttaaacttaaacttgtacaactaatatatgggggaaaaaataactagaaccttgatgttctgcctcctcaaccagtatgatttcaagtcttgcctctaatatgatgtaaagttactgaaagtatccttcaaatttctttattggttctatattatactgtgataatagtcagaaatgaccactatttaataaagaaaaacaaggaataaatcattaaaagtattttaattactataatcttgagatcaacaacatattggcaagttttctgcagtagaagtacattcctaaataagtagatccagggcaacagctagcaaaaaagaagtaattttatctcaaatgccaaaaagtcaactttcaacataactttatcaatgtgaattactcttaaatagaaataggaactaaacatacatgcatcaaattgtaccttcattcaatgatatgacaccaccaatcaagttcatacatgggcaaatacattaagtatatacaaataaatgtatgtttccaaataagaagctacaggctcactcattcctgaaaccaaaatgttcacataaacatactgtcaaatatggcaacaaaaaaaaaatgtaaaggaacatatgtacaccagaacccaaactgacatgtagacataaaacagaggtgcttatacagtatacttaaacatattgctcagccagaaatagctcaaacataaacaaacggtgatctacaaacaccaaaaattattgtaagctttttgctaccagtgaaaactcaacagttcaccctaaaattgagtttaaaatgcttatgcctcaaataaaagaaactaaaaggaaacctaagccaccccccaccca

SEQ ID NO: 58367 - DNA, 1213 bp, Bovine  19866880463461
ttttcactttcatgccttgagaaggaaatggcaacccactccagtatttttgcctggagaatcccagggacgagggagctaggtgggctgccgtctatagggtcgcacagagtcggacacaactgaagcgacttagcagcagcagcagcatgcaaaataaaagaaagtggaagagtttgtgcatgaaaatctatagtcaacttcagaaaaacaccaaaattagaaagcatcttcttaaggatcaaaattaaaaagaaagaaattttcacccctggttgtacaagctgatgtggatctttctgcattggattctaacaaaataatactgagatttagatccatagtcaattcaaataaggtgagatttattcccacttcatttcaaaatacctcatttattttagggtagtgtttaagttcccttcaataaaatccttaggatatgtaggaagcaaagtaactgtgggttctctcacatctttcttctttgtagatttaaaacccatgaacaggtcagcaacacacattgtgatggagtttgttctcctgggattccctggttgctgggaggtacagatttttctcttctcactatttttggtggtttatgccttgactttggtggggaatggagccattatctgtgcagtgaaatgggacccacgactgtacacccccatgtactttctgttgggaaactttgccttccttgaaatctggtatgtttcctccactgttcctaacatgctagtcaacattctctccaaaacgaaggccatctcattttctggctgcttcctccaattctatttcttcttttccctgggcacagctgaatgtctcttcttagcagtaatggcttatgatcggtaccaggccatctgtcacccactgcactaccccatcatcatgactcggaggctctgtggaacactggtatctctctgctggctcattggattccttggctacccaatccccatttttttcatctcccaacttcccttctgtggacccaatatcattgatcacttcctgtgtgatatagatccactgatggctctgtcctgtgctccagcccccattactgaatttattttctatactcagagctcccttgtcctctttttcactattatgtatattcttcgatcctacaccctgctgctcagagctgttcttcagatcccttctacagcggccggagaaaggc

SEQ ID NO: 58368 - DNA, 1235 bp, Bovine  19866880587279
tccctttgatgctcttaagtcagggtgcaatgactttttgcaccctaagtacactccagaaaggccatttacacccacctcagagctctcctagttcctctgccctcggagatcctgtctcttgatatcctgagctctttggcacctccctcgtctcagcccctcccctttcatcttacaggtggacagggtcattgtctttggccagactacaaatgagaaactgataaatgcagccaaacagctcttctggcagcatgtgaatcccaagtgcctctttgttggtgttctcctaagggcaagttacctgtaagggcgctcatgttccttgctcagtgccggcagatagtgatccatatttcctgtctatccctactaaagcttgggatactcccactctctaggccccttcccatttctgcctcttacctctgttgcacttctagtgctagaaccttctctgaagtcttcagcctggccccgtgcccctttgtgacggtccaccccagttctagtctagcacggaaccctattaaaggtgcagaggtgggggtggtgggggcagtgactctatgttcctggcactgtttctaactgctaatgacttcttctttctttggcagatgtaccgatttgaatcccaatgatgtgacactctcaggctgtactgatgggatactgaagtgagtatagcatggacattggagaggttggcggctttgttagaacatcttttagagattatctgtggtttctgctctaaccactttcattttttaagcacgataaaagattattctgcttttacagctgtctaggcatggcagcaacatgatattacaggtacctggtcatcttctatctgttgctctaccattttcaaatactctgcttctactttatagttcaagatggctactacatctccagccatcatttttgtattaatctagtgggaaaggagaaaagggaacataggagattgtactgtttgcttttaagggtacaactcaggagtttgtcccatcatttctattcattctctgagggctctgttccattccatttcagaggaaataccacgttaattgtatttatttatgcctgatctacagaaatctttgtttgtttttctgtccgctatcaggcttccaatttatttgttttctcctctgctctttcctttggatgccacccattgccccatgttaggaagcctcatgctcctccctccc

SEQ ID NO: 58369 - DNA, 1190 bp, Bovine  19866880625671
ccggtgcctggcccccttcctgacctgaagaccttggagaaaccacctgggcatatgtctgcccactcagacatcctctcctcggagaaccggtgcctggccacccttcctgacctgaagaccttggagaagccacccgggcatgtgtctgcccactcagacatcctctccttggagaaccggtgcctggccacccttcctgacctgaagaccttggagaagccacccgggcatgtgtctgcccactcagacatcctctccttggagaatcggtgcctggccacactcaccattttaaagagcactgtgtcaatcagccccttgctccagaatctccagatatctcacttggctcaagctgatctgtgcagcttgaacagcagcaaccacctgctttctgagcatccagcctcgagggtgcagtacctctctgagggacgaggccttctgacctgccccagggtctcgaaaaccatctctgccccagagagagttcaggaagcagttctggtaatggctccaggcagctgtcttcactgcagccatatgtgttggatgctctagtcactagctttcagtgccacactgtccctctgttctgcatctgtgtaccctgtctcctcacagtctcttcctgaggtgccctttacccaaaggttctcttcatcagcatcaatactcttattgcatatatagttcagagattctgaacagtagagcaaaagtagattttgtttttagaaagcctctgcatgggaggagagctggcattatattgcagtagcagagtcagtcaggtgcttttgagatcttacaaggcagagacacgactgtaatatcctggatcacttcactgtgtgtgcatgtgcaaacacacgtccacttacacatctatataaacacctttggcatacaggtcaggatcgataggcagatacacattccttctgtggagacttgagatttggactgagggaaaggtgaatctgagcctttccccttctctgcctattattacaagccactcagacttgggcaagactcttaaccctttgaagctttaattttctcacctttaagatgaagtcagtgaaagtccacctcattgagtcattgtgaggattacagctactgccaccttacatttattcagcactttgcaatttgcaaagagtcatatacacatccca

SEQ ID NO: 58370 - DNA, 1492 bp, Bovine  19866880673453
atcagcatgatatcgccaacctcaaagttggggttgagccctccagctgcgttggtgaccactagggtctccacacccagaagccggaaaaccctcactgggaatgtcaccttagaagtgaaagataaaacatcagagagttttctttaaaattttaccaatagacccatgcagataaacatgacatacatcatgaaagaagagaaaggagagaaccaaaaatctaccttgcctaatcagctaggtagtaaaataggagagagagctctatctcccttcttccagacccaatcaggcttgtgcccctgttttaccttccaaaacggatagccttcatacatgtggaacctgccctgcatcatcacacaggctctgccattcaagatcccaaacaccagtcgaccagcatgacctggcactgtatacagaaaagagaaggaaatgcatggaatgatgctttcatacaacacatatcccctgagcacctacactggcccgactcactgtgttcaacatgtgagggtataattaaccaatagaaaacatcatcctctccactctcagaaactttaagtctggtgggggtgtgctcagtcgcttcagtcgtgtccagctctttgtgaccctatggactatagcctgccaggctcctctgtccatgggactctctgggcaagaataatactggagtcggttgccattccctcctccaggggatcttcccgacttagagactaaaccagggtctcctgtactgcaggtggattctttactactgagccaccagggaagccactggggggagacagaaattaatcataaacttagatacaagtacactctgagattacagcgatgggggcaaagatgtttaatgtgaatatacaccagttactttttaaagacctttaaaagaatgagaaagacataaggcaagagaataaaagaaataagtgggtaatagaatagtgggtaaaaatagagtaagtaggtaataatgaatgcatcgagtgttgtagtcatagacctcttttccaaaattttcaaaactctcaaaatgcatattcttatgaacataactaagctatatgcttcctcactcgtgaaaggcagctcatggtatagcctagcttcctaaaaaggctatgaacaaggaaaggggctgacattggacccatacaaatcttttttgtgactcacaaaatagtcctgtgggaatacatgtcctgtatgtgacaggtgagggcgtgggactgcaaagataactcctcacacagacacagtaacaattcttactatttctctcatgctaacatttctgaagggaatgaatggtctgggagaagaaccaaaacaaagagggagagctcagagggtactcagagattgaggagcatatgaaaaagttacctgtaatagagcagaggtgatacagttaggaaaacccaaatagtatataaaaaataagttgacaaagtttacaattaataat

SEQ ID NO: 58371 - DNA, 3547 bp, Bovine  19866880715104
tgacaggttggtggaccagcgtgggcagctgatctcgggactggatcccaaaagatccttccccgggtgagtgtgagaaggaggtgaggtgggatgaggtagggagaggggcttctccagcaatattctccccgctctccttcttcatcactacccttttgtccaaatctcacagtgggtgcacctagtgctgagcgtgtccagtgattctggcctaggggagacccttgagcagagtcaaggtgcccacgtggtggccctggggcctctggagccatctgcccgggcccagctggtgcgagaagaactggccctgtatgggaagcggctggaggagtcaccgtttaacaaccaggttgggtctaggctggcgctgatagatgtgaggggtgaatctgggacctatgagactctgagtgctgaagctaccagctgccccgcacagaccagctccttcattttctcaggaagtctgtgcaggggaagaggattgtgattgctgataatattacctggtccttttcccctggtaaatgtcggttatctatctgggtgggctgaaccagcgggtgtggggggagagtggagcgagctgggcagagcagtgccgggcagagatagctgtgttctgagtagcacggtgggtctctcccctgtgggggctctcagaggagaagctgccctgcactgggcttggtgcccgagtggagggcagtgggccagctctctggtccagtgctgagtcctctgagtctcatcagatgcggctgctgctggtgaagcgggggtcagtgctgccgctctacttgcgcttggtcaccgatcacctgaggctcttcacgctctacgagcaggtcggttcaggatgtgaaccctcacttctcatcttctgtatcctaaccccatttcccattctccattcaacctcttcatccgcatccctcaccccttcccaccctcctcctttgccactcctcatccacacctccaacctgcttccctcccaccggtgtttccttttcatcccttcccatgcttttccttgctgccccatctcctacccacaccgaagctgcctctccccttctctgcgctgacggaggccgttcgcgctcctcccccaggtttccgaaaggctccagacgctgccggccaccgtccctctgctgctgcagcacgtcctgggcaccttggagcaggagcatggccccgacgtccttccccaagccttggccactcttgaagccacacgcagcggtccgcgcttggagtgggctcaggggttggacgaccttggtcgtattggggtctcagcaagctgtacagggagtgattagggattaggtggggatgggtatgctgcctggtttagggcctcagtgaccttgggttttcaggtctgaccgtggaccagttgcatggagtgttgagtgcatggcggattcttcccagggggagcaagagctgggaagaagcagtggctgctggtaacagtggggacccctaccccatgggccaatttgcctacctcgtccagagtctgcgcaggtacaagtgcccccactgagctcccactgacctgtgcctccctgtctttgaggcagggccccatgtgaccctctttcttcatcctcttcctctcttggtatagcccctgacacttgtctccagaccctgcatggctgtcactcaagttaccactgttgggaggtgggactgggagcccacctctgtgccagactgctcactgacagcccttctcccacttctcttgccttctctcccaaacatggggtcagtttgctaggggagggacccctggagcgccctggtgcccggctctgtctccaggatgggcccctgagaacggctgccaggtgtcgttacgggaagaggccagagctggagaagacagcgcacctcctcactgcaggtgactgcagccctggttaacctccggggcactgagcgtggggcctggcactccccattggctggcctcctcacctgccaccccagtgaggggatggctctcactgtagcctgaggagtgtgatctttggagatgcttcagggccgagctcatctcagtgtctcttcctgtgacccacacctgcagctcagctctggaagacgtgtgaccctgatgcctcaggtaccttccgaaggtgccctccagaagccctggcagacctgccttaccacctggttagtccccagagcccatcggcaccttctcccaaggaactgctgtggccgttctgagccccctcttcccccagccaccaccatcatccccacaatcgttacccgccttccacactctctgtacctctcttctttcagttttccagccctcctccttcaggtcctttgtcccagctcctaagtctaagtgtcagctgcacaggcagggtccaagactagactgtccctcctcaccagctttgtcacatccctaatgaattcagtctgactttccagctccagagcgggaaccgtggccttcttgccaagttcctcaccagtctccatgtggtggctgcacacctggaactgggtctgacctctcagctcctggaggcccatgccctctatggtgagatgagttacgggctggagtcttctccaagctgtggagtcctgggtgtgttcgtggggtcctgctcagagggaggtgtaatggaaggagcagttgatttctattccaaggtgaaaaatgccacgagtgtaagcaagtgattcttaggagaccttttactcagctgtcttaaatcttagtgggcataaaattacttgggaaacttgttcaaattgctgatacctgggtcctcagatttggtttcctaggtctagagagggacccaaagctttgcacttaaaaaaaaaaaattatttacttatttatttttgactgtgctgggtcttcattgctgtgtgggcttttctctagttgcagtgaatgggggccactctctagttgctgtgcatgggcttctcactgcggtggcttctcttgttggggagcacaggctgtagggcacatatgcttcagtagttgtggctcccaggctctaaagcacaggctcaatagttatggcccacgggcttaattgctttgcggcatgtgggatcttcccagatcaaggatcgaacccctgtctcccacattggctggtggattctttactactgagccaccagggaagcccggctttgtaattttaacagatgtgcctgatctggaaccggagggccacactttaagacttagcattttggacacatcatatgattggcttggtcctggggttcatgggggtcaaggctgactctgcatctcttctctagcttcctcagtccctggcgaggaacagaagcttcctgaggctgatgttgctgcatttcacaccttcctgaggcagcaggctcccatcctcagccggtacccactgctcctgcaccagcaggtagccaaccagcctctggactcgcctctttgccgccaggccccccgactctcccagcgacagcacctccagtgtat

SEQ ID NO: 58372 - DNA, 954 bp, Bovine  19866880763663
cgatatagtgtaaataatacaacaaagtaagcataagaagatataggagcatagaagaggaacattttacctagaaaaatataatgaaaatatttatgtgacagatgacaaacagaccttttagaagcattattataattgcatatataagatataacactattatactcaaggacctgattaaagttttccacagataagcctttctaaaaagaagccaaaggcagaaatcaaaaaaggaaataaggatatgaatttgaagataagaatgctcattatagcattttttaaataacttacaatttatgatacaattcaatcattaaaattatgattttatgatttcatcaaacacacaaaaattttaaacctctgtatgtcaaaaaaatcaaggaagactaacaaaagtgaaaaaaatttcttgcaacatctgagttaagtatatgtatagagagaattcttaaaaatcagtggggggaaatctacagcaaatgaaataaaataaaacagataactaataaaagaaaaatatacttaaaatacaggaaaatgtattcatctaaaggccatccaacaaatgcatatttagagagcaatgagattctactgtaatcatatctaactggtgagcagaaagtatggtgaacaagcacctgcctacatttcttaagggaacacaaactgacaagatctaactggagggcaacttttagtactacaatttttaaaactttgaaatgtttcactttcaggtatttaaagttagcaaaaaattaaggatatgaatttaatgataacagtactcatcccagcattttaataacttggaaataaattatgatacattataaccattaaaattatgattatagaatggctaatttttaaatatttaataaaatactcataacaggcataatctattgtcaatttaccaggccacaaaaatggtat

SEQ ID NO: 58373 - DNA, 731 bp, Bovine  19866880847336
caaaggtaaaacccttgaccccagatgctgacaagccctgccagagagcgagctgcagccctctctgaaactagagaataaagaacagaccagagtcaccagtaagatgggacttcaggcacagaaatgcacatccttcccctggtccctcatttccaccttttcttgttattttttctgtagctccagcctatccctggcagtttcctcctccccaacagccgtggcgttctcccctaacgggcaaagagcagccgtgggcactgccaatgggacagtttaccttttggacctgagaacctggcaggtatgacactcaagatggggcagagtttaccttcagaaaagcctcccagcctgccccgaagcccaagacaagacaagcctacctgttatcaccctgtttgattcagcaactttactttcacatcagatcccaagggcttggtcaaaaaatcaatcctacagcaaatgcttgctctgtactttcctttgaaggcagtgtgtactaagcactgcaagaaacacaggacttaggacattgtctttgcccaccaagtggtcagttttgttgaaatttaaggcacagaaggttaaaaagggaaccagaacgtggccatgtgtcatagataagagctaagtgaactgtgcaggtactagaggacacaggatgagaagggcaggtgttccaggttgagtgtggagcctgggcacaaacatcggggggaacg

SEQ ID NO: 58374 - DNA, 2343 bp, Bovine  19866880859926
cgtctggtgctggccttggcccggtatctgcagttgggagccctggagcttcctgtctccctgcagtctgtgaccctcactacaccctcatggcagttcatctggccattcttgcactgaatgttggtggtgctgcagatactacggatgttccaaagatcttcatgaatgaacgtgttgaagcgcttgcactgatgtgaagtcatctttcgtctttgcatcatcaagttgcagtagctgtcattgcctcctgtctcatcagggtccacgtgttgcctcaggaatcgttggtacatgcgatcctggccataggagggctgtaccagccctagccccagcagggtcagcagcaagagcagaagaaaggcctgggtcctctggagagccatcactgccttggagatgcctagagaagaccaaggggcaagaaaaatcatcccaggttcaataggaagtgagcaacccaaagcagcaaggagaatttttggagcaacagacagggcctttttctacacatccagtctaaggtttaggcccagctgagttcctactttgatacatatggttactactgtcctttgttttcaaagatgctgcttcatgatggtggatcacactgtgtgtgattataacgctgatgagggatttgcatcttattccacctacagcttatccttaacaataatgatcaggattaaacataactatcatttgtttaaatgccaccttctccgttcacaaccacgttttgcctgtgcacagaaagacccaaagctctgtgtcacactgctgtgtctgctgctgcagatacgtgatacagagttaggaggagagggaagtgaaggagttgtgggaagcagggtggcaggaagaaatgatgctcaatttactcctcacaccaggaccactggatgcaacttctgaagatacacttagcacttaggtaagagcttcatcaccacaatgtactttgcgttgtctgtcccaaaactaagtgtgcacaattctgtctcctttctctcattctgcttctttgtgaccaacaacatggtttagcaacatgactagctacagagaagattttacttttcaaacaagagcatggatggcctcagtcacagtaaccaactgatttagtaagacaaagaaaaacactatgaacagagttcaatgtagacatccatggggtgcctctcaaagttccacctacaacagaaaattaaatgatctccaaatccttccaacacatactttttggttagagcttgccccaaaggctttctccactgaacacgatgatctcagtaagaacttcttttgatacggtggtcccaaggacctagttctgccacactaactgtatggccttgggaaaattacttaacctctctcagtatatttctcaaaagtaaaataagcataaaggtaatacctacctctaggaatgttgtgaagaaatgataaaatcaatgtaaagtgcttatcataatgcctagcctatgctaagtgttcagtaggggtcggcaatgattatttttagcatttccattttttcttggtttcctttattctcttcattctgctaaaatgacaactatacttaattgcacatgttatagacaccctccctcttatactgtagagaacctatattcccaagacattagaaggctttttttgcagctgaaatatctcagctactaggatttatgctgtgtacctacacgaatgtttcctcttcaaagtgcatggaattttcttccttgcctgtcgctctttttctaaggacttgactattttgagttctttttctcttatccttgcaaagtcagcaaaacatactggaataggatttcaatttcacaaatgattgacctaagataaaatgacttgcctgtgattaatacttcattctaaatagctttttggttgtgagagaacaggagatcaagagcaaaaaatactaggaagggctggctactcagctgctagctccatcagcaagtggagaagcaccttgtctcattgccacatgatttcctgggaaagtgtcatttgttctaacaccagggctgagtatgtgataataatgctctaagctgatgcttggagatgtgaggtttcaaaaaaatttttttcatttatttagctgtagttgtggtgcagttccggtactgagcagtaccactgctcagtagctgtggtgtgtgggcttagatgctctgggccacgtgggatcttagttacctgatcaaggatcaaatccccatccgcttcattgcaaggtgaatctattaaccactggaccaccagggaagtccctggagatgtgagttttcacaa

SEQ ID NO: 58375 - DNA, 1418 bp, Bovine  19866880859927
gatcgcatgtaccaacgattcctgaggcaacatgtggaccctgatgagacaggaggcaatgacagctactgcaatttgatgatgcaaagacggaagatgacttcacatcagtgcaagcgcttcaacactttcattcatgaagatctttggaacatccgtagtatctgcagcaccaccaacattcagtgcaagaatggccagatgaactgccatgagggtgtagtgagggtcacagactgcagggagacaggaagctccagggctcccaactgcagataccgggccaaggccagcaccagacgtgttgtcattgcctgtgagggtaacccggaagtgcctgtgcactttgacaagtagataccactcaacaggggttatggcccagcagctggcccttaacttactccttaaatagtaatgagtaagcatttgagctgtcccaggccgactcccctgattctttgtttttttcttctttatataacccattctgttaaacacattgcatgacagagaaagatgagacacaaacttataatgaatctgggctcttctgtaatatgctttcttttataatattggtcagctttgctatctttgatcttatcatctggaatttagtcattacatagaatttcaagaatttcaaggtcctttcatctaagctatctcattctaataccatggcacccttgggatgctggtcctagtgttacagtatacaaaagctcaaagtgaagggatttactaagactgaaaagttagtagaaaagctaagacaaaagtctagtttaacaggctactcattcagtgctttccccacttcagcacaaggagttttgaaagttttaatacatggcttttgttattcctaaaagtcagctcttgggagaagcattaacaagttggaaatatatactcgcaacgtgagagctctatctgtattatgtggcaaactagctgtatttggatctaataagatcaagaaatgatacaaggaattttcttttccccttcccaaacttttgagtcaccctagtaagtcagagtattaacatgtgctagatcattaagactccttcactcttcctgactgaaagatttttcatatgttccttataataaagaaaataagataatttcaattccaggtatttaagaagactttgttcttgtgtgtgagattattttttcctcctatcctcttttaattcttctctaatttataaacatgcacatgctttaatatcttcataaactccggtcaagactaaagcccatcatattagtgaccacgacacacaaagctttgtttcatctgcttcagagggaatgattcctcttaagataattctcatgcattctccctttgaatatttagaagcaaattggggaacagagatgtataaagacattag

SEQ ID NO: 58376 - DNA, 1731 bp, Bovine  19866880894792
agaggttaagtaaattagtcaaggtcacagagctgtcttcagagcccatactcttaactatttgaggtcctgtgagaagaccatgttttagtttctttcacatgacaatactgattgcacagttcttaagttattattggttgttcttctgtttattcattcataaatttatcaaatatttattaagcatgtttcatgtgccagactgctggaaaaaaatttgggcaatggggatgtaaggattatccagataagatttctgcctcctggaaatacacagtctagcttttttctacttgtcagatggcagagaatctcttcctgagttctctcctttataccactcttgatataacagaatctaatagtttttactatgctattaatatgcttttttgacacacaaaaaagtgaaaattcttgagatgaacttttatttgagctggatttttataaaacctctttttttgaattttattgttgagaagatgatatcctagaaaaggcatgaagtaatgagatgaagaatatcataggagaattgaaacaagtttcaacttagctttcagttaatcatatgatttagtcaaagtattattgtatatgggcattataggtattcttattttttccttgtgactatccacatttatttcaatttcttccatttttggcagtgcttacctattcctttttttgcacacacttatctttttcttttcacctcttgctaccattgttggcttgaagtagatatagtcaacattctcctttagttatataactaaagccaaggatgggttcagtgaaagtccctcagtcgtgtctgactcttggcaactccatggactatacagttcatggaattatctaggctagaatattggagtgggtagccttctccaggggatcttcccaacccagggattgaacccaggtttcccgcattgcgggtggattctttaccagctaagcctcaagggaagccccattggaagctgttaaatgtttatcagatctattgtataatttttcttaagggtgtgctaattgatcttgggacgtgaatatgtgcctggttttcatggtagtcatatattttccagagcacttacggaaattgtaaaaaagaaatttgttcttaaagaacctgggacaaaagacacacacacatgaatatatatgatattccttggatgtagattaatagataataaaattatgatactgtaaattctagctctacaaaagtatttcactgtgttaaattacttttggtgatgaggtaatgggtatcactggaaactgcacacagaagcaggtaagatatctatactgtggtaaggggaggaggccatcttttctttatccaaggtgtatgttttacgcaggtcataagtgttgagttctgttaaaatattattgaatgactttgttttttgatccagaagatctgtaaggaaatagatacttaagttcttcccttatttttcttctagggaacaactccaagtttcctttggacggtacaccagttcgaaatcggggtggtggagatgggagatttatcagttcagaccattttttgtgggttctcccacagcacctgaacctgccaacagttttttcagttttgcctccccaaataatgaattagagcagcagccagtctctagcagggcttttaaagtaaaaagaatttagttgacctcacagaattttctctgttct

SEQ ID NO: 58377 - DNA, 808 bp, Bovine  19866881071763
aattattggctttgactgactcctgttcctttccgagttattttcagatgcctttgaaatgatgtttttccttgtctgtttcagatacccctccaacctacaggccttttctcgaagccgcctcccagggccctgggattctagcagagccgggaagcggatgaagctcgctcgaccagagacctgggagcgggagctgagcttacggggaaacaaggccaccgtctgggaggaactcatcggtagagtaaccttgactatcacactcccttcctgtcttactcactcatgcttctacattttggcccctgaaagagaagtttccatggcgtggtgcaattattctcacttggtagttccatcactggaaatgattggatttaacaggtctgccactgaccacaccaaagtggccagtggcctctgctttgagtagcactgacatcataggaaggtcataatttcagacgtgattaggtgatatgttaggtgatataatacaagcctttatcaatacatgacaaaagcattaccttctctctgatatcccttgtgcaatatctgtgtcactcttccagacaaagtaggactgggacatggcacattgaaatctccaccaaagcccatttttaggacacggatgttctaggtcatatgcccacatgagtaaaaataatttcaggtgggggaggaccaagttactctcaatctcttttcttgcttggttatttttacctatagaaggccctttttattccatggtttcttttacttcctccttcatcttttgaaaggttaaaatcagctt

SEQ ID NO: 58378 - DNA, 2072 bp, Bovine  19866881241758
tctctgatgagctggttagttagtgtctctaacttgtaaatcccacagaacttttcattattggttgttgctttctactatccacatctatcctttcagcactataggaaactcttaattatttataccaactggagaaatgaaacaaatccacaattgtagataattcaattgaaatgtataactgatgctggagtgtagatgcattctctctttctctctcccacatacacatatgcatgtacaagctttctctgaaccaaactgaattccatcctagctcagctataaagccaagaagtagagtttacccaacttgacaaaattaaggagagaaggctccaaaccagtacagagtattgaaagttaactgtactgccactgagatgattcagagaaatagtgaatgacagggggatattattatcattgcttctcttcaaagaaaatgtatgtttatgcatgcacacgagtgtgagtgccacctatgtagccatgggatctgcctgtgccaaaagaaaagatcctttggtttagctgttgccttcagtcaacggctccagccctatccaatctccattcctccatcttttcccctttctatttcacaagttgctacagagagaaaaaataaagctcctattgtaatttttactcaagcatagtttgatttccaggggccctgggagaggaatggcaagctatggagggataaaggaggtagaaagaagggaaatagcaagtctatgccaagtctatttgtaaatctttatggttcaacactctacataaaattggacagttatcttgttcacaaatgtgtgtgtatgtgttctcgattcctcatcatacatcccccctctatggtgagacccttttttaatgtcctaattttattttaaggcaaggaatagtgactttattcagaaagctggcagactgggaagacagcagactggtatacccaaaaaaccattttcaatgtcctaattttaagtaaatgcatgtaaatagaatgttgtacgtcactctctatatacattttcctaatgtttttcatatctggtgcagaattctcattatactgaaactgcaaaactctgacaatcaaccaatatgcaacattagggcagatgtttttatatcttttagctgaattttccttgtcagtatgatagctgcttaaataaacaatcactatggtcttggccaaatactgatagttatgttatcagcaattatttttcacttggcagctggagaagaaacttatagaagtgcctggagtttgagagcctcttctctgtgggaggagactgcaagccctggaagggagccatatcactgggttccattctagggctagttccatgtagccaggctggtgccaccacccactcaccaaacatgagatgggctctgtccgcagtgggagcagtctagtaggtctcctcttggctcaaacttggttcaaatttgagtaattctttcctactatagagttcagctctgggtggtgggcatactagccccagagacaataactatactagctctaagagagttttttggtaatatgtaagaaaaagtaaggtgtctcttgtggctcagtggtaaagaatctgcctgccaatgcaggagacatcagttcaatccctgggttgggaagattccctggaggaggcaatggcaacccactccagtattcttgcctgggaaatttcatggatggaggagcctggtgggctacggtccatggggtcataaaacagtcagacaccactcaagtgactgaacaacaacaacaaaaagtgtgtatatgtcattgctcctgtctcactttgtcccaccctctcccttccccccgtgcccacaagttcattctctatgactgcgtctctattcctggtcatttgtagtgatgcggataggcctagaatctgtcacacagagcgaagcaagtcagaaagggaaaaacaaacattgtatattcatgtatatatggaatctagaaaagtggtactgatgaacgtattttcagggctatcttgaataaagaggaggaaccacag

SEQ ID NO: 58379 - DNA, 1472 bp, Bovine  19866881304097
tacttttgcacgtgtgattctttctgtcgtctcttctggagagttcctaattgtcctctgaaattcagttcaaacattacctcttttctaaagtcttcctgagcatattcaattttgatgtgtttgttgctatactctcagagcacttttgtgttttaattatttgcatttcctacaggctgtgagctttctgaaggtagtcatcttagcagtcgtaagtcctggctcagtacctgacacaagtgcttgataaatttacatgaaatcaattaataagggagcgtttatgctgtttccttgatggtctcctattttagtctgtgttaatgactgccccttggtgccaggattctgctaacattttccttgtctatttactgatctacataaatctgtgaattgtagagtcagtgtttcattgttgaaagtgactcgagagtcaatttcttccaatactctatcaatatatatattatctttaaatgtgtatagctgcatttctcattgtgtcatatctcttgatattcaggaaaggaagttttccccctttttgtcagtgacttgccaggctgttgagtattagggaattgtattccaaaaactggcagatattatggccttcattctttttaaaactgatacttcatactgaagtgctagcttatttttctattctctcaaactatttgaacaaaaatgctattttttcccccaaataaaatatatggttagaatcactttaagcaagatcactcaagtgtgctggaattcaatttgtttatcatttggttggttttcagcatactctcagctcctggcagatttgcacagaacaggcaatcatgggaaaattctcttagaaagttgtgttatgtatatgtacatgtacatgtacatgtggatggtgatgatggaatgggggaataagtgggaagatataaaggaaagagaactgtcctctctctttacccaatgtgggagacagcactatacagtgggaaagagaattggatcgtggttttctgctccctaattgtaactttattttcttttaattttaggaaattgtatatacaatagtgtaaaattaccaaaaaatagagaaaagaaagcttcatttccactcctgaccccttactccctctgctgtagtaaccactccattttcttacatttttcctggggatattctatgtgtatataaacttagtggcatgtcatttaaaagtataaaaataatactgcctttatgctttgaggcagacctcttgaattttagcatcaacttttaaaaattcttagatggaaatactaatacatagtcaacagaatccacagggattttgtgaccgtcaatgaagtaatgaacatacttgaaaatatttgtgaacatacttgaaaatcatcttgtattttacaagtacaggatggaggggagagtagtgatggaagtggtatggtctatacaagga

SEQ ID NO: 58380 - DNA, 1297 bp, Bovine  19866881319459
ccaaagaatgttggcaataaagcattcaaagtcaagtctactactattgcattgcttctccagaggtaagttggtacaaggacagtttcctttagcagtatccatttgttcaaaaagaagtcacacaaatgtgcttatgtttgcagagatatatgtattctccatatctttaaaaccatactaaaaataatttttagatgtcatttaaaaccataacgcatgaagccaacctgaaaaggctacatattcttatgactccaagtatatgactttctagaaagggcaaaactatggggacagtaaaaaagatcagtggtcatcaggggctaggcaagcagggaaggatgaacaggtggagcacacaggatttttagggcagtaaaactattctgtatgatactataatggtagatacaagtcactacacatttgtcaaaacccatagaatgtacaacatcaaaagtaaaccctaatgtaatctgtggactttgggtgataatgatatgtcagagtccacggactgtaacaaatacacccttgtgatgcagaatgttgatggtggggaagcacatgtgtgtgtgtgtgtgtctgtgtctgtgtgtgtgtctgtgtgtgtctgtgtgtgtgtctgtgtctgtgtttgtgtgagggcaaaaggtatatgggaactttgtactctccactcagttttgctgagaacctaaactgctctaaaaaaataaagtctatttgaaaatacttattaaaaatgtaacccaataatgattattgtcaaaaactgtgcaactactgttcgtttaggcagtgacaaacagaagcagacaaagttttccacaaggctttttgctacagagaaggaatctgtgaaccaaaatggactcacactcctcaaatgatcaattttttcatcgactcccatcactccccagacctattttggacacctcaactagaaatcttctccctctctgccagcaagaacaaaaaacttgaagtcaaacacagtagttggcaaaatctagaagagtttggcactgtgtaagctgctttggtgaaaggactcccccaaggaaccctatacccccaggcctaatccaaagttattttaacagattagaaaagaaacttggagagtcataacagaaaaacctagagtccccaaggtcctagttttagactctctgcagaagctatgctttggttgattaagcaggagctggaggcccctgagagccaattagaaaaggaagttaggatgagggagggagaaatgattctagcaactaccaattaaaag

SEQ ID NO: 58381 - DNA, 826 bp, Bovine  19866881335631
tcttctaaaggtcataatgaggaagacacatctttggacatgctgaggctggtatttttatatgacacagtcaaatttattaatacctcaatggtgtgtttttcctggtaactttttgccatgtcatatttcatctctttctctaaaaattcttctttaattatctccattatactttctgaaactcctgcaaaaatcacccccaggccaagtagcagcagaaagaagatctccatctcagatctagggcaaactcttctgcagtaaaaactaaaagataaaaatgaagaaaatattaaatgagtagctctcttttctttatgacattcccagggttgactcctacacatgagctaagacatctacacctattaatgaaagaataagataggagaaagacaatcagctgtgtaatctgaagatccaacttcaaacccctgtttatccactaataagcaatttattccacctcatgtaattaacttcagtttcctcttgcgaaaaaaagaaaacatgagaattatataagataatatgtctaaagtactcagaaccaagtagtcattgctctttcttttcaccacatctataatctcactggtaaagtctgtcatctctgcagggggtcccaataatctcacctaacatattcctcactattgctgtgaatcctccagcctcacacagtacctggcacatggcagccacgtgaaaaaaccaccatgatattttcccacctctcatttcttttcccactgattatcagtcatgggaatttctgtctttaccagttcatttggcaagttgattgtgtggagagaaagat

SEQ ID NO: 58382 - DNA, 1633 bp, Bovine  19866881420784
aggaggaaggagttactttagtttgggtagtcagggaaagcctctctgagaaattggtgtttgaactgagacctaaataatgaagaggaatgagtcacgcaaaggtctggagaaagaatgtccaggcagagggaacagcatgtgtgtaggcaggattgagagtggatttgaggacctggatgaaagccagtgtggcttgaatagtgtaggagagtgataagaagtgaagtttgtggcgggatgagtggtgggaggtcagatctcacagtcttctaggtcataataaggacctgaattttattctgtctgcagtgggaaactatctgagtgtttgtgacatgacctacatttttgtaaggccatccagctatagtgaggagaatgggaaagagtagaagcagaacgacccgttaagaagctgttgaaatagttcaggcaagtaatgatgctgatttagttgagggtactcatagtgacatggagactggtggatggatttggggtgtgaggcagaggtagttggtaagacttggtgggattggattatacctttctactgctgttttgttttaggaaagaatagataatggaaaagctttgattgatgtcccaggaagactcaaacagagatatttaaagaggaaggagaacatttatttggaaagaatgcaagcaagccaaaggatgacttgacaaaaacaacaaacaaaacccacaaatatctaaagaaacaaaactgcaaaaatacaaaatttatcaagcttaaattggcctgtttgtcatagagaatggctctcccatgtttgtcatactcacaaatgtcacatattttaagatatcagcataggaaaaatcagaagtaaggcatttttattgttaggaagtccagttttaagggtaaatttcaaaattttatactttagggaccagtactagataggatgatcttattaactttgttttatctcaaggtgcaaagcatttcctctctcctgactaaggtatatgaagtgcttaatcatattggaagctctgctgggtctaagaggagagactgtcaatcatggtacaggttgacttgggacagtgtgagagtcggctgaacaactttccttccctatctgcaacctgcctcttgtgtcattcctgggtgaggtagaggatcagcatttgcaggccaaaagttggtatggctagccagtctcaaagtttacttgtctggtatcctcttcacttaacggagactattcttataatggtctcattcttatattcctaggaactggtggatcagctgtattcatttcgagagtgctatttcgagacacatagtgtggacgatgctgggaggaagcaacaagatgtgcgggaagagatggagaagaccctgcagcagatggaggaagtagtgggtatgagtcccaaaagaacacacaacccgctgttccttattgaaatgtgatggagctttgctgtctctgtagactctttggtatcctgtttgtggttgctacaagttagtacaacagaacatttcttctaagggtgcctgtgtaggatggcagcctttccgttccctaaactccatttccaaatgctgtgaaatgaaaaagaccatacttattgcttgatt

SEQ ID NO: 58383 - DNA, 1430 bp, Bovine  19866881464430
tccttatctcccacttcccttctgtggacccaacatcatcgaccactttgtgtgtgacccaggcccattgtttgcactggcctgcatccctgctccttccactgagcttatttgctacaccttcaactcagtgattatttttggccccttcctttccatcttgggatcttataccctggtactcagagctgtgcttcgttttccctctcatgctggtagaactaaagctttctccacatgcgggtcccacctgatggtggtgtctttgttctatggaacccttatggtgatgtatgtgagcccaacatcaggaaacccagcaggaatgcaaaaaatcatcactttggtatactcagcagtgactccgctcttaaatccacttatctacagtctccgaaacaaagacatgaaagatgccctaaagaaagtcctgggattaagaattaatcaaaactgagacatctttaaaaaagaagcagaattagtcatttctgaccttaactatttatagtaacaatgatagagaatggctacaataagtcatattttggctcacaagaaagggaaagtcttgtttttcacagttcctttagcagttcaagttcagctcttcaatgataaatgctgaataaacattttaaacatgtacaaaatcactgagtaattatatggtgttattatatagatagatatttttttatgtaagtgtgatgtatctttgctggtttaaccttatctggtgaaagaatcaaatgaatgcatactgggagcctttcaagaatgggtgcaatcctctaaattcagaaaataagtattcttaaagaaaatgggtcaacaggccaccaaataaactacatagtgatggatattatccattgtttgaggttgtcgtcacaccaaaaacagagtatacttcatacctctatcacttacagataaagtacaaactcttcttcctgccttccaagtgctcactcaatagatattccattcagtcttctctcctgcttatccacaaaggccctgcacttcacaatgatcaatcttcttattttgccttgaataatctttctcccaattgtgcatttttactcacagtgcttcctcctaaatccattgtgacaatcccataaccacatattgtatggagtaacaatgccttaaacatatttttgtgcttctcagaaggctatcagacaaagtctaagaaaaatatttagaggaaattaaagcgaaaagcaaaggagaaaaggaaagatataagcatctgaatgcagagttccaaagaatagtaagaagaggtaagaaagccttcctcagcgatcaatgcaaagaattagaggaaaacaacagaatgggaaagatgagatctcttcaagaaaattagagatactaagggcacacttcatgcaaagatgggctcgataaag

SEQ ID NO: 58384 - DNA, 774 bp, Bovine  19866881800634
atgggagcctcaggtggggcgattcgaagcccatggcttaggattcctacccagttactcagcctggagccatgccagagtagcatcttaaggaaaagctggtattattgtactctctctttctctcctccaaacataagccataagcatcaaaaagccaagagctgtctgggttatctttctttatgagttccctaactgcacttcaggcaagcgactgtcttcccaaaccgaaagttaaatggagacctgttatgaaggtcctctctgaaggcttctttttcaccctccttctcaacttcaaagacatccagcaaggtcatggtatagtcactgtgtgtgggagcatgggtagactgtaggtactgggaaatcacctgcgaaaaagaatgaaagacaaggttgacatggactctataagagaccaggctgaactgaagaaccttgggcttcttgtataaattggcctaagcagtctcacaagggcagccagaaagagcattaccttcccaattcttagtaaatagaaattctgccctcaagttttctcttaaccagatgcactcagggaacagtggcatggggagggtggatcttaatggtgaaaataaacgatcatttttcttactttgaactcataactctcatggtctaaagggtgcaaggcacaccgtagttttctatactgttggtccaatgggtgttccggggctttgcagttctgtcttcaccagcttaattgcaatttcaatgtctcccaaagcctgacaagat

SEQ ID NO: 58385 - DNA, 935 bp, Bovine  19866881813161
tttttggatcgcgcattcatcatataggtccagaaggtgtaggcataggcggtgttggggtagagatgccggaaactgtcagtgagtggcacagcctgcagcaattccccgaagccctgccgctcttgtggagtgaagccagcattctttttatttcccttcgggttgcgaaggtcaatttcttcatgagccacattgaggtccccacatagcacaaggggcttgcgggatgccaaacccttccaggaattttgcgaaaagcttcatcccagcgctggcgatactccaggcgcaccagacctcggcctgcattaggcacataggctgtcaccagcacaaatgcgtcatattcagccacaatcactcggccttcctgatcatgttcttcctcacctacagaaatgatggaacaattagcaaaaagaagttttaagaaaagggaaaggagagaataaaagaatcaagaattggggctggactgggataccagtaatgagtttggaggcactgggctttagaaaatcaatagggtctcaccaatgccataagagactttgagtgggcactggcgggagaggaggcccacaccactgtacccttccttgtctgaaggagctgaccagtactgatgggacaatccagacagttcttgaagttcaactggtagtttgttctctgaacatttggtctcttggaggcacaggatgtctggggcttcttcctttacccactgtaagtgaaattaaatgtagaaaaagtattatcaattcagcagccatttactgaaaaatctatatgcgaaatactagaaatatacagatgagacacagtctctgcagaaataacgtctagcagcataatattaaaacttataaatgcagggcaaagaggcaagaaaagtgttacatgcaacactgaggaattctgtttttttc

SEQ ID NO: 58386 - DNA, 1004 bp, Bovine  19866880373329
ctcccccatccctgggattctccggcaagaacactggagtgggttgccatttccttctccaatgtatgaaagtgaaaagtgaaagtgtcatgtccgactcgtagcgacctcatggactgcagactaccaggctcctcagtccatgggatcctccaggcaagactactggagtggggtgccattgccttcattgacatggtccttggtcaaatattattcttaatatccagaatgccctcggttttgcttatgtgtgtaactatagttttatatataacttattttcttcccatttacctccttttcattgatggatttaagttcaaaatacaaaatctgtcagacattatttggagagattcttccttcttttggactgatcctcaagcagatagttccatgtcttacttgtgttaaaagatttccttatagcgatattaaatgcttcagcacatgaagcagtcatttcctcctgctgttttgagatagctcttttacttattggcaccacatgagataaagttctgtaattggaacagagatttatgtagtgttattgctgaatgtatgtgtatgcttctttctggtggtgaaagacccatgatataagacttccgtttggggattgatctgaggcctcgtgtaacatatatgctgtaataagtcacagcagatgctgcctattcagtctctgctgtcccatgtggttcgagagtggataatttcgctcattcttttggcctttgctatgacttgtcagggactgaactcatgttcataactctgagaagtgctcagctgtgaaataagtactgaaaggatgaaatgcaattgatactgagccattgtgatctttcaatcccatgtaagcaagaaataagtatttaaagtggccccataaatcttcttgagtttaaaagttcatagatttaaaatatttatggactgacttgggcagaaagaccaggaaaaacatatatacggctctaagcagagctagaaac

SEQ ID NO: 58387 - DNA, 617 bp, Bovine  19866880393535
tatacatgcctcatccaatcagcaaatgacccgcaagacccctatcccactccttgtaccctgggtataaaagtagactaaggactcctgttcaactcggttctcccttgagctggcctgctcttctaacagcgtctcccactctaatagactttatttccctctccttctgtctcatgtctggaaattcttttccaacccgcacccagaccatgacatatagtagcactaactactccctgagaaaggcaaaggaccctcccgtcaccccgcaaagccgcccctgcccttttgttgtcaacaccctcacccctgggaaactaccgacagtttctatccctataatcttgccttttccagaatgtcgtgtaaatcgactcatacactatatagtcttgtgtgtcaggcttcttgcacttaacatcatgcaaggccaatttttaaaaactgttgtctgccaaggtcatctttccctgtgaaccaaggctaagtgggtgaggatcagtgttcatgcttgtcttaacaaattcactggagtacataactgtagaccctaaatcaaacccgctgagtcaaaagcagtgtctctttgtaatctattctgatgtgatgactca

SEQ ID NO: 58388 - DNA, 926 bp, Bovine  19866880408218
caggcctagtgggtgataacagctcctgactgttgcaaccgctggggtactacactccccattatttgtttccctaaatcctacccaaagctttgtaaatagtccttttattaactgtacctaaagtatccaatttgaatgtaccatctgtttcctggtgagaccctggcttataacaaggattttactgcagatggtagtcaaatatcttgagggcaaagtaccttttctgtcttgcacctgagctagccccactagagggggtaggggaattgtaggaaagtggtagtggtggttggggtggcagggcttatgcaattattctgaatgccaggataagatgaatatgtgcaatagacattacagattcttaaacatgtgcacgatgctctctaagataattctggcagctttgtgaaaacatcctgggataaaggataacttcagaaaaagaagccaactagaaaactgcggctctattattggaacaagacagtaagggcctagagtagaaaagaaaacctagagggaaaagaaagcatcccatagacctagtaaagggtaaaggcagaatttcctgatgagttgtgttggagacagaaggaaaacggggcaaaacaaaacaggaagaataactgtagaacctatgggtaaactagagagttgaggaagatgatagaaataaaaatgataagaatgactaattgaagcttaggtattttaaatgctccctgagttgtgaccacaggttttaagagctaacaagtattaaccctcttaatcccctaccaactttgtgaaatagatctcgttactacaatttacaggaaacagaagcacagagagctccagttacttatccaaagtcacacaggaagcaagttactgaataactgagctgaaatgtaaagtctagagcctgaagc

SEQ ID NO: 58389 - DNA, 669 bp, Bovine  19866880488636
tctctttctattcttttatgagaaaatcttgaacaacctgtttttttctcttgatgtataaaattctaaaaatgggaattgttaaataaatgatgacatacagcttctgtaatctttgtggcattgctgggtatcattacagtctttctaaatcttcctttatggaagaatccaaagtaacagaactttgcctgttttcttctaattcatttaattaaaccttctaccaacctagaaaccaagtgaaagttcctaaataatttctgacatgaactaaattttacttctgattcataatgactgattataaccctgtgacagttacagaaaattaattacaaagaccaagaactccagaaataaaaacgcagaggctgaaatttgaattgcagtctttatcacattatgtgaaaatagtcaaatggaattaaagaacttgggtcacttattatgtattggtttttgaaaaaaataagtagatgtcatattctagcaatataaattacataaaatgcacacacggtattttagttgtgattacaaacttgccccaaattctacttccagtcaagcatgaaacttataaaactcatagtcctaatattttttaattacttggggtaaatattaagaagagacatttgggtctctatgccaaatggactgagt

SEQ ID NO: 58390 - DNA, 720 bp, Bovine  19866880497411
ggagaaaaagaaatttgggggaaaatatgattaggcacataggccagggacatattttaaacaaaaaaaaactttaattcccactcctccaacctatctttgactctctgaaaacattagggttcaagaagaagaaagaaagagaaaatataaagagaaaacaggaaaagaggatggtaacaagaagttgacctaatttttttttttttaatattcatcccaatacacacacacacacacacacacaaacatacttctaacacattaatacatagctgttcaacataggccagaagttgtcacaaaaaatggttactttgaatactgtataatttagataataattgatgatatgcaaatttctgcaacccccaagcctgacaatgggccctctgcagggactttcctaggtggatggtacaaggccaggagccacatttgaggtggatgaatttgcatttcacacttcaatttccttctggctcttcagtgctctgcttgctgagtaataacaagcctaagggttggatgagaaaagcaggaaaaaagaggcttggtttgtccagaaactgagtaatacacctgtaagaacacagcaaaccacagctttataactcatttccttatctaggaacctaaagctcagcaaaaatacagccacaaaaagagatgaacaacagaatgaggcagcatacggtagatagactggaacttgtgttc

SEQ ID NO: 58391 - DNA, 1091 bp, Bovine  19866880512914
ctttttaaaaagatctttgtctagcatgacaccatctgatgttgtttgaagagttaatcttaacatatccatacactctttcaacctgggatcagacgttcgcaatcctgtagatttgagtgcctgtttttaaaaaaataagagtctgtaaatacatagtgcaaataatgtatatgcttattccaactacaagtttttaattcctgtatttagaaacttctacccaagacctgaatatatatatatggcatcttagtgtcactattaccctctttctggaaaagtttctcattgtttctttcatttcctttcattgattaccttgaaatgagcatgatgaaaatttgaaaataagagaaatagtgtcagtcagatgactttaagactacattgcaatatcaccgtatattgcttcatattactggtttttaaaagttaggatagaaaaatataaaaacttactgtaataaatttatgaacaggtattttctcttgtccttctgcaattgtatagaacagcaaatcttccaaactaggtaacagaccctgttttattttactaaagaggaaaaaaagaacacaaaattaactcttatgtgaactttcaagtagattttagctacatccatttaaaaataatcaatgaagcagactacagttgatcgattcctcaagacctactatcacattaataatgccgatttaccaaaatcaaacagtattactgaaaccacattgagaagtacgtttaaaacatattcattaatttacacagatattttgtaatcctaaattatcttttatggcaatttcttcctgtatagcctaatacaatacaatcacccaatactaactatgagcctagaaaatgttcaggtaagagtcaatatttcattctgttgttattgtttttttataggatgattatacatgtgtaatggagaaggcaatggcaactcactccagtactcttgcctggaaaatcccatggactgaagagcctggtaggctgcagtccatggggtggcaaacagtcggacacgactgagcgacttcactttacttttcactttcatgcattggggaaggaa

SEQ ID NO: 58392 - DNA, 1816 bp, Bovine  19866880532336
ataatttgcatcatgatatttttttagtgtttgaattgtgtgtgtgtgtgcccagccactcagtcatatctgactctgacccatggactgtagccctccaggatcctctgttcatggaattttctaggcaaaagtactggagtgggttgccatttcctactccatgggatcttccagacccagggattgaatccatgtctcttgcacctcctgcactggctggtaaattctttaaccactgtgccccctgggaagccccagtgctagaatgatcaaatatcaaaattttttatcttctatgatgagatctcagaaggggaaagtctatcagctaaacccattcctatgactacgtacgaatgagtagattgacaaatgtagaaacttgtgattttttgttttgtcatgctttgcagcatatgggatcttagttccctgaccagggattgaacctgggccccttgcaatggcggctcagcctcttaaccactgtgctgccagggaaatccaggacttgtgccggggagggtggggggctggcgagggaatatatattgacattgaagtctctcagtcgtgtccgactctttgagaccccatggacagtagcctaccaggctccttcgtccacgggattttccaggcaagaatactggagtgggttaccatttccttctcgaggggatcttcccgacccagggatcgaacccgggtctcccgcattggaggcagacgctttaacctctgagccaccagggaagatatttgtcctaattaataatagcaacaacaaacgccttacatgtgtgtgaatatgttccccatactttcaaagtatacttgacatcactaagcacctaatattcttttaagtcgggaagggaaacattatcatgcccacgttgctgataaaaccaccagtgccccaggcacacaatgagctcaagagacagaatttaaaacaggttctccatctggcagcgtagttctttcaaagccaaaccacgtgctccttgaggaaaggaaatgtttaacgaaagcacaatattaaatagaataggagattggctctgttagaactgaaatagaacactgaagtggcatcatttattccaactcagctttcacataattcccctgcatcttcaaaataatagcttggtcacatattaaacaagcaaaaagattatcaaagttgggtaaaactaatatatgtgtaatgtaaaagaggagggttttttttttttttttccctaaaaacgagtaaggtgagaaactgtattttatttattcactgatttttaaaatgtcagtgactgagattagatcagaggtcatacactgtgcggggaatagatttcactgaaatagtccagcaaagaccaaaaacataacaacaaaaaacctgcaaataaacatacaaagaacaaaactaacaagccctggagagaggaagagtctatcagtatctaaagctgctacaatgtattatctgaaatgtccagctttccacaacaaaaacaacaaaaatatgagacccccaaagaaagaggcaagtgtgacctgtacacaggaaaaaagcaggtaacagaacctgcctttgagaggacccagatgttggattagcaaacaaagattcaaagaaactgtcataaatatgttcaaagaactaaagaaagccatgcgtaaagaagtaaaagaagacatgatgacaatatctcatcaaataaaggatatcaataaatagaaaaatatttaaagaaataacaaaaacttccaaaattgaagaaaaacattaaaatgcatattcaagaaa

SEQ ID NO: 58393 - DNA, 1425 bp, Bovine  19866880560605
ctgatggcactagtggtaaagaatagacagggtttgatccctgggtcaggaagatcccttggaggcgggcatggcaacccactttagtatttttgcctggagaatcccatggacagaggagcctggtgggctttggtccatagggtcgcaaaaagtcagacacaacttagcacacatcaccagtgctttttagagctccccgcgaggggctgatggccccatgtttggccacagtgaaaccacaacttgagattcttgaaattatctgggttcatctatctctctgtatctctcacccatgagtaccacactgcccccactctgactgccatttaactataaattacaccaatgcctggcaggaagaaaggttcaaacagttttcctgtatttattcttctacaaagactataggatgcatgtggccacaaaggatgctgaactgggcacccatttcaaatttgaacaccagagaataaaacacagtgtcaccagagggggaaaaatattacaactatttccagccttgaaaaagaagtggccatcactgtggggattgttgggcagctcaactcaaagcaggaaacaggacctgtaggaatgtggtaggcttttaatcaagtgagtacaatttttaaattttcaaatcttttttgtttttgaagcatatccattagcttctgaaagatcagctcttactgactgagctggtgctttgctgttgacacagctgtcaggctatccctgcagaaggactgaggggagtcttgaagctcaccccaggctctccacccacacaccttcataaaacattcaggtatttctctgcctgattactgtgcttataccactgtgtaactatcactctcctaaccagatgttatctcaaataacctcaatagaactattatgaaaatctaggaataaggtatggggttcagccaggattgcacaagaagcttttggctacagatcctgccttgaagccagaagtgattattattactaataattactttcatttattaaattcccaccaggtgccaactgctttatatctgaaatattgatgagaagtaatattattaagctgcttattatgtgccaggtactgttgagattctttacatgtatttacatgtagagattctttacatgtaaataatgcaatttacataagaaaatgcacatataaaatagagagatctttttactatataatttgacttatttatttttggctgtgctgggtcttcattgctgtgcgggcttttctgtggtttgtggtgctcaggtttctcatcgcggcgtcttctcttgtggaggacagcttctagagcatgtaggcttcagtagttgtggcacacgggctcagttgctctgggcactcaagatcctcccagatcagaatcaagcccatgtgtc

SEQ ID NO: 58394 - DNA, 1266 bp, Bovine  19866880584839
ggggagttaaaatgtactagtttctaaattttgaaagagatttgaggatatccggtggccatgtttttgcagcctgtttttgggacacactgaaaggactgattacttgctaatgtgtcttttcttttacaaaacgatttgtgaatatgcattctgagtatttatgaatagtttttcttttaaatatttttttttgaaagagagataaacaagtgatgattgaattcaaggctatacctattcctcccacttcttctccatctgatataattacagtaagtctggcttgtgcatatctgaacatcttctggttttgattgtcaagcaatcaaatagcatttctcacccccactcagacccataatttagaagcttctctgaagtgacacttgttgcagtttaattataatgctcttcaatccagaaagctatttaaggaacaatggaagctgtgcctttgcagtccagtcttttgaaaaaaatgcagaaatacatatgtgtagctgatccctcggagaaggcaatggcaccccactccagtactcttgcctggaaaatcccatgcggaagagcctggtaggctgcagtccatggggtcgataagagtcggacacttccctttcacttttcacgttcatgcattggagaaggaaatggcaacccactccagtgttcttgcctggagaatcccagggatgggggagcctggtgggctgccatctatggggtcacacagagtcggacacgactgaagcgacttagcagcagcagcagctgatccctaattgaaacttgataacgtgtgtgatgaatgacttgtttcctttgggaaaatgactgatattttaacatacatgtttctttccgagagtgtccagcacagttatgccattttaaaacttagaagcaagcatgcacaatttcacaatctgcattctgtttacaggaaatgtcttctttcatttcaaaatgaaattctcaaggctcaaacgggtaagtgttttaattcagcaaagaattaaagagctgctttttccagacatattctctttccttccctggcagttacgggtaccaacttgctcttaattatcttccattcaatgctagtcatagccgcccgcctacttcacacctcggcaggccagcccacagtactcacccagccctctctggctgaatcatcttccgcccccatcctttcccactgctgtttccttttcacttcagtgctctttttagagggacatgcttgcttttccagag

SEQ ID NO: 58395 - DNA, 1566 bp, Bovine  19866880606534
tatatctcagtaaaactggaaaaaagtttacaaaaacaacaaaactccatgcagttcaaattaaaggaagataaaggcaccatcttgggagctgaatgacataggatcccaggggtggctggtatggatcacggccttgcttaaggatgtgacggacagtgtgtgtgacttcacagatggctgagggccatgggatttttcaggttacaaattatgcatgttagaggcttaaggtgtgaaaaattactgcatcatttttagtaacctttccaaatctaagatttttgtgtttacatcatattttttagtttattatgaatgaattgattgtgggaagactcatttgtgtataaaagcttaggatcctaaccttgataacaaagtaatttgaagcaatgcgtaaacttaggtgtcatcatagatgagtgctgtttcagcaatagaatcacaggctctaaatgtccaacaggtcgtttgctattcattttcaacaagatgtttttgaatattatatagttcgccaatatattttccttcagtagtcacaatattcttgaaagctacacctttgactattgaattaaaaaaaaattctgagccattattatttttcaattaaaaaataagccttgttttgaaaaatttggacagttttggattgtgaacactaatattccacctaagcaatttaaaactgtagtctaaaatttagaaaatcaatcgctttcctgaaaattttttctggtaagttttgtgaccgaagtaatttgctgagggaattttaactttcagaagttgtgactaacacttctttcttcataaatgtaacattgcacttaattatttccctttaagaaggggggtgggggaaggaacagtggtaatacacctaatatagctaaattatctcagccccaaatccccttgcatatgtgattaaagaaactcatgtccatgtaggatcctggatacataaaggaaatgtttcctttcagcaacacctaacaataatgtttattctggggatgttatgaacacacttgatgcctgagagtccacacttcccccagattttgtgtgtgaagtgtttaagtgctggtcagaggatgtcacggccttgtaaagagaagaggagagccgtgagactttgccctagcggaagtgggtggggctaatggtcagtagattgttctccatggaatggagacgtgtgggcctgtagaggcaatcaaaggaacaacagcctttatttagcaaagtagaagtttcctgatttttttattgggtttagttgggctgacagctcttgggataaatatgatcacagggtctgaatactcagcaaacaaattctcaactcatgtttaacatccatttcgaaatttaatatggaaagagaattttattctaaacagatgattcttgaaacatagcttgattgcattgatcattaaaagcagcatcccagtcacatcactttttttcccagtaaaataaactattttgaacacgtgagcaatttggaaacatctgaaaccaattttccttctcaagctatgaatccaa

SEQ ID NO: 58396 - DNA, 1324 bp, Bovine  19866880749774
cttttttctagtgtgtatctgtggagaggagcagggctcattgtcattcctgccttacaagcaaaacaggcaaagctgattcttctataagctttaatcaagatcttggaccatttctttttcttttctgtccaggaagagagattatatgtcaagtaaagaaactttgatcctgctatctaatcctttaactgttatactccaagtaatgcgaaattttttcttctttgaaaccactacttgttcttttattccttggcttattaaaagactttcttttttaacaggtgcaaacatggacattttacttctttcatttcttgtgccttagggaggttgtctcagtgccaggcacatgtatcagctatgaactagcaagtaattagtcaaaactaagaaagcccctcagttggtctggtgctgttaatagtcaggtgtcagtgtcatggtggagtcagggggggaagttctgattccagaatttctttgtcccttcccattgcttttcccctttagaatgtcttcataggtttctttcttccctttaaacttaaatttatatcagatatcaaatgggcttccctagtggctcagacagtaaagaatctgcctgcagagcaggagacatgaatttgatccctgagttaggaagattccctggagaagggattggctacccactccagtattcttgcctgggaaatcccatggacagaagagcctggtgggcgatggtccatggggtcgtaaagagtcagacacaactgagtgatgaacactttcacttatatcaaatttaatatgaacttagatttatgtcttgagggaggaatgtagcttcactggaatatatggaatatatggagattattttactgtcttctctattaaatatctggtgtatcctgtactcctttttattaagttgttagcagagctgcagtcttgttagcagtggtagcagaagcatctaaaacaaaagaggaggccgtggcagtgttttgctttgccttaagtcagggtcatacttaaataaatttaaatgttcaggtggcaagtccttagagtgaattgaatttatttgagtaattatttgatatggcttcatgctgttaggttatgttggtgcacgcacatttaaaaaatagaatagggaatggctttaagcactagtaaattatttgggagcaaacattttcctgattacttttctgcctcgaagcttataacttaaagaaaagtcataaagaaataagctctgggataatcgacatagcattttacgtggtaaaacccttaactgctttgtagtaaaaggctctca

SEQ ID NO: 58397 - DNA, 1746 bp, Bovine  19866880784529
cccagacagccattttgcttttttgcatttcttttctatgggaatggtcttgatccctgtctcctgtacagtgtcacgacccctcattccatagttcatcaggcactctatctatcagatctaggcccttaaatctatttctcacttccactgtataatcataagggatttgatttaggtcacacctgaatggctagtacatattaagaataccctttttttttgtcctaaatagaacccttttatatttttacagcaaacatgcaagacattgtccctgagagtatgattagtggattaatgcattcattttactcaaaagtattgtcttggaaaaggcttactgttttatattgtggttgccaaggtcatgcttagttggttcctgtgatagttaacatgattcaaaaattgggctttgtagtatcgaggaggatgataatttaattcttgattctcctcagaaatgtaatatttttcatatatagaggtgattacataaagttttgatttagataaatatctaaatatttgaataaagatctaaatgtatttgaactttagcattgaagagccaaggaaaatgaagcagaaagtctcattagatagctattatttcttgtctccagcatggtgaaatatagggaaaacagtctctgaactactgtggaccttgccacttgtcctacaggtttacttattttctctaaagtagtcgactctcttgtgagctacttgagttaaagatcaagtattatgtcaggaaaaaaaaaataataagagtagtctcttttagacagtgaggctttatttggagaaaattacccttaatcccagcttccaaaaatgatttattaaaatgagcccagtagtagaattactgaagatagttaagaatctgaacatagaagcttattaacaacttagaaggatcttttgaagtatattaaaacattatatttgaattacttaaatagattttaaaattaataaaactgattcctaatttcaacttaagttaacctcatcgtgatatctcggtagatattgtgggtttacatacagttttaacagctgtatgatgtcagccaaatccaagttccaaaaaatctgctactgatgcctttttaaaatagatttgaccccgagagaatttgatactatttcgttcaggccattaaaagatctctgggaggtcaaatcaattcccccagctaccaaagagttctcgttcctggttgatctcccttcctccctctggctcccatacacatgggcacacacacagcactttgtccctggtgtccatcctggactcgaacaagattttcagagaactgggtgtagccatgtatctgaggtttgaggttttgctgcagtgaggttcataatcactgaaataagcaaaatagcctggcctggacttttaatatttcttgttagtttacctaaaagaaaacctacctttccatctgaaatatgtctgtgtgtgtgtttaccactacctggagcagttcttttgcctgtaaatgcttccattcttctagtagtataatgagtagagggccagaaattcaagtcaggaagagtataggtaatacatgtgagagtgtaggtggggatagggagtaaagaatgctgttgagtaaacaggatgatgagaaagcaagcctggaggtgaatggtttcagaggccacaccataaggttggaatgcgtgggcgattcaggagagtggcccacaggt

SEQ ID NO: 58398 - DNA, 1305 bp, Bovine  19866880816022
ggagcccttttctttcccaggaatcctctccagagggagaggctgtaaagaattttcctgaatgtgatgaatgtcagcacattccctgctagaccacacattccattcttatcaaatgaaactgacctgtttgccccagcttgttctccttgttcatcactgtgattaatttaaagttctcagtgatgcaggtttctagatgaattgcacaggtcatttcagatggcaaatgtgtacttccatcgtctccttatcctatggaggtcatgcactggcttacaagaatgaggattttaaaaatagttggcttacattcagatctgtatcctacaaaatgctctgcccagactggcccctctcctttcagttggcagagatccacctcttcctactcgttttctgtttaataccaagtgactcaagtgggagtcatgaccaagacgaaacgtttaccacatacttcaagttttttttttttttttaatgaaagcatttttttggccaatagaagcaaacaggattcatgagagtccttgagttgacattgaataagcccctgagccacgcttagccactaaagacttccaagttcattggaactgatacatgctgctgagcttctggtgaacaaaattattgttccattcgccatcactgtcaaagggaacaaagtatacaaaataaaatctgatcagaaatcaccctttgcatgtacatttctgcatcagaacaattcaacaatgattgaaattggatttctgtacccttaaactttgtcagagcttttaaggggtccaggttatggagaatgggttaattcatgtttccatcttctccctttttaagatttggtcttcttactgaggtactttaggattagataaaaaggaaaaaaattgttcttatgaacatctaggtagtccaaatatccacatggagagcaaatgctgatgaaggctgggactaaggcagtgcaaaaggattagagaggggaaaagccacatttcaaagacatttctgagatggaaatgacaagattggttgtggatgaggattaagaagtcaacagagttttctagtctgggaaactaggttaatggtggcagttccctctctctgcccatttctctctctctgtgtcctttctgtctacctattttcttcatgatgcttcatctctgtgtctctcattctcttgtttggtcagcttctgtctacattcaagctccaattccctttctctgcggatcaacttcttcaccatctacatttgctctgctgcctggttgcttcatataacaagtg

SEQ ID NO: 58399 - DNA, 1507 bp, Bovine  19866880870450
ttttgaaaagctagactttcgtcaaatctctgcatctttaacgttttttggagactagaattgtgtgtgtttatatggtactcactttacttttctgaattaccaggcatgtaactagtctaagtacagatgtccagacttgcagaattgaaagaagaatgtgattactagcatttgaaagttgtccttaaaggttgtttgatgggaacggctttctctagaaaatgtcttccgttctgtctcttcaatggctctagtgtccctcttttttttcccctttagtgagaaaattgagcttttgtgatttacatgttttctagaagcttgtactgccattgcctttgaaataaatcatttcttagcagtaattttggaacacttactttgtctaatgcttattgaccattctacataaaatgtcccttcctgttcctcctagcccccgaagaaaaccagtctacggagggactccttgaagaatatttgttcagatgtcctgggagtttgaatggccaataagataaccttgtttaccgtggttcaaaagagtctgtttttgacaccaaagtttggagtaatagctagaaaattttaggagcagtccaagtatgtgataaacctgagagctttcaatcaaggatttcaagagtgaaccccagctatctcctatttaagatagagtgaagagtactggtctcgatgattgtgaaaaaaattttaatctgtttaaagattccatttcttgaatgatctggtttcaaaatgtagcttccttccttcgacttcatccattttgcctttatgacgtaaacatttctcttattctgggaggtaaggttccagttgatgcatcctttcttacactcagtttccaaagtataggtcattcctcagtcagcgagtcacctgggatgccagcactcactcaggattctgccagtttctgtagaggattattaaaagaaatacccatgtgaaaaataaaatgagtttaacatttgttatgtatagttcttcagttaaaaaattacatcatttattgtaaaaccttacaaggagattagcctttgaattttaggctcaaatgaaaattttttgttgtttggttcctggaaaaaatttatgtaaaacaatgtaatattgactgtttacccttttgccttgcttaccagttagatcagagtgaatttaattcttaaccatagcaattttattagttcatgtggctgggatattcgcttttcctcctttccttgatcttatattttattatccatgcaatattatattctggagggaggtagaatgtgagttatcttttttcatagtcaaattctgaactgttgtcttttaaggctatgctatctctgtcaacaacttcaattctggtttaggttactgatcaaggttaagattttactactgtcctaagtatgttacaggaaaatgtaatgatctctgctcagttttccctgcagtgctcttatttaattttggtagtattatt

SEQ ID NO: 58400 - DNA, 1196 bp, Bovine  19866880903114
gcaaagactctgatcttttaaaaaagacttggaaattaaatactataaaaacaatctaaaatgcataggtttaaaatctaagtgtaagaacaggaaatgtttccttatagctatttcttaaagacccaagtatctaaactattctatttacatattaatatatattttactattctgaacttctttaaaatactcacagttacttatcactcctcccagtggatcccctttaaaatcaaattcaatatccatatatttgccctgcaaaagaaagaatttgtgagttaagttcacctcaaaatattcagtctgtatcttaaaacatagcataataagccctttatgcattggtttaaatgtaattaagaaggacatagtttatgtaaccatgatgcaaaacaacatgcctccataaatcagatcagatcagtcgctcagtcgtgtccgactctttgcaaccccatgaattgcagtacgccaggcctcccagtccatcaccaactcctggagttcactgagactcacatccattgagtcagtgatgccatccagccatctcatcctctgtcatccccttctcctcttgcccccaatccctcccagcatcagagtcttttccaatactaaatactccattagctcaaactgaacatatctcattgctaatttaggaatacatcttcctcagccatcataagacttttccatttcagatatgtgcttcaaagctcttaatggtatgtttattcaatccaaaaatgaaaaccagaaaaaataagtatttcttgcatatgcgctagctaggaatataaattatttcagttttataggcaaagtatgttttaagccatgactagacatttcagacatactggatggtggataaaatggaacacttcaagttctgtttttacatctactcaaatcaaatgcacgattatgtggtgtggaccacctcagaatcaaaggctgatcattattctttttggcttttgatctagattatacagcaacatataactcatgctcgtattatactatatagatggagtctcaaacacacaggaatacacgtagagtctctcatactatgatttgtagagaagaatctcgaatcatctggttaaagagttacaaatatatcagaataactgacagctgttttttgtttggaaaagtgtgtgttgatctaataa

SEQ ID NO: 58401 - DNA, 1096 bp, Bovine  19866880916102
tcctcaaggagagcttatgtagcaaggacagtcactgaccttaaggggccctttggagaggaacaaggcccaaccaagtagccatctggcagcccaagcccagagggccagaaaaatacaatagatatcagtggatgtcagcctgggcacctgcctgttccccattcttcctcccatcatttgggtcccatcaaattgagagctgatagaattgatgaagagagaagttcttttattgactaacactacggttttgcatcttggaagaatttgaacctgacatcggttgtagacattcactagtttctatgttagtgactctaaacaataacagcaacaagcctttttctattattgagaaataaggcattccttgcacacttgaatctgcgagcagagaagcatgttccacacacagtttgctagtgatctttttctgcattcatgtcccgtctccatagctgaactgcaagattttcaaagctggagaggggacccttcctaccctcttttcttcccactcagcatcgtgtacacaacaggccccattttgaagagaaaacctatggaacatgggtgcatggcggttttgtttacatgttggtttggcagagtctcatttcaagagtctttcagctctgacttcatttgtaagtcataaaagttctcccagtattcatttttcactttcagagataacagatgtttgccaagtgtccatcatatacaaagcccacttggacttcttcctagggatgcaggcctcgtccttaaggaacttatcggaaatgtagatgggatgtagatgagggagctaaatgtgcattgactttaggacaacagctaggaggttttgttgcctgttattttaaattcacacataatctcatcaccaaagtgacaaataatctatttgagaaaacttgcaaaatttagaagcaaagaaattgcacccacaaactcagtacctgtaaaattagaagtagtcaatgctgacattttgacatatatcactacttacgcattttaaaatggtatcatgatctgctggagcttgttatttaaagaaaactctgatatactaggttgtatgtgt

SEQ ID NO: 58402 - DNA, 1124 bp, Bovine  19866880918476
ctaacggttttgaaatttgctgcatcatccactccattaactttggccgagtccagactcagggtagttatatctgctgaaatcccgctcaagtttaagcttatctattgaatcacacatatgagttgataagttacttcaataaatctaatcatctttaacatctcattcctttaacccttcagataaaagactttcatactatgcattgaaccaaaagaacagaaataaatggtatcaactcaaatatatcagtaatagtatttgtccaaaatcacctttatcatgtgtacatatttcaaacttttttttttttgcaggccctttccatatttggattatttatcttcaatgagctgtttccttataacatatgatgtctgcctagtgattctcccactgttggacacttggattttctccagtttgttataataaataaaagccagtgataaatgtcttcacacaaaatattctttggattcttttgaatgattccattgggatgtaatccaaaaagtggtgtgcctgggcagcaaagtctgatcattttatgacttcttctgctttgccaactagtcccccaggaaaaagtcctcactttgaagtgatactcagaagctctagatagattgatcagtcctgacaactctgctagctttatcctcttcaataactttagctaatacatgtgtaggggctacttcagtgctgcttcaatttacatttgttgataattaacatctacttctgctttattgactatgccaaagcctttgactgtgaggatcacaacaaactgtggaaaattcttcaagagatgagaataccagaccacctgacctacctcctgagaaatctgtatgcaggtcaggaagcaacagttagaactggacatggatcaacaggttccaaattagaaaaggaatatgtcagggctgtatactgtcatcctgcctatttaacttatatgcagagtacatcatgagaaatgccaggctggatgaagcacaagctggaatcaagattgccaggagaaattcaataacttcagatacacagatgacaccacccttatggcagaaagtgaagaaggactaaagaacctcttgatgaaagtaaaa

SEQ ID NO: 58403 - DNA, 967 bp, Bovine  19866880934357
aaacctgctgtctctttgcccttctatcaccaaaaaggaggcccatgtgggacagcttgagtattggagacggtatctggttctttacatgcgctaatttgcaaattagcatcctttggatgaggcccaaacctagagactgccttggaagctgtatggaaagttattgaaataacacactctctaatctgggggcccaaatctctaatgatccctctgagttacaaaattctgtgactaatggttttgttgactgcagcctctagcaaaaggaggctgtctccacccagggatgctcctgtgacgttttagattcattatgtccctgatgaaactaccaaagatcttctttttaaaaagtagctcttagcgtgccactgtgctcttatcaacactgaatgcctgacccatggaaaccttgtgactctctgatgtgatattcctattttgggtgagtcacctcagattcaatgactaacagagggggacagtcccgataagtttcacttgtcaaatgaaaacagcaccttcaagaacacaaccagcttggcctccacagcacctagattttacacgtagaagtggtacctgttcctttaggggaaactttatgccctattactagctttgtacaaaagtaactacagttttgcactgctgaactttgccatttgatatggaatacattcttaaataaatgtggttatgttacatatcattttaatgcacatctctcctttttactttttttttttttttgctaatgacattgtgctgtgcttagttgctcagtcttgtctgactctttacaaccccacagactgcagccctccaggctcctctgtccgtggggattctccatgcaagaatactggagtgagttgccatgccctcctccacaggatctttccaacccagggatcgaacccaagtgtcccccactgcaggtagattctttactgtttta

SEQ ID NO: 58404 - DNA, 1891 bp, Bovine  19866880937270
ctcctcttgaattttctacacaatttaatgtacatttgcctacacgcaagcaagctttgctgcacaagaatagcacaattcagcagactcaaactgcagcctgctggctctgcatgtacttcacagtgccctggagtggctgttagagagggttttctccacttcctcattgcttcagcctcccctgcagccatgtgagaatggaacagtgttcaaggcgaaggctcattcctggagaacctgggtaggcatagaatataccagcaatggctgagaagaagaaagcgattaattatatatcctttctgccctatttgttttgactttcactgaagtgaaatttctgcagggaaaagtccattttgctttaaaccccaaactgtccattcccagtagtgggctggtgattggataggaaacattatactcagagctagtgtgtgaactgtagcctttctttacccctgttgtgtgtggtgtgtgggatgtgtgtgaaatggcaatgatgctcagcttgccttttggagtcattgtggtatctacatatttttaatgacttttgatgtagtgatttccagtaaggcttgtttgcaaaagtagaaagagagtccatttgtaaattcaaaggtctcaactgatattaatcttaatcaatcatattaagtttgtgcagcttaactttgcagaatagtagcccaaagattccttgtataatagcagaaccctgtcttcctggggtctctttaacaattcaagttcaaagatcttatttaatccaaaattttataaatgtccttttgcaatatgttttctttctgagacttactctgtatcagattcttaagtttatgcttgatgctaatgtgcatttgaccatatttcccgaaaatcttcctatagttatttttataccaccacccaccaccttcctttatgtatttcttgtacttctgtttttctgcttggattgctcaagagtctgttgtgacagcagcagtgagctgagaacttcacatactcaaggtcactgccaccagaagctctgcattatcgcatggtatctgtcatcactaggggaaaatatcgtacttcaacctgcctgcagcccagcccaactctgaaatgtctttctaatcatataggatctcagaaggtgtggtttgcctgtacaaccatcagataataacaacaaaagtcctcagggtctatgtgaatataccgccttctttaataaaaaataagacgactctctttggagagtctggcaaaagaggcagctaaactaccaggactttgcagcgctcaggaaattcacctttccctgaagatgacgtctttgcattctgatcacaaagaagttagtatttcctagtgcaactgaaacaaagtcttctgattcaaggtaggcaggtcacaaggggaaacgaagcacagagccccgggaacaggaagcagggttctccagagaggtgctcacacagctcagaataaggggactcactggggcataggctgaaaatactagggggttctatgtctgtttctcacgccatcctttgaaacttcatgtgtatgttctgtgatgtacagagaatgttagtgtaatgtacatgggctccccaagtgtctctggggtaaataatctgcctgccaatgtaggagatgcaggagacgtgggctggatccctgggtagggaagattcccctggagaaggaaatggtagctcattcctgtattcctgcctgggaaatcccaaggacagagaagcctggtggactacagtccacagggtggcagaagagctggacacgacttagtgactaaacaaccacagtgtactgtgtgcaacgtgtacatttgtacacatggagttgaaaatacatgttccag

SEQ ID NO: 58405 - DNA, 1286 bp, Bovine  19866881003702
ctttcagagaatcattagcgaaaggagataccccccaagtaaatagaaagcaggtggactggtacaaatggtgtcacaaaaatatttttcaagtcaattactgtagggtgtttttttttttttttttaaggtgctgggatatctaggctccacttatctctaaataataaaacttttcactcctagcaaccacttcctggaaaacaacctgacaaaaagatcaaaacagtgaaaagaggtcttttgcacatttgcccatgataagagaggtttaaagagcaaaatcctataatagcttcaatccactctctctcagatgaatagttagggtcaggaatacccttactgaaaaaaataacatgtattgatattaacttttccatgatcactgcattctggatttgactatcaactacccacagaattttatgacaaaacaataattgagattttattggctgtaaataggccccatgcattaactgcacaataataaaacaaattgcactaatttctttgcttctccctgtgctatgccaggcagtttatataacctcagagggccttagttcccttacttgtaacttgaagataataatattcactttgtggggctgttgaggaaattaagtgagtaatgcatgtgtattgttcagggacaggcccacacagaaattcaacagatgttagctccttgtcccttgcaattcatttctatccagaagctagagtgctctccttaagctataaatcagaacatgtgattctgcagcttaaaacccttaatgtcttcccattacactcaggataaaattttttaaaaaattgcaatcttcgctacaaggcctccaaggaagcaacagttagaactggacacagaacaacagactggtaccaaataggaaaaggagtatgtcaaggctgtatattgtcaccctgcttatttaacttatatgcagagtacatcatgagaaatgctgggctggaagaagcacaagctggaatcaagattgcccagagaaatatcaataatctcagatatgcagatgacaccacccttatggcagaaagtgaagaggaactaagaagcctcttgatgagagtgaaagaggagagtgaaaaagttggcttaaagctcaacattcagaaaaacattcagaaagctcaacatggcatctagtcccaacacttcatgggaaatagatggggaaacagtggaaacagtgtcagactttattttggggggctccaaaatcactgcagatggggatttcagtcatgaaatt

SEQ ID NO: 58406 - DNA, 747 bp, Bovine  19866881052741
tgagtttgggtgaactccaggagttggtgatggacagggaggcctggcgtgctgtggtccatggagtcgaaagagtcagacacgactaagcgactaaactgaactgaacaaaatggcagatcttgtcttcttttctgggtacaagaagctaacttttggcagcttggtgagaacaagagtgggtttacccatggctttatactcccttaagacagcaggcagcagttccctgtggccacctatgagtcagtcctctgtctatactgggtgaaatttcctgctctcaccactaatgtttccctctccttttcaaaccaaaggatactctaaaataccagggtgttcccactaccacaaatttcaatattatttcattgtgggaacaaatggtaacagagaccatttgaaatccattcatgatgatatattaatcttcactggaaatgaactgagtgtttactatttattctccatggatactgcaagaactagggacaggaagacatttctgtttgaaatttgaaacttcaaaatgtaaaatccaagtgattttctaatacttgcaatctaagtcatccttaaatattttcctagagtcctcaagagtaacataggttcagtcatctcagaatattctataataaagacagttcatttattctcattttaaaaataatgtgctattcaattaataactagagctaatttctcttataaaagtacaagtgctgtaaagtgtgttagtaa

SEQ ID NO: 58407 - DNA, 1170 bp, Bovine  19866881149723
ctcagccagaacaactcaaaccacagtggtttcactgtctgctgggttgttcctaccaccacatcgatgcaaggcatgaataaatgccacagtaacttcaaaattgaaccctgatcaccaggaaggtctatattaggatttaaatcatgatttaaaaaatcttggttgtggtataactctgactcattcactgtttggatgtcttagatacctaacggatatctcagtaccattcaaaacaaagctgctgatttccccatcaacccattcttttctaaaacctattgtgtcctgccaaaaccctactcctgtctctttcctatcttccccagcttagtaaacagtatctccaagtgacgcaagtcacaaatcacagtcatcctagattctttgctgcttctcacttccacatcagatccttcagtgtaagccattttggtaccatgtgcagaacataatggaatctgcccacgtatttccacctccactgactacgcctcaacctcacatacttcccctctgctccttcagtctgttgcaagagcccactagccatctgctgcttcctttcctatcctggcacctcagagatgattcctgaccctgatctaaagaaacaacccaaaactccactactgtccacattgtatcatgctttattatcttcacagcaactaagcaactattacaacctgaaaaggtttttcaaacctagaatgacttctactataatagggtcctttctcaaagtctggatctgtaacatcttgatgcttatttttccccacttcttgggggcaataaaatcagagagctagtcaccactgccttgaaacagggtctcaataaaacttgttggatgactgaatcaatgtttattgctttattatcctttatgttcagttaggaaaaaagtacctggctgattctctgggcatgatccaagatctttctttcctccttcagacagttacagatgatcatagacatctgtattgggtcttcctgaaaattatcctagacatgggttgttagaataaaagtaaattaatcttcagaatgtttaaaccattgtgtaatatacacggaaatgaagtttgttcatcctgaacttactaaatcctatataagctatttttggtaacatcaaaatattcttttcacatatta

SEQ ID NO: 58408 - DNA, 1623 bp, Bovine  19866881150013
aacaacatggattcccctgggggagtcttgggaagggtgcaggtggtgagcttgtatgcatcaaacacaaagtgtcctcggtgctctccatctgttcccgtgtggattcttctgatagtttatggaacccttgagttagcaagtcattctgaaatttgttcctgtagtcagtgttgctctttcagggaagaaacaaatcagtttcttttggctgaattaaatatacgggctaattttgttgagatgtcagagtgacccaaccaggcctggagatggtagtcagggaaagtcaatccatttgtgtgaagataggaagtatctctgtgccattttatcagggttccagtttcaccagaatgagagtgtggaggagggtatcactatttgctccccccgagaacctagatgctaaaaaaaaaaaaaaaaaaaactggtacgaaacaaaactctgctggctggactaaatggatgttggcatcaccttttcaattggtttactttattgtggtattttgagctgagaaagttgtgttttcagagtttttcccttttacccactgcctataacagcatttgttttgccctcttccgcccttgccctttggattgattataaagttgggaaagaaatgtaaaaatcagaacccatactctcgcttgaaactcatatttgaaaccatggtgaagcaggtttaattacagagaaagattggctgcttaattgctgttacctgccacgaagctgttgcctttctgtagctgtttccataaatagactttatatacaggaatctaccctggggcaaagagttcccattcggcctctttacttaattcaaattgctaggttgaggtggttatttttgaaactcttctcaggttgactttccccttaatccctaagccttcttccctcatctgccaaattacatgtaatgtatcgctgctagattgcttttggcatttctcaagtctgagaacttgaaatttgattgaaatgttaatttattgcgacagtttgggcactcacgttcctattcctgaacaagtctctgaaaggacttagtgtgggcccagccctgtctctggcttctgtgcatctctagagcatggcatgtctccttcctccacctggtttattttgaaagaatctggcctgattcaaggtatgtgaaaccattcttggtgtgactgttgttgggttttagcaatacctggggctgtttattccaagtatagttggcatgatatttaaaaagattaacaaataagttaactttggttttcttcttttgattattaaatagttgcttattggttgcttttgtttgtcggagagccttgctgctggtccttagtctctcttttttggcttttcagtacacacttaaaaattttttttttaatgttgttgttcagtcacttggtcatgtctggctgtttgcaacccatggactgcagcacgccaggcttccctgtccttcaccatttcctggagttgctcaaacttacgtctatcgagtttgtgacgccatccagccacctcatcctccgtcgtccctttctcctccggcttcaatctttccagcatcagggtcttttccgggagtcagctcttcgtat

SEQ ID NO: 58409 - DNA, 649 bp, Bovine  19866881156203
actcaggttcaaatgccactctgtctcctacggctctaaggggctagacaaggctcttggccagcctgtgagggagatctgcctgcagcacctgtcaccctgtgggtcctcaagaagtatttgaccatagagcttgccaggcagtttccacttcctcccgtgtggctgcacagggatctctcccaaactgagccctcagaggacaagtaaacacgtagacgggttaagagtcccaaagccagtgtcttgaaacaagtcttttaagtcctctaagctgaactgcttcttctgaaagatgggactcataacagtacctctctaagagagttattttgaggatgaaataagataacatacatgaaaacactgtgcaaacacacctccttttttactacaatgaaaattatcatttctttgatcatcagcttatacttgccttataccaaaggtttatataaggttggtttccattaatacatggagcactgtttcagaaacaaagaaatgttctctctttaattgcaccagaagtaaaacaaaaattacattgctccaaagtgcttaggattttataacatggagaatacattttctaaaccctgctgaagttataataaaattatcaaagcttaggaagttattaataatt

SEQ ID NO: 58410 - DNA, 1466 bp, Bovine  19866881217212
ttaaggtgaatttcagttttacagtttttctactcaacataaattctactgaggcttacaattctattctaacgcaataatactctgtttgattttagcaacatttctcctattctggacaactgataaagcaacaattacacagtgaatcagtgatgttcttgctcagaaaacagaatctgtaaatggaggagagcttttttccctaagtcattaagtggaaaaacaacaaaaaaaaaaaaaattaggaaaaaagtctttattcaatacttctaatacaaccaattgaaaaacatcctccccgaaagtaagaaaaaacccaccaacactatactacattaaaaaaaaaagagaatcaaatgaagcctttgagtatttctatagtttctcttcacagaagtctcagaattaactaaaattataaagcattttaattatatcttcataaagcatgacttttaaagttaaaattccatttgttatacttaaaatgctggagttgcttttattaaaaaaaaccaataaaatcagcttaaaataaatttattgtacaatacaaaaagtaggcatactggaaaataaaaggtacattaatatacaaagcaaataaaagaaagctaaataacacaaatggattaatccaaacactaagataaaatgcacaacatttatgctaaaaataaaatatttcagaaaggatatgcatttcaaatgaaatgttaatgatggaaaaaaaaagaaaaacaaatatgctaacttcaaaatgcttgaatatcaagaatcagtaatggcataaaacattaaattcaacaatactgggtacttttcaataactttatttgaaaaggtatttaaaatactgaaagaatcaaaataatgtttttaaatctggcaaagattttcctctttttttttttttaaagtaaagtttgaggacctattcacagtatctttcttcttccatttgtaccttcctacaaaaacttctggatgctcatctttaacaggatgagtagcttagaaaacccttctccactggtgtgtatttaagccttatcaacatagtaaatgacacaaattaacatcattttgaaatctgtacaaacgtggatacaatatgaaacatgaaattttcattttataaagtaaaacccacctccaaatgaaacagtaaaatataacaattagagcgtgggagaggggagcctttttttgggaaactaccaattaaagacattcagtccccaaaccacaaatagctctgtgaattaatacgaatcactgttcaaaggtatagcagagttaaggtataaatgtatggagagaacagacacaccactctcatgtaaatggccaaaccagaaacatccagttaggatatgcatctgcacatcagaggaacaattagccctaaaatccttggctaatatcctctaaaacttactggataactattttttaaatat

SEQ ID NO: 58411 - DNA, 1341 bp, Bovine  19866881231612
taggcatatttttgttggaaagcacattcactttaccatagctttgaatataaataggggaaaagttcttgtgtctgggtattatggacaaattaaggtagatatccaggaaatgcagaagttggaatccagtctgtctgctcatctccaaggcagtttggtaacagctgtctttacttccttgcacaaattggacttggatccgaaaaagaaaagggatctggtaatattaaatgaaaagcagttgggagctggcacagaaacattataaaaagggaaggaaatacacccaccgatttgttccttccactagaaagaaaccccacagatgaggataccatgtggtgtcttgaactgcccccaaaccacagcagacacacagagtttgtttgaaaccccttatttcacaagtacacatgcagatatgtgtacacgcagacacaccattcatctctctttctaaagatgccatttctaatgggcacttgcatgtacaggtctgctgtccgcatcctggattgctcagaagtcatcgttagtcacatggttgtcaacttacctgccaaacagacccacctctggatacttgttctttggggcaaccgtttcaggatttcgttctacagttgacccttgaacaacatgggtgtaaacttttcagtccacttacatgcagttttttttccaatagtaaatactgtagaacaacagaatccacagttggttgaatccctgggtgctaaaaccacagatatggaggagcaatatacatggagagctaactataaggtacgtgaattttactgtgtagagggtcatgtgatgctaatccctgcattgttcaagggccagttatattttctgctaagacatgctacattctaggaatgggagctactttatattgggtgcaaagatttaaattcttagttttgccatcaagtcctattttgatgtgaccaagttacttatcattcaataattatatcactgttcttttcatgaaggtaataaaatgtctttaaaccaaaatcagatccctgaatgggccattttgctttatcttagacttcacctcaacaagtcttgccaaatgtacaccgttagacaaaaatgccatttgattgcttggtagaaacctgatactgctcttcaaatgaaggtacattgagagtgtctcacaagttgccattctgacttagtgtggatgctgaggattaaaagtgttagtgaagggaaaacactttcaactcttgcctgaaacgagaatctttcctttcacagtggagtttcaagagtagcaatgaaacaatattgagatcttctctgtcatgtaattgg

SEQ ID NO: 58412 - DNA, 755 bp, Bovine  19866881271587
taattgtaaccctaccataaagctctctagttctaaaggaaacatattataagcaatttgaaatatataattaattagcaattaactagaaaagctgttagacaactaatactctgttgcatatctaaagatatagataatactctattggatagatcttgagttataaattaaggcttgtgttaaatttcttttctttcttgagggtaaggggaaactagaccacaaaagtatgtttaaatattcaaatcattatattgtggaagcaaagaatccagataccttcctgacattgtacagtgcaaaatttagtttgaaatatcctgaactctttggatatcccgactctgccattttctaatcatgtgaccttggtaagtcacttcgataaacttcagtttctctctctgtgaaacagagtacctactcgtagtacctacttctagggctctttctaagcgtaaaataagaaaagcagtcaactgcatagcataatagtagaattttaggatgttggattgtatatatccaataacttaaatactattagaattattatattacaagcattttacagttcatagcgttagctgttctattcagaaccattcattaaaattgagagtcagggtaagatctgtcttcctccacagtgtcaaaggcaatggcctcccttcacagatgccccatgtcacacttaactcattcttaaagactaacgtctgacatctatagtcagaaatgactatggctag

SEQ ID NO: 58413 - DNA, 648 bp, Bovine  19866881308187
tatccgttaacccataccggtcattgcccatttattcaccagagaaagtggaagattacaggaacagaaatttctatgaactgagccctcatatgtaagtatggtattaaagtatcaagtgtctctttcactccagggatgttgagttgacagatgtgtccagctgtttcctttgagtctcaggaaaatgttattagtcatttttaaaaatcagatgaaggaacatagaagctaattgttacagcttattttaaatttaaaaaaaagaagacttcatttgtcctcaggctctttaagtcctgaagtatttggtttcagtatgtaaagtattttctgttaaaaattctgtgtaagtagcagctgctgctaattatttttgcaaataaaacaggaatgtgtattgtttgttattataaacagcccaagcagtgtttccatgcctttgttgggtcaagaaagattccaggtgttggattgtgtaatgggttttgagaaaaagaaatacataataccttcagtttataatcttcatggacattgttcaccagatgtgtgcattaggccaatgatttcaccttccttgaagttagtcacttgtttgatttttctgagaaggtcacttgttgtaaataattcccgtaagtaata

SEQ ID NO: 58414 - DNA, 1685 bp, Bovine  19866881315901
cttagactttttaatgtgcttattataatgtgtagtaaatatggcaataagatgcctggggacagattttacagagcacagaaatagcttcttgtctagttgtgttttcaagcttggtttcatccgctaatgattgggtgatgaaattaactagggtttcctacatattaaaaaaaatccaatctacttattatcaattttactgatgagaataactgcattctaggtcaatgatgaaatgctcaactaacagagaatctatgcttttccttcaatttttattttctgtcagaaattttgctactaatttataatacagttttggagagaaaaatgtaattgataggtagaactttttgaaaattcaagtgaattctaaaagagaaatatgggacatactgtaactgtcttactaaagactctgattaaaatgctgatatataacatgtatttttatacatggtttattcattcacaaatatacatacagtcaacaatcattgagtactttctctgtgaccagatgtgctctggatgctggcaatacaaaggtgagtgagactaccctaatgagtttgtaataggacatcggatctggtaggtttatccgttctgttgtttttaggatacattcattaagatgtgacctcaagaatagatttcgtgaagttcccttaaattgtcccagataactgtcagccttttgaaagatgagagatacgttgcagtttggtttctctcagaagcagacacagatggcatcaaaagggcagagtcttatcgggtaataacacctgtgaaaggaaaggggaggaaggtagcttgtgtgggggagacttcagtctgcaatgcagatctgaccaagcctctctagctcaaccaggagctctggagcacagactgcccattggaggagccctgcattgggtagaaatggttatgctaaaggttccagaactgtccactcagattctccaagatgccatggacgtacaggggcactgcaggatatttttaaatttccagggaaacacagtaacatctgtcagataccctacaaacgattactctttccttgtttggatctgactatttaacaaaaggaactgggaggcaatttctttcagtttaggcagtgctatgaaaaaaatgactgagtctctgggtgccatgaactgataaggcttgaggacttctgggctaggctcttgtaccttgggacctcaagaaggctgtgagcacggctatcactaccctgctcagtcactgactgacaccacctgaaaagagtatgtctcagtctgagggcttggtggtccctagtgaagctggaggctgttccactaaccacagccaagcccattttctacgaatgacatgctccacaaatgctgggaaaatgaataaaaacctatttgtatgaccaggggccccatgctacattgaaggaaccatccagaaatgttccatacatagattagggttgtaggagtagcttcccaggggaagtggagatcttagaaaaaatcacgcagttgctccaggttggaggcaatattgtggttcagtttagctaaggttgaaccttgccatgggaggtagcccgacaccttttccaccagcccagccgttcagttccttgatataagcagacatggttgtcaaaagaattattagagagctgc

SEQ ID NO: 58415 - DNA, 1236 bp, Bovine  19866881407662
tattaagagttcagttcagttcagtcactcagtcgtgtctgactgtttgtgaccccatggactgcagcacgccaggcctctctgtccatcaccaactcccggagtttacccaaactcgtgtccattgagttggtgatgccatccaatcatctcatcctctgtcgtccccttctcctcctgccttcaatctttcccagcatcagggttttttcaaatgagtcagctctttgcatcaggtggccaaagtattggagtttcagcttcagaatcagtccttccaatgaacactcaggactgatttcctttaggatggactggttggatctccttgcagtccaagggactctcaagagtcttaggaatataaaaaaagaggtgtccctgtagagtgattttgggttatgcagcacccttttgaattgctcaaactgcttaatagcattgactttagcaagtgtcacaacatccttttgggtagcaagcattgcgctaatagtgctgtacaactgcaggtcagacaaccaagggacacaagggttatcacacgtctagaagacagttatgcatgaagttcagatggcccacctaacaacgcttcatccacacctgacccaagtggcatcttcttggacttatcatctctctaaccgatgacggttctgagttcctgttactctggattttccgagtgtatctgccatttcctaaacagatggtcagtatcacactgtatcactgtttttgatggtaatagaaatcacatagctaacacttcctgaagaaactggattagatattgaaaattggaccctgggcttttttaaaatttgatttcctgtttcatttccagaaagtcacaggaatattgacagtctatcaagggtattttgaaatagattaaaatctacatttgttacctgacatatactctgaacattttagaaggacctatgggacaagacatgcttctttttgatagcaaaaacagagaggccaagagtacagcatggcttatacattttggggctcagtttcctgtgtaaaataaaagttaggacaaactcacctcttaggtcccatgcagctgtttgatttggtcattgtgatggtgattttctctggtcagctcaaaacctgggcaggaatacctatgtagggatagcattcagcttatttaccagcatattccccatgcttagcacactgcctggcacacagcacgtgcttaaaaatatc

SEQ ID NO: 58416 - DNA, 1436 bp, Bovine  19866881411552
aaaaatttagaaattaaatgctaagttctcctttcatattgcagactttccagcactactacattttccttatcaaatatcttttctcagaacctgccagaatcagacaaccttcttagtttatttgtacaaagttatgacaagagtggaacaaaaatgttacagttcacatgagttcatttaacacaggcatgcttggcatatcaaaatcatacattttcccaaaaaacctagaagcagttatagattctatcaattttacaagcctaaaacatgacattcctctcttcagtcctatcattctatttattttgagcctatttaaaagctgaattgtctgacttttgtgtcttccaaataccctgattctggtcaagtagcaattatgagaattacataagcatattactttgtatttatatagtgcatgactttgaaaaagtaaatattaaaaaaattataattgttttcaaacatctctgatgggctgtactatatttgtaaaatattatttgtagatttgtaaaatatttgtaaatatatttttacatttgtaaaatattgtttgtaaaatattattatagataaactggtatttattactaccactgaggttaaaggccttggctcaaggccatatagcacatgaattagtaatgtagctgggatacattcctaactgtgtacaagtagaccatgataatgtgaatccttacacacagactgttatccaaaggatacaagtcaactaagagactaatcagcaacccagttttaaccccaaaagattctttgctaaatactggaaagaagggaggaaacatggaagagtaggagcagagacgggaaaggagatgatgagggagggagggaagactgatatcactagcatgacactttactccaagtattttatttccaattctattaccaaccacaaaaactgtggtttagcctttttttttttttttttaactctgtcttcatacagagaacaaattcacccttctggaaaggctttaatggaaaaagcaggtaactgaaaatccatccttctgttgctaccacgtttggtttgatgtaagctgctctcttgtttctagctcactacagtatctgttgctgtggaacagatactcttctccatctgttaaataaaccatcatcactccacctccaattttgttttaaaagtttacttccaacttggccttttatagcctctaaatgaaaataaattttcagccttctttcataaatatttttaaggtcaggttaaaaaatacaagcctgctatatagtgtagctgaggaaaaactttaagtttccagcaaatgtaaattaatcacttgctgacgagggtagaaatataaaccattacaacatgtatgtgatcaaagatattctctttcccttactgctgagtttatttaaca

SEQ ID NO: 58417 - DNA, 2119 bp, Bovine  19866881464644
tgcaggagatgggggttttatccctgggtcggaagatcccatggagaaagaaatggcaacccactccagtattcttacagaggacagaggagcctagagggctagagtccatgaggttgcaaaagagtcgaacatgacttagcaactaaacaacaacaaaatctcttcagaggagcaaacttgtagatacctaccactgtttctttgggacatctggagaagaaatctctaggacaagaagggatggaaagcttgatttaaattttaagagagtaggactcagctgggtcctgtgaggggagaaaacaaagtttgtaaaacagaatttcttggaaaaggtaaagattgtgttttttaaaaactatggttgatttacaatattaattttaagagtgcagaaaagtgattgattcagttatacgtacatattcttttccagattcttctctgtataggtcattataaggaattgaatatagttccttgtgctatacagtaagttcttgttgtttatccattttgtatagagtagtgtgtatttgttaatcctacattcctaatttactcctccccccttcccctttggaagttacaaatttgttttctttgtccataggtctgttttataaataacttcgcttgtattattttttagattccatatgtaagtgatattatataatatttgactttgtcttacttcactcagtatgatattctctagatccatcccatgttgctgcaaatggcaatatttcattttttaaattgctatgattgcattgtatatatatatcatatatatgttttatatatatgatatatatatatattatactacatcttaagcctgttgtctgttgatggacacttatgttgctttcatatcttgactgttgtacacagtgctactatgaacagaaataataaatataggagagggtgtggaaaaatgggaacccttgtacactgttggtgggattgtaaattggtgcaaccactatggagaacagtatggagatttctttaaaaaataaaaatagagctgccttgtgatccaacattcccactcctgggcttatattcagaaaagacaaaaactctaacttgaaaagatgcatgcactctactgttcatagcttctttgtttacagtagtcactttttcttttctttcctttgtaagcatatttagtgtcatagaatggaaaatagttgcagtttcttacattctttatcacatattgatatttaatctgtataagagtattttaggcattattgacttttgattatattaaattcaggtctgttctttgtgaatgcaacaaattatagtctttgatcagatgaaactatgccatgttctgtttttaggtacatcatgggctttgttagcaaagaaaaggaacgactcttactaaaggataaaatgcctgggacctttttgttaagattcagtgaaagccaccttggaggaataactttcacctgggtggaccattctgaaaacggtacatgctcactattatttattcatgtgaaattagcattgagtttggttattggtctttccatcttcagaagtgtgtggcctgttgttctatttctcatgtgttcagtgggtttgagtattaattgttacagttgctccagaagaacgtagcatgactttctcacagcctatgtgggtgtcctctatcatgtggccatctgtactctacttaggcagagaaaggctagccttgttttataaccagtgacatgaagagaatgtaggctggaaaaatggccacaaagaatgcctgcaggatcctgaatattccctctgttttctctttttccaggagaagtgagattccattctgtggaaccctacaacaaaggcccggctgtccgctctgccgtttgctgacatccttcgagactacaaggttattatggctgaaaacattcccgaaaaccctctgaagtacctctatcctgatattcccaaagacaaagccttcggtaaacactacagctcccagccatgcgaaggttaggttctttccatttgctttttcttcttaagatttggaaaataatctcagattgcagtaaagtaaataagttcctct

SEQ ID NO: 58418 - DNA, 1802 bp, Bovine  19866881472183
ttggcattagtggttggagcatagacttggattactgtgatgttgaatggtttgccttggaaacgaacagaggtcattcttacattttttagactgcaccaaatacttcatttcagattcttttgttgaaaatgagggctgctctaatctgtgccagctacatatgttcatgggatgatgggtggatatggattataaatgtcattcgtatattcatatacgtttgtacaccagatttccaaatctagttgcttcccctcatctccagggaagacaccactcctgacattttgatagcagttctatcatgggagtttgtattatatataagttgatgataaaggtaaaaatattaggtcttgatagttttcttccagtgatacaaatcttttttaaaaaaaacttactgttttgtttttggctgtgcccaggcttgccaggtctcagatccccaaccgtggattggacctgggcccctggcagtggaagcgctgagctctcactgccaggaattcccactgtcatcatcgtttgctaggaagggcttccctggtgactgagacggtaaagaatctgcctgcaacgtgggagacccgggttcgattcctgtgttgggaagatcccctggagaattaactggcagtccattattcttgcctggagaatcccatggacagaggaaccttcaaagacaagcaatcaatgcttttctgtagaaaggaaggaaagttagacctacataagaataagcagcatctcaggcttgacaagcttttctaagaagtcttttttcccttctctgcagagaacccctaacatgggacatgagtttggtgaaatatgtgcccatgcaaatctttttctctattttctataatcaccatctgaaatcagtaagtgaaggacaccacagtctaatatatcttactattcatcttcatactttaaaataaacatgatttattggtgagtatacttgagaagttttctatttaaattgcatattatgtatgataccaatttttaaaaactgtgtgtgtgtgcgcatacatagggaaaaaaagtctatatgtgtgtttaccaagatgttgattgttttctttcagtagtatgtatgacttctctttatactcatctgtattttttacaaagattattgatttctttaatatttagaaaattgctaattaaacacaaaatgtttatgtatagccttttcaaatggccttccttgtctctctgattcactggagtttgtacctattcattcaataagtaatgaatacctgtcgtgttcaaggtcctgtgctaatggcttagatagttttgctgttttacaaaacccaagcccgtcagctcacagatattcagagtgcctgcgatgtgttcatagctgcccggtaggagctctgtatccaataatgaacaggagagcgttctttctccaggagcttatatgctataaccatgtaaatggataataagtcatagtgtgcaagacatatgttatgaagaacatttgggggtgatatcacagatagtgactaggagggtggggctgctttagctgagggtttgtggaaggcctcacctgatggccttcaacccaaatgtgactgagaaggtcacgtttgggttgaagctaaatattaggagaggctttgtgaagatatgaccttgagcagaaggaacagcagaagggaaagacccaagatgagagcaacttggtttgttcggggaaaacaacaaaagttggcagagtaccgagaaggaagaaatgtaagctgaagccagtagcgcag

SEQ ID NO: 58419 - DNA, 976 bp, Bovine  19866881501090
ggaaaggagggaggacacgaatggggatcccaaggggagtagctctgttgttttgtcttccccagtggaaatctgaataatatgaggtgggaagcctagtgcagagaagaatttggtggtttggggatctggagaggcaagatcttagatctactctctgatgctagaggaggaccctgtgacttaattctaacaggatatgacatattcaggactttgtggtcaccttgatgggttgacatatattctttctgcatcgctcttcactcaagtcgttaattttgtttgactgtatacctctactctggagcggtgctctttgaaaaggtgaagttcattttatttttattttttacgattgatggtgtggaggggaaggatgagacaggaagcagagagataagctgataaaaatgacaaaatacaactttatgtttaaactggaagaacaaaaggctgtttatgagttgtgatattatttggtattgaagagtaatgcagatgtaattaaagtcttccaacccaaagttttatccagagagataaagactttcttttcagagtcaggcagcatttatctcatacaagcaaccctggtgcatgcagctcatttatatgacagctattatgaccatgatatctagagccagggccagaaacacggtcccaaatagaatctttcaatacctgtggcgtgaaggagtgagtatgcatacagagagggtaataaaatcctacatttgcatagtgtttttctcttctttcaaagcagttttacatctattagaacacaaaatggtaatgttagttttttttttttctaatgatcatttggccacaattctctggattatgttgttgaactaagctgaactaagaatcttcaggttgaaaggatatttggtggtctcttggactgggagatgaactgtgagacctaaaggtctttcttaaaatgcaaatacccctggaagag

SEQ ID NO: 58420 - DNA, 1388 bp, Bovine  19866881613694
ttttttttttttaatgtgtcttctttcctctatgcattctgctagagcatttcagtggcttaatcaaaaattggagtgaatattaaataaaggaaaccatttgcaaagctacctcacactttgggttaaggagcctgagctccttaagaaatagtttagcatttcatatctcattaaacagaacacacagtactttagatatttttctttcactctaatgattttgatagcagctgttgttaattggggaagactatatttgtcaaagcagctgatcatcttatattttttaaaaaacagaatgtaacaggaatttggaaatctgcccagtatgctttttgagaaatgatggtgatggttgacaactctttttattgtgcctcttcctgaaacctggagagggcaatggcaccccactccagtactcttgcctggaaaatcccatggacagaagagcctggccagtccatggggtcgggaagagtcggacacgactgagggacttcgctttcaattttcaccttcaggcattggagaaggaaatggcaacccactccagtgttcttgcctggagaatcccagggatgggggagcctggtgggctgccgtctgtggggtcgcacagagtcagacacgactgatgcgacttagcagcagcagcagcagcttcctgaaactccctcacaggggcataacctgcccatttacagggtaaatctaaagacagattgttgtctaatactataatgacacagaaatgtactctccctgaactacactgaaggagaatcaaataagggagccataaattattaatagctgctcttattaacctgctcttcaagaatgcaatactggttgcttttaagggagtctggaaattctttcctctgtgttaagagcaaaagaaaaaaaataattttaaaggaagcaaacaaggagagaggcaagggaagaaaaatgagggcaggaatacttcagcttcctaccattaagcagttctgtatctttgagatgtcaacattttgaaaagaaagcttcttggaatatttattttttccccccaagatttagccaagggcttttattggcagtatatgctcagttttcccccatatatttaaaaaataattatttacatatttcaacactttattttatccctctgagtggctctgtgttgggacatctaaaataactattttagcatttgttgttcttctctccatgaaggcaatttccaattctctttttgcctttgcctatattcttttgagggcccctgatggctcagacgttaaagaactgggttcaatccctgggtcaggaagatcccctagagaagggaatggctacccacttcagtattcttgccaggaaaactccat

SEQ ID NO: 58421 - DNA, 998 bp, Bovine  19866881722630
tatgtgtatattaaatgtttgtatataaacatttacatttattttgcttgtatggatacatgaatatgtaagatatgaaggggatataattgtaaatgaaattgtttcctttttaaattactatcactggccgatttttatatattaatcttcttttcagcagtttcaccatctgatatttttaaattgttgtagatgtgaatgtctactgatgcttaatatgagagaattggttagcaaaagtagtcacagggactctgtgatttgacctcctttgggcatgtccttgtgtaattgttgtgtattgttggcatacaataatgaattcacaagaacttgtggatagatgtagaaaatacaagtggcgttataattcagctacgctttgacactattattacctgtgacgggatgcagaggagtctactgaaggctgctatagtagggaacaagggcgaggcgtgttggcagcctccggctcacgctttaatccagctttcatatagtttttaaatatggcagatgaagcacagtcaagggcctgtatttttattaaagcaaaagtatgttacagagatgactttaataaaccctatcgatctcactttaaaaattcctaacctgcttttaaaaaagtccaaaatgaattatttcacacttgacttttcctaaggggcgctttgcttctttgaataaataggcacaggtggtatttaagtaatgagaccattgtgggtttcccaaaagaaggaaacaatcaaaatgagtgccagtaggtggagatgtgggggtggagctttggaaaatgtggcctgtgtttttgaaacttaacttagaccacttattatttgtaagtcaagtgtgtgaatctggtccgataatatattttaggatagaagtttatgcatcagagcactctcttcaaactagtaaccatccaagagtttaatagaaattagaaatcctgagggaattaaagaagctaccatcaagtgtac

SEQ ID NO: 58422 - DNA, 1154 bp, Bovine  19866881824727
tcagatctatttacaagtcagtggaaaaccagggaagacaggctagaatgcttgcttcttgtgctgtttattattttatcatattcattgaaaggatatcctgtgtaatggtagaagttagatataaaaaatataggcaatgtggagctgtacacagaactcaggattctgtgtagaatgaactttgtatcgttgtgtcgttgttttcgatagaatctttttaagagtgggagtggattagaaggagaaataagtgtggttcaactggaattcttctagtatgaatagcattatgcaccttaatgttcttctacacctcttttttgggggggatttaatgtctttcctgtttgattttaagctgttaaaagacagattctcttcatcttttcccagaaccctcacagtgagtatgatgcctctcagcttggaggtgcctgggaacctcacccttgtggatgttcttgctctaacctccgcgtactcttccatattagttgttaggggccctcattcaagatagaagaaaccaaccacacttcattaatttgcgagataaggcccttcagcagcaaagactgataaagtggagtcagcctctgtgcttttaactgcttgccaagtccaagcaggatgctggccctgtgaagctttcccctgtggcctctcatgctcaggacaccatttgcagaaggaagtcctcaacagcacaagggattactgctaagttccaaagagcagcttctagggcctgaaggcagatgtttcctcctcaaggccttcatatcttaagtccagtccttttccttcctgacataatttagtctttttaaacctcttacctacttcctaatgtctgtcttcagtacctggctgttgcaattcacctttgtaaatgattcaccccttggctcagtccaccttcacatccctctccaggagaaggaaggtgtttgttctgttgagggacacttagccagctgaccctgggctcagtagaactgaggaactccatcataattttgacagtggttgggcccatggggatgggaaaatgtgagcatgcctcagagcttcttccatcgcaagaggattgtaaataaaattcctaaaaatcttgaacaactaccctttaagtgctctttgctgtttgt

SEQ ID NO: 58423 - DNA, 1289 bp, Bovine  19866880282394
actattctgacatgccagttaacccagaatgttaaaggaatccacatgggagctggggttccaaacatctctgattttttttggtgggggaggagaaggactcctttatgggttcattatcaactatagtataaaatccaaactcatcttgtcacttaagacctctcataatccagcccaactttctataaaattgtttttatcaaaattatatttgttcttattttaaaaggtcaaatattactattactatgaagtttctaacaaaagtcatttcctgttctatccgttcctacctgtgagaactacttagctgtttcttttagtattttccactgctgctgctgctgctaagtcgcttcagtcgtgtgcgaccccatagacggcagcccaccaggctcccccgtccctgggattctccaggcaagaacactggagtgggttgccatttccttctccaatgcatgaaagggaaaagtgaaagtaaagttgctcagtcgtgtccgactcttcgagaccccatggactgcagcctaccaggctcctccgtccatgggattttccaggcaagagtactggagtggggtgccattgccttctccattttccactacacttattaatgtactcttgtactagtgatttttgaattttcagctttaggcgttatccgttgctgttctctaggaaatctgcgtttagttttttcatccctgctctttcccttgtttctgttgccacatattattaccattgccaggtactcagtgtttagatggttatgatcatataaagttgcttaaagctgaggcacatagtattctacaattatgtttactttcttgaccaatttttaaatttttttccctggaattagcaactggcctgtgttatcatttgtttaccattccacgtgcctatctccatgctctcctctgggactctagggcaacactcagtatgctggaacatatcagataatcttttggttcattatttcctttggagacatcccacccctccccaggagttttctgttttccagctgtagctttttctaaagctaaaaccctgagtcttccctttaccatcagactggggaattcctttgcctctcttctgtattggctgccctgtttcctggatctcatgcactcatttttcttggtttattgcatctcttcattggaatatatcgtagagtagcttcctgagaaaggatccttgagagattaatgtctttgagaatttgcttatttgaaaatgtctttattctcctttccatttaa

SEQ ID NO: 58424 - DNA, 1462 bp, Bovine  19866880437788
ttacacacagttttccacagctgaataagcactagacacaatagtgtgaagaaaggtgccagaaaataataattttcaaaggtgctaaagaattcatatgattctgataaaaatctttttgtcagctgtctgaaggtggtcaaggaatcttactgttatcatctgaaaagccccagtataaaactaacttcaggactgttcttctcaagagctcagagtatctaactgctcctaacagccctcaaaagaatactgaaggagagtaggggaaatacaggctggggataaaattctcatttgaaagtcagaggcaatgagacacagttacagtaaagtctaactaagaagaaaagaccttgcacatgcatacacacgtaaacacacatattctctcacacgcatacataaaaccaaaaacacagcaagaaagacagtcacaacagctgtctccaggaccagaaccaaactggcctggaccaatcaaaattggtaaacgcaggctcctggaaccatgacagatggagtctggccagaaaacccaaagacagaggacatcccagggaccaactgagcccagccgctggttcagtctgaccttgacctgggcagcctgctccatctgttgaagacggtcccgcaaggcattcccctgagctgtagtctcttctacaaggtcctggaaggacctctgcacttcattcagaagcctcagcatctgccggttctgctgaggagacaagtcctgggcgtgctcggagatcaagaactgaatatcaaaggcaagtgcatccagttgggatttcctctcagccatgggctgtttcaagtcctaagggagatgaggaaaggaagaaaagaggaaagaaacttccaattctctacagaagcagaaactggtggttctaatcaaagaatcaacataatcaaacagaggttaatttcctgtatttttaaaagcaacactgattatttctagggccaacccacaatggaagtctctctcacttctggcctctccagagtcctcacatattatagctaggtttcctttaactataattaaaggaacaataaattaaatcaaccactgatttctaaatgcactacactttccattatttatattaacagaattatagcactgctaatcccaagtatctgtgaaaaaatgctatactttggaaagtatagcatgaatttttggtctgagatagatctaattgtactttattaggtgcaaataactatttgtgtttgtctagccctgagatactggtaaaccagaaatgagaaaatattcaatttcttagtggctcactaaagtttgacttttaaatagttatacatattatacatttaaaactgtacaaaaatgttgaacattttatacattttaaaactgtaaaggattacagtcagataaagcagtaaaaaactgcctaaacactagaatttatcgctt

SEQ ID NO: 58425 - DNA, 4214 bp, Bovine  19866880441998
tggggcttactcccgggtctcgagctgggcaatgagccggtgccaacggtcttgtagctgggaacctttttcctgacagcgctccaaatccaggtttcgctctggggtcagacggctcagctgctctgccactaccttggctttgccaatttcctcatccaggactgaaaacactgaattcttgtccttcacatcactaagccagtgctataaaaacacaagcagagcaacaggttaaatatattccatgataaaaaggactcagactaaggaacaaaacaagttattgtctacagctggctccatgttacatcggtgattcaaacccagactctacagtgtttgtgccagaaatgcctccatagtcctcaggcacactaggcaaccagtagagaaaagtgcaagaaacctgtttgaaacctgagtgtttgaaacctgattccaccacttataagctatgaaaccatgacaagccacttagccaatctgaaaattctctcctctagccacctcacagagttgcttgtgagcatcaaaggaagtaagagctaagtgatttacaaacttacagcataaccattgattgtatccaattacactatgactctactgaggagaaaagggaaaaaataaatagagaagcatggtcctttatctcccttttgcagttagatatatgtctcgatcctctcttctttggacctacgtaaaaagacattaaatataatatattgcctaatttgaatgcaaactttaatcagtggcatgccatccaaaactgcatttctctgctaaccccaagcaatgagtatgttaagtcaaactaggaactaggagaaaccaacccgtaatgtagaccgatgggactccagagctgaaagatctggtggtactgcttcttcttgactcagcttgatttcataacctttgaccaagagttcagcatcctggatgctacgcactataacatcgattgtcttcagcctgtgaggataaaatcacctccattagtacatgcattttaagagctgggcttcggacctggagcgctaccaggagagtcaccgaccgtagctgtcaaaatcaacgtcatcgctactaaatgacgacagggtttcacaaagataagcatagtgtatgtactgccaattcaagccaattaaaatatagtttggaggacactgggacacacacacacgtgtgtgtgcatatggtgggggtctcacaagaaaagaggactggggacagaaacccactcaaaaccatgaagactccaagatctcctcaaggtcacaggtggggatgtgtgggtagaggaaaaaccctcaaagcctaatacacggtttagataaaaatttcaatttctctttctttagtgtccctttttctgttttaaaaagaagtatctaatcaaacagaaatgagattcaaaatagtcataaaactgcaaatcaacttctcttttccccttctgtgttcccagcatttgttcattgcagcccaaatgaacccactccatgttatttggaattaaagccaagatctctttttatgagcacaagctcttcaaaacctgtaatccccctgcattgttcatgaaacatgccaggtacttttattttccccatccaaatggaaaacattgccctcttgacccaaattctcactcactcacttgtttaaatagacagtggagagaccatacacatggtccattttctccaccagcagattgagttctgagcgcagagttgggacactggaaccagatggggactgatggagaaagctgttgcatttcatggaaacagcatccaagtctgccctcaattgctgcagatccgcttgagtgtgctatcaggaacaagacacacaacaaacacagagacagaattgaaccaagaggttagcaagaagtcctagtttagaacagcaaaatatcagaaacagaccaaatgtcatatataggagaatgatgaaataaaccaggcaacagccaatgaaggcagagcaaggcaaagaatacaaacaaataaattctgaacactgacttgactacagacataccttcagtataaagacaaaaagaattacattaaactctagatagtaggtcttccacatttgctggcatactgagtgcagcactttcacagcatcatcttttaggatgtgaaatagctcaactggaattccatcacctccactacctttgttcatactgatgcttcctaaggcccacttgacttcacattccaggatgtctggctctaggtgagtgatcacaccatcgtgattatctgggtcatgaagatatttttggaatagttcttctgtgtattctcgccacctcttcttaatatcttcagcttctgttaggtctataccatttctgtcctttattgtgctcatctttgcatgaaatgttcccttggtatcttaattttcttgaagagatctctagtccttcccagtctattgttttcctctatttctttgcattgattactaaggaaggctttcttatctctccttgctgttctttggaactctgccttcaaatgggtatatatctttgcctttagcttctcttcttttctcagctacttgtaaggcctcctcagacaatcattttgcctttttgcatttctttttcttggcgatagtcttgattactgcctcctgcacaatgtcacagatctccatctatagttcttctatggatggaggctcgtactatctccattttctgagaaaggaaactaaggatgagaagtaatttgcacaggggcttccctggcagtccaggggttatgcctttgccttccaatgcaggggggtgtgggttggatcccttgttggggagctaagatcccacatgcctcatggtcagaaaaccaaacataaaacagaagcaatactgtaacgaattcaacaaagacttagaaaaaaaggtccgggaaaagtgtacatcagagcccatagcagaatctgagcctctccgtactatctgtggagtcacatgactgacaggaaccatgtcacagaatataacatacgtgtaagggacagagcggaaagcagcagctctgctgagcagtcttagagcacccaccttgctataaaggcttacctcttgttctgcaatccttaatgcgttgtcttgctgagcatctttgtcagtccgagagctggctggggactgaattcgctggattagcctctgttcacactcctccaggcgcagccggatgttcttcagctctgaaatgtacatcttggccacagtttcctctttgtcctctgtgaatgcacaagcacagaagaccgttaagcaccacaacagagatcggcaaacctgagaaaaacagatttaccctgcgatagggtaccactggttctagcagaagctgatactccatgaatgaaagcaaagccttatatggggaaccttctgcctgttcccaaactccctgcattatatactgagctttaaggtccaaatacataatttccacaagaaaacgggataggtttattagcaatgatgaataaaacacagccttgttttccatcatctgattttgagaattcatctctgtgagttattcgctatctcaagttttcctagcaatgcaagtggtaaaaaggtgttgacgatactttctagtttgtctgaagggtcgagcagcacctttcagggctctcattccacctttcctctccctcttcccaaggcacacaccattctccatggacttcagcaggtgctggaaatgggttttacacgcctccacctcctcttccaagcgaagacggtcagccactgagaagacggccgagtcacgactctcctgcagaaagtcttcgtagtgggcctgcagattcttcataacctggtggtactccccaggtgctgaggagcggagctgcagagaaaataaacagtggacatttcaatggaatggaaatgtaacacaaaatagtgcacaaatcatatttataaacacgttgatttttcacaaattgaatgtgtccatgaaatcaccattcggatcaagaagcaggacattactagcatctcagaagcactctgtgccctctcggatgcaaaccttaatgatggccaattcaccagcattcccctattccgcacatttatccaaaaggttttagtttctaagatcctcaagctcctaaccctgcaacagtat

SEQ ID NO: 58426 - DNA, 1213 bp, Bovine  19866880579441
atttttggtcttccctagtggctcagctggtaaagaatgtgtctacaatgcgggggatctgggttcaatccctgggttgggaagatccctggagaagggaaaggctacccactccagtattctggactggagaattccagggactgtatagtccactgggtctcaaagagtcggataccactgagcaactttcactttcgtaatcttttcaaaatcatatcatttaaaagattcactgtaaatacaaaacacaagttggaagtaaatggatggaaaaaatatatcatgcaaataaaagagtaagaaggctagaggggctgtattaatatcaggtagaccattagacttcaatatgcaaaatgttaatcagagataatgataaacgtgtcatttcatgtgaatccatcctactgaaacagaagggctttgtgcagctgaaaatgacagactcatgctattctaaatattgatgcttatggttccaaagtggttaaaaggtcctcacatttatcttgggagtcaatggaaaagggcatctgtccatttgaaattaaatccattttgtgactcatgataccagtggatggttgcaccagggatgggggtggaggtgggaggaacctctcaaaatgaagttcacatgttgccgaatctgaatcaaaccaactttggtcaattctttgtgactgatgcagaatcctggcaggagttttgcttaaacacacagagcaaggagacccctctccaaagagcagagactctttgaaactttctttctccactagaagggcagcacaagcagcaggcacacatgggtggaggacccaatggcttcgccctccacgcagcccagatctcatccctgaccttgggcatccacgaggttcgtgatgcgattgagatccccatgcaccggctggtcctcagccagctttggctttgtcttgtactaccagtggagcaagacctgcacagtgtccatgaactggcctgaaatcagcagggcctcccccaacttgtgctccctgagacaagcacacatatctcaccgcttggcaaggggatatctcttttatggggcttccctggtgacacagtggtaaagaatccacctgtcaatcaggacacaggagttcaatctccaggtcgggaagatcccctggagtaggaaatgccagcctgctccagtattcatgccgggaaaatcccgtgg

SEQ ID NO: 58427 - DNA, 1098 bp, Bovine  19866880695245
tttcttagtagagttggtgtttggggttgatcttagcttcaattttatagctaaagaacaattagatgcctgtaggaaggctttcctaattaaagtggtttgggggccagataagtagtataaaaagacaaagcctttaccagttcttctagcattacttttgtgttcagatacgtggtgtttcaggctgccgcacctcttaacttcagttgaatagcacttttaaggaaaagggaaggaaattctcactcattggaccctgtactatatccttagcactaaattgggtgtaatacatttattactgggacttcaaggtgggcattttccttttctttctgaggataagtaaatagaggcttagagaagttaaataacttgctcaaaatccccttgctaataggcagtagagtactggatgcaggcctgactccgaagtccgcactcagctgtacacccaccacacttgtttccttgagcccatacctttagctggacaccattagtactgggccttgggtcaggaatggtgtggtcatgagctaaaagattaatttaaaggaggttaagcataaatgaaaccctgtttttatcttttgggcacttttaaaatatgcttttgaatcaactcctgttcacctttgccattgaatttctgctctcagttagttacagatgagtacagccgaggcctcccctccgccccagtgcctatggacagaaacgccttggtccatgttggacggatcgctctctcagttctcattctctgccagcgttttccgtgcacttcttctacttaccttgctttctctgcacgtccttctagacagaagtctttttgtcagccgaaactgaagttcactactacagatttctaacacagcctcttttttcaccagacctaacaattagtctgtaacaaaagatggggttttggggggtaatgatttggaacttcttcctgtggtaaagctgcgataaccgcccccccatctctgagtcactcctggttgatggcacagtgcgtcatatgctcgttcctcattcgtgtgtgtgcccacacagcgttggtgctggagtgaaaggcacagctgc

SEQ ID NO: 58428 - DNA, 1034 bp, Bovine  19866880699080
tggcttctcaggcaggcagcactgaggagacttggggtctgttgagctcactagctccgaagaaaagcctgacagatgctatgcaacaggtggtggacgttgtcagggggctccagcctgcatgaaatctcacactgcggatgagtccttagtactgagaaaggatgctcccactggtgtctctggggtgacgctaggacagctgggcctggatgctctccccaggctcctttttccaagagacatacgagctgtcttaagtgaagacgagctcgcagatttgatcaacagggaccattacctcactgtcagacactttacagtagctgaggagtcagaaacctttaacatgtattcccatgttaggtgacacccctcctcccactctccatgctgcgatcttgagaacttgtaaagcgcttggcctcttagattctttgtctcaaggccctccgggccctttcccctgagggcagagaccatcccatcctcaccaggaacttttttggtttccttccacttttgttatgcaatgggctctaaggctatttcccacaggtctgaaatacttccccaggacacagggcaagggtcccagcctgtggctggggggaaggtttggagtcctggatgcgaacgtgttccctgcccaggtgttttccatcttggaaatcctctcaaagcagatgtcaggcacctgaaggggaagagctgtaccacttcctctttcccacctccctctcatctcaacccctgactgataagtttgaagttctactcagttcggttcagtcgctcagtcgtgtccgactctttgtgaccccatggactgcagcacgccaggcctccctgtccatcaccaacttctggagtttactcaaactcatgtccattgagtcggtgatgctagaaccatacaaacctgtgcttctcttgcaactccaaggagcttcctgtccctctagccacccttgggccctctgccagcctgacatgagtcagaatcccattcccagaatctgggccttattgca

SEQ ID NO: 58429 - DNA, 1402 bp, Bovine  19866880700199
ctgagtttccacattttacaaatgggctgaatgctctgtgagagcctttcactggagacattgtgagtctgcctctggttgatggaaaatgaatggggtcacctgcaaaggctcctcagggtatttctctaaaaggaactgaggctgaccgctgacagtggtcatgactggtggccagaccacctggaacgctgcctctccctcaagagaccaccccagaattctggctagggatcccttgatgcccatggaaccgatcttgggactcaatgtattttctctgagtccctgaaaatctgctttattttcaggctctcagtcaagaagctctcacaccctctcccggtgtcagggccagatcacagcctggaaaagagctcgctctggctgggctcttgggagctgtacggctaaggggactggagggctattcagacagacaggaagtaggaattaggagggaaaacaatgctgaatttggagccagaagacatggattcccacgtgggctttgcttctcagcagctgcataggctgggcaagctgctgtagctccccatgctcagcatcctcatccgtgagatggggctctccctcaaaggagtgaagtattaatacctgtggtgatgcccaggtgaaatggggctctccctcaaaggagtgaagtattaatacctggggtgatgcccgggtgaaatggggctctccctcaaaggagtgaagtattaatacctggggtgatgcctgggtgaaatggggctctgcctcaaaggagtgaagtattaatacctgtggtgatgcccaggtgaaatggggctctccctcaaaggagtgaagtattaatacctgtggtgatgcctgggtgaaatggggctgtccctcagagaagtattaatacctgtagtgatgcctggaaagctgtgatatgaggcatgcctgtgggatacaagagtggagggagagggatgacactgcagagaatcaggagggtggggaaagggatggctgagctcccctgaaagggggggtgtcagcctccagcagatggtccctgaggagggatcaggctgagaggcagtgatgcgcacagtgctaacccaatacccctggagacaccttacctaccctggagggacaaaggccctgtttcttagtagaccttggctcttgtggcttgtccggagtgaagctttgtaaacaagccgccctacagatctcaggatctggccccttgagccctgggcctagcttgctgagccatccctcccaggagttttcacccgccttacattcttgtccagatgtttggatggaaatagccttttccagatgtagctggacaaagccagggccatagcagtaggtttggcaaatgttgatctggtctcccttgcaaccttct

SEQ ID NO: 58430 - DNA, 996 bp, Bovine  19866880729745
catctcctgcctggtacaacttactcaacctcttttttcaggcttatctcctatccttctcctccaggaaactctcacctcatccaggcacagattcccatctcccctactgtttattcatacttgccctgcaatggattcatctcagcccaggggaagattattctgaattcaaggggctcactgaacatgggcttgatgagagtccagcatggatgaggcactgagcactaggcaatgaacaagatcagtgaggaggaaaagctggaaccagtagtcagcgcatcttctgataatatcccccagtggtgatgttggtatccacaatacattgcgaaaggtccatgagagcagtgagagggcctgacttgtctactgctgcactcctagttgtgcctggtacaaagtagtgtggagcttagcacagaacccagtaatttttttcagtgtataaataaatgaaaaaaataaaagtcacagattttaaaaaattcttaaacagtcttgcactggagtcacaagtgcctgtgctcagactccttaaaagattagaagttcctgaagggcaggcatggtgtacactctttacaaagaatcactttaccaaatggttttacatgggttactggttctgtttctcattacaaccacataaattactatcctcagtttatacttggggaagatttgttccttattttcttcattctcctttctatttcctcctttctctccccttcctttaggatgtatgtatggtttaagcatttcctgtctctaatctagagagacttcagttcagttcagttcagttgctcagttgtgtctgactctttgcgaccccatgaatcacagcacgccaggcctccctgtccatcaccatctcccggagttcactcagactcacattcatcgagtcagtgatgccatccatctcatcctctgttgtccccttctcctcctgccccggatccctcccagcatcagagtcttttc

SEQ ID NO: 58431 - DNA, 827 bp, Bovine  19866880735069
tgtactttatttaaccttgaaagtctccagaggaagtggaatttggttatgttgacctagttataacacagaccagacatggacttctctatgtcagggtaaaagaaacaaaacttacttatctaaatatagtatttgcattggtttttatagagcttgctctttaatgaatggatattttagtgattgacttgaaaatttgcactgtttagaatagcttttccatagtctatggagtttgacttgatcaatttcgtgatcaaaagagaattcttgattctttttttctatacttgcccccatcttccctttctctgaaattttatctagtggttcaggccaaaatcctaggaagctactgtgactcctcttttccatcccatcctatagccctcatcccacacccaattcactagctgtcctgctgactctcctttttaaagactctaacctcttctctgaagtccacctaccaagtctaaagccctatcatttcttgcttagcctactacagagcccccagctcacctgcctgcttccatttatgtcccactagcaagagtcagaggggaaccttttcaaaatataaatcagatcagatatccagtcatgggcaaatttgaaaggcaactggaaaacatatcctcctatggctacattgcaggaagccagggacagttgcaaaaaaaaaaaaagtgtgatgttctatctctagcaaataatggaaaaagagggaggcaaagctgcatgagcactttatgggaagttataaattgcagagattggcctgatcatcttggctctcctccatccttcattggtattca

SEQ ID NO: 58432 - DNA, 1946 bp, Bovine  19866880767954
gactctcagacatgcttgtattagagtctagccaaagagaaaagactgttccttctaacaccctcataattagaggacaggcaagaatcactgagctgggatatgatccagagaaattcatttcggccccaccaaacacgagcattctgacctacacaagcagaagacaatagagggagaagaggaaagaaaacataaacggctctacttaccagagttgcagggtgtgccttgggcagataagagatagagccttacggagcagctcagccgtatcgcacacacagtgtaagcttggtgttagcgtccagcatgcgactgtttgttttttgcaaaaaagaaccccaaacaggtcgtcctcttttccctttgtgcatttgtgcttaaactccaaagggttagttaaacttctaagcaaggatgtcagttaatcagaacaatacttcacatgaaacacacgaacggtaacaggggacacatcatgctcaatgtagtggtgctcagcagcttgactctctttctttctttctccccttttttaacctttcaaaatgagaactggatgttctcagcaagcaattttgttaaaactcttcatgtactcccgtatatggtgaagcaataagccattacaaggtgggttacctcacaaacagagtgctgaaccagcacgtttgttttggaaatctgctctcaaataaatcacagccggttctacactgtggcctgtataactccagctcctgctatacaaatttaaggatcaaagtcaaagcatattttgtctaaatatcattttgagcattatctagaccaaatctgattgccacaggagcttaaattgcctcacagaatttggccattgcttcacaacataggaaataagcaggcaaacacacatatatgtcccagagacacatgtatataatatggtaagtttacatatacacacaagtatccaggaagaactcaggacaaccagcaggaatgtaacaacttccatgtggtccaggcaatgaacatggtggtaactggtaaagatgtcacatgatggggtgactatggataaggggaaccagcgtctcagtcagtgcagctaatccaccagtttgttttggaaattgacatttctcatttatttagtagacaggaaaaaaaagtatggggggagcgtggggaaaaggtccacagactttacttcccaatattcagaactccctgctgtcttttggtgacaatgccacagagtaaccattttgccttctgatcagatatgacacaaaattcaggttctccttgactgtggtctgccacaaaatgcaagatgacacaatggtgaagcaggtctaaaggattagccatatgcaccttctagtgatgctgactgaccaacacatcgtggaaccccaataaagaaacacgagacaaatggctgctatggtgaggttaaaaattaagtcacaccggtcatggaaagctagtgatcatgactctcaatcagcaaagctgcagtcatactgttcccaaggtacctttccaaaacctggagagaaaaactcaaagtaccttttgttctgtctgttgggccagctggctctggagttgctgaagctggtttgctgaaccttcacaaagatcatggtaagtcttactgagggcattcaattgctcagatatctgttctttctctttttctgacagcctagaagatgaagcattaaagctcttttagagaaagacctttcccccaattcccctctattgtttcaaaacgacatctccaccttggagagtattcttctttgtcactgtttgtgatgggccatctggtcagtctcccatactcaccgaacactttggcatctagctcatagtttttctgtcttctcagatgactcttgctgatgttaatgctcatgtcaccaattatctaacactctatacct

SEQ ID NO: 58433 - DNA, 898 bp, Bovine  19866880773869
tgaaaaatatttattacgtggttgggcaaggggcatccttgggcttttcatataaaaatgtgtgtgtgtatgtgtattaaggtggggagggaggcagtgaggctgctggggtggggtgtatctgagtttcattggataagacgaaacgtcaaagtcagcttttaccttggtacagaacggatgtagagtaattgcggcagaaccagtggctgaatggatcactcttttgatattcctgaagttgtggaggcatcatgatgatttaggatacatgcttagaattaagagtgaggttttcagaaagtttggaatatgaaatgtgaaggagctcacatttagtggaagtcaattcaagataatgtcccatatgtgactgtggtacttttggagcaggaaggctccggacaactctgtgaggagcctccaagaagagattggtagaagaaacctctggaccatggtctatagtttgaccaaatcaacagcagtgtgattcttgggctgttcagtatgagaatcgtactggtgtgtggtgctttctgggcagtcaagctctacatcctgtcccagcttccctgagagcagacacgaccagactacacagttagggcctaggaagaaaaactaggtgacttcgagtcagcttagaagtctgacatgtctttgaggttctgtgtccatctggtgatgcagggaccacagactgtatgagcatcctgtatgacagataagaagtaacttctcaagataagtgtcccttatcccttaaggatgaaggtccttaagttcacaggggcctgaaaccctccttggtctctgaaggtcttatcttcagggagctgcaccctgccggtaggctgctcacaaggcctggggacagcgacagccagagaggcag

SEQ ID NO: 58434 - DNA, 895 bp, Bovine  19866880788516
tcactgctcatctgtttataacgtccctaacaggaaagggaatgcacaattatggtagcctggcttgggtccttactctctcttgattaatatctgccaggaagatgctgtggttgcggtatatgtcctccctgatggggtcgtgccagtattctgcttgcaccaggctgcgggagaaaaaaaaataaaggtgaccaagcggcacactagtcagtatgcctggggctggccctgggcacaggccaccaagagaccgaaggggcagaagaccagagccttctgttcctgctgcctgatccctttttccttagcatttcctatgctccttccttcttgtccttgagacctagcttaaatatcttttcttcaaagaccattctggccaaactaggcacctcctccactgctgtccattactgcatcttgtttctgccacagccttagctggtactaaggggggtctagttccctgatcagggatcgaacccaggctcccttgcattgggaactcagagtcttaaccactggaccatcagggaagtccctgggttatcttattttgaacttccaggatctctctcttactctttaatgattggttttatttgaattcttttctagagtcatggatgatctctttctctctgaagataataatataggctttttttttgtttaaggtttccttcagcttcttgaattgccatctgtttcttccaagtccctttttactttttgttgttttgatctatcttctattttggaagctttcctcagatgtctgatggaggggtgggtggcggtccttggctcactgttcatatttaaacaagagcttccctgatagctcagttggtaaagaatccgcctgcaatgcaggagacccggttcaatt

SEQ ID NO: 58435 - DNA, 1238 bp, Bovine  19866880832406
ctctcactctcatccctgatggccaaagttgtgaaaggtccacatttcaaatcacaggaccagtggtaggaaaacagcttgtaaaggttcaggggagaagtgtatcatgttactctttcacagacaataccagacactggtatctgaacagcaccccagtagtggcagtggcaaagtgtgaaggaaggtggggagggaacacattctccccacagcgaggcttttctacccgggacagctgagacttgggacgagtccctctggcaggagacagcctttgtgcagtgatgttttagtgcagtgacctgacctgacctgactccctgtgggactgattttattcctggtaaaccaaccacctctaacaacaaagtgcctttcaaagcaactcatctcacttcctagaggctcacctcttatggcttgtgtgccagagagctcattggaaagtacccaggactaggctaaggctgaggccacttaccaagcatttctagacacagcgagaaacagccccgttctgcaagcctgtgcttatctcaaccacatccactattcaaaactcagtgacaaacccaagttcagcacagggtaaattctagtttttctggatacccgtgtttcccacgatgatcaatcttagttgcaaatgctacatgctgacatgatgtgtgaagaatttcagtaaacgcaattgaaactgctcagtccttccttctggttgaggatatattcatttgttgcttcccttgctatcaaaatttccagccggatttttgtgaaattcatcaacactctcttgatgcccttccatctgattttactaccttcactgagacgtgaggctcctcaaggtgatgtaatggctacaagcttggggttttgcctgtggtgctgatactgaaaatattaacggcaatactttaaaatggggctggaaaaagttcaacatgcagctaacttaaaggtcttaaagactccttcaccttctccccacccagctgcaacggtgggggtgggagaggattattacacagcattggaattctggggggggcgggggaggtgcagagggagatgctcacataagggttataaataccagcagccaaactgtgagctcctgggctgagaacaactgacagcctgtaggctccccttaaaggcacagagcaaggaagctccctggagtatttccacaaaggaagttcctcttcttcagaggaacgctccatcag

SEQ ID NO: 58436 - DNA, 1057 bp, Bovine  19866880880161
gacacctattgtaggacaccctaggagaaggcaatggcaccccactccagtactcttgcctggaaaatcccatggacggaggagcctggaaggctgcaatccttggggtcgctgagggtcggacacgactgagcgatttcactttcacttttcactttcatgcattggagaaggaaatggcaacccactccagtgttcttgcctagagaatcccagggataggggagcctggtgggctgctgtctatggggtcgcacagagtcagacacgactgaagcgacttagcagcagcagcagcagtaggacacccagggtaatatcacagagaattgcttgttgtggagataaacctcatacatctggtgtcagaaatgttgcgagtgtggtagtggtgtgagagtcagggagaaacacaggaagaaagctgggtttttccttctcaagctgacatagagtaatatggagaaagtcagatgtattttgaaagtaattatccttctttttctttttctcatcccttagacttatgcacgatgtgaagtgtgatggttaaatttgtcgttttgttaagttgcaaaatcataatggaaccaggggagaaatggatgccataactggacatgggttctctcctttcagaaggagttgagtatattttttgtttgtatgtgagacaattgcattatgttaggcagaggcatttaaaaaattgtatatggcatgaaaaaagtgggagggcgttgcttggcaacccatggttggaatgcagaggacatctgttgttttcctctatcagcattctatctccttcttttggagtatgcttccacccccactgtatgctggcttggtggggctgtcagtcattgttctctgctcttccctagttggagagaggggggatggggtccagtcccgactaggccacctagaagttccttctctggaagaatatctcgctgggagacaagaggacagaaaactcttaaagttgattcattttgacacactgtcctgaagagactatctgtttctgtcacttaccaatccagaactg

SEQ ID NO: 58437 - DNA, 1862 bp, Bovine  19866880933929
aagtccccacagattctccctaaggagtttcagaactggggagcagggaggctggggaacataccaatatatatatatatatatatatatatatatatatatatatatatatacttaccatggtagtaagaaggcagctgcaacgctgatgccagctgccacagccaccacgtatgtgacaatcagattactctccatgagggccaccaagatgagaaatggcactgctgactaggagagtgggtgtaggaagatgagtcagctggggggctcccagcagtaacccccaggccagcccaggccctaccctttcagccccactcaccgagattccaatgtacacagctgtctttttgccaaaccgggttaggaaccactgccagatggggatggtgactgtggctgagaactttggaggggcaaaggggtgaagaagtgggttagagccctggaatccctcttgcccttcccaggactccaaaggtgctgttaaccctgaccaggagcagccagctgccatcacctggattgctccacggcagctgatggctcttcaaggagctaggacaaagtcctgatcttatctgctgccctctgaatacagaactctgagttctggcctccacatctttgctttcgctatgctttctacttgaacatctaaccccaatgctttcttttttccccagtgttactaagatataattgacaagaacattgtactagttactagttcaaggtgtacaatataaagatatttttaaaatatttatttggctgtgccaggtcttagttgcagcacgcaggatctttttttttttttcctccccatagttgcagcatgcaaactcttagttacaggatcttctgtggcggcatgtgggagctagttccctggccaaggactgaacccagaccccctgcgttgggaatgtggagtcttagccactggaccaccagggagtcccaataaagatttgatatatgtacccaaactctttctttcatagtcctacctaagccactgtaggtcagatccaaatgttctgagaagcctccctcatccctcacgatcttggccagtctgggaaatatcctctggctatccaaagaaccatctcactgcctaagccccttcagccacccttggggccccacacgcaccatgattgccaggagcagattctggaattcgttccgaaagcccaaggtgtaggtacaaaacaaggcaaagttcccctccaccagctgggggccaggacggtgtagcaggaagaaagacaaagaaacaggtgctgatggagctgagcctcaaagactctttgcatgctcgggggacctctgctcaccccacccccattccacctgtccctcaggccctgtcacattctaaggcctatcccatcccctattgcactcccccatcaggctgagcatatcagagccccactcaccatgaaagccaaggaggtgaagaggaagccggcaataagcttgatgtatggcccatggctcatgaccagccggaggccccgaaagaagggcatctgcttggtctgctgagtctcgtaggattctgggggccagaggggacagtgagcaggagcagaggcccctcccagagtctgaggcccaggcagagggacaaaaactgccccacgatggggcctgtacccctccctgggacccctcacctctctgttcccgcacgcccaggatcaagatgacagcacagatgacatagatggaggcaatgactcctgccgccagcaggtatgcattttgctataaagcaggtaaagatcacatagagacacagtcagtctgatttcatcccagctcccagcagctctactcaatga

SEQ ID NO: 58438 - DNA, 1683 bp, Bovine  19866880937133
tcctctccattcagctgatagatggagaagacaaagggtcatgcttggaggtctgtgtgaggaagtgaggcacatcacttccactcacattctgtctgttagttctcagttgcatgcttacaccccaacagccccacggggggttcccaccaagaccagcatcaagcccccaatgtgtgtgtgagggtgtctccagatgacttcagccctcagctgttgaattttcccaattgaggacccagacaccaaggaactgaaacccactgcttcccactctgccctgaacaaaatcctgcaactgtatacattttaatccttaataaattccttttcctatactagtctcatatttctatttatatgacccaaattctaaccagctatggacttgaactgaacataattgtcactcccagtggtaagagcgctgcacccgtgggttctgtatcttttaagaaaacaaaatcctactgacttactacttatacaagtgttagaacacacccacaataaaaccaaagtaaagggtaaattatttaggcgcactaacaagtgagtaattggaggataaagataacctgatgattcctctgaagcacagagcagagttctccctaaagaatgagcaatgtggtgtgtgccgtgggcagggacgtgggcgaagcagcagaatgccatcaatttttctcagaagtggctattttaggaggcccatttatcaatgttcatgatgatataccatcaacagatgaacttatatttataaataattgattgtactatttattgcagttgctacttaccgtttcccaactaatatcttcatatttcaacatttcatccactgtcacaggctgcacagggcacgcccacccagcagccctgttagagcctgctattttggggggcagggggcggggtgaactggtcatctagttagatgtctccccacctgcaagtcctcctttcagaattcaaattgtagaaacattttgcttgatcttttcaaacaagaaaaacatttcccagatgcaggccattcccatgtccttaccccatgcacatctggtttattctggggccctttctttcccatccaatgctcttcacctgagggcacagactaccctgcttttatttctcctccctgggtctccagttttcctgaatgtaaaatgaataagatggacaggtcagcagtttacaaactttatcacagtagactgactacagttctctgtgctagtaggactttgctgttatctgtgctgtgtataatggcttgatctgctatcccaaactccagtccatccctcccccagccccttggcaagcacaagtctgttcgctatgtctgtgaatctgtttctgtttcataaatgagttcatttgtgtcctatttcagattccacatataagtgatatcacatggtatttgtcttttcctgtctgtcttatttcatttagtaaaataatgtctaggtccatccatgttgtggcaaatggcattatttccttcttctttatggctgaatagtattcattacacacacacacacatctgtatatatgccacatcttcacatcttctttatccagtcctcggccagtggaagtttaggttgtttccatgtcttggcctttgtaaacagtgctgctgcaaacataacaggggtgcatgta

SEQ ID NO: 58439 - DNA, 1535 bp, Bovine  19866880962782
caaagtgccaatttccatatgtgaaagtgtgctcccctaggctggcctaagggtaggggctgtatgtgggaaagatgcttctctgtggactaattagcatcaccatgtagttaacagtacgttaggtctgattcagcatttcatggctgtaacaattggtatgtcagggagatacctgacatcaaccttttttacagagggtggtattgcatagggtgggactttgcaaactattcagtataatgtgctggaaattctggtccattcttggatcacacttgttgagaagctagacttctggatgtgttaatatagatgtattagtcagggtagctcatacttctgacaaggaagcagtgtacctgagtacttgcctagacagtagatcctctttctctttatttgctgtggcctcatagcactaccgtggtgtgttgggattttctgtttatgatctctcactatatggcaagaccttctgattgatctaggttgtgttcctaacacttaagcaaagtgcctggcacatacagggtatcagtgtttgttgaattgtttaattaaatttacctctaaacctttgtttgatagccacaggagatgggcactgagaaagtgatcgaccgaaaagttgagcttgaaaaggaggatggccatgttctccacaaacgcctaagccaggttgacccggaaatggctgccaagctgcacccacatgataagcgcaaagtggccaggtaagaaagctggggccactgaccccaagccccttgagaggtagagggcagtcagttcttcagggtgcctgggtggcgagacaggtttggtaatagcatctagtggagattgatgtgttctagcacagcaggttactgctaagtcacttcagttgtatccgactctgtgtgaccccatagacggcagcccaccaggctcccccatccctgggattctccaggcaagaacactggagtgggttgccatttccttctccaatgcatgaaagtgaaaagtgaaagtgaagtcgctcagtcgtgtccaactcttagcaccccaggctcctctgttcacgggattttcgaggcaagagtgctggagtgggatgccattgccttctccactctagttagaagacaacattttttatagtaggattaaaaagcaagactcagttcagttcagttcagttcagttgctcagtcatgtctgactctttgtgaccccatggctgcagcacaccaggcctccctgtctatcaccaactcccggagtttactcaaactcatgtccactgagtcagtgatgccatccaaccatctcatcctctgtcgtccccttctcctcccaccttcaatctctcccagaatcagggtcttttccaatgagtcagttcttcatatcatgtggccagagtatcagagcttcagctacagcatcagcccttccaatgaatagtcaggactgatttcatttaggatgaactggatggatatcctgaagtccaagggactctcaagagtcttctccaacacaaa

SEQ ID NO: 58440 - DNA, 1929 bp, Bovine  19866881023831
cttcctctgagagctgactcaagaattctctcccattgtggtaatgttcttgtttttacatgccataccagtttgcagccttggcgtttgggggagcaccatttggaggtgtcaagtcgggaatgaggaaagtaaaaatattttcagaggttccttgagagaaagcttcctttcactggacataccagttctccctagatgctgtggcgcgagaactgaagcatcctaagcatatattcttcctttttgatgtcactgattcctctgaataacagttacatgtttgtctttctgtgtccaatgagactgtgcatcctgagaactgagacagcatctcatccatcttttagtcctcaaagtttagcacagcgcccagcttgaagtcagtgtttataaatgtatgttaggttgaataatggagagaagctttaaatgcactgcatgccagcagacatgcctggcatgttgagttgggaaacattagtagaaaatggagataggagagagcgagataaaggagtttttgtggacaggatacagggaattttcgttgcctaagaattacttgagaagcagttgttttgcagtcttccttcatgtgagaaagcatttaaaagttgaatgttagttccatctgactagctaatgaccttggataaggcttctaatcactgaccttctttgtggcagggactaaagatacatgcttgtccctctcaaatggaaaaggggggtgtcagggttagattgtgggtgggaaagaaggcattgagaccctgctaagcagcattgtggaaacataaagctgttataataatggtgctgttggcaaacaagaagtctcagcctcttctctggtttgtgtcccacactcagccacaacctcagattgggtggatgcagactttaaatatcggggtcacctgtacctaaaatgtcccttgtggtttctctgagtattgtgcgaacatttctttttggctctttcctacatgaggaaaaaggaggaagtttgtgggagttgtgcttttggttggcattagggcagtgatccctagcctttttggcaccaggtaccaattttgtggaagacaatttttccacataaccaggggtgggggggatggttttaggatgattcaagtacgttacatttgttgtgtgcgttatttctaatcttaggccgctgctgatctgacaggtctgagtcccagaggttggggacccctgcattagggcataaggggctttcattttccccttttatctggtaactatctgaactagtaaagagctgtaagaaaacagccctggcttggaagttctctcagtagtgactgaagcctgagaagaactcggctttcataactcctgcgttgaagaaggggacagtcatttccctgacatggctgggattctggtcagctgatttcctgtctctatagggatgtgattcctcccccttcctttgggaagaaatggatattttttcatttcctgttcgatcgcgtattttctgagtaccgggagacacttgctggctataaatcggttgggtcatggggaaggaagctgcttttgttttcagcagaacagcttccatttgagagatagacatgtacaggaaccccagcttccttgtgcccctgggagagacatgggacctagagggattgttttgaaacccttcctgggctgtgtctgctcgacctgtggtagtagcgccccttcgccccctgaaggcgagaaaagcttggtccctcacggggcctgcgtgctgtgaccccactctggccgtgtcctctggccagcccttttcggtgcctgaacgctgcccgggagcaactgttagtccctggtggaagtgacaccattcttggaatggaacctggcaggatgcccccctgagccctgatggagtgacacagg

SEQ ID NO: 58441 - DNA, 2048 bp, Bovine  19866881042265
cccttcgcttcttgaggacttttttcttagcgtttggggtaacctggaagtttaattttgtgacacgctaacttttgcgttttttttttttttttcccttgaccttggagaagtccttaaaagttcttacaaaataaaacattgcttgataggttacaaggaatgtaatttttgagttttgtgtgtaacacagctgttcctagttcggcagggtttatatgaccaggtaattggtgtgtttcaggttcctgaaggtcatcagaggaagaacagccttagaagtggaattagtgtgcctgccttgacttgaactcttaactttgaattcttcctttacctctgtgccttcttgctccaggggctttctggtttgtggtattttatagtatcagataaatctcccctctagggtgaagagcagcattttacagtggaaagggtgtaaacgttgaaatcctggttctggtacttataagctctgtgaccttggccagtcacttaaccgatacgtgtgattttcctaagtcctcatgtatcttgtactgtttctgtaaaggttaaaagaattaatatatagaaagcatgctgcttgatgcatagtgggtatgtaattgtagtttctttttattaataagagtcttgtaaaatgtgatttataatgtaaaatatgcataaaagttaccattttaaccattttatgcgtacagttcagtggtgttaagtacagtcacactgctgtgttaccattaccactgtccatctccagaacttctcaaacttatatttcatacccattaaacagtaattcacattctcccctccccagctcctggcagctaccattctgttttctgtctctgttaagtttgactgttctaggtacttcatgtaagtagactcctacaagatctatacttttgcgattggcttatttcacttagtataatgtctttaaagtttatccatattgtagtatgtgtcttaattttattcctttttaaggctgaatagtatttctttgtatgtaccacattttgtttattcattcttccattgatggacacttaggttgctaaaatatgattagtttcagtagcagtattgttcagttgattccttatctagagctctcaaagctgggaggaagaggatgaagtgagggacaagaccattgtgtgtcgacttcatctctctgggttttggttgcaggacctgttttgataggagtctagcaaatgatggcgcccattctgatgggagtccatatagagggtccaggcctggcagaactctagtggggaaaagtgttgcttcttagcccaggcaaggattagacccttctccagggatggactgcttaacagtagctgtagcttatcaaccttgcctttccttctgccctcttctgctgttactgtgaatgggactcttgctgttgtgatgtgtctagactcttagtttgttttacacaggtcagggcctgagggggaattgttgtacagccatacagtaaatagccagttgtgtgccagcctggcttgtaggatttgtaggctatatacacacacgtgtgtgtacatgtgtatatgtgttcatgtatatgcacatgcatacgtacgcacatatcctgtcattggcagttggcacagtatagaagctgtgtgctctcctccagcttcgccccggcccagcccaccaccatggtgtgtggattggtaacagggggatcccaggatgatggaagaggtctccacggggattaaagcactaagaaccttagcaggatggtcttgacagcttagataggctcttgcagtttcttccaaaattctgcagagagtactctgcagctctgacttcgttgtcccatcttcaggcctgagttagacctggaaaagcccacacgcttggcttctgcatcctccacttctgttggacatagaagtggaggttgagaaggagaagcagctactctaaactcctggatccctctgtgtggactctcctgtttgtctgaaggggctaaagggtggtttgtactgattccc

SEQ ID NO: 58442 - DNA, 2094 bp, Bovine  19866881043808
aatgtgaagctatcaaagttagagttgtacagtagcacaccatttctataatacttcccccccataccaggtccaatagataatagtaaaatccagtaaaaacaagtggggaatgatgagtttggagtctctacgatctttgtttttaatatttatttatatgtaaatgtatataaagtgaaagtcactcagtcatgtccgactctttgtgaccccacggactgtagcccgccaggcttctctgtccatgggattctccaggccagaatactggagtggatagccatccccttctccaggggatcttcccaacccagggatcaaacccaggtctcccgcattgcaggtgatccttttaccatttgagccaccagggaatccctggtaaatatataaatgtataaaatttatataattttattttttatggctgcagtgggtctttgttgctacaagttggggctactctctagttgtggggttggcttctcactgcagtgacctcttgctgcagagcacgggctctagggcattcaggctcagtagctgtggctctagggcattcaggctcagtagctgtggctctagggcgttcaggctcagtagctgtggctctagggcgttcaggctcagtagctgtggctctagggcgttcaggctcagtagctgtggtacaactactaagttgtggcttacttgccttgcagcatgtggaatcttcctggaccaaggattgaacccatatccctgcattggcagctggactcttaatcactggaccaccagggcagtcttaatttaatttttaatgaccacatgtaacaaccagcttccatgattcctaaaaagacaataaccagctctcactgagctagtgcaaacttttccagcacagcactgggcctaggtaactcaggcccctggtggcagctcctttggctgccttggggctcctacgcacaggagtcattgtctctctagtctgtgtttccctctagtggacagaagagtcattccaggtgattctctggctccacctgtgctcagagctcagcacccaggtgtggatgtcacttttcatggaaaaagtttcttaaagggagttcagatggtttcacaattatcttcatacacaaggcatgtagcattccacctctatgaagggcagtgcctgcagggcccctgggccacagccatgaccacaacctccagagcatctcaaagtcccatgtcaccccccatgtgaccgctcaggcttgctacatcagctcccccccactcccatcaggtctatttctaaaaaaggcaaacttatcagcacctgactgtattagggtttatgttttcatataattcatagtccgctagtgaaacaccaatgaggaccattcatatgcatagggcacatatgagaaaggcttccctgatagctcagttggtaaagaatctgcctgcaatgcaggagaccctggttcaattcctgtgtcagaagatccactggaaaagggataggctacccattccagtattcttgggcttccctagtggctcagctggtaaagaatctgggttgggttcgatccctgggttgggaagatcccctggagaaggtaaaggctacccactccagtattctggcctagagaatttcatggactgtatagtccatgggatcacaaagagttggacacaactgagtgactttcactttcacgtgagaaaatggagtcagttaggtgcagagctagggctccctctcctgcattatgcttagactcttcttccagaacccatcttcccaaagtgcggatatatctgtgtcactcctccacccacaaacctcctatgattctccactgctttcagcttcagttcaagctccttcaccagacattcaaggccttgattaagactccatgcatattgtttaccttgaatctccaaagaaaaaaaggaaaatggcatttaaaaaattttcttcttggtcaggtactgtgctaaacacttggctaacagtattatttaattctccagtagtgctactagataactgtaaccactttccaggtgagaacactggaaggcagtgcgggc

SEQ ID NO: 58443 - DNA, 1308 bp, Bovine  19866881070957
ttacaggagccagagggtgtttcaaggactcggtcatgatcatttaaaacgtcagtcagatcacatcacttcctgctcaaaaccatccataagcttcccatgacattcagaataaaatgccaactgcttaccgtggcctatacacagggtgacatgtgagactggggcacctctgagagtgaaagaaagcaaccctagaactctcaggaccgccaaggcgttcctgggtgtgaggccatcccaagccctgggttctgcccctttcctgttcacccatgcactagagccttcgtgcccttccgctgacatttcctgcctgtggttgctgcaggacttcgaattggttgttccattttcccagaatcctcttcccccaattgtctcggactcatcatctcactttattcaggtctttgttcatatgttacgtccttagagaagactttcctgaccacctgtctaaaatggccacacatcctcggatcactttgtgccccctgcctcacaccattttactttacaacatctattaagctcatggttgttggttagtcggttgtgtccgtctctttgcgatctcatggactgtagcttgccaggctctttgtccatgaaatttcccaggcaagaatactggagtgagttgccatttccttctccagaggattttcctgacccaggaatcaaatctgccatctcctacattggcaggtggattctttaccactgataggttgagatatttatttatcatctgtgtcgtccaccacaagataaactcattgagggtagacacttgtctctcctgttccctgctgattctccagcacctagtacaatgccaggcgttaggtagatgtgcaataaatatttgagagcagaataaactcatttgagatgcttgactacgatgggaatgtaagctaggataataactggaggcagacgtggaatctgggtttgtttatttttgcttttgttttattttaagatggaagtgaatagggcatggattgagcagcaggaaactatccctctgtggattctatgaaggcgcttccaccttaactgtgaagttcttgggggtagaagtcatttgtgtttttcattatcatgtcccttagtgcctagtaaagtgtctcatgcagagtaaacatttaaaattgttgtgagggacatccccggtggtctgatagctcagactccgcactcccaatgcaaggggcccgtgtttgatccctggtgctagtgataaagaacctgcctgccaatgcaggagacacaagagatgcgggtggatcccggatc

SEQ ID NO: 58444 - DNA, 1037 bp, Bovine  19866881190368
ttattttgcctgcaacttacatcacccttaaatatttttctgtttgtttttaatagttttagtgcacagtgtacagttctctgttagactataagttattgtgggtagaaataaatatcctgttcattttggccttgggcattccgcatgcaggcagcaggatgttgtaggaaaaaacactgaacttagagccagaagacttgatttgagtactggcttcccaactaactaactttgtgactataggcaagtcatttaacttcattgaatttgtttcctatctttaagaatatattaattatctttccattcataagtagttgttgagaggcttattaaactgagagaacatatgtgactgttccttgtaaattctaaattcttacacaaatacttagttgatgatatcatagtaaatattcagtaagtatttggatgagtaagtatttgctttcagttaacactgtttcctgggtagttcttttgcttaatgaggtctctaggcttctgcaaatatgctaaactatcttccatcttactttactgtaaaatgattctgttcctcagaattggcatcttctttatctccagggcatttctcccccgacccccccaccccaggttctgtgtcatattaaaacaacaaataacatttggtctgtttcagcaggtggtacattatggctgacatgcgaaatctggtagaaagattggagagagtggtgggccgcctggaggcagtctcccatgcctctgacacacactgtgggtatggagacagtgctgcaaaaggtaagcagtatacgtgccagtagagtgctttgagtgaaacttggtgtcctggcctgaaatttttctatcttggtatgatctcttctttggagctaacttgctgaaacattaaatttagaaagttcatcgcctgtaagataagggaggaagtgacttctttgcagggaggcctgtggttaagttattttaacacgagaacttcctgcttcctgttctttctttagcaaaatgactctagtataagt

SEQ ID NO: 58445 - DNA, 1026 bp, Bovine  19866881240117
cccccaccaccactctttctcttcgggacccagaaccttactgctagtctttgagtgatcctttgtaagcagtaaccatgtttaggatcagcctgacccttcagtaaaactgtttccctgatctttgaaagatctatttgaagcctcttagataccatctgttggcagtggtgttaactctagagagtgggactgggacttaggagtatggggcttgcatttttactttatacagtacataacatttggaaaagtttaaaacatatcagttctacatttaaaaaatacaaacccagaaaaatgacttgactttgaatttttatatgtggtagtgcttatagcttcatgcttcttaatattcatttgtccatggccctcagtaagaaatacatatttgtaaccaagatatgcatgtgtgctaagtctctttagtcgtgtccgactctttgccaccctagggactgtagcctgccaggcttctctgtccatggaattctccaggcaaggatactgcagtgggtcgcccatgccctcctctagggatctttccgacccagggatcgaaaccgtgcctcttacatctccttcgttggcaggcaggttctttaccactagcaccacctgggaagaccagttgagatagatgtttcacaaaatagtgtttatgctacttgtattgaaccttaaaaaaaaatttctaattgctgtattgcactcattgttctactatacttcactgaatgaagtgctcattatgtgtcacaaagttgatttaattacctgtgataggtcatggtccaacacctgaaaacagctttaaccttatggagtaaataccttaagaatttgaggcataagcttaggcttttgcttttactcctacctctggtttttgaaaataatttttttttggtgatgagaggtaggagagatttttcagtgcacttcgtaccacacatgtgcagttgcaaacttgacttctttgaaagccctaagtatcttcatttccaactctggatatacaac

SEQ ID NO: 58446 - DNA, 987 bp, Bovine  19866881464662
tacttaggaagaacccagcaaatgtcagtgaaaaaagaacagtctacagagagaggtgatttactttgctcaaagttgcacaactaagtagacaccagggccaggtcttgcctccagggaggcctggctccaaacatagtctcctgccaagctgtccctctgtgggggcctcaaccatgaaccaggggactgatatttgttgccatgatcatgaggccagtcctcaatggggctgttccatccttgcccagaaggtgactgagagagggcaggagtggagaggcagtgagaatgtgaatactcttgttggcagtccccctggtcaccccaaattaacaggtccccaaaacagggtctctggcttgagggcagcagctgaggtccagggtgggatcctgcttcctagactgcactttgtgctgggaaacaaactcgaatacctatgggggcccaagcagtcatataaatgatagttcacttttcatttgttaggtatttctgtgcaccatttcattttgtcctcccttctgtgtgtagcaagtactgttacatgcccatttcacagctcgggaaattgagacatggaaagattaagaatcttgtctgtagtcagagtgctggttaagtccatggtcaatcagctggcctccgaagacctcacgctccattgctactctccgctcccctctccaaggactctcccagctctgatggctcttacaccactgcccagcatccaccccatcctcagagctgttccacacctccgtgtacacctggcaagcgtctgcttaaatgaagttatcttggccacagagtttcttctttgggttaatcatgagttatgatgaaaacaatatattttataatgctctgtggttagtgaatttatttggtcctcagacctcacctcctcaaccccaggtgtgtgtgcgtgtgctcatttgtatccaactcttacaagcccaggatgtactccaccaggca

SEQ ID NO: 58447 - DNA, 1999 bp, Bovine  19866881482704
ggggattcttgataaacatgtgtaataggattctatggctcagcgggtaaagaacccacctgccaatgcaggtaatgtaagagatgtgagtttaatctctggatcaggaagattctctggagaaggacatggcaacctactccagtattcttgcctggagaatcccatgggcagaggagcctggcaggctacagtccatatggttgcaaagagttggacatgactgaagccgcatagcatccatagcacgaaacataatttttgtttgtttgttttatttatttggctgtgctggatcttagttacaacatgtgggatctagctccctgactagggattgaatccaggccccctgcaatgggaactgagtcttagccactggaccaccagggaagtcccacaataggatttttgctaagagcaggccaaggacttagatattaagggtagggaatcagtaacttcatgaggtattaatggtgatgagatactaagaatggggcaagtcttgctaaactaactcagcaggatgcttgctaaaactgggctaggcaagagcccaagggtgaagaagagtcaaaaagaggactcagagtagcctgtctaaagttttgtcaaggagtctttgtcagaattctgtacctagccaaactgccagctgaatgtgagggcaaaataagaaacaagtagaatgcaaaatgggtaacatcatatactctatgtgaaaaaaatactcatagatacacttccataaaacttctgcaaaatgaaaatcgaatctaacaaagatctatatgacatcggataaaaaagatagaagtataagactagacaaagtgaaaaaggcttgggaaacaaaaattaaagatccataagatcctgatacatggaaagcttccttttgagctacaaagttttgatgctatacggatatatttctatcactaaggatctaatcatgttacttggttctacaactattacttatagaattataatatgtgggcacttgaaatctctgttaattttattgaaaagtcagtgggtgtctagatcctggtcatcaataatcatgttttttaatggcaagcaactttaccaaattttaacaatctatgaaaagtgctttcatttatctgcaaaaacagagaattgaaatttatgagtgttcagatacttctccaagttctcattgttccctgcctaattagggaatgtatatgtatcttattaactttcagtattctttgaagctacatgggaattcagactttgcaagctctcacttcctattatactattaataagcatcagaagctacttattagaataacaatctggaattgacttaaattgaaagaactttgtctcatactaaatggttcctcttaaaaccaaatccaaaggaagtaagaactctgctggtacttctctacatggatactttgaactatttgattaaaaactgcttgggcagggaataaactctgaagagatcaatggaagagacagacaagaggttgagctttgtgggatggactgtatttgcctggaataaagatgatgagcccattcaagatgctataaatgatgttggaaaaggagcagagaagggattttcaggcaatatctctagtagatcagaccagttaattcaagattagagggagatacgtttggaaagatggtttgggtttttttgttttttgaaagcaaaaggatcaaccatatcctgaaaactagggaagaagtgttgaaattttttcaatttgctttaagaaaaattatgctgttgttcttataaaaaatacattttcatgataaagaatttaagcaatgcaaaacacatacacacaaaagaaaaatattttaaatccctcaaaactcatcatcaaaaataaccactattaacatttggctaacttcattctaaatatctttgcatgctttattacagatagaatgatagataaatagggaatggtaaatgatatatcta

SEQ ID NO: 58448 - DNA, 1076 bp, Bovine  19866881492154
gagggctggtgaggatgctggccccgtctgcagtgttctacaggtacctcactcccagggatgagggcagacatgcagaagggcagagaggtggggaaccagaaaggtccattgggtggcgctggtggctcagctactgcgcaggggcggcctgcttcgtaggtgaggtccgccgggatgtctgagccacgccgtaaggcacgtgggcggccaccgtgcccatctcctgagccccagccacgtggaacatctggtcgtcaaagaagatatgcgggcggatcttctccagaagggggcccttgggtgctcccgcaaggaacagggcctcatccgtctccaggccccagctgcgcagggtcttgagagcccgggcccccgagctggctgcactgcgtgctgtcaccaagtaggtgcgaatcggacactccagtcgcaggcccttggagtagaacttcttctgcagtctccccagtgcctccaggaagccctttaaggggccctacaagaaggtgaaggaacgctatgagcttacccatctcccaaacactttgccccctcaccagctgggctccctacagcactaagatcttgctgtttgtggttggagtgttttgcaggatccctattaatctctcagttctgctctgcctgctcaggctactgcatgcatcagttggattgtaggtacccacggcattctaggtgtccacactgctgtgtcagaaaaaacacacctgggcccctgttactatagcagcccaccaggtatatgggtgtctgtcctacagctctgtaagtgtggcttttgtgctcatcagcagggaggagattaaaaatatttagtaactatggcatgggcaccctttaaacagaatggattctggttgcagactactgggacagacagaccagtgtgtcactgcccagtatcgaccctgctcctggggcgcatgggtggctcagagtgtcgtgctccagtttcgtaggatcagggaaaggatcaggaaaggtgtgcttctaatcttggagacccctcacttgctgggtacctgggaaagcagaggtctcctggggct

SEQ ID NO: 58449 - DNA, 1522 bp, Bovine  19866881501418
gacaggaaactgtggcagaaagaaagagacttgagagccccagggcaagcgccacgtgtaggacagggaggcagggcaacgacacccacccaggggctgagaggccaggaaacaagcagagacaaggtttcctgggcataaaaggatgggagaaacagaagaaagcaggttgcaaccagaccagactctggggttcctaggaggaggggggcaacttcaggtcacctcaaatactcttccccaagaagctcagccatcagccaagaccaatactgatgccatgctgccttccaagccctgctcatgatacgtaaactagttcttcaaatggggccagcacttcaaagactgtcggaaggaattccagtcagagaatggttaaggttgagttctcttaacgtcttccttcctggactttaagatttgatctggatctctgggtagaacatcagtaactcttctttttagtaacagggagatttggggagttgtcgtgtatggagttgctgaaaataaaagtttaagaaactgcctacttgcaattccctcaggatcctggagccagctagcgtaggacaagagtcactgtccttctcatcttagggccttggatcctcccccagtgctaacttacaacagttaagggtgaaactagagcacaatcatcactttcaacagggaagcagaagtcggggtctgctaataaggtaagtgacatccaggacagagaaaagtgagttcacttcctttcactgcaaaaactgaatctacaccctgtcttcccacaaggacaggaaaacctaaacaagctactcactcattccctaaagatctgggctcccatccagcttattatcgcagcctgtacaaaaagagagagattcaggtcctctcagaggggctacaaatgaaacagaacattgccaccagaaggaaccgctggctcagagcgctgactcactctaagagccccaatttctttccaagcctgcccctatcaccccaaagacaaagggtacaaagactataaaaggcaatttcttatattaaagtacatgggtggaagaaacgagaattcagggttggctggctctctggataagcatctggaatccggccccctacatcagcctggtcagccattccatttggactgaggtgggcccctgctatgtgagaccaaaagaaaagttaattcccaatggtgtttgtttaatgcagctctcgttcaccttcactcgggtcaccgccttcttctgctcacaaacacttaattgtctctgaaaagtaggtcactgccttgtggaacaagccggagggggagctaagacccagactctcactccaacaggcctggagaggcccaagccgtgtctaggagaccaggaccagtcaacagtgcactgtgccaagagcgctccaggtggcaacctggctactgccattcctaggtggtgattcagcaggttggtggagcagaagacgcccaggatgtgagggtgaggctcctgtcacgccaagg

SEQ ID NO: 58450 - DNA, 1086 bp, Bovine  19866881546245
gatcactgtctgaacaaaaaatacacattagaggatttaatgactgaatggagtcattgacttcagctcagtttgaagacactgcagtgcccagtaaggacaaatagagggcccatatgtgcaacagcgtcacggactcccaccgcctgcctgccatggggcatggaatgctgtggaccagtcagactcaggtctttgcccttcttcccttctctgctcatctcagtctcccaaaatcctggctactccttccctgatgatttattgcctcttgaggcattaatacatctaccccagattattttaagtactccttctgggaagatttcttattttaccaatcccttctatcaccttttaaatatgactaattggtgttctaggtggggcttgctaaatggtttaaataatactaatcatttactaagcacttagtattgctcacaacaaccctaagaagcaggtgctatggtttatacttgttttacaaatatggaagttgggactgggagaagttaataatttgtcgaaggtcacaaagctggaaaatggagagcttgatttggaactgagctctgttggttgtgggaggttacctaaccatactacttcccacaagtttagaggtgattcaacagttacttcttgggcaccaacttgacccctggcactgagtattaattgtttaataacttacctgattaaagaccttaagatcatatttaggtttactcaccaaaagaatggcaatcttaatacaggcgcgtgcatgctcagttgcttcagtcatgtccaactcttttcaaccctatgcgttatagcccaccagactcctctggtctatgggattctccaggcccgaataactgtggcaggttgccatgccctcctccaggggattttcccaacccaaggatggacccctcatctcctgggtcctctgcatcgcaggcctggtggctcagatggtaaagaatctgcctgcaatgcaggagatccagattcaatctcgatcccccgggagaagggactggctacctactccagtattctagcctggaaaatcccatggacagagggagcttg

SEQ ID NO: 58451 - DNA, 1459 bp, Bovine  19866881576791
ttatttaaaaaaagaaaaaaattaaaagaccataactctaacttctcctaagcagagaggcaagagctggcttctgtcagtgagaaactgaataataataataataacaacaaccacaacctagttattatcattgtttttaacttccatgttctctgaaccttatttggcaaaatcctttgttagctgtatttggcagctagaaattcttattttgttttatttatttattatttgcttttgcatgtggctttatggttcattgaaaactgcacagggagaaagctgcaaaatttgagtataaatgcacttggtagcagacagaagcatcctctcctgtcgtctttatccctgtgtttctaagatggctccaccaaggatccctgcttaaccgagaagtgacgttctcagagggagtggagcactcagttttctttgttggctcagtctcctgaggagcagcattaatgtctcttcggttttcttctcattttgtaggatgaaaaggagcagcttatacaatccaagagttccgttgccagtcttgttgggagatcaaaatccgttgttcagctaaaaccacgcagtcctgaccacatgctaaagagcaccatatccgtgaaagccatctgtgactacaggcagattgaggtgaggaggtggggagggtaccctcctgctccaaagggagacaagggacaagggaagccttcagttagggttatgataataaggaaagatcagatgataagagttctgttgttagaacttaaacgtgcttaaatctatcattaaaagcataagcctcaactctacaatcttgacctgctccctgcctcagtaactgacatcattatctacccagttgcctaagcgtggctagaaatggggctttttagcatcctagagagaccatgactcctctcctcttttcctacagctgctaccacgtcagcgtttgtaaagaaacccctcactgtgcttcccaggtggcgcagtggtaaaggactggcctgccagtgcaggagacgtgggttcaatccctgggttcagaagatcccctggagtaggagatggcagcccactccagtattcttgcctggaaaatcccatggacagaggagcctggcagctacaatccatgagatcacaaagagtcagacacaacttgagggcacacatacacacacacacacaaatatccctcaagtattcttctttctatccctgctgcttctacctaaatcagacccacttggattattgcatcagcctcccattcaatgtattctttatcctaccaccagcatgatcttaaaaaaaaaaaaaaaaaatcactcccctgcctaagtcctacaacaattctccatttgttcttcttcattttattttttaagattttttttttcacacatgggccacttttaaagtctttattgaatttgttgcagtatttttt

SEQ ID NO: 58452 - DNA, 745 bp, Bovine  19866881755449
aaatggagctgtctgagcttctccccctccttctcccaatattttcttccggacaaccaaaaataaacacggctccttccttacccatgagctagaggcacattcttagcagtgtaagctgtcacctgagcatgcctgacaatgaaggggttaacatctctaagcaggatacatcttgttcctaggcccagatactccatccacccagaacacgaaggtgggtgagactccccctcaatcctcctccaacctctcactgactaattcactaaatataggctattgcttcaaagtaaaaaagacggggcccagggagatgaggcgacagagggctggtaagtttgggaaacagttaccagagggtcagctgtccagctggctctggaatctgaaaacttccaaatctaacaactgcctttctcagcaagaatcaaaagtatgtgaatcagctgtggaggataaaggttgtagagtccagtttcagaagccagtagcaaaccacttccttagccattgttcccaacaaacagcaaactgcagcaacctcaccttcagaccagctaccagctctaagagaaacgggagggagttagttatctctttggcgtatggagtgaaagcatctctctctcaatctctctctctgtatctctctccaaccacctccccatcttcaattttttcgggttgtaaaaccaaaaccattgaccaccccaacttttctaaattctgacgatgcaatttt

SEQ ID NO: 58453 - DNA, 1436 bp, Bovine  19866881778795
atttgtggggtgggagtgggtatgactacagcaggtcattacttccttggtctgggaggatggtgagggttctcgtgccccaggagagcctgaaccaagccgtagaggaggggcctctggtccttcgaacatacagcagtgggagaagcaggaggcgtgtcaggagcgaaagggggcatccccagggctggtgccagtgcctgtagtaccaggtctgggagtgtcattaatgggaggcgccaggctagcgcctggccactgcatttcctgggccataagaaagagatgcagtgaatgagtcgccctaagcctctgagctgttttataagctgccgcctcctttcccggattggtggagtggctaaggaagggacacagaaatttaagtgttgtctctttcttgcccatgtctgcattgctgtagcttttaggaaggattttcgtgtctgcctccctgctcctcgccccctattccccacccacccgcccagtacctcaaggtgaagtttcatcttacctcttgcaggaagttagtttctaaagttagcacataaagggaaaatctcaaataatcaaaattatccttgaaaaatatctcaaatggtccataaatccaagtgtgtaaacctggttttgtatatactccaggacagagttgggacaccatatgaagtattcagtctgtaattaagggtcaatttaagtgagaggatagctgttcttaaacactagaatcatattcaggattcaagatgctcacagtgtgtttgaggtacactggagcccagacttgctcatgtctcagatgcaagtcctatcacctcgtgttcacctcgtgcataacttcaccttggtgtgaaacctcatcaggtagaattgtgggtaaacctctgcacatgtttaaattccctctctctcttcaggcttctgtagttcaatgcaggtgtgttgagattctctggtatccttcttttgtgcattctgtttttcttatttactttttaagtcgttatttttttttcttctaaacatgttttataaccctctgcagtcttcttttatccaaaatacttatctgtgtgtctgtttattgcattcttaattattttcagtgatcaagattctttaaaggggggttgcaggagagagcaagtgggcagggaaggccttaaacaatcttcatttaattctgtaaccatagcttccactttcctcctctctggtcctctgctaacttacaattcttaccccttgcacataagaccctgactttccttcattttcttctccctttatgtcattcttcagtagaaaacttctgcttatgctaggccagttagaaatgaattcttgttatacctactatacatcactggtttagctctagatggttagttggttcatggattaaccccagattcatagtatcattaaga

SEQ ID NO: 58454 - DNA, 3126 bp, Bovine  19866880430772
ctgtatattgtcaccctgcttatttaacttatatgcagagtacatcatgagaaatgctgggctggatgaagcacaagctggaatcaagattgccgggagaaatatcaataacctcagatgtgcagatgacaccacccttatggcagaaagtgaagaggaactaaaaagcctcttgatgaaagtgaaagaggagagtgaaaaagttggcttaaagttcaacattcagaaaactaagatcatggcatccggtcccatcacttcatggcaaatagatggggaaacagtggaaacagtggctgactttacttttttgggctccaaaatcactgcagatggtgattgcagccatgaaattaaaagatgcttactccttggaaggaaagttatgaccaacctagacggcatattaaaaagcagagacattactttgtcaacaaaggtctgtctagtcaaggctatggtttttccagtagtcatgtatgaatgtgagagttggactataaagaaagatgagcactgaagaattgatgcttttgaactgtgatgttggagaagattcttgagagatccttggactgcaaggagttccaaccagtccatcataaagtcctgggtgttcattggaaggactgatgctgaagctgaaacaccaatacttcggccacctcatgtgaagagttgactcattggaaaagaccttgatgctgggagggattgagggcaggaggagaaggggacaacagaggatgagatggttggatggcatcactgactcaatggacatgagtctgggtaaactccggagttggtgatggacagggaggcctggcatgctgcggttcatggggtcgcaaagagtgaacacgactgagcgactgaactgaattgaactgcatttcctcaaaggaaaaaaagagatagagaaaaaatggtgtaggtttttagtgctaccactagggggcagagactggctgcaaactccaagccaggtccttgcaagaatcaaccaacccgtcagcctctcttttcctgttttctccctctccacgtccctgtcctctgtcctgtcgtgtccccaggtcccagctgcagcacaaaaattcatcatgccatgcctttgccagggcagtttcttctgcatggaatttccatcccttggggtgaaagttgaatttattagaagataaaccaaatatgagagagatgacctctgggggcatttactctgagacagtttctgttcggtgtctcacaactgcctaccagctaggttgtattgcccccatttcacagttgaagaaactgaggcttagagaggatcgtgcccaggatcatggagctagtcagaggctaaagaggaatttgaaactcagtctgtctgaatctagcactcctgacttttctaccacaaagattactttttaagtataagctgagttttccaggggacacacccagcagaagcggagggaaagggattcagaacaaggctctggagtggacagccccacccagattcccagcagcccacccctgctccaagccttcttctggggtgcagagagcggtaggtgcctacaccccagttctctgcccagggggatgagataggcttcaggcagctgttaccaggatcagagccctgtgaccctcctctagagactccaggctcttgtggacggcctggttcatctcgaggaaggccttgagacgcttctggatgtcctggctgacttcgaagagcttcccgtagtgctccaccatggctgccaccggggtttcttccggctcctccccttggttgtagcctacggagacagtgcgtggcaggatgggtgggcacagaatgcccagcccctgcctgccccctgcagtgatgctcacacggtggtggtggggaactgctgctgtcagctggagcctcagagttgagaaggctccatcatccaacacctcctgtcccttcaggagaagcctcagcatttgaaaggctgcaaggattcaggattgagtgattctggatcactgtcgagcgaggcaggagactccccacgccctgccccatcccctggaacccccaggagaaactgctggctgggggagcctgcaggaagaggacaggggtcgttgctgccctgagtgaacaggccccagccttggtgtttgctccttctaggtgggttgaacagggttgcatggctaggaaggccccaacctaggaggttgctggcagcagccctgggcgctgggtccacatcaagacctgtgcttggactggagccctgtgcccctccttggctcggtgctcaaggctctctggtgctgctcaaccttccaatcacacctcccagcaacccctgccgggccccggtgttccagcacactggaactcaccagccccaaacacaccacgcggggctccagcctacgtttgtgctgttccctctgcctgcagcgctggttcccctttgctgaacacctttgagctccatgagtggccccctcctccatgaagccttccctgacctccagggcagagtccttggggctcccacagctccagagcacttagcacagtggctctgaaatcagatagaccaaagtctgagacccagctccaccacttcctggctgggtgaccttgggtgagtcccttaacgtctctgagcctaggtaatacagttcccagaagctcctacgtgtatgcatgctcagtcacccagtcatatccaactgtttgcaaccccatggactgtagcctgccaggctctactgtccctgggattctccaggcaagaatactggattgccatttccttttccaggggatcttcctgacccagggatcaaacctgcgtctcctgcatctcgttctttgacaggcagattctttaccactgagctacctgggaagccctggcacctcgtaaggaggacttataccttagcacagagtaaatatttcataaacaataacagttattttattattgatggtgtaaagataataatatgatgataataatacaaatatgtaactatgacttcccttccatttcctaccaaattcccagcactgatcacagggattctggcacaaaccagatcaaacgagacacagaaacc

SEQ ID NO: 58455 - DNA, 2440 bp, Bovine  19866880639700
atctgagggcgatgtgaagggaagagagcgttgctttgggttaggccagtggatttgtgaaaaatgggagagcagagggcaaggtcatgacaacagcctgcctctctcgggtgctccgattctaaactgatagcatctctcctgggaagagggtccccccccaccccccgccacccacaagagcactggcaggcctggaaaggcacagacacaccccgaagggaatttctccagccttctgctgaagagaaagcttcacttttgtgaatgctgcacaaactagaaatgcagttagggagcagccactgctgattatactgtgcctgacagcccggcccgagacccaggacacctctcacgatggctcagagcagccgagattgagctcggggtccttcagtttggaaacagggatcatgacattcacaaaccatgtaacgtgttagcccactctgacagtgtacttgtcacagtgtactcctccccaggccaaggtgggagaggcagggagggggaacccctgcaccagttcagagatcagggtcagatttacattcctgtgaagaagggacaatcacttagcttgagcccgtgggtccacattccagcccagggcagtacgggaacctgggcccctgcctgcgattaagagcaccctgacactggtcttcccaaaggcagaaaatggacgcaagagtgccctttgtatacagggactgggagcagtctgttacccagccctggcacagtcttggctgtcagcagacactgcagtcttgacactgaagcaccagtagattcgaataaatccctgcagattggaacctttgaaggccttcgattaaggaaggcaattccacacccctgcattctccctttcttcccagaggggaagacagcttggctggcagtggccgtggcccagccagggctccttgagatcctgaggcagcaaggtgagcaggttattaagggccaagtccagatggatgaatgaggaggctggcaggagccagggctcttggctccccggcatctcccacagtggtggtctcccacactaacacctgctcatctccgtctttcccacctaacctctagccagcccataagagggaagggagaaagaagtcaaagacagcctcaaaaggcttgtctgctctgctcggctggagtctggttgcatgtgctggtcagtgcctccacctggctgcatcgctagatcctacttccaaggtgtgttagggatgacgagacagcttcttggtcctccaggaccctcgtctttctcagtgtctgtccaggtggggctggtggcagaaccctgcagggctgccctccagaaggcaggcagtcctggccctgagggaggtaaggggcccgacaacttgggcttcatgctgatggccacaggcccctttctagactttggtattaaagtcttgttcctcaagttcggggtgagaaagcactccatcgtgaatgtttggaagtacactggagatctccaagttggcctcagttcagcatcccacgtgcactccagcagctgactggacttgattttctatagaactggtaagaccttgagcttgagcttttcctccactgcagagaggcactgcctccagggaaaataaaccaaaggacatttttttacccaacaacagaatgtcagcactggcaggaacctcctccagatggagatttggacccagagatgggtagtgacctatgcaatgtctcagaactgggggtagagccagtctggcatccttgcccagagttataaaacattagatcctccatgaaaataaatattaaaaatattatcaccaagttaccagcagtccatagtgagtaggccttattcccagtgcctttgccccaaaggcggcaacgttctctaactatagtctaaatcgcttaaaaaactgaaaagccgtaatgtccattcagaatgcagtcccgttaggtgacaggctccactgcatggcctaaaattaatcaatgtttatcggctgcataaaggatgttgtagtgggatgttttatagagcaggtacacggagggggtggcagcctcggggaacacgtggtggttcagggccgtgtccatctcgtccacgtactccacctgcagggcgatgttcagggcctgggacagggccgtgatctggatgtggtcacactccatagccatgggctccacttcctgcaaaagccacaaggagaaaacaacccagttgaggatgcatgcccagcagaggacaggtgagaggtcctggctttttgcccagttgcagagctcaaaacctctgcaactgtgcaatggtctccacaacaggccttgaggcagatgtcgacacacgcattttctagagaaggaaacacaggctcagtgagaaaggaacagatagaaatcaccagaattaaaaggt

SEQ ID NO: 58456 - DNA, 663 bp, Bovine  19866880801844
atgtgtgactgcacttctggcggggatgaccacctctggagggaggagcctgcccttgagttggagcacagcccaacacacccagcccacacataagaaaagaacaccccctcccggaggaggagtgctgtggcactgagcaccctctcaccctccagagacagctgagggggcggctggagtttgggaagagttggcaaagtgacgatcaggccgggcgaggggcggaggcagttaatagtgaggaggactggggttgggggaaggtaaactgagcacgcaaatcctgttgctaatgaaacagttccctgcctgcccaaccccaaggctccatgtcgaggaaatgggaccccctcccacccccacttccccataacagccacctggagcctgcccctgcaagtgatgatgctaactgcctgttcaaggacaggccagaatacttcatgaggctgggctgctcatggggccacagagtccccttcaggacttcaaaaggatcaattccatctagcccacccaatgccctgcctgctaggctgcacgtctctgtctgacctccttcctcaatggctgcagcccatcaatgcttcctaccagctctgtcctgacctgggtggcagacaccccagctgtcgccctcctcactgttccttcccttat

SEQ ID NO: 58457 - DNA, 1894 bp, Bovine  19866880976938
tagaaaagagatttgttcatactgttgcatggaggaatagaattgttcatcctcatggctgtgtgatattctattatatgaacataccatatatactcttggtggaaatttgttttcagattttggctgttatgaataatgctgctacagacattcttgtacaagtcttttggtgaatatacacatgcatttctttctttttttttttattttattttattttttttacacatgcatttcttttagttatgttcatagacgtagaactcctggtcacagcatatgcatatgtcccgcttagaagatactgctaaaccatcttcccaagtgcttgcacagtttatactgcttccagcagtgcatgagtggtctcaccctatgttttttaggaaacaaaagtgacaaactttgtagtacagaaatttctagtatatcaataatgaactacctatgtaatagcccatataattatctgttattctgtatctgatttacttatgtcatacaactttttctttccatgtaagagagtttccatgaatttttacacttagtttttaattgtgctagatggcttggctaggagactcttggttattagaaggtcttctttcaagggtgccacctctcgtcgctgtgctttttaatgattccaagggtcctatttttaaaaaatcatccaagttatccagtgtgaaagtgatgcacagatttcttgcctttgtgcatggaaattggaggcatcttcattttcgcatcctaggataagcaggattactgtttcacatattcagaggcgtacataatggattccagctgtatgtctcgcatcatcgctgaggcctcattacttaagtacttggcaaaccctgaactccctgttttggaaaagtactaggtctctgaatctaaggggtttggagattatttcccatctccttttgcttatcttttgctatgagaacaacgatgggaggcatctgtttctttttttcctatttactggagcttctgaaggctgtctgtgacatcagtggaaagcagaatgctttcatgggatctgcaagaaaagcttaaaaataaagagtaaactattttcatcaatgtaaaggtgacccgtataatgtcattgggaagacctagagcttaataacaggatgcaattgtgagagatttgagcagttttcatcttgttaacatagctgtttttgatcccttatttaaatacctacatgtgggacttccctggtggcccagtagctgagcctctgtgctcccaatgcagggggcctgggttcaatccctggtcagggagctaaatcccacatgcctcaactaaagagttcagatgccacaatgaagaccaaagatcccacgtgctgtaagacccatcacagccatataaataaatatgaaaaaataaatataaataaataaaatacctataggtttctatgagaaaatatactataaagtaatgctaaaacaaatgcttgtatgaagattcaaataaaatgcaggttaagttctgtaactgcaatgtacctatattatggcatatagatgtgtggatgttataaatgtatatatatgtttgtgtgtgtatatatttattttcatgaacaattagttcatactgacacttgagacgtagctaagtgaggcacaaggagactgaattttgtccccaaacttatctaattagttcccagtaaaaatttggggttttattgctttactcccaatcttgttgtatagtggtttcttagtagttacattattatttaaagtattgactcaactaagtggtaaaaatcataactcttagaattagggtcacatgaagggaattaagggcttccccagtggctcaatggtaatgaggagtgcaatg

SEQ ID NO: 58458 - DNA, 767 bp, Bovine  19866881108256
tcgtcagtctcacaatggatcttggtctctgtcagcgtctctaccgtagcctcctttcttgtgaggtcaatgaccttgggcttgcccctcatgccaatcttctgcatgaggaggtcaagtttggcagttttgtcgattttcttagcgtgcttcttgtgaaggatacgggcaggagcttgatgtaccagggtcagtgtggcggaaaaaacaagggtctgtctctttgggttgtactgggaatcactgagcatctctagcagctgtgagagctcagcaaagtggcctttctcaaccatccggtcagcctcatcaatcaccaggcacctacagatccagacagacccgtgatcaccaggttagtagcaggaaagaggagtcaccacagcatactctgccagtgcccacccccctacccctggccaacccaagacaaacaccactttcaccacctccaccagggccctcaactaacctccttcacacatgcttggttttctaaaggccaagtccctagtacctagtagggtacctagtaccaaggcttagtaccccacgatggcactttgtgacagggaggatgcactgtgccaagtcacctcaggcccacttcagaacaaggggtgggggaaaaagggaggtactctcacctgagctgccgaaggttgctcaaatgagggtgcttttctttaactagctcccacagccggcctggagtggcgatcacgatctcaggctggcggttcagcatcctctgctgtttctgcgtg

SEQ ID NO: 58459 - DNA, 1658 bp, Bovine  19866881252625
actttagaaagccaggcggcacttccttaagtgttagctcctgttgatgcggacgttaatattcgtgcgtgaacctagcaagaattagcagagagtggtggttaggagcatgggctctcaaacctcacttccagcctttgaatgcttcttggctgcttctcagtgggttagcttttggcatgttacttagtgtctttggtttcagtgtctttgtaaattgggagtggtgatgctgctgcctacttcatggggttattctgatgagatgaactaatgctgatggattactcctagcaccgtgtaagtactctgctgctgcctacttcatggggttattctgatgagatgaacttaggctgatggattacctggcaccgtgtaagtactcagtaactggtgtaattatttctccttttaaatccttcttgctttctttttttttcctttaaatctttcacacttttaacagtctttgagggtgccagttcagttgagcaaatctttattcttcctctttttgggagagtccaggtcagtctgtgggaagtatccagatgaacgaaatacagttcccagcccctaagaagtatcaaatccactagaggaggtgagatgcctgcagccataatttaaggcagaagatactagaaagtggcaaaataaagttggacaaagagataacttctggtgtgggaggttaggttggaaagtgctttctaaaagatgcttggcatttagggatggagaggattccggcatgtagaggtagggacggaaggaggagagaacgtgtggtagagggctgttgctgggcagtgagaagagggggtgtgtgctctaagaggaagtgaagggtatttcacgtctcgcaccatcatgagccatgggttaggcactgaattaaatttgcccattctggtccattttagttcactgattcctaaaatgtcgatgtttactcttgctgtctgtctcctgtttgaccacttccatttgccttgattcatggacctaacattccacattcctgtgcaatgttgttctttacagcatcggactttacttccatcaccagtcacatccacaactgggtgttgtttttgctttgtctcagcgtcttcattctttctggagctgtttctccactcttctccagtagcatattgggcacttaccaacctggggagttcatctttcagtgtcatatctttctgccttttcatactgttcatgaattctcaaggcaagaatgcttaagtggtttgccatttcattctccagtggaccacgttctgtcagacctctccaccatgacccatctgtcttgggtggccctacagggcatggctcatagttcactgaattacacaaggctgtgatccatgtgatcagtttggttagttttctgtgattgtggttttcattctttcttccctgtgatggataaggataaaaggcttgtggaagcttcctgatgagagggacaggctatgggaagtctgggtcttgccttgaagggcggggccatgctcaggaaatctttaatacaattttctgttgatgggggggctgtgttctctccactgtggtttgtcctgaggccaaatatggtaggggtaatggagacctccttcaaaaggacttaagccagcatgctg

SEQ ID NO: 58460 - DNA, 791 bp, Bovine  19866881487896
cttatgttttaaaaacaagtaagtttttgcatgaaaatggttcttgagaagaatttgaagtatttaggcggctagagtattacagattgttttggtaacactgtagtgacctaatgaatgctgtatcaaaaaggtaccgtataaatacaccctactgacttttaaaaatatagagtatatatattattaagtttctggcaacttggaatcagtggagtgcaacagatagtttcattgtactagaagaaagttgtatgattctgctatagctaattttgttgctgttcctgctgttgttatgattattagtattttactatagtgaaatttaccaaatctatttttataaagtatagcaaactggcaggtcataggggaaaatgaggtcaaattttaaagtaagtaataatggtctcaatattttttcagtaagacgtgtagataatcatgttttagcataaacataattaatatctccatgtatttgttgtaagatttacctaatgaaatttcatctctggcttaatttttatatctaattgatgcatttaaagtttaaaattgtcagaagtttggtgttcattattaaaagcagttgttttcaagttaatccatgctttttacaatgtaaattataatcacaaatttatagttacaaatcttaaatttgtgttttctttgtaagtgctggtcaggatatccagggaacaagcgtgattgcgaatcttccatttctgatgcgacagaaccctgctgagacacttcggagagtcttgccaaaagttagagta

SEQ ID NO: 58461 - DNA, 2650 bp, Bovine  19866880159292
ttgcatttctctgataacgagtgatgttaggcatcttttcatgtgtttgttagccatctgtgtgtcttccttggagaaatgtctatttagttttttggcccactttttggattgggtcatttatttttctggaattgagctgtaggagttgcttgtacatttttgagattagttgtttgtcagttgcttcatttgctattattttcccccattatgaaggctgccttttcaccttgcttatagtttcctttgttgtgcagaagcttttaaggttaattaggtcccatttgtttatttttgcttttatttccaatattctgggaggtgcgtcatagaggatcctgctgtgatgtatgttggagagtgttttgcctatgttctcctctaggagttttatagtttctggtcttacatttagatctttaagccattttgagtttatttttgtgtatggtgttagaaagtgttatagtttcattcttttataagtggttgaccagttttcccagcaccacttgttaaagagattgtctttaatcattgtatattcttgcctcctttgtcaaaggtaaggtgtccataggtgcatggatttatctctgggttttctattttgttccattgatctatatttctgtctttgtgccagtaccatactcagacatcaagcttttcaaaactccagctgaatgtgacaaaggtagtagtttccagatttcttgatatttccactacatgtatcaggctgatgaactgaatttctcaatttatagccacatttttttcataatgtaggacgtgtccatttctgtcaacctaaatatcatgttcctactgctatttcaaattaatagcttctttaagttaactatatttttgttgtactactattttgtttgtggctttctctatttcagccttactaaaattaatgaattaatacagaaactaatgaaactataatgcactgaaacttgacaacatccaacatactatctcttgctaaatggtcctttctgtgtttagttttgtccttttttatcctgatttgctgtatccacagtgctagaaccagaagatactcagagctatttgttgaatgaataattgagtgctgtcttcttaaaaagtaaagaaaaaggaatgcttaaaccaggatagaaactgtaacattaaaaaaaactgaaatatttcattcaatgggtaaaaagagaactaatttgctacatacattgaagacttgcatgtctactgtttcttatagactttccaatatccctagcatccagggaaagcaggtacttcattggccaaatgcatttattgacttatctaaaggttacatattcagtaaatagaagtgttcagactcttgactctgagtttattgtcctacctactataaaatgctacactctgaattatttggggtttcacagacatcacggtaataatttgtccagttactcagtattttctctttagaagaattaattgatatgaaagctagcagcttctggattgtgacctgctgggggagagagtaactggagttctgaacactttttaataaaaaatacaaacaagatttagcaagaagggccatgagtcaaaaacatcagtaaaatatttccacaactattttggttcatttattttttcctataagaaatgcaagcctttgtttatttaaagatatgcaactttccatttattaatatcctttttagtcagaccacataatgtaggcagggaatgttagataaaacatctgcagaacagacttgctttccatgactgatgttgttccacagagatatgtcataagcaatatagctgctggaaactcaaatagcagcataaataagatatatccatggaaagttttgaaaaaccttaaaataattctcctgtatttttagtttcctaagcttataatcaaggcatcgtatttatcttactattacagacttgtgcgtcctctaccaaaatggtttgcatggagacagatgctctgcactgagaaaatatcaagaaaataatgaattggaagttacaagtgccttcagccaaaagtccaaagggaattgtcaccttgaaattatatgtagcagaaggagccaaagaaaacaatgaaatggcaaaagtgccagtgttaatccagaaattaatctcaggggtgtttaggccaggttaattgaaccaacaatagtctttctttcattttgaaccaaagcatgtccaaaaggagaggggaggccaaaatatcttcaactagattaggtgaaacaggacagctgaatcagcagcataatcaagaaatatttgaaaaagtgacatgtatttattgggcaagatatataaatgtagctccatcacttgagtttacaaattagaaatgacagcacttacctgggaaaaggaaaccatcaaaaacaaagtactgattgagtgacattaagctacatgcagtttaagcattctgtgcataaataaaattcattcctgccttccagaaacttagattctaagaaatataatagcaatattagaaacaacaataacctctatcattattggagccatttcttgagctactgggtagtgctaactaatatgccaggggctcctttggtggctcagtagtaaa

SEQ ID NO: 58462 - DNA, 2979 bp, Bovine  19866880209333
cctcctccctccccataccctccctctgggtcgtcccagtgcaccagccccaagcatccagtatcgtgcatcaaacctggactggcgactcgtttcatacatgatattatacatgtttcaatgctattctcccaaatctccccaccctctccgtctcccacagagtccgtaagactgatctatacatcagtgtctcttttgctgtctcgtacacagataagttttgagaggaagtgaaagtattcaatctgttgtgcttagtgggaatactgctcatttgcctttgtgtgcgtgcttgctaagtcgcttcagtcatgtccaactctttatgaccccatggactctagcccaccaggctcctctgtccatgggattctccaggcaagaatactggagtgggtcaccatgccttcagagatgttttatttttgtttctgtagaatcattatggacagtagcaagatcattaaatcatagacagccttggccctcttagatgtctagatgtctagtcttcagaaactgaattgtgtagacagttctaggtcttctcctgtgtacatgagagctgagtggtacctgatctcctcctccttcatattccaaagaggaggcttatggagttgcctctccatttacctcccttctcttggaaatgcctctctctcacttaccatcccattgcacccatctgcctggagacccttcttcttccaattcaaatccagtagtagctcaccttctctgtctgagagcactgcccagcctttccaaggatttatggctccatgtctaatccacacaactcttggtgtgtatttttgcctattttatgtaagtgctccatgcgtctcctagaccactctcttgcgtgcacacctttaactttaattctcttacatacaccttatatatgtctctcaggtacctcaaattcattgggcacagagctaagctcattctagcctttcctgaagtcactttcccttcagcactctgtatcttggtgaatgacactcctgctaaggagagccccactcccttcccgctgttacccaatctgaagtcctccaactctgcaaggagaaatcagagcaggtccctcctttttgaaaatactcatttatgcaacacccatttatgcaataaataaatagccttgagtaaggctcatgtgttgacttactcaaacccctcaagcctttgcacagacatacaccctggctttggcatattaaaccactcaggatttctggaagacagcatttctctcttctcagggattttatatttactgcaccattttggaaaacccctttaccttcacttcctagaaaattcccatcatcacctttatacttcctcctccgctttcaccagctcatctcacaagcctttctaagatccctcaaactgagatgggtgcccctgtagtgggctgcctcgggtctctgggcttactttatgcataacacctgacactgtgatgcaatagacactaagaaccatagccaatgtttatttaggattattttgatcaaggaattgtaagaagtgttttatggagagcaggccatctaaatgtgattgttttattactaatgtaacagacacagttgtcggtttacctgccttatgcgtgaccctccttggagattagccatcgtccctgctgagagagcagtggatcccttgcctgccccgctggcctcagtgcattggagtaggacaaacacttgattcagtctgggtcaaccaaattctcccttattgaaatcttgaatttggactctgtacgatataggaggtcactgaaagctcagctaagagtaatgactacttttcatcctgtgggtgcagaataagcccaagcagaaaggagactggagctctgcagcccacgggtcctggggaggcagatagcggacctctggttctgacttcaacctgatggtttcagcccctcatgaggcctgagtaaacatactgcctaggggtccaggacatttctgtgtgtctgcccctagatttccttcttagctaagctaaatgactgcattctattgcttgaaatccaagtgttcctaattaaggtattgatctttaccacaatactgactatgagccttttaaggacatggagtgtggactgggtaccttcagatagttaaagccagtgtggcttcttatagctggtgttcctgggtgtaccacttgaatcaggctttttgtgaagcttattactccagtttagagttgcattttgtatatgtgataaattttctaatctaacacaatcatttctttttaatagtatacttaggatgttctaactatgattaatgggctgtacctcctagagctgcttagcatctgaaaaaattaaggctaatgtttaatgtgtgcaatccattgttggttttacagtagttaccaggaatctagtattccaaagatggtattaaatatgtgtgtgtgtgtacatgtgtaatctctaaacatccatttatgtgcacacatttgaatttctacttacaaagggtaatagaaacagaattcttaagacctttaattggtactttcatgctccctgtatacttcactagtgggtgatcaagatgattaatattatagaaatgcatatggttatcagagattcaagaagtaagaagaataaagatgtaagcatatgtgtgatctgaacagatgtctgtcctaacacagggccggtcaataattaagaagtacccattcaggcttccctggtggctcagacagtaaagcacctgtctgcaatgtggaagacccaggtttgagccctgggttgggaagatgccctggagaaggaaatagcaatccactccaggactattgcctggagaatcccagggacagaggagcctggtaggctacagtccatggggctgcaaagagtcggacacgactgagcgacttcacttacttactcacttacccatt

SEQ ID NO: 58463 - DNA, 1303 bp, Bovine  19866880486835
ggatcaaacccaggtctcccgcattgcaggcagacgcctcaccatctgagccaccagggaagcccatttaaattataagcagtggtttataacactccagtctaacagaagcaatgggtgacacaatgtgacagcacatgtcaccatcactttgtaatccccctctgcttttcattaaaaacaggtctttgaatccaaataaattagattttaaagaacaaattgaaagtttaatttgattgccaacaatgcagacacattgctctttccctcaggccacctataacatctttttaaatccaagcgacaatgtgaataaatattaaggagtacatgtttgaatttaatttagtggaactattttcactaaatgaaatatttttaaaaacatctatattcattgtgagtatatttcatagtactttgaaaaaaattgtataatttatccagaatattagaaatttagagctagagagattatctcagaggctatctaatccactggtactcaaactacatctacgccttgcattgtttttctagtctaccactgattttgtaaaatataataaatatgaatctaaatataaatataaaatataaaataataaaaagaagagaagtttccatttttaatcattagttgcaacagacataaaattactctgaaaaaccatgtaaaatttggaacaaacactctcaatctgtacttattttaaatgagatagttcattggtcatttgttgtttttagttgttaagtcatgtccaactctttggactccatggactatagcctgccatgctcctatgtccctggggattttccaggcaagaatactggagtggtttgccatttccttctccactctgggtcatcactggttagcaaattatacttggagtgtcacttgtaaagtctctttattttatagatgaatgaagtgagaactataaaaatttctttttttaaaaaactgtataaaaatgatctagattcttcacataatttatttagtcctcagaaaatctttgcctgttaaatatcatccttacatagctgaagatactaatgctcataaaaaagacacatctaataatatctaacacatctaatgacttctaaaacatctaacacatctaataacgaagtctcaccaatggagcggacatgctgcctgagaccttttcccagtggggactccagatgtgctgtgacatggtacttcacagcgctgattaagtctggatgccagtcaaaacgcaatttgaaggacatgtgctcgctgatgaacaaccatcaa

SEQ ID NO: 58464 - DNA, 1904 bp, Bovine  19866880570304
tttagatgacactgacatctgtatttatataatgataactgtctcatttttaatcataaaggtttaagataaggtactgatattaatggaaaaactgccagaaaaaaaataaaaagatttttttaacaaattaatcatgttctttctgctaaaactgactttattcagacattgctcacaaagacagtagcacctcaacaaaatgaagttctaatagtttaattaagatttaatcttcttattttaatgatcatgactttcaaaataagtgctttcattccttcctaacgcaccaatagtctgttgaggttatattctgtaaagccctactttctatagagcaagcttgaagtttacaatttcccctgtgcatttttatttaaaaagtggggagggtgaaagactgaattatgaaggcatttatattaattcatttaccttctccagggatgaagatggatttgtatagtcatattgcactgaaatgtaactgctttaatatatggtaggtttttcaagaactccttgtaaaaaggaaaaaggttaaagtcactaatttatgagaagaaaatatatataataaattagaatgtatacaattttgggatcataatttttctactattgaatatcaaatctattaaactataacaaaaatgatagtagataaagaggaataatgaaaaaataaaaaatctggaagcagattcagtcattcaacacttcagtgtagacaaaaatctcatcacaggttttaggaaggaaactcatgcagcagagtttaagccaagatcttatcagttaattgcagattcatatgacaataattaattaatgcatttttggtcaactttattatttttgtgatcatcatacatgtcaaacaacatattgaaaaaaaaaaatcaatagtttatacaaagtattgtcactttagccattgtgtagacatctttcagggtgattagttttctgtgacttcctgaaaatagtttgagaacatgtagaagttcaacttgtaggaggaaaaaaaaaaactaatctggtagaaaataagaactatttagtaaaaataatattgaaagagtttgagaaattttataccgatatgaagattttaaagttctagcaaccagtggagaattaacatagttaaatgtagctgtgttagagtcttaagacatcgttatttgtgtaccattgagaaaagaacaagaaaatctgcccaatactactaattgaattaatcaatgctttggaagctttagaaatgtttattcaaagaactcttttgaactgattaatgtgtatatatttttacaatgaataaataaaaatgaaaatattagcaaaacacattggtttaagtattcctgaaacaacttccaaccagaattattaaactctgtgttttaacataatgttattttctgggcaatcaagagtgttgatgatacagcatttattaagagagggctctaccattgtctttgaggttttctccttatccatcaacaccattctgtaacatttgatgcctgggctttcttactctggagaaggaaacggcaacccagtccagtattcatgcctggaaaatcccatggaccgaggagccaggtgggctacaatccatggggtcgcaaatagtcagatacgactgagcgacttctgtgttctgttccttactcttaccagaagtaccaagtggtgtcaaccacgttatgactgccacaaggccaagaatgtttgagagaagaaaagatttatcctgattttagatctgtttaaaatgagaaaaggaaatgcatctcacagttgatgatatactgtatgtatgtgtgtgtgtgtcctcagacatgtctaactctctgtgaccgcatagactgtaccccaccaggttc

SEQ ID NO: 58465 - DNA, 1542 bp, Bovine  19866880591538
gtcctggagtttacctttagcatcattccttccaaataacacccaggactgatctcctttagaacgggctggttggatctccttgcagtccaagggactctcaagagtcttctccaacaccacagttcaaaagcatcaattcttcagcgctcagctttctatatgcatccaaatactgtataaacatgaattgtcaatgagacagtttagtattctgagagaacaatcataaccacaatccaaatagctgagtatatttttctaagcaaaggaacagtgttgcagctgatttcataattgaagaaaacaggaaaaagactgtgaaaagggaggaaactgccaggagagaagaatgcaagttacaagtgtggcataggagggccaaaagggatacaaataatgatgtgtattcatttattatttgtcattcagcgaagtgctgagctgcatatcaaggctttgactctattagcagatctagtgctggcagggcggtcgaccggtgacagctgtgcagggtactgaaaacagatgggctctgaaagcgcgtgagcttagtttcacatggcggctctagtattcagtggcttcacaactgctagtagtttctttagcatctcttggtcttagtttccaatttgtaaaaggggggaaagccactactgtggtgttatgaggattaactataatgaaagtaaatgtctttcaacacctaccctacaaaacaccctcagtgaaaggcagcaattatcattatgtgacgttagactcagcactgaatctctgtctctctataattttctaatctataaaatggaaactaaagaacaaaaaaaaactcttctatcttacaaaaagtctgtggaggtataaatgagcttgagcactttgttgacattttggacaattccattaaacagagttctttcagaatcctgtccccaggccccagcccccaaaagaaaatcaagctagttataaataaataagctggtcttctttaaataatcattcatttcatccaaactttaaaatatttccaaactgtgactatttctttgctattcttctcatattttttatgtttacagtatccacattttttcatattatttccagttcaaatccaaaaatataaaaaaggaaacatttgggggaagagtcttcctttgtaatagttggctttcttgtaccttttgaaagcctgcatatatttgaatggatcagtgagttacctgcaccccgcgattttcccctccgcctctcacagccattctaaaccacccaggctagagtcagtttccctcgatacagttgcccagttgcttctggtttttgtttgcatttctgttcaattgagtgttccagtttcttccctttagctgctatggccagacttatcttctgaaataaaatgaaaagacattatagtcaagtaagttatatcgcgaggagggcttgtgtccaaatccctttctcctctttaccctggtgaacagagctagaaaacgcagcagcctcatgatccctgccatcctcccc

SEQ ID NO: 58466 - DNA, 1292 bp, Bovine  19866880690907
aaacatataatggggagacctcgagggagaacccttataaatacaagattttcttctttatctctcatttgctttattcatcttcttagatttaagtctgtcattaatgttctgaaagtaaaatttccaaagtgctttgcagggctgatatttctatcactaccccagcaatttaaaattgagtaaacaccatcaggctccattcactcatgcaaggattcatgattctaattgctgttccctaagtattatatattgtttgcacaaaatagcattgcttggccttcagataatcagttcaatgacagctgcaatgaatcttcctcctactattcagtgtcaggtgcatttcacagctttactgtctcccttttgtgaacactaattatctgaatcttctgagcttaatgcttatgctgaagcatctgtattctgtaatactataattcaggaaggcacctggatttcttctaataaggtgtacccctgatttctcttgtgttatcaccttttcccatccaatatcacagtcaaaggaagcaggctacttctcatgtagattttaaacaaattctagtgaagtgacagatgaacacaggcatttatttctcacccatataaaatccaacgtggggagatgtcagaggctcggaggctctccttcatgtaattatgcagaaatacaagatctttcaatcttgcaattatgtcattaaaaaaaagaaaattggccatattgcctggcatgtgggatcttagttccctgaccagagatcaagctcacaccctttgcagtagaagcacagagtcttaaccactgaactaccaaggaagttcctccatcaactttaacatgtgacttccaagattactgcagttttcttcatctcagtcatccaaaagggaaagagcataaagacatacacttgaaaggctttcataggccagaacaataatccagaacatcaaaggaaactattagcaaggtgaaaagacagccttcagaatgggagaaaataatagcaaatgaagcaaccaacaaacaactaatctcaaaaatatacaagcaactcctacagctcaactccagaaaaataaacgacccaatcaaaaaatgggccaaagaactaaatagacatttctccaaagaagacatacagatggctaacaaacacatgaaaagatgctcaacatcactcattatcagagaaatgcaaatcaaaaccactatgaggtaccatttcacaccagtcagaatggctgcgatcccaaaagtctacaaataataaatg

SEQ ID NO: 58467 - DNA, 956 bp, Bovine  19866880748369
cagcacgccaggcttccctgtcctcaccaattcccagagcttactcaaactcacgtccatcaagtcagcaataccatccaacaatctcatccgccgtccccttctcctcccaccttcaatctttcccagcatcagggtcttttccaatgagtcaattcttcacatcaggtggccaaagtattggagtttcagcttcagcattaatccttccaatgaacacccaggactggtctcctttaggatggactggttggatctccctccagtccaagggactctcaagattcttctccaacaccacagttcaaaagcatcaaaagtttagtggcagagtttagtgacggagaattagcactaggtgatgctgggatgtgcaggagggcaggcaggacagtctttaaacaggtgcccagccacccggggttcagaggccagctttccagacccagcaggaaacagaaacgccagacactaaaggcaaagccacatttctagaagaaatgggtgtttaatctgctgagacatttgagaaacccaattcgaagaacaaagtggggttctgtgaattagcatagcgcacacaagaggtctgttattctgcaggcagaagcccactttcagggcaggagacgccgcggtgacttataccaagttccaggctaaacgtggaccaggggttggggaggtcatcacatgaggctgtgttcaaagcagggggcagtccagtcagacaggagggctccatcgattgccttctaccacatcatagcgctgtcagatgtgaccgaaagcccatctttctgctggctgctctcgatcaatgtgatggatctgcccctcagaggcctgtctgaatcctattattctgcctacacgcatgtgaagctaaattaatgatgatgactcatgggcttccaagcatctgtaaactgttattatcatcatccacaccagca

SEQ ID NO: 58468 - DNA, 2016 bp, Bovine  19866880785276
caagtaagtgatgcatgtgactaaaactcaagtcatttgactcaactcaacagtctttccaataggatcctactgcttcgttgactttcttaacataatacctttagaggccatcaactggcttaatagaactttagtcctgacaggacgttcagaggcattcttgtgttttgtgtgtaaagatgatgctttatgttttccatggtacaaagaaagaattcaagagtaaagagacttttcttctttcaaacctgaagaatgcactttctcacttgccccagggtttacctcttcaccggcaacaaagttattgaccccaaatgaagccaataccctctcagaattgaagacaatcatcttcctggtgataagcacctggatttagggctaaaatcctgccttttaccctcctacttaacaatttttaaaataaaatcaggttgtactaacatacaggactgtttggctctccatgctaagctcgcttctgcagctttctctttagtcacgtcagggagtggacaaagcaggaaggtacaaacgcagctcactgttgtgctgacacatctctcataaataatcaagatttaatcacaaaacacatacaatgagggttttaaagagcctattcatgaatttgaatctttgttcaccggattcttttaccaaatggtgcagcaggcagtgaggagactatatttacggctcattaataaagattgctttctgaaaagcatatctttcacataatcatgaagatgagggaatttttaaaggaattataccagtgaaaagtgattgatgtgcgattagcagtgattcctttaactcaactgagattttatatttgaataattcctgtaagtatatcttttgtgcaaatacatttttgattggtaatgaatgttactagttatttcattttcagcctacagactgatctgatatgatcctgtatcctttatatgtggtcttgattgacaatccaaaaattcatgctgggagactgcaaaagaaattgtctagcataccacctgaggggataatgtgaagaaactgcagacaatagatgaaacaggtcactctggcaattatggaatgtgagaaaaatttgcttcttccctgtgtctaagagcagtgagagaaatttattcagctttctacatgatttatcaaaaactggtccaaaaacctcttttaaaactcctgtttaccattttataaagtagagctgttaaaaaaccattatgaatatttccaaagatgtatgagtttctgaagggtattcccaagctcaaaaaatacatatatggttatcgaccttaacaattgacttgtaaggctgccaggctattaatgagcatctttaaaattttcatagtcttctgttattactactactgttgctaccgagtacaggaccattatcagctgcaattattggaggctcaccatggaccaatgtgattcacaaacactgtcttatttaatcctcatcacatatgagatatgtattctatgaacctttcatatgtgagaaatcagatttagataagttaactaacttgagtaaggtattcaagttgacagtgccagagattaaaataaagcatctcaacaattttttgcagggaaaatgcttccacagccagcaagagtcagaaaatgctttccaagagttcataaaatccagaagcatagatttccatgctacaggaataagtaaacttattcttgttggcaaaaatgtgatgattgcaatggttcctattttgattaataaagatatgtttgagacttgttataatgagttaaaattcatggtcccaaactgcaattagatttgcaccaactaatacatatctgtatttaagaatattaataacagttaatttaaatgtattaattaattcatagtctgttttatttattagcggaaggaagcgtagtatagcagtgtggggtaaacagacagactctggggccagatttcctgggtttcaattccagctctta

SEQ ID NO: 58469 - DNA, 999 bp, Bovine  19866880985217
attaaagtagtgggtatgtggattttattaattggtaaggtctgaccttatacctgtttacagagaaaatgacatgcatattgtacaaaagcacattttgtatctgtgattacaaaagatcaagaagaagcctatttccaaagaaaattctgtttgttagctaccaagaatttagctgactcacttcattccttttctccttttgggaaaacttgcccagccaaccacaaaatggctctgggagacacaggtcccagcaggacaagagacaagtattctcctcttcacaagaaagccccttccttcaaaggtatttatttgaaatttctctttgctattttcacatcaatcctgaagttattttccagcagagcgtatatacattttaatcagcattatctcaagaggaaatgctatactgtaattaatggctcaagaattgtgataaatacaattgcctgacagtcatagttttgtgttaactgtatgattgctgttcgtgctttgtttattcaaaagtcatgttattatcatctgcagataattagcatttactgccagtattcagagcataagcaaggcagtgccatgctggccagtgattttgtttaacatgctgcattacagccctcactgcaaggaggtcgtgcctactcagtattactctgtgtgatggagattaagatgatgaaaggttaccttttgtgatgccttagaaaaatgtagcacattaaagggaaatcaaaagttgctcaatatattctacaaaacatagcacttggtctgtctttgttcttattcttcccatattttagcttcacacaagagaaataacctctggcttatagtgaatactacataaaaaaaaaaaaaaattgaaccataaaacatcagaaggcagtattgtttaccagtgttgtgttcagccacagaggagcccaaggcagaagaactcaacagtattgatactgtttctgcttaaaatgttgctactttatt

SEQ ID NO: 58470 - DNA, 1537 bp, Bovine  19866881019696
tctttgtataatattaagactagcccattaggagaaattttgaaatttaccaagaaatgaatcagtagtgtgcttttttgtttttaaaaaaacagagctatcgattaaagaatagtgtcatctttttccccttgtactcaaattcaacacttcttaaatattccccaagaggtaggggcatttctagaatgattatatatctatcttaggtgagttgagtgagatgaaagaaactttgcttaattgaaaaaggatgattggatatgttgagatcaagagcttcctgaaaagacaggattctgtttgaaatgcattagaacaaagaagtttgtagttcagaaagatgtaaataaaacactgctccgaagacatttttgttgcttacttgcagctgttatttacttgagattttggttatttaagtatactttattccagaagatattcaagatcatagttgtggcagatttttaattatatacaaagctatactaagtggaacatttcaccctggggaacaccccagaatggctggagccactttattaagtgagctgctgcagttttgtctggttgctaaatcaaaggttttatttatttacttatgttttattcctttgggcaatagttgctccatagttttcatttttgactaactggatgtacaaacaaataaatctttgaagaaataaaaaaagtttttacatttttatatagttattacccaaatagtattgaatagtatacaggaaactttaacaacaaaaatggcctgtaaattcagtgtgtgtgtacatacctaaatttacctaaatacttgataaggttcagatatatacactacattttagcttaacattataaaaacaaaaacctagacaaaatattgtttcacatttttaaaaatcttaaggtcatatttttctttacttgtgggagtggtcagagccatctgttttggaaattgacttaggaaattggaggggtaaaatctatttcgttctcagtgctacagaaagtatatgttattataatatcacactctaaacaataattatgaaagcaatttctataagcagtcctgtttttcagtctatttgaagaagctacataaattaatgcagttgtctctctcagctattgagtccagctatccattttggacatggcatccattaagttagaacttgaaagaaaaatacaaagaacagtagtaagtcagctgaatcttatttagagtggctgttttaaggaagcaaactgaagatgactgtaactttatatatgtctattattagctgaaattttttcttcagtaagtggttgaggtctgttatatttcagttcaaaacattcttctttcattaacagatttctggcctttgtgcattacattctgtttttgttccttgctatattcaccggggaagaaaataaggaagaatggtccttccttgtatcagagccctgacagggatcctcagaacttgtgaaatcagaagtttttagacatctgttgaagagctactcataaaca

SEQ ID NO: 58471 - DNA, 1414 bp, Bovine  19866881096324
atgaagtcttactaaataatgttggtgaaatattattgacattcaaaaatattaataaataccaactggcctttactaggttgaggttagagaaaataagggttaaatattaatgattttcttccactaatgaattgaaactaatgctcaccaaataacataacatcactaagaactgaaattttagtttcagtgtttaataatttctcagactatgtcaacaaaacagtcaaaacaattgatatttgtgtggctgtcaacaatttggacatttcctcaatagtcaaacccctaaaatgcagtgccattactcactctactgaactttactgttaggacttgtctaatctgatcatgctagcttatgggaatattcagcctcctctcccagaacattgcaagatgcgtggatgaagctgagctcagaggtttggagcttgggctttaatcctagctcatcattttattggctttgtggtcatgagcaagttgcttaatctctttgacttctagtttcctaacttgtaaacagactctttgttcctctttgagaattaaataaaataatataaatgaactgctcagcatggggataatttatcactcaataaatgatatttagaaagcaattttttatattatgatatgcttctcattccatatcactagagacaaacatgacagggtttggtgtcagcatgagaagccaagagtggtgtaaatgactcagtaatgatttgagaacagtcatgttatgtagtcacggtcagtatcagaaggcaaataacaggcatggagaggggtaagggggaagcattttgtaaatatccaagaagattttaatctaaaaatctttatggaggacagtctcatagaaccagaagaagaagtatttattggggaccgtctacatgcaaggccagatgccgtaagagacatacagaaattcattaattacttactttactccttgccagctggagtaagaacagtgaataacagagtcagattctctgctcccatggagtttatattctagtgtaagaaatatacaaataccattcctttcttcaaggcatttactatttatttaaggaaacatgaatttttacactaaaaaagtataaaagtaataacaacaactataacaaaggaaacaaaaatgttactaggaggctatgtggagcagtaaaggaacttacggtgtctaagaaacctaaatttaatccaggttctgataacactttgggacctagggacaataaacatttagctagtctcatattctcatctgtaaataagcataaaataatgacttaatatggttctgattactaaataaaattacatgtgtaaatcctaatatactacatgaatatatatatgccttcattgaggaggaggcttgcctcaa

SEQ ID NO: 58472 - DNA, 1940 bp, Bovine  19866881131199
ggtcagaattgcgcaggactgggatgttttctctcacatgtcagtgttgtattgagcccttccaggcgtgtgcagagctcgtcttcaggagattaactttccaaagccaaaatgcttgaccaacttgaaatctatttgtggaatttattgttattttcaacactgaaccgtgaaaaataaattcaacaaataaatttctaatactcacccatcatgaaatatctctaaacttcttaaagtgtccaagaattagagagaactgtggaatgtatcattatcttagtctacttacatatattcttttgttttctgtatcttggatttctgacctgagaaagaagagttgttgttctgattactgtcagtgtctctggaaaatgtgattttctcaccaggagaagccttgaatgcttttctttgaaacttgttagcaaagagaaatatagtttcctttgacatgacttgaacaaaatccataaagtagtagaacaagaagacactgggtaaaaggaacaactatgtatttttttttgttttctcaggtagaagataaaaaaattaatttgttcctcctgagaatttttagtatttggaaaatgaaatgcaactcttagatggatattgagaatcatctttaaagggaaaattttatagtcattttataaacaagatgtttgcaaagatgaaagtgtatattatatacatatttaattaaaacataatgacatattacatttgtttcagatatacaacataatgattcaatacttgcatatactgtaaaacaatcaccaaaataagtctaattaacacttatcactatacatagttacaaaacattttatcttgtgaaagaactttttaagatcaaatttctcagcaattttcaaatatgcagtacagtattattaaccacagacaccatgatgtacattacatctccatgccatatttattttataactggaaatttgaaacttctgccctccttcatccgtttcactcatcccccacccgctgactcgcaaccaccggtctgtgctctgtgtcgagtttgtttgttgttttttatatgccacatgtaagtgacatcatgtttctctatgttcttgattttaacgaggtacatggttttctcctaccattgaaaattcaaatatctcatcataaatttcagcaagcatttataacttcttgaactacttacaaaggtaaaagactattctagcacacattttctctgcctttaattaacccactaaagaaagaaaatggaacattttaacagtccagtaaagaaaatggaacattaatgtgaacatgagagtaagaatttgtgaacacttaggaaaagactctggataaatgagtttttctctaagggttcacaattcttactgactatcatgttcattggataaatgatccaataacaagcggattatgaatgtacctcagactactgattgactgggaatacactattgtattctcagaatacactactggggacaatgggttccaaaggaaaaataactaacattggttaaatatctacagcttgaaaaatcgcttttacttagaccatctcccctaattgaaagatggtagagagaaggagagaaggaatgcttatgagagtcagggatgtacagacacattgcaagcaccatctaggtaccatctcaggtgtcaccagtgtctcacaatgatcctgagtgtttttggctttgataatctctcagagcctcagagtctttaagtgacttattggctctgattattactggtgtataagaatttgcccccaaatgtaggagtttaaaaaactctctctctcttcagatttgttggtcaggaatttggaagacaatggctagtgtttctcatggtctctgaggtggtagcagccagatggcagtggggcctgaggtcctttg

SEQ ID NO: 58473 - DNA, 1460 bp, Bovine  19866881248547
ctgtgcagtgactcattctctccttgggtcaatgagaggggatgagaatgcaggacacgttttttaaatcccaagatgatcttgtcttgtttttttttcccataaccagtattgattttctactacttatgtaagtcaacacatttatcttgtcagaaaaaggtaacaccagcgaagtaccttttatgaaaaggggattatgtttctcaaaattttttcaataattacttatgcatgtaccagtgatatgattttcttttaggaagattagacttagtgttttgttttttgtttttgtttttgttttctgaagaaatatttagttataagaaaaggtattagttttatttttacttatggtaaagctgtaagtattaattataaaaaaacatgtcctttggcagtgatgatttctgtgtggaaagctattatttatggtttatcattctaactggttttaaaatggtgaaaataataagtttgacatctgttctgctgtttttgtacttagtggttcaggaaagtacaccatccccagggctctgctgggtgtgagcacaggcacttttctcttttgtaaaatgtgagttataaaatctcctttctcacaaggttgttctatgaatttaatgagttgatatacccaaaacacctagctattgcctgatacacagtaaccatacactgaatagtttagacacgtgaagaagctacagaacccaccgtgaggccacatgatattgatgaaaactctgtctttgagtcagacttgtagggattcaaattctggtgctgtcatgtatcagctgtgtgatcttgggaacatcaccttgctgtctgatccttggcttaatcttagtaacttgatcaccccctgtttttctctaagctgtagcttttttcatctctaaattaccaatagtcattcctctttcattggactgatgtgatggttatgggggatattgtgtagaaaatatatgggaaaacatcacatgtaaggtttgtttgacagttgctggggatgcttacataagccagcctctcctttactgccggccagattcacttccatcctgacagatatgactgtagttatttctgatagcttattcatttctcacagtctgttgcacctacaagtctctaaatattagatcatttttgcaacggggtatagattttagaacaagtcagaatcaaaattatgaagccattagttatataatggtgattgtcatcttgttttatataagcagcagaggctttattctaaagtacataaaacataactcctaagtgagtaagtcttagcttacttctcattcaagggcaatcttgggaccctttcagcagctgtgaaaactgactcatttaagacaacttggtagcctacctccagcaagtgtacagtgccatctccctgagcgttgttgtggcagtgaatcaaatgtgaatca

SEQ ID NO: 58474 - DNA, 1307 bp, Bovine  19866881349171
caaatcagcttctgcaagagaaacatgtaaattttaaaggataatactgcttttctggaaaataattattttaaagttgcaattttatgtaactgaacgatttatttatttcatattcttccaaaattgagttctatcaagtatcacacatatccatgaagaaaatgagatttattatagcaaagacttttttatttaccctatcatttgagagagaatatctgactgcaaacatgcctatgcaaattaatttgcttttcatgtgttttcctagatactattatctgaaactgagatcagaatcatttctatgcataattttgggccacataattattttgaaaaggttaggtacatttcaaatacaatttttgcaaacaaagtgacactgtcattgtgtgtagaaattttatctttctaggcttgttttaattcatattttacttgggtgattaagtaaaaagattttgtgtttcaaagaacattgtcttgtggttttattttacaaactacatttttaaattaaagcacaacagatggaagcttcgttgcttaaacaagcatctatactctaatgcaaaaactcagaattaaagttttgacaaataacttaggaatcttccaaaaaatcttgattttcttcttagccacaatgtactcacattgacagatttttctttctacaataaaatgaagcaagagattcctaatatctgcatccaacctatctttacttccttctaatgtaagggcaaaaccatatgtctcttcagcttcaaatgattattcaacctatcagctatgtcacagattttaacagatgctggtggtagaatttttgttccagtttctcaatcaattttactataatccatgaaagataggctctgaagtcccaggaagccaggagcatgcagaaacaatgctggtgaggggtgggctctcaagagtcaagaactgcagatccaggaaccacctactccattatgagaacactttccatgtttcagatatgagtgtaaataagcccatacggtctccaaggaacagaaatacaaacgtggcactatctactaacacacagtgaagtaaattgtaacccacccttttactcagtattccagctgaatgagcttcaaagcccaaagtattccagctgaatggttgttcaaagaaaacaaccagaatcttttcttagctgattcagtctaaaatttagactttgccgataatttttctttggctgataatgaaaatgctggcatatttcccagcctgaatagttatctataaataaataaagtccc

SEQ ID NO: 58475 - DNA, 963 bp, Bovine  19866881445043
cagatgcccttttccttggtccccgcccactaaacacctctattcatcaaagcaaccaaaacatctctagcataatagtgtcactcccagttgagactctcttggtacatggaaaggctgtcacaaatggctaactcctcgaatgattaagaatgtacttctccctttcttttgtaagtctgccataaacaataaaggagagacgtttgctattagaaaaacaccagtttagaagaggcgctatagtgtttcgttatgagaaaaatctgttttgaaagtgtggtttctctttggggaaatttcatttattgaactctaaattgagggcaaaaattgcatgttattgagaagatttactgtgtggatttaatgagataaaatacatgaggtctttggcactgtcctaccacatgaaaaatactcaataaatgacaagaattattatttttgatgttgctgctatattgttgctcataattcttaatgacaatactgcattcagaaattaaattatcctcatggtgacctagaaatgcaaagtccaaacatccaggattcagcagttttcaaataaactctgtgaccaccagttttacagtcaacattgaaatgttcgtcaggtgtatcttgaaatgtttgaaattaaactggaaatctacaaaaatcttaaaaaaaatgcaaggaacttgtcagagagctgcctccaattcaaactatattttcctgacaaagaggatctcagtcattgtcgtctctttttgttttttctttatccttttggtaacttcaaataattgtgtttatctttccaggtagcatttgtggcagcaattcaggcaccctggagagtggtttaaagatgaggaatcccagacacatttactttccatctcctggagtaataggcatgaaaattttacagcatttcttgtcaactttccccctaacctgcaacactttctc

SEQ ID NO: 58476 - DNA, 1017 bp, Bovine  19866881478334
gttaggtttaaacatatgaattttgggagggatgtatttagactactcagccttctctcataaggtatatagtttgctttgtaccattatacactgatctgctttccaagactgctgagtgaaaattctcaccttgcaaatactcaatatccacatattctgttaatcacagatagagtctctactgaggtattctgggaacatgaagatcaacatttgttttcctagctttacttcaattagtattgaaaacctgaggaaagcatgcttgagtccttaattcttttagaaaaaaaaatgcaccaagccagattcatttgccagaaggcataatatcccttgaacttagcctgatcaaagaatgagtcatctaactagagataatacccagtgtggtgcttcataaacaagatgcattaaggaaaaaaaatagcccaaatgtcatttgctagtataaatcttattgtttctttcatggaagagactgtgcaaattgttttaactggccacgattttatcaagatgctttcagaaaaaaaatgaataaattaaaattttaaaagttaaaacaatagacattatggagctgtttcaaattcctatgatagtaaagctaggactgttgcttcatagaatataaatgaataaatcatttatgatttattcaaggatacctaggaattagttctgggactgacaactgatcttaatttattcttgacaattcactttgtgaatgtcctccttttccttgctttcctgcccctttgtcaggatctaggtaccatcatttgacaggcgttaaaggccacagggctcagctgtctccaggaagcaaatctctgagctggaaagcagaggtgcagcaagcataactctttctttgcagaacaagcacaatctatttccttccagccagcaggaaagcaggaacagatgcttccctcatctccactcaagtgaaagaaacatttgttctttctctatttcctaggatttaccaactcttaaaatccg

SEQ ID NO: 58477 - DNA, 1482 bp, Bovine  19866881492286
ttacttttctgtatttccttatttttcttcaaaacaacttaaatcactattaatcttgaacaaagacatggtttgatttcatgttcttactgtagtacgtttcatctggaatgtagaattgtggtgggcccttcatgcctgtggctaagagacacttgaccagatgttccagggataactcataaattactgcttatacaacatgaaatacactgacatgagattgacatcaaagagtgggtccccactgaaatcatggttgctgatattaaagttgaactctcagattatgtctttgtagaaaaattaaaatcgaggaggatcgtaaactcctgcatttgcagtaaaccagcctgaataaacaagcaatgacagttgcaggtaggaggtatacttcgcgtttgttggaatggatatgtagccaatttatctaggagttagcataaggtctctatgttcttttttatagtcttaagtagatcatttctttatggtattgaattcttcatctaaaatatctgagatcatcctggatataagataccttaattaaagaaaaagaatttatcttataataaaataggctctctgtgaatcacttcttacaaacaaggctgcaagctcttttctttgaaaatattaactcattcttcctgtgaccaaaaaacatcaaaacacagcacttttaaaaaatctagtatcaaaaatttaatcaagttatgttattctatccttttataaagcaacagtattctatatatcgggtagtagtcacacacacacacactcacaaactgggttggatacacagtaagatagaaagcctttactttctttgaagtaaagaaaccagggcttatgctcattggatttgtcacattctctgaatgtccttggacaaagtatctatttctctgagcctcaatatcctcatagaaaatggggatgatggcaatgatctcttttccataggaatttggtgtgggcttaatggataacttgaatttgtcctgtaaatagaaaaacattctaccaaggttatctttccctcaatgagtagaagcaatacttaacaacccagaaaagtcaaggagaatggaatttatataccctgaagatgatatgcagattaattttaactgctaaatgactcgaactgggtgctgttgtgcttttagaaccatccctactctcttcaacttgcactctaggcttcccacggtagtagcaagagtctgtcactagcctgtttaaaaatcccaaaaagtaacctttaagagttgaaaataaatccattcagagttctttatttcaacaacttattcactgtcattttgaaccaaagcagtctgtgagctgttcttgcaggttaaaggaagtagacaatgagcatctgcttgtaaggtgcttacagaattatttagcagacagagcatatgaaaagacaatccattcaccataatgaaagggttgcaaattaag

SEQ ID NO: 58478 - DNA, 652 bp, Bovine  19866881726624
tgtatatgaaaaatgatcttaattctttggcttttatggtcacttgtttttaattgccatcgtctttttcttttttcttctgccacaccttgcaacttgcaggatcttagttcctctaccagggactgaatctgggcccttggcagtgaaagcacagaatcctaactactggactgccagggaattccctatgttcacttatttttgacactttttaataaaaatatgttcaaattctgtatattttcactacaattacattttgtgttttaatcctttagatcaagagttggcaaactttttcttaaaggactagagagtaaatatttcaggcttataggctatatggtctctgtcacaactcttcaactctaacactgtaacatgaaaacagccatggacaacatgtaaaaaatgagtctggctgaatgccaataaaactctatttacaaaaacaggcaacagacctgcagatcatattttgccaacctctgctttagatcattagatcattactgttagtagaatacaaatttgtgaaaaccttgataataacataattatttaattttgttgagatgaaagccaaaacaatatggaataaatatataataacttatgaattggggtgtaccttgattttattattcat

SEQ ID NO: 58479 - DNA, 718 bp, Bovine  19866882019848
attctttactgtgtacaataaatctcagctttctatcccatcagtaaactaaagaagctggcagaagataatgtagtattttcatgagagaaaagattcttgttaacctatattcttatgcttctgtaaaactttgtggctttctttggttattgctgctattgaaaggatagtatcttccacttaacgcaagagacttggtggtgtttttgtcttctttatcctgatgaaatctgatgtatgcattgactgaatagtgactataaaagctgacttgccctagtgaggatgagcaaaaataaatggagctgtcgaaagcagtaaagcaaatatctagcatctttaatgtagcttaatttgacactgtggttaaattcaaaattgctttgctctgagcagtctttcttcccgccttctccacctcccttttaccctccattctcaataggaagcatcccagacatagctgggaataaagtgattctaattagatggtacttccccgacctaaatcgtctttggcttttgtatatgaaatgttattgcacagctctctcttcacatcacaaggaaatatgaacaagtccccttccttttcttgttctctgagaatagcgatgtgctaaagacagaagtgctcagtactgtcagcttgctgaatcagattctgtgagagtctgtggccagccacacgcactgccactatttccttcccagt

SEQ ID NO: 58480 - DNA, 1384 bp, Bovine  19866880366024
cagtaattagaatactgatcacaaatcacaagtgattttcttaatttctggaaagtttaccaaaaaggttttaagagtatttgccaaatgatcaaagatgtttgattacatccattactcttttacttagacaccttacataatcttatatgttctgtaaatgttggaaagcttaacctgattgaactttgatagcatattttcataaaatgcattaatcttattgaagtcctttagtacatttaaaaaaatctttgatgctacagattttcagttcagttcactcactcagtcatgtctgactctttgcgaccccatgaaccacagcacgccaggcctccctgtccatcaccaactcctggagtccacccaaacccctgtccattgagtcggtgatgccatccaaccatctcatcctctgtcatccccttctcctcctgccctcagtctttcccagcatcagggtcttttccaatgagtcagctcttctcatcaggtggccaaagtattggagtttcagcttcagcatcagtccttccaatgaatatttaggactgatttcctttaggatggactggttggatctccttgcagcccaagggactctcaagagtcttctccaacaccacagttcaaaagcatcaattctttggcactcagctttctctagagtccaactctcacatccatacatgactactggaaaaaccatagccttgactagacagacctttgttgacaaagtaatctctctgctttttaacgtgctgtctaggttggtcataactttccttccaaggagcaagcgtcttttaatttcatggctgcagtcaccatgtgcagtgatattggagccccctcccccccaaataaagtcagccactgtttccactgttttcccatctatttgccacgaagtgatgggactagatgccatgctcttagttttctgaatgttttaagccaactttttcactctcctctttcactctcccaaaaggctttttagttcttcttcactttctaccataagggtgtgtcatctgcatatctgaggttattgatatttctcccggcaatcttgattccagcttgtgcttcttctagtccagcatttcatcatgatgtactctgcatataagttaaataagcagggtgacaatatacagtgttgacatactcctttttctgtttggaaccagtctgttgttccatgtccagttctaactgttacttcttgacctgcatacagatttctcaagaggcaggtcaggtggtctggtattctgatctctttcagaattttccacagtttattgtgatccacacagtcaaaggctttggtatagtcaataaagcagaaatagatattttttctgaaact

SEQ ID NO: 58481 - DNA, 1156 bp, Bovine  19866880482615
tagggagaagtgccagtggtttctgccagggttggggagcaggaggggggtttggaggaggcaggagctttggaggtggtggttttgggggtcatggctttggaggtggtggctatggaggaggtggtcttgggggtgctgggtttaggggtggcaatttggggcttgggggctttggtccttcttgtcccccagggggtatccaagaagtgaccattaaccagagcctcttacaaccacttcacctggaggtggaccctgaaattcagagggttaagatgcaggagcgggagcagatcatggttctgaacaacaagtttgcctcgttcattgacaaggtgagtgccccaggggcaggcagtctctgggctctgacctaatgaccttgtaccctgccgcctctcaacacgttgtttctggtgatgacagtcatttccagtgtgtgtgtcctgggaccttaagaaagcattgacttcatttaggcctcaatttgacttcttgaggggttcatctttatcttttcattttggcaggaaagcagatccaaggaatgaaaataacaatcagacaaaatacatgatgtgatctcgctcatcattttcactttccatccacccatccatccatccattcatccatccacccatctatccatttactcattcatccatatacctcttcacccatctacccattcacccacccattcacccatccatccatccacctgcccacctacataatcatccagcccacaaacatttactaagcatctactgtatgccagacactccaggtgtttcagggtgacaaggacacaggtcctgccctcaaggagccccagatctacagggaggaggattgtgacagtgtgtgggaggtgtgttgatagggacatcgctctctgggccatagcacaaaggagggtgtgatgagctctgggctgataaaggtcttgaaggtggagaaagagccaagcaggttctcagggcagagggagtttccaggcagaagaaccaggaggcctgagagtttgatgcttttaggaaatttcaaatggttacaatttctggagaacatggcacaagagaggaaggaggaggaaagtggagatggagacacagagcagggagagagaagaaaagtgggcacactg

SEQ ID NO: 58482 - DNA, 828 bp, Bovine  19866880677473
ttgtgcaatctcctcgtactggatcctcacggcatcaatgatgctgtccagatccagggagcggttattgtccatggacaggatgacgttggtgtcggtgatgttggtctgcatctgagacagttcctgcaaggcatggaacacaggctgacttcttccactcccctcctgggacctcagtttccctctatgccccccaaccaaggctgtctggggaagccttgagagagaaaagctctctgggaaaagctcttagaatcactgttgtgtgcccagagggaccttcactaaaggtacaggcatccggatctaggctcagagaagaagggagcctgaactcagagctgcccatcatgcctttcctggaccctccatccctccttactctggcttggctgccatcttgagctggacccccagccaggcaggcttgttccttgagatcacgtgagctcccagaggcagcagaaaggactccatgtgtgtagacgttcagactaattttagcatctgggctccactgttaaccagctgggtaactgagcaaggaactcagtctctcagtacccctgttctctcatctatagactggagatacccaagaaccagtacagctcccaggacagcatccagtccagagaaggtgtctccaagttagaccagggttgggaggagtgtgttatccccacctctccagtcttcatctgtgttccctttaagacccacactgccctctcccacagagttccctgatggccccatctactccccagtgctgatgaagctgtctggttggttttaccccatatgtcctgggcattaaccttc

SEQ ID NO: 58483 - DNA, 1812 bp, Bovine  19866880725921
catctgctggattcagtgtgggttccctaggaagtactgtgacctcatccatctcctggttgaaggttgtaccttgaaggggttgacatttctggtgtttctacaataaattttctgtgctctccaaactgctgtttgatcacacgagtttactctttttttactttctgcaggcttctgaaattattcataattgaaaagtttacagcttttattagttttttattgcatgagtaatagttgaccctcaaaaaccttgcacacataatcataaaattaaaccttaaagtggatgatctttgaaaagtcagttacatgtttgttcaggaggaatttgttctgctcccatcgtgtggcaggcagtggcctatgcactggggatgtgatgttgaatgaacacatttcggaatctgaaggcactcacaacacaaacggggagggtacagtgggagatgaaatcggagtgtgggcccctatggacccttggcctgagggtggaagcaaggccatattgaggacagaggcagacccactgagcaggagcagtgggggtcgcaagaagtgcacatgctggggaagggaagttcggtcccaacaggctcttgaaggaaagtagaacaaatggggaaacagagtcagagcagctgtggacatggagtcagggaggggccctccagacaggggaatgatctgctcagagtcttgaagatcagaaagtgtgaaagtgtgtgtgagtgacaggggacagccaggtaggagaaactgaactggagagagaagaagctgaggccattaactcagcagagtttatggtcaggggtgtctttaactgatgtcctccagggaggcagagatgcagaaattcaagggtggagcaggttaagccatcaccttatcctctgtggtatttctgagtctgtgtaaaggagtcacgtaaaagatgtgacctgctttctcattctctgaaggaatacagatggaatttggatatgggattcattcaaatagaactgcaactccttttgatgagacatcgtgttcccatgtgtaggcctacattgtcttggaggagtttctccccatctcacctgtcttggaagcaggcctgtggggcaagaactgggaaagggaaatggggcaagaactgggaaagggaaatgggaggggctgcccaaggggagggataaagggagcagacaaatacaatttctacacttaaaagtcaaaagagcacaaagaccaggatgggaagacatggacaaacagcagtgagtagaaacatgcttgaaagtattcagctgagactgcacacgagagagtaaggtgcacaggcttcgaggccaggcatgggaaccagcaagagtgtgatgtgtagagcctcctttttcatctgtagaaagagcctagaagagacgaccaagatggacaggtgggaatgcagcgatttggctcaatattagaagtatcttttaattaatcctgacatgagagaggccacgtggatttagcacattgtaagcagaggttggctaactatttggcaagaggttgagggagggagtgaaggatgggtggggttgtgtgcatagcagcattgcatgtctttgttgccctaagagtttgtgcaatgaagcctgagaaaaaaggaattctactctctattttatagttgggaaacttgaggtcagatgccaaggaaggaccaagtcatggagaggtcaagagctctctaaccaggacggttttctggcatcaccagacctatttcagggtgtggatttgattatccctgggatcagcacatgtgtagga

SEQ ID NO: 58484 - DNA, 1260 bp, Bovine  19866880792892
tgatagttgttagatctccagatttctcaccagggttaagagttaaatcgtagcttcccaaagatgcccctggaggacagctggcatgaaggcaggaggaagaggctggagactgagaagtttagagaaaaggctaacagaagaggcaggaggtgtccagaatgacatgagagtcagtgggtacctggaccaaagaggtggacctctgagagttaagaattagctggattgaatataagctgggcaaaccaagcgtagggcatggggggagcagtctctgcaatattgtccccagtggggagggagttgactgtgactgggtcccccaagccaacctgctgttccaagaagagctgcacctgtcctggggaaaggcggcctcctctggcccaggccctagctgtgcctgcgggttgctgaccctgctctcccctctgctctccccgcgcagccatcatcagcagcaccagcggcagcggcggctatggcttccggcccagctcggtcagcggaggctacgtggccaacagcggcagctgcatctctggagtgtgcagtgtccgtggcggggagagccggagccggagcagcaccaccgactacaaggatgccttggggaagggctccagcctgagtgccccctccaagaaagccagtcggtagagtccgctgccctcccgccatccctgcgtccccgctctggctcgcacacttgcgctctccccagcccattgtcagccccacccccaccccgcccagcctgctcttgtacctccggtgctggccttggccgctcacttctccagactgtgtcttactgaacctggacaggtgtggacaactaagcttggtgaaattcctccttgcacatgctggagtttgcctccttggctgtggtccctgaaccatgccatgggctcccagccttttgtcctctgcacagcctttgactcagttgctgattactctgtctggctccgtgggtctcagacccaggccctcttctcacactggggcctttgtcccagctcctgcttgtggtaggagagggctctgtgttcagttaaaagagggctgaaggacagacgaccaaacgagaccatccccaccccaccctgtctggctcacgactcattctgagtggaccgagtacaactcagggactcttcttcattctatcctgcacccacaagcagggaagaggaggccccttcatttctcctttccccttaaagaccctcccactgcatcctcaataaa

SEQ ID NO: 58485 - DNA, 888 bp, Bovine  19866880799887
ttatggcggtggtggctttgggggtggcggtttcggtggtggtggctttggggcaggcggttttggagttggtggcattgggggtggctttgggggtggtggttttggcggaggtggttttggtgggggcggttttcctgtctgccctggtggcatacaggaagtcaccatcaaccagagccttctgcaacccctcaatgtggaaattgatcctgagatccaaaaaataaagagtcgagaaagggagcagatcaagtccctcaacaaccagtttgcctccttcatcgacaaggtgagtctatcggcacagtccaccaggacagctgctcctgttccatgtgggattggtcctgcccaggcgtgtttgagtttgagcctcaggtttctgtggttggatggttaaaaggatagtttgtggagttgtcttcaggagatacattagaagtatgtttgcagtgattctggtgactaacttctctcctgggcaaaaaggtctgtggtccacataaaggaaggtcaatttgacctcaccatgaagtgctttttttttttttttaattcaactcctgagctgaatttggcctcatagatgtttaataaagataatagaaatgaggttaattcaaccttctagcatgcaaacagagctctggaaaggccttcctaaccataaaaaggaacttacttgagtataaacagagcacatggtgatattgtagccaaaagtgtacagtaagtcaaggtcaagcatctcttgctgtcggaagaggaggaccgcaccctgaggattttccattcatactgaccagggtggggaactttttgtgcttgtatttccaagtatctgctctagaaaagaatgtaaattattttttacttatcatcaat

SEQ ID NO: 58486 - DNA, 1123 bp, Bovine  19866880827049
gggacagcatgagaagggaggaaaactggaaagttgatcactgaaacatgaaattcagatgtctccatcttcaaactctgccccctccaggtgcggttcctggagcagcagaacaaggtcctggacaccaagtgggccctgctgcaggagcagggcaccaagactgtgaggcagaacctggagcctttgttagagcagtacatcaacaacctcaggagacagctggatggtatcgttggggagagaggccgcctggactcagagctcaggaatatgcaggacttggtggaggacttcaagaacaagtgagctggggtagaatggagacagggcgggtctctgtaccagatatactttataaccagaccactgcttatgccttgcccaaggactgaaaacagatacatttttcatggacatctaaagtgctgggaaaacatcaggtccatgtttagaaagttctagctgcaagctcagtccctctgcaaaatacttagccttcagccagagtaacaagctcagtgtccttggcatggcctggtgaaaagagcagttgtgtaatccttgctttgggggaccctcctccccaatacactccaagtacatgacatggactttttgatggattcccctcaaagcaggaactgatgatgtaacctaggttgggctaagtactaaacaatttctttagtccttatgaaccagcagctgggctgctaattttttgtttttcaaaggccatgaaagctgaaaaataaagcactagagaaagggactagatgtggaatttgaatgaagctgtatagtttttctacaggaatgttcctgaagcaaccgtattacagcattaatagaatagctatctgctaagcaattacagagaaaacagtatcctaatgggtagggagcttgccccagaggttcttgctcctggtgtccctccctctctgtccatatgatgtgagaggcctcttccagggagaaggtaggctcacagttgactatgtgcagtacaggccctgggtctcatcctctgataagcacttcccattcctttttaccaccaggtatgaagatgaaatcaacaagcgtaccactgccgagaatgagtttgtgatgctga

SEQ ID NO: 58487 - DNA, 515 bp, Bovine  19866880949056
acaacaaccgtgacctgaacctggacagcattattgacgaggtccgcgcccagtatgaggacattgccctgaagagcaaggctgaggctgaggcactgtaccagaccaaggtgagctggctgaagctaggccggggagggtgacccccttagacaggaggactgggccggatcattctcagagtggagacaatatccagttaagtgtccagcatggcctgtccccatcacattaccaaccccagccaccatgcactcccacaacacactcatcacccctaaccatggctcttttctttgggtccccagttccaggagttgcagctggcagccggccggcatggggacgacctcaaaaacaccaagaatgagatctcggagctcacccggctcatccagagaatccgctcagagattgagaatgtgaagaagcaggtgagatggctggttgcctttgcctggggcagacgggcacaattggtggggggtgggggcggaggtgatgaatgggctgag

SEQ ID NO: 58488 - DNA, 1437 bp, Bovine  19866880963701
ttaaggcctcagactgactgctccttctactcatttgtctgtgggaaggggctaatgatttgcgtccagagtcaagataatcgagcccttgctccatcagaccctcaataaccacaggctggtaattgttccaccgtggtgtggactggcttcttcccctggtcctgccaggtgcacacctctccacggtggcacggggcaagtcacaagtgacaatgaggtagcagaggctcttgccacacccccttgtctcaaagcctcaccatggcaatgtgtttatgtaccataaggccaagagagatcactgaagagaaggcagccaaaaacagggcactcccctggagcccataggggtttctctaatcccaaacacacctttgcagttagcagagtgtgaattggagacactcaaatgttaacctgttgattggagtgatttcaactacaggaccatctcctgcttccctcagggacatagagttggtgcactatatgtcccttccacgtgcccagaacgttcttcaagctcactaggtgtagaacaaaaggaaatcaactgtgctgacaacaggagaaattaaagctgacaccaaaagggactaatcaacagcctcattgcacacagagtagagaggaggagaataggaatgtataggttgttggatccagaaagctaaaccagggaactgcccccgcccttgacacacccctctcaccttccaaatagtttgaggttaattaaggacctataacttagaggatggggcaagaacagcctcacctcaatccttgtctcatgcacaccctgccatgaaccatccaagatcaaggactgaacttcagtgtcttcttaactgaacaaagatgttctccagatcacctgtcagatcagctcagaccaagaccaaacttttatactctttaaacagttggtcaaaatattttggaagttgactctgaaacttagggaagaaaaagaaaggaaattgaatatggagtcttgggaaggtgatagggaaacatggaatgagtctcaaggttggaagtggttccaaccagggtttgactcttctgaagcacgcctgcctggagaaaggccagtctactcaagtatgtccagtggaggttaactcatcatcacaggacagcccctaccaccatcagacaactggacctcagtgaatgtccttcagagtgacttttatcccttccaagcaagaacagccctgactttctactctgcaacagtggtgtggtccatcttcagtgagagtgaccttcacacacacaccttcagtcacctttgattaagtctcttctctgcccctgttcttgcccctgagctcacactagctcttcggtgggtcatttgggctttccaaatgctcagactgaatcaacacccaagttcagtcactcagaagtgtccaactcttt

SEQ ID NO: 58489 - DNA, 1240 bp, Bovine  19866881101967
agaaagccgtattgagggtttttattaccaacctgcttcccttggtgggcaaaagataggaagttaattgtcttttagggcaaggacagggcacctggtgggatgtgggtgataatgaccaatggctctgggtgcctctcggcaggatgcagatgcagcctacacagtcaaggtggagctccaggccaaagtggactctctggacaaagatatcaagttccttaagtgtctgtatgatgcggtgaggacaccccccctcccctcccccacctctttccagctgagagattccctggctcttccagggagatgctaataagaatgactgaggataaacagaattaagggtgttttgatgggaaggtgcaaaaccctgcactgggaggccatggaagtataggatcctggtccctggaagccatattcacaggaaaaaaatctcactggggctgtgataatgaccttggcagtaggcaggtaaaaatggccccatgaggtcctagatgcctgatactgtgaattgcaagaaatgcctcccatggcctgctacccacatggggtgtatcctgatgtgtgagccttttcctcagctccagcaggcatttcttcctccactttggcccattctgccaggcaccacaggcccagaagtctgatgggcagaggagggaggtgggggaaggaccctgactctgtcctcacctctcaactcaggaggtggcccagatccagactcacaccagtgagacctctgtcatcctgtccatggacaacaaccgttacctggacttggacagcatcattgccgaggtccgagcccagtatgaggacatcgccctgaagagcaaggctgaggctgaggcgctgtaccagagcaaggtgaggactgattgggtctctctcctccaccagccttcctttcctgggaagggacacctccaccaatggatgtgagacatcccttaggagatgtgttgaatgaaagaagggttataatcaatgccatagcgacattctactcaaaaagaattcttggcaaaaatcgttatcaaagataagccataaaactgggtaggcatttccaacagagagggacaggccatcctctgatggaggaacgaagcgaggtgctcttgctgtaaaatagggattaggtcatgtcaccatggggaagaaggagagtaacaaatatggaggagagtagctatgggtgacctgtagtgggacagggagaaagaag

SEQ ID NO: 58490 - DNA, 1176 bp, Bovine  19866881125881
gacagggacgagcgatagggccctgagggctcttgagccgacagagtctgagcccacgtgtttgaggaagcagaatctagctgatataggagttgggtgggggaggctggaggtgctgagaaaggggcaggtggttctcggagcaaataattgtctccagaattaaggagaatgagctgggctattttggagaaggcaatggcactccactcaagtacaattgcctggaaaatcccatggacagaggagcctggtaggctgcagtccatggggctgcatagagtcggatacgactgaagcaacttagcagcagcagagagctgggctatttggatgacgtcagctctggtcctgccagccctgctcagcagacggactcaggcaaagagcatgttgtctgtgaatcctgcacaagtaccccctttatccccctacatcctcctatagtttcaggcaggcagggcactcagtcccaagcctgacagttagagcacagttcctgggggacttggccatggtcagagccatccatctgggggcaggacagctgtttagcaggtttgcagctggcaaggccgaaagtgagttcatgccagaggagccggggtataaaagccaaggaagactgtcctcccaaacacttggctctgctcccaccctgctgtttggttgccagagaggtgccttccagggctgccccatccccctcatttcctccttgctcaactccgtgggcaagaccatctcctttgagctttgctggtcatctcctttctctagcccaccccaagcctctggcaaggtatgtgggctcaggactctgtgcatccaggccctggtcctgccatgtgaccacgggtaggtctcccaacttcctaatcctctgtttctacatctctaaaacagggggtactaatacctgctccgcctgctccccaaggtggatgggaggcatcttgtaaataataatgatgatggtaatgatcctggcgaacacacagcacgggctctgcaggacactgctctaagcactacatacatattaactcatttaattctcacttcagtcctgtgaggcaggtactgttattatccccattttacagatgaagatactgaagcgcaggaagttaagtaaatatttggaagttgcacagctagtgagtagttgcacca

SEQ ID NO: 58491 - DNA, 1679 bp, Bovine  19866881136274
tgtctcaagccaagttttctcctcttctggagtctagtcaatgaagcctatcgcagacccacattctttggttcctggaaggcccaaccccccagtctctagcctggtgtgtcctgattttatgctctgctcccaagcagcctttgagtctctatagcctggtcctcggtgacagaagaatccaatgttttccagtatctaaaccatcaaaacagagtcctcaccccaatcccatctggtctgactatctccagattgtgttcaataaaatgctttcataatataagctgttgggaagaactgttttttcaagatctacacccaacctagagattcactgagggtccatctgtccagatgtggttggttcctttgattcatagggggacagaatggccttgaaaggaaggtgaccgctgtgggtggtacagagactccaggaggcacgaggtgtggatgctaaagcctctacgatgaaggggtctctggagggcgtgaaggggaagcttccctgacttgtagcttgtatagattgtagagctgtttgttggaggggggcccattcaaggtgggccgattttgcaaattggcttaagtcaaatttgtaaataaggaatttgttgtcttgaagcctccaaaaggcatagagataccttttatagatgttagtcctgttctaataatgtgggtgcttacagggtcagtagcttatagttccttaatagtgtcagggatgtaggggcccttggattagcaaataatttcaggaatttaatggaggtggccagaatttgcactatgtgtgggatcacggcccatcctctttccataagcttgtcttaactgatcctgaatgagggtgtttaatgaatctcttcgaacaggaattcatgggtgcaatgtcatgcctgtgcttctggtatgcatttaagatcttgcctgcaaagacaatgtgtgatggcagggtggctgaggtaccccatcacacgtggggggagatggattgtgctccttcagagatgaaagcactgtgacaaagaggctgttgcaatgggcactgaacagaacatttatcagccaaatcctcaagagtgaaatatttaccgcttgctgtttgaacagagccaacaatttcagaaatattgggtagggaccttaacaggtatgacaatggcattaggattttggtaacccactgtgaggcatctttattctttccaggtttaaaaataggccaaactgagttgttgaatggagaaacagtgggcataatcaccccttctctaaatatattccctataatgggtttcaattttgaaggccctgttttcgtttacactggagcatattaactatacccaaaagtccatgaagtcctattgttacaagccaattttcaagtgtcaggacttaatttaattttagtgtgttgctcattggatcagagtgtccatgactactgtgagatatattgggggcggggggcaacgagtggtaagatcatgtgaaattgaggcaagtcagtagttctgataattatggtgaggcatacttgtttgctctcactttggtgttcaatgacttcttcaagattacaggggaaccttgtttaaacttagtgagattaccagtgagataattgagctccagtatgggattaaggccatgaagatggccaa

SEQ ID NO: 58492 - DNA, 1720 bp, Bovine  19866881158433
ttggaaggctgtgtgggtgcaggaaggagagccggctcagctcttctgggtttggcaattctatcactgggcagagttgacctgccagggtcaattggggaaggattccctacccccttaaaatcatctccccaaagatatgatgtttttctgctttcagacaagacagggtcccccagcagacaacccagagcatcttcatctgccatcatcctcactggtcacccagagacagcagtgagaggaggaccttaactggccactgagggtcccaaggagaggcccccccagccctacatgcgctgagtgtccagtgggaggaagaggtgtggggcctgcccttggagcggcatacctgaaggggacatggggcaggtttactgcacacagaaaaggcctgcgaaagatggaaaaaagaaaggaaacctaaattctaatcctaataaccagctggacaccctgggagagccccttcctctctccagcccagattccttatctgatctgtgagagtccggtgaaataagtacaaggcccctccagttctgagcagggagccagctctgagtgtacgggtcccaaggtatggcgaggaagagggaccatcaatggtccagagagtcccaagttggaaaggggacatctgcttttcactcaaggatgggctccagtctctccctcacagagggtgaagcccgacctcagggctctctgtgggcttgctgcccacctgcttcttcacatttgcaatctcacagcggatcctctggatgagccggttcagttccgacatctcattcttggtgtgtttcaggtcgtccccgtgccggccagctgccagctgcagctcctggatctggtttccagagacaggaagttggtgatgagacaggacaccccctatatccctcaccaccccaggcaaagaaagtgtcctgagcaaacccttccaccactggagcaacccaggggagatagctctgcggcaggaggtgatagagccatgacctgggttatccttccagctgtttggagctgattctgaccaagaagtccacctgtttctctaagcagaaatctatttgctgggcctatcctcctttctcatctccctgactaatcttttctgggggaggataaagggaaaatgcagtttgcatgtattaagcacttccaaagtaaatagggcttccctggtggctcagttggtaaagaatccacctgcaatgcaggagaccgggtttgatccctgggtaaggaaaatcccttggagaagggaatgactacccaatctcatattcttgcctgaaacattccatggacagaggagcctggagggccacatacagtccatggggtatcaaagagtcggacatgactgagtgactaacactttcactttccaaaatagaagaattctgaacctctccattgatttagcacctctttatagagggatcttttaaaggccaggttctgttctaggtactggggatacacacctgagcagtgtgggtgaggtccctggtcccatgaaatttacatgggacctacaaaatttacatgggacctacaaaattcccctacaatccttccttagtgacgggtgaagggccaaggctaaggaccgcatgcatgtaccctggaggtggtgggattgccggctcaggacttgtagctcagatcctcccctcaccctggccagtccttcagaaaagag

SEQ ID NO: 58493 - DNA, 1580 bp, Bovine  19866881301743
gctgagctctactctcactcactttgtattctcagcataggctggccaaataaatcactttgcaaggaactgagtggtgctgaatttatcaggctgcagaatgcactatttttcatccaccaatgtctaaacacaagacagtgaagctaaagctaaggaaggacttgccaatgccagaaagggctctaactagaagggaggaacagggaggtctgacaggtggaggtgggcgtgtctgcttcagaatctcagagaatgagtgggactttggatgtggatgattctggggagcgcttctggtttccaattggtctccaattccctgtttaggcttccaacttggagactgccatcgctgatgccgaacagaggggtgacaatgctctgaaggatgccagggccaagctggacgagctggaggccgccctgcaccagtccaaggaggagctggccaggatgatgcgcgagtaccaggaactcatgagcctgaagctggccctggacatggagatcgccacctaccgcaagctgctggagagtgaggagtgcaggtaatgggagacgctctggcaggaaggccccgggggttcgggaaggacccaaggagaaagcccaacacatcctaatccagaaaagatgagttcttggggactgaagaggtggtgatgctagggaaattaatagaattgataatacctacccagacatgagtgcttacttcattccaggtactgtgctacgtggattggctcattcaatcttcacaacttccctgtgtgtacctgggcacactcccattcccgccaaaaagaaaaagaaaaacacattacttgttccatcttccttaactgcccaggtccaagatgagcttgtgagagatgggcggccactccagcatccccagtgatcttgggagaaggaagagatcaatgcctgggtctgacctttgggaggtgtcatgctgtctctcagatgttaaacctcattaggtttaacttggatggttgccttgttaccccaaagactcaagggtgtccccatagcttctcaggctctgtgccagaggagccccggaatttccataggtgtctaccgagttcagaaacccacgttagtctggtaggggcattagctttgaggttaatagattgcaggttgaaatgactgcttgctcttatttctccccttgttaacaggatgtcaggagaatttccctcccctgtcagcatctgtaagtacctgtatgcttggacctaaaactgtacactctgtggacttgaaagggccttagttataccccacgtgtggagatgagcaatctaaggaccagagagggaaaacctttggctgaaatcacacatccagatagtggggcatggccaagcaatcaggcctcctgactcccaacccaggtctccttcccacttatcactttctccctgttcccaggggatggcagctaggaaggctctcaccatgggaatggggaaacaaaggacatggtgcaagacaatgagtatgggtgagaggcccggagagccaggttgcaaggttatgatcagacccgggctgggggactg

SEQ ID NO: 58494 - DNA, 637 bp, Bovine  19866881336324
ctggacaccccctagatttgccccagatctcctggacacacctccaaaccaacagctcagtggtggagtttcttaagaagatatcaagatttggggggaaaactgtataggagtttccagctacttgacctgtggagactattgcgttctgatctctaaatggcaagagatgaatgataaataatcgagttggggaagtttgtctggagtgcggtttctgcaattcttaggtgtgagattttaaacagatgttgctggcaaggcaaactaaacataaatactcccctcccaggcttcagaaggtgcccagcccagcaaatgcatgtatatatagggactgagccagatctcccgccaaaggagtcatagctccttccctccctgttctctgcctccttttattccctttctcttgtctgcgtctctggatgctccaggagccatgagccaccagtttagctcccagtcagcgttcagctccaggagcaggcgggtttacagcactggttcttctgcgggctctggtggtgggagccgggctgtgaggtccgtgtgtcaggcccgagggaggtgtggcagtggtggtggtgggtatgggagccatgcaagggggtttacctccaggagcctgtacaat

SEQ ID NO: 58495 - DNA, 916 bp, Bovine  19866881359186
tcgtctgcctccagagctgtaactcctgcttccagagctgaatcctcctccataactggaccctctacctccagaaccataacctccaaagccagccctggaggccacgcttgaagaaatgctgctgctcgtcacagctgcagagagacagacagcattatacctcagtgccaactgcctcggcgcctctgccccactccacccccaggacaggaccactcccccgccccccgcacttacacacagtcacgttgctgctgaggtctccagacatcctgccagagagagagaaaagataactctaggcagagcacttaggtactctgcatacgtggttttacaacttccacctataaccacccatgtcagcctcaaaactcagccaccacggcctcacacagcccactttctttggtgctgcggatcacagagatggggacgggccccatgtttccacacagtctggcatcccaagtcatctcaatttcttgctctgataaaactgatcgaaagcaaattcacttctgaactgggaacccattgttttatttaaatccatcttagggagtctgatatgcagaatccaagccacaccagaaattctcaaatgaagactgttctgtgaacattcaaatcagagagaactgcgactctgtacagcctccctgccctgcacccaccccgccctcccctgcttcatctgaattctttcccacatcatcttgcaagctggggagaagaggcccggcctccagacaggtacccagcagcagcccgagcaaagccaaagccactccttctctgtaatactggctctctggtggaccgaggagcttttgccgtctaattgcttcagccagactgaatcaccaggggtactgaggacacgacaagggtcttagaccacagaggaagg

SEQ ID NO: 58496 - DNA, 802 bp, Bovine  19866881403242
gacgcggaaaagcggctctgttatctaggagccgcaagcccctcttttatcctctagacctggtttgggcgggagagttgtcgagctgtgaatgattaagtgggctgggcatgcctggggggcagctgtgagctcaccgacacacctgcgcagcggtgtggggtgcaaacgctgtcttcctggcaggctctgctcagctagggataaacttgccttgcagccctgatgtcttggcagcgaataggccatgctgccagcaaatctttctttacagccggggcctagggctgtgagtagcccaaagaagggtgctgggaagcaagggggcatttggccaagatcctgaaagatccttccaggaccaggaatgtcatcaaacattgcagcacattgcacactatccatgaacagggggcagagcgagtcccccactggcagtggtctgctctgcttattcctttagggagagcttgcttcagggacttcagcccttggaaagccagctgtggcctgatctctccactctgtgccagaggggaaaatagatttccatcacatactgcaaaactccatttcttagaggaggcacagttacatcagagcctgctgggcagattctcctgcaagatttgggccagaaagtctccccaagaaccaagttccagaaacagagactgtggaacaccctcagcccccggtctatcccactttgctctctggagggacagacccatcccaccacaacgcctcctaattcagccttttctgctgcattgaactttttccttgcccttggcccagg

SEQ ID NO: 58497 - DNA, 1222 bp, Bovine  19866881507976
ccttgcccctgcccctgctttctctgcctcccctccgccctggctccaggagtaggagaaggtagaccagggtaccctctggcctcctggggcccctcacctgcactcctcgccctccagcagcttgcggtaggtggcaatctccacatccagggacagcttggtgttcatcaggtcctggtagtcacgcagcagccgggccaggtcctcgcgggctttttgaagagcctcttccagatcattcagcttgctctgggcgtctttgagggcattctctccccgctgctcagcatctgcaatggagtcttgtacattcttacactaggagagaaggagaaaaggtttctgttgggacaggaagtgcaatctgtcttggcagaggaggagagggagggagcaaggatgtgcagggtgtgagaagccagaatcactggccctggaagtgtgtcaccagagagttaatgcaagttacaagcaacttgctaagacttgctgctgtctctgagcctctgtcttcccaagtcccttttaactggacccttaaccctttccccatcatgacctttgatgctcacaatctaggaccagagtcattaccctattttacagttgcagctgcaaacactgatgtgaatggcttcatagaacttctgttgcttgtggagtcagttctctgccccacattacctcttccagagctaatgtccaaacctggccaaccccctgcagcactccctgcccctgcatcacacagccagctgtgcaaagaggtacaaatgggaggtgacgcctgtgatctttggtaaaccatgacctctagcttcgtaagccactgttccatttcacccatgaaagcaatcaaaaagttaacacaattctttccctgcacttaatccctacttgagaatgagccttaaaagtgaaagcaaaagctgctcagtcctgtcctactctttgtgacccctatggactgtacagtccatagaattctccagcagatcttcccaacccagggattgaacccaggtcttccacattgcaggcagattctttacctgctgagccacaagggaagaccaagaatactggagtgggtagcctatcccttctccaacagatcttcccaacccaggaattgaactggggtctcctgcattgcaggtggattctttacctactgagctatcaggaaagccccaagaatgtctctgatcactctaaa

SEQ ID NO: 58498 - DNA, 1199 bp, Bovine  19866881508397
cttgacctccttcaggctgtctccatgctttccagcagttatcttgagctcctcatactgcacggaaagaggaggagagttatctaatcagggagggtcaaccaagctgaatgtcatgtctgcatttgtgggagatgggggaccagtgccatacttgactgagggcatttggggtactataaacactctttcttgggaatgatgcccaattttcactagacaaaaccaccaataaccttactgtacacttactggctgggctggaacacagctcattagaaagagctgcggctctccctgcccacccagaacttgccttgctgtggtacactgcctcggcctcggccttgctcctctgggcaatctcctcatactgggcccggacctcagtgataatgctgtccaagtccaggctgcggttgttgtccatggacaggatgacggtggtgtcggtgacactctgttgcatctgggacagctcctgcaacacagggaaggtctggccacgacgtccctgcccacagccacaggcagtgaggagggattcccctcccccggtgtcagggaaatgcagaatctcagactaactatgtactgggtggggtgtaaagtgatatagccaccattcccagtcaggtagtactgagaattacagccggggtgggggggtctgcatttctgagcctcctagtttatgcagcttaataagtgcccccagaaagaagccagttgatggcaaatgccttaaattgtacttcctgttgcagaagtcatgtgtgtgcacttgggcagggaagcggggagtacattatattttgacctctgaaatatattggatataagaagagaagcagggtgagtcttttcctaaggggagctggagtgagggaatttgtcctaatagagcattacttcctgtgacatcagaggagaaagttcttctcctccaagacctataccaaagaagctcccagtggcctagacattgatcagttgaagtcagccacccatgaaccccacccacagccccctttcccagtgggagaggacttcctttgaggggaagggtaggtagcaagggtccatttaagagcagcctacttactgcatcaaagagcatttttgtgaactccacgtcctgtctcagcaagtccaccttggcctgcagctccaccttgttcgtgtaggcatggtccaca

SEQ ID NO: 58499 - DNA, 832 bp, Bovine  19866881810399
tggagcctgctccagcagcagggcacacatccccatcacaggcacccaataacctcgagcccctttttgagaactacatcaattccctgcggagctacctggatagcattctgggggagagaggccgcctggactcagagctgaggaacatgcaggacctggtggaagactttaagaagaagtgagtggcaggcgcgtgtgggaagatgctggggggaccctgtctcggaatcccagctttcactgcgttccccttgcctactgagagggctgtcacttatcccactttcctatatcttcatagcggacagtttggttcactgggttcctcctcactttctttcctaaaggatagtcctttactaagaaaattagaaggctagagctgaagaagcaccttatcatgagccaggctggggaagatcctggctgtaggatctgaaggatgctgggacaactcacagggtggtgaccaagcatccagtctactggggatggaggggtttcccaggacttactttccgtgttaaacccagtctgcctgaatgaatgggaatggttggtccttctaactaacagggggacagtgagagggtgtgtttatttaagaggggcgggagggggacagaggacagaagagaggtactttcagagtttcagagaacagtgacatttatgactacctcatactgcaaacagtgatttccttttaactcttacagatatgaggatgagatcaacaagcgcacagctgctgagaatgaatttgtgaccctgaagaaggtaagggctgtagtgtgaggtttctagggcttgtaggcacggtttccat

SEQ ID NO: 58500 - DNA, 1813 bp, Bovine  19866880349470
cttaaacatgcaaaaatgttttctatttcattaaagaaaagagatggtcttctaacagtcaggttcaaggagatacaatgaaccttgagataaggtttaaggttatattggtcaactaagatccttctagtaactgtttcttagactgatgtttaaataaattttattgaagcatagtagattgaaaatgtgttagtttctgctgtacaacaaagtgaatcagttataaatatacatatatccactcttttatagatgcttttcccatatagcagagaaggcaatggcaccccactccagtactcttgcctggaaaatcccatggacggaggaacctggtaggctgcagtccatggggttgctaagagtcggacacgactgagtgacttcactttcaacctttcacttttcccatataggtcattacagggttttgagaagtttcctgtgctatacaatagctccttaataattacctattttatatgtggtaatatgtatatgttattcccactctcccaatttatccctcccccaccttctcccaccctagtaactgtaagtttgttttcccatctgtgactgtattttgtaaataagttcatttgtaccatttttttggattccacatataaatgatattatatatttgtttttctctgtctgacttcactcagtatgacaatctctaggtttccatgttgctgcagatgacattattttgttcttttttagacttatttttaaacaattgcatttaaaaccatttggccaaccttctagatgtacaataaccaaagggacagttagcataggaaattggtgcaaataaagataaatgagatgacaggtttaatgcaggttgagttggtgttcttctaagaatttattgtcatattttcttcgcagtttacctgaagtactgcagagacttcaggagacatgttcttttagatttactcttaaaactgtgtatctgtgtttgcttaattacttgactaaagtactataaataaattttcatgaaataaatgaattgaaatttcttttgaacctattaaaacttagaatggtttatggtagtttacattttttggttttttttgctcaaagtatagttgcttggaaaaatgccataaaattacttttttctgttatgaaaagttgtgatggaggtacattgacttcctaaagacaacctagctgttttcttatggacttctatagtacaatatacttgattgcaatgggattttcttttggtacttaaagacttagttgtaaagtctttgtctgaaattgttgggaaaagatatgattaactatttttacctcacttggaatcagaaagtatagaatttatcatggttgaaatgttagtgatggaaagcattaaaaaaaaataaggtatacttagagcaattttattaaattggtaaaatctaatgactacgtaatatttattttgttttctatacagcatcatttgttattcctgctggtagaactcgtcccagttttaccgcagcagaactggtatgtagcttatttaagatatatttttaaaagagatgccccagttttagtgaatggtggctgaaggctgggcagagatgtaatttgtaaaactttagttgaatgaggaaagatgtcgtaagggatgggaagacaaaaatagcttctataatataggtgttggaaaaagtcaggagtttcagatgtaatattttctcaccaacttttcctatcttccagagcagttgttagcatctgccaagactgtacctacaagattaggaaatttctaaagtta

SEQ ID NO: 58501 - DNA, 2569 bp, Bovine  19866880426671
ttatactgtgataaaacatttaacaatttttggtgttatattcactgtgtatagtaaaagatgttaacttaggttagcaattttatgcagcagatgtgatacatatgaagaacaaaaaattcaatacctcatcctgcatacatattatcaacaaattggaagattattattttcaacagcagcaattctatcattgtggctatccaggttcaactacagttaacatggaaacaggacagataaagttgttatccctggcttaatgtcttgacaactgaaaaagacattttcattaggcttctcatttgacagttttgctcaaataaactctacaagttaaaagaaaaatgtcttttttttttaaatgctttatcatcatagaaacagctgaaagtaacaaaccaaaatcataagcttatgtgtatatgtatatatgaaatcatcagaaaataaaaacaaggtcattgtctatgaaacaagatgcagcatgagctaagactgaacttttagaaagctgcttttgccattgtaaaaaatacattatgaataagtttaactttattagtatcctttgtcctttttgaatgatatagtcaagctatacaaatgatatgaaaaaatgtgtatcatataagcagatttgttcaaatactgaaaaaggccttgggcaatacacatttggaagagtaacaaaatcttttaggatggatttaatggcacgtaattacactgcctccttaaaaggatttataaaattttatacaaattttaaaattcatgaaggcattttgtctctataattttgttaaatcctttaacttaattgggtgcacatacaatttaattcatacaaagcttgaatagaagttttttcctaaatgatctacctttatttatgatgacataaataacacatattcaaatgtttatattagattacactccattcatgtaattttcagaatgcagtacatttaacaagccaatgaaagatcctcttattgcaaaagtgtgcctaaatgggactccatggctatatcctttcattggatactttctcctcagcaaagacagctagtggctaaaatcaaaataatggttgcaaagcactttggctgcaataaatggctccaatcaacactatggaatatcttcggaagttaaaaaatttgaaaaaaataatattgtaacaaactgaagttcttagaataaattacatcacaaaattgccttttctaaatcttagaactttttgctatctctttgccgattatgcaaaaggaactttctggacatttaggatcttttcgaacttacattcaactttgttcatgtgtcaacaaaaaataattaaaaacaaaaattaagacaaaataaaatattcaaatctcatcctactggattacacgtgtcaagagaggagtatgggagaaagaaagcagcaaaatttctagctggatcggcaactatagttaattacagataggaaaagaaaatgaaaaaaaagttagagttgccagttcttacacttggacatattaacagaacaaaagacttccctacaagtttaagacagaggcttgggacttttttttttttttttaaacataaaatttccaatcttgaagacacttatcacaaaaattatgcatttaggatttcacatcatattgatgattgggcatgatcctaacagcaactatttaataaaaattcaaaaaacaaaaatattttgaaataaacaattagcacccctcccccaccctaaaccaaaagaagtccattatggctttgatatcccttgtaaagaattaagtagaagagtattgccacatttaaaaataatttcacactagtaagtatttctattttttccgctgcttttgattctgtgtctttgcagtacttattagagaacctagacatgtacgaataccagcaaggtgaagcagagatccagctgcctctttgagctcctcatcaatttcttgacatgcttgttttcgcatctttttgtctggctgccccttttcagtggtatctgcacaagcctgcgatgcatagccactgtctccaagtggatcatcttcataatcaacgtctgtgtcttcttcactgcgaaatccttcactgccatcacttcctacatggctactctttgggataaattcatacacctcatccacagaagacagagaagacacactagatctggacgcacaacgctgtgctgccatgctacttgcactgtaattgtggtcttcttttgggtcaatgctggtggctaaagaatcactctcatgtaatcgcatagcactggaatgattgaatgcattgctataactcctctttttttgcattgctgttttaagaggcagaggcttctcacctgtggaaaataaagcttccatcagtaaatcaaatacatctgactgcagaaacaggccatttaaaactattatatcactcctgaataagtgctttagactggtgatgtttcgtgggtctttaaattttatgcagaccatcatcctgtaggaatcaatctaaaatatttttaaaccattta

SEQ ID NO: 58502 - DNA, 2611 bp, Bovine  19866880468789
tttaaagataggtattgcctcaaaccaattacaactgtaggttcccccacttccccctgcattttaggagcttggagtgcacagatgctttccagggtaggaccacctgctgaagcccacaggctgagcaggaccagaggaagacaaaagccagggaagaaatcccatgctaatctggagtcctcaaagcctggatggggtcttgttcaccttgctggagccttcacctcttctgctcagaatggcagaaatgaaatgttttcattcatttccctctaattgtttagaaaagccatctgtattaccaatttaagaaagctacaaacatccagccattttgcatagctacacaccctgaattttaaaacactgaaaaatcagaggaagagaaaaagacataaacccgggatggtcaaagatatgtttgcaaatgaactcagaaatgggagcattaaacactgaattgttcaactttaaaagaatgttaatgtttttgtatttattacataagaccttgttctacatcgaacagagacttgagaattcctgcgttcttttcaaagtcagtcattataataaacttgctttcatcttggaatgaaataaaagtggctttccccttcacaaatgattttaaaccattatgctttcaaatgcattaatgtatttggtaacttcattactgagtatgtcttcttttattggcctcttgtctttagcatttacctggaggaaaccgagatgtcaatgttaactgaaatatgaagtcagtatagatgggcatccaatatgttaaagttttacatcagagaatttgggaatacacttttaagcacttcctgcattagattcagtgaatcacaatagaaaggattgcttgcaagtggtttggtccaacccctcactttagatgaagagtcttaagtggggaaaagtgaaatgacttccccgaaacggcagggcagttcagcagcagaccgggactagaacatgggttactctgttcctggcccagtgctatgtcctacgttagtcaaatcacagcaatcctgttccttaggggtgtgttgatacacccccactacacagtcctctggttcttctgcaaaaaccttgcttctgttagagccaccagcttcttgagggtatgtgctcacagtctttaacttcaaagtgtgagtcactcagtcatgtccgactcttggtgaccccatggactgtagcccactagacgcctctgtccatggaattctctaggcaagaatactggagtggatagccattctcttctccaggggattgtcccaagccagggatcaaacctgggtctcctgcactgcaggcagattctttaccatctgagccaccagggaagtcccctaacttcctgttttcccatgaagcttttagagcctaccagggtgctctttcttcctctcccctgtcttcctcagcactaatggctacattaaaaatagtttctctttttctgcactgttttttgagaattcaccaggtgttttgtatgagcgtttcctctgttcaccattgaactcctagtgtcacagcccctttcttctttccccactgtcgttctccttggccattcttccccttggctgctccgtagtccacatattggtttctcttcacgccatcctgagtttcctctgcctagtagggcctttcctggtaactcccaccacgtcactctaatgctcagattcttctgtccctcctcttgacctgtctacttttctacaaatgtctcagccttgcattcgaggcccctgaaacaaaagcttaaacttcctttgccaggcctatcagccacacttcccctcatataaccaatacaccaaactggcactgtccaaaaatgcagccgccagccacatacgggtattgagcacttgaaatacatccaggccaaacagagatacactgtaagtttcaaatacacaccagatgtcaaagacttggcaaagcaaaataaagcacctcattaataatttttatatcgattgacgttgagatgtatgtggctgaacccccttgactctgtttttctcagctttctcttaggcccacagtcttacccctctcctttctgcatggctgacctttagtgcactcagaaggaatgcacccaaattggatgagtttcctgtcaccttttacccttgtcttcatccaaaatgaaaactggaagaatgcctcctgctgatgcagatgattaatggtcatgaaacccccaagcggaaggaaaaacccctggttcccatctggtgtggacctgcttctccatggcagtcaggttctattttcagctctggtccctgtaaagcccccgtacacccttttccacaccctgcagtatggagtacaactgtgcacgttgtccacttaatccccacctgtatataaattaccctcaataagcttcatagttgcacttcatgaagatgcctgttttgtttttcaatctcaagtttagaagacattatttaatataataattttgccttccaacaaaaattcaacattgaatattcaaaatttcaatattcaatgaatattcaaaattcaaattcaacttgccttccaacaa

SEQ ID NO: 58503 - DNA, 700 bp, Bovine  19866880469579
gcctactgtagagcactatatttaacatcctgtgataggccctaatggaaaagaatttttaaaacatgtatgtatatatataattgatgcttttgaactgtggtgttggagaagactcttgagagtcccttggactgcaaggagatccagccattcaattctaaaggaaatcagtcctgaatattcactggaaggactgatgctgaagctccaatactttcgccacctgatgtgcagaactgactcatatgaaaagaccctgatgctgggaaatattgaaggcaggaggagaaagggatgacagaggatgagatggttggatggcatcaccgactcaatggacatgaatttgggtaagctctgggagttggtgatggacagggaggcctggcgtgctgtggtccatggggttttaaagagtcggacacaactgaatgactaaactgaactgatgagtaccaaggtccacatttaatttcaaaagtacatatgttcatctgagaaggatagaacaaataacgaagcctcttgcatggtaggcagattctttacctgctgaatcatcagggaagcccgaatataaaacagtatgctatcacagaaagttaagtgattaccaattctacgcatttaggaatcaagttttaaaatttgactatgaaaaagatgataaacgagaccttgcagcttatttcccaag

SEQ ID NO: 58504 - DNA, 1809 bp, Bovine  19866880486430
ctgggagttggtgatggacagggaagcctggcatgctacagtccatggggttgcagagtcagacacaactgagtgactgaactgagctgaaccagatagtacctagaaacctatccaggtcagcagtgtcttctgagaggcagaaatacagggctcaagatctggcgattggcagaaaggaaggtcagaggctttccttctggatggactttggggagaccaggcagggtacaggataagaaatcaaggccaaaataagtaccagtgcagggggagcatagtttcaggtactaaggtgcaccataggcaaccatcctgacgtatgttcatatgttttctaatgtctggtgtgcctgtattttaattctgcaagtagtattgtgcatatatgtcattaatttcttaggcatttctcttttttattttttttaatttaaatttatttcttttaattagaggctaattactttacaatattgtactggttttgccatgcatcaacatgaaggcatttctcttaacaccatgattctaagatccacacacactgctccgtgtacctttacacacttgctcctacctgccgaccccttaggtaagtgtgcacatttcaccattccctcaagaaaatctttgtgaaggtttccttaagtatcagtgttgagaacttctctgggatgtatacaggagtagaaccgcagggttattgggacaattgtccacgttgctaagagcttctggcttcatgggtagaatcacagaagcatcaaacaggaaaaggatcgcctccaaagggagtacattgagatggttattaacaaatcatgggccacatgaacaaacatttaaatacaggatacagacacgtttatgcttcggaactgctgcccttggaaaatgaatcaggaaggaatacatgacgtcactaaaataaaaatgtgtctgtggaggaaacagttcgggattcataggcccaccttccccatatcacttcatgccaatacttctgttgtgaaaagcttggtgcacctgtctcaccccatctctccctccatcctctgacccccgggcctcttttctggggccagccacatccataaagctacctgatgttcactcggtgtcttttttatggacggcactctgttttcactctcatcactagcctttcctgctctgcagcatcaacatcaactctacaaaatttcatcttgcaccagggctgttgcacagtcactgggagcagccagtgatgatctacagcttctctcacttctctccaacccttgctccttacccctcatccctccatcagtcaaacactcaggtgtcctccctgggtcagctctgagccaaactgctctcctgggagccacacgtgctcccttttggaggagaaggctgcctgctaagaggcttcagcttctgagctgcatttgcatgaataaacagctctgaaggggttcagttgaagcttttatgtaaacactctccaaaatatgttctgcactgcattatccccagcaataaagattctggaatcagaatttggctgtcagttttattgatgttgcatggggtacagtagaatacagctttctcctctggaaatttattgacttggcagtgcagagagcaataaaactgtgtttttaatcagtaagccaagcagacatgattccagaagaaatataggaagcaaacatgccatcataagaagatttctccctgtcctgtccctgttcttctcagatgttctgtcaaataagtttgggtactgaaggatatgcttgggggggctgtcttcag

SEQ ID NO: 58505 - DNA, 742 bp, Bovine  19866880487210
agaaaagtgttaagcggggagtgtgagagagagagagagtgtgtgtgtgtgtgtgtgtgtgtgtcttggtagaccaggaggcctttctcagcaatttaagcaatggttgtgaatacttcacaaagctgtaaagactattgtcttaaatactacagtagcttaacaaccttttgtgaagaccatagcatttaattaagaaactttgaggctttctggtttacatatatatatattataggttttttttggtttgaaatgttatatagctttgatttaaacagtttgcttcaatatgttaatgatgtcagaatatttattttctgaaaaacaaagtattttgatgttatacctgccattttttcttaaatcacacaattttttttgcttctgactgccagtgccaatgtcaaaattgttgtacatttcttattaagtgcttaattttaaagtattatgttgccattaaatagtgtataaaaatgtgtaattgccaattcattgtaactattatttatttttaagtgaaagtgtaagaaggtttctgatttaagaaatttgagttattaaattgtgtccttatccttttttctaatgtagcataaaaatccccctgagtttgagttataactgccagtaagtagatgacaagtccacgtgaaccacttcttagttgccagtctttgctcatattaaaaacaacttaacaaacgtttagtttttatatctaatctctgattattaa

SEQ ID NO: 58506 - DNA, 1027 bp, Bovine  19866880510066
attcttgccccagtagtagatataatggtcgtctgagttaaattgacccattccgtccttttagttcctgactactaaaatgtcaatgttcactcttgccatctcctgtttgactacttcctttttatcttgaaattggaacagagagtacaaaacagatatgtatccgaatcacttggaaaactttgtcaaaatacacatgctgtggaaattctggaagacgcttggggaggggaaatagccatctgtatttcatccccaggttaatgagatcctctctcagggctgtttcagtagatttaggtgtaattacttctgaattagttttaataaaaactttccaaatttggaattactgaacaaccagaatatgtcattcagcagtgttccttgtgtgaatgtatatcttgtgttcacatttggtgtttatgtatttgtttattacatagctgctccattttcagagggctttctaatcgtgggttcacgttggatcagtaagtgacttcattttaagtgaggagtgaagtacaagaaaggcagaggagggtggtgactgatgtctgaacagtttcattgttaggctgtcccttgaatagtgtcatctctgtgtgtattccatgaaaacaaatgttcattattggctcttaaatagtgctattcttctatgtagaaaaagttaatattgatacaagggcaaaaggaatgtatttttggtagttttgtgcttttttccttctatttatttgtaatagctttatcttgtatttttattttattttatttttaaactttacaaatgtattagttttgccaaatatcaaaatgaatccgccacaggtatacatgtgttccccatcctgaaccctcctccctcctccctccccataccatccctctgggtcgtcccagtgcactagccccaagcatccagtatcatgcattgaacctggactgggaactcatttcatacatgatattgtacatgtttcaatgccattctcccaaatcttcccaccctctccct

SEQ ID NO: 58507 - DNA, 6455 bp, Bovine  19866880583992
ttcacgtggccagggttatctgtaacaccccacatcttcacctgacatcacaccttagataaggtgtgtgtgatgggaggagaaagaacaggtcaggactcggtggctgactcaacaacacaagacaaactggcctgaaagttctgaaagttgcgccttaacaaggctgtgtaggatcatcccaaggtgtcatttttttatagcactgtaaaagcctcgtcatcagcaatctggtccatctatctgggaggaagctgacttttcccaccccacagatagcttctcctccatgcacagggcacatgagtatcccttccacaaggcatgtaccccttccacaacatgtgcagctacaggcctgtagactgttctggacagatcagcagcccaaagcctgcctgctccacaaaaccagtgattacttcctcagtgacagtcggggttgtttttcagtaagcttcatttttgtagttagcctgcaagtatgaattcagcactagactcccagaggctctcaggggtacttactcttctcagacaatgacctgcacccgagaaaggaaagagtggatgccacctttcatgctcagactgtgaggagtgtatctattgtctctactagagttgggttctctgaagaggaccggaagagtgtgcatgtgtgtgtgtgtatgtttctgtatgcacacatgcccgaatgcaggtgtgtatctatttttgagagaataaacatattgttgtttttgttgtcatttagtcgctaagttttgtctgactctttgtgactccatggactgtagcccgccaggctcctctgtccatgggatttcccaggcaaggatactgaagtgggttgccatttcctactccagcggatcttcccaacccagggatcgaatttgtgtcccctgtttggcaggtggattctgcaccactgagccacctcggaagcccataaacatgttaataactatattatcaattattatcaactatgttattaactattaataactatgttactctatgttatattcccattgggcaccaataacttaatactctcattgaatctttacaaccctgtgaggaaaatgttaatagaacctctgatgaataaatctgttacaagctagtcttgggaatgacataagactttctgatacattttctctttggagatgtttgaagatttttacagcaaggtcaatttttttcccacttaaccacttttataggactacactgcctgtaattcaggttaagttatacatgataaccaagtttaataagaaaaacaataatgtatttcaggatttcaacatttttaatgagtggtactttattcgtgaacagttctaagtcaagtgattttattaaatgaaaatgctcacttaagtaactgttagatcatgaagaataaatcttgagccaaaataataataatattcatgacaaatgtgtattcagtgtgctttgataacttgctctaaacatttccttaaggacacaagttgttaagtgcctcagttgctatactgatactccaaaaagtaaagagacttgctcgaggtcacacaagctcagtctctggctgccctttgtctgcctctggctggacagagaaagccatgagtgaaatacaggtgtctctgctctccatgtgggcacaagttgggggctgggatcctttccattcaggttggaaatccccaggaaacagtcatcataaaccaatcgtaggccaaaagcaaaagaggatacatctttcaaaagaagatgctattccagagctcacactggtgacatcactgactgatccttacttcctttctggacctgagagcatttcaaaacaaagggttttctaaggatgaagattctaaaatgtacctggaaaagagccccggacagtcctggggtggtcatcaggcaaacatcactcatcccatccttagaaatgatgacacctttgcctgcatttgggttctgtcgtcctggcaatgtcatctctgaacagttcctcttccagacacccccaaagaagatggccgaagggtggagtcaggagttttgatcaagatatagcctagcctgaagtgcaaggtggttaggatgtatctggggaaaaggtaaagattttcactgccctgaaaaaaatgcttaaatttgttggttttatatccatttttactcctataaggttcgaagaagcaggcatagcccctggcatggccctacccacagaggaggcaatcaagccacagttgtgattagatggaatgaagtgacatgactttaaggatatcataacattttttttcctcaattgttttcgcaggtgaggaaacagacccagaaaggttaagctacttgcccaaagcagcttaaccccctagcccagtcccagagcttctgagcatcatctgctgcaggaagattccactgacctgcagtatacacaggggtctcccaacctcgccttgcccgggccaggctgcataggagacaccgcccactctgtgtctccctccttggcacgagatgaaatcaggtggtcccattcttcctgttccactctgccaagtttatctgaacacatttcctctccacaaagccaactcgccaattatctgctccaattaaggcgtgtgagatgtggttaattcagtcactccagtagggtgaccagggtgaacagggggctggccatgctggctgcaagtcccccgatgcccctggccgtgctgcttcccctggcattcttcctacccccagatggcctctgtggtttcttcccctccccgctccttcctttctgagtccctggagttccagaactgtgccttgccctggctcctcccctatcaatggacagttctgtcctaattttgtgtcctctgataaactaacatgtatagagttgtcagtggtaaatggcatggtaatacttaaagaattaccataaaaaacagtaatacttagagtctctcacaaataagtaactctctaatgacattgcacatgaggcatcttccgtatttatgtccaaagccagccttgtgaccaatgaatgtaaaaatcatgcctgttttgctttggcatacaaaccccaaacactcagctctctaaggccagtccttcctgcctcttagcatgaaaacaaagaaggcagacaaaggctgaacgtgtattagtctgatcagttaggacaatggacacaaggtcaagttcaataccttcctcccttttatgaaataaatactatgaccctgagatgaaatgtataaaataatataacctacgtatacacgtgcagtgctgggctcagtcactcagtcatgtacaatgctttgtgactccatggactgtagcccatcaggctcctctgtctatggtattttctctgcaagaatactggagtgggttaccatttcctcctccagggaatctcctccagggttcttctggggatcgaaccctcatctcttgcattggcagacggattctgcaccactgagctacctgggaagcccctatctacataagcccctaccttctcaaaaataaaaccaacatattgccttgactggaaagattcaaaggagaaataagacagagataatttctaataaagtaatacatatttcaatatggaaatgcttgggcccaactatcttagaagataagatgaaggagtcaaatgtaattattcatacattcaccataaatgggacaactataaatgtagatcaattcaataattgtatcatgttgcatacagctagtgctgtaaacaaatcctagtaaacttccaaaaaccaaagtaccagattactttgcttcatgtggcagctgcattcttggaaaaattaagtgtctctgaaaccatgcaaatatacattttatttatgtgtaaaatgtagttaagtttgaggcacaggtagttataaatactatcgttgttgtcattttaaagctacatgagcatctgagacaggacatcccttggctcttatccaccattttattgtattacaagtagtgtgatttattgtgacaacaaaaaaaatacaaccacctccccaaaagtcccaaatgctcctggggtagtactgtgcccttcactcaatagcaagtcattctattagcaattacaattagcttctactaacagacttgagagacaatatttttctctcaggtaaaacaaatctggaagcagcagtcttgggctgattttttccaagtctcctatcttttcttttccaacattcctagtactgatatccatccttaagttcatggtcacagaatggctgctggaaccccagctactgtatctatgatttagttaagataaagaaagaaggggaaaagtcaggaagagcaaaaccatgtagtaaatgaataagtctcctttagaaatatttctagaagtctctcccaacaactacctttatatctcattagctacccctgtcctcaaagaggcctacaaatgtaattaggcactttgctgtctctaataataatcagttccatagtgaagaagccggagtgaatggacattgggtaggcagccagtcgtctctaccatattacttcacccactgataatgttcagagatcctgccaaaaccccaaaagcagatgtaagacacaggtgctaagaagggcatgcagtcttttgggttgcttagctcaggacctcaagcttatgtgggcttcaatatttgtatgctattccctgcacaggagcaatgtgacacttcatcacagtgatcgattctgactagatcctggcactgaacaaatctgggtcagcagacggatctgagaaggggttcaaaactcaaaatctgcctgagtgtctactgtgagaattcaagatgacaatggttgagcttctcacatctggcattagccattcaaatgcacgtgtgtgcttccagatgttgggccagcccctctaaattttcctaggggagttttgttcaggctcacaaacatgcactgcatctactcatttttcctgctgtgtgacagggatgcaagataaaaccaacaaaattgcttccctgaaaagcttatactctgggtgtggagggagaaggcagggaaggaaggttagggggagcagagagggttgaagtggtccgtgctgtggaaaggcatgtcctgggtattgtgtgtccgcagcagccagcaccatgccattcctagtgggtgctcaataaatagttgtcggtacttcccaggtggtccagtggctaagactccacgctcccaatgcagggtaccctggttcgatccctggtcagggaactagatcccacttgctacagttaaaaagatcctgctccagggcagccaaataaataataaaagaaaataaatagttagctgtattttttatttcaaattcttctccgtgatacttggagaggaatctgttctcttcggagacttcctgggctgaggagttattcatcacagctgaattgctttgttttcccttccacttcattcagtcagctatgtcctagaaaaagttcccaaaatatagcttaaattttcaaacttgcagaaagccttcttggttgaaaccatgccaaagcttttcgaactgggaaatatcagtgatatgcaaagataataaaaataatctcgtgcttggaaatttctaattcttccatagcctcagaatccctccagagggcaatttggcaacagttttcaaagttttagtaaaacattcatatcttttgactcagcaattctaagaacttaaaccaagaaagtaatgaaggatatagaggaagatccaaaaataaggatgtttattagagtttggtctattgttgtgaaagatgatagatgtggttgcttccaatgttttctaaccaataatagatcaatgaataaatatagtgcatttcatacaacacagtatagccacttgaaatgattcatttaacaattgtgtattgattacctgttgtgtgccagtcactattgtagatagaaggacataagtgaatagaacagacgatgtggatctcaacattctggtaatgtgccatgattgtgtttattaacatgaaaatagattgctaaatttaaaaggcaatatagcacatggaactctactcagtattatgtgtcagcctggatgcaaggggagtgtggggggagaatggatacatgtatatatatggctgagtcccttcactgttcacagaaactgtcacaacattattaacccaatagaaaataaaaagtttaaggtttggaaaaaaaaatttttttaaagcgggttagaatgtaagtattcttattatgaagaaaaataatagttaacactcatatagtttttattatgtgccaaaattatgctattatgtgccaaacatcaaacatttaatttacataagaacccagtagatccaata

SEQ ID NO: 58508 - DNA, 1456 bp, Bovine  19866880594363
ttcatcccatagccaatgagaaactaagaaatgtttgaattaatgtaatgtgcgtaagacaagccattccagtaggaatatacagatggactaggaagagggctaaaattgggggaaggatgccaagaagaaaactaatgtaactgtcccattagaaagaatgaaaatctgaactcaagcagtagcagtggggttgggagaaagggagtgccagagtggaaccattccttcactagggacacagtccctcttcagtcagtccactctctgaatctgactcatatcctaagaattatctaccctcaattatttctttctattgttcatgactctattcttcctctgctcctaaatttcttctgagtaacgtaaccttggttccatttctcaactgggctgcctgattagccaaggacttcagcatgtcctcccaaagctgataatcttcaacagtgtgagcctttcaatcccatttgtgttctactgcagacaaacagcttgatagcaatttggttagcaactaaaggagataaatagctaagaaaatgtcaagaaagtttttttagattgagcaagcatagattatgtctctaaatttgttttccaaagaaaagaatgctctgtaaacagcttcattaaatccttgcatcactgtgtaaaatctgcatattaaaaaaaaatctaaatggcttttcattcccttcttaaggaactcctacgccaattcagagttctcagataacaaataaatataagattgaggctgttttgacttcgtttcctttagtttgctctccttaaaaaaaaagaaaacaaaaaaccactaggggcgatttctaaatgtttttcaatacccagaatcatagaaaatctcttaagtttacactgagtcacaatattcttcttacagttattctgccatctttgctgagagtgaactgagtggctgggattatgactatggtttctgcttacccaagacactccagtgtgctcctgaaccagatgctttcaatccctgtgaagacattatgggctacaacttccttagagtcctgatttggctgattaatatcctagccatcacgggaaatgtgactgtcctctttgttctcctgaccagtcgttacaaactgacagtcccccgctttctcatgtgcaacctctcctttgcagacttctgcatggggctctacctgctgctcattgcctcagtcgatgcccagaccaaaggccagtattacaaccatgccatagactggcagacagggagtgggtgcagcgcggctggctttttcactgtgtttgcaagtgaactctctgtctacaccctcacagtcatcacactagaaagatggcacaccatcacctatgctattcaactggaccaaaagctgcgactgaaacatgccattccagtcatgctcggaggatggctcttttctactctcattgg

SEQ ID NO: 58509 - DNA, 2033 bp, Bovine  19866880634830
ataattccaaacatcttaagtcatctctgtgttggtgtcgattgtcttttctcatttaagtagagattttcctggttattggtatgacaactgattttcaattatatcctggacattttggtcattattagactctggatcttatttaaatcttctgtcttagcaggtctcctctgacacagggccagtggaggaaggtgaaagtgcccacttgctgtagcaggtagaagtgaagggtcctgttttctggctcagtctctgctgacagcctaggggaggaggatctcctagtgactgctggatagagtgggtgttcaggctccccatttggcttccactgacatcatgctggttgacacagggaggggaatcttgtaactccttcttaggtggcctctaccgacacttcagagggaggtttcactgtcacctagcaggaatgaaagtcttggttttctttgacaccaccttagtggttggtggggatgactcattatagttgggtagggggacaagtccaagcaacccacgtggcctccagtgacatcatggggagggctgcacctcagtgcagctgggcaagagtggaagtctaaactctactctgcctttgctgacaggggtgaattggggtcagtttttttctttggtgtttgaagtagagctgctgctgctgctgctgctcagtcactttagtcatgtctgactctgtgcgactcccatatacggcagcccacgaggctcccccatccctgggattctccaggcaagaacactagagtgggttgccatttctttctccaatgcatgaaagtgaaaagtgaaagtgaagtcactcagtttagcgatcacttggactgcagcctaccaggctcctccatccatgggattttccaggccatcccagtggggtgccattgccttctccgtgaagtagagcagtttttgtctaataagagttttctgtcttgctgcccatttttctggcccttggctgtataaaaagactttttattcttttttgtctgtgacctttgatgtctctgaattgccagcttcagcagtacccagctctgttatagacaaggtaaaaagaaaacaagggaatttattgctgtgcattctttggggtgtgaggttcctaactggtctgtgctcttctctccatcttttatgtgtaatatccagagtttttttaaactgtacttttttaaagctgtacttggtagtactcttgggctaccctggtggctcagctggtaaagaatccacctgcatgcaggagacctgggttcaatccctgggttgggaagatcccctggaggagggcatggcaacccactccagtattctcgcctggagaatcccaatggacagaggagcctcgaaggctacagtccatggggtcacaaagagtcagacacaactgagcgactaagcacagcatagcacagtagaaagaacaggcaggagtgtgtctaattcatgttgtccctgcctctcctgatatttgaagcacctatgataacatagaatatttaagatcctaccattacaccttataaaatgagaccaattatgaaagaggataagtacagttattgtgggaacaaagctggttggttctttccaggtcatagccttaagttcaatgtattagtttttacttctgtcttctctaagtagaaatttaggttggaaaattcactggagacagacattattcttgctaacatttcatgttcatatttgattatacatattgtgattaaagtaatgaaaatgaaatcatttgttaacttggaaattactgaattcttatcaagaccctgatgaatgttgaaaagtagccacagagaaaattgtgtttggagacatccttcacactttccatgagttaattatagtcactaattttcatacgtacacaatgtgtacatctcttcaatattaatgtgttagccgctcagtcttatgtgaccccatggactataatgcaccaggctcctctgtccatggaattctccaggcaa

SEQ ID NO: 58510 - DNA, 1409 bp, Bovine  19866880679946
tttattattaaatatacctagcatatttgtttgtactcatcccatgcacatcagtataattacctaatttttaaatctttaaagagataatggtggctatcagagtgatgaaggacctgggaaaagcccttcattttattggtaaggagaccaagattaaaggaggtaagtgccttgcccaggcccctcagcactgacctagtggcaacacgaggtcttcatatgcatcgtccaggggactttcttctactccaccatctctcagggtttttcaaggtgtggtccttggaccacttccatcagaatcactagagtgttcattacaatgcagattccttggcttcacttcagaccctgaatcaaactctctagagacagagcccaggaatgtgcattgtaagcaagttctctggatgattcctacaaaataatcaccttcattacatcacatgagaactttccaactattgttgccttggtttcctttactacgttccccttatcaaaataactccagctgctactagaagcactaatttaaagacgttaacaattctgccatggtttctgaataaacttacgtcactaagagatcaaacaggtttccttttccactcccctggtccctcgctctttctttttttgccctactgggcattcatctaggtttttctccctgctgatttgtcttcggactgaatacctatctgctgctacttacatttgtgccctgggacgactcctgagggcatcaacatgcttgttggcaaaaccctgcatggagctgtctttagtactgaaggctgtgcagagagtgtgaatggacttggatgggcttagcagcattgaggcagaggaaggagcaacagtagcaccactgctccagcagcaatcagtagacaggaaaaaagacgggggttttaggaggacagtggggccaaccacagcagtgaggacaccaaaatatcttaaggagagcagataagactcagtggctggctctagaatttctgaactccagacactcaggaatagcaatctggtgggaagggaaggaaggggatttatcacaagaaatgttttcacagggagcacattctttttacttagattgtgtgttaatttttggtagttttgggggatgctgaagattgctgctgctgctaagtcgcttcagtcatgtccgactctgtgtgaccccatagacagcaggccaccaggtttctccaatgcatgaaagtgaaaagtgaaagtgaagtcactcagtcatgtctgactcttagcgaccccatggactgcagcctaccaggctcccccgtctctgggattctccaggcaagaacacaggagtgggttgccatttccttctccaatgcatgaaagggaaagtaaagtaagtcgctcagtca

SEQ ID NO: 58511 - DNA, 1838 bp, Bovine  19866880807590
aacatttggactctgtcagcttggtcgtgtcacctggtccaggttactgaatttcttcggatcaagtttcttcggctattgaagggaaatacctgcctcacaccattgttaagtggataaaataaggttagaagtgggtgtgcatagtttatacagcatgttacaagtcccaggagcaagtcctttctggaactgtaagacatctcactgattcttacctgctcgtcatggaggaggtgcgctctcccagcaggtaagccaggctctgctgcatacacagaaaagcaaggcagcatctccacttctgttctccatactctcaatactcacttccctcctgaaatgcctggtccactccccgcctctcttccagtccctgggccaaatccttcaatcagtgtagatgcttgataaattcctgttaaccttcatctctgccttgcagatgctttctcctgagttatcttaacccaggctcctttatcactcgtacgttgtcctattctggttctgctctcgctgagtggtcactcttttctcaactttttgtaatgcgtaactttgatctcaattcaagaacactcagattgttcttctggatataagtaagagcctgaaggagtctctttagatgtttccctcaaatggcatgagattaaatggcattaaatcaaaatggtatttgattaaccataggagcaaagtggtctggttgagatagtattaaaatgggctgcctggggaagatggtatagagtgaaataggagcatgctgttagtgaatcttcccttctcctacctgcctggttttcaattgtattttcaccatccatttctccactctacccaagacagcttcttttctatcctcccaacaagcctatatgtccactctaaaactatgtgttaactgcttacttggtaccaagcccgattctttatacaggttatcttgattaattttcacaatgaccctgtgaaataggaattattatttcaattttatagacaaaggacctgaaatagaggatctaaatagtatgcttagggtcttgtagccaggtagtagaagagtggagatttgaccctgggtgcatctgatcccaaggttcactatcttaaccacgaaattacacactttttgataaagaccaagaattagtcatggcacatttctttattgatagaagttagaattttcgacctgaatctagctattgggaactctgcgatcacacacatacacacacatttcattcatgaacttacaaggcaccgaatcttaaatcttaaactcttggctttccttttttcttttctagatcactcacctatctccctatcaaagtaatcccatctcaagctttcagaggacttaatgaggtcataaaaatgtaagtaagatactgcatatcaaaagacattcataattgaaatacaattttttctcagagaacacatagttgaaaagtggtaatttttctaggagagaaactgtgtttaggaaaccctagtatttttatctttaaaatacaaataatatccagggacctttgaagaaaagggatgattttcaagagtcattaaaattcagataattaaccttgtctcaacaaactgaatgcattttgataggtgatgataaactactccaataaaaaaaaaaaaagattccaatcataaaaaactccctctgctagagcgggctgttccctcatgtcacatttttagataacacccgcatagagaaaatgtgttgaaagtttattgtgcatcagaagactatcctttgtatctaaataataagtatataacaaatacagtatttgtatctatat

SEQ ID NO: 58512 - DNA, 2000 bp, Bovine  19866880978352
atggggtctcgaagagtcagacacaattgagcgacttcactttcatttttcacttgcatgcattggagaaggaaatggcaacccactccagtgttcttgcctggagaatcccagggacgggggagcctggtgggctgccatctatggagtcacacagagtgggacacgactgaagtgacttagcagcagcagcagcagtcctgccttcattcacactgtttctgccgcctggcacatcccacccttctctgctggttagattctacccttggttaaggtctgtcttgggcgctgggtactctatggaatgtgtcttcattgccatgtgcatgtgctttctctctgggcggcagcatggtgggaaagtgacaatgtagactcaggagccagactgcctgggtgcatttcacatgtacagagtgatgatgatactaactactgcacagatttttgagattcagtaagaaaatgtttatgtaatattaatacagcatctttcacaagattagagctcaataagtacttttaattcccagctgcttgctgtgaagggttcaggttaccccagccatgcctcatgacaactctgcctccttgctggggatggggtagggtggactctgtactttggaatggattcttgtattgtttgtccaacccttacgttgacaaagtgcctgtgacttgtctccaactctttactccgcagattatacataggacaactgagagagagggtggaccattcccacttggcacctttccgttgagctcaggtattccttatagactgtgtctgatagccttttaaagaaatgataaggaaatgataaagaataaccttccattaaacatttcaactctagggagccactctgcagagttctcatttgctcattgattctaaaaagtgtggtcagttgcaactctcccgctggaaagtacaatttgagtgactcttctttaagacagcctttgcaaagcacccgagaagcttgaggagtttatgaattacaatgtgaaccaagagtttcaagaagattccctgggtgatggattttccaaatcatttgtacaacaactaaattaaaaatgtaaagtctcagagaaaaatggtcaacacatctaagcccttactcaagacccatttctaaagacacaaagcaaaataacccaatctctacccccaaactcgaattcttctagcaataatataacatgacaggaataactctggtaaataaaactacatgttgaatcttccccagggaaggtgtgcattttctgtaatgatttctcaaaaatatttcttagaagcagagaacattatgttgtcagggcagtcacattgcagctatgcttcgggagcctctttcattacaagattctgtttccagacacttttttatttttttggtgagcctgttaaagctggatgcaactgataaactacatgcttttaattaatttgatggaatgggtttgaattgcctgaaattattggcatgtgtaccttcccttttcactagctcctcagatctggtagacacgtttgtgtggttgcctggttcacaaaggccccttctctggaagcatctcagtgctgcttgcagcagcgtggaagcatctcattgtctgtgctccagtctcagcagtgggatggggcaccctcagattctccctctaggaatttgaaacttgtgataggtctttggagctgattcattacaaaggtggaatctagagaaaagttccctgacctcttgctgctaaaatgccaaattctccctggatcttgctcacatctttctagctccttattcttctgttaagttaatctcttatgattaaatctgtcagaattgatttctgatgcctgcaaataagaaaagccttcatcagagccacacccactgtttccaggggaaagtcatccactctccattgatgatccatgacacagacagggcacatgcctggggtccatagagagcagaagg

SEQ ID NO: 58513 - DNA, 2338 bp, Bovine  19866880988970
gagagattgctggaagaaaaaagccgtgggctcaggatagcatggtgggatccctaccaggaaggaggaggaatcaaaggcactcttggagccagctctgcagcagagaacggatgatccatgcaggcgcagagaacaggcgatccatacagggactgagacaaattataatcaaacataaaggcagaggctttctaccttgaatttaaagataccgaaaattaaagaaaatcctgtgcatgactttacttctgctaaactagtcaatagaaaggtcagttaaaggaaacaccaaatggtggagaaataagtgtaaaacaaatatactcctgcatttaaaatggtttaagccttttggaaagcaacatggtaattctcatctcagttcagttgctcagttgtgtccgactcttcctctgtcatccccttctcctcctgccctcaatctttcccagcatcagggtcttttcaaatgagtcagctctttacatcaggtggccaaagtacaggaatttcagcttcagcattagtcattccaatgaacattcaggactgatttcctttaggatggactggttggatttggatctccttgcggtccaagggactctcaagactcttctccaacaccacagttcaaaagcatcaattcttcggcactcagctttctttatagtccaactctcacatccatacatgactactggaaaaaccatagccttgactagacggacctttgacaaagtgatgtctctgctttttaatatgctgtctaggttggtcataactttccttctaaggagtaagcgtcttttaatttcatggttgcaatcaccatctgaagtgatttcggagcccagaaaaataaagtgagccactgttttttcccatgaagtgatgggaccagatgccatgatcttcgttttctgaatgttgagctttaagccaactttttcactctcttctttcactttcatcaagaggctctttagttcttcactttctgccataagggtggtgtcatctgcatatcgatctaggcatatgtatatgttcctcaatccagtgatcctagaattgaggattttccaaggaaataattgaatggactaaaaatgccatgagaatggagatgttcaatatggtcaattctacattacacatttgaaataacctgaatattcagcaatattgcagtgatttaaagaaatgatgattcatttaagcaatgttactgtgcagtcacaaaatactttgagagacataggaaagttaatgtgttaaaaagtcagattacaaagtcatgtttgaactgtaaatccagtaatgtattcctgttcctttgaggagaaaagcaattgttattttctgtcccaatcctacacctgtaagtctgctcaatacatatctattttacatatggtaatttaagtttccacgttactctttccatacatctcaccctctccccgcctctccccatgtccataagtctattctctgtctgtttctccattatttccctgtaaataaattcttcagtaccattgttctagattccctatatatgcgttagaatatgatatttatctttctctttctgaccgacttcactcagtataatatgttctaggttcatccacctcattagaactgactcaaatgcgttccttttatggctgagtaatattccattgtgtatatgtaccacaacttctttatccattcatctgtcaatggacatctaggttgcttccatgtcctagctattgtaagtagtgccacaatgaataatgggatacatgtgtctctttcaattttggtttcctcagggtatgtgcctaggagtgggattgctgtgtcatatggtggttttattcctagtttttaaaggaatctccaactcttgcctctttatcaagcttagagtgccacctccaagcctcctcactttatattagcagctagctctgctcctgactttcatcttcccccaggccctgctgtgactggttgttccagtatcagaccatctcaggtattaacccccacatcaatggtcctttaatgcgtttaagtttttactttaaaagattatatcaaagtaatgttcctgctaaaattattcaaatggctttaaacaactaatattaaaatataaaatacttcctcatatccctcccccatccacaggcctttgcacttgcttcctttctaaataattgctgtgtgttttgttttatattttctgtgtgctttaattatctattgttgtgtaacagattaccacaaaccaagcagcataaaacaacacgtatttgtaattgcacacttgctg

SEQ ID NO: 58514 - DNA, 847 bp, Bovine  19866881023816
agagcattctggcaatatctaaccaaatatatttgccctttaacccagtaattccacttatagagatttatttaatagataaaactgcccacatatgaaatgttttatgtacatggtcattcaatagcaaacaactgagaaatagctcaaataagagatgagttaaagaaattttaataattccacaatggaatattgtggaatttataacacagttataaaaatatccagacaaagatttctaagatatattgttaatctcttaaaagacaagttgcaaaatatagtgttgtctatgctacccctttaggctctactggaataaagatactaaatatataaagaaattaatgtaactggttacttatttgcactgaaggcagtgacagggagctactggtaggaagagcagatggagaaggactgggtaccagagtccttatggtataccttttatagtatttaggtattttaacaatgtgtatgcgatatctattcaaaaaacaaaagcgagagagagagagatatactgtgctacacacctagtaattacccactgtaatacgagtatctaagggacaaagtcagctaaactgttaaatgaaaatggaacatatttaaatagtttcacattccactataaatagtatcctatttataacacagaacactcctaactatagtaaaatgtttcattttgccattaatcttccctataatatctttattattttaatctttatattaatcatgtacattctctctgcctctgaaatagtatgtccagaactttcattcagcatgtttatcagtgaccttcatttaaccctttttcactgccatctta

SEQ ID NO: 58515 - DNA, 844 bp, Bovine  19866881107746
ttccagtcttgggccccatgtgcacagttcaaaactgatggccatttccaaactattctttgaaggcgattcctctttggataaaggcctgggagacccgagggtaatgactggccttcctgtttgtctgcatgccacatcatgttcagaaagcataactcagtgtgacagatagcagcagcaggcagacagatggggtggctctctgtgcatctctaagagagccgcaccctaggaagcgctctctcagtgcgcctgccagcccatcaccatgcccgcccaggacaggatgtgagcagaggggtgagagaagagggccacctcctccacacaaagcagctcggagcaaaacagaggttttcttcaccctccaggccctgatctctgtgttttaagtgcatctgaaggcagatcagagtccaggtttttgacgcagctctaatgggaagaagctttctgcaaacgcttccctctctgctagcgaagtgcatctatctcctacactctccataaaaaagtagtcttgaaaattaataattcaggtgaagatgcaatcaaatcaatgtgccctcaccctgtgctgtgttttcagttttaaaagaggcctggggaaggtgatgcttaacctaaaataatacattgatatctagaccttgagtatccacatcatagggagaagagggatccaggcaaccttgcctttcactaccaaagccgcacgttagtgggctcattccatcctaatgtcagctctgccttctagttcagtgaagggattctttgccataaaagtcaggtgccgaacatttggaataaatcagtgttctcaaccgttttcccaaat

SEQ ID NO: 58516 - DNA, 914 bp, Bovine  19866881296363
ttgcagtgcttgtccttttctgtagggtttggtttggattttttcacactgctcagagagaattccatccaaaggtcctcaagtgcctggaaaaggacaaggaaagagcatctctgaatcaagtgcctggaaaaggacaaggaaagagcatctctgaatggtggcattgttaaatgccaagaacctgcctctccagtggattatctgagacactgaaacacttttcaaaggctttgctaagtattcattgtggtaaaagacaaattctatattaaactcacactggggccagaagtggccttgggttaaactgaactggatgatattcatcgccttctttttattgccttttccctcatagtaaatgctccatcccttccccctaaaatcccttggagtcttccccctctcttcctcttagctttatatgattgagtgccaggaaaggctatatatcggtaacttagatcttgttccttcccagggacattggtcccgctgcaggcttttcaaacagagcggctcattcttccttaccctcgcagatttataacagcttctctgcttcctgtggtcttacaatctacctccacgctgcagtcagtggagaacatgtgaactggccttatttaccagccaaccttagctttgccaagacttcccctgctgtctatcctccagccaaacattggaactactctcatttccacaaacctaccacgttccttctgcaccccgagctttggcttacagtgccctaccgctggaacatccttccttgcccccttcctttgtcccttattcattccacagatctaagtttagatgtcctactccaggaagcctcccctgactcctcccattcaggttagttgctcctcataaataatttttagtacgtaggcccattatat

SEQ ID NO: 58517 - DNA, 2030 bp, Bovine  19866881379923
aggagcctagcgagctacagtccatggaatggcaaagaatcagacatgactgagtgactacccctttcacctctcaggtgagtcacacggatatttacgtttgcgatgccctgatctaggggctaacctagcacagttcagcaaggtggtccatagccacatgttcctattaaaacttaaattactgggacttccctggtgatccagtggatggaaatccaccttccagtgcaagggacatgggttcaatccctggttggggaactgggatcccccatgccacaattagagaaaagcctatgaggtgcaaagaggagcctgcgtgctgcaactaagatctgatgcaatcaaaaataaaataaaaaataaacttaaatgacttaaataaaatccaaaattcagttcctcagctgagctagccacgtctcaagtactcaacagccccacgtgctagtggattccctaccagacagcaaacatgcagaacattttcattctcctggaaagctccagtgcacagcacctttagtagtgaacccaatacactagggtagaaaaaaactgatactccattttactttagtccagctcctgagtcttacttcttttacaagaggaagcaatcagattcagccaagctctgctgtctggtaagcaaaactgatcctttcctaaaatgagcacatctaagagtaccaatctaaaaagtttccaaaggcaatctccttcataactacaagaagcatcaattgcaaggtaaaccattagagaaataggatccagctttcccactggtttttacagctttgaaaagagctttaaaaagattacctttatctgagcaaaagctactaaactgacaccatttcttggtggttctcaaactctggtgtgcacgcaaatcactgggagaggtttgttacaacacagattcccaggtctgaccaccagtttcagattcagtaaatccagggtagatgcaccccattcccaacactgatgctgctgatcccagggctacgctttgaaccactgacccaggataccacaaacaatggaaagatggttagatttgacacttgtttccacacggacattgtgtcaggcaagaatgcagaagcctgtgcagagaaagcagactgaaatcaaatgggtcaggactgtgtgccctcagcctcttttccagaaagatacacaccaagtaagaaatggtctctggttcttaagtcaacagtgtagtcaaaatgaggccctgattaactctccctcacatctcaaagaggcagcctccaactattacctattaacttcataaatctctgaaaaccagcttctaaccccttccccgccccaaaactgttaaaccagaaattttaaaagcctacaatgattgcctaattgcccaaaccactaatgtcttaacctccactttaactggcctttccatacactttatgttttagcaacctgtctgcctcagaaattgtcatctgcttcagcctccatggttcatcttttatctaacgaaactctcagtctcttttaatggaagctcctcagactgattttgctctttctcaggggcaaaaaagattatgacagaagttataaagggagaaatgggccccttcctggcacacagactgagatctgcattaaataagaacaagaagattctgcaagtgtcattggttgagggatcatgcttgctgctctcttgatatttaggcctccttctatagcttaaaaggacatcatttttctttgtatcctaaataaggaaaaagggagacaaaactgaaattcaacatcagcccacaaacaaagctaacaaaaaggtaaaatacccccttccataggcacagggctgaaggtagcatgcatactgcttgctgggtcactcacttgagtctgactcttgtaaccccattgactgcagctcaccaggctcctctgtccatgggattctccaggaaagaatactggagtgggtagccattcccttctccaggggaatcttcctgatgcaa

SEQ ID NO: 58518 - DNA, 900 bp, Bovine  19866881401391
ccttcctcccttcctgaccttaaaagaaggagtttttgtcattgttgttttgaagatcatcatttactttctggaaaaggagattctactttttaatttgtaagtctaagtggactctacctgatttttcacttagagcaccaagatcacatttgaccttctgccacagctcaggtcagaagaactgtattaaaaattctctccacccaacaaagaatgttaatttaatgctaagtaatgaatatttaaggaccctaatagatgtgcaaatgaacaattatgctgcagaaccctgctgttcctaccatcaccctttgcattgccacaaaaactcaacttgggcttcagtcagctttttgttattattttcagtactgaatcttgagatgcgtctgaaggctggagggctggtgaataaatgactccagcagtgaggtgccggcacatgctggcaacctggaaagcctgaggggtgattaattggaccctatgctgaaattactttgaggtgtaaatattcattaagttcatccgaataagactctgagttctttatgggcaggatgccataaaacagatctgaaaggaccagcagtaattaactcagttaccgtccctgggaccatggagcagcaccaagttcagcctgcctccatatttgctctgagcagattgaagtcattccagaatgtgccacaccaggtgagtcaggatggtagaattttttttatatgatgcacacacagatttgctctcgtatatatctatagcgagtctcaagcatgtgatattatgagcaacacatcaagtgaagttaaaaagagcaataccaattcattttaacagtcaacttttgcattctttgcctttacagtaaaataatgaaaagcagtaaatctg

SEQ ID NO: 58519 - DNA, 817 bp, Bovine  19866881408877
tgcttagatgctcagtctgtcctactctttgcgaccccttgggctgtagcccaccaggctcctctgtccatggggattctccagggaagaatactggagtggtttgccatgccctcctccaggggatcttcccaacccaggcctcccactttgcaggtggattctttaccttctgagctactggggaagctcttgccaatagtagcaccactggaataacagtatctcaaaaggcttccatgtgattgtgaggacttaaatgtgtatgtttaggcacaggttttatttttcacaaaacaatgcatttcaccttggtgcatatccgttatatgaaattttttaaagcgtgtctcagtttctccaaagtaaaaaagagtctaagcttccccatgctcccttgaatgccaagatcaccgaaaaccaagtttaatgactactgaatctatttccaaagatgcaagattctgcttttagaacttcattagaatattcttgaggcagaaccacactacacagaaaagcagcaccgcccttttccaagaaaagggtcccatcagttaaaagactgatgccataaatatgacaaagggaaaggtcactattttgcttaattcaacatgttctgagcatcttctgggtgctctgccccactccaggtgacccaagaaaaagagaaaaggacacagccctagcactccagctttcaaaatcattttcagacaacgtctttccaaagcactgaatccattcgtaaccacctatctctggtgaagtagtttacacgcatgactctatttacacttcagatttaattgtg

SEQ ID NO: 58520 - DNA, 1853 bp, Bovine  19866881465915
tgacttagcagcttagcagcagcttctttaagacatgttcctcagaccgcagcataaatatcacctggaaaatgttagaaatgcatgctctcagcccccagccccaatctactacatcagaaactccgagggtatagtccagcagtctgcatttgaacaacctccctgagagattctgatagatgctaaagtttgagcatcaaggtattgctcgccagtgctcagtcactcagtcatgtccaattcttgcgacctcgtggactgcagtccaccagaatccactgtccatggaattttccaggcaagaatactggagtgggttgcgcatttcctattccaagggatcttcccagcccaggaatcaaacaccatatcttttgcatctcctacattggcaggcaggttctaaaactagcacacctgggaaatcccagttgctctccatggaggatatgatcttctggaaagcaagaagaatatttagaacttctatgtgccataaacttctcttctccatctcctccaacatccactccagcacacacacacatacatagacaatatctatttattaaaaaaaaaaaggcagttgtgatcagattaaaacctcaaagtctgagacatatggaaaaattaacatgattaagaaaagttttttgttttatttttctggtgttgtcttcaaaaaggagtagaggaaggaatctatggagaaggactgattgaagatgcaaggaatgatggtataaaatatcagtgtgagtgggaggaaggcactggcatcagattaaaggggaaggggtaattcttaaaatacagggatacttctgagtctgagagaagacagatggataaaggtgtaatttaacactgaggcaaaggaaagaaaaagtgaatgggttcatgctgaaatcctcttttcttaatgatgaatgaagtggtaaacagtaattatgagacagaaaatgacacaaataacaagttattgggagttcataaaaagagaattaaaattatgagataaaggataagaaggatgcagtcttgcactaagtcatccacagggtttgattctgtgcagtgaggggtggttctctcagttctgggggttggacaggtgagaaccacagagcaccttagaattcatcactggtccatcagtagatgctagtttatgtttcagtcatttcaggccttggtagtcctgcctttggagaaggcaatggcaccccactccagtactcttgcctggaaaatcccgtggacggaggagcctggtaggctgcagtccatggggtcgtgaagagtcacacacgactgagtgacttccctttcacttttcactttcatacattggagaaggaaatggcaacccaccgcagtgttctcgcctggagaatcccagggacaggggagcctgatgggctgccgtctctggggtcgcacagagtcggacatgatgaagcaacttagcagcagcagcagcagtcctgccttataagacttccatctgaagtccactattcggtttaaaaaaaaaaaaaggaacgtagataataattgcttatcattaataagcccactacttgcaaattttgaaaatggcatcattctgttgttcagatctttctagcccaacagtattttattaaaaacttaagaatttaaaatctaaaatataatacaaaaaaaaaaaatgcctcccatgtgttcactcattttaactggagaaaaaaaaatctaaaagaattaattaaaaatttttccttttccttttcttattagttccagacaagtagaaggagagaaagaaaaaaaaaatctcaccttgcctatggttatataaagatatt

SEQ ID NO: 58521 - DNA, 773 bp, Bovine  19866881469617
tttattacatgaatatcccaggtatcccaggagcgttagtggtaaagaacatccctgccaacaaaggagacgtaagagatgtgagtttgatccccgggttgggaagatactctagagaaggaagaggcaacccactccagtattcttgcttggagaatcccatggacagaggagcctggcagggtccaaagagtcggacacgactgaaatgacttagcatgcacgcacacgaatattatctgttcaacaatatgaaaaattaatagatgggactgaattaaaatgagacataattctttctagtgattagttattgagaagcatggcttaaaagaagcatattttactattctaaatttggagtgaaatcttttagaaagttcttatttaacaatcaaaattaaaagatctgtgttgtctgctttgaaaggagttatgttatcatgagaaagcgtctctagatatgtgcatttctctttcttgactatttatcaaagaagactttctggattgaacctactcccatcaccagatagatttcagcctctcacaaagaagttatgtgcttttatagaattttttctataaagactcatcttttatacatttgtattcattctgtaaggtccttaaaattcaaaacaagtatgattatattttgcagcatccaattcagctacttttctgcagaccaagctcaggaaagtagggtgaagacccaagagggccaaaagggggtggtgataagagcctaaaaatgaggtcacatggat

SEQ ID NO: 58522 - DNA, 1056 bp, Bovine  19866881554459
cttctccaggggatctttcccaacccagggattgaacccgggtctcctgaattgcaggcagacactttatcctctgagccaccagggaagactctaagctcctttctaaatattccaccacctcaaggactccatacccttccttccaaggtaagagctacttggcaggactccacaatgtcaattttaatttccaactttgtgttgtgatgtttcagaatttatacagctcccagggagaagcagttgtcaccatggcaacctgcaggacactgcagtgacagaaattggtgcctgcccagacctagtaattgctgcagtcttttcctcttggattcctagctatggatgcttgaatacaaatactgagtgggctccagccagcgagggtaatagtgtacagcaataaactatctgttagctgatgcttacatttcagacaaattgaggaggttgtcaaaggcattagcttctatcttttccagggaatcactctgagagatttcactaggggagagagagaaaaaaaaaaaaaaggaaaaagaagcatgaaataaatgattgtttctgcatgataataagttgtatgcatgacccaacaatgggtgggggtgtgtgtccttttaaaaaagaatagggatgccttaagttgtcctcacatcataacgtgctcacacctccctctaggagcccgaatgggcacctacaacccagatgcagttgaaatgcaagtttcagtatttcccgttaatgtgaccattttgcttatttatctgtggactcagagttacagattgttggaagtagacatgtcctctggggaaatccagttggattcccttgttttatagctttgggcattaaaattctgagaggagaggcaaatagtgcttataagaagattcgggatcaggatcaaaatgtctgggttcccaactccatcactctagtgaggttttaatttgggttaggattcctggtttcttgactctttacccctctcccaaatcctcttctgaggcagctgcagagtggataactcctgaatgaagtgtc

SEQ ID NO: 58523 - DNA, 1991 bp, Bovine  19866880401275
aataagatatagacagagggtaatcagaaaagccttcccaagataaaaaagaaaagacttcatagaggtaataatattctatttgaatataggaggttcaaggtagaggatagtgtgtaagtagaaaaggtggaagattaatttgaagatcagcattagtttataaagtagcttagattatactaatagtaccaaatttattgtctagaaattatggcaataaaaaacccttgagatatttataatgagaaatttagcacaactgcacataaggttactgaaagtattcatttatttccttcaataccttaaaatatggaacattaatatgcattttttattttgtttcattttgtctttttctaagtgtaaatcttaagcatccttttttcattaaacataaatatttgtgagttttacacaagtgattttatgcatgtgcatttggctgactctgtctcaaaccaaaacacttgataggaatattgacacttttttccaataatgtttaattttcccttgcatctgagcaatttcagaattggttttgtgtttgtttgctcagataggcagaacaaatacactaatcagttttgaatgtgaattgtgaatgtgtttagctaatactacaggatttttcataatattatttctaaaataaccagttagctggcctcagatcaatggcttattcattaacttaattagcttatgtaggaagtacaaaagatggaaaagtgggtggccactgtaggggaaagctttttactgggaaataaaattaactttgttttaaaaaaaggagtttatgaggccatttatttcaccactgggaaaccagttgtccccagactagaattgttaccttggagggaagacagggaatcaaaacaagataaacatgaatttgtagaactcttactatgtgccaggaattgacctggggggttgtgatacagtacaatacaataaatgaaatgtaaaacatttcttttagttttcactgccactttgggaaataggattattttcccattttacatattagaaatggtaaagctgcttggacaagtagtagggtttgaaagttaaagaaaccaggtgtcagaattcatttcagagatgtcttcagtcacttaaaccagtggcttttctaattccttcctagaagctctcctgtgtgccctagagacctgaggagtctaaaacctttacctttcttctgtcattcctccatcctgctgaaatgttcagaactcctggaataagtggaaaaatcactaaaacacaatatacttctgttatcatttttatatttcaataattcacacaagtctggctactcccacctgatctgttttctacttcactaatttccccctttccttgtgaccatgtttgacaaatataacatcagggttgttttactgaattgttattttcatttctagaatatcccattgacttgaattctatcaatgttagtttctcctgtaattttccatgtttgcctctgtttcctgagtatgcaaacaagttattatattatctctggtaaaacttccaatgtctaaatcctctttggatttatctctattttctttctttcttttttttttttcttgttagtcatttggatcttcttttagtttgccacataattttaaattgaatacagcatattgcatttgaaatttggttaaggttccagaagatactatcttcttccatggaggattaatttttcttctgccatgcagtaagaacataagtagttcatttcttttagccaaagaccttatgcatttcaaagtgaaagtgaagttgctcagtcgtgtccaactctttgtgaccccatggacggtagcctaccaggctcctcagtccatgaaattttccaggcaagagtactggagtgggttgccatttctctctccaggggattttcccaacccggggactgaacccccgtctcctgcattgcaggcaga

SEQ ID NO: 58524 - DNA, 2455 bp, Bovine  19866880527159
ttaagtaaatttgagtatcagctatcaaagaaggtttagacagaggggtaaaacatgggaaaaggagaggttttaaacaatgccttcgtgttatgatctctttgtgggacagagttttagatttttaataagttgaaaagtagaagtactgcaagtaatcttcactattacattcagcaagaagtcccctgaaagacacggtttccctaaatattttatgcaccactgaagtctgggacagataagtaattgtgaccagctcaaaggtagaggcaatggtgggaatcttcctcagaaagacagggaaggcaggagtgaccaaatctgcaaactgaaaaagaagagtaaagggaaagtgaggtacttatcaagaaaatacatggagcaggggggtgtgatgggagatacactgcacatttgtttgccctgcacatttccccttggcaaaagaaggggcagggaccatgaagtgtagaggaaacggtttccagtaattgctgctatggagcgcttatgtgccaggcaccgtgctgcatactttaaatatgtattctcatttttgtttacaatcatcaaatgagagaaaatttccttgtttgacagatgaaacagcaagagaggttaagtagctacccatgtggtggacaatggtcatattaaaaagctgtctgagactctaaagcccttggtcttcaccactaggtaaatctccctttttatttaataataaaatatcatgcttactaaagataagtgattgagtataagaagttagcattggcacatttgcaaaacattgaaagaaactgaaacacttaaaacaaccaaaccctgcaagtcagatttcaggtcttgattcaaaggaaaatgacacccatttcatcaagtataaaacagtgtccccagtgcagcccagcctcttccccatttctaactacaactagatctctttatgccacttttggttcaaggttttctgttttttttttttttactcacgttctgcatattttcccccctgctgttccattttccttcttttgttcttgggctactaccttgaaccctatcataattgtgacctcctgggctagaccccatctctgaccctgctccagtgggtttcagcagaggatactacctgggctccctcctagtcttcatcctgattctctgagggttccagggcctggagccagtcatccaaaggggtggaatccattggccctaagggattgtccattccgcacctaggaaggcagcagagtcagagaaatgtgcacttcagtcaggctctcccttttcagccagtgaaagtgaaacctctgcaaagtggggagagataaggcttagtccaccactcaaggaaggaacaaggaatagtgcacacacccctcagcctgcagaggctggctgggagggtcccaggaatgtagggctcttctccacttcctgatctgggcatcccaggagcgacggctgtacctcctgttcttgtttggtgtttgagggtgaagtcctggctgtcgctgtgccctggcaatgacaaatgtgtcagactaaggtcaaggccaaggggcacagcttattgcttattatggtgaattttccaggcaagagtactggagtggttgccattgccttctccattatggtaaattaggagactcattagggattttctgagaatgaggtaagatcaatgtccttaattcaaagaaaatgtttaaattagattaaacatcaaacttcccaactgtctaatattctttcttctgggtaagctaaattagatattccaagtccctcattagtcaagatagatacagaagaaagtatttgacatctctttaaaacatattctactttttcattcattaatttgtatatatgcttgtaagcttacatgtaattaggcaggtatgttgtaattaacagtcagatggaggcatgggccttcccaggtggcactagtagtaaagaacccttctgccaatgcaggagatgtaagaaatgcaggttcaatccctgggtcaggaagatcccctggaggagggcatggcaacccactccaatattcatgtttggagaatcccacggacagagggaatcccctggggctggggtccatagcgtcctagttacccatgacccggtattcatggccaatcttgtttcatctatattcaccaccactcccacgggattatttaaaaagcaaatccccagctgaagtaacttatcatacacgcacatggaggcatgaggtgaaaatggaagaaaaaaaatttactagcaaacacgaatagagctttgagaagtcttataggccaagtataacttgttccttttgaaaaaaaaatcttggaaatgtatttgggggactagattacaggataatttagtaatgttgcaactttgtgggagcattcagattttagtatctttccatcac

SEQ ID NO: 58525 - DNA, 960 bp, Bovine  19866880722290
actgagcgactgagctgaactgatggttgttagtcctcagtcgtgtctgactctctgagactccatggactgcagcatatcaagcttccctgtacttcactatctctcagagtttcctcaaattcatgtctattgagtcaatgatgctatctaaccacctcatcctctaccacccccttctccttttgccttcaattttccccagcaacagggtcttttccaatgagttgtcactttgcatcataaaagggaaaattaattgaagatagatactcattacaacaatagaggatgatatggttagatagcatcactgactcaacagtcagtgatgaacatgaatttgagcaaactctgggagatactgaaggacagggaagcctggtgtgctatgaagtccatggtatcagaaagagttggatgtgacttagtgaatgaacaacaacttattacttaatattgtttttgtatattaattggctcttagtcctaaattaaggaagattgtttcttatagctgttttgtctaagtcattttagaaattaccacctcactataacaaacaatcttatgctttccataacacagtaaggaacaaatgcaaacaaccactgaagatttaatcttaacaagatattcagggaactcatggggattcttcctttaattggaaattgaatgacaaactctaaacgtcttatttctgcaaaagctctgttatcctaatctactggtgagagatgaaattttctgttagaaatgctagtttcagtttaaatatttgaacatactattttttgtggcggtgggggggggaagggggatctgatagacaactgacaataagctatttaagacaagttaaaaaatctgttttattgaaattatatcttagattaaccaaaccaaagaatgagtcagactagtaggaatgaaactctgctaagtaatgcaacacc

SEQ ID NO: 58526 - DNA, 1317 bp, Bovine  19866880803248
aatttaccttctaccttttatggagaggatttccaggttggtaggagattttatttttaattatatttccttaggaattttcatagaaccatcttcctctgttatctgtatcttctcatggcattctgtatgtgtgtgtccaaatttccctcttataaggccatgagtcatttaaaattagggatctaatggccacattttaactttattatgtatctacagactttacttctaaatgaagtcacattcacacatcctaggcattcagacttcaatatattttaaagagagaagggaacactgttcaagccataataagaatatacctgggttaacatcattgcataatggcatagtagcggtgtttctggtatttggaggaaaatcttttcatctggacaaagcacagggttggataatatgagagaaatgggtaagtgttctgagtattcttttgtttctctagatccattctcagctcttctctgtgcccttgaagctgagttccatacaaggcattatctggaaatcacatgacttctgtcttccagtgaggttcaaacaacaggagttacagtgttgagaaactggattagttattactgttcttcctgcatgtcagtgcttcacttttattactaaagcttacaaatgctgtctagtggtcagtcatcttctacaggtacacacaattcttgcttaattctaatagactctctgcatatctcttcattccagagtgataaaatgtctccaaataggggagcataatacttacttgaatgagcttgtaaagtgttgcaagagatttttgatgggaagttatacctaagcacagtgggctgcacgctccccaacgtgcatgaaaaaagactatgcaggccaattaagcgattggctcctaacctttccccactcatgtaagcaataatgctttgtaagtgttacaaaaacaggtgctatagacatgttctaaaccatgtatgacagtccgatttctattgtaaattacacatgagggtttctatttaaatgagataattccacccatatttacttatttgcagttttcatgcttcatggttatacaactgcactaacaatttcaagtggtttataaacagattcttccctagaagacaagtgatatcttaatctctttactctgctctaggaaaaaacttccctacatgtcttagacaactccttctttttcatttcttcccttaatttaaaaaatagtaaaaaacatttttattaaaaattctttttgtatgactttctgaacttgtcattctcacattcaccaaacaaatg

SEQ ID NO: 58527 - DNA, 702 bp, Bovine  19866881081074
cctgaggctttaatatacaactctattctattttaaaccatatattttagaaatttgtctcctccattctttccttattgactatcatatttcagtagactttctgtcttgttctaaatacaatatttataattctgtcaccccatcaggatattatttggattttccttgctttgttgccagattttcatttgtgtagatggtaaaaaacacttcttacttttttgtagttatccttaagttctttataaacaggacctctggccatgactgaatgaaacagtgctttaaatgaacaccagtgatttctgaagacgaagatgaatgatcatttagtgattttattctttatcaatctgcataacatttggcattattgattcttccttctgctttgaaatctcctccttcctccagtaattttaaactcttggccttgtacctacttttctacctgcttttctctttcttttttaaattctgcttttggatattttctcaagtttagccatatctcttctttatttagaaatactttttgttctgttctgagaagtaaaatttattgtttttctgaggatctattttaaaaacaattctgtaagtcctttgtgctctgatgttgtatagaggttctgcaatctgacaaccccttgtgcataggtattaggattttctctcaaagaaacactggcagcgagg

SEQ ID NO: 58528 - DNA, 1277 bp, Bovine  19866881091394
cctttgatttttaaaacttggggaacatttatattattaaaaataaaagttgtggtaaggcttgatgagacataaggtgattttgtgaagtagctattgctgccatttagcagtttgttagacgataattctcaaaatgaaactgaacaaaattctggtttggaattcattactcagtccttaaggatgttttattgggaaaaatacggtattgtgctgtccaaatagaactttataatgagctctttttattttacattggttttatagttactaaaagcactgattttttgggggtttcaaaaattattatccctgctgcaacattataaatagaaagtgcattagtctgtcagagagctaactttgctaaattggttaattttgatctagtaagcacagcttgaatgtagaagtaattataacttgtatatatattatacaaaaaataaacccaataacttataataaggaaatgtatatattatagtgcatgaacataaatttatcctaacatagaaattaataatcctatatatacaatatttaacccattttttccccatgaactatgaacatggcaaatatatttctaaatcaatactttcctaagcaaaatataaaaggtttaagtcaaccttcgggagattattgaaacatttttgaaattaggattgtctcagctaatctctggcactattgttaaagaacttgcctgccaataaaggagacaagagatacagcttcaatccctgggtggagaagagcaacccactccagtattcttgcctggagaatcccatggacagaggagcctggtgggctatagtccatagtgttacaaagagttggacatgactgagcaactcagtgtgcatgtacacatctcacaaggttattctgaatatttgtagtaatggttatgaaagagatcacagagtctggaagactgtaagtgattgatgatgatagtattaatgatacaattgatatttattgagcaattatgtgtcaggaacagtaaaaacgttttatacactttggtcaaaatttccttgaaataactctacatggtaagtattattttagttttcatgttataggtgaggaaattgaggcttaaaaacttgcatgactaaatttaaagttatactaactagaaaaaaagtgaagctagcatccaaagtcatgcctgaagcaatcaaataaaattgataggtcgccatacccataaaacacatctctctaaacttcatattctaattttagacaggaca

SEQ ID NO: 58529 - DNA, 1656 bp, Bovine  19866881430555
tctatattttttaaatagtttataagagacatcatgtgaaaattgtatgttccatatttgaattagtactaggcagggaaatgagacttggcaacagtgagtaagggaagagtagaactggaaccagggggtaacatgaaatcataagccatagtatttttcagcatacatgtaaagtgtattgaacattccacaagattaaggagatctttaaatcacctataattttagtgattcatggatccatctggattaaagttgggtctcttcacacataaagttatttgaactgtgttataacagtccaaaccagccaacctctctttgtattgtgcttgtgatttatttgcacaattttcaaagtttggaatattttgagtctctctgaattattcaccatctgcttgtctcctttgagtgcagaagtcaccatttgctcaggagccaatttgcttgtatgatactccaaggtttactgtgcatctgcactattgcatattagagttcagaaaaatatgtctctgaagcttagtttatatattcaaccaaatgcaattatttggaaaatacagaatgatctctgtactaaaattgatctgctctaatctagagagagttaatatattcagtgatcaattccatgcaaggcgtgtaaattttacatagactaacactaacagattgcaaggaatctaatgagtgagtttctgtgtcttctaggacctatacaaatatgcaaccataataaattagaagagctggaaaaaagaaaaaaaaggtacacacactcttcatatggtaattacccaagtggagattatattaaaataggtgttttactcaatttctaaaataaattcacacattttttaccttaagaatggtaacatacctggaatattgcctgaatataaaatcattgtacaggtgttttcactacagtgagggatgttgagagagaatattcaattcaataattcaggaagtttcaaaaggtattacagtaacctagagttggcagttatgcataattttcatatgcagttgcataaaacttcctaattctaggcatcaactcaaattccaagagcttataatttgatttttattgaaaccagcaccttggtaataatatatggtacagcaatatatctgagtaacatttatacgtgagatatcaacatgattaaaaatattaacaagaagtctgaatttccttctcctgaaaggcatagaataaaagtacattatttaacttgttggtctactcttttccaaatgttcacaaaataatgcaaatataatcctccaaagagaaacaaagtgctgttttcaatatcaataaaagagatgcagtaattgaacattaaatgttgctgctagaatttatgtctaggttgagcggttaagcaaattgcgatctgttataaaagatagctgtgattgctatctatatgagccatattgccccatttgcacaatgttgaaaattcagtagtactggacttttcagtgtctactttgtgtaactgtcagggtgaggggccaggatcttagacggtgcattttaagatgttgctaattctggacaccaaatcctccaaaaatttcagttttactatttttatcatttgtggtattgaatgctcttacttg

SEQ ID NO: 58530 - DNA, 1498 bp, Bovine  19866881470706
catagaggatttttagggtgatagaacttcctctgtgtgattcctcttatagtagataaatatccttatatacttatcaaaccctatagaaatatgcaacatcaagaatgagccctaatataaaatgtgtcaatgtaggttcattaattatagcaagtgtatcactctgtgcgggatgttgattgtaggagagactatgcatccgtagggagaggaagtatagtaggcatatataggtatctctgtactttttctaaaatttttctatgaacataaaactgctataaaaatactctgtttttaaaaatatgtatgtcccttgcattatttggtatgactgtattatatttttcttatgttttctaaattgcatgctttttaaaaaacattttcatatttttaactatctttttctgtgtgtttaaaaatagcatgtgttacttttaaagattagaaaatatttaactttgttgtagctgtttttttattgtattttactttattccctgatatcttcatggatgtatacctcaaatatgtaagaaaatacttttacttgtggctttataagcgtcagtaattcctcagtccttaaaactatcttccatgccagttcgtgaaattttcacaaagagtatcttacatctgtgatatgaatttgttgtgaggaggttgtttcaaaattggaatagagggaagtcaaggaatttttagtttttcttttacctcactctccagaactacccccaacagataccacaagcaaagaactttattttagttccaaatttaagaatagtggctatatatgaaggcatttgacaaggacaaagagatttaaattggagtatattttgaaataggtgaagtcatctatatagtaaggcatgctgctgtagggtaaaatgcataatgtcaattttcagattctttttcagtatcttaggattttgagctatagatttgaaatatacaattattgtcagaaagtcctaagctcatagaaaaaataaaaaagacatttgatgggtgtttttccagtcttttcatttccaaggcagataattatatgaaattgtgacaatcactgtagtgctttaggatgaattgcctgagcagaactataatagtttgagcagcatgttgctgtcatcgagtacttggcactgctttcaggttaaaactcttctcattaatatactagaattatgaaagcaaagctggactgtaaagaaagtaaatttattttatttgctattcttatgtcacatagatagaagcataataattaagaatgtgggatttgtatcccatttgcctatgttcaaactgtgacttcttcattttctttttctttatttttttattttttattttggctgtgctaggacttcattgtggggcacaggtttgtcttgcttcttcactttctagtctggaatcatatactattccttctctgaaattcaatttctcatacatatattcagttcagtcg

SEQ ID NO: 58531 - DNA, 1470 bp, Bovine  19866881559623
actcagtgtccctataataaatcactcagaagacaagggcaccctgtaatggaggagcagccattatgattgtagtccagctctgtccatggtacatagctctctataagaccatgggagcctggtgatcttgtgtgctctgcttcctctctgcctgtgagacctcctctacatcctcacaaaaacaatccagtattttataactacactatgtggcactaataatctatgtgcccctgttcctctgaaataaatcacgattaaacaactagtaaacaaataaaacctttctaaagtaattattttaaaatgtatttcaaaagaaaaagttagaaacatttagtattttcttgaggaatcagtttttttttttccttatattttctccaataagaaattttcaatcacagaaaaacatacctttgggaagagcaatagtatgtaaaataaaatatagatacagcttgaggtaatctctcagaagccctgtaacaattttaagaaactcttcaggcaaaaatagaaaacctcaatatcactagcttatttggaaagaagacaaaagggtttcaaaatgtaacagctacaattcttcagaagcacccatctggaaaaactcttaatattcatgctaatataattctgtttttaagcacatatgtgtgtgtgtatgtgtgtgtatagcttaaaaagctgctttgataatgcagcatgagtaataagaggttatttttaattttaaaagttcaaatttgattcagaatttatataattttgatatttccaagtaaaaatgaaattattcattctcccacttttaatgactttttacataaatgaaaaagcaaggtatatttttagttttcagtttcacctcagacagaaaggagtgatcattaattttccagaaatgttcaaatttaaataataatagctattttaataataataataaagattgtgccttaagctgcaaattaatttgctgagtgtagaagttgcactgcttcagtgaattaaacaaatctcttttcaattttatgcttttctcaaactttctgggataacgggttaggatctttcaagccctcccttgataatccaagtgtagttcatgaaccataagcaccagtatcatctataagatttgatttgaaagttcagactctgaggacctcccagaactagagtctggattctaactagaacgttagtcgatcaatttttaagttttagaacccttgctgcagacctaaaattctcacagtttgctgtacattagaatcacctgggaggatattaaactgctgatgcctggattctatccccaggttattccaaagtggtaccaagttttaaaacttattactgatgctttttaagaatgcctagatggccattagggcctccattttgtaaagttaggcacagagacctgaacctttcatagacagagctagtatttaaatc

SEQ ID NO: 58532 - DNA, 1493 bp, Bovine  19866881694150
ttttgcagtaaaatcccagtattgaatatattcattttataagtcatcataaagacaatacacactttattaaattaatcatttaaataattctacctaatactataatattaggtatatttgcaccgaatccaaatatcagttgaaatccatttcatattaagtatgcctgggatgattttatcctaagctggatttaacaaaatcattagtgtgtgaataacacagaaatgtcaaaaagtattaaagtccctttccaatttttgatattggcaaaatagagtgagataagaaaagtgcttatatattacttaataaagtttaactttgagcaaatcaaataccggatcagactgaacttttaacccatactaactgctaccaacttttgccaaaaaaattagtggttcattattgcctgttagccattatttcaaagctaagagtttcctgtaattttgaatgtactgcttttgctaaatgtgttgaaggcccttaaaaactggaatatgccacatatgatcataaaagaaatgagaatgtaataacctctaatgacaaggaaaactcattacgcctacagttttgcattgcctttttattcagtttttataatttcttctattgctttgggtttttttttaatatgcaattttattctttattcattctcatgccattcatttcttttgtttagtttcttcccttttgacccattgtgttaaactattcttgcagaagataatttgtcatcgctgccataatgaatccaattttccttaacccagacctggccacggcttgctatactgcaaaggaaactccctgaaaggctaataaggggcactatatgagaagtgtgactggattattatagttttaattagatcagtcacaattcttgttgaatactgttcagagaagtattctttagtaaagcaaattgtgttcttaaaaaaaaatccttattcaagaatatagtcctataactgctaaatataaaagcagagaagttcaaagcgtgcaattgagttggatttttctactcttttttttaaaaattgccagtgctaaatgtgttgcatcttttcccagttatgcactataatatcggattaaatttatagaatttacctattctttcatttagattatgcatatatatgtaaataagaatgagaaaaatgcatacctgtattattgaaaaccatcacataattttggtacaggatttaataatttagtgatcacttcataaaattattttaggaaatccttccaacacaattcagagtgatagtaatataaacataaatttatactcacagtactagagtagaaacaatgtaaaatttggagctaaaatattaagagtggttggttaataaatatatacttaaaacttagttgaaaaagacagaggcatttgggcttaatacctatttttttttttctgatgttattttttttctgatgttagttttatttattta

SEQ ID NO: 58533 - DNA, 1807 bp, Bovine  19866880349662
cagcagctgctcccctttcagccttaggagtggaatcacatcactcctgtccccagcttttcactgagcagcactttgttcttccagttcagcccaaagtctggccaagtcgatgttaaattttaataagagtttctttcttctctccaaatgccagtcaagcacatttataatacatttgggtggggtagcttattcttttccagaaatctcatctagattgcttgtgatgttacaaatactgtttaaaatcattgctattgttcagtaagcagctccctgcccctccttgggaaggtaccatcatgccgaaaatcaaaacaaatacaagtctgatttgataaggaaagatgcggttcttatgctcatgttctgcctggctctgaagagggctgttttcttctaatttttcccagaaagctaatcagggcagcttacatagatccagatactaaccagtgacagaaaagtcatacagtccaaatgtgttaccgctggtgacacacctcactccgttgtgtgagtgacaatcatccaaatagccggagagcatccgaatggaagttttgaagtgggaagctcgatacttgaaataagtagagggggagatatccaaaacacttctaaatgcaatgatacaatttgatgggcactcaaaccacatgcttaactcccttatcactttaaagaggaaagtactacattaaaaaagaaaagaaaaaaaaagaggacagtactacagtctttgtgctgttctctgttagggccacagggagatgggaaactgacgggagcatttagctggatcttccgaagcacttagttcacttggtttcagctaagtgataatgccagtattacgatgagatggtttggatggcatcgccgactctatggacatgagtttgagcaagctctgggagttggtgaaggacaagggaagcctggcgtgctgcagtccatggggttgcaaagaatcggacacgactgaccaactgaactgaatatgggccagatcctgactctggagttttaaccccaatgtgcccactagatttcacgaaatatgtggacacttggaaccaggcaggttaaaagagcaaacgaccagaatccctaaagccggttaattgttctattgtagaccatttaaattagctttcatcaaaatgtcaggtttggggatttttctttaagttcagggagactgaataaatctcacttcgctcttggctccattttaacctagagtgagaggactctgtcatctcccaccatcatttcatccatcactttcacaaaaactcaacatgctgaggaaacagacctgtctcccagacccaggacagagagataaggcttatctcctggtcccaggtaggacttcctggaggtgatcccaaaagaccacctttccctttgtctttaaaaatctctgaagacaatcccaagccctcccatagtggttaaccacaattctcataatttatccattctttatatgagggctttatccttctattgcaaaaaaaaaacaacccaaaaactagattcagcgtgcgggtaaagcatttatctcagttttcggcatgtagtcagcactcaatatatgacaccttttactggtattttttcttgggtagttatgcccttgacctacagtttcggcatagagaaaaacagcctctagctgatgatacaaaaagcctttttgtttttaaagactgttcccaagattaaacctatataagtactgtctcgaccaaaagagttgctgggtcccgtgagcccagattaggaagtgtga

SEQ ID NO: 58534 - DNA, 1375 bp, Bovine  19866880369425
aaagatttaacctctgagtttgggtaaggaagtaacagaggagggccccttagagtaaatacccactccctactcccaagcgccctttacgtatgagaggcatggtcattctcactggtgggcttttacggcatcaccagggagtcagagacaccactcttttggacaacccagagtagggccactccagtatttcttgcctggaaaattccatggacagaggagcctgtcatgctacagtccatggggccacaaacagtcggaacaactcagcgactaagcacacacacagagagcagggacagctttgaacgtgggacttccacggtaacagacgagcccgcgctcagaagggccgacacttggtttaatcccctgctttgccctcttgaaattcttgagtattttttaaataagggcccacattttcatttggcattggatctcacaaagtagatggccctgccctgaggggttttttgtggtcttcaagatagattcagaatagtactgcttaatttacttggataaattcactcccccccaaactggtcacagtgactcatctgacggaaaccttcaacactgggctctgaatccgcctgtacttattattccacaggtactggaaaaacaaacacttgtcacccaaacggctgagcacaggtatcctcatgtacaccctggcgtcagcagtctgtgaagagatccacttgtatggattctggccttttggatttgaccccaacacaagggaagatcttccgtaccattactatgacaaaaaaggaaccaaatttaccaccaagtggcaggagtcccaccagctgccggctgagtttcagctgttgtaccgaatgcatggggaagggctcaccaagctgaccctgtcacactgtgcctgagaactccaagcaggaagtgccaaacggctggtttaaaagtgccccgactcacaccgagtagcccgtcagaatagacccctagagagtctctcataaggactgtctgccccttaagagcaaaggggtcttttctcccctctgccctgctcttttaagggtcttagcaagacagatgggcttttgaagcctcatgatctaaacttgattgataaagtgactgttgcattgggaactctgctgctaacgaaatggttggaagtattttcaagtttgtattttaataataaactgcctcctttttttttttttttttttctagtgaggattagagctatagtgtctacagctttgctcagatagaggcctcgcaatcagaggcctctgggcagaggttagggcaggatttcagttttgcctgggtgggatcagactcttcaaaataaaacagaaaaaaaggttgcaaatatcat

SEQ ID NO: 58535 - DNA, 1004 bp, Bovine  19866880866943
ggaaagctgtaatgatgaaaagctgatggaaagctgatgaaagccgtaaagtcataaagtctgttgtgttgcaaaatcaaatcaactcattgttctgtgaaatggagatgccaacggggccacgaacagctggggtatggtgctctgggccccccgtctacgagcacccttctggactcagtagagaagggagtccacgtcggctcccccactgacacagtctagtcaaggtcgtggtgtgcaaggacgtggacgtttgctcgtctctcgcccaccatccatccagcgtttggggtgatgcagggctcctgcctggcacattccctgagggtttaatgacagctccggtaggttttatgtccctgtgctgggtctttgaactcaaggcacatgggctccaggcacagagggatggatggatggatggtgtctgtacatcgacctctagccttcatcccgaagacggtctccccaaggccacccgactaattcactctgttccttgatttccgctcctcccctgcccactgacagaacctaaaacaagagacagccttcctttgcccaactgttataaattcccgtctgagcggatctcaggctgattgccttggctccgccatctgtctgtaaatggggctcctcacatgtgacggatggccctagctctggagttacctttgacctgataggaagcatcaccgctaactatttaacaagattgtttcggagctaactcctctggatggcattctccctgggttgaccatttctcatcaataaaaactgtctatgggaagaagtcactcccacctcacgttgaatgatggagaatggagcatggcctggagctcagagagccccttgcctcctgaataaccatcacaaaggttgtcagaggttagtctctggtcttcccgtcaagcctgcatttagcaaaattagggtatggattttcctttattcctctggcatcacaaatgtaatgtcggattttttttcct

SEQ ID NO: 58536 - DNA, 1285 bp, Bovine  19866881066253
caaaagctctgaaagtctgtctatacctgctgtattcaatagctaccctccgttttggcgtgaatccactacaataggacttttgcctccagcaatccaaaggtattcttctcatcaagtttgctgatgacttccaggctgctaaagtcatggagcaattctcagtcctcatttagtttgccacagagctgaagtgtatgccctttgctcagcgtatgcccctctcctctgtggcacgttttcctcccttgggtctttgacgcttcactattccggcctccttcttactctgtgcactacacttcctcagaacctttgctggcctcctcattcctccagcccccagatgttcacatgacccagcccttggaccccttatttttcctgtcttctctctccctccatcatcttattcaggtttctgattttaaatgtcatctatatctatagatgctgatttctatatgctgatttctatttctagctgggttcccattcctgaaatttagactcatatgttcaataggcatctcagcaccttcacttgtcatttttaaaactgaactcctgatcttcgtctccaaacttgctcctcttgtaggcttccccatctcagcatccacatggcaattgcatcttcccggggtccaaaccagcctgggtcagagacacagttgaacaagcatcccttctccaggttacctggatggacctggggaaccggcatgtgctgtgaccttgaactatgtaatggagatagttcagggcagctaatttaggtgcctcagagggaatagggcgtttagcacatgaacaaatgaaatccaaactaagagcagaatccagctcccaggccaggcagttcccagtctgggatctactcatgataattctgactggaatttcaaaaagatcagaaaaataaaggcggatcctgatatttcttgtgtccttcattgagagttctgaggccaggagccacagcttattcatctagcatgatgtccagcatacactgggtgctcaggaaacctgtatcaaatgaaaaacaattattaacaactgtgtctttgccagggagctagagaaagtgggagatttgagagctcatttaaaagggagtattgggatgcagaagtcttgtctctgtgaagctggtttgggtagggggtggttacacatctgaaggcatttttaaaagcctatttagccagagcctgtttgtgtgctggggtgtgaaactctatgaatgtattatcagcagggccttaagatgggttgtgtg

SEQ ID NO: 58537 - DNA, 1342 bp, Bovine  19866881081081
cttttaaaagagctttgtcaaaatcctttggggagctcttggtggctcagacggtaaagaatctgcctgcaatgcaggagacccaggttcgatccctgggtcagcaagatcgcctggagaggggaatggcaacccactccagtattcttgcctggagaatcccacacacagaggagcctggtgggccacagtccatgggtcacaaagagtcagacacgactgagcgactaacacactttgaggagctgagaactttttcgggcacgagcagccttgtttctttacatggccttgcaagaaacctttctctgctccagtctccaacgtttttttcatgtgtttggcctcactgcgcgttgggcacaccaacgggtacttctttccaccttagaaacaccctcccttcccctccacttggcctcagtctaatcatcccacggggcctgttccaacctcacttcctccttcacgaacccggtgacacctggtcaccctgaactctagctctccttgttctccctgctgatacttcttctattaggatataatgctaattattttatgatgggtgtaactgttcagttcaatattatgttaaagatatattctgaccaagtcccccagctagggaataaaataggtggggaggggctataaagacaattaagtctgtatcactggcaggcttgagggcagggaaaaggatttagtctcaccacaatctctctcagtcgcccccttccattctttagcttggatgatttatgctttctcaattttaggtaaaaatctatggagcctaaggaggcatagctttcccttccatccagatggaaattctagaacctcccttttctgttaaagataaaaggaaaaattatcatcaggtagagtatcttcactgaccgcagtgcaacacagctgggaattaacaacaaaacattaactaaaaaaacgatctatacttgtgttaaaataagataaagactagtcttaaaaatcctccaagcaaacaaagccatgggagtgaaactaaatttagcttattttttattaacataagtgaaacttaacttacattatttcctgcaaatatctatgataagtataatagaaatttaagtcatcgtccaaaagatggtataagataatcacttttaatcaatcctctgccatttggaaatcccactacaacaacgaatcattgtaaaagtcaaaccgcttcctctttcacactttataagccatcctgggatgagccccctgtgttttctgtcaatggttgaatttggaaaccagttcaagaactatttttatatgtacaatagactcttactaaaca

SEQ ID NO: 58538 - DNA, 815 bp, Bovine  19866881167072
cctttgcacttgtaataaaaatgcaataaagtaattggttaaaatcgagacacccctgataaagaatatttgctttttaaaataactggctaaaataggaacatatctgataaatgagtttatgggggtggggggcggaaggccaggccttgctaattagttgagattctgtttcctacatggattccttctttacctctttggagagaaatggagccgtgaaacaaggaaaatggtctgcagcactgaccaaaaccatgtgtgctcctcagttaatagagaggtgtttacacgctgttaacacttgtttaaaattcccaagcttcacagtactagaaaacgcaggctttgacggcatatttaatcacaaaactgtggttctcaccagatcgccaatatactttgaccttctttgctataaagcagaagacatggagacgcaggaagggagacgttctgtatcctctggtctcttaattcgttgccatctgtacttgagttgaaaatccatgaatgtcttgatcttatttcccttgagagtttgctctatattaggtccctatttaaaagctccaatttttaattaaaaatttattttttaacaattaaatatataaaggatgacacttggtataattgtgagcagaccagaatacattacacatagcaatagtaataggaatgacaaggaggagggcaccataaaaaaggcatgtattgatttcacacctttacgtggccccctgatagcaattaatgagtctgggaggcagtcatgttgcctctggacactgcgtaccctggaggtccccatt

SEQ ID NO: 58539 - DNA, 1488 bp, Bovine  19866881168416
cctccctgcattcggtctagatgtttaaggagtgtttgaggacctaagaagctccctgtgaaacacatgtctggtgtggccagcagtgcatggaatgcaaccgtctgtttccaatggaaaagacagtaatttgtacccactcaagacattttttatcaacatctaaaaatgtaggtcaagaggacacagattttcccccatgggacgttttactatgtaaaagttacagagagggcttacaggtctgtgcatgatgaatatttgaaccatattttttgaataaatacaattttataaaaagagatcatatgagtgtagtgtaaaatgcccaaaggaataagaccttatgagagctgtctgggaatgatacatgttggaaaaaactctccttgaccaggaggtagaggggtctgccatggagtccagaggacactggttacagcttcaggctctggagtcagcagactggccctggaacgctgactctgtgacctaggagaagttgtcagcttctgtgcttctagctttctagctccttatctacaggactgaaaataaagaccgccccccgcccccgacccagaatctgagaaaaaattaaacaaggcaggtaaaggccttggcagagctcctggcttgtattgaacagttaataaatatgagctaaaacagccctgggtacatttttagtgtctttctgtgaccctataaatatcctactgtacaatgtatagaaaaagacgtatttggtgaggcattttcctacagaaaacggcaaagaagctctttggttctcttacagcgttacaggttttcctgggacatatgatatggactcattcctcttggatttaaaaattgatgtattgcttatgcttagcacacctctgtgaaccttctgaagaaagtcctgctagaataattcccatattgcatatggatcactgaaggtcacatgatgtaaaggaaccaaattagctagaaaataaataggcatgcaggaatcctatgccaggcctaaaggcaaaaatggattgctcagtaattaccagagtgaaaaatcttgggaatgcttcatcaaagagcaactgaggttacagaatctgatatttttcaggcctgggattatagccacttagtaaaataaaaatcaggtacttttacagaatatcacttttcagatttcattggaaatctgacctctacaggagttcaggaggatgaatactatatatatatatatatatatatatatatatatatatatatctatctcaagacttctttgacttaaagtttcctaggggagttattattttggatacaagtatttccccgctttttcggtggcacagtgtgaagaattcgctgccaatgcaggaaacgtgagagatgcagtttcagtccttgggtcgggaagatcccctggattaggaaatggccacccactccagtgttcttgcctggaaaatcccatggacggaggtg

SEQ ID NO: 58540 - DNA, 1107 bp, Bovine  19866881355592
cagttaaggcagtttcaacatgagatttgaaaaacttgattttcagagctttttttggatttaaaaaatgcagacaagaaataatgaatccattttcatcaacaaagacctactgtgtcgtgcaggaactctgctcgatgtcacgtggcaacctggatgggaggggagttcgtggagaatgaacatgtgtacatatatacggctgagtccctttgatgctcacctgaaaccatcacaacatggctaaccagctatactgcagtacaaaataaaaagcttaaagaaaaaagaaataacgaggttgtgttttctataaataagagattgttttcacagagcttctagacagaaaatgctctaccatgtccatttgaagttcctacaagcttgaatattaaatctatctcttaaattcatctacatgtaaaatcactttcacaatattttaaaataattgagaagattctcaaattcaaccagaaagatcacttatttcaacctgatgcctaattcagctgatccgtactatagcatcctagccagatggtcactcagcctttgccgagtactcatgtggataaacgattcacttttcatgcagtaacctgctgtactctcaagcaaccttaattattagaatcaaagtcaactcccctgacacttttaccctttggtcccaactctgccctggggatcagcaaaaactactctcccccaactctgccgcatgacagctaggcaaatatttgaagtggcaatcataccattcacctcttctccagcctaaacatttgctcgaactcttccccataaagcatggtttcctcttccctcacaccctgagagcccacggtaatctttaacttgtcaatatctgtattaaaatgaggtaggtagagcgagacaagcctctagcccagagtacagggaaactgctaccttctttgtaagctatataccacatttctattagttcagcccaaaattacattagctgcttatggagcataatatgtttatatcattttgcacttagagtaaactaacacctctatttttgcacatgcattgttgtggcaatccaggaatctcttttgatttctattt

SEQ ID NO: 58541 - DNA, 1691 bp, Bovine  19866880379023
tatgagtttatctttttgaagaatttgctagtggtcttataatattcgatactaaaaaaagaaacagcttctgtttattttagccagatcttcattcataagagctgtacttcctgacagctgtgcttttctctcaagagttttcaagctgttctccctttatagctagatggtgcaaaaaggggagtggctccccaagtcacaagccagtcagcagtagagcagggagagaatcctaaactccagccaccaaagtcacgctcctcttgtcgttgttgttcagtcaacaaaaacatcacatccgactctctgcgaccccttagactgcagcactccagtcttctccaggagtttgctcaaactcatgtccactaagttggtgatgccacccaatcaccttgttagttagaataggaaaaagggagtccaaaatgtcgatggctaaaagacaaaggaaggaaaagcccacagaaaatggaacaaaagaaaatccaccgactggagtgagaacctcaggtgaaacaaacagccctcctggctagcccagtttacatacggcaggctcagggggaggagagaaagcctataaaagaggagccaatgttgaactgcttttgggtcagttcaccctcatgtcttgaggatgtattttcctttgcttgccaaataaacctgagctgtaacagagctgtaacactggtccaccatttcaaatttttgctgcggcaagacagaactgaggaaattacacaggcccccgacaatcttatcctctgttgcccccttctcctcttgacatcttttcttaatttgatataatccaaaaggtgtacatatttcatgggatattaatacaagtatatattagggagcagcaaggcaacatgacatcttctcttccttcccatcattaagttggaaagttaaaaaaattaagcattattatccgtaataggtgtcctgcttagttctttaaaaaaaaaaaaaaaagtcttgtagttcacagtatacgcaatttttactcccttagtaaaatttaagttctatttttttttcattatcacagatgagcttgtttagttttctattgaaatttttcattgttcagttcagtcactcagtcgtgtccaactctttgcgaccccatgaattgcagcacaccaggcctccgtgtccatcaccatctcccagagttcactcaaactcatgtccatcaagtcggtgatgccatccagctatctcatcctctgtcatctgcttctctttctgcccccaatccctcccagcatcagagtgttttccaatgagtcaactcttcacatgaggtggccaaagtactggagtttcagcttcagcatcattccttccaaagaaatcccagggctgatctccttcagaatggactggttggatctccttgcagtccaagggactctcaagagtcttctccaacaccacagttcaaaagcatcaattcttcagcgctcagctttctttacagtccaactgttacatccatacattactactggaaaaaccatagccttgactaggtggacctttgttggcaaagtaatgtctctgcttttgaatatgctatctaggttggtcataactttccttccaaggagtaagcgtcttttaatttcatggctgcagtcaccatctgcagtgattttggagcccccaaa

SEQ ID NO: 58542 - DNA, 3946 bp, Bovine  19866880399825
tgctctttctgaaatgggcctttaagatgctgtttccaggaggtgggggacatgtttctcttcgtcttattaatgttagcagtactaataatatttatgaggctcttctcagattataaatcacctttatgtagggaaatgtgtggctgcttaattcactttgctcagtgctcaacacagtagctgacatgaggaggaacttaatacatgctctcagggatgctgctgctgctgctgctaagtcacttcagttgtgtccgattctgtgtgaccccacagatggcagcccaccaggctcccccgtccctgggattctccaggcaagaacactggagtgggttgccatttccttctccactgcatggaagtgaaaagtgaaagtgagttgctcagttgtatctgactcttagcgaccccatggactgcagcctaccaggctcctccatccatgggattttccaggcaagagtactggagtggggtaccattgccttctccactcagggatgctactgagtactaagtcagttccgtcacgtgttcactgtttgcaaccccgtggattgtagcccaccaggctcctctgtccatgaggattctccaggcacgaatactgcagtgggttgccatgccctcctccaggggatcttcctggccagggattgaacgcatgtctcttatgtctcctgcgttggcaggcatgtccttaaccactagcaccacccgggaagccaacaaccattattttatcatcaatacctgtttttccatgtgctggctgtgggcagagctcttatttgtttttcttttaaaaaaatacttggctgcacagagcctcacttgcagcacgtggatctttattggaccatgcaaactcttagttgtggcatgtaggatctagttcccagaccgggatagaagcaaggccccctgcattggaagcacagaggcttagaaactggaccaccagggaagttcccaaaggcctttatgatataattttatgcctaaattcatggggcagaaggtatgaagagtgacctcctcactttattttttcatcctggtaagaacttttgtccatctcttatttatgggaatctattctgcttttagcttccttggtggctcagacggtaaagcgtctgcctgcaattctgcttttaagatacacatctggcaattgccccaaagactgactacatgtttaacttaatcctcgtggactgcacttccagctactatagcttcttcctcccagggaaggtgctaaacaaccggtcgatcctttacaagtaactgctttcacctctgggatgaatgatttcattttccttggtctttccataaacactgttttccagtacttcatggttcacttgtgaaccctgtcaaatgctctaatgcctcgaggcctaaacggaggcacatttgggcaaggctcttacaatggcactggtgttatctcttgcgcctcttgggaaaggcactgttcacctgttttgtaatgataaagtagttccactccttttacaataaagttacttggaatctttcatagtaataatggctaccagttagtacatggttgtgctgtgtgctgtgctaagtcacttcaatcatgtctgactctttgtgaccccatggactgtagcccgccaggctcctatgggactctccaggcaagaatactggagtgggttgccatgccttcctccagggatcttcccgaccagggactgaatcagcatctcttatgtctcctgcattggcaggcgggttctttaccactagtgccatctggaaagcccctagtaagtacttactgtatgccaaaaatggtatagagaactttacacttaagatcttgtttaatctgtacactggctctctgacgtctgcattattaatgtgtctagtttagagctgaggaactaagtcttacagaggtcaagcaaattgcccgagctcacataactgaacagtggcaaaggagcagaaccacgcctgaccagcttccaggtccccgctcttagcctttttgctcttctacctttaaggctattacagcatcacttttgtataagagggtgtacaaaacaaagcccccaatttctatcaaagcatccccccaaatattgtccctttatagccagatcatgaatatctgcccagtttttgaaggatgatatttaacaagtcctctgaaaaataaaaggaatagggcttccctggtggctcattggtaaaggatccgcctgccaatacaggaggcaggggttccatccctggtccaggaagatcccacagtggagcaactaaggccatgagccacgaccactgaccctgtgctccagagcccgggaactgcaactacggaagcccgctcgccctagaatcacgctctgcacaagcgaagccactgcggtcagaagcctgcgcactgcagctggacagtagccccgcgtgcgcaactagaggaaagcctgcacagccacagagacccaccacagagaaaaataaagtaattaaaataaataaaaagaataaaagaggctgtgccatacattttcctccctgttcataaatgtgcaaaggtctggagctattggttaagactgtaggtgttttacagccaggccgttaataaaactccctataaagctgctgctgctaagtcgcttcagtcatgtccgactctgtgcgaccccatagacggcctcccgtcaggctccccggtccctgggattctccaggcaagaacactggagtgggttgccattttaaggctagtggtccatatacatgaggttttaattaaggaacacaagaattctatgccataacaatgtgaaacacccatggagagagtctgaaaaatttccccgctacgaaaactcacacatttaaaaagatttaccagtggaattgctctcataagtaagagacaatttaaagacgattgcttcctatcatttggaaagcaaagcaagacaaaataaaaacaaaccaacctactttcaaaacaaggagacaaaatgaaaaagtcatacacaaaaacaacttgtgaaacaaaataaaaatcaagaaacattagcgaagacattttcaggaattactgacattgtgtctctagtggttcaaaagaactttgatctatcattaaaaaagggaatgcttaagaaaattgacaacggcaattcccatgtgtaaacatttatggcaaagagctattagcagtttgctctgttgtatggaacaagaggctggatgaaggctgctgctgccctccacttacatcagaggttccagagacttgggtttaatgaagatggcaatgggatacagctgggccacttgtaaccgcttgatagcatttcctgatacgtcaagtatacagtgtttgccctgggagaaggaaaagaaaaatacggtgttaatccagggagaatgattataatcaaagcaaaagaaaaaaaaagtaagtatgctttagagggaggtaaaagatactacatttcttcaaattttgaaaagaattgttgcaaagcataaataaaagttggtatagagggtcatcgccgaatgtttgcagtaatatgtttcttattcctttactaagtgtcagccaacagagtagacattttactaaagttatctcagctaactttatttatttccttaaataaatacctgatgttttgcacaaggaagccatctagccatatataatgtgactgagtccattctcatgaaaccctcataaaccatctctgaagacaatcgtcgaaaagaaattcccaactagtcaaagaaggaattccccacctatgacatgtgaattgtcaaccgcattttacagaagagaaggctaaggcttaagaatactaacttgcccagtgctcatgtcagcagtacatacagtagaaactcacgcaggtctcag

SEQ ID NO: 58543 - DNA, 1922 bp, Bovine  19866880426335
tttgaggccaaaacatctcagaagtaactccgatgtacatacttattgccaggctgaccaggagcaaattacttaatctctctgacttggaaataatgccaactgtaattacaagactatggttaggataaaaatgacacaggtcaaagagctgcacaaaatggggcccagaaaatgcccgtgctaagttgatttttagttgtgtctgactctgtgcgacccaatggactgtagcccaccaggctcctctgtgggaggaagtattctccagggaagaatactggaatggattgccatgcccttctccagggggtcttcctgacccagggaacaaacccgtgtctcttatgtctcctgcactggcaggcaggttctttaccactagtgccacctgggaagcccagaaaatgcccagtctcttcatattaaattgagaattcatttgaccagattattcatgcttttttatgtactcagggtttacagggacttgtaagctaattaggacaacacagtatgtggaataacactttcatagagtttctctgttaccaatatttggtaatgatggtgatgatgaagaaaaagaagtatgagaaggagctggaggaggaggagaaagagaaaagcacccagtatgctcagttcattctaattaaactgctcattagaaggagaatgccccaggaagtctaattcagaatgttgtttggttctaaatcaagagcatcgaatagggagacaattaaattctgtttccaaaacatacctcaaggataagatcaagtttggattttgcttctcacctggctcagagttaccaaggtcacactgacagtctaaggacacagcttctggctagagaaagccctggtgaactatcatgggaaagcaagaaacaaaccacctggaatctacgtgtattagtaaagccggcctgtgttttagagaactgaattcttcatggcatggaagaatatagtttcttctcaaatgaaatgcagactcatcagtgttcactccgaagtgctaaaagctttcataattatgctctttttcaaatctttgcagcacagttgttccccagcttggagccacaaagcagtgattgtagatgacgtaggagggtatctatctggcaacagcctgtgcttgttttaatttctccacctgctattgaaaagggggagaggaccaggatttagaagccaattattcactttgaaacatgattattaagatgaattgtgctcaagcgcacacttgaaatctggctgtatgctttttaagtgtgttgtcttaatattattgtggtctgattaaagatgaacaccacccaaggaaagtccttctgtgaatcgttatcatatcatggtgagttatcacttccttccaggctgacctccctttgataagaactaaggaactatatcttggttttccttcttcagactctttgagtttcatatcccaccaaagttgtacatgactagcccatacctgtgagcttttatacgcactctcctttaatccttccagaagcccaatgtacatatgtgaaaactgaggctccgggcagccacagaatgtgcccaaagtcacacaactggaaagcagaggtggcagaagaggagccccagtctaacttcccagcggggtgtgttgattttcgcggtggacacagagcgactgtcaagaccaaaaatacctgagcaacaaagggaaaacagcaacttttcggtcataggcccagctataatgatttaacattcaccgtgggctacatcatatgccaaagcagtaactacaagctgaacaatcctgagacggagctgaaagcctcagtagcttttgcagtcattttccccttgctctcctctcctctggagagagaagacaccactcacaactgacccaaccat

SEQ ID NO: 58544 - DNA, 1889 bp, Bovine  19866880429297
tacttttgagacaaaatttggtagagctttgctctggtgctttgtaatagatagacacagctatagctaccctctacatgcctgcatctttcccttctgctaccagtttacaacttctttttctccccctttattcacattccacagaatccaattggccttgacttttttgagcactaccatgcaagccatggttgcagagttggggggtccaaccctggtccaagcagtttggctagggaggagagtaagttgggttggactcatgtggggcaaatgggcaagggcgattacaggcagggttgttattgttcagttgctaagttgtgtccgattctttgaaaccccataaactgcagcacaccaggcttccctgtccttcactgtctcccagaatttgctcaactcatgtccactgagtcagtgatgccatctaaccatctcatctctgccaccattcccctcctgccctcagtctttcccagcatcagggtcttttccagtgagtcagctcttcacatcaggtgaccaaagtattggagcttcagcttcagcattggtccttacaatgaatattcagggttgaccgccttttggattgactgatttggtctccttgcagcccaaggaactctcaagagccttctcctgcaccacagttcgaaaccatcaattcttcagcactcagccttcgttatggtccagctctcatgtgcctaggtgactactggaaggtggttttccttaaaataaggttgagtgaagcacctccctctaatatactagcattgtggatgagcaattaaaactgcccccagaaagcagaacaaatagcaagtgctaatggtgtccagagaaaagaaagatcaccacaggctggggtgtactaattatatgctataagagcctgcaattataaacccatagatatgcaaataaatgctgatggctcagcactgcagagtacaaagccatttatccacggcccctgataagtggacagcaagataaatgatttgtttataaattctcttagagattatgctaatgtctctaactgcgtttcccccccttctggggacatcagcagaatgaagagagcctgtaggtaccttggattgcatttccgtattcattaccttctgacctaggaggtttgcagtgggatgaagaggccctttcagttgtgtctggctgattcatactgcccagagtcatttccccggggcacttctttcctgcatatattggaagtgacgataacatctgttcctgccacccagatcccagtgtcagctcataaattggcatttcttgtctgtctggcagagaggtcatagagaatataactgcagggaaatagcaggaatgctgactgctggcattaagccttgtggagctcagagctgtgaagcctttgaagggccccagcttctgaggtgagtctcacaggaagtgagggcaggcgttgccgtagccagacttgcacatacacgagcccgtccctctgagagctgatgagctgtgcgtaccaagtacttaaagctgtcagtttctgagaacactggagtttctgtccttctgtattacctgtaattaatgatgatctgaaaatctgaaacctagtcaggcaattcagaataacttagggcttcttgaaagagttggaagtctttttctcattgagtcttttctctcaatggagaatggttaaaaaaaaaaagctatataaatatagctttttttttaaaccattctctatccattcattcaaagagccattctgtatgttcagatggtaactttcatagaaggatattagtggatgttttactgtggcttatgtagcatataacacgaactatcagacagaaatcttcaaatgtgaa

SEQ ID NO: 58545 - DNA, 3181 bp, Bovine  19866880450993
tcgtgtccgactctgtgcgaccccataagatggcagcctaccaggctcccctgtccctgggattctccaggcaagaacactggagtgggttgccatttccttctccaatgcatgaaagtgaaaagtgaaagtgaagtcactcagtcgtgtctgactcttcgtgaccccatggactgcagcctaccaggctcctcagcccatgggattttccaggcaagagtactggagtggggtgccattgccttctccacacacagcatacggaatcttattccctgaccagagatggaaaccacagcccctgtattggaagcttggagtcttaaccactggaccaccaggaaagtccctataacttgaatttagattctgaaaacatcaggatctattttcaagacattatttggtgggatgtggacctcagattttgagggagaaattagatgattgaaggtcaatgcccaaggtggtgtgatgatagtggattctctccctaggtcatgacaggaagaccctgtttgtatcccagttcttccacgtactagttgagagaccttggacaaattattttctatctctgagtctgtttttcataatttctaatacgaggtcgctggtgtcccatttccctgacttcacgtgatgatttactggaaggacatatgcagagttcctggcatgtggcatgtattcccttccttttttttttttttttgtctgccccaggtcttcactgatgctcgcaggcttttgtctagttgtcacagtcggggctacttctagttgtggcgcgcaggctgctcattgcagtggcttctctcgttgcagagcacaggctctagagcttgggctcagtagttgtggcacacaggcttagttgccccacagccagtgggatcttccagaccagggattgaacctgtgtcccctgagttggcaggtggattcccaacccctggaccaccagggaagtcctcctttcctcttttaaaggtaagagatgagcatgagacctgtgggaactgccaataatattcattctcttaggctccccttctcaatctagggtatgcaatccttcatcaagaaagcatcttctgagaggaggaaacatttttctcaaatcagttgtgcatataaccaaattttgcaattttttttttttaacaagaggctctttaggcaacaaaccacactgtaaagttcagctcaacctcagcgtgcattctggctagctactctgggcagacttttaaatcacattggctggaatgaatagtgcttcactcagcatcattacaatgatcatcctggtgctgttaatattctttgggctgcccaaagatgcttggtggctgagggacaagtcaagagtttaatttacctttctgagtatctgcaggttttgttttcaacagagaatttcaggttacataactgtcttggcttctgcttcagaaagtgaaccttgattctctaaattaactttcaatacagatcttcaggagcagagcctgttgtacctggaagcaatttgcccccaaatcatttggaaggaaacaagatgcctcttgacttctctagatacttggcagaagcagcaggagtaagaacattctaatcataactaggtagttgttaaaagtagagagacagtctaaaaaccaggctaagctttcttttttcaaactctttataactttaccctaattctgtccatactccactggactggtttgttccctcctaccaatcactgttgtgggtaggcattttgccaaggattttaaagaagggtgttaaacaaagggaaatgtaatatgataaaaatgaggctcctgggaacacgtagaagcaaatgacagagaaatataaagtaaatacgctgttctgtctaacacatgtgaaatcagttttgaattaacacctaaccccagtccacaaggtgcttttaatttactcaagagaaagacacatttcagtgtggcatgcagagtgttaaaatgaacaatttttaggaacacagaggaggaatattggaaggagggggcattcagagactaattaacaataatatacaactcataacgtgggcctatttgcagatatggatgatataatcaaagcttgaaactggtactaggatgttcatatagttagtataattcagggcttaatcttgtgtctacatttttacttcaaatcctgtgtgttttcccaatagtgacaggaaacagggccatggaacagtagtgacaaggccatgcagagtggtttcatatcaatatactacagaaatggaactaaaatgtaaagggcttgcaggagaaattcatttttattgaagtatatgaatttctgtgttgcaagatgaaaaagttctagaaatctgttgcatgacaatgtttatacttacagaaccatacatttacaaatggctaagatgatagattaatgtgttttcaccacaaaaaactctaaaatgtaatattatattaataatgttataataacataaatatgccaataactgtcatctataacaagtataactgatacatatggaccactaactgtatgccaggaactgtgttaaatgtgtaacatggaccatctcacttattttaatatctctttttgactaatgaaaagcccaaaacctagattgggtaacatgcctaaggtcccacacaactagaacatgagcacactgactgtaaaaccatggcttcatcagtcaccttccacaccaagtctcctttactgaactgcaatcaaagtatgcaattcaaaatcagatactcttttttcttgccttgtgcacacatggagaactaggtaaaggaggtgacgactcactgaaggtcaaattgaagtcactgataaactgtttttaacgggacttcctggtggcacagtgaataaaaacctgcctgccaatgcaggggacatgagctcaatccttgatctgggaagattccacatgccatggagcagctaagcccatgcaccacaactactgagcccaagtgctgcaattactgaagcccatgtgtcgcaagcttgtgctctgcagcgagaagccaccacaattagaaggctgcacaccacaacgaagagtagcccctgctcgctgcaacaagagaaagcctgggagaacagaaacccagcacagccataa

SEQ ID NO: 58546 - DNA, 1889 bp, Bovine  19866880466112
atcctctatcatccccttctcctcccaccctcaatctttcccaacatcagggtctttccaatgaatcagttcttcacatcaagtggccaaagtattggagtttcagtttcagcatcagtccttccaatgaatgttgaggattgatttcctttaggattgactggttttatctccttgcagtccaagggactctcaagagtcgtctccaacaccacagttcaaaagtatcaattcttcagcactcagctttctttatggtccaactcttacatccatacatgactactggagaaaccatagctttaactagacagacctttgttggtaaagtaatgtctctgctttttaatatgctgtctgctgctaaatcacttcagtcgtgtccaactctgtatgaccccatagacagcagcccaaccaggcttccccgtccctgggattctcaaggcaagaacactggagtgggttgcccatttccttctccaatgcatgaaagtgaagagtgaagtgaagtcgctcagtcgtgtctgactcttagcaaccccatggactgtagcccatgaggctcctccgtccatgggattttccaggcaggagtactggagtggggtgccatagctttctccaaatatgctatctaggttggtcataacttttcttccaaggaacaagcgtcttttaatttcatggctgtagtcaccatctgcagtgattttggagcccccccaaaaaaaaagcctatcactgtttccactgtttccccatctatttgccatgaagtgatgggaccagatgccatgatcttagttttctgaatgttgagttttaagccaactttttcactctcctctttcactttcatcaagaggctctttagttcttcttcgctttctgccataagggtggtgtcatctgcataattaaatcctgtaaaaagaacctcaggattaatagatgaattgatcaagatgcatgggaagcagatttcaatgttgatatccagagagtttaggaactcagattaatattttcagttgtttttgctaattgctaatgacaggtatatatattatagcatccgaagaaggcagtcgtgtggagacagcctggattaaaattctaagcaggggaagtgaattattctttccctcaatataaaaggttctggaaattaatcattttatttcagaatgaaatctgtatggcgacagggcaggcctgggcagctaacttaacatagttttagctgctgtgtaggtggaattaaaaaaaaaaagcttcctgaaactcttgtttataccaaatcctggtgccaaacaggtgtcctagactcccagaggtgctgagtcataaacattcatgaggcattttctgtgtcagtattttcagctatcagattaaagtggtaatggatctagagactgaaaggctgcttaggatttccagaattctaaaagcagacggtctctgggtcaggattaagttctttgagtgcagagcaaccataaaatcactctctgttaagtgagaatgactatgactaatgaaaatgcatatatgggaaccaattttttcttgataacagagggtattaatgttgacttccacattcaacataagaaacaaatttcacatattcaccgaaaagtgacacctttcaagttgaattccttctaaagcacagggcttgatttgtatcctgccctgttgtcatgggtagaaccacaggtcaccatgtgattcagtcagagttcatatggaaaacagaagctgtcctgtgatgtttaaaaggaaagaaatgtaatacggggaattaaatatatgaatagtatcactgaagaaccggaagagtaggaattaggaggctgttgctggattgaagtcaagaa

SEQ ID NO: 58547 - DNA, 1372 bp, Bovine  19866880506070
cttcattccattattctctcttatgcctaccttctttcctctggcccacagcaacaggtaatattccttcatcttccctctgatgcacaaaacggtggcattatcctaggcccaggaggaagtaaattggcaaagagaacccttgctttgcagaataactgagggtaagaaagccattgggaaactgagaaacccaaataacattggcagtgccactctaggaagctgagacagctgtggggctaggaactgggtggcattttggacctagagatctgtaggctcttggctgtgggacaaagagttcattgcctagtcaatgacaatatacaaacacatctgcagaatatattctttggcaccagcaaatgttggcaatatttagccaacctctatttttctagtccccattcacttctccttctaatctattctttccccttgtttttcctcactgaaaatgatttcaaacaagacattaattttgaagaaaaatgggtagaagtgagagtaatagatgtacagatgttttcagaatttaaaataagggaaattgatctaaaatgttgtctactctgttgctgtcacaacccagcccaagtgccatcatttaaaagcaagtattgaaacattttccagacccaacagaaacataagcaccttatctcttactaatagtgaaacagtaaaccaaactcacacctcctcttcatctttctgcctcacattttaccccctctctcagacacacacatacacaaatatcctagatacgaaatattttaagactttctccatgactgttacgtttaaaactttgagcatatgatctacctgtcaaattatggttggtagggggtaaaagtgaaaacagaccttagatgttaggaaactttagcgttaaggcttatagcacatggagaaaggcaagaatggaagaaagagcttggtgataatttctgtttcacttcaaatctttttgcctctttaatatggcagagaattctttgccactaattgcatggtcttgaggccagaaaattaactgcttcattaaaaaaaaataattcaggctctaaacatgatcatacaaaatatagattatgaaaataatcataaatagctttttgaggtgcctcgtttgagacatacaaaacctcatcctttatccagttaattagaagctacttatattaatggtcttttcccgattcgacttttgtcttatttgtcacgcctttcctaatgccatgtcttctgacttcctgtatctgaatgataaaagcagaggtcgtcattatccagaagggtgacctgtgtagcatcctgccttctttccaggatttcccagcaggtcaaaatgtatgatgag

SEQ ID NO: 58548 - DNA, 609 bp, Bovine  19866880520567
agggaggttttaaaatccttcacatattattttaaactaagggaaaaaaaaagaaacaaaaagcatggtaatggtagttaagaagatcatattaatatcacgtaaatgaaaatacagtataacatatcttaaaacgtatagcaaaagattaataatgaaaacaataggaaaaaagtattgatccctaggtcaggaagatcccctggagaatggaatggcaacccactctagtattcttgcctgggaaatcccatggacagaggagtccatggggtcacaaagaatcagacacgactgagccactaacattttcattttcacatcacacaagctcactgaatacttggctttccctattcatttttccaaaccctagccatgcagtacacttaatcaaagttctggtgggttggtcggcttgtctctatgccttccactgcaaacacttcattaatattttcattgtgagtgtgtgtataatacacacttgcacatttccccaagacaacccattagaaagcagaatgtggaatgcaagattagggttttggattattggattttttcttaccctctccaatgtaatttcttcaaactcatattcaattt

SEQ ID NO: 58549 - DNA, 1334 bp, Bovine  19866880572792
gggactgtgatgaatttagcacaaaggcagtgccagccagcagaaaaggactgcattatttcagtctaggttaatgccagttttctaagaaggtactcgggaggaaagccagagatctttgtttattgtcattcttttgatgtagtgcttagaactgcctggcttaataaatgtttttgaaataaaatatttattgtgtgaatggataattattttctgcacatacttgcttcttgaaaacaaaaacaaggaaggagaacactttaaaattattgggcactgagatgggccaagtatctcactaaatgctcacagtaaccaagacgacttcatacgcccattttaccgtcaggtaaagcaagggtttaaacttagaggccgtccaaaccctaaagtcttttcatgaagttgctttgctattgatgataaattggaaagatttatagtcacggtatttatcatagcaacacacttcctctgaaaacttttaaaaatactatacatacaaaatgaatctatatacaaaacagaaatggtctcacagacatagaaaacaagcttgtggttactaaaggggagggtgaagggggataaatcaggagtttaggagtatgggatattaacagatatcataaaatagacaagcaacaagatttactgtatagcacaggaaattatattcaatattttgtaataacttataatgtaatataatcagaaaaaataactgaatcactttgctgcatatctgaaactaacaaaatattgtaaatcaactataccttaacaaaaaaactgaaaaaaatgctatacaagtaagtatttacctgaacaaatattcatagctaggtaaacagcattttctatgtgaattataaaactttagaatgtcaaaaactggactccatctaatacaatgcattttttttacatctgaagttttcacaggaaaaataattttgattttcaagaagtcatcgataataaattctgttaaaaatcataagccagatttaaacagcaaagaaaagaaacaatgactacgtcttaacctcaaggggcaaatgagaggtgtgatatcactccttagtttccaaaaggatttagcaaatagaactaattgttttactctcctataatgttataatgtacagaacagtggggactatagcagaaaaattgtagtttgttttttcatgaataaataatttctttaaggccttaggagagagcttttctacagatgtcattatgaagaccgaccaaacatcagcttgggagaaagaacctcctaacccataagtgatatgtatttcatttatccagaaataatg

SEQ ID NO: 58550 - DNA, 1044 bp, Bovine  19866880575650
actttccttctaaggaataagcgtcttttaatttcatggctgcagtcaccatctgtagtgattttggagcccagaaaaataaaagtctgacactgtttccactgtttccccatctatttcccatgaaatgatgggaccggatgccatgatcttcattttctgaatgttgaactttaagccaactttttcactctccactttcactttcatcaagaggcttttgagttcctcttcactttctgccataagggtggtgtcatctgcatatctgaggttattgatatttctcccggcaatcttgattccagcttgtgtttcttccagtccagcgtttctcgtgatgtactctgcatataagttaaataaacagggtgacaatatacagccttgacgaattccttttcctatttggaaccagtctgttgttccatgtccagttctaactgttgcttcctgacctgcatacaaatttctcaagaggcagatcaggtggtctggtattcccatctcttgaagaattttccacagtttattgtgatccacacagtcaaaggctttggtatagtcaataaagcagaaatagatggatgactaggagatagctaattaagaagatttctaatcagagtgagaaggatgtgatatgcagagatcaggggataagggggttgatcatggttctctggtggagtggaattttatccatttatcactcaataaactaagtatgcatgatggaaaaaatactaacttcagagtttaggaataccggagaattattattcatttttcatgaacttcttcaatgcaatgaaggttgaagtggtaaatgtcatgctttatagttagacagtcctgattcattcaagctgacctttacaagttgcttatcttctctgaactgaacttggtccctcatctataaaatggagataaatgtacttatcatacagctggttgcattattctgaaaatttaaagtgcgacatatcttgcttcccacctgccacaaagtagacaccagagtaattggtaattcacatc

SEQ ID NO: 58551 - DNA, 2009 bp, Bovine  19866880736030
cctggctgaaaatctgtagactgggggaccacttcttgtcatttcagtacaatcagcgttcccattgtcaaagcactttccccagacacaaagcactttcaccatgcatcgattctagggaccaatgttattatttctctccatttccacatcagggaaagaggattcagaatggctaaatgatttgtctatagctccacagctcctcactctgacgtgggactcaaaagcagctcccttgaccccagatcagtgttctttctcctcacggcacaatctctcttcaaaaccttgacaatgatctcagtgtatacagccttctttgtacacattgcttggtgtgcacagcacactcagaagcacacagaaccacagtgagtgagtgaaagtcgctcagtcgtgttcaattctttgtggccccatggactatacagtccatggaattctccaggccagaatactgaagtgggtagccattcccttctccagaggctcttcccaacccagggatcgaacccaggtctcctgcattgcaggagccaccagctgagccaccagggaagcccaagattaccagagcaggtagcctatcccttctccaggggatcttcccaacccagggatcgaacccaggtctcctgcattgcaggtggattctttaccagctgagctagcagggaagcccacacaaaactataaggaactaatatttacatggagcttttgagtcagtcacaggtgtagctaacgtaatcttataacaactctagccttattatgttcacttgaagtatgaataaactgaggcacagagatgatattattgactttttaactctgtttaagaaatcccctaagctatgggttttatttgtttaatctctaggcaggtggtgggaaaaggaacgagataataaccttgttatggctcaacaaagaaaactcccaagtatttctgcttccagaagtagattaatccatttaaatattattgccaggaccacagagtaagcatggcaacaaatcagaattatagtcttcttagagatttcaattcatagtacataacagcaatgtctgaagttcaaatatcatattcttttttatgtaaaacatttgcaaagatagtttaacaatgaaaataccattcattttttacagttggaaaggaaaaggaattcttttcagcttgtgaaaatttatataaactgtggctataaattggctagtataaaggttcagtattggaatttcattgtttaacactacaaggaagaaataaacaggcttgagaaactcacacgttattacaatatggaaagaaaactgacagaattattagcaatggaatatggaggataatattttgcacctacagcttccactggacatgtaaagacaagctataccttcctagaagacaaaagaacaaaaacccctaaataaaaattcaatgcatagatttctaagtcatgtaagatttatttgcaagtaagtcatgctaaaaatagcatagtacatttagagaggagaaatagcatccctggggaagagagccgaagggtagatctctgctctcgattgatcttcatcaagaagggacttatataacagacaactaccttgctaatcagggatgcaatatccatttctattttcctgaattattctcccacacagactgcagactcttctaagacaatttgttttattaatggcttactatgtgtcaggttctgtaccaggaaatgaaatctcaaagatgagtgagaataatagatctcaaaatgctcactgcccaaagcagatacagctgtcttccatatcctcggaagatttgttccaggacaacctgtcaacagcaaaatctgctaagctcaagtcccttgtataaaatggcatagtacattgaatacagtcggccctccgcatcagcgggttttgcatccatgcattcaaccaactgggcttcccttgtggttcagcggtaagagaatccacctgccaat

SEQ ID NO: 58552 - DNA, 2367 bp, Bovine  19866880845481
cgaccccatggactgtagcccgccaggcttctctgtccacgggattcttcaggcaagaacactggagtgggtagccattctcttctcacaggatcttcccgatccagggatttaaccccaaacatcctgcattggaggtggattctttaccttctgagccaccacagacgccctcttaacagaatactccttggaaaatagtttacatgggaaaagacagtttaaagagaaataagacagaaatccattttccaacaagaagtatggtaagaataataaccagtaattttgggagtatgcattataaccaggcactgcattttcttcttcttaattgtttggttggtttttgtttgtttgtttttttcaggcactatgttttcttgatgtatttaatcgtgcaagataaacattaacatatccatttttacagataaagcacccatgatgctataaatcagtgacaaagctagggtgtaagcataaggctcttgggtccctaaacctatgctctttctctaatttctactaaaggccatagtgagtaaacctgctcacatgcccatctgcccctagagttgaatgtgaaacactacttgggatggaaggatatgtttaagagcgtgggctctggaaccaggttgcctggagtcgattccaaccctgtcacttagcagctggtatcctactcagatgtgttaacctctctgaatctcaggtttttttttcatctgaaatatgttgttcgtgataatacctacctcatagaaatattttgaagattaaataaagattaaatgagcctgagcactaaaactaactgcctggcatatgagaagtgctcaataatagctattattatcaaaacatgatttctggtgttgatactcagtgaacctagagaagttataccgaccttgtcagtgaggaaacagctcagatactgctcctccgtgctgcctgcctgttaatgatttttggccaatcaatgggactgtttctgatttctgcccttctccccgttttcagggcttctttgctctagaggtagcacggtaggatagaaagacagttttaacatcagaagacctgggtttggggtcaggctggaatcgtacttggaaaccgtgtgacctgcgcaagtcattctctctctctcttccttacggactcctcatctgcacagcgggcagcttgaactcccgaacctctagggcctcttaacagcttccatttctaggagcactggacagagtcacttaacttctctgatggctcatttacactgtagcactgctgaactctccttgttgctgaggggctctgcagagcccttctctcagggagagcaaagtgtttggtgtgctgtgatgggctgtgcagatatgagtgctggtctttacagaactgttatgagaattgaacctgagtactatgccttgtcgtgtaggcatcggagactcacgggctttcctccacattttgccatggttgcctacccccactgggttgggtggatccaccttaacaaggtgtgggggaactcgaatggaggatgggggtgctgtacggatggtgggaaagcatcttattggttcgtgctggtacatcccaaacaccaattactgtcgctgcttttaaggctgatatatttatcaggatgagttacaaggaaatatatgtacccagggagagaggatgctgcgtggtcaccccctgtgatgtaaaatatgagagtctaggaggggctgttttataattcatcaggtttcgctagtgagttctgccggagtcttcgttataaaggcaagtgtgagctggacggcagacaggagaacctggcaccaacgagacggagaagctgcctttggtgccttctgcctcctccctgctttgttccaataattttgtgctcggtaagttccccggctttgcagctaatcgttgttgaataagcttggcaaatgaatctgtagtttgaaataggcacttgctgtcagaagtgtgtgtcagtgtttgggcttctgacaaattccacagttctatttaatgagcaaaatagcttaaaagatgaaacaaaagccgacaaatcaattattcaccttgatccttggaaggctgctttctttggttgctaaagtttctcaggtttcattctgtcagtttcatgtgttgggtgagctttgaaaagaacaagtctctttgtcacgaaattgttttgcctagctgccaaaaggaggtatgtacagggcggtttgtccatccctaccccccagcttaccctccccagcagtcggtgattcttaaaacacagtttgcctggtaaccagctccgatagagctgaacctatgcaaggcaagattcaa

SEQ ID NO: 58553 - DNA, 3593 bp, Bovine  19866880856322
gaatcctttaggactatcttgtccgtttcttctttccaggtaggggagctgaagcttagtcagcctctagataagaaagcagttcaatatcttaaaagctgtcatagctactaaggctgagcagctagtaaattccttaattcttttaatctctataatagctcatgaggacagatggcttaaatagcccaagaaatcatccgataagccattatgatcaaaaggacataaaggaatttttttaaaattctcatggcatctcagggatttcttatgtatacaactttcctttcctttctagtttactgttgttaattgctattgttcatgtatcacagttaaattatgtatgtatatgtgtgtgtgtatgtgtgcatgtgtgttaaaagtataaacaattattgttaatttaaaaaataaccaccaatttggaaatattgctagttcaatacatagattaactatattatgattttcctctttctcatcctaaattcttcctggagccccctttatggatccatccatctttccatcatcaatcagttcatccttagtctattgccacataccgatttctccaagtatgatacatgaaatctgttttagttaatctggttggtatgttctaatttttaccaaaatattaggaaacaaaacgtcatgtgactctagaatctgtgcttcttagccacgtctttctcttcagctctttctcatatacgtatacatccactaaaggataccaccacctcctgcaactggaaatctccaggatgtttcctcaatgcatccgttttctagccttctcctagttgctttcgttttctcctcagcctccatctaacacatagaattataaaatatgaccaaaaagatgattcctggaaattgagtctacagattcactagaaggttctctccagatactttaatgattaacaatgctgaatccctctgtcttgtccatacaccagtttggacctagagaaatgtaatgacgacaaagggagataccatttcctactcttagaaaactctcttgacctcattctctatcctgggaatacaatatcccaaaatcatttcaaagggattaaaaatctttacaaagataattatatgtcatgcctactcccactgtatcatccctcttcccatctccatagcaactctcattccataattaaatatatcaatccttgtatccatctatataatccacctatataatgattttatatgattttgcggatcccttggcatctggtaacataaacgcattcactccttagtactgaaagagactaagtatatccttgtgctggagacattttgacaacccagaaacatctctaagatccttattcatctttagaaacatccagctcgaatacatggaaatgaagagtcttaatcccattcttcagtatacaaataatgcagagtgcgcacaaatcattgttagataaccctcccatttgctaagaaatttcaggatgttaggtaactgtctccacagagatgaaaagaagaatataaaccaagacagatttaaaatacttactaacttaactccatcaaaaggaaaacaaatcaaaacagatttaaaatacctcttaactcagtattctgggttcccatctagttcacccccacatctttttgactatccccttatttaagccagtcctcaaatataaaaatacagctttgttctcctttccctgactctgcagccaatgctttattgaccacgtttaagccacatcactcttctgaacattgattctcttgcttgttaattaagatggttagagagattatttttaagactctttccagctgagctcctataaaagttagtttactgtgtcttctaattaaaacttgtcgtctaagaataataattacaagcagttaatttctaaatgttctcttattccacatattttaaaacatggatattctgctttcatccacttgtgggaagggaaaagatctgtatctatggaaatttctctttctgtgtttaataggatttgaaccctccaataatagttttaagtgtaattcaagtggaagcacttattgcttgtggctgcttccaagatgaacaacttattatacatggtctctttgtttatagactcattgtagcctaaatcttgtccacttaataaattaaattgtaattactaagcctacaaacagatttattgaggttgaaagaaagtaatatgaaaaaaaatcaatttcaggaaatcaagtgcacagaaaactgaaatagaacggtttaaattctcagaatcgcaagtaatagcaacttcagcatggaacaaaaacaagcctaggaaatacaaaatatacatctttaatgtgctgtttaggttcctaatccaaataagattcctggtagactcattgactaagtctgtagaaggcaaaagtatccaaattgtgctttggtgcaaaataatcttctcttattccctcttcgcgtttcctcatatcatgtttccactgctaaggataatttgctttcttaataaagaactgctgatgcattacaaaaattaaggaataacaaaacaaaaattcattcatccagtttttatccagctaatgtttattaaatgcttctgatgagtgacacgctgccctgaatgctagagctagaatgatgagcaaaacagacatggccctttccctaatgtacctacagaggccaagtaaaatcacactagtgattatattactattacattagcttatggagcctggtaggctgcagtccatggggtctctaagagtcggacacgactgagcgacttccctttcacttttcactttcatgcattggagaaggaaatggcaacccactccagtgttcttgcctggagagtcccagggacgggggagcctggtgggctgccgtctctggggttgcacagagtcggacacgactgaagtgacttagcattagcattagacaagctaataaggtggtcactttagaaaaagagaagaacttggatctagactcttggagtctagaaactcaagtatgtccttagagtacagtatgtgtgtgcatactcagtcactcaattgtatctgactctttgtgaccctgtggactgtagccctccaggctcctcctatccatgggattctcaggcaagaataccggagtaagttgccatgccctcctcccagtatcttcccgacccagggatcgaacccacctctcttatgtcccctgcgttggcagacaatttcttgacaactagcaccacctgggaaggcctagagtacactaagccagatcaaacccagaccaacaaaaaactagagagagggttaagaaggaagcatctcccccaaacaatattttctttactctcaaggataagtaggtatgaatttgtccaagtcccatatttaaccagtcccatattggtgggcatttgatcattttaatcttttgatatcacaaacaatgtagcagtggcatatcttctacttctttgtctcagtggcttagcagtgggaaagcattttgacagtcacaagacgagtaacccctcaag

SEQ ID NO: 58554 - DNA, 797 bp, Bovine  19866880858102
tgtttgacaagtttttgattgcagtgctccaagttgacatcaataattcttctcactctcaaatagtaggtgcacataaaggtttattgagtgaataaaggaaacacttgcaaacagcttaaattatctatgagaagagagaagagttggaactgtactattactagagaaaatgtagagtctaatagtctgtattaacttgaatctcctctgagggtacagaaagctagccattcaaattgctttctttacaaatgaaaaaaggtaagagccttgtcatagcttagtgaaagtgaagtcgctcagtcgtgtccgactctttgcgaccctgtggactgtagccccccaggctcctccgtccatgggattctccaggcaggaatactggagtgggttgccatttccttgtccaggagatcttcccaacccagggatcgaacccaggtctcccacattgcaggcagatgcttttaacctctgagccaccagaggaggaaaaaatggatatttctttttccaggatagaaatatgaggaattacagaggactatttcttagttcattcagcacccgctctatgtcatgctctctcaggcaccttaagactcaatgtaagtctcagtgaactctggaactcagcacaggtaaagagggagagcaatcaatacgttaagaaagcataaagtacggccgtttctagcataaaagtctggcccgagaaaagtggggcttcagagataatttcagaggaggggactttgagctgagctttgcaaagatgaggcattgctagctaa

SEQ ID NO: 58555 - DNA, 2057 bp, Bovine  19866880865638
tgtgaataattgtcattgtggagattattgtgaaactcagtatggtggtagtccctgtgtttttgccggaatgggatcagaaatgtgagcagatttgcatttggcatgcctgttggtgatgtgggagaaggaggggaaaaaacagactggatcgttatggaaagagctatacaacccacccgcaggacagacgaatgcagagagcaggactgttgtatttgtgtaacttgggactgttttctctagtttcctgttcccgttaataattacctgaagctgcgttttggtccgcatctgggtacactccagatcctggctccgggcagggtgagcgctaactcctggtcagctagctgtaggcagtcatttcctcctcagaaggaaagaagggagacctgtaccatcgcggactcctttctgccgtgttgtttgcctctgtccaaatctcatggaaaccacagcttgatgtacttttttttttttttttttgcagtagcagatttaactgtggtgtcatatggcgtattatgtatggaaaggaatagcaagacatttttctgaatgtttcaagtgtgtctggcttgttgacatttgctttatttcactggcaaggagctactgtcttctggacccataacggtttgtctgtccaaagcatttactttatgcataattgcactttctctttagatgtggaatctgtagatctgaaaagaaatgtcctctttatcctcaaggaaagcaactcgttttagcattgccttgataaaaagtacgcatcctccccctcagcatgctttttgttttttcctgataaatattttggtcaccagtaccactgtacttcaaataaagttgtttctccattcctagcacactttctgattgcaccaaaacccaaaacttggcaaatttggaatatggaatgtaccttttttttcaggaacacattttccaggcatacttcttttgtccataaatagcttttccatattttccatttctctgaataagttctgctcaaagagcagaggagtgatgtattgtggttggcacttaggggtgtgtaacctgagactcggtttctaatttacaaacggctgccccacaaggggtctgtaaaatgtttttttgtcttatgttcagttcaaaacctccggagtacagcagtaatgatcaagataggaaattcagcaaattattgcaggtataaaccaatatctgtatttgatggtttgatcagcacactatgctttgtaaagatcaggacacatagctgaatgttcctaaaagtgttaatgtatcttaatgccaagaacatggctgtaaagtacctttgcaatatattgtacattgaattttactgtactgtatttttaaaaatctcctaccagagcccctggtttattttgcagcagtatctgggttttgattcagtgtggttttatggagaaataagcaaatgaactaatttccataaactgagtttcttctcatttggtggtgattttttcatctccacccaccaggaatcagctcctttaatagcaacaaaagaaaatttagcttgagttattctcaattaaatttacaggaagacaaatatggactataataagaaccttctgagagagcacatacacaccaaaaaacttgtctcttaaaaaagggttaaaagccaaagaggtatgaacattttgcctgcatgacacatgatttctgagaaaggttgtagggggtagaaagggggagaggtttacaggagctgttctgagacctggcttcagcagctagcaaatggaaagggcaggggctttgtgtcactgtggtcgccacctcactctccttatctgtaaaatggggtcagggaggtcaggaagatgatgccagaaaggtgatgttgtgtacatgttaccaacagtacactctttgatacaaaggggacccagtgagaggtagtcattatggttagatgtcaaattttgtaaaatatatgttcatttttgatggttgattttgaaagaaatatgcacattaaaaaggaagattataaaaat

SEQ ID NO: 58556 - DNA, 3016 bp, Bovine  19866880897754
tgtatccactttctgcaataaatcatagccatgaagatgagagtctgacaagccctcctagttgggagtcttcaggacccccgacactcactccatagattggaaaccacattcacatacactttctcatttgtgcctcaatccattcccagaaagaatgtacaacggatacagtacttagcatcccctttttacaggtgaggggcataccaggcgaggccccctccaactaacacaggatacgtggcttagaggcagcaactggggctggagtgctgttctctcggtcctaagtcctagttcagtggtctccaccttgcccctgaccccaccccagtctgggaggtggtgaaggtggtggcaagggggcaaggatgagaatcatgatgacaagtattattcatgcccaccttagggggcctggccctttgtgttcatcgtcctacatttgacatcataataacctgaatggtaaatattagtatctctgtttaatagatgggagaggaggttcaggaagttcagaaacctgtcccaggtcacaagtaaacacgtggtagaaactgaacctagaataaggcctgactccaaaatgcacatccctggttatttcatcacagtgcccaggactcggccataccaggaaattctaatcttcccttcagagctgaccacctcttctcccccagatccctgaagttcccttacggctcagctcccgtcccttgtattccttatcttaaggtccccaaacctctagtttggctccaggttcttctggatgtaaagtgtgaggactggaggtagaaaagccatcaggaaagctggcaggtggtggccaagaaggcaggctctagggtcagactacttgggtttgcaactttttaactgtgatcttaaacaaggtacttaacgtctctgcatttcaagctttcttaattataaaatggcatagtaataacaccagccaccttgaagagctgtggtgaggattacatgaaataatacatgtgaagtattataacacagcctgacagtagcaagtgctcaataaatgctagctaatactactatgataattattctgaaaaatgcactgggatttgaattccagtttctgagtcccaactgtgccacttagaagctgtcttatggactgtgtacaaagatatctaaaacttctctgtatcctcaagacccagtatagtgctgggtacaaggcagaccttcagaaagatctatggaaatactttggatgatctttgaaagcccctggtgactcagactggtaaagagtctggcctgcaaagcaggagacctgggtttgagccccaggctgggaagatcccctggagaaaggaatggcaacccactccagtattcttgcctgaagaattccatggacagaggagcctgatgggctacagtccatgggatggcagagtccaacagaactgagggactaacactttcactttgaaagctccacttctttgaagtctcagtgtcccggtctgtaaggggagggcagccgaaaccaatcccaaaggtcctcagcaggtgatccattcattctcctgagctccattctagtctcaaatcgtcttttcaagaaaacacttatttacttggctgcgctgggtcttagttgcaacatgcgggatctttggttgcggcatgggagctcttagttgcggcatgtgggatctagttccctgaccagggattgaacttgggcctgcattgggagcatggaatcttagccactggaccaccagggaagttcccccaagtattcctgaggggagatttcccacccttgggatcagcaacacgctttctccatgagttctattatcttggacaaactgcctctgtaggatcacattgattcagactcgccaggtccctaaaaataagcagctgacacatttcagcagctcctggctcctttggatattaatggatcatcacatctggggaagaggctacagtgccctgtcacctattttaaaaagcgataagctgcttttaatttgctttatgtgctaattcatcacagcaacttttataaaatgctattaagactcacactttccacccagggtgcttttaacaagtccattagacaagtggaattagacatgaataatgcaacgggctctcccatccctcccgcccctcctgcatttcaacatgtggcggccccttgcccaccggggaagcctagggagggagggctgaagcagatgcttgtcctcctggctggccaaccttggttgtgcagacctaggtaccagaccgaaattgtgcttagtaagtgtcccacaatgtgctaaagacattctgttcatcgtctccctcaatttgctgggtttgagccaacataccagttacacaccaagctttggagaaaggaaagatctggtgttaagttccaactctgtcattgctagttgtgaattttaggtctgtggcttaacctcttagatgacactcttaaccagagacgaccattctctcattgatcaaatgcagataacgatggcacgaactcacaagaccgttatggagatactgctatggcatggtgcctgtaaagttcccaagacctgcacagaatgaatccccttcgttattatttctgttaacaatcctgccatgtcagcgttttggatctcataaaagaaatgagagtcaaagagccgaaatgaaaaaaagctagtaagtggcagaatcaggatttaaacaagacagatgtgtctgaatcaaaagcctgtgctctgactgcagaattcagcttggagctcctgatcaggaatgcagtacttagatctcatccccgaagatttcatgatcagtggacggtcgccttgacgctggcactgtggaccagacatcaggagagaggcgcatgcagtttactgagcacacacttggttctcacgctgccctgcagtgtgtgtcttagccttgtgctgcagacgaggaaacacaagctccgtataaattaagc

SEQ ID NO: 58557 - DNA, 1520 bp, Bovine  19866880922141
tcatgtctaactctttgtgatcccatagactgtagcctgccaggctcctctgtccatgggattctccaggcaaggatactggagtgggttgccgtgccctccgccaggggatcttcccccactcagggatcgaacccaggtctctcacatctcctgcattgccaatgcaggaggattcttaaccattagcgccagcgggtgcctataaagaaaaaaaagctagctgttgactatgttttaagattacgggcgccatctagtgtccttacattgtctaaacactttgcaagctgaagacggaggattcccaagctccattgcaggaatttatcctgcgcttcctcctccccgccaggaactaagtagttaagatgctgaaggaaatcatctcctcaggctgcattccatacacatattgtgagtgatcttctctaatttctcctttatattttctatctctccaggatttattatagaaaggcttatccaataatcgaaccatcttcttgaggttttttgtggtggagaatttagggcattcagcatgcaatcatgttaactagtgcagtagcctcctcaggcattctttctgcagagggaaagacagaaatgcctctgttattgtttgtttcagtgctttgttatgaaaaaatatatatgtggagcagagcacacagaagcaatactctataaagaggctctttcctatctcaccaagcaattttagtttgttcaatcctcaggagtctaaaagcgatcaacctagctgaccccaccaactccaaagctcactcttgatggacgtgaagtgtttaactcactgttccaagatccgtggttgggaataaaagtgaattgtggcagctgttgtcctgaaagtagaataggttgttgtgagttttcaaactgaaattgcatggtggatttaggaagagtgaaaaaagagtcacagctcacctgggcattgcgttaatgcttaggtttccttcctgtcttcatgtttagagccgtgcagaagggaagggctttgtttgctaaatccttactgtcaagggactcaagtggaattcaagcacgatatacactcttcaccatgcaagggtactgataatgtcacctttgtatttatcaagtaacaactcaattccttccagtattacacctgaaatccagccctccccctgcctctcacaaaaaaaataataaaactaaaataaagtctcacattatttgtgtggtgccctgaagtggtcctcttagaagcttcccagccccttcccgtccagtgaccctgccctatgggccgtgtccttcccctccagctctgtccccagccccaaggaggatccacattttcatcattggcagtccctgagggcttccgtttaagggactgtttcccagtgcatctgccttccaaagaggttctgaggtccggggtggggtgcaaaggttgggacaggcaccatctctcaactctgagctgcacccacctttttccaaaagcacaacagcttaaa

SEQ ID NO: 58558 - DNA, 1005 bp, Bovine  19866880989565
cagtgaccattcctgggaacttactcagagtctttgttccataaccgtcgtcacctaatccggggatgtcctgcatggaagtccccagagagagcaatgagagagggagaacagccacggaagaggaaggaagaagtcagtggagttgaaacggatactaccatgacagaccgtgttgctggagcagtctggatccctcgctctcttcttaggaaacaaatctcaccccaaactccctgggctgagacttgaggattcgcattgcaactcgaaaggtttaagcagaaggttgtcatgaaaaagataaagagtcaacaagagccgtttttaacccactgtcaatattgccacagcaacgtaccgctgagaccaaggatccattccaagattcacggctgatgcttagattgaatataagaataagctcagttatcccaagataagcttcactgtgagggaaagagtgaacaaatgctagtaaccgatagaggggaatttgatcactcccagttagctagcactccaaaacaatacatgtggcaatggaatctaaggtttctgtccagaaaagaagttgtctcaagcccttggagagttgcatgatagaaaaggtgaaccagacacagtcttggtcacagataaaaaaatgctgtttggaagccaagtcccccgcttcctcaggtccctttccaatgcattctgtaggaaaaagagctccgtccaggggagggatccagactgcaggcaaacactggtcacagtagtaagccctgacctgcctgcctgccgtgtttgtttgcctaggcgtgtggcgtggggcagcctacgtcatgcgtgttgcccgtgaaggatttttttttttctcttgtgttgcaggtgacattctcttcgagaatctaccttacgttcaggatcactggtttcctgctcactctgctccttgttcttgtagaatgggaattttcgtgaaaagatgaagctctttttacgcttgtcattgaatga

SEQ ID NO: 58559 - DNA, 2407 bp, Bovine  19866880990480
aatcctgagggaagaaggtctgatctcttattcatctctgtagctaggcatctgctacagactggtatattgcaggtatattcatgtgaaatcatgtttgttgaatgaaagaactgatgctctgatgaattgttgcgtaaaagatttaaacaacagagcaggaggcagacctcaacatttgtcatatatagtccttgaaggaaaaactgtcaaagaaagtacaaagtttgagttactagtttaaaatgtggatttaggaccacagaaggaagtaaatacttcaaatccagaacataaaactgtgagcagagggctcagagtggctaaagaacgcagaggagagatggaagcaattgtgaggatggggtgctgatgacagccatgaggaactggaaggggggtcccacagatgctgactataatgtcgtgaagacgtgttctcttgcctgagtcctgtgtcatctacctagaatgctcttccttgtttattccatctgcaagctgtagatcagatcccattagtgagtcattaaaccaaattaatgagttgtgacttccattttttaaagaatgagagaaacagaatggaaaatagcaaagtttactgtacataaaacataaacttcaataataaaatcttttttcagctttctgtgtgtatgtatttactgggtcgtgataaaaatgtacttcttattttgagtaaaaatggtttgaaggcctctgaattaacttatataaaatcttcaagaattaattcagatatccttgtataaggtagcagtaaaggctcttggcctttctagagctaactttccacagcactctgcattatgactgtcttcccctcatctcttttccatactagatgcaagttccttgaggacagggcatgacttctaggtcctcagtgtccattataggttctggcacagaatatacactcaaaacacgcttgaggaacacataaataaataagttactgacttttaaacctaaattcacaacagaaagcttattcccttgaactcttcaaattgctatcttttattaacaaatgaacaaggaccaggttctcttttatattctctcctgtgacctccttcttactctccattggtggacttacctgcttttctttctccccctctccgttctcccagtgtcctaagtgctcttgcttctcttttatccaaagaaaggatttctccttagccatttgcactctggagtgaatttaaccccctctactctgacctttcatgggtagtttttagatataaaggcacatcctattagtagcaggaaaagccttgttctgctagtgggatgtatttagagctggtagaaagataccaaggggactgcatattatagcggtagagagacctcagcctgcacatatatagagccccaaagtacacgcaacaaaccccataccaggagcccaggtggcatctagggctgaagaattgataatgtactttggagcattttgaaaaatattttattcaaatttttaatgttttatttacttttaaggttctacaactacatatgtttcacaatgcaggaaatacacaatacacatagcccattcaaccaagcagatccaaatcattggcatagaacatgtacagcattatcattagtgacaatcaactccatttgcatgacacgaccaaagcacttcaagtgccttacaaaaaaagattagaagaaggaaaataattacaactagattggaaaatagagagggttggctcaagtttacaacactgcctggatagatgtgctagttccctgccaggcaaatacatcgccatcaccagagggactatttctaggaagggaaggaggccaatttctgcatgagcccgagaagatgcatcgtcttgcacacagccagcatagggctaatgttgagagagagagtgtgtgtgtgagagagaaagagagtgtatggtgtttagggaagaggaggtaactccaaggggaaggtggttttgtggtacaagcaaatattctactaagtcagctaaattgtttattacagaacaaagaagcagcttgctttctggcttaggttttggcttcatggaaaaatatgaatagtactaaagaaatcccatatgaaagccctatagtacagtttatcctgtgtaaaaaccccaaagaagtattctttttgaatttctcctctcagctaatctgtttcgtaatccaagagtcggccactgtgctgacagaagcacattgggattcacagccaaagcgcactgaacagctgatgcgcataagctgggcccaaggcagctagagtgatagatggctctggaaggcaggagatccaactctgctgccaagcggctgtggggccccttcctcctgcggaaggaatttcccc

SEQ ID NO: 58560 - DNA, 1785 bp, Bovine  19866881119066
actttgttatatattactgatattattattattattagccattactggtggatcagatggtaaagaatctgccttcagtgcgggagaccttggttaaacccctgggtctggaagatcccctagaggagggcatggcaacctactccagtattcttgcctggagaatcccatggacagaggagcctggggggctatggtccacggggcctcaaagagtcggacacgagtgagcaactaagcatgtcacaacctttagccataataatctgattttgaactgggttcttcgtgtttgattatgctgtttcagtaacttagctcagttctgggcacgttcgtggtgctctttaaaatttatttaactgactgtttgctattgcaattgtgtcaattctcattaaaaatgttttgactgaataagggtatgaagctgacaacaaagtctctctccttgatgaatatttaattccagtttagatttgccaatcaaaattcataaagacggttggaaactgactttttatctttataactagtcatgtatattatattttcccaattttaactttagtctgtgcagctgaaccatcacagcagttattatcactgtcatagttgttttacttcagactctcaaattaataagtgctaaggaagaatttaattagctgaaacctaaattgtcattattaatttactagttacattacaataccttgtaaaacatttatgctgcagtaaacggagcacctactttccaatgatcacgtggcatagctaatttactatacaactatatttaattactaatcttagtaaagctaatagtacttacccaaattacattacttacaacaaaatgcttcaatcattacgtcaaatgttataaaaatctcatcaaagaaataacagaagttcaggcatgtttaagtacctctgaaacattcttagaatagaatttcttaacaggtaaatggaactattgtaaattaatcagagttttaggaaggtccagtggggaaagcctgaaggtttagacatctagactatccgatgggtagacagtttctgtttgggatgatgaaaagttctagaaatggatgtaaacttaagtggttaaaatggtaaattttatgttatgtgtattttatcacaatagacacacagactatcaaaattagactacattcaagcttgatagtctgtgtgtctattgtagtcctcatccactacacaatgtattccttgaacactgcgtaggctatgctcactgccacatcccagcttcctggcatattgtaagacacatatttaatgaataaatttatgggttgttaattttttttgccaagtacttgaagttaatgttcaatttctttaaagtaaagaaaatagttctactgcagaaagggatgctattggctcagtcagtgaagaaactatataaattagaaataggtgggatatggaaaaagaggcaatacacattctagaacattaaatgttaattagaaataaaagtaagctgactccagtatttgagtgttctcatatccattgaacaggccctaagagcacagaaacacatggaaatatctatatcactgagcaactaatagcaatgacggatattgagtcctttccaaaagcagagctggtgctttgggaagacagaagttcattatactaattaaaggctcttgccctacctcctcagagaatgttctcttgggtagatatcaaggcagacacccttgggtagatgattttcaaattaatgactca

SEQ ID NO: 58561 - DNA, 927 bp, Bovine  19866881127974
ctccccttttatacttaagttgtatgcacctcactatgatacgtgggtttcctaggtggtgtagtggtaaaagaatctgcctgccaatgcaggagatgtaagagacacaggtttgattcctgggtcagcaagatcctctggagaaggaaatggcaacctgctccagtattcttgtctggaaaattcgatggacagaggagctggcaggctacagtccttggggtcaaaaacagttggatgtgactgagcgcgcgcacacacacacacacacactatgatacaggacagttttttctgtttttgagtaactccatagatgagaagattgtttattttgaactgacatctacttccataatgtctacccactggtgctaaatttatcgtctgtattgtactgttagacacatggtaaacctcttaaaaggtctaggcgaactgaattggttcttgaggttttcttcttgacttacagtttcccattcttttcttattcttcccatgatgctgtcctacaaaatcttcctttttttcttctttacttacatgtctatccctgtttgctctattccctctgttcctaggacccgcagaggaagatagaaaaaggaatgaatggaggatattgagtaacttatgaaaaagagttagtgatgataccaattctcttcctcctaattcttctgtgagaaaaggaggttcatatcaagttcagattccaaacagatgtgttttccaggggggcttaaaaatacaccagcacaaaatatatatttctgctctttaaccccagcctgcaaacattacaatgtttaccaaaacctacattagcaaactactgtccacattaatgctataatttactgatttaggctgcctaggaaaatcccaggacggagaagtcggtaggctgcagtccaggggtcg

SEQ ID NO: 58562 - DNA, 1981 bp, Bovine  19866881143152
aaaagtttaatgtgtgtgtgtgtgtttagacaggtagtgagaggacggggaggataggagcttttggaaatgagaggtatgaggataaagacaagatcattccatttttatatactcagttacatcttcactcagcaaattcatcaagtctgtcttctcctcctcccggcctgctgcagtcatccatgctctatgtctcttcaacccagaagagctgaacagccatggccttgctctagggtgggaagactagctgtcttcccagacttggcttctagtgagccatgctggtcatttaatgtggttgctgactcagagcttagcactggtgatgatgacccaccagagggagtgggctgatgagaaccaagaaaaggggtcagaaatcagaagccagaagatgaagttgatccatgtgactatcttggagctcagagtggtcttggtaagaggaatctgtgaggtgaaactctgagtggaaataagggagcagactttatgagtcactggtcattcccttggtaggtagtctcttctggcatgacaagcatggggttaggtgagagttgaaaatggttggaaagaaatgaatcgaatcaagtacaaaagatagtggacttgtagtaaagactggggaacagggagagatggggctaaagaagtcatctatttcttcaccaagaggctgtaatagttatcctctgattgcagtagcatttattcagggaaatcaccttctttgattttcttgtttaatgtctcctaatcattatgttgtgcaatattgaatggccagaccggcaaactcgggatgttcttagggaactagcaaagcatgaaatttttttagagatgtggatggacctagaacctgtcatacagagcgaagtcagagagaaaaaaaaacaagtatcatatattaacacatgtatgtggaacatagaaaacttgtacagaggaacctattttatgccaggaatagagataaagaatggacatgtgtacatggggtaggggtaacagagagtacagtgaattgggagattaggattgacatgtatatatttggacatgagtttgagcaaactctgggagatagtgaaggacagggaatcctggtgtgctgcagtccatggggttgcatatagtcagatgtgacttatcggctgcacaacatctgcttggtaatatttaagtgaaaagagagatacaattgtagaaatatatggtgtatcatgatgatgataaggactgaaggccaagaaaaatacaagcagggaagagagagaaggagtgttggggagctgaaattaccattttagttaccatgacccaggtaggaaagacctcatcataaagctgatggtaaatctatgagttagatgttatttctgccttatagatgaagcacctgggctcagagaggtgaagtgacttggctgaggtctcatagggagttaatgactaagtaggtatttggacccagatctgggcgaccttgaatgtaggctgtttctgcaatgctcctctggttgtagattttcatttgtaaaacatagggctgggctcagtcaggacacatataacccctttgttctgactctgacatgcctggtgccagtgacctttcccaaaggtgatagaacacacaactgctgtcaatactagcgaaaatgtctcatgttatattatccaccttctcgctcacattggagtcattatttctggttagagatttgctctgaaagttagatctttaacacatagacacaatactgaaaagtgaaaatgacagagccttcctgttgctgcatgatgctgttaaagtgtagcagtgtggggacctccctgttggtccagtggtcagcactctcctcttccaatacagggggcacaggtttgatccctggtccaagaactaagatcccacatgcctcatggtgaagccaaaaggaaaaaaaagtaaaaaattgtagcagtg

SEQ ID NO: 58563 - DNA, 1212 bp, Bovine  19866881180148
ctttctttttagtttgcttgtaaaacctgggagtgaagaacaaaactgaggttatcaaattgctttcaggaacagctggaaacaccattcagggctgtattctgtttaatgcttagtgccctttcacagggaactaagagaaagatgagtcttggcatatgttattttctgcatgaaagcttaccaagatccctggtgtatttcagttgcaggagtgataggcaatagcattttatcgtctctgccataccgtttggcatttgattatattcagtttagtgcttcatgacatactgcctttgaaaatcttccctctgatgaactctcaaaacatttaatctttttattcaattttagcacattttattccatttaccaagttttattcaatgaacaggttttatcttgtagaaaatcctacttcttctaccagactgtaaactccttgaagtagggaagtatatcttacttacttctatgtttcctggacctcatccagaatgtcttgcacacgaaggtagtcatttgttacatgaatgaatggaataaatgagaagtatctgtttaatatattgtcttctaattgtcttagattatatattttctctcctgagattggaaatttcaggaaagcaaagcctaagctatcacatatatttgtgtacctaatacctgctaataaactctgaagaatggcccttcattaaattatttaaccttttgttttgaaagtaagtttagatgaaattatctgaacaggatttattaccaaaactagtggttaaccttaaactatgaacaatggtttaaagattttgcttttgtctttagcctcatttatgataataagtgattgttacttaaagccacatcacttccacttaccacttccaattatttgataagtacttataatggaccaggcatccttctagctggtaaactttttaaaagagtcaaattccttgcctccatagaacttgcattctaatgtgggtggtgggagaggaaataagtgaaaacgatgttgttgttgttcggctgtccagttgtgtctgactctatgcaaccccatgcactgcagcacaccaggcctccctgtccctcaccgactcccagagtttgcccaggttcatgttcatgcatctgtgatgccatccagccatctcatcctctgatgccctcgatctttcccagcatcagggacttttc

SEQ ID NO: 58564 - DNA, 808 bp, Bovine  19866881180819
ttggttttgtattttagctatactctggggaagttcttgaataggtcctgccccaggctcaggctgctatagcctgttctcaaaataaatgtcaccttgcttagatttatcttctctaaagtctaactgtgtctcccaccactgaggtaaggtcataaagctgagctctctggtagggaatactgttggcaggttgttataaaccttaataccgcaaagcttaggcatgcgtctcctgtaaagtaacccatgactgtgtttcaactcccagaaaataaaagaacaataaaaaaaaaaaaaaagtggcaggtaaagagaatgcttactgacaggtctacgaatttaagtctctactgtctagaaacttctctgatttggaggctagcaagttttttgtacatgcggaaagagctttgcagtgttaaccattggcctcagatgtcagaaaaaaaaatttactgtgagaaatatggtttacagacatttggggggtcattaatctaacttttctttagatgcaagcatcaaagtctcaggattgaggattacctggtaaacatacctcaaaggcctgatttagataaatgggcacaaaatgcctttagctgaaattcagctgctgactccagccttctccatttttctttatagctccaggctgacttatctcccttctttcaccccacaaaccatctgtcaccggagtattaccaagtgctcccttctagatccttaccctgagcttcgcatcatctaaactggccgatatatttccttctggaaaccacttgttatactggaccctcag

SEQ ID NO: 58565 - DNA, 653 bp, Bovine  19866881200666
ctctggagcctgggtaggtttgtttagtatccagtataacaatattcttctctgaggcacagcctaggcagatttatgctcactgtaaaagattcaggttccctaggcttgggatcctctcctgtaatgcaacccactacatgtgcccgcatctcatggcctcccttgttttatcctgtggaaactagaactcagggaaccagtgaaaatgatgatactctggctacaaagattagtatgaatctataaagttgctaggacttccctggtggtgcagtggtaaacagtcttcctgcaaatgaaggcaatgtgggtttggtccttgagttgggaagatcccctgaagaaggaaaaggcaacccactccagcattcttgcctggaaaattccatggacagaggagcccagcaggctacagtccatgggtgtctcaaaagagttggacatgacttagcaactaaacaacaataaagtttcttttccaggaatctcagatcttctgccagtatccatgacagcacagcagggtaacttgcaagtttgcaagtaagaaagaaatctcagacttttcacagtcttgacattcattcccttgcttaaacctgctttacctgctttcagtggcatcccatgcatttaggataaaactgcta

SEQ ID NO: 58566 - DNA, 1841 bp, Bovine  19866881314468
ccctatgtaacaactatgccctgcattcctttggtaatcccctttgaccagtgcctaaaatacaattttgcctattgtaggtgttggtgaaggtatggcttttctcttgtttccaggggaattagcaagtgtttatcgtgtcttcctatgtagaacaaacatgtttcaggagtatttttaatcctgtcacaggttgattcatctttttaaataattttgcttgttcatttttggctgtgttgggtcttcgctgctgggcaggcttttctctggttgccgtgagtaggggctagttgcggtgctggggcttctcattgtggtgacttcttgtgtgtggagcgcagccccgagagcgcacgagctttagaagttgctgcacgtgggctcagtgggggtgacttccgggctcagaagtggtgacttccgggctccgtagcacaggctcatcaactgtggcaaagcggcttagttgttccacgtgatgtgggatcttctcagaccagtgatcaaacctgtgtctccatcagggaaacccggttgactcattttgaaatagtttgtttaaaaaaatttaacttatgtgtaaaaaagagttccttcaggttgtaataggtagatccagaccttctattttatgtgttatggaacatattattatgtgctatctcaagaatatatatatatatatatatatataatttttataattagtaaagccagggagtagctttttaagctagaacttttgtgaaattactaaggacttagtatagtactaaatactacattagaactttttattactgtttgtgaaagtgttaaatatttaatgtggtagtaaatactgtattgctatatgctaataatattatgaaagttccaagcttgagcataaaggaagaatagatttttggaaatgcagttacttgtgttttgagatttaaatcacagatacctcacttttaagaaatgtttttgggggagctcagggggaggtgcagggtgaatgcctagaacacatatttaagccttcagaatcacagagtatagatcttattcagtgtaagccttatgactgaagttcgaattatcccctcaggttttccttgagcagaatgtgaaaatactatcaatatttgcaagagtaaatgagtttaatagtgcacactttaccttctaaggaaaaatgactatagactctttgcccttctacctgtcatggcttttttgaatcgagatgccaggccgtctcccatcaagcactctttcttagcaatatatcatctgacagtgaaactgtgtgcagcattcaagtttgaaaatcattggtaaatttgggggataaatggaggtaggtaaattggggcgggggcagtttactgcggagttaaaattaggaacatcatggaaaaccggtcgcaggctcagattttttcacaaacgtcctcctaggcaccagaccttcctgctgccatcctcttaaagccaaaggacctcagggaaatcactttgctctttggacctgtgcctcctagtctgtaaatatatagatgctcagttagataacctcttagtccttcccagatttaaaagtttccttccaggcctgaaggacagagcatattatattacatctaaatactttctcttcagtcattctagggaaaaaaaaaaaaacctataaaagaaaacctgtgcaagcctctgaaacacttttcccctgacccagttagtgggctgtttcagttccttttcatctgctagagactgaatgactttgcttgggttcagggtcattaagctaaactaaaaagactgcttttaagaatgctaatttacag

SEQ ID NO: 58567 - DNA, 1827 bp, Bovine  19866881329470
gagcctagtggtcctcgtccatgtggtggcaaagggttggatatgactcagcacgcacatgctaaaataaggctggggcatgttttcctcaggggaagtctctcctacttgttcactctataattcttttagccggtgttctgacttctgatacaattttgtattattgactaagagccccatgtgggtgactctcattttgacaaataaccttcagattttatttttttaatttttggaccacgtggcatgtaggatcttagtttcccaaccaggaattgaacctgagccccctgcattggaagcacagagtcttcaccacaggacttccagggaagttccaacctttagttatttaaagagagggaccctggctcaagccattactattgtatgctgagcaggatctggctctatttccaacctcagctggtgttcttcatctaagacaaactggtttcctttttttactgggaccccatgctccttctccatccgtgttctcatttaggtttgtgaggttagaaaaaccttatttttttgactcagcctggaatcttctcatggagtacctttttagactcttttccatcccaactcctacagaaaaccccaaatccatcaatacatacaaggtgcgtaatatggcatttctttgttaatactacttacagtatatcattttctacacattttattatttgctcatcaactcatactattcttctttgctaccagactgaagaccccatggaacaaaagataacatccatattccttcctcccactgcctggcccaatgctgaatgtggtagccatcaacaaacacaaattaaatactagttgaaattcaacaggagatctggaaagtcattacagaaagcttgctttgacagtcttttctttcaagtacagaacttttggagaattgttattctccaaaggcacaggtatgtcttactgatgtggcagatttactttccaaataattctaacatttcagatcattacctgagtctgccatcctctgccgcagcacctcccggtataatcttcgtaataaatatgccagggtcatctccgatgtggggattatctgtccctccagcaatactgaatcccaggccagaatttccctgtagaaacaataagtagacattaaatgatgtggctctcatctaaacccagttctccttgtactctgcgttatcatcttacgactcaaatggaaatcaggtgataacagccttgtatgcaaagccataaactgcaccatcagcagacaaaggaaggtcagggaaaacactcaggcttgtccctgcattgcaagaattcaagtgctttatgcttctgcttattcaaagggccttacattttttgcttctaagaaacgcagcctttattagaaactaaaatggtcatgatgaaataaaagttgacactgtgcaatatgagaaaatgcaaaagataattatggtccattataaaaattgtacacacataaaaaaaagaacggacggaaacaggttatgtgaaaaacatttgatttgacggagtagtgaaatttgggtgtttccattctgctatttctggtactgttgctctaatattgtttatccatcaaataagtgtattttcctatttgttaataggaactttgacttcaggaggcaacggccccttctagagtcatagcaaatgtgagacactttgcagtaaagtagctcttaatttgctatagatacagacaaggaatacattattgttgcagcatgtaaatttgaacaccttatattctaatatagctttcatacttactcctgtaga

SEQ ID NO: 58568 - DNA, 1109 bp, Bovine  19866881407795
ttacaaggtcttaggattaaatgagatgagggcatgtcatagtgtttgagtgaactgctcaataaagaggcactggcaacaacaatttgcagtggtcgtctttccagcccactctgtccctcctccatcttcaccatttctctgatcctttgcctccgtctccctccctaccctgcttgcagctgtgccttggacttttccaaggtggccatccattctgggacctcggaacagctgctactgtccattttgctgcttgcttcccctgccaggtgacaggggagaacggcagggctgcatttagcatggacaaacacctgtcctctctgtcactacagccagacggacactggcgctgagtcatgctgctgctcacgaccgatgagctctcagaagctctgagagagagacctgagaggacaatctgtccatccctctctccaggtcaggctactcttcaatctgccaggaggcaaaaatagacacaggaagattctatcattcacggagaactgaagaatcttcaacatcaggacatttcttcttgtgcctaagctcaatttcagattctgcatttaaattcacttcttatatttatctttcataggtaaaaataaacttgatatctaggtcactgcaaatatatacatatatatagtataatatacagcatacaatatgcagtatcctgtgtatccatacagagtactgcttactaattaagagactgagctctatgattagccacccagtctaatcccagccacctactggtgatgtggttttgttctaaaaattaataagagtgatgttctcactagatccttgtataagcacagttctcagttcatagaaagaattcaacagatgttaactattgttgttgtttagacatataaatacatagtgagaagccagggggcttcttaaagatttgttttgcaacctaaatggctccagtttgattgtggcttttaatcagtttcttctataaccttatttttcattttctatttatttactttcctaaattccgaaccatctacataatgctcgttgactccagtcagcacaggaaaaaatgtatatcttagaactaatagatttcc

SEQ ID NO: 58569 - DNA, 962 bp, Bovine  19866881476258
cttgtatatcctgagattacttggccagatggtgatggtgtgtgattggcatctcttctgggtgacagagaagacttggctcaatagagaggggatctgtagttgtaggtaatgcacaaagttggcactgctcataagtaaccactgattgattatatctttttgtaattgttaccttcttactctatcataaaaaaaggaccatcagcttagagaaacagaatgaacactgaactgggcattcaaagataagggttctaaatttgattctgtaacttacaagttgtgggacttacagatagccaacaaattttgttagactttgtgtttcttgcccaccaaatggagaaagattagactctatattcatttatggcccttccaactctgatagtctataattctatgagccaaaaaaccatctcagcatcattgtaatagctttattttccaaaaattgaagaccagagtatttacataacaataattttgatttataagggactcagcagagtttctactaagagaattttatccaaggcctttttgtttagacttcctttctctacatcaatggaaaaacaaaatttctcagcttactcaggtacacatatcctgaaacagtaaaagaggttaaaaaaaaaaaatccaggtacgtcattatagcatacttctaatcaaaattctttttataaaccctattatatttctccagcaaaagtgaatataaatcagcaagattgaaaatacttctcacaacagatagagtaagatattatgaacatctggaacaaaagactgccaatttgatataattatatagatagttggaaggttcccatttcacagaactgttttcctatcagcccaagtcacaccattaaagattaattctcttgatttactattttaggaaaataaaaacaggccacaaaggtaagccactatagtgccttaggaga

SEQ ID NO: 58570 - DNA, 1536 bp, Bovine  19866881519154
agaagaatgcataaccgttcatttatttttaccactgttttagaatgtgtgtgtatctgtgtgtgtgtgtgtgtatatatatatatagagagagagagagagaatacacacacacacccttcaaatcaacttgggaataatttttaattctccaaaagagtatttttaaaggcttattcactttagggaaacatgttgctgaattggaaaggggatcttttttttttttttcccacagtggaaggaacttaaaatttaagatacacctgaacttaaattatagttcttctacttattattatttatattcagatacccatgtctcccaacaaacccgcagatattgtctctctctttcatgaaactaaatagaaagatcagtgtaagagaaataacctgggttcagatcccagccctactatcttgcacctgtgtggacttgaatatgttgcccgatttgccttgtcttcagttttcttttaatgtatatcaaaaggagatttagggcgtaataatatacattgtatgggctgtttttaggattaaatgagttactacatattcagagaaggcaatggcaccccactccagtactcttgcctggaaaatcccatggatggaggagcctggaagtctgaagtccatggggttgctgagggttggacatgactgagcgacttcactttcactttttactttcatgcattggagaaggaaatggcagcccacttcagtgttcttgcctggagaatcccagggacaggggagcttggtgggcttccatctatgggatcgcacagagtcggacacgactgaagcaacttagtagtagtagtacatagcaagagcaaagccagctgcttttcccagtaagtgacatttaaaaatatatattattaaacataagtcatccagttgtgaaatgatgtcgtagttatcagagctgagatggcacatttgtggacactgtgcctcatctctttatcttgtcctggaagcccctgatgtgctgtaatatgataatggccaagtcttgctcctggaggatccttagagttacttttccagacaacctagagagaagttacaacttcagtgttatcaatggctttcccagggcttaatttcagaggtgttagattgaagaacagggaatcatttttatctacttagtatctggcctccccaagataaaatgaaagcatggaatttggtatcacataccagtgaaaagtgaagcaactttgcaattccatctctgtaaaagaaagattgggacttgctctttgatgaagatagaaggtctaagaacaagtgcccttactgagctcagcatcatctgatagtgtttcaaacaatgccaagtcttaatgggagctgaatttaacaaaatatcacagtcagcttttatcaaggccactataaaggagatatctcagaaatgatccaaaaagtgtgtgtgtgtgtgagagagagagagatggatgaaatgatgagtacctgctgaataagcaatgagataatatatgcagcagt

SEQ ID NO: 58571 - DNA, 674 bp, Bovine  19866881643649
tgagtccccctgcctccgagtaattttaataaacaaaaacaagcccacaggctgtcatgtaatatagttcatcgtctggcctattcagtctagtctcttgtcccccaaattctcttcctctttttggatacatccatcctattgaatactgctgcagtagtgctcagtacaagaactgatgttataaacaaaggaaaattggaagtaaagctagtttaaggaaatgttttggaattagggataaatttgcatgtatattgccatttgttacagtgaggaattcagacgtctgccctgatattagcatatttttgatatgcaaatttgtcataattggagaagccattttcataggtactaagtaagagcgatgtaaatcttgactgggccgccctatggacgtgattctccgcttgtttctgcagggagccccgcaaggtggtcctgcataaaggctccactggcctgggcttcaacatcgtgggcggagaagacggagaaggtttttttgtctccttcattctggctggtggaccagcagacctgagcggggagctccagagaggagaccagatcctatctgtgagtattgctccttaatctttattccctccatgtctgacaccatctgagagaaagtcccttccagttataactccaaaagcaccttcatt

SEQ ID NO: 58572 - DNA, 1244 bp, Bovine  19866881671888
attagacattcaccttgatgctgggatggttccagaaccctgccctcctcactccagcccagtcagtgagccctagtgcattgtatgaacaagactgtagatgcctcagtagaaggctaagcgtaggcacactcaggctgactgaatcaggatctttttaagttccaaagaaaatcaccgctaaacaactgattgaagacatattgatggttacgagagaggaaaaaaaaaacaggaagaacaaatccactgtagaaacataaaactttgattcttagtgcctcagcttcattctacccttcattttacaaatatgaaatggaaacagagaaaggaagtggaatgccccagagctcataatcgttcagtatcaaaacagaagataggataacaacagcaacaagaataacaataagaaaatattaagcacttattgaagacgatatgttccagtggttgtgataaacacttaagatacatcagtgtatttacttctcaaggtatcctaaggaaaaccttatcattatcattaaaaataatgataataataaggctcaaagtggctaaaccacttgcccaaggtcagaaattctaagaggtaccacagtgtgaaagttgctcagtcgtgtccaactctgtgacaccatggactatccagtccatgggattctccaggctagaatactggagtgggtagcctttcccttctccaggggatcctcccaacccagggactgaacccaggtttcccacattgcaggcggattctttaccagctgagccaccagggaagcccaagaatactgaagtgggtagcctatcccttctccagcaaatcttcccgacccaggaaatgaactggggtctcctgcattccaggtggattctttaccagctaagctaccagggaagccccatatcccgggtgtccaatccaggcctttccaaccccagaacacaagctggctcctgattccttctcctgagattttccaggtaagacttaaaaaaaaaaaaaaaaaaatgcagttattttctgccctgaaaatggctagtttctctttcccagtctgaagagaaatttctccccatactgactcagattcaattccccaattctctgagggtttctaggtccctatatcactttcaaaaccccacttaaaaatgggacaatgctatttcccagctaacctatttcctaaggagttagctaggggaataacgcacataaggaaagggat

SEQ ID NO: 58573 - DNA, 1231 bp, Bovine  19866881672800
taagccccctcctccctgcattagaaccttctgtctctcagcagactctggctatttgaacagaacttgcatgcatcacatatctgatctgaaatcagtgtagatccaggcatttctggaacccatttaagtcagccacaagaatttcacattcctaaatctctctctggtacacagtatcaaccatcaactgctcacatgaggcagatatattatgaagaggccagtggtgaatcaaacacgtggagtgtggttcaggggcggcactgaggcacaggaagagaaaaattcactaattcttgttccccgagaacacagacagcaacagacaagaaaacagaatagccttaaggagatgcctccaagcagtgggtgctaagaaaaggcagacgttgcagttctagggagggagaggggaggggcctctgctgtcctcttttcatagccctggccatgattccccactggtctctcaagagaaatgggtctgacaaaagccgcatggttctcaccacagctccttagccagtttccagaggttttcagcatagcaggcaactgctccccaaagtcagctctgctcccctcttcctggccgagtctatggtgtatcaactctgcccgtctgcacacactcctgacgctcttgcgttggagccaaatcctctgaggagtgaagcaggtggggcctcctgctcaggctagtggcagagctagtttgagatgctttgcaacacaaaagggccaatttaagagacgggattactttccccattccacccttttaaaagcagttacaaatcattttccagatgttgactgtttcactcacctctctctctctcttttttctcttctcatctaaaaaatgccttagtgctggaaaggtggtggacgtctgcccagggagtctgccgagggagcccggaagacttcttaaaccccagtcccatcccacagtccagcttggccgctggtatttgaaattccgatactgaagtgctagtcggtatcttcttttaaaatgcagaagtgagtaaacaaagttattcacactgtagagttaattcttcagctggcagactggaatctgccggctcccccaggccaggaagtgcctgcttacatcagcctttaggcaggaagagtattcaaaaagggatggtttagggatgcagaacttctaagtttatctttttgtgggcaactccaagtcgagaaactaggtccc

SEQ ID NO: 58574 - DNA, 1697 bp, Bovine  19866881824940
ctaaaagaaaacatttttgtcaggacatgaaaattaccaatggttctgttttcacctgggacaaatgaagcataatttgctttgatgcaaaaatcaattatacatgaattctttcttcacaatgctttatttttataacaatgaattctatcaagaaaaaaataagactatgggaatctaagtgatactgctacttaggatggctcagatgtgaaagttttcctttcactcttcctatagctcttttaaccagatgataaaaagagctttggtgacatcagaaataaaagggatcaactgtgccagggtaatcatagtggattcatcagatcacctgcagagggagtgtcaaccaagcagtatgcttgaaagctcttaaaaagaaagcctgtgaacagaaccagagatatgggagaacaagggaaaaagcagagggcaaaagtgtcaaagaacaggagaaggagaagacagatactagtggtactattaaaaaagagattattattattgctcaagccagcaatcttatgagtgcaaatcacttcagtcatgtcctgctctttacgaccctatgaactgcagcttaccgggctcctctgtccatgggattctccaggcaaggataatggagtgggtggccatgccctccctccacggtgtctccccagaccagggatctaacccatgtctcttacatctaacctgcactggcaggtgggttcttgaccactagcaccacctaggaaggattggaaaaaagctattggaggattaatatggcctgtaacccaggaaagactgctattcctatccacttccatccttcaaatgaggaaccaacaggaatgagaatttttaagatgccctctggttgctcagatagtaaagaatctgccttcaatccagaagaccttggtttgatccctgggtcaggaagatcctctggagaatggaatggcaacccactccaatattcttgcctagagaattccattaacggaccattgagtcaaaagaatcagacacgactgagtagctaacacacactcacacaaccttaataaagacctgcaatatacacatttgcaatctgtatttccttattgattaaaatttttcatatcttcattttaagggtacgttaagcagtccaatgtagctgatattcccagatgttttaggctgaagcaaaggtaaatcaaagcaaataacccacaaacattatcctcactccagtgagggacggagctggcagtgagttcacacaattcttattgtgcaaaataagagtctgtatgatttatgttgtagcatcagctgcaatattctgggtcagcccaatttatgaagcacaatacatgttctatacccagaattactgctgactcaaaatgctcagtaaagaagtagctttaagagctggttttattttgtttagactcctacagtgaactcatttccagaactctatgacactttctcagttacagcttcacattttcaccttttaatatgcatattatagataaagaataaattagggctggcatgcataaagagggaggaaccactaacaaattaagtgattggggtctcaattatgtctctcacgcgggatacacatctctcggcttaaacaagaacctgaacctcccttaggctgctcacacctgaaagcagggactgaaaatgcctgg

SEQ ID NO: 58575 - DNA, 1174 bp, Bovine  19866882170707
tgtatatgtcaatcccaatctttcaatttatccctccttccccccaactaaatatttgaaattctgtaggcaatggaaagcaatcaaagactattaaccagaggaataaggcaatctggtgtattttcaataataccattctggccaaaaaaaaaagttggaagatagattttagagggccaaagtagaaacaagaagactagttacaattttttttcccccccagaatctatgtgattgacaggaaaagccacactgggataagtgggtataaaggaaaagtttgaatctaaaaaaaagtatgtgacggattggatgtgtggctgagagaggaaaggaaccccccccagttttgggtagtggaatgatttactttgataaaatacataattgtgaagtacatagttgtccatggagggaggacaaggataatttggcattcagcttcgagtacattccagatttccaagggggcaggctgagttgaccttgaatttagatttatagaacactagagctagaaaagaattgtaaaatgagggaattcagcttaaactgagataaggaaaaaatgccttacttaaatggaaagtggcgggattagaatttacctctggtttatgactcactgttttccccaccataccatggtccttcttgtgcttctcaacttttcactgaagtgttcatccgtattacaaagccaaatcaaattagactgtgaaaatataaaattatcaattatatatatgctgatccatatcaattccttagattggagtagaggaaaataggaatcaaatccaacatttgaaaatgtgtttttaatgtatagtacttaattttcggttctgcaggggtaccagatcaatctgtagcttttcaaggggagtctatcatgcatttccttttcagacattgtaggcagtgaggacttgaatgattaggaaacattttatgaggctgaagaacacgagcttgcctggaatgaggctggttggagttgggcatttgggaggcagaaagtaacatgaaagaaaatgcaaaggctggaatgagcttgttatattttcaggccactgaggatgtttggagaggagtttgagagcataagaggcagaattagaggcccttcaatgatgcgcattgattctaaagtgacagctgtgtagca

SEQ ID NO: 58576 - DNA, 2509 bp, Bovine  19866880716523
ctggcatattgagtgcagcactttcacagcatcatctttcaaaatttgaaatagctcaactggaattctgtcacctccactagctttgactgaaggacttcactttcacttttcactttcacacaatggagaaggcaaaggcaacccactccagtgttcttgcctggagaatcccagggacggcagaagcctggtgggctgccgtctatggggtcgcacagagtcggacacgactgaatcgacttagcagcagcagcagcactagctttgttcgttgtgatgcttcctaaggcccacttgacttcacattccaggatatatggctctaggtgagtgatcacaccatcgtcattatctgggtcgtcaagatcttttttgcacagtcttctgtgtattcttgccacctcttcttaatatcttctgcttctgttagttccataccatttctgtcctttattgagcccatctttgcatgaaatgttcccttagtatctctaattttcttgaagagatctctagtctttcccattctattgttttcctctatttctttgcattgatcactgaggaaggctttcttatctctccttgctattctttggaactctccattcaaatgcttatatctttccttttctcctttgctttttgcttctcttcttttcacagctatttgtaaggactcctcaaacagccattttgcttttttgcatttctttttcttggggatggtcttgattcctctttcctgaacagtgtcacaaacctccatccgtagttcatcaggcgctctatctatcagatcatagtcccttaaatctctttctcactcccactgtatagtcctaagggatttgatttaggtcatacctgaatggtctcgcaaagagtcggacacaactgagcgactgaactgaactgtactgaactgaatggtctagtggttttctccactttcttcaatttcagtctgaatttggcaataaggagttcatgatccgagccacagtcagctcccagtcttgtttttgctgactgtgtagagcttctccatctttggctgcaaagaatataatcaatctgattttggtgtcgaccatctggctttaagaacatattttggagagatggagctgggctcagattggtggctctgctgtttaatttctgtgaggatttgataccatcctatgagcacactttgggctggcatgaacttaagccaacattggggtttgcagcctttgaagctgctctggttggcatctcttcttcaaaatatagttgttcctagatgtccatgaggattggttccatgacacccctcacctaccaaaagacatggatgctcaagtcccttagataaaatgtctgagtacatctgccctgagtaatcttgggttcaattaaccacaggtggaaattcgtggatgcaaaccccaggatacccagggtggactgtatttctgatctgacctttggatgttctgggttggatgaatggttggtcatttacttcagaatcaatcaacaagtctgctttagcaataaggattaaataacaatctgcctccctttttcttgtgaagatgagctcttcctccttggctctggtgcatgctaattcaagaactttacatggtcatgctgacctcagaaggaaaagatctagttagttagcaaatcaaggaagtcatcgaaagttttctaagtgtggccctgactccagtccttgtatctagagaggtgcttcaggaatgttaaaggagactttcccagactatcagttatcatagactttatggctttaaaacagctctagaaactgtatgcaaatttgaaaaaagaaaaacatgctaatatttagtccaaatttctaaggatttaaaaacactggtcaaatgaacctatccttctaaagagtttcccaccatgtgaattaaagtgacttatagctgtttcacagtttcagtgaagtttatatagtaagtataaaggaagagagattacttgctgcgtggtgtagccaaagagagacagagagagagagagagaaattacagacagcaaaatttaagttgattttttcttcccaaactccagagagttttttcttcccaagctcggaggacttttgtgtctccagggatttaaaattgaacagtcacagagacataaaccttgacagaatgctgtgccaccctgaacaacttgggctgcagggccaactaatatgaataaaattgaggtgacatgtcataagcatctgaaatgaaataatacatttcatttcaaaatgaccggttagtcaaatgtgaactttgagcactttcttttgcttagctatctgtgacactgttctgcgctggctgtcttcccagaagctgcctgaaaaactggttcagaagtagttcccctccccctcatcagccaaccggtacttagtgggttcctgtgggacaggcacacagcaccacacgtggggctccattaagaatggtgatggctg

SEQ ID NO: 58577 - DNA, 959 bp, Bovine  19866880839935
tgagtgctttcctggcttcttgccttctgtgaatacttaacaatatatatttttcaaagccaactgttctcacattgaggccagtttttcttttgctaataatttcttgacctcaatccaaaacagattgaaaactaagaaagatatattctatccacagttttatatcaccaatagtccattcaatttccactaagagcaatcatttatatatctttaaatattaatgttgacactaaagaacagaagacaatacagcattgagagcccaaattgagtcagaattcctgtggaggaacaagcaaggtggggtttcttcagactggtcagtttggttttataatgctagttgttggaggtgacatgccctacaaggaaatgaacaaatccagagggaatggtgtctgtcaccaatctgtgtgtttggatatacggttaagcaagcgcatggcacattttctgtaattgtcattggtgccatgttaggttgaaaatggacccccctagaagctagagagaaacctggagagaaatgacctcctgcttctcctctttgtttcttgtcgcagtgacatcactgcaccttactcagaatcccaggattagcctctgtatttcctagtgctgtgtcccagagctcaccccaacttggttcttagattaacacagcaggtggctgggggagggcattattaccacattgaactattgaagagattaagtgaatcttgcaagtaatgcagttagtaagtgcaggaggccctgcctctctgcctctgttccctccagttcgtgctgaacgccgtcccacgcaaagcttcagaagaagcccttcagaagatgttataaagattaattaaaaggtagagtctccattttaaaataattaaatataaagccttatccatagaatcagaataaattgttgttatttgttatttgtcatcaggacaaatgtt

SEQ ID NO: 58578 - DNA, 700 bp, Bovine  19866881237459
cgtggtatgatattaacttaaataccaatctttaagccaactataaataagataaactgtgctctctggtctcaagttttaatagtatcttttctttaaacttaatgcttttatgaagcatacaagagtgactgcatataatctgtgatcatgtaatgaaagaccctattgtgataagcatacgccaaaaaaaaaaacccaaaaacaaaaaaacaaaaaaaagaacaccctcaaaaactagagttaaggttgttggaggaattataaaaagtgtttgtgatgaagatcaatgcagtgaagccaagtcagaatcagaggcaaagacattttcctggataaagaaagcaaatcactgtcagcagcagcttgatttatataacaaaccagtcaaggggtgaggaagagagaggtctaaaatgtgaacactgaaaacaaaaactgactttactcacatcagcatatgactacactgaattatgcttcaacatgatgtggtatgatggaattcagcttccctcatggcagcttgtgtttattctggctgttctgatcacatcttagcatccagatgccattcctctttggtgcttaatgtgtttatgttcacattatcagcaggcattgggttgcaaagatcatattggaagtgatttcattccattttcaaagaggaaagaattatccctttgaatgctacttg

SEQ ID NO: 58579 - DNA, 703 bp, Bovine  19866881476474
gggtaggaggtgcttttgctggcagataagaccgtgcaatttaggaacttgaggtcccagctgcacccgaatctgcccgtatgttcccattccagttctcaggacctcgttcttttccagttgatgactcaactttaacaaagagaccctgcaaggataggggattcaatctgtgttgtcattcagacaggattagactttggctttgcttttcagaaatcttgaccttgcaagaaaataagggtttcacgcctcgcttttattcttttctttctttttttctcctagaagtcatagaagttttcaggtgctaaatgagctgggaatttaagtccctgagctcatcattgtcttcctttaagttttctagtacaattagcaatgaccaaccaaccaatcaatccaccccattaaaatgctctaaggttgcaaatacttggccactcggagtcctgtcttttgtaggaactttatcacagatatctaaggctaaaatctgagtaactcttttgccatttcactagagccctcttcaccaatggcaacagattcattaatgcctttaaatctaatcagatcagagaaccaattccagaaaactcagaacctattcagagaacccgtccttaagctctgttccttaggagctattcttggaacctcaggcagttgtgtaaggtcattgcctccatgtctgatggtg

SEQ ID NO: 58580 - DNA, 1920 bp, Bovine  19866880443175
aattcttcaactccacggcatttcttagttgatatattgagctcaacagttaaaaaacaatacatttcaagcagaaaaaaaattaatcacacacaaaggaaaacaaaacgtcaggcagaactcaagctttccagatccaccttaaatgtcataaaacaacagaggaatatctacagaattccaaaatcaacaagtttaagccaagaatgtgattaaaggtgagattaccaaatgcatattcttggctaacagacttgagattgtttttaagttattacaagacattgaatatagtttcctatctgatacagccgcacctgttgtttatcgattttatatatagtagtatctgactcctaatttatgctctggccccttccccctttggtaaccataactttgttttctatgtcaacacatcatttcttaattctatagtagaaagaaaactcaagagaatatatttagatgatatgagagtatatctagatgttttgtttttgttgttgagtctctaagtcatgtccaactctttgcaaccccatgaactgcagcacaccaggctctcctgtccttcactatctcctggagtttgctcaaatacatgtccattgagtcgacgatgccatccaaccatctcatcctctgtcatccccttctcctcctgccttcaatctttcccagcagcagggtctctttcaatgagtcagctcttcgcatcaggtggccaaagtattggagcttcagaatcagcccttccaatgaatattcagggttcatttccttcaggattgactggttggatcttatagtccaagggagtcttatgagtcttctccagcaccacagtatcaattctttggtgatcatctagattaaatcatctaattgaattttaggtcactaaaccctcttgtaaactgataggtataaactccagaaataatatctgtccagaacaggacacaggaattccaggaaaaatcatcttctcttgctccttcttggatattccttcttgtcttagaagagctggtctcaaatttgatgtcagctctctggtgtatctcagtaagcactagcaacctggaggttaatgaccattaaataatggatgtacttcaaatgatgtactttataaataacttggggaaaattcaaggttacctctgtgaaagcatcactcttgcttgaattcccataggttttcttaaagtgttattcttgggtgtcatccacaccctggggcttgctctgtgccccctgaggctagctctgtgccccctgaggctgacctgaattttatacatcagtgaattctgtgggggggggggctacaagcaatagccacaaattcctccccttcctatatctgtgctctactacagcacagctttgtggttcttcctatcaagaagtagaatctatctctccacctagtcctcctctttcagcccccggagtctgagtcagcttgtgatttactttgacctttaggatggagcaaaagcaaaactgtggggagttctgatcctggacctgatgatccctaagcttctgctctttcttagaaccctgacagcaccatatgaggaagcctggactcccttccctgagaatcagagaccaaatggagacagaagtccagcctagagccagcaccaactgccagacatgagggagaggccccctgggactcacctgccccaggtgaactgccagatgatgccaccgccggagccaaatgggcagtgacagcgaaagagccacccaggtgagcccattccaaaatgctgaccaacaacaaaatcttaaattccaagaaaattccccagtggtccagtgggttaagactccatgcttccactgcagggggcctgggattgatccctggtcagggtactaatatcccacatgcca

SEQ ID NO: 58581 - DNA, 1934 bp, Bovine  19866880736536
tctcatttttcttatctggggtgattagttagttatttttagtgcttaaaatatcaaaatctattccatgaaataccagctccatgatgctaatagatattccacatataaacggatacgttatcaaacatggctcatcatttctaagaagaaattattttacattttatgattcctaaagggatctttctagtgactattctaaatctccaaggaagtaccagaatattcagtttttcaatacatctctgacacacgggaagcattttccacagaaaaccctagtgttgtacaaacacgcctggtgcaatgatggtgtaagacagaatacacattccaaaatgctacctactattattattactactgttattattgctaatataactattattcagttattaattattacttagcagcaacaataataatgcaagaggcccaaatctgaagaaatccaagttacagttcaaaattccgagttttccaaacaaaattttgcatgttggattttccttggtgcatctcctctgaattctactggttatagaatagacaacttgaacacagacaaatccctcttccccttgctaattagcaagttggattgttgagatgggactgctccatcaccgcagagatgatgccatggcttttaattaaccatacagggacttgaattgattcaaaaagaaagaaaagttctgaacatgcccactcacctgggttaaggaccaaagaagtcaaagaattaacagctgggggcatgtgtttcctactgagctccttacatgacaacaaatttatacatacaatccatggggttgcaatgagtcagacacgactgagctccatcaccaccaccatgactttgaatatttataactgtctgtgttttcataacgtggggctaataagagcatagtcagagaaagcggtacactcacataattctgaagtgccagctttttgtccagtgccttcctggattatgctattaattccttggaaagtgtgaatcacagtagtttctaggtgatgagtgattttccattattcatgaatgcattcttgtatataaacaacagcctctgtgttgccagcatctgttttattcactggacagaggcccccaccccctgcactctggctctagccctccagcccccctaggtctccaggatgaatggaaaaccagaaagaacccaggccttgggggtctttattgcctctgggttcttatctagactcttccccgtgtgggagtctgggcaagattcaccatcattcctcttctctttcctaagatgagctagatgccttctgagtccaagactgcatgactccatggcttcgggttaagggaaaaatgaaacccttgggttggagggagaaaacgggaatattactctgtcactggccctagctatcttttataactactcagcagacatttactgagcacttagttactaggccgtgggttggacactggagaaatagagctcatgatcaaattgcagagaaaaacacgcgcccataaaataatgcggtgtgtggtattcagtcctgatgcggacatgctaccaaagagattacaaaaggcagggtggttgcagcaggcctcacagaagtcactgctctgaagcagagttctgaaggttgaatgtgtgtttggcagttgagtagggatgggaactctgagtagagagaacagcacgtggaaaagtgctgtgagactcaatatagaaaaggaaatacacacacacacatatagtaactatatatagtaaatcaatctacaggcaatccagaaagccaactcaagggcctcccaggtaactcagtggtaaagaatccgcctgcaatgcagaagatacgggttcagtccctgggttgggggaagatcccctgcagaaggaaatggcaaccgg

SEQ ID NO: 58582 - DNA, 2679 bp, Bovine  19866880787924
tcaaagatcctgcatgcagcaactaagacccagtacagccaaataaataagtaaataagtattttaaaaataaagtaaaagctctggcagagggctggcacccagtgagcatgtgataaatattggttgagtctaaatccatttatacatctctgcagcctcagctggcattttacttactccctatgccatgacttctggggttcttggcgaaagacagccttcccttggcctgaacatgaagaatgtgagccagcaggacgaagggaataactgcaggatggagagtcaaacgcagggcgagcaggttgacccagatggcaaggagagggaacaggaaggccacggccgcgggagcctggggaggccaaggtgcgtgtcttggatggtgcaggcgggatgctggcccctgtctcactgcttttccgagtcctggcagggactacaaataccttctctgcctcaagtcaagcaataaccccgagagtatgtagcttcttcctcttgaaaaattcacaatttcataaagggtacactttacagaccttacatccaagtttatttttcttctgggcagacacatcaatcttcctaagccctcgtttgcaaataatgagccaaagtcattctctcatccctctgttttccatcttgcaaagaaaggtgatgctgcaaattcatacttaaatttcatgctcagacggtttcccagctggaatgaaggcaccttaaggatcatctgtcttagccctgcatcacagagaggagtctggggccaggagatgttcagttaacttgcttaaaatcacagtcagggggttggaaggaaaggatgaaccatcagaaagaacagctggagccaaatcccagatgggaaaaagatcctggagttccaggcaagcagcactggagaggagagtggcgaccttgtcattttcctgggtcaccaactatagttgaaaatttcagtgctttgtcccttaaattgtccctaagattctttatgtaatctcattaagcaaataaaggttagacacttaaactgtcaaagggtcattagtcatgttctggagactccgagcaggtgaagtgaatccaaagtatgagataagaagatctataactttgccatccattgcattaaatgtgtcatttatcaccatccactgatgcacagtgaccatcctaaaaccagtccatgttacactcatccttttaagaatacatttttgttgctgttggcttgggacagactgacatgatggatgaaagaggtcatgaaagaaaagaactttgaaccaagcaagtgacatggcaaaactgcatctcattccccacttctgtcttctcaagggctctggcccagggatggttcagccaatactgacgctgcccacgaggaaagacaggtctggagaactgaagggaccgtgggaacttctatctcttgacaacagtgctttccacaactccacgttgttaaatcagcaacccagaggagaactttttctaacagaaaagcagctgctcaaaggctttgagaaaattgaaagtagagtaattgatttggcaacagcaacagagtaactgtatcagtcaaggctcgattagagaaatagaccctgtgtgtgaaatagaccctgtgagtgtgcgtgtgtgtaggagggaagggggatttagggggtgactcagactgagttattggattacacaactgtaggaggtggtcatgcaagtttgaagggtgtaggacaggccatgagaagggaagagcagaacatacaagaaaccaacagacctgtgatccaaaggcaggagcttctctctctgcataaaagcataaaagatgttccaactgattaactgaggcccactcaaagaattcccctaatttaaagtcaagaagtatgaacttttaccatatctggaaaattcatttacagaagcaactaggttaatgttgttattgagtgactgatgacttgtccaacctagccaagtgaacaagaagctttcctcaaattcatggatacctagtaaccagatttccagccgagtggaaaaatcaggaagagaagaaacaatcctgggtgagaaaatgcttgaagtccatgatgacattttcaaattgtatttataacgaaagaagagtttcaagagatgtcaaggttccagatacattattggctacaagcagctatattgctggatcagtttgctagtgtttgttaaggattttgcgtttatattcatgagaaacagtagccactactttttttcttataatgtctttcttaggtttcattattaagattatgctgtcgaaagttggatggtggttactgttaggtggggatagagactctcagaagatacaagaggacttgtctgccctctggtagtttttctgttgacctgtgtgctgcttacatggaggtgttcaacatgcaaatacttatcgatctgtatactgatgaagtatgtacttttccatctataggtccaactgtccagacccttcaggaaacagacactcagaaggaatacaagggacttccatggtggtgcagtgggtaagacttcaccttctaatacaaggatacaggttcaatccctagtcacagccagaaaaccaaaatacgtgaaacagaaacactattttaacaaattcaatgaaga

SEQ ID NO: 58583 - DNA, 677 bp, Bovine  19866881375177
attactacatgttggacatatgccagcacttcaatacacgatcacatttaatcatcaataaatcctaacaataggtgcatgcgtgctcagtcatgtctgactctttatgactaaatgaactgtagcccgccaggcccctctgtccatgggattctccagtctagaatactggagaggattgtcatttctttctgcaggggatcttcctaacccagggatcgaacatgagtctcttgcattggcaggaggattcttcaccactgggccacctgggaagcccaacaataggtactcagtataattttatagatgcaaaaatagagagttaagtagttttaataactttaaaattttaaacccagttccctctctcctcacatccgatggttgttaacacctctgaaggatgcctgtaaagcccttgacttttcccattagttcttattttcacaagaacttgattttattagtttcaggtaaatagagcatcacagccatcaggggcaaaggaagagtcaatcaaattaaacacctccaaggagcttgcaaagagttataataagcaaatagatatcaacagtagtaattagcacacttgtggctgaaggaaagtcaatggtgatgatttgtgaatttcaccatgaggataaaacattttctttcccttgcctgacttg

SEQ ID NO: 58584 - DNA, 1087 bp, Bovine  19866881477565
ttatgttatgatgtatctgctttcttccttgtgttctaaagaaaaatgtaccggatacatgtttatgtgtggccgagtccctttgctgtccacctgaaatgaccataatgttgttaatctactgtactccaaatataatttttttttttaaagaacaatgtaatgcaaagaacagcatttaaattccatggtggggatggagacaaagagagacgtcaggaatgaagtgtgtttgagctgagtcttgaaggctgatagaactgagaaccagagggtaggaagcacaggggaagggttctgagctgaccttgaccttggcagtgggtcagggagggatgagtcagcagagagcagatgaaaagaggaagaaagagagcgcgcgggaatggaaatgtagtttgccggagctcagaatcctctcctttcgatttgattccccgaggaatacagatccccacgggggatggtggtggagaagtggcccaattaggactggattcaaagaaatcgccggtggccctttgtgtagctcattagtgaaagagggactggaggcagcggcagcgtgaggagggtcccggcaaagaccccgcagcaggaggagacggagagcagaggagagaccactgggagaaaatcatcagaactcagtgttccccaactgggcaacttgagcgcttgttatctgcctctcctgagtcgggagatgggctggagcgtgtgaataacagatgaagtgctgtgtagatgatgttgattagaatgaacagtttaacaatgtgcttaaatgaaaatttcagggctggagacccaattaggagtctcattagaggctcagcacaaggggcgccggctttgttctctggatgatttttagggagtgatgcagaacattttaatgatgatgtcacagtggggcgtgatttctggagggtccggcagggcagcgatccggagacaggcagcttctgcagcagcaacaaggatctgagggcatagtgtgattcagcattcctcctgcacctgtttctggcaaaaataatcataattaattttagggtcgttttggatccccctcaaaaagaac

SEQ ID NO: 58585 - DNA, 1279 bp, Bovine  19866880611852
gggtgatttcctttaggattgactggtttgatctccttgcagtccaagggaccctcaagagtcttctccatcaccacagctagaaagcatcaattcttcggcactcagccttctttatggtccaactctcacatctgtacgtgactactggaaaaatcatagctctgactatgttggcaaagtgatgtttctgctttttaataagctgtctaggtttgtcatagctttttgtagatttacatatgatcaaagcctgataaacagttcggtttatcctaatttactaacccagttctttgagcttcagaagatcccgtcagtgattttgcaggtcatcaaagattcacctgcagcacaattagatgggcaaagtttaagtgtggagggtgctaaacatgcagattcccgggttcagcccttggccaactacaagaaaacctctggtgtacatattttaaaaaatacttatctatttggctgcatttaggccttggttgtgaaaccagacttttctcttgttgcctgctggctccagactgcacggctcagtagttgcagcgccctggattagatgcctcacgacatgtgggatctttgttccccaaccaaggatctaacccatgtcccctgcactgcaaggcagattctcaaccactgggccaccagggaagtccccggggtgcatatttatttttaccaagttccctggaaaactccagaacacactacagtctgggagtctcagttccaggttcggggcctgccactggctcgctggacaaccttggaggaaccacaaaacttctgtttactttgcctacatcataactgcatcatctcccaaatcctccccagttctggcatgatacgattggaaccaaatttaaagaaagtttaccttcttcgcagagctgtaaatatcttctcggttactacagtctaccacaaaggtatgagcctttgcacccagtctcttgcattcggtggctgtttcctcaagtccatgctgcaaaaagcaacgaagggcaagaagaacaagataaatgacatgagcggattatacacgcagctgaaaacagctgagggtattcagattttctggtctaggactggacaagaatttaactgatgtatttgtgacagggatataggcacacttcactctcggtactacaactagtttctctttatttggaactgaattgaaagcaagcttttaaaagaagacaaaagtcttaaaatactgaacgtgcattcatgaatttcacatactctttta

SEQ ID NO: 58586 - DNA, 1003 bp, Bovine  19866880651326
aatttaatggaaactagtctagtctttgggaaccacaagagctttttagggcaaatctgcttctgcaagctggaggaagtgtgggtgtactgaagtcccggtcacaccttgtgatgtcagtcacccccagctcaaagttgattggctgtgaagagctgaaacagtgtttaaattcctgcaccatcagagaagtgttcagaacctcaacccaagagaggcttcattgttacagatttcctcttcaagaacttcagcctgattgttgagcctttgggggaaaagtctttgttaattgaagagggtaagatattttcattcctaaattctaaaaaataacttctgctgtgttgtttggaaaatattaatatatgtacacgtttgagaagcgttatgccatacagagaaagatggggagaactgtgccttgggtaaaaatgatttcatttgtacctttgctgtttatgccagtaaacagcggtattaaaatgacacgttgtcaatagagacaggtgattttctcagtaacactttaattagatttctgcatggtacttctgaaagggagtttatttatcaagaggcagatggaaggtcattttgaagtttggctttaattagcaaaacaaatgaagcttttacatttaggttttatgggtataggtatgttcatggcccacaagacataaaagaatctaaactagactggtagaactttcaaaatatggtcttttaaattcaaaatcatatgatggtattcatccaataatattcttatgaattgagtagctgaaaggagatgctaagaccactgaaataaaccaagggtgtgttacttacactacttttctggtgtttagctggatattcatgtaagcgtgatgtcttacacactatctgagttcaataaatgttcttctgttgtttagctgtgtattcatgttaagatgatgtcttacacaccatcagagttcaataaatgtagactataactatcttttaaaaa

SEQ ID NO: 58587 - DNA, 1365 bp, Bovine  19866880833884
ccagaagcaatttagaatgactggtaaaacgaaaaatacccaaagctcgcagcaacaaaaaaggatacagttctttctggccagcttcctgcttctgccctttctgctcgtctgcatcgtagagtctctcctgaagctttttattcctaagaagaagaaaatcagtcaccggagagattgtccttattaccggagctggacacggtattggcaggcagactgcctacgaatttgccaaacttaagtgcaagctggtcctgtgggatataaataaggtaatagtgcttcctgtgttttactttctagttcctttgatctgtggtgcattttgctggcaacagccccttacagcatttctgttaagtaggtaggaaatagaagggggaaaacatactcaatgtgttgatgttcacatgataaacgaacctagaggatgtaagatttccaggtactgcttatcactaatttgacattgtaaatttatcttcagttcagttcagctgctcagacatgtccaactctttaaacctgatttcactaatccctctggcttttattttttgactgctgggcagcatgtgggatcttccccaaccagggatcaaacttgtgccccaaatagggatcaaacctgtgccctctacatcgggagggtggggtcttaattattggaccaccagggaagtccctgatccctctatcttaccctgtaggaaaagtcatagttttagctggtgtattaaaaaagaggtttgcacctattaagagaaaaatcttacggttactaagtacgtttaaaagatacccaacagaaagcaacgttactctgtcatagtaatttccaagagaaattttgaaatcaccttttagttaaaaacaatgaaaaaaaaaaaaaccaactttcaatgtaattcccagaaaaggtgtacccgaaggaagggagatggacttagactcttaccttttattatttgaccagtgttggatggacaaaggggtttgggagagccacacgatgccaagaaacaccatcccttacacaatatccaatgctataaatgaattcagggggccgagagctaacctggcttccctggtgactcagaggaaaagaatccacctgaaatgcagtagccgcaggagacgtgggctcaatacctgagtggggaatatcccttggaggagggcatggcaatccaccccaatattcttgcctagagaattccatggacagaggagcctggcaggctacagtttatagggtcaaaaagggtctgacaaaactgaagcaacttaacacacgtgcacaagagctacccagtgagtgactgagatgccatcaacaaataccgttcactgtctgtt

SEQ ID NO: 58588 - DNA, 791 bp, Bovine  19866880852574
gtgacatttcttgcacaacggaaaaagaccatataagtagatagtctaaagtagtttattttacaaagcaaaaagtgcaacctgcttctcagtagcaggattctcaaaaacttagtataaattttatactcagcaatatatctcaggaaattaattataccaaatttatgagtcactatttgaataatataattgattttaaagtattaattgcttattagctcctgtcttttattatttagtttttctttttttactaaactaataatgtaggattgtatctgattacagtaagttttccttcctttaaacatagtgaaaatttgtatgattatgaaaattttaaagagttaaatctcttgctatttattttaattcaaatctagtatatttttatatatattcagaattcaaactattcatcttcatcttaaccttcaattaaattccacaatgcaaacctcttggcacagaaccacagttcatgtttattcaactgagcttgtgtgttgagaaaagtgtggaagttcgggagttttctggtgagaatccacattctgacatcactttggccatgacagtgattggctgtgggaaggcaaaaaagagtttatagcccacaagagcaagtgaatgagtgagtgagagagcagagagagtattcaatctgtgtcactcactcctgggagcctgccttctcactccagcactgcaaaaggtaaggtttaatataacaacttcattatcttataaatcaggcactctgcatttcacatctcctgggcttggtt

SEQ ID NO: 58589 - DNA, 1486 bp, Bovine  19866881042937
tgcctgcccatttttattttaatgctggtgaccctgaagtcagaattggattaaaaaagaaagactagttgtatagcatccagagaagccaatttccaaggaactttctgccgtccctaaatatgtaatgaagtgaatataatggtacttggcaggactcttcagagaatgtgctgaaggttgtataggcagctgaaagtgaggtgggcacctcccaaggagcatgctcaaggaacagtagaaagaccagtgaacaactatctaaagaatgtaagttttcaggactccctggtggtccagtggctaagactcagtgctcccaatgcagggaacccaggttcaatccctggtcagggaactagagccctcaaatcatatcaaattcatggatgtttcactgtgaactgccaagaggtggggggcataaatgaggataagagagtctattttcacacagagctgattaaaagaccaaagttcataggcggaagctataaattccctacgttctgttccggttctgaattatactccctggtggtttcataggtcttgactgaggtctgtcctagtagaaccttataatcttatgtcagagtggattctgggaaaattttggcaaaggatgttactggacgttgttttgggatctccatattcctgcataaaagcagacagagcaactagataaccaaactgaaaaccatagactacatatacaataaaagtaatttttttagttctatttctgcaagaggggccaccgaaatgagaagcctgtgcctggaaactagaaagtagcccctactggctattactaggaagaaaacccacacgcaccaatgaccacccagcaccgccaaaaataaaaataaaaaaaattaaaaattaatttttaattaaattattgtatcttaatgcatatatgtggaatctctaaagatggtgcagacaaacctatttgcaggcagcagtggagatgcagacaaagagaacagccttatggacacggggtctgggatggggtggggagaggatgggatgaatggagagagtagcatagaaacataaacaccaccatatgtgaaatacatagccagagggagtttgctgtaagactcaggggactcaaaccggggctctgtgacaacctagaggggtgggttggggtaggaggtgggaagaaggttcaagagggaggggatatatgcatgattcatagggacgtatggctgactcatgttgatgtatggcagaaaccagcccaatattgtaaagcaattatccttcaattataaataaatgtttaaaaacttgaaataaattttttaaaaactgaaaatgctttgtatcttaaaacaactctggtagctgggggctgcagtcatctggggactcaactgaaacagaatattcaaggtcgctctcatattgttgctgcctgggagctggaactgctattctgggcacttcagttcccctttgc

SEQ ID NO: 58590 - DNA, 796 bp, Bovine  19866881063897
acaagcacattattattattttcagccctctcttcaaaaatgccatgcaccgtatgtatttacttttacgaagtaaaaatgataattcctggtaaaagtatgctgtggcagatgggaaaaagatgctttggtcagattcagggactaactataagctaccatggaaacataaaagaacaagagagcacaacactctgacttaaaggaactgactgaccagatgacaaggatgtaccttgtttcaacagtgttaccacaggttggcctgattttctgcagggattcaggggacattttaatatagctggtttatcctattcatctctcttgactacacttgggtgaggagatctgtatcacagggaggtaccccttcatttagatagagaaaaagcaaagtcttagagaatgactgagtaataaccaaactgccagatcacaaatttgttgcaaacatggaaaaccttctcctactgaattgatagagacctctgtttgttaatttttcaattcattagataagaatttgtgaatttccatgtctgcctgctaccactattctaaatactttataacaagttataccactattgaatggactacttaaacggagggtgggtgactccatctaagattcctctgcctgttctgacaacattacctacaacattactaaaacaattaacaacggggtacatattactttgtctactcagcatcttttttctaagaatcatcctgtacatccctctccgcagtcacacgattactgtcccattcctgcactgtgaccctg

SEQ ID NO: 58591 - DNA, 1835 bp, Bovine  19866881128217
cactgaaaattcaactctcactgaaattcagccagaaagaccacttgctaaagcagtctgtttttaatataataaagtttcttcccaaggtttcttataaagcagagctatacacgcacagagaataaactcatttgggcccgggggagaatgatataacgaaagcacacgccacggaagatcgagttcaggtgttttgactaattcactgacaaagtggacaattttatcagctgttgacatttaagtcagtgatgcagccatgaactgccattttatgtagattcaatactgtcatatagctgttttatatccaataacatagagtcctttaatttacagggaaatgaattcataaacaacaaagaccattacaaaattcctgataatctgtggtttgctcaagattttcttaacctttgacctgtgtaattcactagaataagaatggctcaagaatgcaaaggaaagacaaattcatgaagcgaactaaaaaacttgtgagaaaaacaaaacattcttaaaatttgtaaacaaacaaaaaataactaaccactaaaaataagagtttctgtttatactgggttactacctgtgaagagggttctgaaaactagagggtgtggtgctgattttaaatagacaacaaaccagcattgtgctatttttattactgtacagtttgggttcagggcaccaattatgcaccatctgacccaggacttctgagacactaaaagcagtcaggacgccgaaaactatgcttcagcacagtggcttggcataacatcctgccatatgttgagctaacccatttctaactcatacaatgataggaaatgatcattttaaagtatttctagcaccgtaataattatggggaatgtgtgtagccgcagaaatatgagcatggttgatacaagcattgtgggttttcagaattgccttccattctttggtttgcccataaatataacagtgctcatttgaaatttcgttgtctttcttaaactaaatgataatacattcaaattttggaccacttcctcaacttttctaaaatatcatatagagatattcctatctagaaaattttacagatatatacatgcggtccaattcaaatgtccacactgaaaagatattaggaaaggttatatttttccttattgatagacccaaacttcatagatctttaagcggatctttaatattcaaaattgctacagactgtatgcagataggtctatctcaagcaatgcagaatttgtaaataagagagttgttttaaaatagaattcataacacaacattgtaaatcaactatactccaacaaaattttttttaaaaaagaaaaactaaattaattaaataagtaaaatagaatccaataaatatatcttgcaatctaacagtctgagctagtactgatgatctactgttccactttacaaagtttgatttccaagatgtttctccttgcatgtctatttatatgcttccatagctcttaattactcattttcttaagtctattaagtatctagtacccagattatcacccccaaaatcattaagcttcgttggctttgacattcatgttatattcagatggaatctttgtttatatacaatcatttccaaaataccaatatgcatgaaatatattgattgccaggttgtcaacctattgcagtttatctgcttggctatagaaatggaagtataaataagggtttttttgctattgctacgtcacttcagtcgtgtccaactctgtgcaaccccatagacggcagcccaccaggctcccccatccctgagattctccagg

SEQ ID NO: 58592 - DNA, 1346 bp, Bovine  19866881258289
atttgctgtaagggaaatagtaattattaaaatataatctatataataaaatgaaatcttagaatgatcctaaggaggaaaactcttagagaaatgagttgaattttccatgactcttctcaaacagagaagaggcaaagagaaggaaggactaaaatttccccaaagtgagcatgaggtaaaaggttttccagtcacagtgaaaatagaacttgctgacaaggtcatgatcacatcagacaatgcacaactgggaaaaagaaatttacaaaaccattctttatttttaactatacaacttgggaagtttccaaactatgtctgggaagtccctgcttgcccttgaccattatattgctccttttctatcttctatctcttattcctctaccaacacatatgccaacctaaagctagtgaggagtccacctacatgaggtagctagaatagccttaaacccacagaagcagagtagactggtggttgctgggggttggggggaagagggtaaacagagtgttgatttttgatgggtgcaatgtttcagttatgcaagatgagagatgggtataaaacattgctcctctagttatcaacattgtatcatacacttaatttgttaaaaggctagatctcatgttagaaattcttacatttttaaaggtagtaagaaagcactcagttgtatttaattctagatgtactttgctcctttaatttataatatattaatataattgattcaggtggctcagggacttatcattggtaagacattctttattaaatggactagaacatctgtgctcctaatataaggcaaaaatcctatgcctttttgacctttgaggtctggcattatttctagagaagtctaatttggtacttgtattgaaatccatttaacaaacatcctcatactttagtatagtgaagtaaatcttccctgataacaaaaaggttttatttacaatacaattgatgattctgagtacatcactcacagtggaaaatggaccattcacctgaagaaggatcctatcattttaagctagtaagtagaacaagatggacttgaacccgtttcccaagaatgacattgatttttgcagtaagatatctgtagggtcatttctctacatcatcagaagacacgactccttcctgacattatatctttggatttctctggactggtggcattcatacagatgagtattcaaagttgaacaaaatatacttgaatgtctttgaagcagctttaaagaaatgaaacacacacccaatagaccattcagccctaaacgactctggaataattacataaactccataacccaaataa

SEQ ID NO: 58593 - DNA, 770 bp, Bovine  19866881258583
aataataatgtgcttgtacttgctatttttaaccacctctccccaaaaaacccactcagtacaaacaactgctagaccaactccgtctgggaagagcagatttagaaagaagggagacattatagacagtaccacatatgagaaagaaaatataacgtctcagcccgatacactgcgggatgttgactcactttgcaacaatagtccttcatgaatgtagaaaggaagctagtcttttacgcaatgagttcagttcaaacaaatctctcctaaccctgcgttgctacaggaatagatgtcgccaatgttaatatctgtattggacactctgtgtaattatttttccaaaggtcagaccaaacaatttctcaattagagaaaactctctgtacacatagtcctctcctgtgcaagcaataggaatagttggacaaatgaaaaaaagcaagaaatattgatgacattttaagaataaacacgtagttcctccctaaaaaagaagatatttgcaaacagcacaacctgctcaactggcagaccaacaggctagattcaaacatcccatccatctctcctgagggaactttgagttttcctgaagaaaatttccagttctaaataaatgttccaaacatctctataattacttgttacttttaaagtattatctggctgaaaattcattttacctaaagcatattttactgaccagtagtaacaaatttggtccaagaattttaggtaggaaaagttatataaacatgtctccc

SEQ ID NO: 58594 - DNA, 1430 bp, Bovine  19866881329505
ggaatggcatggcataggccagtctgactggaaaagagatgcccccagcagctgtggccacagttagagggtcctgccaaacggcatccagctagtgagggagagggcagagggggaaacccaactcctgggcccccagatctcctgtcctgcctcctattgactgaatgcaggggagcccagtggtgcggtctgtaagggtcagctgtgaggtgcagagaatgagaattgatctgagaataaagtgagattggcctgcccatcctattgtggagagagtgagcagcagcccacagcaggtggatgagaagccccaggtggcctctgctgggggcatcagactcactggtgtggatagtgttgcgggaggtggtgggaagtgaagttgaagggcacattggaagtcccaagcatcaggatcagagacgcctgatcttaatctgatattcagtagtaagccaattctgtttcacataagccaatgttaatttatttcttttataagccagagaactggggaggaaccctggaagaatgaaaagggaaggaaggcaggatggctgtctgtgtgtctactgagatggtgtgagcgagtgtgccgggtcctttgcacacttcatttggcttgttctgtcttccagtgacctatgggatgatgagctctagtgtgtactactacacccggatcatgtcacaactcttcctggacaccccagtgtccaaaatggagaaaactaactttaaaactctttcttcaatggaagacttctggaaggtatttgcaaatgacctctttatcattgaaaattgttcatttggcttcataaattcaattcagtagtgtctacagatcttgctgtgcacttaacactgggtgagatgctgtaagttatggtgagttgttagcactcctgttgagaaccttgcatgtaccttatctcataccttaccttatttaacccccattgtaactgaataaggtaagtacaaaaatcatgtcccagattgtaaatgaagaaactgacatgcagagtgcttacatgtggctaagaagtaagaagaatggacttctctctggtgtgacagagacttcctcatcctaggttgtcattcattcagtcattcatgatgcactaaatatctgttgagtatctcctaggatataaggcccatgagggcagaatttgattgttttgtctgttttacttctgtttttgtctcttttgttgatggtggcttgtaccccagaatagggattcatgtgcttagtacaaggcaggcatattctttcaaagatctctaatgtaaaattcaacccagcccctccccaaattgtcacaaattccaacattaacattagaggataagctataagcgatatcataggaaaaatattaaactgatatcgaagttatatccagaatctaaga

SEQ ID NO: 58595 - DNA, 1424 bp, Bovine  19866881395308
cttgatcctaaatttccagatactctgatggaccccacttgagtcagatgcctacaatcgggtaggccagtggtaagagctaggttgcataaacatgattcttggggtgcatcccgataaatttagggtggagggaggacagttcctagtgaagaaggaaaccttatgcattgacactcaaaaagctgcatcttaccgataaacagtgtatttcttttgtagcttttcatgaacgtactatgtgtttgccatcctcggtaaccttgtgaaagaaaaaagcccttggtgatctgaagagtccacttttcatacatcaattactcagttaactggctgccatttgtctcgtcgcagggtcctgacccactctgagctcgcacctttgcgagcatctctcgtgcccatggaacactgcataacgcgcttctttgaagagtgtgaccccaacaaggataagcacatcaccctgcaggagtggggccactgctttgaaattaaagaaggtaaattgatcatcagcccagggagaggggtgctctcttcccccagacaagccctaagccctgcagttcccagagaggtcctgcttgctgtgtgttagactggaacccagaagccacaggctgggcagtgtccccggtagaaccgctgccactgcaaggtcatttcttaatctgtttccaaaaggctgtgccagtgtgctcagtcactcagtcacgtctgactctttgtgaacccctggactgtagcctgccaggctcctccatccatgggattttctaggcaagagtactggagtgggttgccattcccttccccaggagatctttcggacccaaggattgaacccaggtctcctgcatctcctgcactggcaggtggatttttttaaccactgagccacctgttctaaagggtagcatgggtgaatatttaagagataaaggcactgaggtctcagaaattggttaaacctaagaaagtgatgtgaactccaacagctgagtcaaatctcagaaggctacccttctgagcaaggaaggaaggattttatatccttccttaatttgaatattgggcctaactttaaaaattgtatgtgaaactgaaactccaatactttgggcacctgatgtgaagagctaactcattggaaaataccttgatgctgagaaagattgagggtgaagggggtgacagaggatgagatagttggatggcatcaccaactcaatggacatgagtttgagcaaactccaggagatagtgaaggacaggaaagcctggtgtgcggcagttcatggggtcacagaggtggacacaacttggtgaccgaacaaaaacagtgtgattgttgaacaacaacactgaacaacaacagtgtgttgtcaatcaaacagcaagctgattctaaaaatcagaga

SEQ ID NO: 58596 - DNA, 938 bp, Bovine  19866881477977
agttctgtcttcctcctccctgactttcccttatgttcaatgccgttgccacaggcacttctggggtgaaatgaagataccttccgttcacggtcagttccatattcagtgaagagtgaagttgctgccagctctcccagtgtagaaaccgcttcctgggacaccctcaccattgctgttgttgttattgtttagttgccaagttgtgtccagctcttcggacttcaaggtcttgcagcctgccagctcctctgtccatgggatttcccaggcaagcatactgtggtgggttgccatttccttctccaggggctcttccccacccagagatcaaaccaacatctcctgcactggcaggcactggcaggtggattctttaccactgagccacccttaccatacaggcactgtgccaactcacctggcatggtgaggttggaaggatacagccagttcaagaaatgaacctctcacattgcaattggcaccagaagcacgtgggttgttaatgagaaacaggtttgaaatctatggagacaagacttagcctgcaaaattgattccaacaacagacatgcaaaaaagcagtgaaggaatcagttctcatctacaccttgtcaaagcagaagttcacctctgtcaatagtatactcagtgatgcagtatatacacagttataaagactcagacattattttttcttttttatgagaatggcatactaaatttcaactgcaacttggccggaagtttagctttttgttttaagtgagaaattacaaacccctgatttgatttttatataaagcatagcttgttttataatgtgaatgtgtttaatagataggaaaagttaagataagtatctacatttaaaataaataaaaatgttaacagtttacttctttgcaaaagcagttaggatgagaataaaataa

SEQ ID NO: 58597 - DNA, 1102 bp, Bovine  19866881717667
atgttatggacatttaggaataaaaagttgcctgattgcaaaatgctttattacttacagttctatgtgaaaatttactcaggaaattgtttcttcttgtcatcgaaagactaaagttggtataacattctccactgaagactgtgattttaggataacaaaggcccacatattttatggttatatttaaataaaacatccagtagggaaaaatccctaggaacagaaagcaccttaggtggctaccagggctggagtgaggggatgaggaatgattgctaggggaatggagtttctttttagggtgatgaaaatattctaaaattagttagtagtgatggttgtacaaatctgtgactatactaaaaactgtacactttcaaggaattttatgctatgtgaattatagctcaatgaaaatgtgttaaaaagtcttctccctccccaaaacatagactttcaaagttagtattttcccttttacagttggtctttaggaggagcctagcaggctacagtccatggggtcccaaagagttggacacggctgagcaactaacactttctctttctttacttttcacatttaaattaggttagcagtacttgaaatgggattaaactctcccttttcacttgacccctcagctgtttctcattctttgaatatagtctttgatggcaagttttcataccctggggatgaatgtgatactgaaaatgactaaaactcagtgcaaccaaaaacaattaatgaggtgtaagtataaaatgacactttcttgtgtgctcataaaatatctctgaatgtcacttccaaaaattatttcagaaatagttggaacaggtcagcatatttggattcaacataaaatcatcaatggtgaccttctggaaatgacacatttactttcacttatattttgattattgaaaaaataatgttagtattttatggttctacctcttggtcatgatagatgtaacagcccagggttataatgagacaaatgtgccaagtgaaaactgtaaagatgccctccaactccaggcctactgggttcaagaagtaaatttctttctttctttttttttttctttt

SEQ ID NO: 58598 - DNA, 973 bp, Bovine  19866881849774
acttagcagcagcagacacacttgaggttcactagtgttacgttccccacaaatcacatattttctggcaggcagtaaaagtagaggcacaccccccttatccagtctggtttgctcttaattcaagtgcagccctcccacagcatcagcagaaagcctggggtattcaccaaggcttttcctacttactgggcaattaactgaaatttttgactccccagactcatgcaactgccaaaagctctgctcaggttcccagcttcttagttgcttgcacccatactgcttcttttttttttgcttttttgctttagactttttatattggagtataattaacaatgttatgatagtttcaggtagacagcaaagcgatttagtcatacgtacacacatatatccattctacccaaactccgctcccatccaggcggccacatgacactgagcagtcccctgtacaacacggtagacccttgggggttatccattttaaatgtaacagtttatacattagactcaactgctttttattccagagggaaaggtacattgccgatgagtataatgctcgatagtggcttgaggccccttctcatttagaagcaaatctcttagtaatgaataacgcactgcctcgtgttgttctaccttgttgctgttgtttcttacaagcttcaacaatctggaaggaagttccagtgctcgggtaaccttctggttgtattttcaaatgatgcgttcatcgttataagtcttttgatgtttgaaatgactgacatcgtgtctcttgttacagagatttaacttctacccaccccaaggagcaccattttcccctcagatcccatttcccacaactgtacaactgcccctggtaagcatgggtttggggaaatctcaagttacgaaaagtggttattagtcggatgacggttgtaacactttgcagatttggacacagacctaaaag

SEQ ID NO: 58599 - DNA, 919 bp, Bovine  19866880355031
cagtttccttatttcaatggtacacctgcttctctaaaatgatatagctcatgtgtcttttccttgtctttgtttaggtaattactagagtttacaaatattctttaaaatataattgctgtagatttgccaaagaaattccacaagctttattcaacagcttttgcatcatgttatatgcaggatactgagttaattttaaatcattattacctactctcactgtaacaaaatgggaaatattgcaaattatgtaaatattttttttcttgaatttacaataactttttttttcacttcagactctcagtcgccaattttttttattagtgtttcctcacagaagaatggaagcaaccacagcccacattagattatagaaacacaaccttggcattgctactcagcccactggcctcagtgcctgtgtcaagccacccatttacctgtgccatcagtgacattttttattgttgttcttatcctggaaacttgtatattcttgctccttttcatgccttgttgttgttgttcagtcactcaatcgtgtccaactctttgagacccggaggacttcacccagtctcccagagtttgctcaaactcatgtccatggagtcagtgatgccatccaaccatctcattctctgtctcccctttctcctcttgtcttcaatcttgcccagcatcagggtcttttccaatgaattggctcttcgcatcaggtgaccaaagtattgaagcttcagcttcagcatcagtccttccaatgatattcagggttaatttcctttagaattgactggttcgatctccttgctgtccaagggacgttaaggaatcttctgtagcactacagtttgaaagcatcgattcttcgctgctcagtattgtttatggtacaacggtcacatccata

SEQ ID NO: 58600 - DNA, 993 bp, Bovine  19866880406852
ccggaaacgctagggaaaatggattcttcctcacaaccctcagaaggaactgactatgctggcaccctaagatcagacttctagcttctagaactgagacaataaatatccattattcaagccactcagtttgcggtcctttgttacagaaccctagaaaaccaatataccagctaatagtactttgtggcaaaaacaaagtgatattgcaaactaacgagactgatatttaattatgtctcataaaccgtctcagaagaagattctgaggattacatgcaaactttgtatgtaaatacggatataaatgcttccctggtagcacagctggtcaagaatctgccagcaaagcaggagacactggttcgattcctgggttggaaagatcagctggagaagagataggctacacacttgagtattcctgggcttccctggtggctcagctggtaaagaacctgcctgcaatgtgggagacctgggttcgattcttgagttgggaagatcccctggagaagggagaggctaccctctccagtattctggcccggctcgcaaagagtcggacatgactgagtgactttcactttcatggatataaatacatctttatttgtagaggacaaaaggaagatatctgacatatatatataaaaaaaaaacaacattttcactgaaatgttacttttatgattttatcctgatagactatagggcagttctgtctcaaatatgttctaaatagaaagtatagctcccagtcagaaatcttcctttttgtattgttgtgaacatttttcagaccactaactcttccaacttctcaaaatagtttaaccggtgagaaagagactggggaatttgagtttctttttgctaataagacttatgagtcataatcatagctctctgttcaaaaggtgttagccaaatctgcctacagcagaaatcaatggattcatggggaggaaaaagcacagagcaagaaaacaa

SEQ ID NO: 58601 - DNA, 1205 bp, Bovine  19866880503426
tttttcattattactgtggttcaaatcagatcatatcaaaggagaaatagcttacacttctctttttgaagctagacttcagttcatggtctgatgagatttccactgcagtagtggttgggagaatgccctacgtaaatcatgatgccttcagtaaaaatatccaggtagggtgttgtgccttttggctgtaatctcctcacagagctttctttcttatctcttttttatttctcccccacatctgtaataaaaaagaattccgggtaagaactcgaaagtcttaaatgaaaccttgtgtggagtgaatattcgcgagacattaataataaatttggagatgggcgagcagagattctttgctgcttgcttttgtacctccgcccctggtctgtgaaccgcggagttgactctgacacttttagggaacaaagtgtccccagctctacctctcccccctcgcttcagacctcatctgagaactcctgaaatgaagctgtcactcagggctgcttggggacctgtcaccacaacattgagccttttcattttgatgggtcagcctgcaatccccttgaaagagatgtccctgccactgtggcttctctttccacaggaattctgaatcctaatgaaactccaaatcgctcaataaaggcaggggcacgaggaagtaatccaatgcagatctgagtgaaatttgtattttatcttttttttttttctctcccagaccattattctaatcgtttaggtggttcacaaagcgttggtttcgcagttcaggcacaagaggaatgaggtgtcttttgtccggatggcatgctcagattaggtagcagctctctgaaaatgaaaggccgtggctcaaatttccttgggtaaatatccatccacctagcgtagttggcacctacagtgctacatatacattcctaatgtgcaaagcgctaatcgagaagagagaaattgtcatattttattcccatatttttttaattttttgtgtggctgtgaaactgtctttcaaaaaaatctcatgtgcaccttggaccataaaatgaaggaaatagcattgttactctctactttatgatcagaaagcaggcatgtcgcagctataccctctggagagtgtcgtccaaattattgtttacattctgttgtttcaacactcttcatgtgtttgagatacttatgttgag

SEQ ID NO: 58602 - DNA, 1996 bp, Bovine  19866880506535
taattaaatacgtttgctcagcctggataactatgatagctcctgttcagatcaaaggtataaaaacagaacccaggggactgaaagttagtataggaattacttttccaaccctctaatttggcctaaaaggatgcagagagcacatggcgatacatccatggatgtatgtgaaagagggagggatagaattgtccagggtcaggtgtctttctccacacaagactgcttgctccccagtcttggaaccccaggaagcccaaacccagaggccacagagcaaaatttaagcttatataaaacagcttacaatgggagggggagtggtagcaaagatgagaaagtgtagttcttgtattcatctacctgacaaattcatgaaataagtaagatcctaaataaattatgcttgacaacaagcttttaaagtatccaaatttgtatcaataatatcaatactaatgattctactctgatgaggtacataaaaatatctttttatctcttttatacttttagacatggaaattgtttcatttcccacagaggtgatacttgtagttttctgaggtataaaagattttgtttagtaaaagtttttgaaatgaatataataatattttatataagctgaggattactttacagataataattgaaaaacaagtcatctccccaaatttaaaaattcttctttaaaatacagttcccttcaaatgtagttttccacaaggtaatccacagtctttgcatgtttgtatatcactcatctcaatgtcctccataaaagactacatactttgagtattaattctagatcaaaacactaatttttagcattaacatcatgaacaagaaatagtagcactctatgttttatagataaataatttttatttagagttagatcagtttacataaattcatatctgatgaaaggaaaaacataaataatcaaaacactctacagcattcttaagagaggcttaagatcaatgtttaataaatacgatgtgtgacttccataatgagatagcagcctgctcagtttcctatgctacagaattctccgtggaacatctttttatttaccccatacacaaaacaccaaagttagaagctgacatggcctcacataaaattagctctgctacacatcccaaattatgtacgtggagtgactaattacttcccctgcttgtttggctggtatcattagagtacatctcattttactgtttttgcatgtgcttttacatgtttctccaatttgatattatctgttacaaacagtcagctacttacaggctgcttccaaagaattttataacaagcccaggcgggtgcttaatgagcctattacaagggcttcaggaagaagaggcttttgtgagttcctttctgccccctttcgagtttagaaggtgggagaaagtggttgagagggtttcaatgagcctttgcgggtcgatccacctgtgaatagaactggtatgttgcaattagaaagggcgagtggctgtggaactgagagctctccagggaacatctttgggggactgacttggtggccacctaaggttaggggttggggccatctcagagtctgggcagatggattctcaccttcgcatcagcataaattcaagcaagtaactctttgcccaactctaatgctattgctgctctaatttttgaaaaacagaatttagccctcacaatatattttgatgtagataattagagtcagagtgatagtgaaaattcccaggaaatgagatcagaccaaccaacaatccactcctatctatgctgtttaccagctctgcaaccttgagcaagttgcttcctaagcttatttgtgccccagttttcccagctgtaaaatgagtgtgataatcacccctccttagttgttttgaggattaaatgttgcacgtaaattgcttgttttgcaaagatttcttatgagctgtgactggggatccctggggat

SEQ ID NO: 58603 - DNA, 827 bp, Bovine  19866880506983
agcaaagggaggaaagaggagaagtaggaaggattagagaatgacttcttttttctcttgtggaagtatcagttttctctgacccaaaggagagtgctttgtcattgttttctttataacattgatgaatttctttttgagtgggtattgggctttatttaaacacgacaggaacagagatttatgggcggtcccctcagaggctgtctgaaaggccccacaatgcttcagggcacagctgtgatttcagcgttcacttctggtaaagaaccaacagtttcatacattccaccccttcatcctgattagagagctctccttgaaaaatgaagtatacttgatgaaattcaaagcaaaggcagaagagaggataggaggtaggtttttgtggagtttttgttgttttgttttgttttcaacttacacattcttagaaaaaactgtggtattcaacctgtccttgtgttttttatagagaaaggcaatattgtggatgacaaattgtattctaaatgccattatacttctctgtacaatctgatagttctaaaattatctcgctctctctctgtatatacacataaaataaatgtttcttagtgaaagcaaaagagtgaaggtaaggacctggacacaaactaattactatgaactgtaccataatttacaaaaccgtttgatttcagattgcctatgttttcaatttttcacaattttgcatagcatagaaattatattttgcacataatattttttcttctattcccttagtcagtgttccaaaaggtatcctaacttggtatgaacatttttaagaacatttggtt

SEQ ID NO: 58604 - DNA, 1869 bp, Bovine  19866880511696
ataaaaatgatcccactggggagtgttacagcacgtcttagatatctcatactaccagtgggtgaccttcagtgaccaacaagtttcaaggaaggtgcaattaagactatgtggccctttctattattcttagaaatatatcagcgtaccagtgaaagaataaaaagattaaggataaccttgaactttcatgtctgaattgaccagttgatgattatcaaaatccatctccccaattatcattaaaaaatcattggcaaactttggaagtccaacgggttttgactgcaaacatgcaactgtcttgcaatctgactcataaccgatgaacggcagtgctccactgtgacccactgggtcggactgtttccagtggttcccagaggggctgagacaggcaccagatattgaagggtgtgaaggacttaaaggagcaaagaaaggccaagagttacatgtgtctaaggggaagggacaagctgaacagtatggagaagtctcgaaacaacaaaagagcaataatggaggctgggacccaggacaggggcataacaacagggaagaagctcaagggatgtggttgaagccaacagaaagagactaaagtgctggacttttattccttaagctaaagtaatgagttttcatttaaacttctctatttcaatgctatcacataatatatttgttatattttattttattgtttactgttttggtgtatttggagggagatgagcactgaggagacgtgtgtggtaaagactcagagcatatcaataactttacttagcaggcaacagcaacaaacaggaattggaaaaacaggatctgttgagccttcgtgttatttaccacttactggaatgttggctgaaaaacagtaaaataaatatttcattttacccagcatcatttaaaaagtaaataagacacagagctcttctaagacaatttctgtggcggtatggggtagctataatgggcttcaagccgcataaagtttaagctaatattcttgggcttacgagtttacacctccctctcccctgaaacagttccctatatgattcccataggtaaaatcatctcagtgggtttcgcaaagcagtgtaaataagtgcaggtttgcattaaagctccgactacatattaaaggcaaatcaacagcccttactaatagagatgttcaaaaaagataaaacacctcaaagcccaggcgctgggtttgtgctgctatttcatgtcaaggcaattatagtgatagtattagggaagatgagggcgggagtggtgttgtcatccagggggaagggaacgcgagcctttaagtaatcatgtagagcatgcagaacatcttagagctgggggaggaacaaagctccacgctgtcggagtattgatccactccagaaggtgcagggagccgcccggccgtgattgccttccccgctgggtttagagaggtctgaaagaatacagtattgatctggccccgttcctgagaagtaacttagaagataagccctgactggagcgccaccaaccttgagaacaaacctgttgcaaaacgcccctctttgccatgagtccgacgtcagcgctaatgctgtgggggtgaggatgagagtgcacttaaacccagtctgagaggagtcgcccacgtgccttcttccccacctggctctccccaggggtctccaaagaccgaaactgtcagaacagtattaggagtggaaggaggggaggacagagctgaagtcccatttgcgaaggaagaaagattggcgtttctgaagctttgtgtcagtttttaaagtctgagtgtttgctccaatcttagtcaaccttcatttagtgcaactttta

SEQ ID NO: 58605 - DNA, 1767 bp, Bovine  19866880516836
tgaccttttctcccctaatatctctgtatcttttaaaaattaattttattggactatactcttgcctggagaatcccatggatggaggagcctggtgcgctgcagtccatggggtcactgggcgtcagacacgactgggtgacttcactttcacttttcactttcatgcactggagaaggaaatggcaacccactccagtgttcttgcctggagaatcccagggacgggggagcctggtgggctgccgtctctggggtcgcacagagtcggacacgactgaagtgacttagcagcagcagcagaattgcttgacaatgttgtgttaatttctgctgaacagtaaaactaatcagacatacacatacatggtcccctcctttttggatttccttcccattcaggtcactaccttgcattaagtagagttccctgtgctgtatagtaagttctcattagtttctattttttacatggtatcagctctgtatcttaagtatcagtaccttttaaaactttactggtgagaaaggtgaaacataggtgggttaagtgatttgcttaggatcacattgccaacaaggagcaaagaaaggacttgaacaatgggtgccagactatcatttctacttttcttccattaaagtagatagcttctcatgcataatctcccccagtagcaagaatacacatacagggttcaattcaacagaccctcagtgaatcgtgatgtgacaaatattgttctagatcatagggagagcacacaaaactaggaaaatagagttgcctcttaccctcatgatgtttgctattttgggggaagcttggcagaccaaagaggttaatttccatggaagaagctgcaaggctgcagtggtctttccatggtaagaacaatagtttctacataaaacaaggaagtatgacaatctaattcaattagtccaaaaaaattaaagctgcaaggctacaatggtctttcagtactaaaaccaatagttccttcataaaacaaagaagtattacaaatctaaatcaattagtccaaaaatttcagaccattagctgcaaaaacctgaggcagttgtactctcaagagaacaatttggcagtgagataccacccaccatgaaccaagataattatccaaatcctcagactgggaaaaaaaatactagtgggcgccaaaacttatgaagcaactctcatcaagggcatctgagcttttgcatgcctatattctaccccagggatttctattgcaaacatcaaggcgtggaagaaattttcagtcatcatcagtcagttcagttgcacagtcgtgtctgactctcagtcatcatgccaaccagcaaacccaggaactggggccacaacactgtagagagctagactctttcttccttcttcactttgtcttctcaactcactcatctcgagcagcaggtcagcattcacaggccacaggagatcatgatattggcctctaaagaatgctctgccttcattattttggactctgattcatcagcaattagaaatcttacattctccaaaatttaacagaaaccagaactgtggaaattgtaaatgattataaacagttataaaaatgtaaattttcatatatttcccatatttataatcaagattgttataaaaccaagcttttctaatgtgtctcagacatctgaatagcataactcttaataaacattataccactctccctgactttcaaggcagaagagctgtgagatgaaaaa

SEQ ID NO: 58606 - DNA, 1599 bp, Bovine  19866880532332
tccaatgagtattcagtgttgatttctttagggattgacttttgatctcccttgctgtccaagggactctcaagagtcttctcccagcatcacatttggagagcatgagttcttcagtgctcaggcattttcatggtccaactgtaacatctgtacatgattactggaaaagccgtagctttcactatgtggacctttgtcggcaaagtgaagatgggtaaagaggcaatttgtaaatgaagaaatacagttagcaagtgtgcagtagtgaacaatctcactgatattcagacaatgcaatattatttttgttaataatatagaaaaagacttaaaacattattaaatcttagtgtttaatgtgtatgtaaaagatgtgctttggcttgaggtacaacaagcatatcctcatacataaataggacaatatttccagaggccaatttgaccacatatatccaatatctcatgcatatatgccttgaccctcctacctaccctactagaagatttcaaactaagatctaatcatacaagatggaaaacactgcacaagatattcattgcaatattattcgtaagagaaaatacttccatagaacatttaatcaaacatggtgcatgcacaaaatagagaacctacaacaatgatacataaacttttttactgacatggaaagcagtctacttaatatcttgggtgaaatggcaaactagaaaacaaaatgcatagcatgattctacttatataaaaaacatatacacacatgcacatatatgcttacagaaatgtttgaaaggatgttcaccaaagtgctaacgatggttagcattttaatcattttcatttgtgcaatgaatattattttgccaaaaatatactttcagaggaaaaaaagcaaaaaacaaaaaaacatactcttggtattgatcctgagagaagccatgtttcctggatgacttgaggcttcaccttggccttgggaaactaaaacattatagctctcttgatttttaatagctaaagtaaacactgtgggagattttggtcatcaaatgacatcaatactaccagcatcatcactatctattcaggtctccaaattgaaagtcagcttcaagaaaagccatcgtgaagaaatatcctcttctccgagatcagaagaacctgagtggactgagaaaggccaagctggaagcagctagaggcaggagttggctctttactgaaacaaatattccttattgaaccctgagggagtgatgggttctaggaaaaccagtaatagccatctccaagttgaagggaaatgatagcagagaggataccctgaaataaacactttgtgtctcccagaataggtggaaatcaatttatctgaggaacaaatgggactgattaacaaacagaatgactggactcctaaggggttttagagttaattgggaggaggttaaggagttctatgggtctaacttcgggattgcaatatccagagtcacatttgaaaccatacttggcactaagaatctgttctgggttttcatctgcaaaacctaataatggaagttcttttatattcctaaataaaaccagag

SEQ ID NO: 58607 - DNA, 1486 bp, Bovine  19866880586998
caaagtccagaattccagacagccaccccatgaactccaagatggtattgcatcttgacagcaagatcccctaggaaggcttcatctcctcctgccctgtgcgcccaggtagggagaactctgcacttctgtttcttcactcacaaaataaacatacccatcttctgcccggtgtacccccatgaggcagaagaaaagagaaagtgctgagaagtgttttgaagctggaggcagaagatgccatggaagtaaacagtaattttattaattgcctcgaaatagaaaatgtggagtttaaatcaatgctactttcttcggagtaaacactaaatataacagccaaagcgatatggttaaaattaacttgcagttgctttgcaagctggggagagacaattacaaatggggagatattgccaaatctcatttaccgctttctttcttctgaatactgtctctacgttcaggtcttcatgagacttctcaatggcacaggaatcccattgcattcgcttattcttgatctttgtcaatgggaaaaaattaaattcccctgcaacacaggataccacgataaatacccaccagggccgctgcagcaaccccaaactctggggccaacctcctccccgctcctgcccttcacgtgtgtgtgtgtgtgtgtgtgtatgtgtacagggtgtgtgtgtgtgtctgcatgtgagtctcttactctccagctactgtgtgcaaaatggctctttctgactgctcacaggatgccaaacagcactgaatgggttaattggcattttaaaaaggtaattgtaaagtgtaaccggcagggttatcgccagaattgggaggtggaaatgtaggtctcccacccactggagactctcacatcttgaagagcaagctgaagacaaaagcagggctaccactgcttcttgattttccctttcagcggcaactgttcgcccccaatgctctctttttgaatgtgctgtatcaagccagtagttactgaagagtacagtgtggtctgtcctgactacagaattaccttgggatttgattgtagcataaatatgcagtaaatcattatgtgtatgggtttttttaatcgtgcataatgtatatacacaagacgtgtttggaaaagaactaagaaataactggaatcaaaaggaaactgatatattttaagacacttctatgacttttagtgtggaatgtaaaattttaaatgggtttttatacaggttactggaaagcccacataaatgccatttacctcagctcatgattactgcaaaatagagatatagccaccacggtgagcagctgccactggtgcccaacggatcgtcttggtttaattttcaaaaggaagagtttcatggcagttagcacgcctgtcattacacgtgagtgaaagagaaacagggaaaggcaatgattaacaggaggtttctaaatggtatggtgagtgacagggggaaat

SEQ ID NO: 58608 - DNA, 1986 bp, Bovine  19866880644762
aaaaaaaaccaccctggctagaaatggtctcagcatttattaaattaatccaagcagtggacttaggaagcttaataaaattagagacagaccccctgaaaagtctgaattaaatgcttagctctctcatatgccagctgtgtggctttggacatgctaccctcaggtattctcctccataaagtgggaaaaatgattcctctacctctccgggtggttctgaggatttcacaaacagatgcttgaacaatctaagcacttggtaaatatttcttctcttactgcattaagtaaaatttgcttcttcctgttcattataaagcatctttctcactataacggtaaaatgtggttttgatatttgctcttcaaatgaagtgttagtcgtgtcccactcttcacaaccctgtgcactgtggcccactaggctcctccatccatgggattctccaggcaagaatactggagtgggtttccatttcctcctccaggggatcttcccaatccaggaattgaacctgggtctcctgcattgcaggcagattctttactatctgagtcaccaagggagctcttcaaatgggactaccataaaaaatgtaaaattctccctagtcattagggagttttccttcctatgaattttcagaattgtagtatttttgtttaaaaaaaaaaaaagaacatgactattttacagtggcaaattttagtagaggaaaactaattttaaaataatatcctgacatgacatacatgtatatcttgtcacatattgtgtgtatatatatatatatatatatatatgaactcagattatgtgagtggcatcatctctgaaaagtttcaaaggattcttagacctggagcccttagatcaccatcaagagtcaactgtgcctcccaattaaagcacgagatcctaggagagctgcccaagataaccagtcgtagggggctgacaacgtaccccaggcctcagtccaaatgcagcctgttggggtgatgctaccaatgttcccccaagattttattacagaagaaaaactctaaagagttctatcactcctgggatcatctgaatctcagccttcaactgcaacttttccaatttggccatcaatcattctctgccccaaagattgtacatattctgattatcatatgagcattcacatgtgtgtgtgtgtgtgtgtgtgtgtgtgtgcgcgcacgcgtgcgcgtgtgtgtgtatggatgtgtgagtgaataatgttgtcattaaatagactagaagccttgggagcttgaagcaatatctttctccactaaactgctttattactgccgtcccctccctcctgggcatgcagtcagctgagaccaggccaaattggcagtcgttttcagagagcctggcaagcccctgatccctgggagttcccagacagtgcttctctctcaaccagcccctccaagggtcatgagtggccctggctcccgaatgtagtttgcctgggctaggtcaagagtcgagaccagggtgcatccctatcttaaagtcatattgtgaaaacagtctctgcaccccatggtattctcgtagtaacagctctctttctgactgctctcctaattctccgactctggagcctagcgtgccagatttctcccaagtggctgcaaggaaggggccctttggtgaccaaagtgttaaattgataacatagttgttctaaaaaaaaataatttggggagatgtgttgactgttgataagcagacctgaaataataatagcagagactgcttatcacgggcaggcaatagtcctatgacaatgttccagctgatgaaaaaaatgagaacaaaaattaatagtgacagtactggtaaaaacaagccataaattcgatactaagtcataaaatacagactaacccaagtaaacacagtgctactgttattagtattaagtattgttaaaaagtgtcataacatttttttaa

SEQ ID NO: 58609 - DNA, 1477 bp, Bovine  19866880726479
ctcttatgtgtttgagatacttatgttgagtgccgtacactattcaccactgtcctctctttgggtggaaaagtaattgagaaaacttccaaaaggaaggcattcatgtgctttcccactaaacttcatttcttagtatatttgtacatatatgctagaataattgtgtaaattcacatgaaaaggcaatctccccaaaagttcaccaaagaattttttaccccatcttatatttatttagaggatgctttgtgttctctaaataagagacctgtgttctcaggtcctttagaaagatagtgaaaaaaaagatggatggacatacacatacatacatatgtagataaatagatatactgtatagctatagataaagatataataaagctggcttttttgatctgtaacaagctgaaccccagttaacgcttgttttattatttaaccttcataaaaagctaacaaacaatatctaaaatatgtcactatgtccttgcaacccaactctacaatcatattcatgttgcttaaagcctaagagcctccaatccacatcgtctgcttctactccaacacatcaccctaaatatgtcaactgcatgtactttaactgtccaaagaacatctgttagaactccaggtgcttcagggtccagacgttagttgcaatttttttcccagttgatagatgcaacagaccattgcatataaaacaattcttccaacccagccttgttgtttttctatatattaaaaagaatatttggaaaaaaacattaatattaaattgcaatttctatagttgtttccatgatacattttattctatatgcgtgtactaccagaaaacagtgaattacctttaaagataaattttgatctaccatataaaggagggagaaagagaaagaaaattgtgggggcagggagagagagagaaaatcatgaatcacagctccttttcttgtccattctttgtataatatacagaaatattacaataaacgccggggtgctctcagttttaaatctccattttggattagattgatttagaccatagattttggctggcttgtgtccttataactaattttttcctactttctactttgtctcccctgtgaatgctaaatgctcccattttttatatttttttcacatatacaaaatgcattcccttttgtactcattcaggttaaatcacatattaaccacagccacccacatacgcacacactgaggcttggggaaaactttaaactgtggagcgttctaaactgtctggaacaagaaatactgttctttctcaaactacagaagccactaagtttgcctaaagctattttattgttttgtggcatttttaaaatacgaagtataaggacccagtggaaaagtttgtattagattttatttgttctgtttgttgggttcaaagacagacttagaaggtccccacccctcgaagactcaa

SEQ ID NO: 58610 - DNA, 835 bp, Bovine  19866880771946
tacaacttttatgtgtcatttctacactcaattatattgtgagtcagaagtgaaaaatggtttctctattttgtggaagtattaaatttagcctttaaaaattagcacagtgtctatgcatgatgtaaaaataatcatctagagaagtgaatattattctcctcagttcaaaggataaattaaaacaggcaggtgattcacttatttttacttcatagcaaggtaatatattgatttcctccttctttccttttaaattcaaagaaaaatctcaaataaaacctaattacatcactcggattctaaacgctcatggaaattacagagctatcactattaagtacactttacaccacttttgatatctgttctgcccagacatagttcttatgctactctgattttggggtgaaaaaaactgaatggaagttgcactcagtcttgtctgattctttgcgaccccaaggactacacagtccatggaattctccaggccagaatactggagtgggtagcctttcccttctccagggatcttcccaacccagggatcaaatccaggtctcctgcattgcgggcagattctttaccagctgagccaccagagaagcccaagaatactggagtgggtagcctatcccttctctgggggatcttcccaacccaggaattgaaccagggtccccacattgcaggctgattctttaccaactgggctattggggtagttgagctctaaatggcggttattgtggatttttctaagtagcttatgctaagttagctgagagttttaaatgtgaaatggaaattaggctgtttattttacgttttt

SEQ ID NO: 58611 - DNA, 1119 bp, Bovine  19866880881595
ggtggttatcatcagcccattttctactccctgtgcacaaatcatttcatgcattctacaaaccaagccccgatgttgggcttcaaaagcaatttcagcagcaaaataaggtgcttttcttcaattttcaagccatttgtacgaggttagtgttgtttacccacctggtacactgatatttacatacccctttaaagaaaattggtaggtatgatttatggagtactgtaagagcacaattttccatgtagtgcacctaatctgaaagggcacttgcaaaggtcactctggccatacaaataccaagtcttctctttggaataagttaggagattcatttttcttggaaaatgtcagcagtaccctactccagaggttagtttatgcagataaatgcgtaagcctttaatctttgagcaaaaatactctacacaaatgtaaaagcagtccatctatcactgttaagacctgtaatttgtttttatttaaatctcaagccagggcgcagtgggcaacaggacgggcaacacggtatctcccatgtaagccgagatcaaggcgcagaaacgcgtttctagtcaacccaggtgggtggcacacggcgagcctgcgacagcggagaccgctgttctctgttctgcgcttgctgctccagcagctggaggcttcctgcccagcccgggagcgtgggaatgtgtccagtaagtttcctctcccagagctccagcgaaaattcaggtgaaggaaatgttgtctttttctttctttttcaacgtttcacttcagccccaggagagaaaaccaagtcacgtccttcaggaacttcttttccccaaagaactgctgtgttttgagaaaatctctcacttttcccataagtaatcattcccggtcctgagattttttttcattttgcatctgacaagagaagtgatgagagtcagttgtgggtaatacactttagcatgttttatatgctctccttcttttcctgctgcataaattctatccttaatctttatcccaagtcatagttctcttgaggaccatgttttaatattagatttaacagacatgaaaaaaagctaaaatacgatcaagcaacgttttcctctgttt

SEQ ID NO: 58612 - DNA, 1345 bp, Bovine  19866880889910
aagacagttggctttctctttgaaggcagattaaaaacggagtggccgaatggagaggtggtgtcttaagctgagggcgcttcagagaagagccaggaggggtatgtccatggcacttgtctttgattcacatgagccatttcgattccggcggcgacagactccaaagttatcccagtgacaatgatcacttcacagagcagggagctaatacagtaaataaatgaactcagtgtatgagccacacctgcccaatgcccgtcatgatgtaatcaaggggctctggaaacaagaggatggccgggggttaagctgcgttagagagagggcagaaccccatcacgccaagactcccaccctgttctcctggctgaagcactgtctggtttgcctgattttttttttttattagacagctgtgatcttctcccttcaaacccttgtcaccgctgttcacagcgatgtaagtgatatgattagggaacatggcatcttgtgtaatcggtcataatcaccatctgagggtttcaggagcgtgacacgcgcctccagagctgcctgaaagccggcgcacagaatgacaggagaccacttgcgtctcccctccttgcgcacgcacctcctctcggccaatacatggaacttcccaccttccacacgctggagacccctttctcttttcatgtgtgagatgaaaacactgcagttctctgtcaaggtgttctgcattagaggattttccagatgattgaaagatttgcctgtaagtgtgcaaataattcatctttcaatgcaatttaaaaagaaaaatcttttaaaacaggttttaattctgtcacttaaaatatatggtaaaccactttcttttctctaaaataaataattatttagcagtacctcgaggtcaaaggaacctcatttttaatgtctgagacgatataatgaagtccttgtacataaatgttcagctgcttcagtcttgttcagctctttgcaaccccatggactgtagcccaccaggctcctctgtccatggggattttctaggcaagaatactggagtgggttgccattcccttctccaggggatcttcctgatccagggatcgaaccagtgtttcctgcatcgcttgcactgcaggctgattcttttccatggagccaccagggaagcccaatgaagtcctcaggatttgtaaaagtttcagttcaattcagttcagtcattcagttgtatccgactctttgcgaccccatgaatcacagcacaccaggcctccctgtccatcaccaactcccggagtttacccaaactcatgtccatcaagtcggtgatgccatccag

SEQ ID NO: 58613 - DNA, 2112 bp, Bovine  19866880897605
atgattaaaagagaagtagaaagaggtaagggcttcccaggtgattcagtggtaaagaatccacctgccaaggcaaggagacacaggaggtgcaggttcatccctgggtggggaagattccctggaagaggaaatggcaacccattccagtattcgtggctggagaatcctggacagaggagctgtaagctgtaactgtccagttacctggacagaggtaactgttaaatatgtggaatggatacttgagggttttataccttttagaaaaggtataaaaaaggtattatacctttctctttatatatgtttgcatttttcataataaaagttttataagtgtgtaaaaaatttttttaaaagatactctctttactttcaggtcagttgattagtaagtttaatttctctacaaagtcctatattagtagtacctagactagtgtttgagtatgtaaccaggggatggaatctcagagacatctttgaaattctgcctctcatacttccataagctacaaaagctaatcagaacttacagtctaaaaatatagcatctcacatgccttaaccttggtttccagggaggagacagaaacaaaatctaggagtgtaagcctctagagtgaggcctaacattctacttgtcctatcacaatgagttcatcaatcaaacaagcaaatgggttcaaatcctgaatgccccctccactagtgaaataacgtctgctcttagaaacaaaattcttttggttctttaaattgatgcattttattattttaaccacattagtgaaattaaaccattaaatttgcatcattcaaatatacttccattaatgctaatcaactaattgaggagcaatctacaaaaagtttcctaattagcacttggctccccaaatatccatttgcaatgaataatttatcacttaactgtgtcctgaagaaaaataaaggcctgaaactttaaaaagtgattctacatttactattggcttcatactgcatgagtacatgatataattgtaaggctctctaggaaaagaattattagaacaggttgcaacttctttggtaaaaaaattctcatcaagtgctcttaatgaaacaggtaagctcataagttattcaaatgaagtatagcaaatatgaaaacatttttttctttgtgaggataattatactttattgtcaaatcatatccttgtttgggtaatgtagtacttcaaagcctgcttctaactccaacagagaactttttggtccagagaagtccttgactagggctttccttgtgactcagctggtaaagaatcacctgaaatgcgggagacctggatttcatccctgggttggaaagatcccctggagaagggaaaggctacccactccagtattctggcctggaaaagtccatggagcccatggggttgccaagagtcagacatgactgaacaaattttacttcatttcagtccttgactaacttattcactccatgcagttgaatcatgtcaaacatctgctgcagacatttttttttttttctaaaaaaagaaaccaaaaaaaacctgaaaggagtttttcataggaattaatttttttaactggattacattttattttgttgttgtatttttttaatatggcaatataaacatactacaaaatgaataaaaagggtataacataaagtttcattttagtttctattactttcataattaagatttaattattattgcctggccataagcggctgtagtcccaaagaactcctagtctggaaggaaaaactaaatataaacaaagtacaaaaaaaaaaaaaatcaggaatatctctaaaaaggttaacccgaatggacttacttcagaggtgagcaaaccaccacctgtgttcccaagtcaccgagtctcctgttccggcgaattacgtttcactgaacagtcatgcccatccatttctatatcatccatggatgtgttcctgttacactggcagagctgaataactgcaacagagtttgtgtagcctacaaaaaaaatgactatctcaccctttcaaaagaagtttgctaacctctactttcctctcataggaattctttt

SEQ ID NO: 58614 - DNA, 792 bp, Bovine  19866880930943
tgaggccgtttggtagacttagcacattaataaacaattaacattagagtgctaattattttgcttcacctgttgtcactgaaagagttccttacttgatatggaaaattacatttaagtcattttaagttagaaattcttcagcaaatggtatgcatattaaaatacatgtgtaattatgagactgtatgttgtctagcatttcaaatgccagtttttctaaacatggttattcttttatattttaaaatttcatattaatataaatcaatgcttttatagattacacagcatcttattctgatgattacgaactagactactatattagtttggattatatttggaaacactacaccagctataaaactatatgtttgatcgtatataactttacagcaattttcagtttgtagcaagtaaatataaacataaagacatttaatatcttattgaatgtatactgcattttaaaacacaataagactatttcttacaatagttccaatttggctcctggcttttgttgggaaagttgttatgtggatcctaaattatttaggtagacatcatgaaaaatattgtgaggcataccatatgtgtaaagttctcaaacttgtatgtcagaggcaaactattgtcacatgggaaatattttggtacaattaaggcagtgcataaaaaaggaatattccttgaacattattatacccaatatgccatcagtagaaatgtgataaaaaatgaaactatttattagaatgtaatttagagaacccgataggtgtccat
